United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 145

SEQ ID NO: 6152788 - DNA, 16 bp, Homo sapiens
ctctacccatattaca

SEQ ID NO: 6152789 - DNA, 17 bp, Homo sapiens
ctctacccatgagcctg

SEQ ID NO: 6152790 - DNA, 22 bp, Homo sapiens
ctctaccccaaagaattcctga

SEQ ID NO: 6152791 - DNA, 12 bp, Homo sapiens
ctctaccccttt

SEQ ID NO: 6152792 - DNA, 13 bp, Homo sapiens
ctctacccctttc

SEQ ID NO: 6152793 - DNA, 15 bp, Homo sapiens
ctctacccctttctg

SEQ ID NO: 6152794 - DNA, 17 bp, Homo sapiens
ctctacccctttcttct

SEQ ID NO: 6152795 - DNA, 18 bp, Homo sapiens
ctctacccggcccagaga

SEQ ID NO: 6152796 - DNA, 21 bp, Homo sapiens
ctctacccggcccagagaccc

SEQ ID NO: 6152797 - DNA, 14 bp, Homo sapiens
ctctaccctcccac

SEQ ID NO: 6152798 - DNA, 15 bp, Homo sapiens
ctctaccctcccacc

SEQ ID NO: 6152799 - DNA, 16 bp, Homo sapiens
ctctaccctcccaccc

SEQ ID NO: 6152800 - DNA, 22 bp, Homo sapiens
ctctaccctcccacccccttct

SEQ ID NO: 6152801 - DNA, 13 bp, Homo sapiens
ctctaccctgctc

SEQ ID NO: 6152802 - DNA, 15 bp, Homo sapiens
ctctaccctgctccc

SEQ ID NO: 6152803 - DNA, 14 bp, Homo sapiens
ctctaccctgtctg

SEQ ID NO: 6152804 - DNA, 15 bp, Homo sapiens
ctctaccctgtctgt

SEQ ID NO: 6152805 - DNA, 21 bp, Homo sapiens
ctctaccctgtctgtcccttt

SEQ ID NO: 6152806 - DNA, 20 bp, Homo sapiens
ctctacctcatatcagtttg

SEQ ID NO: 6152807 - DNA, 14 bp, Homo sapiens
ctctacctccaccc

SEQ ID NO: 6152808 - DNA, 17 bp, Homo sapiens
ctctacctccaccctgc

SEQ ID NO: 6152809 - DNA, 14 bp, Homo sapiens
ctctacctggccgg

SEQ ID NO: 6152810 - DNA, 17 bp, Homo sapiens
ctctaccttcaacatgt

SEQ ID NO: 6152811 - DNA, 18 bp, Homo sapiens
ctctaccttctccccagc

SEQ ID NO: 6152812 - DNA, 13 bp, Homo sapiens
ctctaccttttaa

SEQ ID NO: 6152813 - DNA, 18 bp, Homo sapiens
ctctaccttttaaaattg

SEQ ID NO: 6152814 - DNA, 22 bp, Homo sapiens
ctctacgccaaagtgcagccct

SEQ ID NO: 6152815 - DNA, 18 bp, Homo sapiens
ctctacgccactccacaa

SEQ ID NO: 6152816 - DNA, 15 bp, Homo sapiens
ctctactaaaaagaa

SEQ ID NO: 6152817 - DNA, 18 bp, Homo sapiens
ctggcagctgagagccct

SEQ ID NO: 6152818 - DNA, 19 bp, Homo sapiens
ctggcagctgagagccctg

SEQ ID NO: 6152819 - DNA, 20 bp, Homo sapiens
ctggcagctgagagccctgc

SEQ ID NO: 6152820 - DNA, 15 bp, Homo sapiens
ctggcagctgcccct

SEQ ID NO: 6152821 - DNA, 23 bp, Homo sapiens
ctggcagctgcccctcctggagc

SEQ ID NO: 6152822 - DNA, 15 bp, Homo sapiens
ctggcagctgctgtg

SEQ ID NO: 6152823 - DNA, 16 bp, Homo sapiens
ctggcagctgctgtgg

SEQ ID NO: 6152824 - DNA, 23 bp, Homo sapiens
ctggcaggacacatcccggcctc

SEQ ID NO: 6152825 - DNA, 12 bp, Homo sapiens
ctggcaggacct

SEQ ID NO: 6152826 - DNA, 13 bp, Homo sapiens
ctggcaggacctg

SEQ ID NO: 6152827 - DNA, 17 bp, Homo sapiens
ctggcaggagacactgg

SEQ ID NO: 6152828 - DNA, 21 bp, Homo sapiens
ctggcaggagacactggtctc

SEQ ID NO: 6152829 - DNA, 20 bp, Homo sapiens
ctggcaggagagagccttgg

SEQ ID NO: 6152830 - DNA, 12 bp, Homo sapiens
ctggcaggagcc

SEQ ID NO: 6152831 - DNA, 22 bp, Homo sapiens
ctggcaggagcctcgtgtcctg

SEQ ID NO: 6152832 - DNA, 24 bp, Homo sapiens
ctggcaggagcctcgtgtcctgct

SEQ ID NO: 6152833 - DNA, 12 bp, Homo sapiens
ctggcaggaggg

SEQ ID NO: 6152834 - DNA, 19 bp, Homo sapiens
ctggcaggagggtggcact

SEQ ID NO: 6152835 - DNA, 15 bp, Homo sapiens
ctggcaggatcacag

SEQ ID NO: 6152836 - DNA, 18 bp, Homo sapiens
ctggcaggatgctgagct

SEQ ID NO: 6152837 - DNA, 18 bp, Homo sapiens
ctggcaggattcttcccg

SEQ ID NO: 6152838 - DNA, 22 bp, Homo sapiens
ctggcaggattcttcccgctcc

SEQ ID NO: 6152839 - DNA, 11 bp, Homo sapiens
ctggcaggcag

SEQ ID NO: 6152840 - DNA, 24 bp, Homo sapiens
ctggcaggcaggctcccagggaca

SEQ ID NO: 6152841 - DNA, 23 bp, Homo sapiens
ctggcaggcaggggccctgcagc

SEQ ID NO: 6152842 - DNA, 13 bp, Homo sapiens
ctggcaggccctg

SEQ ID NO: 6152843 - DNA, 21 bp, Homo sapiens
ctggcaggcggggggggcgcc

SEQ ID NO: 6152844 - DNA, 13 bp, Homo sapiens
ctggcaggcttcc

SEQ ID NO: 6152845 - DNA, 18 bp, Homo sapiens
ctggcagggacctgagag

SEQ ID NO: 6152846 - DNA, 20 bp, Homo sapiens
ctggcagggacctgagagca

SEQ ID NO: 6152847 - DNA, 21 bp, Homo sapiens
ctggcagggaggtcaggccct

SEQ ID NO: 6152848 - DNA, 22 bp, Homo sapiens
ctggcagggaggtcaggccctg

SEQ ID NO: 6152849 - DNA, 12 bp, Homo sapiens
ctggcagggcag

SEQ ID NO: 6152850 - DNA, 15 bp, Homo sapiens
ctggcagggcagcag

SEQ ID NO: 6152851 - DNA, 16 bp, Homo sapiens
ctggcagggcagcagg

SEQ ID NO: 6152852 - DNA, 17 bp, Homo sapiens
ctggcagggcaggcaga

SEQ ID NO: 6152853 - DNA, 18 bp, Homo sapiens
ctggcagggcaggcagag

SEQ ID NO: 6152854 - DNA, 21 bp, Homo sapiens
ctggcagggccacctgcagga

SEQ ID NO: 6152855 - DNA, 14 bp, Homo sapiens
ctggcagggccagg

SEQ ID NO: 6152856 - DNA, 17 bp, Homo sapiens
ctggcagggccagggca

SEQ ID NO: 6152857 - DNA, 21 bp, Homo sapiens
ctggcagggccagggcaatgc

SEQ ID NO: 6152858 - DNA, 22 bp, Homo sapiens
ctggcagggccagggcaatgcc

SEQ ID NO: 6152859 - DNA, 18 bp, Homo sapiens
ctggcagggctcacactc

SEQ ID NO: 6152860 - DNA, 21 bp, Homo sapiens
ctggcagggctcacactcctg

SEQ ID NO: 6152861 - DNA, 22 bp, Homo sapiens
ctggcagggctcacactcctgg

SEQ ID NO: 6152862 - DNA, 13 bp, Homo sapiens
ctggcagggctgg

SEQ ID NO: 6152863 - DNA, 21 bp, Homo sapiens
ctggcaggggaaactctggtg

SEQ ID NO: 6152864 - DNA, 21 bp, Homo sapiens
ctggcaggggagacaggagcc

SEQ ID NO: 6152865 - DNA, 22 bp, Homo sapiens
ctggcaggggagacaggagcct

SEQ ID NO: 6152866 - DNA, 20 bp, Homo sapiens
ctggcaggggatccagctca

SEQ ID NO: 6152867 - DNA, 22 bp, Homo sapiens
ctggcaggggatccagctcaag

SEQ ID NO: 6152868 - DNA, 23 bp, Homo sapiens
ctggcaggggatccagctcaagg

SEQ ID NO: 6152869 - DNA, 17 bp, Homo sapiens
ctggcagggtccctcca

SEQ ID NO: 6152870 - DNA, 17 bp, Homo sapiens
ctggcagggtgggatgg

SEQ ID NO: 6152871 - DNA, 18 bp, Homo sapiens
ctggcaggtaccgtgctc

SEQ ID NO: 6152872 - DNA, 18 bp, Homo sapiens
ctggcaggtcaacctcgc

SEQ ID NO: 6152873 - DNA, 18 bp, Homo sapiens
ctggcaggtcatggagca

SEQ ID NO: 6152874 - DNA, 21 bp, Homo sapiens
ctggcaggtcatggagcagcc

SEQ ID NO: 6152875 - DNA, 14 bp, Homo sapiens
ctggcaggtgcaga

SEQ ID NO: 6152876 - DNA, 20 bp, Homo sapiens
ctggcaggtgcagatgggct

SEQ ID NO: 6152877 - DNA, 18 bp, Homo sapiens
ctggcagtacagagtgca

SEQ ID NO: 6152878 - DNA, 18 bp, Homo sapiens
ctggcagtcgcacacaca

SEQ ID NO: 6152879 - DNA, 22 bp, Homo sapiens
ctggcagtgctgagggaccgag

SEQ ID NO: 6152880 - DNA, 17 bp, Homo sapiens
ctggcagtggctctcag

SEQ ID NO: 6152881 - DNA, 18 bp, Homo sapiens
ctggcagtggctctcaga

SEQ ID NO: 6152882 - DNA, 17 bp, Homo sapiens
ctggcagtgtgcggagc

SEQ ID NO: 6152883 - DNA, 16 bp, Homo sapiens
ctggcataaatctgaa

SEQ ID NO: 6152884 - DNA, 20 bp, Homo sapiens
ctggcataactaaaattaag

SEQ ID NO: 6152885 - DNA, 15 bp, Homo sapiens
ctggcatagccctcc

SEQ ID NO: 6152886 - DNA, 17 bp, Homo sapiens
ctggcataggactcttt

SEQ ID NO: 6152887 - DNA, 15 bp, Homo sapiens
ctggcatagtttcat

SEQ ID NO: 6152888 - DNA, 22 bp, Homo sapiens
ctggcatcaagaggtgggaggg

SEQ ID NO: 6152889 - DNA, 14 bp, Homo sapiens
ctggcatcaggtct

SEQ ID NO: 6152890 - DNA, 19 bp, Homo sapiens
ctggcatcagtttaggcct

SEQ ID NO: 6152891 - DNA, 13 bp, Homo sapiens
ctggcatcatggt

SEQ ID NO: 6152892 - DNA, 21 bp, Homo sapiens
ctggcatccaaatggctgctt

SEQ ID NO: 6152893 - DNA, 13 bp, Homo sapiens
ctggcatcctggc

SEQ ID NO: 6152894 - DNA, 14 bp, Homo sapiens
ctggcatcctggct

SEQ ID NO: 6152895 - DNA, 16 bp, Homo sapiens
ctggcatcctggctgg

SEQ ID NO: 6152896 - DNA, 23 bp, Homo sapiens
ctggcatcctggctggctgtgtc

SEQ ID NO: 6152897 - DNA, 17 bp, Homo sapiens
ctggcatcgcaccattc

SEQ ID NO: 6152898 - DNA, 22 bp, Homo sapiens
ctggcatcgcagcttcctgtct

SEQ ID NO: 6152899 - DNA, 17 bp, Homo sapiens
ctggcatcgtggtgggg

SEQ ID NO: 6152900 - DNA, 15 bp, Homo sapiens
ctggcatctccccca

SEQ ID NO: 6152901 - DNA, 21 bp, Homo sapiens
ctggcatctcccccaccctgt

SEQ ID NO: 6152902 - DNA, 14 bp, Homo sapiens
ctggcatctctgga

SEQ ID NO: 6152903 - DNA, 16 bp, Homo sapiens
ctggcatctctggagt

SEQ ID NO: 6152904 - DNA, 15 bp, Homo sapiens
ctggcatctgtgtgc

SEQ ID NO: 6152905 - DNA, 16 bp, Homo sapiens
ctggcatctgtgtgcg

SEQ ID NO: 6152906 - DNA, 21 bp, Homo sapiens
ctggcatgaccatcctgtcct

SEQ ID NO: 6152907 - DNA, 20 bp, Homo sapiens
ctggcatgctgtctctaatt

SEQ ID NO: 6152908 - DNA, 18 bp, Homo sapiens
ctggcatgggaatgaatg

SEQ ID NO: 6152909 - DNA, 22 bp, Homo sapiens
ctggcatgggaatgaatgtcag

SEQ ID NO: 6152910 - DNA, 18 bp, Homo sapiens
ctggcatggtgcagggag

SEQ ID NO: 6152911 - DNA, 21 bp, Homo sapiens
ctggcatggtggttgggaccc

SEQ ID NO: 6152912 - DNA, 17 bp, Homo sapiens
ctggcatgtcagagcca

SEQ ID NO: 6152913 - DNA, 13 bp, Homo sapiens
ctggcatgtcatt

SEQ ID NO: 6152914 - DNA, 18 bp, Homo sapiens
ctggcatgtttcactcct

SEQ ID NO: 6152915 - DNA, 16 bp, Homo sapiens
ctggcattaattatta

SEQ ID NO: 6152916 - DNA, 23 bp, Homo sapiens
ctggcattaattattaataccaa

SEQ ID NO: 6152917 - DNA, 18 bp, Homo sapiens
ctggcattaccctctgca

SEQ ID NO: 6152918 - DNA, 19 bp, Homo sapiens
ctggcattactcagcagga

SEQ ID NO: 6152919 - DNA, 18 bp, Homo sapiens
ctggcattagaattattt

SEQ ID NO: 6152920 - DNA, 22 bp, Homo sapiens
ctggcattagaattatttaaac

SEQ ID NO: 6152921 - DNA, 21 bp, Homo sapiens
ctggcattatgtccactgtgt

SEQ ID NO: 6152922 - DNA, 21 bp, Homo sapiens
ctggcattctacacctggacc

SEQ ID NO: 6152923 - DNA, 17 bp, Homo sapiens
ctggcattctagattac

SEQ ID NO: 6152924 - DNA, 16 bp, Homo sapiens
ctggcattgtccctgt

SEQ ID NO: 6152925 - DNA, 13 bp, Homo sapiens
ctggccaaagtca

SEQ ID NO: 6152926 - DNA, 17 bp, Homo sapiens
ctggccaacatggtaaa

SEQ ID NO: 6152927 - DNA, 16 bp, Homo sapiens
ctggccaacggggtga

SEQ ID NO: 6152928 - DNA, 16 bp, Homo sapiens
ctggccaagctgaggt

SEQ ID NO: 6152929 - DNA, 17 bp, Homo sapiens
ctggccaagctgaggtg

SEQ ID NO: 6152930 - DNA, 13 bp, Homo sapiens
ctggccaagggcc

SEQ ID NO: 6152931 - DNA, 15 bp, Homo sapiens
ctggccaagggccag

SEQ ID NO: 6152932 - DNA, 16 bp, Homo sapiens
ctggccaagggccaga

SEQ ID NO: 6152933 - DNA, 19 bp, Homo sapiens
ctggccaagggccagacag

SEQ ID NO: 6152934 - DNA, 20 bp, Homo sapiens
ctggccaagggccagacaga

SEQ ID NO: 6152935 - DNA, 23 bp, Homo sapiens
ctggccaaggggtgggcctgtga

SEQ ID NO: 6152936 - DNA, 16 bp, Homo sapiens
ctggccaaggtgtcca

SEQ ID NO: 6152937 - DNA, 18 bp, Homo sapiens
ctggccaaggtgtccagg

SEQ ID NO: 6152938 - DNA, 22 bp, Homo sapiens
ctggccacaaggaaaaggagga

SEQ ID NO: 6152939 - DNA, 24 bp, Homo sapiens
ctggccacaaggaaaaggaggagg

SEQ ID NO: 6152940 - DNA, 20 bp, Homo sapiens
ctggccacaaggacgctggc

SEQ ID NO: 6152941 - DNA, 23 bp, Homo sapiens
ctggccacaatcctccccaccag

SEQ ID NO: 6152942 - DNA, 18 bp, Homo sapiens
ctggccacagacccccag

SEQ ID NO: 6152943 - DNA, 14 bp, Homo sapiens
ctggccacagcctt

SEQ ID NO: 6152944 - DNA, 15 bp, Homo sapiens
ctggccacagccttc

SEQ ID NO: 6152945 - DNA, 20 bp, Homo sapiens
ctggccaccaccccccactc

SEQ ID NO: 6152946 - DNA, 14 bp, Homo sapiens
ctggccaccagcca

SEQ ID NO: 6152947 - DNA, 16 bp, Homo sapiens
ctggccaccaggctgg

SEQ ID NO: 6152948 - DNA, 18 bp, Homo sapiens
ctggccaccaggctggcg

SEQ ID NO: 6152949 - DNA, 17 bp, Homo sapiens
ctggccaccatggtcat

SEQ ID NO: 6152950 - DNA, 12 bp, Homo sapiens
ctggccacccaa

SEQ ID NO: 6152951 - DNA, 14 bp, Homo sapiens
ctggccaccccaga

SEQ ID NO: 6152952 - DNA, 21 bp, Homo sapiens
ctggccaccccagagtgggag

SEQ ID NO: 6152953 - DNA, 14 bp, Homo sapiens
ctggccacccctcc

SEQ ID NO: 6152954 - DNA, 15 bp, Homo sapiens
ctggccacccctccc

SEQ ID NO: 6152955 - DNA, 17 bp, Homo sapiens
ctggccacccctcccca

SEQ ID NO: 6152956 - DNA, 20 bp, Homo sapiens
ctggccacccctccccagta

SEQ ID NO: 6152957 - DNA, 22 bp, Homo sapiens
ctggccacccttggcctgtcca

SEQ ID NO: 6152958 - DNA, 23 bp, Homo sapiens
ctggccacctagaagtctccctg

SEQ ID NO: 6152959 - DNA, 17 bp, Homo sapiens
ctggccacctgaggtgg

SEQ ID NO: 6152960 - DNA, 16 bp, Homo sapiens
ctggccacctgccagg

SEQ ID NO: 6152961 - DNA, 21 bp, Homo sapiens
ctggccacgcagccaggacac

SEQ ID NO: 6152962 - DNA, 18 bp, Homo sapiens
ctggccactaaagcttca

SEQ ID NO: 6152963 - DNA, 19 bp, Homo sapiens
ctggccactccccagtgct

SEQ ID NO: 6152964 - DNA, 21 bp, Homo sapiens
ctggccactgcacagagctct

SEQ ID NO: 6152965 - DNA, 22 bp, Homo sapiens
ctggccactgcacagagctctc

SEQ ID NO: 6152966 - DNA, 21 bp, Homo sapiens
ctggccactggccctgtttct

SEQ ID NO: 6152967 - DNA, 16 bp, Homo sapiens
ctggccagacaagaag

SEQ ID NO: 6152968 - DNA, 13 bp, Homo sapiens
ctggccagacaca

SEQ ID NO: 6152969 - DNA, 15 bp, Homo sapiens
ctggccagacacagg

SEQ ID NO: 6152970 - DNA, 21 bp, Homo sapiens
ctggccagacacaggccctcc

SEQ ID NO: 6152971 - DNA, 14 bp, Homo sapiens
ctggccagacgctg

SEQ ID NO: 6152972 - DNA, 16 bp, Homo sapiens
ctggccagacgctgcc

SEQ ID NO: 6152973 - DNA, 13 bp, Homo sapiens
ctggccagactcg

SEQ ID NO: 6152974 - DNA, 15 bp, Homo sapiens
ctggccagaggcagc

SEQ ID NO: 6152975 - DNA, 16 bp, Homo sapiens
ctggccagatgcacca

SEQ ID NO: 6152976 - DNA, 21 bp, Homo sapiens
ctggccagatgcaccagccct

SEQ ID NO: 6152977 - DNA, 18 bp, Homo sapiens
ctggccagatgtcgctgg

SEQ ID NO: 6152978 - DNA, 23 bp, Homo sapiens
ctggccagatgtcgctgggtcct

SEQ ID NO: 6152979 - DNA, 12 bp, Homo sapiens
ctggccagcacc

SEQ ID NO: 6152980 - DNA, 19 bp, Homo sapiens
ctggccagccccacagccc

SEQ ID NO: 6152981 - DNA, 12 bp, Homo sapiens
ctggccagccct

SEQ ID NO: 6152982 - DNA, 20 bp, Homo sapiens
ctggccagcccttcctctca

SEQ ID NO: 6152983 - DNA, 11 bp, Homo sapiens
ctggccagccg

SEQ ID NO: 6152984 - DNA, 13 bp, Homo sapiens
ctggccagcctgg

SEQ ID NO: 6152985 - DNA, 15 bp, Homo sapiens
ctggccagcctgggg

SEQ ID NO: 6152986 - DNA, 20 bp, Homo sapiens
ctggccagcgagcgcccagc

SEQ ID NO: 6152987 - DNA, 13 bp, Homo sapiens
ctggccagctgtg

SEQ ID NO: 6152988 - DNA, 21 bp, Homo sapiens
ctggccaggacacactgaaaa

SEQ ID NO: 6152989 - DNA, 14 bp, Homo sapiens
ctggccaggagcag

SEQ ID NO: 6152990 - DNA, 17 bp, Homo sapiens
ctggccaggagctcttc

SEQ ID NO: 6152991 - DNA, 11 bp, Homo sapiens
ctggccaggca

SEQ ID NO: 6152992 - DNA, 17 bp, Homo sapiens
ctggccaggcactgcct

SEQ ID NO: 6152993 - DNA, 13 bp, Homo sapiens
ctggccaggcagg

SEQ ID NO: 6152994 - DNA, 18 bp, Homo sapiens
ctctactaaaaatacaaa

SEQ ID NO: 6152995 - DNA, 20 bp, Homo sapiens
ctctactaaaaatacaaaaa

SEQ ID NO: 6152996 - DNA, 19 bp, Homo sapiens
ctctactaaaaataccaaa

SEQ ID NO: 6152997 - DNA, 20 bp, Homo sapiens
ctctactaatgcctcttcat

SEQ ID NO: 6152998 - DNA, 20 bp, Homo sapiens
ctctactaccacaaggaaaa

SEQ ID NO: 6152999 - DNA, 21 bp, Homo sapiens
ctctactagcaccatcaccct

SEQ ID NO: 6153000 - DNA, 20 bp, Homo sapiens
ctctactaggtctgctcctg

SEQ ID NO: 6153001 - DNA, 17 bp, Homo sapiens
ctctactcatgccagat

SEQ ID NO: 6153002 - DNA, 13 bp, Homo sapiens
ctctactccaggc

SEQ ID NO: 6153003 - DNA, 13 bp, Homo sapiens
ctctactcccagc

SEQ ID NO: 6153004 - DNA, 13 bp, Homo sapiens
ctctactctggaa

SEQ ID NO: 6153005 - DNA, 22 bp, Homo sapiens
ctctactcttacagagccttga

SEQ ID NO: 6153006 - DNA, 16 bp, Homo sapiens
ctctactcttacttcc

SEQ ID NO: 6153007 - DNA, 14 bp, Homo sapiens
ctctactcttcctg

SEQ ID NO: 6153008 - DNA, 14 bp, Homo sapiens
ctctactgccccag

SEQ ID NO: 6153009 - DNA, 21 bp, Homo sapiens
ctctactgccctccccttccc

SEQ ID NO: 6153010 - DNA, 22 bp, Homo sapiens
ctctactgccctccccttcccc

SEQ ID NO: 6153011 - DNA, 22 bp, Homo sapiens
ctctactggtaggaagaggtac

SEQ ID NO: 6153012 - DNA, 14 bp, Homo sapiens
ctctactgtctcct

SEQ ID NO: 6153013 - DNA, 15 bp, Homo sapiens
ctctactgttgcaca

SEQ ID NO: 6153014 - DNA, 17 bp, Homo sapiens
ctctactgttgcacagc

SEQ ID NO: 6153015 - DNA, 17 bp, Homo sapiens
ctctacttaatccaatg

SEQ ID NO: 6153016 - DNA, 17 bp, Homo sapiens
ctctacttagcatgtcc

SEQ ID NO: 6153017 - DNA, 20 bp, Homo sapiens
ctctacttagcatgtcccta

SEQ ID NO: 6153018 - DNA, 17 bp, Homo sapiens
ctctacttccccttctt

SEQ ID NO: 6153019 - DNA, 21 bp, Homo sapiens
ctctacttctttttctttgag

SEQ ID NO: 6153020 - DNA, 18 bp, Homo sapiens
ctctactttataatcaag

SEQ ID NO: 6153021 - DNA, 15 bp, Homo sapiens
ctctactttccaggc

SEQ ID NO: 6153022 - DNA, 13 bp, Homo sapiens
ctctactttgagg

SEQ ID NO: 6153023 - DNA, 20 bp, Homo sapiens
ctctactttgtcccctcacc

SEQ ID NO: 6153024 - DNA, 14 bp, Homo sapiens
ctctagaaaaaagg

SEQ ID NO: 6153025 - DNA, 20 bp, Homo sapiens
ctctagaacacccactggcc

SEQ ID NO: 6153026 - DNA, 18 bp, Homo sapiens
ctctagaacatgcacatt

SEQ ID NO: 6153027 - DNA, 23 bp, Homo sapiens
ctctagaagcagaaccagctcta

SEQ ID NO: 6153028 - DNA, 18 bp, Homo sapiens
ctctagaagccaagggaa

SEQ ID NO: 6153029 - DNA, 19 bp, Homo sapiens
ctctagaagctcaggttcc

SEQ ID NO: 6153030 - DNA, 18 bp, Homo sapiens
ctctagaagtgccatctc

SEQ ID NO: 6153031 - DNA, 18 bp, Homo sapiens
ctctagaatcccagcagc

SEQ ID NO: 6153032 - DNA, 23 bp, Homo sapiens
ctctagaattttaagtgctttgt

SEQ ID NO: 6153033 - DNA, 23 bp, Homo sapiens
ctctagacaaccctgcaaaggac

SEQ ID NO: 6153034 - DNA, 21 bp, Homo sapiens
ctctagacactgccacacagg

SEQ ID NO: 6153035 - DNA, 13 bp, Homo sapiens
ctctagagagagg

SEQ ID NO: 6153036 - DNA, 16 bp, Homo sapiens
ctctagagcagggatt

SEQ ID NO: 6153037 - DNA, 22 bp, Homo sapiens
ctctagaggctggcaagaacca

SEQ ID NO: 6153038 - DNA, 21 bp, Homo sapiens
ctctagaggttcaaaggcagc

SEQ ID NO: 6153039 - DNA, 21 bp, Homo sapiens
ctctagagtagaggtataatt

SEQ ID NO: 6153040 - DNA, 23 bp, Homo sapiens
ctctagagtagaggtataattgt

SEQ ID NO: 6153041 - DNA, 19 bp, Homo sapiens
ctctagagtctcactgctg

SEQ ID NO: 6153042 - DNA, 14 bp, Homo sapiens
ctctagatcataag

SEQ ID NO: 6153043 - DNA, 16 bp, Homo sapiens
ctctagatgagctggg

SEQ ID NO: 6153044 - DNA, 23 bp, Homo sapiens
ctctagatgagctgggccggagg

SEQ ID NO: 6153045 - DNA, 14 bp, Homo sapiens
ctctagatgcaaat

SEQ ID NO: 6153046 - DNA, 17 bp, Homo sapiens
ctctagattttgttttg

SEQ ID NO: 6153047 - DNA, 13 bp, Homo sapiens
ctctagcaaggct

SEQ ID NO: 6153048 - DNA, 17 bp, Homo sapiens
ctctagcagcacctcct

SEQ ID NO: 6153049 - DNA, 17 bp, Homo sapiens
ctctagccaggagtctg

SEQ ID NO: 6153050 - DNA, 22 bp, Homo sapiens
ctctagccaggagtctgtgctc

SEQ ID NO: 6153051 - DNA, 21 bp, Homo sapiens
ctctagccatcccttggggaa

SEQ ID NO: 6153052 - DNA, 14 bp, Homo sapiens
ctctagccccagcg

SEQ ID NO: 6153053 - DNA, 14 bp, Homo sapiens
ctctagccctgccc

SEQ ID NO: 6153054 - DNA, 20 bp, Homo sapiens
ctctagcctggcaacagagc

SEQ ID NO: 6153055 - DNA, 22 bp, Homo sapiens
ctctagcctggcaacagagcga

SEQ ID NO: 6153056 - DNA, 21 bp, Homo sapiens
ctctagcctgggccagagaag

SEQ ID NO: 6153057 - DNA, 21 bp, Homo sapiens
ctctagcctttattattactg

SEQ ID NO: 6153058 - DNA, 17 bp, Homo sapiens
ctctagctctctaggcc

SEQ ID NO: 6153059 - DNA, 13 bp, Homo sapiens
ctctagctctggt

SEQ ID NO: 6153060 - DNA, 12 bp, Homo sapiens
ctctagctggca

SEQ ID NO: 6153061 - DNA, 13 bp, Homo sapiens
ctctagctggcag

SEQ ID NO: 6153062 - DNA, 14 bp, Homo sapiens
ctctagctggcagg

SEQ ID NO: 6153063 - DNA, 15 bp, Homo sapiens
ctctagctggcagga

SEQ ID NO: 6153064 - DNA, 17 bp, Homo sapiens
ctctagctggcaggaca

SEQ ID NO: 6153065 - DNA, 18 bp, Homo sapiens
ctctagctggcaggacac

SEQ ID NO: 6153066 - DNA, 20 bp, Homo sapiens
ctctagctgggggtgggcca

SEQ ID NO: 6153067 - DNA, 15 bp, Homo sapiens
ctctaggaaatattt

SEQ ID NO: 6153068 - DNA, 22 bp, Homo sapiens
ctctaggagggagccttgtgag

SEQ ID NO: 6153069 - DNA, 15 bp, Homo sapiens
ctctaggatggggca

SEQ ID NO: 6153070 - DNA, 16 bp, Homo sapiens
ctctaggcctctccag

SEQ ID NO: 6153071 - DNA, 12 bp, Homo sapiens
ctctaggctctg

SEQ ID NO: 6153072 - DNA, 14 bp, Homo sapiens
ctctaggctgcccc

SEQ ID NO: 6153073 - DNA, 15 bp, Homo sapiens
ctctaggctggggaa

SEQ ID NO: 6153074 - DNA, 15 bp, Homo sapiens
ctctaggctgttctg

SEQ ID NO: 6153075 - DNA, 18 bp, Homo sapiens
ctctagggaaggccacct

SEQ ID NO: 6153076 - DNA, 19 bp, Homo sapiens
ctctagggaaggccacctg

SEQ ID NO: 6153077 - DNA, 18 bp, Homo sapiens
ctctagggaccagaacca

SEQ ID NO: 6153078 - DNA, 16 bp, Homo sapiens
ctctagggacccctcc

SEQ ID NO: 6153079 - DNA, 19 bp, Homo sapiens
ctctagggacccctcctcc

SEQ ID NO: 6153080 - DNA, 20 bp, Homo sapiens
ctctagggacccctcgcccc

SEQ ID NO: 6153081 - DNA, 22 bp, Homo sapiens
ctctagggcagggtgggagccg

SEQ ID NO: 6153082 - DNA, 13 bp, Homo sapiens
ctctaggggcagc

SEQ ID NO: 6153083 - DNA, 17 bp, Homo sapiens
ctctaggggcagcctcc

SEQ ID NO: 6153084 - DNA, 20 bp, Homo sapiens
ctctaggggtcaggctccat

SEQ ID NO: 6153085 - DNA, 12 bp, Homo sapiens
ctctagggtcca

SEQ ID NO: 6153086 - DNA, 22 bp, Homo sapiens
ctctaggtgcccttggaggcca

SEQ ID NO: 6153087 - DNA, 19 bp, Homo sapiens
ctctaggtgtgtccacaga

SEQ ID NO: 6153088 - DNA, 14 bp, Homo sapiens
ctctaggtgtttct

SEQ ID NO: 6153089 - DNA, 15 bp, Homo sapiens
ctctaggttatacaa

SEQ ID NO: 6153090 - DNA, 12 bp, Homo sapiens
ctctaggtttct

SEQ ID NO: 6153091 - DNA, 16 bp, Homo sapiens
ctctagtactgtgaat

SEQ ID NO: 6153092 - DNA, 20 bp, Homo sapiens
ctctagtagggagaggctct

SEQ ID NO: 6153093 - DNA, 24 bp, Homo sapiens
ctctagtagttaaaacagctattt

SEQ ID NO: 6153094 - DNA, 14 bp, Homo sapiens
ctctagtatttcca

SEQ ID NO: 6153095 - DNA, 14 bp, Homo sapiens
ctctagtcatttgt

SEQ ID NO: 6153096 - DNA, 23 bp, Homo sapiens
ctctagtccccaaggcctctctc

SEQ ID NO: 6153097 - DNA, 20 bp, Homo sapiens
ctctagtgaatgtaggctgg

SEQ ID NO: 6153098 - DNA, 14 bp, Homo sapiens
ctctagtgccctcc

SEQ ID NO: 6153099 - DNA, 18 bp, Homo sapiens
ctctagtgccctccacag

SEQ ID NO: 6153100 - DNA, 16 bp, Homo sapiens
ctctagtgccttctaa

SEQ ID NO: 6153101 - DNA, 17 bp, Homo sapiens
ctctagtgcggtttact

SEQ ID NO: 6153102 - DNA, 12 bp, Homo sapiens
ctctagtgctgt

SEQ ID NO: 6153103 - DNA, 14 bp, Homo sapiens
ctctagtgctgtga

SEQ ID NO: 6153104 - DNA, 13 bp, Homo sapiens
ctctagtgggaca

SEQ ID NO: 6153105 - DNA, 18 bp, Homo sapiens
ctctagtgggacagccca

SEQ ID NO: 6153106 - DNA, 19 bp, Homo sapiens
ctctagtgggacagcccag

SEQ ID NO: 6153107 - DNA, 23 bp, Homo sapiens
ctctagtgggacagcccagagcc

SEQ ID NO: 6153108 - DNA, 14 bp, Homo sapiens
ctctagttctagat

SEQ ID NO: 6153109 - DNA, 15 bp, Homo sapiens
ctctagttctagatg

SEQ ID NO: 6153110 - DNA, 16 bp, Homo sapiens
ctctagttctagatga

SEQ ID NO: 6153111 - DNA, 23 bp, Homo sapiens
ctctagttctgttgttttgtgta

SEQ ID NO: 6153112 - DNA, 15 bp, Homo sapiens
ctctagttctttgtt

SEQ ID NO: 6153113 - DNA, 16 bp, Homo sapiens
ctctagttttatctta

SEQ ID NO: 6153114 - DNA, 23 bp, Homo sapiens
ctctagttttatcttaaactgtt

SEQ ID NO: 6153115 - DNA, 12 bp, Homo sapiens
ctctagtttttg

SEQ ID NO: 6153116 - DNA, 21 bp, Homo sapiens
ctctagttttttcttcctttt

SEQ ID NO: 6153117 - DNA, 14 bp, Homo sapiens
ctctataaagaaac

SEQ ID NO: 6153118 - DNA, 13 bp, Homo sapiens
ctctataaagggt

SEQ ID NO: 6153119 - DNA, 14 bp, Homo sapiens
ctctataaagggtc

SEQ ID NO: 6153120 - DNA, 19 bp, Homo sapiens
ctctataaagggtcaggcc

SEQ ID NO: 6153121 - DNA, 16 bp, Homo sapiens
ctctataactttttct

SEQ ID NO: 6153122 - DNA, 16 bp, Homo sapiens
ctctataaggcagcct

SEQ ID NO: 6153123 - DNA, 17 bp, Homo sapiens
ctctataagtgttcagt

SEQ ID NO: 6153124 - DNA, 17 bp, Homo sapiens
ctctataattgccactg

SEQ ID NO: 6153125 - DNA, 15 bp, Homo sapiens
ctctatacatctctc

SEQ ID NO: 6153126 - DNA, 16 bp, Homo sapiens
ctctataccaataaag

SEQ ID NO: 6153127 - DNA, 18 bp, Homo sapiens
ctctataccaataaagtg

SEQ ID NO: 6153128 - DNA, 12 bp, Homo sapiens
ctctatactgtg

SEQ ID NO: 6153129 - DNA, 22 bp, Homo sapiens
ctctatacttctcctttggaca

SEQ ID NO: 6153130 - DNA, 12 bp, Homo sapiens
ctctatactttg

SEQ ID NO: 6153131 - DNA, 13 bp, Homo sapiens
ctctatactttgt

SEQ ID NO: 6153132 - DNA, 17 bp, Homo sapiens
ctctatactttgttctg

SEQ ID NO: 6153133 - DNA, 19 bp, Homo sapiens
ctctatactttgttctgtt

SEQ ID NO: 6153134 - DNA, 20 bp, Homo sapiens
ctctatactttgttctgttg

SEQ ID NO: 6153135 - DNA, 13 bp, Homo sapiens
ctctatataaaaa

SEQ ID NO: 6153136 - DNA, 19 bp, Homo sapiens
ctctatatgtagtgcattt

SEQ ID NO: 6153137 - DNA, 22 bp, Homo sapiens
ctctatattatgtcttcttttg

SEQ ID NO: 6153138 - DNA, 22 bp, Homo sapiens
ctctatattgttcagcatgcaa

SEQ ID NO: 6153139 - DNA, 11 bp, Homo sapiens
ctctatattta

SEQ ID NO: 6153140 - DNA, 15 bp, Homo sapiens
ctctatcaccaagga

SEQ ID NO: 6153141 - DNA, 19 bp, Homo sapiens
ctctatcagaaatacaaaa

SEQ ID NO: 6153142 - DNA, 15 bp, Homo sapiens
ctctatcagcattgt

SEQ ID NO: 6153143 - DNA, 20 bp, Homo sapiens
ctctatcagcattgtttcaa

SEQ ID NO: 6153144 - DNA, 12 bp, Homo sapiens
ctctatcatgca

SEQ ID NO: 6153145 - DNA, 13 bp, Homo sapiens
ctctatcattaaa

SEQ ID NO: 6153146 - DNA, 15 bp, Homo sapiens
ctctatcattaaagt

SEQ ID NO: 6153147 - DNA, 15 bp, Homo sapiens
ctctatcatttaata

SEQ ID NO: 6153148 - DNA, 21 bp, Homo sapiens
ctctatcatttaataatatac

SEQ ID NO: 6153149 - DNA, 23 bp, Homo sapiens
ctctatcatttaataatatactt

SEQ ID NO: 6153150 - DNA, 14 bp, Homo sapiens
ctctatccctggcc

SEQ ID NO: 6153151 - DNA, 19 bp, Homo sapiens
ctctatccctggcttcccc

SEQ ID NO: 6153152 - DNA, 16 bp, Homo sapiens
ctctatcctgggcttt

SEQ ID NO: 6153153 - DNA, 18 bp, Homo sapiens
ctctatctcacagcacac

SEQ ID NO: 6153154 - DNA, 13 bp, Homo sapiens
ctctatctgctgg

SEQ ID NO: 6153155 - DNA, 14 bp, Homo sapiens
ctctatctgctggg

SEQ ID NO: 6153156 - DNA, 18 bp, Homo sapiens
ctctatctgctgggctgg

SEQ ID NO: 6153157 - DNA, 23 bp, Homo sapiens
ctctatgaaaagcacaaggggcc

SEQ ID NO: 6153158 - DNA, 15 bp, Homo sapiens
ctctatgacatgaaa

SEQ ID NO: 6153159 - DNA, 14 bp, Homo sapiens
ctctatgagtctag

SEQ ID NO: 6153160 - DNA, 17 bp, Homo sapiens
ctctatgagtctagatg

SEQ ID NO: 6153161 - DNA, 19 bp, Homo sapiens
ctctatgagtctagatgtt

SEQ ID NO: 6153162 - DNA, 14 bp, Homo sapiens
ctctatgataatta

SEQ ID NO: 6153163 - DNA, 17 bp, Homo sapiens
ctctatgccagctcagt

SEQ ID NO: 6153164 - DNA, 15 bp, Homo sapiens
ctctatgccaggctg

SEQ ID NO: 6153165 - DNA, 16 bp, Homo sapiens
ctctatgccaggctgt

SEQ ID NO: 6153166 - DNA, 14 bp, Homo sapiens
ctctatgccctgca

SEQ ID NO: 6153167 - DNA, 22 bp, Homo sapiens
ctctatgccctgcagagcaata

SEQ ID NO: 6153168 - DNA, 14 bp, Homo sapiens
ctctatgctctgga

SEQ ID NO: 6153169 - DNA, 14 bp, Homo sapiens
ctctatgctggctt

SEQ ID NO: 6153170 - DNA, 16 bp, Homo sapiens
ctctatgctttccaaa

SEQ ID NO: 6153171 - DNA, 21 bp, Homo sapiens
ctctatgggccatattccgca

SEQ ID NO: 6153172 - DNA, 22 bp, Homo sapiens
ctctatggtcttatatttacaa

SEQ ID NO: 6153173 - DNA, 14 bp, Homo sapiens
ctggccaggcaggg

SEQ ID NO: 6153174 - DNA, 15 bp, Homo sapiens
ctggccaggcatggc

SEQ ID NO: 6153175 - DNA, 12 bp, Homo sapiens
ctggccaggccc

SEQ ID NO: 6153176 - DNA, 16 bp, Homo sapiens
ctggccagggaggagc

SEQ ID NO: 6153177 - DNA, 18 bp, Homo sapiens
ctggccagggaggagccc

SEQ ID NO: 6153178 - DNA, 21 bp, Homo sapiens
ctggccagggaggagccccag

SEQ ID NO: 6153179 - DNA, 20 bp, Homo sapiens
ctggccagggcagggccacc

SEQ ID NO: 6153180 - DNA, 13 bp, Homo sapiens
ctggccagggcca

SEQ ID NO: 6153181 - DNA, 20 bp, Homo sapiens
ctggccagggccacgctcca

SEQ ID NO: 6153182 - DNA, 22 bp, Homo sapiens
ctggccagggccacgctccagc

SEQ ID NO: 6153183 - DNA, 16 bp, Homo sapiens
ctggccagggcctgga

SEQ ID NO: 6153184 - DNA, 18 bp, Homo sapiens
ctggccagtccaccctgc

SEQ ID NO: 6153185 - DNA, 22 bp, Homo sapiens
ctggccagtccaccctgcctgc

SEQ ID NO: 6153186 - DNA, 15 bp, Homo sapiens
ctggccagtccaggc

SEQ ID NO: 6153187 - DNA, 16 bp, Homo sapiens
ctggccagtccaggct

SEQ ID NO: 6153188 - DNA, 23 bp, Homo sapiens
ctggccagtccaggctgccgtgg

SEQ ID NO: 6153189 - DNA, 18 bp, Homo sapiens
ctggccagtcctagagct

SEQ ID NO: 6153190 - DNA, 22 bp, Homo sapiens
ctggccagtcctagagctcctg

SEQ ID NO: 6153191 - DNA, 21 bp, Homo sapiens
ctggccagtcctggtcctggc

SEQ ID NO: 6153192 - DNA, 13 bp, Homo sapiens
ctggccagtcttc

SEQ ID NO: 6153193 - DNA, 17 bp, Homo sapiens
ctggccagtcttcctct

SEQ ID NO: 6153194 - DNA, 23 bp, Homo sapiens
ctggccagtcttcctcttagcct

SEQ ID NO: 6153195 - DNA, 21 bp, Homo sapiens
ctggccagtggctggatctgt

SEQ ID NO: 6153196 - DNA, 13 bp, Homo sapiens
ctggccagtgtca

SEQ ID NO: 6153197 - DNA, 16 bp, Homo sapiens
ctggccagttgcccag

SEQ ID NO: 6153198 - DNA, 20 bp, Homo sapiens
ctggccagttgcccagagca

SEQ ID NO: 6153199 - DNA, 16 bp, Homo sapiens
ctggccatctccaccc

SEQ ID NO: 6153200 - DNA, 21 bp, Homo sapiens
ctggccatctccctccccaga

SEQ ID NO: 6153201 - DNA, 13 bp, Homo sapiens
ctggccatctctg

SEQ ID NO: 6153202 - DNA, 20 bp, Homo sapiens
ctggccatgaatctctgcct

SEQ ID NO: 6153203 - DNA, 23 bp, Homo sapiens
ctggccatgaatctctgcctctc

SEQ ID NO: 6153204 - DNA, 14 bp, Homo sapiens
ctggccatgctgtc

SEQ ID NO: 6153205 - DNA, 17 bp, Homo sapiens
ctggccatgctgtccct

SEQ ID NO: 6153206 - DNA, 12 bp, Homo sapiens
ctggccatggag

SEQ ID NO: 6153207 - DNA, 15 bp, Homo sapiens
ctggccatggagaaa

SEQ ID NO: 6153208 - DNA, 16 bp, Homo sapiens
ctggccatggagaaag

SEQ ID NO: 6153209 - DNA, 18 bp, Homo sapiens
ctggccatggagaaagct

SEQ ID NO: 6153210 - DNA, 15 bp, Homo sapiens
ctggccatggcctgc

SEQ ID NO: 6153211 - DNA, 20 bp, Homo sapiens
ctggccatggcctgcaaact

SEQ ID NO: 6153212 - DNA, 13 bp, Homo sapiens
ctggccatggctg

SEQ ID NO: 6153213 - DNA, 17 bp, Homo sapiens
ctggccatggggccctc

SEQ ID NO: 6153214 - DNA, 19 bp, Homo sapiens
ctggccatggggccctccc

SEQ ID NO: 6153215 - DNA, 21 bp, Homo sapiens
ctggccatggggccctcccag

SEQ ID NO: 6153216 - DNA, 20 bp, Homo sapiens
ctggccatgtcacctggctg

SEQ ID NO: 6153217 - DNA, 14 bp, Homo sapiens
ctggccatgtcctc

SEQ ID NO: 6153218 - DNA, 15 bp, Homo sapiens
ctggccatgtcctca

SEQ ID NO: 6153219 - DNA, 21 bp, Homo sapiens
ctggccatgtcctcaacccca

SEQ ID NO: 6153220 - DNA, 12 bp, Homo sapiens
ctggccattctt

SEQ ID NO: 6153221 - DNA, 22 bp, Homo sapiens
ctggccatttgccaattttcct

SEQ ID NO: 6153222 - DNA, 19 bp, Homo sapiens
ctggccattttcttgcctg

SEQ ID NO: 6153223 - DNA, 20 bp, Homo sapiens
ctggccattttcttgcctga

SEQ ID NO: 6153224 - DNA, 21 bp, Homo sapiens
ctggccattttggaaagcaag

SEQ ID NO: 6153225 - DNA, 17 bp, Homo sapiens
ctggccatttttctggg

SEQ ID NO: 6153226 - DNA, 15 bp, Homo sapiens
ctggcccaaccagaa

SEQ ID NO: 6153227 - DNA, 19 bp, Homo sapiens
ctggcccaagctgggctcc

SEQ ID NO: 6153228 - DNA, 22 bp, Homo sapiens
ctggcccacacgtgcatagagg

SEQ ID NO: 6153229 - DNA, 18 bp, Homo sapiens
ctggcccacagcaggtgc

SEQ ID NO: 6153230 - DNA, 19 bp, Homo sapiens
ctggcccacagctctgctg

SEQ ID NO: 6153231 - DNA, 13 bp, Homo sapiens
ctggcccaccagg

SEQ ID NO: 6153232 - DNA, 16 bp, Homo sapiens
ctggcccaccccaccc

SEQ ID NO: 6153233 - DNA, 18 bp, Homo sapiens
ctggcccaccccccagcc

SEQ ID NO: 6153234 - DNA, 23 bp, Homo sapiens
ctggcccaccccccagcctccag

SEQ ID NO: 6153235 - DNA, 17 bp, Homo sapiens
ctggcccacccctcttc

SEQ ID NO: 6153236 - DNA, 19 bp, Homo sapiens
ctggcccacccctcttccc

SEQ ID NO: 6153237 - DNA, 22 bp, Homo sapiens
ctggcccacgtagggggctctg

SEQ ID NO: 6153238 - DNA, 15 bp, Homo sapiens
ctggcccactgcatc

SEQ ID NO: 6153239 - DNA, 17 bp, Homo sapiens
ctggcccagaaagcctc

SEQ ID NO: 6153240 - DNA, 19 bp, Homo sapiens
ctggcccagaaagcctctc

SEQ ID NO: 6153241 - DNA, 22 bp, Homo sapiens
ctggcccagaaagcctctctct

SEQ ID NO: 6153242 - DNA, 23 bp, Homo sapiens
ctggcccagaaagcctctctctc

SEQ ID NO: 6153243 - DNA, 17 bp, Homo sapiens
ctggcccagagctggaa

SEQ ID NO: 6153244 - DNA, 11 bp, Homo sapiens
ctggcccagcc

SEQ ID NO: 6153245 - DNA, 20 bp, Homo sapiens
ctggcccagccaaaccctgt

SEQ ID NO: 6153246 - DNA, 21 bp, Homo sapiens
ctggcccagccaactgccccg

SEQ ID NO: 6153247 - DNA, 16 bp, Homo sapiens
ctggcccagccagcag

SEQ ID NO: 6153248 - DNA, 13 bp, Homo sapiens
ctggcccagccat

SEQ ID NO: 6153249 - DNA, 16 bp, Homo sapiens
ctggcccagccatggc

SEQ ID NO: 6153250 - DNA, 17 bp, Homo sapiens
ctggcccagccatggct

SEQ ID NO: 6153251 - DNA, 18 bp, Homo sapiens
ctggcccagccatggctg

SEQ ID NO: 6153252 - DNA, 19 bp, Homo sapiens
ctggcccagccatggctgg

SEQ ID NO: 6153253 - DNA, 15 bp, Homo sapiens
ctggcccagccctgc

SEQ ID NO: 6153254 - DNA, 12 bp, Homo sapiens
ctggcccagccg

SEQ ID NO: 6153255 - DNA, 14 bp, Homo sapiens
ctggcccagccggc

SEQ ID NO: 6153256 - DNA, 16 bp, Homo sapiens
ctggcccagccggcct

SEQ ID NO: 6153257 - DNA, 14 bp, Homo sapiens
ctggcccagcggcc

SEQ ID NO: 6153258 - DNA, 19 bp, Homo sapiens
ctggcccagcggcccctcc

SEQ ID NO: 6153259 - DNA, 14 bp, Homo sapiens
ctggcccagctccc

SEQ ID NO: 6153260 - DNA, 13 bp, Homo sapiens
ctggcccaggagg

SEQ ID NO: 6153261 - DNA, 13 bp, Homo sapiens
ctggcccaggcct

SEQ ID NO: 6153262 - DNA, 12 bp, Homo sapiens
ctggcccaggct

SEQ ID NO: 6153263 - DNA, 14 bp, Homo sapiens
ctggcccagggcat

SEQ ID NO: 6153264 - DNA, 18 bp, Homo sapiens
ctggcccagggcccagag

SEQ ID NO: 6153265 - DNA, 19 bp, Homo sapiens
ctggcccagggggcctgga

SEQ ID NO: 6153266 - DNA, 12 bp, Homo sapiens
ctggcccagggt

SEQ ID NO: 6153267 - DNA, 22 bp, Homo sapiens
ctggcccagtgagagtgaggcc

SEQ ID NO: 6153268 - DNA, 12 bp, Homo sapiens
ctggcccagtgc

SEQ ID NO: 6153269 - DNA, 21 bp, Homo sapiens
ctggcccagtgcaatctgtcc

SEQ ID NO: 6153270 - DNA, 17 bp, Homo sapiens
ctggcccagtgccagca

SEQ ID NO: 6153271 - DNA, 16 bp, Homo sapiens
ctggcccatcagtgta

SEQ ID NO: 6153272 - DNA, 13 bp, Homo sapiens
ctggcccatcatg

SEQ ID NO: 6153273 - DNA, 17 bp, Homo sapiens
ctggcccatctcagcct

SEQ ID NO: 6153274 - DNA, 18 bp, Homo sapiens
ctggcccatctcagcctc

SEQ ID NO: 6153275 - DNA, 20 bp, Homo sapiens
ctggcccatctcagcctcct

SEQ ID NO: 6153276 - DNA, 21 bp, Homo sapiens
ctggcccatctcagcctcctg

SEQ ID NO: 6153277 - DNA, 21 bp, Homo sapiens
ctggcccatgtatggccagga

SEQ ID NO: 6153278 - DNA, 16 bp, Homo sapiens
ctggcccattcttgag

SEQ ID NO: 6153279 - DNA, 20 bp, Homo sapiens
ctggccccaagatgttgggg

SEQ ID NO: 6153280 - DNA, 12 bp, Homo sapiens
ctggccccaccc

SEQ ID NO: 6153281 - DNA, 16 bp, Homo sapiens
ctggccccagagatga

SEQ ID NO: 6153282 - DNA, 17 bp, Homo sapiens
ctggccccagcccccac

SEQ ID NO: 6153283 - DNA, 14 bp, Homo sapiens
ctggccccagccct

SEQ ID NO: 6153284 - DNA, 23 bp, Homo sapiens
ctggccccagccctgctggggat

SEQ ID NO: 6153285 - DNA, 14 bp, Homo sapiens
ctggccccagcctg

SEQ ID NO: 6153286 - DNA, 16 bp, Homo sapiens
ctggccccagcctggg

SEQ ID NO: 6153287 - DNA, 14 bp, Homo sapiens
ctggccccagggca

SEQ ID NO: 6153288 - DNA, 15 bp, Homo sapiens
ctggccccagggcac

SEQ ID NO: 6153289 - DNA, 18 bp, Homo sapiens
ctggccccagggcaccct

SEQ ID NO: 6153290 - DNA, 18 bp, Homo sapiens
ctggccccagtgaccggg

SEQ ID NO: 6153291 - DNA, 16 bp, Homo sapiens
ctggccccagtgccta

SEQ ID NO: 6153292 - DNA, 22 bp, Homo sapiens
ctggccccagtgcggttcctca

SEQ ID NO: 6153293 - DNA, 23 bp, Homo sapiens
ctggcccccaacctcagggctcc

SEQ ID NO: 6153294 - DNA, 12 bp, Homo sapiens
ctggcccccacc

SEQ ID NO: 6153295 - DNA, 13 bp, Homo sapiens
ctggcccccaccc

SEQ ID NO: 6153296 - DNA, 19 bp, Homo sapiens
ctggcccccacccaccttc

SEQ ID NO: 6153297 - DNA, 13 bp, Homo sapiens
ctggcccccactg

SEQ ID NO: 6153298 - DNA, 15 bp, Homo sapiens
ctggcccccactggc

SEQ ID NO: 6153299 - DNA, 19 bp, Homo sapiens
ctggcccccagccctgggg

SEQ ID NO: 6153300 - DNA, 13 bp, Homo sapiens
ctggcccccagct

SEQ ID NO: 6153301 - DNA, 16 bp, Homo sapiens
ctggcccccagcttca

SEQ ID NO: 6153302 - DNA, 20 bp, Homo sapiens
ctggcccccatcagccctgc

SEQ ID NO: 6153303 - DNA, 21 bp, Homo sapiens
ctggcccccatcagccctgct

SEQ ID NO: 6153304 - DNA, 22 bp, Homo sapiens
ctggcccccatcagccctgcta

SEQ ID NO: 6153305 - DNA, 23 bp, Homo sapiens
ctggcccccccagccccacaccc

SEQ ID NO: 6153306 - DNA, 13 bp, Homo sapiens
ctggcccccctgg

SEQ ID NO: 6153307 - DNA, 19 bp, Homo sapiens
ctggcccccctggtcccct

SEQ ID NO: 6153308 - DNA, 23 bp, Homo sapiens
ctggccccctattgtctccaagg

SEQ ID NO: 6153309 - DNA, 17 bp, Homo sapiens
ctggccccctcagctct

SEQ ID NO: 6153310 - DNA, 13 bp, Homo sapiens
ctggccccctccc

SEQ ID NO: 6153311 - DNA, 15 bp, Homo sapiens
ctggccccctccctg

SEQ ID NO: 6153312 - DNA, 20 bp, Homo sapiens
ctggccccctccctggatga

SEQ ID NO: 6153313 - DNA, 12 bp, Homo sapiens
ctggccccctcg

SEQ ID NO: 6153314 - DNA, 13 bp, Homo sapiens
ctggccccctcgc

SEQ ID NO: 6153315 - DNA, 22 bp, Homo sapiens
ctggccccctcgcgcccctgtc

SEQ ID NO: 6153316 - DNA, 20 bp, Homo sapiens
ctggccccggatcagagcag

SEQ ID NO: 6153317 - DNA, 24 bp, Homo sapiens
ctggccccggatcagagcaggacc

SEQ ID NO: 6153318 - DNA, 20 bp, Homo sapiens
ctggccccgggctctggcca

SEQ ID NO: 6153319 - DNA, 22 bp, Homo sapiens
ctggcccctaggctgctgctgt

SEQ ID NO: 6153320 - DNA, 13 bp, Homo sapiens
ctggcccctcacc

SEQ ID NO: 6153321 - DNA, 20 bp, Homo sapiens
ctggcccctcacccaccatg

SEQ ID NO: 6153322 - DNA, 17 bp, Homo sapiens
ctggcccctcagggtcc

SEQ ID NO: 6153323 - DNA, 18 bp, Homo sapiens
ctggcccctcagggtccc

SEQ ID NO: 6153324 - DNA, 13 bp, Homo sapiens
ctggcccctccaa

SEQ ID NO: 6153325 - DNA, 22 bp, Homo sapiens
ctggcccctccagaccctgcct

SEQ ID NO: 6153326 - DNA, 14 bp, Homo sapiens
ctggcccctcccac

SEQ ID NO: 6153327 - DNA, 24 bp, Homo sapiens
ctggcccctcgcctgtggagctca

SEQ ID NO: 6153328 - DNA, 23 bp, Homo sapiens
ctggcccctctcaggctgtgctt

SEQ ID NO: 6153329 - DNA, 19 bp, Homo sapiens
ctggcccctggcctgccgg

SEQ ID NO: 6153330 - DNA, 12 bp, Homo sapiens
ctggcccctggg

SEQ ID NO: 6153331 - DNA, 14 bp, Homo sapiens
ctggcccctgggtc

SEQ ID NO: 6153332 - DNA, 21 bp, Homo sapiens
ctggcccgcccctcgctgctg

SEQ ID NO: 6153333 - DNA, 23 bp, Homo sapiens
ctggcccgcccctcgctgctgct

SEQ ID NO: 6153334 - DNA, 18 bp, Homo sapiens
ctggcccgccctcacctc

SEQ ID NO: 6153335 - DNA, 21 bp, Homo sapiens
ctggcccgccctcacctctga

SEQ ID NO: 6153336 - DNA, 21 bp, Homo sapiens
ctggcccgggcatccacgtag

SEQ ID NO: 6153337 - DNA, 18 bp, Homo sapiens
ctggcccgtcatgttcct

SEQ ID NO: 6153338 - DNA, 15 bp, Homo sapiens
ctggcccgtgacaga

SEQ ID NO: 6153339 - DNA, 16 bp, Homo sapiens
ctggccctaggcactg

SEQ ID NO: 6153340 - DNA, 23 bp, Homo sapiens
ctggccctatgcttccggcctcc

SEQ ID NO: 6153341 - DNA, 17 bp, Homo sapiens
ctggccctcacccctgc

SEQ ID NO: 6153342 - DNA, 23 bp, Homo sapiens
ctggccctcacccctgccctggg

SEQ ID NO: 6153343 - DNA, 18 bp, Homo sapiens
ctggccctccctccctag

SEQ ID NO: 6153344 - DNA, 17 bp, Homo sapiens
ctggccctcctggctgt

SEQ ID NO: 6153345 - DNA, 18 bp, Homo sapiens
ctggccctcggtggctgc

SEQ ID NO: 6153346 - DNA, 22 bp, Homo sapiens
ctggccctcggtggctgcacag

SEQ ID NO: 6153347 - DNA, 16 bp, Homo sapiens
ctggccctctagcttc

SEQ ID NO: 6153348 - DNA, 15 bp, Homo sapiens
ctggccctctctgaa

SEQ ID NO: 6153349 - DNA, 14 bp, Homo sapiens
ctggccctgaggtg

SEQ ID NO: 6153350 - DNA, 19 bp, Homo sapiens
ctggccctgaggtgtgggg

SEQ ID NO: 6153351 - DNA, 12 bp, Homo sapiens
ctctatgtacag

SEQ ID NO: 6153352 - DNA, 17 bp, Homo sapiens
ctctatgtatcaaatgt

SEQ ID NO: 6153353 - DNA, 19 bp, Homo sapiens
ctctatgtcaattgatatt

SEQ ID NO: 6153354 - DNA, 22 bp, Homo sapiens
ctctatgtcaattgatatttct

SEQ ID NO: 6153355 - DNA, 20 bp, Homo sapiens
ctctatgtccggctttaact

SEQ ID NO: 6153356 - DNA, 16 bp, Homo sapiens
ctctatgtctgccttc

SEQ ID NO: 6153357 - DNA, 20 bp, Homo sapiens
ctctatgtttacaaatggac

SEQ ID NO: 6153358 - DNA, 17 bp, Homo sapiens
ctctattagtttcaatt

SEQ ID NO: 6153359 - DNA, 12 bp, Homo sapiens
ctctattcctga

SEQ ID NO: 6153360 - DNA, 16 bp, Homo sapiens
ctctattcctgaccct

SEQ ID NO: 6153361 - DNA, 18 bp, Homo sapiens
ctctattcctgaccctcc

SEQ ID NO: 6153362 - DNA, 20 bp, Homo sapiens
ctctattcgccacacagtat

SEQ ID NO: 6153363 - DNA, 17 bp, Homo sapiens
ctctattctctaaactg

SEQ ID NO: 6153364 - DNA, 18 bp, Homo sapiens
ctctattcttgggaaaca

SEQ ID NO: 6153365 - DNA, 18 bp, Homo sapiens
ctctattctttccatgac

SEQ ID NO: 6153366 - DNA, 18 bp, Homo sapiens
ctctattgatacaatatt

SEQ ID NO: 6153367 - DNA, 23 bp, Homo sapiens
ctctattgatgtacagtctgtca

SEQ ID NO: 6153368 - DNA, 19 bp, Homo sapiens
ctctattggatttgtccaa

SEQ ID NO: 6153369 - DNA, 19 bp, Homo sapiens
ctctattgggcacagccta

SEQ ID NO: 6153370 - DNA, 20 bp, Homo sapiens
ctctattgtagcatttcttg

SEQ ID NO: 6153371 - DNA, 21 bp, Homo sapiens
ctctattgtagcatttcttga

SEQ ID NO: 6153372 - DNA, 14 bp, Homo sapiens
ctctatttaaattc

SEQ ID NO: 6153373 - DNA, 16 bp, Homo sapiens
ctctatttaaattctt

SEQ ID NO: 6153374 - DNA, 18 bp, Homo sapiens
ctctatttaaattctttt

SEQ ID NO: 6153375 - DNA, 14 bp, Homo sapiens
ctctatttaagatt

SEQ ID NO: 6153376 - DNA, 15 bp, Homo sapiens
ctctatttaatattt

SEQ ID NO: 6153377 - DNA, 15 bp, Homo sapiens
ctctatttacctgcg

SEQ ID NO: 6153378 - DNA, 24 bp, Homo sapiens
ctctatttacttctaatcttaaat

SEQ ID NO: 6153379 - DNA, 13 bp, Homo sapiens
ctctatttagcat

SEQ ID NO: 6153380 - DNA, 16 bp, Homo sapiens
ctctatttattagcca

SEQ ID NO: 6153381 - DNA, 14 bp, Homo sapiens
ctctatttattggg

SEQ ID NO: 6153382 - DNA, 13 bp, Homo sapiens
ctctatttcacaa

SEQ ID NO: 6153383 - DNA, 17 bp, Homo sapiens
ctctatttccccctttc

SEQ ID NO: 6153384 - DNA, 18 bp, Homo sapiens
ctctatttccccctttct

SEQ ID NO: 6153385 - DNA, 13 bp, Homo sapiens
ctctatttctcta

SEQ ID NO: 6153386 - DNA, 13 bp, Homo sapiens
ctctatttctgga

SEQ ID NO: 6153387 - DNA, 11 bp, Homo sapiens
ctctatttctt

SEQ ID NO: 6153388 - DNA, 23 bp, Homo sapiens
ctctatttcttcttcacatccat

SEQ ID NO: 6153389 - DNA, 17 bp, Homo sapiens
ctctatttgaattattt

SEQ ID NO: 6153390 - DNA, 22 bp, Homo sapiens
ctctatttgagaagttctcaga

SEQ ID NO: 6153391 - DNA, 14 bp, Homo sapiens
ctctattttaaagt

SEQ ID NO: 6153392 - DNA, 14 bp, Homo sapiens
ctctattttaatgt

SEQ ID NO: 6153393 - DNA, 20 bp, Homo sapiens
ctctattttcataatcagta

SEQ ID NO: 6153394 - DNA, 15 bp, Homo sapiens
ctctatttttaatca

SEQ ID NO: 6153395 - DNA, 18 bp, Homo sapiens
ctctatttttgtaaaaag

SEQ ID NO: 6153396 - DNA, 12 bp, Homo sapiens
ctctcaaaacaa

SEQ ID NO: 6153397 - DNA, 21 bp, Homo sapiens
ctctcaaaacaatattacttt

SEQ ID NO: 6153398 - DNA, 23 bp, Homo sapiens
ctctcaaaacttggtatttttca

SEQ ID NO: 6153399 - DNA, 17 bp, Homo sapiens
ctctcaaaagtctattt

SEQ ID NO: 6153400 - DNA, 14 bp, Homo sapiens
ctctcaaaatgtgc

SEQ ID NO: 6153401 - DNA, 15 bp, Homo sapiens
ctctcaaaatgtgcc

SEQ ID NO: 6153402 - DNA, 16 bp, Homo sapiens
ctctcaaaatgtgccg

SEQ ID NO: 6153403 - DNA, 19 bp, Homo sapiens
ctctcaaacggcaacattc

SEQ ID NO: 6153404 - DNA, 19 bp, Homo sapiens
ctctcaaacttagttttta

SEQ ID NO: 6153405 - DNA, 17 bp, Homo sapiens
ctctcaaattcagctct

SEQ ID NO: 6153406 - DNA, 15 bp, Homo sapiens
ctctcaacaccatga

SEQ ID NO: 6153407 - DNA, 20 bp, Homo sapiens
ctctcaaccacctttcagat

SEQ ID NO: 6153408 - DNA, 17 bp, Homo sapiens
ctctcaacccaggagca

SEQ ID NO: 6153409 - DNA, 16 bp, Homo sapiens
ctctcaaccttggcct

SEQ ID NO: 6153410 - DNA, 19 bp, Homo sapiens
ctctcaaccttggccttct

SEQ ID NO: 6153411 - DNA, 20 bp, Homo sapiens
ctctcaaccttggccttctc

SEQ ID NO: 6153412 - DNA, 17 bp, Homo sapiens
ctctcaactgcctcagc

SEQ ID NO: 6153413 - DNA, 18 bp, Homo sapiens
ctctcaagagtgctgaga

SEQ ID NO: 6153414 - DNA, 18 bp, Homo sapiens
ctctcaagctagtgtttc

SEQ ID NO: 6153415 - DNA, 14 bp, Homo sapiens
ctctcaagtaatat

SEQ ID NO: 6153416 - DNA, 16 bp, Homo sapiens
ctctcaagtagctggg

SEQ ID NO: 6153417 - DNA, 21 bp, Homo sapiens
ctctcaatagcaaaagtgatg

SEQ ID NO: 6153418 - DNA, 14 bp, Homo sapiens
ctctcaatatataa

SEQ ID NO: 6153419 - DNA, 22 bp, Homo sapiens
ctctcaatatataataaatggg

SEQ ID NO: 6153420 - DNA, 23 bp, Homo sapiens
ctctcaatatataataaatggga

SEQ ID NO: 6153421 - DNA, 15 bp, Homo sapiens
ctctcaatatgctta

SEQ ID NO: 6153422 - DNA, 16 bp, Homo sapiens
ctctcaatatgcttac

SEQ ID NO: 6153423 - DNA, 18 bp, Homo sapiens
ctctcaatattcaataaa

SEQ ID NO: 6153424 - DNA, 17 bp, Homo sapiens
ctctcaatccctttgca

SEQ ID NO: 6153425 - DNA, 20 bp, Homo sapiens
ctctcaatttgggtcccagc

SEQ ID NO: 6153426 - DNA, 13 bp, Homo sapiens
ctctcaatttttg

SEQ ID NO: 6153427 - DNA, 21 bp, Homo sapiens
ctctcacacatcacattccca

SEQ ID NO: 6153428 - DNA, 19 bp, Homo sapiens
ctctcacactggttctcaa

SEQ ID NO: 6153429 - DNA, 22 bp, Homo sapiens
ctctcacactggttctcaatga

SEQ ID NO: 6153430 - DNA, 11 bp, Homo sapiens
ctctcacagac

SEQ ID NO: 6153431 - DNA, 18 bp, Homo sapiens
ctctcacagacaggaccc

SEQ ID NO: 6153432 - DNA, 20 bp, Homo sapiens
ctctcacagacaggacccct

SEQ ID NO: 6153433 - DNA, 17 bp, Homo sapiens
ctctcacaggcagctct

SEQ ID NO: 6153434 - DNA, 23 bp, Homo sapiens
ctctcacaggcagctctgagccg

SEQ ID NO: 6153435 - DNA, 13 bp, Homo sapiens
ctctcacattact

SEQ ID NO: 6153436 - DNA, 22 bp, Homo sapiens
ctctcaccatgatgtgaagagt

SEQ ID NO: 6153437 - DNA, 23 bp, Homo sapiens
ctctcaccatttggatcctgtgt

SEQ ID NO: 6153438 - DNA, 15 bp, Homo sapiens
ctctcacccaccagc

SEQ ID NO: 6153439 - DNA, 19 bp, Homo sapiens
ctctcacccaccagctcca

SEQ ID NO: 6153440 - DNA, 21 bp, Homo sapiens
ctctcacccaccagctccaca

SEQ ID NO: 6153441 - DNA, 21 bp, Homo sapiens
ctctcacccagtccccacccg

SEQ ID NO: 6153442 - DNA, 14 bp, Homo sapiens
ctctcacccatccc

SEQ ID NO: 6153443 - DNA, 12 bp, Homo sapiens
ctctcaccccac

SEQ ID NO: 6153444 - DNA, 14 bp, Homo sapiens
ctctcaccccactc

SEQ ID NO: 6153445 - DNA, 20 bp, Homo sapiens
ctctcaccccactcctgtca

SEQ ID NO: 6153446 - DNA, 23 bp, Homo sapiens
ctctcaccccacttcccatctcc

SEQ ID NO: 6153447 - DNA, 21 bp, Homo sapiens
ctctcaccccccgacctggct

SEQ ID NO: 6153448 - DNA, 13 bp, Homo sapiens
ctctcacctcagc

SEQ ID NO: 6153449 - DNA, 12 bp, Homo sapiens
ctctcacctcct

SEQ ID NO: 6153450 - DNA, 15 bp, Homo sapiens
ctctcacctgctccc

SEQ ID NO: 6153451 - DNA, 23 bp, Homo sapiens
ctctcacggccacacagctgccg

SEQ ID NO: 6153452 - DNA, 16 bp, Homo sapiens
ctctcacgggccctgc

SEQ ID NO: 6153453 - DNA, 15 bp, Homo sapiens
ctctcactaaacttt

SEQ ID NO: 6153454 - DNA, 19 bp, Homo sapiens
ctctcactccacccagagt

SEQ ID NO: 6153455 - DNA, 21 bp, Homo sapiens
ctctcactccacccagagtag

SEQ ID NO: 6153456 - DNA, 14 bp, Homo sapiens
ctctcactccagcc

SEQ ID NO: 6153457 - DNA, 14 bp, Homo sapiens
ctctcactccccag

SEQ ID NO: 6153458 - DNA, 12 bp, Homo sapiens
ctctcactcctg

SEQ ID NO: 6153459 - DNA, 20 bp, Homo sapiens
ctctcactcctgaattcagt

SEQ ID NO: 6153460 - DNA, 13 bp, Homo sapiens
ctctcactcctgc

SEQ ID NO: 6153461 - DNA, 18 bp, Homo sapiens
ctctcactcctgcctccg

SEQ ID NO: 6153462 - DNA, 14 bp, Homo sapiens
ctctcactccttga

SEQ ID NO: 6153463 - DNA, 15 bp, Homo sapiens
ctctcactccttgaa

SEQ ID NO: 6153464 - DNA, 20 bp, Homo sapiens
ctctcactctcttcctttca

SEQ ID NO: 6153465 - DNA, 21 bp, Homo sapiens
ctctcactctcttcctttcat

SEQ ID NO: 6153466 - DNA, 15 bp, Homo sapiens
ctctcactctggcag

SEQ ID NO: 6153467 - DNA, 14 bp, Homo sapiens
ctctcactggccag

SEQ ID NO: 6153468 - DNA, 15 bp, Homo sapiens
ctctcactgtgtccc

SEQ ID NO: 6153469 - DNA, 23 bp, Homo sapiens
ctctcacttttttataaattata

SEQ ID NO: 6153470 - DNA, 16 bp, Homo sapiens
ctctcagaaataaatc

SEQ ID NO: 6153471 - DNA, 20 bp, Homo sapiens
ctctcagaaataaatcacag

SEQ ID NO: 6153472 - DNA, 20 bp, Homo sapiens
ctctcagaactcctgtgtgt

SEQ ID NO: 6153473 - DNA, 15 bp, Homo sapiens
ctctcagactctaaa

SEQ ID NO: 6153474 - DNA, 18 bp, Homo sapiens
ctctcagagactcccagg

SEQ ID NO: 6153475 - DNA, 13 bp, Homo sapiens
ctctcagagcaag

SEQ ID NO: 6153476 - DNA, 15 bp, Homo sapiens
ctctcagagcaagcc

SEQ ID NO: 6153477 - DNA, 17 bp, Homo sapiens
ctctcagagcaagcctt

SEQ ID NO: 6153478 - DNA, 18 bp, Homo sapiens
ctctcagagcaagccttt

SEQ ID NO: 6153479 - DNA, 21 bp, Homo sapiens
ctctcagagcaagcctttgac

SEQ ID NO: 6153480 - DNA, 22 bp, Homo sapiens
ctctcagagcaagcctttgacc

SEQ ID NO: 6153481 - DNA, 15 bp, Homo sapiens
ctctcagagcctcag

SEQ ID NO: 6153482 - DNA, 21 bp, Homo sapiens
ctctcagagctacttgggcca

SEQ ID NO: 6153483 - DNA, 22 bp, Homo sapiens
ctctcagagctacttgggccat

SEQ ID NO: 6153484 - DNA, 17 bp, Homo sapiens
ctctcagatacccagtg

SEQ ID NO: 6153485 - DNA, 10 bp, Homo sapiens
ctctcagatc

SEQ ID NO: 6153486 - DNA, 23 bp, Homo sapiens
ctctcagatcaccccagcctcac

SEQ ID NO: 6153487 - DNA, 15 bp, Homo sapiens
ctctcagcaagtgcc

SEQ ID NO: 6153488 - DNA, 23 bp, Homo sapiens
ctctcagcaccaagagcagctgg

SEQ ID NO: 6153489 - DNA, 20 bp, Homo sapiens
ctctcagcatagcctgcctg

SEQ ID NO: 6153490 - DNA, 19 bp, Homo sapiens
ctctcagccagctgtttaa

SEQ ID NO: 6153491 - DNA, 12 bp, Homo sapiens
ctctcagcccag

SEQ ID NO: 6153492 - DNA, 13 bp, Homo sapiens
ctctcagcccaga

SEQ ID NO: 6153493 - DNA, 13 bp, Homo sapiens
ctctcagccctca

SEQ ID NO: 6153494 - DNA, 13 bp, Homo sapiens
ctctcagcctcca

SEQ ID NO: 6153495 - DNA, 16 bp, Homo sapiens
ctctcagctcccaggc

SEQ ID NO: 6153496 - DNA, 19 bp, Homo sapiens
ctctcagctgctggatgac

SEQ ID NO: 6153497 - DNA, 12 bp, Homo sapiens
ctctcagcttgt

SEQ ID NO: 6153498 - DNA, 14 bp, Homo sapiens
ctctcagcttgtgc

SEQ ID NO: 6153499 - DNA, 15 bp, Homo sapiens
ctctcagcttgtgcc

SEQ ID NO: 6153500 - DNA, 20 bp, Homo sapiens
ctctcaggaaatgctgaccc

SEQ ID NO: 6153501 - DNA, 17 bp, Homo sapiens
ctctcaggaccaaagct

SEQ ID NO: 6153502 - DNA, 19 bp, Homo sapiens
ctctcaggaccaccctgcc

SEQ ID NO: 6153503 - DNA, 13 bp, Homo sapiens
ctctcaggagagt

SEQ ID NO: 6153504 - DNA, 16 bp, Homo sapiens
ctctcaggagcacagg

SEQ ID NO: 6153505 - DNA, 21 bp, Homo sapiens
ctctcaggagcacaggcagct

SEQ ID NO: 6153506 - DNA, 13 bp, Homo sapiens
ctctcaggagcca

SEQ ID NO: 6153507 - DNA, 14 bp, Homo sapiens
ctctcaggagccat

SEQ ID NO: 6153508 - DNA, 20 bp, Homo sapiens
ctctcaggaggcgcagcccg

SEQ ID NO: 6153509 - DNA, 22 bp, Homo sapiens
ctctcaggaggcgcagcccgaa

SEQ ID NO: 6153510 - DNA, 13 bp, Homo sapiens
ctctcaggatcca

SEQ ID NO: 6153511 - DNA, 18 bp, Homo sapiens
ctctcaggcatgcctgtg

SEQ ID NO: 6153512 - DNA, 12 bp, Homo sapiens
ctctcaggccaa

SEQ ID NO: 6153513 - DNA, 19 bp, Homo sapiens
ctctcaggccaccacagag

SEQ ID NO: 6153514 - DNA, 17 bp, Homo sapiens
ctctcaggccgagagcc

SEQ ID NO: 6153515 - DNA, 18 bp, Homo sapiens
ctctcaggccggcagccc

SEQ ID NO: 6153516 - DNA, 16 bp, Homo sapiens
ctctcaggctgggccc

SEQ ID NO: 6153517 - DNA, 21 bp, Homo sapiens
ctctcaggctgtcccaagctc

SEQ ID NO: 6153518 - DNA, 22 bp, Homo sapiens
ctctcaggctgtcccaagctcc

SEQ ID NO: 6153519 - DNA, 19 bp, Homo sapiens
ctctcaggctgtgcttacc

SEQ ID NO: 6153520 - DNA, 18 bp, Homo sapiens
ctctcagggccaggcctc

SEQ ID NO: 6153521 - DNA, 21 bp, Homo sapiens
ctctcagggccgagaggacag

SEQ ID NO: 6153522 - DNA, 14 bp, Homo sapiens
ctctcagggcctgg

SEQ ID NO: 6153523 - DNA, 16 bp, Homo sapiens
ctctcagggcctggca

SEQ ID NO: 6153524 - DNA, 19 bp, Homo sapiens
ctctcagggcctggcaggc

SEQ ID NO: 6153525 - DNA, 21 bp, Homo sapiens
ctctcagggcctggcaggcca

SEQ ID NO: 6153526 - DNA, 23 bp, Homo sapiens
ctctcagggcctggcaggccagt

SEQ ID NO: 6153527 - DNA, 15 bp, Homo sapiens
ctctcaggtgaccaa

SEQ ID NO: 6153528 - DNA, 14 bp, Homo sapiens
ctctcagtctctga

SEQ ID NO: 6153529 - DNA, 17 bp, Homo sapiens
ctctcagtctctgagca

SEQ ID NO: 6153530 - DNA, 13 bp, Homo sapiens
ctggccctgccca

SEQ ID NO: 6153531 - DNA, 14 bp, Homo sapiens
ctggccctgccctc

SEQ ID NO: 6153532 - DNA, 15 bp, Homo sapiens
ctggccctgccctcc

SEQ ID NO: 6153533 - DNA, 16 bp, Homo sapiens
ctggccctgccctgag

SEQ ID NO: 6153534 - DNA, 17 bp, Homo sapiens
ctggccctgccctgagg

SEQ ID NO: 6153535 - DNA, 15 bp, Homo sapiens
ctggccctgccctgg

SEQ ID NO: 6153536 - DNA, 12 bp, Homo sapiens
ctggccctgcct

SEQ ID NO: 6153537 - DNA, 13 bp, Homo sapiens
ctggccctgcctc

SEQ ID NO: 6153538 - DNA, 15 bp, Homo sapiens
ctggccctgcctcat

SEQ ID NO: 6153539 - DNA, 15 bp, Homo sapiens
ctggccctgcctcct

SEQ ID NO: 6153540 - DNA, 21 bp, Homo sapiens
ctggccctgcctcctgggaag

SEQ ID NO: 6153541 - DNA, 22 bp, Homo sapiens
ctggccctgcctcctgggaaga

SEQ ID NO: 6153542 - DNA, 14 bp, Homo sapiens
ctggccctgccttc

SEQ ID NO: 6153543 - DNA, 11 bp, Homo sapiens
ctggccctgct

SEQ ID NO: 6153544 - DNA, 22 bp, Homo sapiens
ctggccctggcgggtggctgca

SEQ ID NO: 6153545 - DNA, 21 bp, Homo sapiens
ctggccctgggccccgcctca

SEQ ID NO: 6153546 - DNA, 14 bp, Homo sapiens
ctggccctggggcc

SEQ ID NO: 6153547 - DNA, 19 bp, Homo sapiens
ctggccctgggggtctggg

SEQ ID NO: 6153548 - DNA, 14 bp, Homo sapiens
ctggccctgtgcag

SEQ ID NO: 6153549 - DNA, 13 bp, Homo sapiens
ctggccctgttgt

SEQ ID NO: 6153550 - DNA, 18 bp, Homo sapiens
ctggccctgtttctcccc

SEQ ID NO: 6153551 - DNA, 14 bp, Homo sapiens
ctggcccttacaca

SEQ ID NO: 6153552 - DNA, 23 bp, Homo sapiens
ctggcccttacacactcaggcct

SEQ ID NO: 6153553 - DNA, 19 bp, Homo sapiens
ctggcccttacttgcttct

SEQ ID NO: 6153554 - DNA, 13 bp, Homo sapiens
ctggcccttagag

SEQ ID NO: 6153555 - DNA, 17 bp, Homo sapiens
ctggcccttcagtctgc

SEQ ID NO: 6153556 - DNA, 23 bp, Homo sapiens
ctggcccttcagtctgctccacc

SEQ ID NO: 6153557 - DNA, 15 bp, Homo sapiens
ctggcccttccttca

SEQ ID NO: 6153558 - DNA, 16 bp, Homo sapiens
ctggcccttccttcac

SEQ ID NO: 6153559 - DNA, 23 bp, Homo sapiens
ctggcccttgcccaactcccagc

SEQ ID NO: 6153560 - DNA, 19 bp, Homo sapiens
ctggcccttgcctttgtgg

SEQ ID NO: 6153561 - DNA, 23 bp, Homo sapiens
ctggccctttcacccctcttccc

SEQ ID NO: 6153562 - DNA, 20 bp, Homo sapiens
ctggccctttccccttcccc

SEQ ID NO: 6153563 - DNA, 15 bp, Homo sapiens
ctggccgagctgaag

SEQ ID NO: 6153564 - DNA, 21 bp, Homo sapiens
ctggccgagggtcctggctcc

SEQ ID NO: 6153565 - DNA, 16 bp, Homo sapiens
ctggccgagtccaagc

SEQ ID NO: 6153566 - DNA, 20 bp, Homo sapiens
ctggccgagtccaagctggg

SEQ ID NO: 6153567 - DNA, 23 bp, Homo sapiens
ctggccgatgtgggtccctctct

SEQ ID NO: 6153568 - DNA, 13 bp, Homo sapiens
ctggccgcagagg

SEQ ID NO: 6153569 - DNA, 18 bp, Homo sapiens
ctggccgccacccccatc

SEQ ID NO: 6153570 - DNA, 19 bp, Homo sapiens
ctggccgccacccccatct

SEQ ID NO: 6153571 - DNA, 22 bp, Homo sapiens
ctggccgccccctgccccccag

SEQ ID NO: 6153572 - DNA, 14 bp, Homo sapiens
ctggccgcctcacc

SEQ ID NO: 6153573 - DNA, 13 bp, Homo sapiens
ctggccgcctcca

SEQ ID NO: 6153574 - DNA, 14 bp, Homo sapiens
ctggccgctgagcg

SEQ ID NO: 6153575 - DNA, 16 bp, Homo sapiens
ctggccgctgagcgcc

SEQ ID NO: 6153576 - DNA, 17 bp, Homo sapiens
ctggccgcttctcccca

SEQ ID NO: 6153577 - DNA, 22 bp, Homo sapiens
ctggccggaaggagactgtggt

SEQ ID NO: 6153578 - DNA, 23 bp, Homo sapiens
ctggccggagtcagtgccaggtc

SEQ ID NO: 6153579 - DNA, 13 bp, Homo sapiens
ctggccggccagc

SEQ ID NO: 6153580 - DNA, 19 bp, Homo sapiens
ctggccggcccacgtcctg

SEQ ID NO: 6153581 - DNA, 15 bp, Homo sapiens
ctggccggctccagt

SEQ ID NO: 6153582 - DNA, 19 bp, Homo sapiens
ctggccggctccagtttcc

SEQ ID NO: 6153583 - DNA, 17 bp, Homo sapiens
ctggccgggactgctgc

SEQ ID NO: 6153584 - DNA, 20 bp, Homo sapiens
ctggccgggactgctgctct

SEQ ID NO: 6153585 - DNA, 21 bp, Homo sapiens
ctggccgggactgctgctctc

SEQ ID NO: 6153586 - DNA, 15 bp, Homo sapiens
ctggccgggcacagc

SEQ ID NO: 6153587 - DNA, 16 bp, Homo sapiens
ctggccgggcaggcgt

SEQ ID NO: 6153588 - DNA, 17 bp, Homo sapiens
ctggccggggcccctca

SEQ ID NO: 6153589 - DNA, 19 bp, Homo sapiens
ctggccgggtcaccctgtg

SEQ ID NO: 6153590 - DNA, 22 bp, Homo sapiens
ctggccgggtcaccctgtgacc

SEQ ID NO: 6153591 - DNA, 20 bp, Homo sapiens
ctggccgggttggaggcctc

SEQ ID NO: 6153592 - DNA, 21 bp, Homo sapiens
ctggccgggttggaggcctca

SEQ ID NO: 6153593 - DNA, 16 bp, Homo sapiens
ctggccggtccacccc

SEQ ID NO: 6153594 - DNA, 16 bp, Homo sapiens
ctggccggtctgcaag

SEQ ID NO: 6153595 - DNA, 17 bp, Homo sapiens
ctggccggtctgcaagt

SEQ ID NO: 6153596 - DNA, 23 bp, Homo sapiens
ctggccggtctgcaagtcagagg

SEQ ID NO: 6153597 - DNA, 15 bp, Homo sapiens
ctggccggtgctggg

SEQ ID NO: 6153598 - DNA, 21 bp, Homo sapiens
ctggccggtgctgggttccca

SEQ ID NO: 6153599 - DNA, 17 bp, Homo sapiens
ctggccgtggctccaga

SEQ ID NO: 6153600 - DNA, 16 bp, Homo sapiens
ctggccgttcagcctg

SEQ ID NO: 6153601 - DNA, 19 bp, Homo sapiens
ctggcctaaaatcttggaa

SEQ ID NO: 6153602 - DNA, 20 bp, Homo sapiens
ctggcctaaaatcttggaag

SEQ ID NO: 6153603 - DNA, 21 bp, Homo sapiens
ctggcctaaaatcttggaagt

SEQ ID NO: 6153604 - DNA, 20 bp, Homo sapiens
ctggcctaatcactctgagt

SEQ ID NO: 6153605 - DNA, 23 bp, Homo sapiens
ctggcctacccctttctccagcc

SEQ ID NO: 6153606 - DNA, 21 bp, Homo sapiens
ctggcctaggggccagggctt

SEQ ID NO: 6153607 - DNA, 23 bp, Homo sapiens
ctggcctagtggggaggggcctg

SEQ ID NO: 6153608 - DNA, 22 bp, Homo sapiens
ctggcctatccgctgccagcct

SEQ ID NO: 6153609 - DNA, 15 bp, Homo sapiens
ctggcctatgaccct

SEQ ID NO: 6153610 - DNA, 19 bp, Homo sapiens
ctggcctatgaccctgtgc

SEQ ID NO: 6153611 - DNA, 20 bp, Homo sapiens
ctggcctatgaccctgtgcc

SEQ ID NO: 6153612 - DNA, 22 bp, Homo sapiens
ctggcctatgaccctgtgcctg

SEQ ID NO: 6153613 - DNA, 12 bp, Homo sapiens
ctggcctattta

SEQ ID NO: 6153614 - DNA, 16 bp, Homo sapiens
ctggcctatttaagcc

SEQ ID NO: 6153615 - DNA, 18 bp, Homo sapiens
ctggcctcaactgagaag

SEQ ID NO: 6153616 - DNA, 14 bp, Homo sapiens
ctggcctcactggc

SEQ ID NO: 6153617 - DNA, 15 bp, Homo sapiens
ctggcctcactggct

SEQ ID NO: 6153618 - DNA, 17 bp, Homo sapiens
ctggcctcactggctgg

SEQ ID NO: 6153619 - DNA, 19 bp, Homo sapiens
ctggcctcactggctgggg

SEQ ID NO: 6153620 - DNA, 20 bp, Homo sapiens
ctggcctcactggctggggc

SEQ ID NO: 6153621 - DNA, 13 bp, Homo sapiens
ctggcctcagact

SEQ ID NO: 6153622 - DNA, 13 bp, Homo sapiens
ctggcctcagagc

SEQ ID NO: 6153623 - DNA, 15 bp, Homo sapiens
ctggcctcagagctt

SEQ ID NO: 6153624 - DNA, 16 bp, Homo sapiens
ctggcctcagagcttc

SEQ ID NO: 6153625 - DNA, 20 bp, Homo sapiens
ctggcctcagagcttcctgg

SEQ ID NO: 6153626 - DNA, 17 bp, Homo sapiens
ctggcctcatctcagac

SEQ ID NO: 6153627 - DNA, 18 bp, Homo sapiens
ctggcctcatctcagacc

SEQ ID NO: 6153628 - DNA, 19 bp, Homo sapiens
ctggcctccagcctttgct

SEQ ID NO: 6153629 - DNA, 14 bp, Homo sapiens
ctggcctccagctc

SEQ ID NO: 6153630 - DNA, 15 bp, Homo sapiens
ctggcctccagctcc

SEQ ID NO: 6153631 - DNA, 18 bp, Homo sapiens
ctggcctccagctcccac

SEQ ID NO: 6153632 - DNA, 15 bp, Homo sapiens
ctggcctccaggccc

SEQ ID NO: 6153633 - DNA, 22 bp, Homo sapiens
ctggcctcccaataaagctgga

SEQ ID NO: 6153634 - DNA, 17 bp, Homo sapiens
ctggcctcccacagact

SEQ ID NO: 6153635 - DNA, 19 bp, Homo sapiens
ctggcctcccacagactca

SEQ ID NO: 6153636 - DNA, 17 bp, Homo sapiens
ctggcctcccacccgat

SEQ ID NO: 6153637 - DNA, 21 bp, Homo sapiens
ctggcctcccccaacacctgc

SEQ ID NO: 6153638 - DNA, 14 bp, Homo sapiens
ctggcctcccccac

SEQ ID NO: 6153639 - DNA, 18 bp, Homo sapiens
ctggcctcccctgccacc

SEQ ID NO: 6153640 - DNA, 14 bp, Homo sapiens
ctggcctccctccg

SEQ ID NO: 6153641 - DNA, 21 bp, Homo sapiens
ctggcctccctccgtccctct

SEQ ID NO: 6153642 - DNA, 18 bp, Homo sapiens
ctggcctcccttctcctt

SEQ ID NO: 6153643 - DNA, 21 bp, Homo sapiens
ctggcctcccttctcctttct

SEQ ID NO: 6153644 - DNA, 13 bp, Homo sapiens
ctggcctcctgcc

SEQ ID NO: 6153645 - DNA, 14 bp, Homo sapiens
ctggcctcctgggg

SEQ ID NO: 6153646 - DNA, 21 bp, Homo sapiens
ctggcctcctgggggcccatt

SEQ ID NO: 6153647 - DNA, 15 bp, Homo sapiens
ctggcctccttcccc

SEQ ID NO: 6153648 - DNA, 17 bp, Homo sapiens
ctggcctcgcctggcct

SEQ ID NO: 6153649 - DNA, 18 bp, Homo sapiens
ctggcctcggggcagggc

SEQ ID NO: 6153650 - DNA, 14 bp, Homo sapiens
ctggcctctagaac

SEQ ID NO: 6153651 - DNA, 21 bp, Homo sapiens
ctggcctctagaacacccact

SEQ ID NO: 6153652 - DNA, 22 bp, Homo sapiens
ctggcctctagaacacccactg

SEQ ID NO: 6153653 - DNA, 20 bp, Homo sapiens
ctggcctctcactgcctccc

SEQ ID NO: 6153654 - DNA, 13 bp, Homo sapiens
ctggcctctgcac

SEQ ID NO: 6153655 - DNA, 14 bp, Homo sapiens
ctggcctctgcact

SEQ ID NO: 6153656 - DNA, 16 bp, Homo sapiens
ctggcctctgcactcc

SEQ ID NO: 6153657 - DNA, 15 bp, Homo sapiens
ctggcctctgccatc

SEQ ID NO: 6153658 - DNA, 12 bp, Homo sapiens
ctggcctctgcg

SEQ ID NO: 6153659 - DNA, 14 bp, Homo sapiens
ctggcctctgcttt

SEQ ID NO: 6153660 - DNA, 16 bp, Homo sapiens
ctggcctctggcctgg

SEQ ID NO: 6153661 - DNA, 17 bp, Homo sapiens
ctggcctctggcctggg

SEQ ID NO: 6153662 - DNA, 13 bp, Homo sapiens
ctggcctctgggc

SEQ ID NO: 6153663 - DNA, 14 bp, Homo sapiens
ctggcctctgtgat

SEQ ID NO: 6153664 - DNA, 24 bp, Homo sapiens
ctggcctctgtgattacatagatc

SEQ ID NO: 6153665 - DNA, 15 bp, Homo sapiens
ctggcctctgtgcca

SEQ ID NO: 6153666 - DNA, 16 bp, Homo sapiens
ctggcctctgtgcctt

SEQ ID NO: 6153667 - DNA, 22 bp, Homo sapiens
ctggcctcttcctccctccctg

SEQ ID NO: 6153668 - DNA, 17 bp, Homo sapiens
ctggcctcttctgggct

SEQ ID NO: 6153669 - DNA, 19 bp, Homo sapiens
ctggcctcttctgggctac

SEQ ID NO: 6153670 - DNA, 13 bp, Homo sapiens
ctggcctcttggc

SEQ ID NO: 6153671 - DNA, 17 bp, Homo sapiens
ctggcctgaactgagga

SEQ ID NO: 6153672 - DNA, 17 bp, Homo sapiens
ctggcctgactcccatg

SEQ ID NO: 6153673 - DNA, 13 bp, Homo sapiens
ctggcctgactgg

SEQ ID NO: 6153674 - DNA, 18 bp, Homo sapiens
ctggcctgacttggggga

SEQ ID NO: 6153675 - DNA, 12 bp, Homo sapiens
ctggcctgagag

SEQ ID NO: 6153676 - DNA, 15 bp, Homo sapiens
ctggcctgagagtca

SEQ ID NO: 6153677 - DNA, 20 bp, Homo sapiens
ctggcctgagagtcagctct

SEQ ID NO: 6153678 - DNA, 16 bp, Homo sapiens
ctggcctgagcgcagc

SEQ ID NO: 6153679 - DNA, 15 bp, Homo sapiens
ctggcctgaggaccc

SEQ ID NO: 6153680 - DNA, 15 bp, Homo sapiens
ctggcctgatcttgg

SEQ ID NO: 6153681 - DNA, 16 bp, Homo sapiens
ctggcctgccagtctg

SEQ ID NO: 6153682 - DNA, 20 bp, Homo sapiens
ctggcctgcccgtgccctgg

SEQ ID NO: 6153683 - DNA, 16 bp, Homo sapiens
ctggcctgcgcctgca

SEQ ID NO: 6153684 - DNA, 17 bp, Homo sapiens
ctggcctgctgggaacc

SEQ ID NO: 6153685 - DNA, 23 bp, Homo sapiens
ctggcctggaatttgggcagata

SEQ ID NO: 6153686 - DNA, 14 bp, Homo sapiens
ctggcctggaggct

SEQ ID NO: 6153687 - DNA, 14 bp, Homo sapiens
ctggcctggcacac

SEQ ID NO: 6153688 - DNA, 16 bp, Homo sapiens
ctggcctggcacacat

SEQ ID NO: 6153689 - DNA, 12 bp, Homo sapiens
ctggcctggcag

SEQ ID NO: 6153690 - DNA, 14 bp, Homo sapiens
ctggcctggcaggg

SEQ ID NO: 6153691 - DNA, 13 bp, Homo sapiens
ctggcctggccag

SEQ ID NO: 6153692 - DNA, 15 bp, Homo sapiens
ctggcctggccagtg

SEQ ID NO: 6153693 - DNA, 17 bp, Homo sapiens
ctggcctggcccccagc

SEQ ID NO: 6153694 - DNA, 13 bp, Homo sapiens
ctggcctggccct

SEQ ID NO: 6153695 - DNA, 15 bp, Homo sapiens
ctggcctggccctgc

SEQ ID NO: 6153696 - DNA, 19 bp, Homo sapiens
ctggcctggccctgccctg

SEQ ID NO: 6153697 - DNA, 13 bp, Homo sapiens
ctggcctggcctg

SEQ ID NO: 6153698 - DNA, 15 bp, Homo sapiens
ctggcctggcctggc

SEQ ID NO: 6153699 - DNA, 18 bp, Homo sapiens
ctggcctggcctggccct

SEQ ID NO: 6153700 - DNA, 12 bp, Homo sapiens
ctggcctggctc

SEQ ID NO: 6153701 - DNA, 14 bp, Homo sapiens
ctggcctgggaaaa

SEQ ID NO: 6153702 - DNA, 22 bp, Homo sapiens
ctggcctgggaaaagggcagga

SEQ ID NO: 6153703 - DNA, 23 bp, Homo sapiens
ctggcctgggaaaagggcaggag

SEQ ID NO: 6153704 - DNA, 13 bp, Homo sapiens
ctggcctgggcca

SEQ ID NO: 6153705 - DNA, 16 bp, Homo sapiens
ctggcctgggccacac

SEQ ID NO: 6153706 - DNA, 22 bp, Homo sapiens
ctggcctgggccacacctgagc

SEQ ID NO: 6153707 - DNA, 23 bp, Homo sapiens
ctggcctgggccacacctgagcg

SEQ ID NO: 6153708 - DNA, 20 bp, Homo sapiens
ctggcctgggtggggcaggg

SEQ ID NO: 6153709 - DNA, 16 bp, Homo sapiens
ctggcctggtccaggc

SEQ ID NO: 6153710 - DNA, 23 bp, Homo sapiens
ctctcagtgaaggtggggagaag

SEQ ID NO: 6153711 - DNA, 16 bp, Homo sapiens
ctctcagtgccttctc

SEQ ID NO: 6153712 - DNA, 18 bp, Homo sapiens
ctctcagttaaaatgtga

SEQ ID NO: 6153713 - DNA, 20 bp, Homo sapiens
ctctcagttattcagattga

SEQ ID NO: 6153714 - DNA, 17 bp, Homo sapiens
ctctcagttctctccct

SEQ ID NO: 6153715 - DNA, 21 bp, Homo sapiens
ctctcagttctctcccttcct

SEQ ID NO: 6153716 - DNA, 15 bp, Homo sapiens
ctctcagttgcagcc

SEQ ID NO: 6153717 - DNA, 19 bp, Homo sapiens
ctctcagttgcagccctgc

SEQ ID NO: 6153718 - DNA, 22 bp, Homo sapiens
ctctcagttgcagccctgctgc

SEQ ID NO: 6153719 - DNA, 12 bp, Homo sapiens
ctctcagttttt

SEQ ID NO: 6153720 - DNA, 23 bp, Homo sapiens
ctctcatagaacattgatctgtt

SEQ ID NO: 6153721 - DNA, 22 bp, Homo sapiens
ctctcatatatagacagctttg

SEQ ID NO: 6153722 - DNA, 19 bp, Homo sapiens
ctctcatatcactgaagga

SEQ ID NO: 6153723 - DNA, 15 bp, Homo sapiens
ctctcatcccccatt

SEQ ID NO: 6153724 - DNA, 19 bp, Homo sapiens
ctctcatccttttctccta

SEQ ID NO: 6153725 - DNA, 18 bp, Homo sapiens
ctctcatcgccagacaac

SEQ ID NO: 6153726 - DNA, 17 bp, Homo sapiens
ctctcatctcttagctc

SEQ ID NO: 6153727 - DNA, 14 bp, Homo sapiens
ctctcatctgaggc

SEQ ID NO: 6153728 - DNA, 16 bp, Homo sapiens
ctctcatctgatcact

SEQ ID NO: 6153729 - DNA, 14 bp, Homo sapiens
ctctcatcttgttc

SEQ ID NO: 6153730 - DNA, 13 bp, Homo sapiens
ctctcatgcgtgt

SEQ ID NO: 6153731 - DNA, 16 bp, Homo sapiens
ctctcatgctgcccct

SEQ ID NO: 6153732 - DNA, 19 bp, Homo sapiens
ctctcatgctgcccctgcc

SEQ ID NO: 6153733 - DNA, 22 bp, Homo sapiens
ctctcatgctgcccctgccttg

SEQ ID NO: 6153734 - DNA, 22 bp, Homo sapiens
ctctcatggtacctgctcatgg

SEQ ID NO: 6153735 - DNA, 23 bp, Homo sapiens
ctctcatggtgaaatctgctctg

SEQ ID NO: 6153736 - DNA, 18 bp, Homo sapiens
ctctcatgtccccttcct

SEQ ID NO: 6153737 - DNA, 16 bp, Homo sapiens
ctctcatgtccctcca

SEQ ID NO: 6153738 - DNA, 16 bp, Homo sapiens
ctctcattcccaggca

SEQ ID NO: 6153739 - DNA, 19 bp, Homo sapiens
ctctcattctttgaacatg

SEQ ID NO: 6153740 - DNA, 18 bp, Homo sapiens
ctctcatttagcctgtcc

SEQ ID NO: 6153741 - DNA, 19 bp, Homo sapiens
ctctccaaaggccctacca

SEQ ID NO: 6153742 - DNA, 21 bp, Homo sapiens
ctctccaaaggcggggtggcg

SEQ ID NO: 6153743 - DNA, 16 bp, Homo sapiens
ctctccaaaggggctg

SEQ ID NO: 6153744 - DNA, 19 bp, Homo sapiens
ctctccaaaggggctgctg

SEQ ID NO: 6153745 - DNA, 20 bp, Homo sapiens
ctctccaaaggggctgctgg

SEQ ID NO: 6153746 - DNA, 22 bp, Homo sapiens
ctctccaacatgaaggatcaaa

SEQ ID NO: 6153747 - DNA, 13 bp, Homo sapiens
ctctccaaccact

SEQ ID NO: 6153748 - DNA, 14 bp, Homo sapiens
ctctccaaccactg

SEQ ID NO: 6153749 - DNA, 20 bp, Homo sapiens
ctctccaaccactgtgccac

SEQ ID NO: 6153750 - DNA, 21 bp, Homo sapiens
ctctccaaccactgtgccact

SEQ ID NO: 6153751 - DNA, 16 bp, Homo sapiens
ctctccaacctggaca

SEQ ID NO: 6153752 - DNA, 14 bp, Homo sapiens
ctctccaagacagc

SEQ ID NO: 6153753 - DNA, 17 bp, Homo sapiens
ctctccaagacagcagc

SEQ ID NO: 6153754 - DNA, 23 bp, Homo sapiens
ctctccaagcactagccttccca

SEQ ID NO: 6153755 - DNA, 17 bp, Homo sapiens
ctctccaagcgcctggc

SEQ ID NO: 6153756 - DNA, 13 bp, Homo sapiens
ctctccaagggct

SEQ ID NO: 6153757 - DNA, 15 bp, Homo sapiens
ctctccaagggcttc

SEQ ID NO: 6153758 - DNA, 17 bp, Homo sapiens
ctctccaagggcttctg

SEQ ID NO: 6153759 - DNA, 22 bp, Homo sapiens
ctctccaagggcttctgcaccc

SEQ ID NO: 6153760 - DNA, 17 bp, Homo sapiens
ctctccaagtctcagtg

SEQ ID NO: 6153761 - DNA, 16 bp, Homo sapiens
ctctccaagtctctct

SEQ ID NO: 6153762 - DNA, 14 bp, Homo sapiens
ctctccaagtgcca

SEQ ID NO: 6153763 - DNA, 15 bp, Homo sapiens
ctctccaagtgccag

SEQ ID NO: 6153764 - DNA, 17 bp, Homo sapiens
ctctccaatgttctatt

SEQ ID NO: 6153765 - DNA, 15 bp, Homo sapiens
ctctccaattgtaaa

SEQ ID NO: 6153766 - DNA, 23 bp, Homo sapiens
ctctccacacccatgactgcccc

SEQ ID NO: 6153767 - DNA, 12 bp, Homo sapiens
ctctccacagga

SEQ ID NO: 6153768 - DNA, 13 bp, Homo sapiens
ctctccacagtgt

SEQ ID NO: 6153769 - DNA, 22 bp, Homo sapiens
ctctccaccagacgccttcctc

SEQ ID NO: 6153770 - DNA, 12 bp, Homo sapiens
ctctccacccag

SEQ ID NO: 6153771 - DNA, 17 bp, Homo sapiens
ctctccacccagaggtc

SEQ ID NO: 6153772 - DNA, 16 bp, Homo sapiens
ctctccaccctccggc

SEQ ID NO: 6153773 - DNA, 15 bp, Homo sapiens
ctctccaccctggct

SEQ ID NO: 6153774 - DNA, 16 bp, Homo sapiens
ctctccaccctggctg

SEQ ID NO: 6153775 - DNA, 19 bp, Homo sapiens
ctctccaccctggctggga

SEQ ID NO: 6153776 - DNA, 10 bp, Homo sapiens
ctctccacct

SEQ ID NO: 6153777 - DNA, 12 bp, Homo sapiens
ctctccacctca

SEQ ID NO: 6153778 - DNA, 14 bp, Homo sapiens
ctctccacctcact

SEQ ID NO: 6153779 - DNA, 14 bp, Homo sapiens
ctctccacctcagc

SEQ ID NO: 6153780 - DNA, 20 bp, Homo sapiens
ctctccacctcagccttgga

SEQ ID NO: 6153781 - DNA, 14 bp, Homo sapiens
ctctccaccttagt

SEQ ID NO: 6153782 - DNA, 20 bp, Homo sapiens
ctctccaccttagtacttta

SEQ ID NO: 6153783 - DNA, 17 bp, Homo sapiens
ctctccaccttccaaag

SEQ ID NO: 6153784 - DNA, 13 bp, Homo sapiens
ctctccacggtag

SEQ ID NO: 6153785 - DNA, 23 bp, Homo sapiens
ctctccacggtagcacttgacct

SEQ ID NO: 6153786 - DNA, 17 bp, Homo sapiens
ctctccacgtggttgcc

SEQ ID NO: 6153787 - DNA, 21 bp, Homo sapiens
ctctccactcatgtgactctt

SEQ ID NO: 6153788 - DNA, 12 bp, Homo sapiens
ctctccactgcc

SEQ ID NO: 6153789 - DNA, 13 bp, Homo sapiens
ctctccactgctg

SEQ ID NO: 6153790 - DNA, 22 bp, Homo sapiens
ctctccacttctggtcccctgt

SEQ ID NO: 6153791 - DNA, 17 bp, Homo sapiens
ctctccactttcagctg

SEQ ID NO: 6153792 - DNA, 19 bp, Homo sapiens
ctctccagaaacagctgct

SEQ ID NO: 6153793 - DNA, 21 bp, Homo sapiens
ctctccagaaacagctgcttc

SEQ ID NO: 6153794 - DNA, 13 bp, Homo sapiens
ctctccagaagcc

SEQ ID NO: 6153795 - DNA, 12 bp, Homo sapiens
ctctccagactg

SEQ ID NO: 6153796 - DNA, 13 bp, Homo sapiens
ctctccagagagc

SEQ ID NO: 6153797 - DNA, 11 bp, Homo sapiens
ctctccagagc

SEQ ID NO: 6153798 - DNA, 15 bp, Homo sapiens
ctctccagcatccca

SEQ ID NO: 6153799 - DNA, 16 bp, Homo sapiens
ctctccagcatcccag

SEQ ID NO: 6153800 - DNA, 19 bp, Homo sapiens
ctctccagcatcccagcct

SEQ ID NO: 6153801 - DNA, 20 bp, Homo sapiens
ctctccagcatcccagcctc

SEQ ID NO: 6153802 - DNA, 15 bp, Homo sapiens
ctctccagcccctgg

SEQ ID NO: 6153803 - DNA, 18 bp, Homo sapiens
ctctccagcccctggatg

SEQ ID NO: 6153804 - DNA, 14 bp, Homo sapiens
ctctccagccctat

SEQ ID NO: 6153805 - DNA, 11 bp, Homo sapiens
ctctccagcct

SEQ ID NO: 6153806 - DNA, 13 bp, Homo sapiens
ctctccagctata

SEQ ID NO: 6153807 - DNA, 14 bp, Homo sapiens
ctctccagctccaa

SEQ ID NO: 6153808 - DNA, 16 bp, Homo sapiens
ctctccagctgactaa

SEQ ID NO: 6153809 - DNA, 21 bp, Homo sapiens
ctctccagctttccctcccca

SEQ ID NO: 6153810 - DNA, 15 bp, Homo sapiens
ctctccaggagggct

SEQ ID NO: 6153811 - DNA, 17 bp, Homo sapiens
ctctccaggattgtcca

SEQ ID NO: 6153812 - DNA, 24 bp, Homo sapiens
ctctccaggattgtccacaaatgt

SEQ ID NO: 6153813 - DNA, 18 bp, Homo sapiens
ctctccaggcacccttct

SEQ ID NO: 6153814 - DNA, 18 bp, Homo sapiens
ctctccaggcaccgcctg

SEQ ID NO: 6153815 - DNA, 23 bp, Homo sapiens
ctctccaggcaggtctgaagctc

SEQ ID NO: 6153816 - DNA, 15 bp, Homo sapiens
ctctccaggccaggt

SEQ ID NO: 6153817 - DNA, 17 bp, Homo sapiens
ctctccaggccccacca

SEQ ID NO: 6153818 - DNA, 21 bp, Homo sapiens
ctctccaggctgtttcttttt

SEQ ID NO: 6153819 - DNA, 17 bp, Homo sapiens
ctctccaggtcagcctg

SEQ ID NO: 6153820 - DNA, 18 bp, Homo sapiens
ctctccaggtcagcctgg

SEQ ID NO: 6153821 - DNA, 21 bp, Homo sapiens
ctctccaggtcagcctggaag

SEQ ID NO: 6153822 - DNA, 16 bp, Homo sapiens
ctctccagtcttccac

SEQ ID NO: 6153823 - DNA, 20 bp, Homo sapiens
ctctccagtgtgtgtaacag

SEQ ID NO: 6153824 - DNA, 23 bp, Homo sapiens
ctctccagtttgcacctgtcccc

SEQ ID NO: 6153825 - DNA, 13 bp, Homo sapiens
ctctccataaccc

SEQ ID NO: 6153826 - DNA, 22 bp, Homo sapiens
ctctccatacctgcccctgcct

SEQ ID NO: 6153827 - DNA, 11 bp, Homo sapiens
ctctccatatc

SEQ ID NO: 6153828 - DNA, 20 bp, Homo sapiens
ctctccatatcccttcctct

SEQ ID NO: 6153829 - DNA, 20 bp, Homo sapiens
ctctccatccctctcctctg

SEQ ID NO: 6153830 - DNA, 21 bp, Homo sapiens
ctctccatccctctcctctgc

SEQ ID NO: 6153831 - DNA, 24 bp, Homo sapiens
ctctccatctattgatagtttcat

SEQ ID NO: 6153832 - DNA, 22 bp, Homo sapiens
ctctccatctcccaaggctgcc

SEQ ID NO: 6153833 - DNA, 12 bp, Homo sapiens
ctctccatgcaa

SEQ ID NO: 6153834 - DNA, 18 bp, Homo sapiens
ctctccatgcaagtgctg

SEQ ID NO: 6153835 - DNA, 13 bp, Homo sapiens
ctctccatgccca

SEQ ID NO: 6153836 - DNA, 15 bp, Homo sapiens
ctctccattctgctc

SEQ ID NO: 6153837 - DNA, 13 bp, Homo sapiens
ctctcccaactct

SEQ ID NO: 6153838 - DNA, 15 bp, Homo sapiens
ctctcccaactgctg

SEQ ID NO: 6153839 - DNA, 15 bp, Homo sapiens
ctctcccaagtccac

SEQ ID NO: 6153840 - DNA, 23 bp, Homo sapiens
ctctcccacagagtgctggactg

SEQ ID NO: 6153841 - DNA, 16 bp, Homo sapiens
ctctcccaccccctcc

SEQ ID NO: 6153842 - DNA, 17 bp, Homo sapiens
ctctcccaccctaaggg

SEQ ID NO: 6153843 - DNA, 13 bp, Homo sapiens
ctctcccacttcc

SEQ ID NO: 6153844 - DNA, 15 bp, Homo sapiens
ctctcccacttcctc

SEQ ID NO: 6153845 - DNA, 16 bp, Homo sapiens
ctctcccacttcctcc

SEQ ID NO: 6153846 - DNA, 22 bp, Homo sapiens
ctctcccagaggctcctggagc

SEQ ID NO: 6153847 - DNA, 14 bp, Homo sapiens
ctctcccagctctg

SEQ ID NO: 6153848 - DNA, 12 bp, Homo sapiens
ctctcccaggcc

SEQ ID NO: 6153849 - DNA, 14 bp, Homo sapiens
ctctcccaggcccg

SEQ ID NO: 6153850 - DNA, 22 bp, Homo sapiens
ctctcccagtctacccagagaa

SEQ ID NO: 6153851 - DNA, 13 bp, Homo sapiens
ctctcccagtgaa

SEQ ID NO: 6153852 - DNA, 22 bp, Homo sapiens
ctctcccagtgaactcctgcca

SEQ ID NO: 6153853 - DNA, 19 bp, Homo sapiens
ctctcccataccatcactg

SEQ ID NO: 6153854 - DNA, 20 bp, Homo sapiens
ctctcccatcacttccctac

SEQ ID NO: 6153855 - DNA, 12 bp, Homo sapiens
ctctcccatccc

SEQ ID NO: 6153856 - DNA, 16 bp, Homo sapiens
ctctcccatcctgggg

SEQ ID NO: 6153857 - DNA, 16 bp, Homo sapiens
ctctcccatggagccc

SEQ ID NO: 6153858 - DNA, 19 bp, Homo sapiens
ctctcccatggctttgtgc

SEQ ID NO: 6153859 - DNA, 18 bp, Homo sapiens
ctctccccaacccccatt

SEQ ID NO: 6153860 - DNA, 20 bp, Homo sapiens
ctctccccaatatcctcgct

SEQ ID NO: 6153861 - DNA, 21 bp, Homo sapiens
ctctccccaatatcctcgctc

SEQ ID NO: 6153862 - DNA, 17 bp, Homo sapiens
ctctccccacccctacc

SEQ ID NO: 6153863 - DNA, 19 bp, Homo sapiens
ctctccccacccctacccc

SEQ ID NO: 6153864 - DNA, 15 bp, Homo sapiens
ctctccccaccttct

SEQ ID NO: 6153865 - DNA, 15 bp, Homo sapiens
ctctccccagagcat

SEQ ID NO: 6153866 - DNA, 13 bp, Homo sapiens
ctctccccagcaa

SEQ ID NO: 6153867 - DNA, 13 bp, Homo sapiens
ctctccccagccc

SEQ ID NO: 6153868 - DNA, 16 bp, Homo sapiens
ctctccccagcccaga

SEQ ID NO: 6153869 - DNA, 19 bp, Homo sapiens
ctctccccagcccagagac

SEQ ID NO: 6153870 - DNA, 18 bp, Homo sapiens
ctctccccagccccctcc

SEQ ID NO: 6153871 - DNA, 13 bp, Homo sapiens
ctctccccagcct

SEQ ID NO: 6153872 - DNA, 17 bp, Homo sapiens
ctctccccagcctggca

SEQ ID NO: 6153873 - DNA, 24 bp, Homo sapiens
ctctccccagggaagcagcagcct

SEQ ID NO: 6153874 - DNA, 14 bp, Homo sapiens
ctctccccagtgcc

SEQ ID NO: 6153875 - DNA, 17 bp, Homo sapiens
ctctccccagtgcctgc

SEQ ID NO: 6153876 - DNA, 15 bp, Homo sapiens
ctctccccatgatgt

SEQ ID NO: 6153877 - DNA, 16 bp, Homo sapiens
ctctccccatgatgtt

SEQ ID NO: 6153878 - DNA, 17 bp, Homo sapiens
ctctcccccaaccccct

SEQ ID NO: 6153879 - DNA, 20 bp, Homo sapiens
ctctcccccaaggccactgc

SEQ ID NO: 6153880 - DNA, 16 bp, Homo sapiens
ctctcccccaccccct

SEQ ID NO: 6153881 - DNA, 19 bp, Homo sapiens
ctctccccccgcctgccac

SEQ ID NO: 6153882 - DNA, 17 bp, Homo sapiens
ctctccccctatttatt

SEQ ID NO: 6153883 - DNA, 19 bp, Homo sapiens
ctctccccctcctccaggg

SEQ ID NO: 6153884 - DNA, 16 bp, Homo sapiens
ctctccccctctgtct

SEQ ID NO: 6153885 - DNA, 14 bp, Homo sapiens
ctctccccctgcag

SEQ ID NO: 6153886 - DNA, 23 bp, Homo sapiens
ctctcccccttcagctcctgagt

SEQ ID NO: 6153887 - DNA, 14 bp, Homo sapiens
ctctccccctttca

SEQ ID NO: 6153888 - DNA, 23 bp, Homo sapiens
ctctccccgctcaggggcctgga

SEQ ID NO: 6153889 - DNA, 17 bp, Homo sapiens
ctctccccgctctggat

SEQ ID NO: 6153890 - DNA, 17 bp, Homo sapiens
ctggcctggtccctggt

SEQ ID NO: 6153891 - DNA, 12 bp, Homo sapiens
ctggcctgtggc

SEQ ID NO: 6153892 - DNA, 18 bp, Homo sapiens
ctggcctgtggcacagcc

SEQ ID NO: 6153893 - DNA, 19 bp, Homo sapiens
ctggcctgtggcacagccc

SEQ ID NO: 6153894 - DNA, 21 bp, Homo sapiens
ctggcctgtggcacagccctg

SEQ ID NO: 6153895 - DNA, 15 bp, Homo sapiens
ctggcctgtggcagg

SEQ ID NO: 6153896 - DNA, 16 bp, Homo sapiens
ctggcctgtggcaggc

SEQ ID NO: 6153897 - DNA, 19 bp, Homo sapiens
ctggcctgtggcaggccta

SEQ ID NO: 6153898 - DNA, 22 bp, Homo sapiens
ctggcctgtggcaggcctagga

SEQ ID NO: 6153899 - DNA, 17 bp, Homo sapiens
ctggccttaaaaggggc

SEQ ID NO: 6153900 - DNA, 21 bp, Homo sapiens
ctggccttaaagagggacagg

SEQ ID NO: 6153901 - DNA, 17 bp, Homo sapiens
ctggccttccacttggc

SEQ ID NO: 6153902 - DNA, 12 bp, Homo sapiens
ctggccttcctc

SEQ ID NO: 6153903 - DNA, 15 bp, Homo sapiens
ctggccttcctcgtt

SEQ ID NO: 6153904 - DNA, 19 bp, Homo sapiens
ctggccttctgaactccat

SEQ ID NO: 6153905 - DNA, 22 bp, Homo sapiens
ctggccttgcccgtcgtgtgct

SEQ ID NO: 6153906 - DNA, 23 bp, Homo sapiens
ctggccttgcccgtcgtgtgctg

SEQ ID NO: 6153907 - DNA, 13 bp, Homo sapiens
ctggccttgcctc

SEQ ID NO: 6153908 - DNA, 14 bp, Homo sapiens
ctggccttgcctcc

SEQ ID NO: 6153909 - DNA, 16 bp, Homo sapiens
ctggccttgggccctc

SEQ ID NO: 6153910 - DNA, 14 bp, Homo sapiens
ctggccttgtactt

SEQ ID NO: 6153911 - DNA, 15 bp, Homo sapiens
ctggccttgtcctca

SEQ ID NO: 6153912 - DNA, 19 bp, Homo sapiens
ctggccttgtcctcagcca

SEQ ID NO: 6153913 - DNA, 21 bp, Homo sapiens
ctggccttgtcctcagccagt

SEQ ID NO: 6153914 - DNA, 20 bp, Homo sapiens
ctggccttgtggtccaaata

SEQ ID NO: 6153915 - DNA, 20 bp, Homo sapiens
ctggccttgtgtcactggct

SEQ ID NO: 6153916 - DNA, 21 bp, Homo sapiens
ctggcctttcctagctagaga

SEQ ID NO: 6153917 - DNA, 14 bp, Homo sapiens
ctggcctttgtaag

SEQ ID NO: 6153918 - DNA, 19 bp, Homo sapiens
ctggcctttgtaagtgcag

SEQ ID NO: 6153919 - DNA, 21 bp, Homo sapiens
ctggcctttttcatttatcta

SEQ ID NO: 6153920 - DNA, 16 bp, Homo sapiens
ctggcgaagcctgagc

SEQ ID NO: 6153921 - DNA, 23 bp, Homo sapiens
ctggcgaagcctgagcaggcagg

SEQ ID NO: 6153922 - DNA, 13 bp, Homo sapiens
ctggcgacacact

SEQ ID NO: 6153923 - DNA, 22 bp, Homo sapiens
ctggcgacacgtagcagcttag

SEQ ID NO: 6153924 - DNA, 17 bp, Homo sapiens
ctggcgacactcagggc

SEQ ID NO: 6153925 - DNA, 19 bp, Homo sapiens
ctggcgacactcagggcag

SEQ ID NO: 6153926 - DNA, 21 bp, Homo sapiens
ctggcgacactcagggcagct

SEQ ID NO: 6153927 - DNA, 22 bp, Homo sapiens
ctggcgacactcagggcagctg

SEQ ID NO: 6153928 - DNA, 16 bp, Homo sapiens
ctggcgactgcagctg

SEQ ID NO: 6153929 - DNA, 14 bp, Homo sapiens
ctggcgagccctta

SEQ ID NO: 6153930 - DNA, 18 bp, Homo sapiens
ctggcgagcccttagcct

SEQ ID NO: 6153931 - DNA, 22 bp, Homo sapiens
ctggcgagtgaatgccagtgtg

SEQ ID NO: 6153932 - DNA, 15 bp, Homo sapiens
ctggcgagttctctt

SEQ ID NO: 6153933 - DNA, 13 bp, Homo sapiens
ctggcgatctccc

SEQ ID NO: 6153934 - DNA, 16 bp, Homo sapiens
ctggcgatctcccagg

SEQ ID NO: 6153935 - DNA, 20 bp, Homo sapiens
ctggcgatctcccagggctc

SEQ ID NO: 6153936 - DNA, 19 bp, Homo sapiens
ctggcgcaagagaacattt

SEQ ID NO: 6153937 - DNA, 14 bp, Homo sapiens
ctggcgcaggtggg

SEQ ID NO: 6153938 - DNA, 21 bp, Homo sapiens
ctggcgccaacaacttctcca

SEQ ID NO: 6153939 - DNA, 22 bp, Homo sapiens
ctggcgccaggggcaggcagct

SEQ ID NO: 6153940 - DNA, 16 bp, Homo sapiens
ctggcgcccctgcctg

SEQ ID NO: 6153941 - DNA, 12 bp, Homo sapiens
ctggcgcctctg

SEQ ID NO: 6153942 - DNA, 13 bp, Homo sapiens
ctggcgcctctgc

SEQ ID NO: 6153943 - DNA, 14 bp, Homo sapiens
ctggcgcctctgca

SEQ ID NO: 6153944 - DNA, 12 bp, Homo sapiens
ctggcgccttct

SEQ ID NO: 6153945 - DNA, 17 bp, Homo sapiens
ctggcgccttctcggag

SEQ ID NO: 6153946 - DNA, 15 bp, Homo sapiens
ctggcgctcagcagc

SEQ ID NO: 6153947 - DNA, 17 bp, Homo sapiens
ctggcggacgcagctgg

SEQ ID NO: 6153948 - DNA, 17 bp, Homo sapiens
ctggcggaggtctctgg

SEQ ID NO: 6153949 - DNA, 13 bp, Homo sapiens
ctggcggaggtgg

SEQ ID NO: 6153950 - DNA, 12 bp, Homo sapiens
ctggcggcaggg

SEQ ID NO: 6153951 - DNA, 13 bp, Homo sapiens
ctggcggcagggg

SEQ ID NO: 6153952 - DNA, 22 bp, Homo sapiens
ctggcggcccttctgactgttt

SEQ ID NO: 6153953 - DNA, 14 bp, Homo sapiens
ctggcggcctgtgg

SEQ ID NO: 6153954 - DNA, 16 bp, Homo sapiens
ctggcggcctgtgggt

SEQ ID NO: 6153955 - DNA, 20 bp, Homo sapiens
ctggcggctactcagcagcc

SEQ ID NO: 6153956 - DNA, 23 bp, Homo sapiens
ctggcggctactcagcagccctc

SEQ ID NO: 6153957 - DNA, 18 bp, Homo sapiens
ctggcggctggggtccca

SEQ ID NO: 6153958 - DNA, 20 bp, Homo sapiens
ctggcggcttcctgtccact

SEQ ID NO: 6153959 - DNA, 14 bp, Homo sapiens
ctggcgggcagccc

SEQ ID NO: 6153960 - DNA, 18 bp, Homo sapiens
ctggcgggcctttttcct

SEQ ID NO: 6153961 - DNA, 21 bp, Homo sapiens
ctggcggggcaggaggcctgg

SEQ ID NO: 6153962 - DNA, 18 bp, Homo sapiens
ctggcggggtcccccctc

SEQ ID NO: 6153963 - DNA, 21 bp, Homo sapiens
ctggcggggtcccccctccat

SEQ ID NO: 6153964 - DNA, 22 bp, Homo sapiens
ctggcggggtctgctcctggga

SEQ ID NO: 6153965 - DNA, 17 bp, Homo sapiens
ctggcggggttggccct

SEQ ID NO: 6153966 - DNA, 15 bp, Homo sapiens
ctggcgggtggctgc

SEQ ID NO: 6153967 - DNA, 19 bp, Homo sapiens
ctggcgggtggctgcaagc

SEQ ID NO: 6153968 - DNA, 15 bp, Homo sapiens
ctggcgtagcaccca

SEQ ID NO: 6153969 - DNA, 14 bp, Homo sapiens
ctggcgtcacctgt

SEQ ID NO: 6153970 - DNA, 19 bp, Homo sapiens
ctggcgtcatgcaaagtca

SEQ ID NO: 6153971 - DNA, 16 bp, Homo sapiens
ctggcgtcggccagag

SEQ ID NO: 6153972 - DNA, 13 bp, Homo sapiens
ctggcgtctgtct

SEQ ID NO: 6153973 - DNA, 15 bp, Homo sapiens
ctggcgtctgtcttc

SEQ ID NO: 6153974 - DNA, 16 bp, Homo sapiens
ctggcgtgctcagacc

SEQ ID NO: 6153975 - DNA, 22 bp, Homo sapiens
ctggcgtgctcagacccaacag

SEQ ID NO: 6153976 - DNA, 19 bp, Homo sapiens
ctggcgtggattaaactta

SEQ ID NO: 6153977 - DNA, 13 bp, Homo sapiens
ctggcgtgtgggt

SEQ ID NO: 6153978 - DNA, 19 bp, Homo sapiens
ctggcgttctcaagaatct

SEQ ID NO: 6153979 - DNA, 20 bp, Homo sapiens
ctggctaaagataattgcta

SEQ ID NO: 6153980 - DNA, 13 bp, Homo sapiens
ctggctaaagctc

SEQ ID NO: 6153981 - DNA, 14 bp, Homo sapiens
ctggctaacaaggc

SEQ ID NO: 6153982 - DNA, 16 bp, Homo sapiens
ctggctaactggaagc

SEQ ID NO: 6153983 - DNA, 17 bp, Homo sapiens
ctggctaactggaagca

SEQ ID NO: 6153984 - DNA, 19 bp, Homo sapiens
ctggctaagcctctgcttc

SEQ ID NO: 6153985 - DNA, 23 bp, Homo sapiens
ctggctaatggagtgtttgaaaa

SEQ ID NO: 6153986 - DNA, 16 bp, Homo sapiens
ctggctacatcccagc

SEQ ID NO: 6153987 - DNA, 21 bp, Homo sapiens
ctggctaccttgtgggaataa

SEQ ID NO: 6153988 - DNA, 17 bp, Homo sapiens
ctggctacgacttggga

SEQ ID NO: 6153989 - DNA, 19 bp, Homo sapiens
ctggctactccctggacca

SEQ ID NO: 6153990 - DNA, 14 bp, Homo sapiens
ctggctagagccga

SEQ ID NO: 6153991 - DNA, 16 bp, Homo sapiens
ctggctagagccgagg

SEQ ID NO: 6153992 - DNA, 17 bp, Homo sapiens
ctggctagagccgaggg

SEQ ID NO: 6153993 - DNA, 21 bp, Homo sapiens
ctggctagagggcccaaagct

SEQ ID NO: 6153994 - DNA, 16 bp, Homo sapiens
ctggctagagtcctca

SEQ ID NO: 6153995 - DNA, 18 bp, Homo sapiens
ctggctagagtcctcact

SEQ ID NO: 6153996 - DNA, 20 bp, Homo sapiens
ctggctagagtcctcactcc

SEQ ID NO: 6153997 - DNA, 22 bp, Homo sapiens
ctggctagagtcctcactccca

SEQ ID NO: 6153998 - DNA, 18 bp, Homo sapiens
ctggctagcattcctcag

SEQ ID NO: 6153999 - DNA, 23 bp, Homo sapiens
ctggctatcaaagaataagaaaa

SEQ ID NO: 6154000 - DNA, 19 bp, Homo sapiens
ctggctatctactaccaga

SEQ ID NO: 6154001 - DNA, 23 bp, Homo sapiens
ctggctatctactaccagaaggg

SEQ ID NO: 6154002 - DNA, 15 bp, Homo sapiens
ctggctatgcatttg

SEQ ID NO: 6154003 - DNA, 21 bp, Homo sapiens
ctggctcaaagcagcaggact

SEQ ID NO: 6154004 - DNA, 14 bp, Homo sapiens
ctggctcacagcca

SEQ ID NO: 6154005 - DNA, 16 bp, Homo sapiens
ctggctcacagtacag

SEQ ID NO: 6154006 - DNA, 17 bp, Homo sapiens
ctggctcacagtacagc

SEQ ID NO: 6154007 - DNA, 13 bp, Homo sapiens
ctggctcacccag

SEQ ID NO: 6154008 - DNA, 13 bp, Homo sapiens
ctggctcacccct

SEQ ID NO: 6154009 - DNA, 23 bp, Homo sapiens
ctggctcacccctctcccccgcc

SEQ ID NO: 6154010 - DNA, 20 bp, Homo sapiens
ctggctcacgcgttctggga

SEQ ID NO: 6154011 - DNA, 17 bp, Homo sapiens
ctggctcactggcaggt

SEQ ID NO: 6154012 - DNA, 19 bp, Homo sapiens
ctggctcactggcaggtgt

SEQ ID NO: 6154013 - DNA, 16 bp, Homo sapiens
ctggctcagcccggga

SEQ ID NO: 6154014 - DNA, 18 bp, Homo sapiens
ctggctcagctgtggtcc

SEQ ID NO: 6154015 - DNA, 23 bp, Homo sapiens
ctggctcagctgtggtcccaccc

SEQ ID NO: 6154016 - DNA, 14 bp, Homo sapiens
ctggctcaggagga

SEQ ID NO: 6154017 - DNA, 22 bp, Homo sapiens
ctggctcagggatcttctccct

SEQ ID NO: 6154018 - DNA, 13 bp, Homo sapiens
ctggctcatctct

SEQ ID NO: 6154019 - DNA, 22 bp, Homo sapiens
ctggctcattctgcaccttgcc

SEQ ID NO: 6154020 - DNA, 22 bp, Homo sapiens
ctggctccaaggtgctctgtgt

SEQ ID NO: 6154021 - DNA, 23 bp, Homo sapiens
ctggctccaaggtgctctgtgtc

SEQ ID NO: 6154022 - DNA, 12 bp, Homo sapiens
ctggctccacac

SEQ ID NO: 6154023 - DNA, 17 bp, Homo sapiens
ctggctccaccgggagg

SEQ ID NO: 6154024 - DNA, 18 bp, Homo sapiens
ctggctccacgccctggg

SEQ ID NO: 6154025 - DNA, 22 bp, Homo sapiens
ctggctccacgccctggggagt

SEQ ID NO: 6154026 - DNA, 15 bp, Homo sapiens
ctggctccactcttg

SEQ ID NO: 6154027 - DNA, 17 bp, Homo sapiens
ctggctccagaggacct

SEQ ID NO: 6154028 - DNA, 20 bp, Homo sapiens
ctggctccagatgcagggca

SEQ ID NO: 6154029 - DNA, 11 bp, Homo sapiens
ctggctccagc

SEQ ID NO: 6154030 - DNA, 16 bp, Homo sapiens
ctggctccagcctgga

SEQ ID NO: 6154031 - DNA, 18 bp, Homo sapiens
ctggctccagctggccgg

SEQ ID NO: 6154032 - DNA, 22 bp, Homo sapiens
ctggctccaggctccaggctga

SEQ ID NO: 6154033 - DNA, 23 bp, Homo sapiens
ctggctccagtctcatcctccca

SEQ ID NO: 6154034 - DNA, 22 bp, Homo sapiens
ctggctccatgattctctgagt

SEQ ID NO: 6154035 - DNA, 23 bp, Homo sapiens
ctggctccatgattctctgagtg

SEQ ID NO: 6154036 - DNA, 18 bp, Homo sapiens
ctggctcccaagggaggc

SEQ ID NO: 6154037 - DNA, 19 bp, Homo sapiens
ctggctcccacaggccctt

SEQ ID NO: 6154038 - DNA, 22 bp, Homo sapiens
ctggctcccacaggcccttcct

SEQ ID NO: 6154039 - DNA, 16 bp, Homo sapiens
ctggctcccaggacac

SEQ ID NO: 6154040 - DNA, 14 bp, Homo sapiens
ctggctcccagggt

SEQ ID NO: 6154041 - DNA, 15 bp, Homo sapiens
ctggctcccagggtc

SEQ ID NO: 6154042 - DNA, 14 bp, Homo sapiens
ctggctccccaaag

SEQ ID NO: 6154043 - DNA, 13 bp, Homo sapiens
ctggctccccaag

SEQ ID NO: 6154044 - DNA, 15 bp, Homo sapiens
ctggctccccaaggc

SEQ ID NO: 6154045 - DNA, 18 bp, Homo sapiens
ctggctccccctccccag

SEQ ID NO: 6154046 - DNA, 19 bp, Homo sapiens
ctggctccccctccccagg

SEQ ID NO: 6154047 - DNA, 21 bp, Homo sapiens
ctggctccccctccccaggct

SEQ ID NO: 6154048 - DNA, 13 bp, Homo sapiens
ctggctccccgag

SEQ ID NO: 6154049 - DNA, 19 bp, Homo sapiens
ctggctcccctgcagccct

SEQ ID NO: 6154050 - DNA, 14 bp, Homo sapiens
ctggctcccctggg

SEQ ID NO: 6154051 - DNA, 16 bp, Homo sapiens
ctggctcccctggggt

SEQ ID NO: 6154052 - DNA, 12 bp, Homo sapiens
ctggctccctct

SEQ ID NO: 6154053 - DNA, 22 bp, Homo sapiens
ctggctccctcttggtcttccc

SEQ ID NO: 6154054 - DNA, 16 bp, Homo sapiens
ctggctccctgggcag

SEQ ID NO: 6154055 - DNA, 18 bp, Homo sapiens
ctggctcctaggggaaga

SEQ ID NO: 6154056 - DNA, 12 bp, Homo sapiens
ctggctcctcaa

SEQ ID NO: 6154057 - DNA, 15 bp, Homo sapiens
ctggctcctccagca

SEQ ID NO: 6154058 - DNA, 15 bp, Homo sapiens
ctggctcctcccagc

SEQ ID NO: 6154059 - DNA, 12 bp, Homo sapiens
ctggctcctccg

SEQ ID NO: 6154060 - DNA, 13 bp, Homo sapiens
ctggctcctcctg

SEQ ID NO: 6154061 - DNA, 15 bp, Homo sapiens
ctggctcctcctgga

SEQ ID NO: 6154062 - DNA, 15 bp, Homo sapiens
ctggctcctctgccc

SEQ ID NO: 6154063 - DNA, 24 bp, Homo sapiens
ctggctcctctgtggtgtctgcct

SEQ ID NO: 6154064 - DNA, 19 bp, Homo sapiens
ctggctcctgaagggtgct

SEQ ID NO: 6154065 - DNA, 14 bp, Homo sapiens
ctggctcctgaggg

SEQ ID NO: 6154066 - DNA, 21 bp, Homo sapiens
ctggctcctggggatggccag

SEQ ID NO: 6154067 - DNA, 14 bp, Homo sapiens
ctggctccttcacc

SEQ ID NO: 6154068 - DNA, 23 bp, Homo sapiens
ctctccccggacaagcccaggac

SEQ ID NO: 6154069 - DNA, 18 bp, Homo sapiens
ctctccccggcaggcctg

SEQ ID NO: 6154070 - DNA, 23 bp, Homo sapiens
ctctccccggtaatgtcactgtt

SEQ ID NO: 6154071 - DNA, 22 bp, Homo sapiens
ctctcccctcacatcctcctgc

SEQ ID NO: 6154072 - DNA, 21 bp, Homo sapiens
ctctcccctcagagtgcaagc

SEQ ID NO: 6154073 - DNA, 13 bp, Homo sapiens
ctctcccctccag

SEQ ID NO: 6154074 - DNA, 17 bp, Homo sapiens
ctctcccctccagcctt

SEQ ID NO: 6154075 - DNA, 20 bp, Homo sapiens
ctctcccctccccatctgtg

SEQ ID NO: 6154076 - DNA, 21 bp, Homo sapiens
ctctcccctccccatctgtgt

SEQ ID NO: 6154077 - DNA, 17 bp, Homo sapiens
ctctcccctccctcttc

SEQ ID NO: 6154078 - DNA, 15 bp, Homo sapiens
ctctcccctcccttg

SEQ ID NO: 6154079 - DNA, 15 bp, Homo sapiens
ctctcccctcctctg

SEQ ID NO: 6154080 - DNA, 13 bp, Homo sapiens
ctctcccctcctg

SEQ ID NO: 6154081 - DNA, 18 bp, Homo sapiens
ctctcccctcctgctggg

SEQ ID NO: 6154082 - DNA, 15 bp, Homo sapiens
ctctcccctctctgc

SEQ ID NO: 6154083 - DNA, 17 bp, Homo sapiens
ctctcccctctctgctc

SEQ ID NO: 6154084 - DNA, 12 bp, Homo sapiens
ctctcccctctg

SEQ ID NO: 6154085 - DNA, 16 bp, Homo sapiens
ctctcccctctgcaac

SEQ ID NO: 6154086 - DNA, 17 bp, Homo sapiens
ctctcccctctgccctg

SEQ ID NO: 6154087 - DNA, 20 bp, Homo sapiens
ctctcccctcttatgtacct

SEQ ID NO: 6154088 - DNA, 19 bp, Homo sapiens
ctctcccctgccccctgca

SEQ ID NO: 6154089 - DNA, 14 bp, Homo sapiens
ctctcccctgcctg

SEQ ID NO: 6154090 - DNA, 16 bp, Homo sapiens
ctctcccctgcctgcc

SEQ ID NO: 6154091 - DNA, 17 bp, Homo sapiens
ctctcccctgcgcaggc

SEQ ID NO: 6154092 - DNA, 21 bp, Homo sapiens
ctctcccctggaactgtctct

SEQ ID NO: 6154093 - DNA, 13 bp, Homo sapiens
ctctcccctttct

SEQ ID NO: 6154094 - DNA, 19 bp, Homo sapiens
ctctcccggctgcctgccg

SEQ ID NO: 6154095 - DNA, 19 bp, Homo sapiens
ctctcccggttcttccagt

SEQ ID NO: 6154096 - DNA, 18 bp, Homo sapiens
ctctcccgtctcgcctgc

SEQ ID NO: 6154097 - DNA, 21 bp, Homo sapiens
ctctccctaccctcttctcag

SEQ ID NO: 6154098 - DNA, 22 bp, Homo sapiens
ctctccctaccctcttctcagc

SEQ ID NO: 6154099 - DNA, 14 bp, Homo sapiens
ctctccctacctcc

SEQ ID NO: 6154100 - DNA, 23 bp, Homo sapiens
ctctccctacctccctcctcagg

SEQ ID NO: 6154101 - DNA, 14 bp, Homo sapiens
ctctccctaccttg

SEQ ID NO: 6154102 - DNA, 20 bp, Homo sapiens
ctctccctaccttgcctcct

SEQ ID NO: 6154103 - DNA, 12 bp, Homo sapiens
ctctccctccac

SEQ ID NO: 6154104 - DNA, 14 bp, Homo sapiens
ctctccctccactc

SEQ ID NO: 6154105 - DNA, 15 bp, Homo sapiens
ctctccctccactcc

SEQ ID NO: 6154106 - DNA, 21 bp, Homo sapiens
ctctccctcccccagagcccc

SEQ ID NO: 6154107 - DNA, 13 bp, Homo sapiens
ctctccctcccct

SEQ ID NO: 6154108 - DNA, 23 bp, Homo sapiens
ctctccctccctctctcatgaga

SEQ ID NO: 6154109 - DNA, 13 bp, Homo sapiens
ctctccctcctgg

SEQ ID NO: 6154110 - DNA, 18 bp, Homo sapiens
ctctccctcctggccaga

SEQ ID NO: 6154111 - DNA, 16 bp, Homo sapiens
ctctccctcctggtga

SEQ ID NO: 6154112 - DNA, 10 bp, Homo sapiens
ctctccctct

SEQ ID NO: 6154113 - DNA, 13 bp, Homo sapiens
ctctccctctggc

SEQ ID NO: 6154114 - DNA, 19 bp, Homo sapiens
ctctccctctggccctgcc

SEQ ID NO: 6154115 - DNA, 15 bp, Homo sapiens
ctctccctctggtcc

SEQ ID NO: 6154116 - DNA, 14 bp, Homo sapiens
ctctccctctgtct

SEQ ID NO: 6154117 - DNA, 15 bp, Homo sapiens
ctctccctctttcta

SEQ ID NO: 6154118 - DNA, 14 bp, Homo sapiens
ctctccctgaccct

SEQ ID NO: 6154119 - DNA, 18 bp, Homo sapiens
ctctccctgacggctgcc

SEQ ID NO: 6154120 - DNA, 13 bp, Homo sapiens
ctctccctgcacg

SEQ ID NO: 6154121 - DNA, 22 bp, Homo sapiens
ctctccctgcactccctcctgg

SEQ ID NO: 6154122 - DNA, 15 bp, Homo sapiens
ctctccctgccaagt

SEQ ID NO: 6154123 - DNA, 21 bp, Homo sapiens
ctctccctgccaagtctcaga

SEQ ID NO: 6154124 - DNA, 16 bp, Homo sapiens
ctctccctgccagagg

SEQ ID NO: 6154125 - DNA, 13 bp, Homo sapiens
ctctccctgcctg

SEQ ID NO: 6154126 - DNA, 14 bp, Homo sapiens
ctctccctgcctgt

SEQ ID NO: 6154127 - DNA, 16 bp, Homo sapiens
ctctccctgcctgtgg

SEQ ID NO: 6154128 - DNA, 16 bp, Homo sapiens
ctctccctgctgctcc

SEQ ID NO: 6154129 - DNA, 13 bp, Homo sapiens
ctctccctggccc

SEQ ID NO: 6154130 - DNA, 14 bp, Homo sapiens
ctctccctggtctc

SEQ ID NO: 6154131 - DNA, 23 bp, Homo sapiens
ctctccctgtcacacactggacc

SEQ ID NO: 6154132 - DNA, 22 bp, Homo sapiens
ctctcccttacccatcttgctt

SEQ ID NO: 6154133 - DNA, 15 bp, Homo sapiens
ctctcccttcccttc

SEQ ID NO: 6154134 - DNA, 16 bp, Homo sapiens
ctctcccttgggctct

SEQ ID NO: 6154135 - DNA, 17 bp, Homo sapiens
ctctcccttgggctctg

SEQ ID NO: 6154136 - DNA, 21 bp, Homo sapiens
ctctcccttgggctctgatga

SEQ ID NO: 6154137 - DNA, 23 bp, Homo sapiens
ctctcccttgggctctgatgaaa

SEQ ID NO: 6154138 - DNA, 22 bp, Homo sapiens
ctctcccttgtttactctgtta

SEQ ID NO: 6154139 - DNA, 17 bp, Homo sapiens
ctctccgaaagaagaca

SEQ ID NO: 6154140 - DNA, 21 bp, Homo sapiens
ctctccgaccagacaccttga

SEQ ID NO: 6154141 - DNA, 17 bp, Homo sapiens
ctctccgactctgcacc

SEQ ID NO: 6154142 - DNA, 20 bp, Homo sapiens
ctctccgactctgcacccgc

SEQ ID NO: 6154143 - DNA, 17 bp, Homo sapiens
ctctccgagctctggtg

SEQ ID NO: 6154144 - DNA, 19 bp, Homo sapiens
ctctccgagctctggtgct

SEQ ID NO: 6154145 - DNA, 20 bp, Homo sapiens
ctctccgagctctggtgctt

SEQ ID NO: 6154146 - DNA, 20 bp, Homo sapiens
ctctccgcacacctctggct

SEQ ID NO: 6154147 - DNA, 21 bp, Homo sapiens
ctctccgcccacgcggctgct

SEQ ID NO: 6154148 - DNA, 20 bp, Homo sapiens
ctctccgcgggtgggactct

SEQ ID NO: 6154149 - DNA, 14 bp, Homo sapiens
ctctccggcctggc

SEQ ID NO: 6154150 - DNA, 18 bp, Homo sapiens
ctctccggcctggccttt

SEQ ID NO: 6154151 - DNA, 13 bp, Homo sapiens
ctctccgtgcagg

SEQ ID NO: 6154152 - DNA, 21 bp, Homo sapiens
ctctcctagagacagaagcag

SEQ ID NO: 6154153 - DNA, 13 bp, Homo sapiens
ctctcctagagct

SEQ ID NO: 6154154 - DNA, 14 bp, Homo sapiens
ctctcctagcccct

SEQ ID NO: 6154155 - DNA, 13 bp, Homo sapiens
ctctcctagccct

SEQ ID NO: 6154156 - DNA, 18 bp, Homo sapiens
ctctcctagccctcctga

SEQ ID NO: 6154157 - DNA, 22 bp, Homo sapiens
ctctcctaggcattctggacct

SEQ ID NO: 6154158 - DNA, 20 bp, Homo sapiens
ctctcctcaatgctgggccc

SEQ ID NO: 6154159 - DNA, 15 bp, Homo sapiens
ctctcctcagactgc

SEQ ID NO: 6154160 - DNA, 18 bp, Homo sapiens
ctctcctcatctccaagg

SEQ ID NO: 6154161 - DNA, 15 bp, Homo sapiens
ctctcctccagagtc

SEQ ID NO: 6154162 - DNA, 16 bp, Homo sapiens
ctctcctccagagtca

SEQ ID NO: 6154163 - DNA, 11 bp, Homo sapiens
ctctcctccca

SEQ ID NO: 6154164 - DNA, 13 bp, Homo sapiens
ctctcctcccagc

SEQ ID NO: 6154165 - DNA, 15 bp, Homo sapiens
ctctcctcccagctg

SEQ ID NO: 6154166 - DNA, 16 bp, Homo sapiens
ctctcctcccagctgc

SEQ ID NO: 6154167 - DNA, 13 bp, Homo sapiens
ctctcctccccta

SEQ ID NO: 6154168 - DNA, 15 bp, Homo sapiens
ctctcctccccttcc

SEQ ID NO: 6154169 - DNA, 16 bp, Homo sapiens
ctctcctccccttcct

SEQ ID NO: 6154170 - DNA, 18 bp, Homo sapiens
ctctcctcccgccccgcc

SEQ ID NO: 6154171 - DNA, 20 bp, Homo sapiens
ctctcctcccgccccgcccc

SEQ ID NO: 6154172 - DNA, 15 bp, Homo sapiens
ctctcctcctcagct

SEQ ID NO: 6154173 - DNA, 20 bp, Homo sapiens
ctctcctcctctgtgctcct

SEQ ID NO: 6154174 - DNA, 23 bp, Homo sapiens
ctctcctcctctgtgctcctgtc

SEQ ID NO: 6154175 - DNA, 20 bp, Homo sapiens
ctctcctcgggccctgtggt

SEQ ID NO: 6154176 - DNA, 13 bp, Homo sapiens
ctctcctcggtgg

SEQ ID NO: 6154177 - DNA, 18 bp, Homo sapiens
ctctcctcggtggcattt

SEQ ID NO: 6154178 - DNA, 23 bp, Homo sapiens
ctctcctcggtggcatttgctga

SEQ ID NO: 6154179 - DNA, 20 bp, Homo sapiens
ctctcctcgtccggcctgca

SEQ ID NO: 6154180 - DNA, 13 bp, Homo sapiens
ctctcctctccgc

SEQ ID NO: 6154181 - DNA, 15 bp, Homo sapiens
ctctcctctctctcc

SEQ ID NO: 6154182 - DNA, 20 bp, Homo sapiens
ctctcctctctctccctcca

SEQ ID NO: 6154183 - DNA, 21 bp, Homo sapiens
ctctcctctctctccctccac

SEQ ID NO: 6154184 - DNA, 12 bp, Homo sapiens
ctctcctctctg

SEQ ID NO: 6154185 - DNA, 15 bp, Homo sapiens
ctctcctctctgctt

SEQ ID NO: 6154186 - DNA, 13 bp, Homo sapiens
ctctcctctctgg

SEQ ID NO: 6154187 - DNA, 10 bp, Homo sapiens
ctctcctctg

SEQ ID NO: 6154188 - DNA, 11 bp, Homo sapiens
ctctcctctgc

SEQ ID NO: 6154189 - DNA, 12 bp, Homo sapiens
ctctcctctgct

SEQ ID NO: 6154190 - DNA, 13 bp, Homo sapiens
ctctcctctgctg

SEQ ID NO: 6154191 - DNA, 14 bp, Homo sapiens
ctctcctctgctgc

SEQ ID NO: 6154192 - DNA, 14 bp, Homo sapiens
ctctcctctgtccc

SEQ ID NO: 6154193 - DNA, 21 bp, Homo sapiens
ctctcctgacttttaatgtca

SEQ ID NO: 6154194 - DNA, 19 bp, Homo sapiens
ctctcctgagcctgtctct

SEQ ID NO: 6154195 - DNA, 16 bp, Homo sapiens
ctctcctgaggagcag

SEQ ID NO: 6154196 - DNA, 21 bp, Homo sapiens
ctctcctgatagtctttcagt

SEQ ID NO: 6154197 - DNA, 13 bp, Homo sapiens
ctctcctgcatcc

SEQ ID NO: 6154198 - DNA, 15 bp, Homo sapiens
ctctcctgccccttg

SEQ ID NO: 6154199 - DNA, 14 bp, Homo sapiens
ctctcctgccctct

SEQ ID NO: 6154200 - DNA, 15 bp, Homo sapiens
ctctcctgccctctg

SEQ ID NO: 6154201 - DNA, 13 bp, Homo sapiens
ctctcctgccctg

SEQ ID NO: 6154202 - DNA, 14 bp, Homo sapiens
ctctcctgccctgc

SEQ ID NO: 6154203 - DNA, 12 bp, Homo sapiens
ctctcctgccta

SEQ ID NO: 6154204 - DNA, 19 bp, Homo sapiens
ctctcctgcctacatccca

SEQ ID NO: 6154205 - DNA, 15 bp, Homo sapiens
ctctcctgcctcagc

SEQ ID NO: 6154206 - DNA, 16 bp, Homo sapiens
ctctcctgcctcagcc

SEQ ID NO: 6154207 - DNA, 22 bp, Homo sapiens
ctctcctgcgtgtgcccactga

SEQ ID NO: 6154208 - DNA, 18 bp, Homo sapiens
ctctcctgctcacccgcc

SEQ ID NO: 6154209 - DNA, 13 bp, Homo sapiens
ctctcctggacgc

SEQ ID NO: 6154210 - DNA, 21 bp, Homo sapiens
ctctcctggagcaagctctgc

SEQ ID NO: 6154211 - DNA, 23 bp, Homo sapiens
ctctcctggcctatccgctgcca

SEQ ID NO: 6154212 - DNA, 14 bp, Homo sapiens
ctctcctggctggg

SEQ ID NO: 6154213 - DNA, 16 bp, Homo sapiens
ctctcctggcttccca

SEQ ID NO: 6154214 - DNA, 15 bp, Homo sapiens
ctctcctgggcagct

SEQ ID NO: 6154215 - DNA, 19 bp, Homo sapiens
ctctcctgggcagctgcct

SEQ ID NO: 6154216 - DNA, 15 bp, Homo sapiens
ctctcctgggcccct

SEQ ID NO: 6154217 - DNA, 17 bp, Homo sapiens
ctctcctgggcccctcc

SEQ ID NO: 6154218 - DNA, 19 bp, Homo sapiens
ctctcctgggcccctccct

SEQ ID NO: 6154219 - DNA, 19 bp, Homo sapiens
ctctcctgggggtggcagg

SEQ ID NO: 6154220 - DNA, 10 bp, Homo sapiens
ctctcctggt

SEQ ID NO: 6154221 - DNA, 12 bp, Homo sapiens
ctctcctgtaag

SEQ ID NO: 6154222 - DNA, 15 bp, Homo sapiens
ctctcctgtacctct

SEQ ID NO: 6154223 - DNA, 14 bp, Homo sapiens
ctctcctgtagcca

SEQ ID NO: 6154224 - DNA, 22 bp, Homo sapiens
ctctcctgtataaccccacctt

SEQ ID NO: 6154225 - DNA, 12 bp, Homo sapiens
ctctcctgtcca

SEQ ID NO: 6154226 - DNA, 15 bp, Homo sapiens
ctctcctgtctccct

SEQ ID NO: 6154227 - DNA, 17 bp, Homo sapiens
ctctcctgtctccctcc

SEQ ID NO: 6154228 - DNA, 21 bp, Homo sapiens
ctctcctgtctgccctctggg

SEQ ID NO: 6154229 - DNA, 19 bp, Homo sapiens
ctctcctgtgagctcccca

SEQ ID NO: 6154230 - DNA, 15 bp, Homo sapiens
ctctcctgtttggaa

SEQ ID NO: 6154231 - DNA, 16 bp, Homo sapiens
ctctcctgtttggaac

SEQ ID NO: 6154232 - DNA, 18 bp, Homo sapiens
ctctccttaaatgcttct

SEQ ID NO: 6154233 - DNA, 12 bp, Homo sapiens
ctctccttccca

SEQ ID NO: 6154234 - DNA, 16 bp, Homo sapiens
ctctccttcccacaaa

SEQ ID NO: 6154235 - DNA, 13 bp, Homo sapiens
ctctccttcctct

SEQ ID NO: 6154236 - DNA, 16 bp, Homo sapiens
ctctccttcctcttgg

SEQ ID NO: 6154237 - DNA, 16 bp, Homo sapiens
ctctccttcgtgtctc

SEQ ID NO: 6154238 - DNA, 21 bp, Homo sapiens
ctctccttcgtgtctctccca

SEQ ID NO: 6154239 - DNA, 15 bp, Homo sapiens
ctctccttgccccag

SEQ ID NO: 6154240 - DNA, 19 bp, Homo sapiens
ctctccttgccccagtcct

SEQ ID NO: 6154241 - DNA, 21 bp, Homo sapiens
ctctccttgccccagtcctgg

SEQ ID NO: 6154242 - DNA, 18 bp, Homo sapiens
ctctccttgcccccagtg

SEQ ID NO: 6154243 - DNA, 21 bp, Homo sapiens
ctctccttgcccccagtgcct

SEQ ID NO: 6154244 - DNA, 15 bp, Homo sapiens
ctctccttgcccccc

SEQ ID NO: 6154245 - DNA, 17 bp, Homo sapiens
ctctccttgccctgggc

SEQ ID NO: 6154246 - DNA, 20 bp, Homo sapiens
ctctccttgctcctggcctt

SEQ ID NO: 6154247 - DNA, 12 bp, Homo sapiens
ctctccttggaa

SEQ ID NO: 6154248 - DNA, 16 bp, Homo sapiens
ctctccttgggctcct

SEQ ID NO: 6154249 - DNA, 19 bp, Homo sapiens
ctggctccttcaccacccc

SEQ ID NO: 6154250 - DNA, 17 bp, Homo sapiens
ctggctccttcagcagc

SEQ ID NO: 6154251 - DNA, 17 bp, Homo sapiens
ctggctccttgcagcag

SEQ ID NO: 6154252 - DNA, 22 bp, Homo sapiens
ctggctcctttacaaaagaaat

SEQ ID NO: 6154253 - DNA, 19 bp, Homo sapiens
ctggctcggacccacccca

SEQ ID NO: 6154254 - DNA, 20 bp, Homo sapiens
ctggctcggacccaccccaa

SEQ ID NO: 6154255 - DNA, 23 bp, Homo sapiens
ctggctcggacccaccccaactc

SEQ ID NO: 6154256 - DNA, 22 bp, Homo sapiens
ctggctctaattcacagtgctc

SEQ ID NO: 6154257 - DNA, 16 bp, Homo sapiens
ctggctctacacatat

SEQ ID NO: 6154258 - DNA, 17 bp, Homo sapiens
ctggctctaccctgtct

SEQ ID NO: 6154259 - DNA, 16 bp, Homo sapiens
ctggctctaccttcct

SEQ ID NO: 6154260 - DNA, 22 bp, Homo sapiens
ctggctctacgtttaggcaccc

SEQ ID NO: 6154261 - DNA, 20 bp, Homo sapiens
ctggctctaggacccccagt

SEQ ID NO: 6154262 - DNA, 14 bp, Homo sapiens
ctggctctcagagg

SEQ ID NO: 6154263 - DNA, 15 bp, Homo sapiens
ctggctctcagagga

SEQ ID NO: 6154264 - DNA, 17 bp, Homo sapiens
ctggctctcatggggtc

SEQ ID NO: 6154265 - DNA, 19 bp, Homo sapiens
ctggctctccaagtgccag

SEQ ID NO: 6154266 - DNA, 23 bp, Homo sapiens
ctggctctccaagtgccagaggt

SEQ ID NO: 6154267 - DNA, 20 bp, Homo sapiens
ctggctctcccatttcctga

SEQ ID NO: 6154268 - DNA, 22 bp, Homo sapiens
ctggctctgaatgtagccagcc

SEQ ID NO: 6154269 - DNA, 13 bp, Homo sapiens
ctggctctgagaa

SEQ ID NO: 6154270 - DNA, 16 bp, Homo sapiens
ctggctctgagaatca

SEQ ID NO: 6154271 - DNA, 21 bp, Homo sapiens
ctggctctgagcgcctccatc

SEQ ID NO: 6154272 - DNA, 13 bp, Homo sapiens
ctggctctgattc

SEQ ID NO: 6154273 - DNA, 24 bp, Homo sapiens
ctggctctgcaatgggcactggga

SEQ ID NO: 6154274 - DNA, 12 bp, Homo sapiens
ctggctctgccc

SEQ ID NO: 6154275 - DNA, 19 bp, Homo sapiens
ctggctctgcccctcaggg

SEQ ID NO: 6154276 - DNA, 14 bp, Homo sapiens
ctggctctgcctca

SEQ ID NO: 6154277 - DNA, 16 bp, Homo sapiens
ctggctctgcctcagg

SEQ ID NO: 6154278 - DNA, 14 bp, Homo sapiens
ctggctctggagcc

SEQ ID NO: 6154279 - DNA, 12 bp, Homo sapiens
ctggctctggga

SEQ ID NO: 6154280 - DNA, 13 bp, Homo sapiens
ctggctctgggac

SEQ ID NO: 6154281 - DNA, 14 bp, Homo sapiens
ctggctctgggccg

SEQ ID NO: 6154282 - DNA, 12 bp, Homo sapiens
ctggctctgtga

SEQ ID NO: 6154283 - DNA, 18 bp, Homo sapiens
ctggctctgtggaggggc

SEQ ID NO: 6154284 - DNA, 23 bp, Homo sapiens
ctggctctgtggcgagccatttg

SEQ ID NO: 6154285 - DNA, 15 bp, Homo sapiens
ctggctctgtggctt

SEQ ID NO: 6154286 - DNA, 18 bp, Homo sapiens
ctggctctgtggcttgct

SEQ ID NO: 6154287 - DNA, 23 bp, Homo sapiens
ctggctctgttcggcctttgggt

SEQ ID NO: 6154288 - DNA, 18 bp, Homo sapiens
ctggctcttccaggctgg

SEQ ID NO: 6154289 - DNA, 21 bp, Homo sapiens
ctggctcttccaggctgggag

SEQ ID NO: 6154290 - DNA, 13 bp, Homo sapiens
ctggctcttctct

SEQ ID NO: 6154291 - DNA, 16 bp, Homo sapiens
ctggctcttctgccca

SEQ ID NO: 6154292 - DNA, 20 bp, Homo sapiens
ctggctcttgatacccccct

SEQ ID NO: 6154293 - DNA, 22 bp, Homo sapiens
ctggctcttgatacccccctct

SEQ ID NO: 6154294 - DNA, 20 bp, Homo sapiens
ctggctcttgtgctggatgg

SEQ ID NO: 6154295 - DNA, 20 bp, Homo sapiens
ctggctctttcgtcaccctt

SEQ ID NO: 6154296 - DNA, 23 bp, Homo sapiens
ctggctctttcgtcacccttgga

SEQ ID NO: 6154297 - DNA, 15 bp, Homo sapiens
ctggctgaaaatcac

SEQ ID NO: 6154298 - DNA, 18 bp, Homo sapiens
ctggctgaaaatcactat

SEQ ID NO: 6154299 - DNA, 18 bp, Homo sapiens
ctggctgaacagtgctct

SEQ ID NO: 6154300 - DNA, 20 bp, Homo sapiens
ctggctgaacagtgctctgc

SEQ ID NO: 6154301 - DNA, 21 bp, Homo sapiens
ctggctgaacagtgctctgcc

SEQ ID NO: 6154302 - DNA, 20 bp, Homo sapiens
ctggctgaacttggagaggg

SEQ ID NO: 6154303 - DNA, 15 bp, Homo sapiens
ctggctgaagaatga

SEQ ID NO: 6154304 - DNA, 23 bp, Homo sapiens
ctggctgaagaggaccagaggag

SEQ ID NO: 6154305 - DNA, 24 bp, Homo sapiens
ctggctgaagaggaccagaggagc

SEQ ID NO: 6154306 - DNA, 12 bp, Homo sapiens
ctggctgaagga

SEQ ID NO: 6154307 - DNA, 13 bp, Homo sapiens
ctggctgaaggac

SEQ ID NO: 6154308 - DNA, 14 bp, Homo sapiens
ctggctgaaggact

SEQ ID NO: 6154309 - DNA, 17 bp, Homo sapiens
ctggctgaaggactgtg

SEQ ID NO: 6154310 - DNA, 16 bp, Homo sapiens
ctggctgacctgctgt

SEQ ID NO: 6154311 - DNA, 17 bp, Homo sapiens
ctggctgacctgggccc

SEQ ID NO: 6154312 - DNA, 23 bp, Homo sapiens
ctggctgacctgggcccacagag

SEQ ID NO: 6154313 - DNA, 20 bp, Homo sapiens
ctggctgagaatctgggggt

SEQ ID NO: 6154314 - DNA, 19 bp, Homo sapiens
ctggctgagcccctgggga

SEQ ID NO: 6154315 - DNA, 16 bp, Homo sapiens
ctggctgagcctggct

SEQ ID NO: 6154316 - DNA, 17 bp, Homo sapiens
ctggctgagcctggctg

SEQ ID NO: 6154317 - DNA, 12 bp, Homo sapiens
ctggctgaggct

SEQ ID NO: 6154318 - DNA, 15 bp, Homo sapiens
ctggctgaggcttgg

SEQ ID NO: 6154319 - DNA, 21 bp, Homo sapiens
ctggctgaggcttgggcccag

SEQ ID NO: 6154320 - DNA, 13 bp, Homo sapiens
ctggctgagggca

SEQ ID NO: 6154321 - DNA, 17 bp, Homo sapiens
ctggctgaggttcctct

SEQ ID NO: 6154322 - DNA, 20 bp, Homo sapiens
ctggctgaggttcctctgcc

SEQ ID NO: 6154323 - DNA, 21 bp, Homo sapiens
ctggctgagtgcgaccaccac

SEQ ID NO: 6154324 - DNA, 23 bp, Homo sapiens
ctggctgagtggaatgcagggaa

SEQ ID NO: 6154325 - DNA, 24 bp, Homo sapiens
ctggctgagtggaatgcagggaag

SEQ ID NO: 6154326 - DNA, 20 bp, Homo sapiens
ctggctgatgggtggacctg

SEQ ID NO: 6154327 - DNA, 23 bp, Homo sapiens
ctggctgcaagtggttaagaatg

SEQ ID NO: 6154328 - DNA, 13 bp, Homo sapiens
ctggctgcacagc

SEQ ID NO: 6154329 - DNA, 17 bp, Homo sapiens
ctggctgcacagcccaa

SEQ ID NO: 6154330 - DNA, 18 bp, Homo sapiens
ctggctgcacagcccaac

SEQ ID NO: 6154331 - DNA, 21 bp, Homo sapiens
ctggctgcacagcccaaccag

SEQ ID NO: 6154332 - DNA, 14 bp, Homo sapiens
ctggctgcactcaa

SEQ ID NO: 6154333 - DNA, 23 bp, Homo sapiens
ctggctgcagagcagtgggcctg

SEQ ID NO: 6154334 - DNA, 14 bp, Homo sapiens
ctggctgcagctgg

SEQ ID NO: 6154335 - DNA, 16 bp, Homo sapiens
ctggctgccagctatt

SEQ ID NO: 6154336 - DNA, 12 bp, Homo sapiens
ctggctgccagg

SEQ ID NO: 6154337 - DNA, 15 bp, Homo sapiens
ctggctgccaggcgt

SEQ ID NO: 6154338 - DNA, 12 bp, Homo sapiens
ctggctgcccag

SEQ ID NO: 6154339 - DNA, 12 bp, Homo sapiens
ctggctgcccct

SEQ ID NO: 6154340 - DNA, 13 bp, Homo sapiens
ctggctgccctgg

SEQ ID NO: 6154341 - DNA, 14 bp, Homo sapiens
ctggctgccctggc

SEQ ID NO: 6154342 - DNA, 16 bp, Homo sapiens
ctggctgcctccactc

SEQ ID NO: 6154343 - DNA, 18 bp, Homo sapiens
ctggctgcctccactccc

SEQ ID NO: 6154344 - DNA, 20 bp, Homo sapiens
ctggctgcctccactcccac

SEQ ID NO: 6154345 - DNA, 15 bp, Homo sapiens
ctggctgcctggccc

SEQ ID NO: 6154346 - DNA, 16 bp, Homo sapiens
ctggctgcctggccca

SEQ ID NO: 6154347 - DNA, 11 bp, Homo sapiens
ctggctgcctt

SEQ ID NO: 6154348 - DNA, 14 bp, Homo sapiens
ctggctgccttaga

SEQ ID NO: 6154349 - DNA, 19 bp, Homo sapiens
ctggctgccttagaacctt

SEQ ID NO: 6154350 - DNA, 18 bp, Homo sapiens
ctggctgcggggcgggca

SEQ ID NO: 6154351 - DNA, 15 bp, Homo sapiens
ctggctgctaggcca

SEQ ID NO: 6154352 - DNA, 18 bp, Homo sapiens
ctggctgctaggccagag

SEQ ID NO: 6154353 - DNA, 14 bp, Homo sapiens
ctggctgctccctg

SEQ ID NO: 6154354 - DNA, 17 bp, Homo sapiens
ctggctgctccctgctc

SEQ ID NO: 6154355 - DNA, 13 bp, Homo sapiens
ctggctgctgaca

SEQ ID NO: 6154356 - DNA, 16 bp, Homo sapiens
ctggctgctgacagga

SEQ ID NO: 6154357 - DNA, 21 bp, Homo sapiens
ctggctgctgatcgccttccc

SEQ ID NO: 6154358 - DNA, 19 bp, Homo sapiens
ctggctgctggcccacagc

SEQ ID NO: 6154359 - DNA, 14 bp, Homo sapiens
ctggctgcttgccc

SEQ ID NO: 6154360 - DNA, 14 bp, Homo sapiens
ctggctggaaagca

SEQ ID NO: 6154361 - DNA, 16 bp, Homo sapiens
ctggctggagaccgag

SEQ ID NO: 6154362 - DNA, 14 bp, Homo sapiens
ctggctggagagct

SEQ ID NO: 6154363 - DNA, 18 bp, Homo sapiens
ctggctggagagctgcta

SEQ ID NO: 6154364 - DNA, 15 bp, Homo sapiens
ctggctggagcctag

SEQ ID NO: 6154365 - DNA, 16 bp, Homo sapiens
ctggctggaggaagga

SEQ ID NO: 6154366 - DNA, 18 bp, Homo sapiens
ctggctggaggagcagca

SEQ ID NO: 6154367 - DNA, 20 bp, Homo sapiens
ctggctggaggagcagcagc

SEQ ID NO: 6154368 - DNA, 14 bp, Homo sapiens
ctggctggcaggtg

SEQ ID NO: 6154369 - DNA, 13 bp, Homo sapiens
ctggctggccagg

SEQ ID NO: 6154370 - DNA, 16 bp, Homo sapiens
ctggctggcctgagca

SEQ ID NO: 6154371 - DNA, 14 bp, Homo sapiens
ctggctggctgagg

SEQ ID NO: 6154372 - DNA, 17 bp, Homo sapiens
ctggctggctgagggca

SEQ ID NO: 6154373 - DNA, 15 bp, Homo sapiens
ctggctggctgcagt

SEQ ID NO: 6154374 - DNA, 16 bp, Homo sapiens
ctggctgggacgtggc

SEQ ID NO: 6154375 - DNA, 21 bp, Homo sapiens
ctggctgggagtccttacctc

SEQ ID NO: 6154376 - DNA, 22 bp, Homo sapiens
ctggctgggatcagagcaggag

SEQ ID NO: 6154377 - DNA, 12 bp, Homo sapiens
ctggctgggcca

SEQ ID NO: 6154378 - DNA, 16 bp, Homo sapiens
ctggctgggccatcct

SEQ ID NO: 6154379 - DNA, 19 bp, Homo sapiens
ctggctgggcccctgggga

SEQ ID NO: 6154380 - DNA, 22 bp, Homo sapiens
ctggctgggcccctggggacag

SEQ ID NO: 6154381 - DNA, 12 bp, Homo sapiens
ctggctgggcct

SEQ ID NO: 6154382 - DNA, 16 bp, Homo sapiens
ctggctgggcctgggc

SEQ ID NO: 6154383 - DNA, 16 bp, Homo sapiens
ctggctgggccttcac

SEQ ID NO: 6154384 - DNA, 12 bp, Homo sapiens
ctggctgggctc

SEQ ID NO: 6154385 - DNA, 16 bp, Homo sapiens
ctggctgggctctggt

SEQ ID NO: 6154386 - DNA, 19 bp, Homo sapiens
ctggctgggctctggtggg

SEQ ID NO: 6154387 - DNA, 17 bp, Homo sapiens
ctggctgggctggctga

SEQ ID NO: 6154388 - DNA, 20 bp, Homo sapiens
ctggctgggctggctgaaga

SEQ ID NO: 6154389 - DNA, 16 bp, Homo sapiens
ctggctgggctttggg

SEQ ID NO: 6154390 - DNA, 21 bp, Homo sapiens
ctggctgggctttggggctgg

SEQ ID NO: 6154391 - DNA, 20 bp, Homo sapiens
ctggctggggacttggccgc

SEQ ID NO: 6154392 - DNA, 14 bp, Homo sapiens
ctggctggggcaga

SEQ ID NO: 6154393 - DNA, 15 bp, Homo sapiens
ctggctggggcagag

SEQ ID NO: 6154394 - DNA, 13 bp, Homo sapiens
ctggctggggcct

SEQ ID NO: 6154395 - DNA, 18 bp, Homo sapiens
ctggctggggcctatcag

SEQ ID NO: 6154396 - DNA, 21 bp, Homo sapiens
ctggctggggtggcctgtgtg

SEQ ID NO: 6154397 - DNA, 21 bp, Homo sapiens
ctggctgggtcgcccctcctc

SEQ ID NO: 6154398 - DNA, 12 bp, Homo sapiens
ctggctgggtgg

SEQ ID NO: 6154399 - DNA, 18 bp, Homo sapiens
ctggctgggttttcaggg

SEQ ID NO: 6154400 - DNA, 17 bp, Homo sapiens
ctggctggtagagcagg

SEQ ID NO: 6154401 - DNA, 18 bp, Homo sapiens
ctggctggtagagcaggt

SEQ ID NO: 6154402 - DNA, 16 bp, Homo sapiens
ctggctggtcctccca

SEQ ID NO: 6154403 - DNA, 15 bp, Homo sapiens
ctggctggtgcctga

SEQ ID NO: 6154404 - DNA, 16 bp, Homo sapiens
ctggctggtgcctgag

SEQ ID NO: 6154405 - DNA, 23 bp, Homo sapiens
ctggctggtgggaaggccggcag

SEQ ID NO: 6154406 - DNA, 21 bp, Homo sapiens
ctggctggtgttaacagaagg

SEQ ID NO: 6154407 - DNA, 22 bp, Homo sapiens
ctggctggtgttaacagaaggg

SEQ ID NO: 6154408 - DNA, 21 bp, Homo sapiens
ctggctgtacctgttcctccc

SEQ ID NO: 6154409 - DNA, 18 bp, Homo sapiens
ctggctgtactgctcagg

SEQ ID NO: 6154410 - DNA, 21 bp, Homo sapiens
ctggctgtccaaccagacttt

SEQ ID NO: 6154411 - DNA, 20 bp, Homo sapiens
ctggctgtctgcctgtattt

SEQ ID NO: 6154412 - DNA, 21 bp, Homo sapiens
ctggctgtctgcctgtatttt

SEQ ID NO: 6154413 - DNA, 21 bp, Homo sapiens
ctggctgtctgtctgcagtgc

SEQ ID NO: 6154414 - DNA, 19 bp, Homo sapiens
ctggctgtgaatgccaaag

SEQ ID NO: 6154415 - DNA, 21 bp, Homo sapiens
ctggctgtgaatgccaaagcc

SEQ ID NO: 6154416 - DNA, 18 bp, Homo sapiens
ctggctgtgacacctggt

SEQ ID NO: 6154417 - DNA, 22 bp, Homo sapiens
ctggctgtgagacgaggcaggg

SEQ ID NO: 6154418 - DNA, 16 bp, Homo sapiens
ctggctgtgagcagcc

SEQ ID NO: 6154419 - DNA, 21 bp, Homo sapiens
ctggctgtgcacattctccct

SEQ ID NO: 6154420 - DNA, 16 bp, Homo sapiens
ctggctgtgcccagca

SEQ ID NO: 6154421 - DNA, 23 bp, Homo sapiens
ctggctgtgcccagcaggcccag

SEQ ID NO: 6154422 - DNA, 13 bp, Homo sapiens
ctggctgtgcccc

SEQ ID NO: 6154423 - DNA, 12 bp, Homo sapiens
ctggctgtgcct

SEQ ID NO: 6154424 - DNA, 14 bp, Homo sapiens
ctggctgtgcctgc

SEQ ID NO: 6154425 - DNA, 20 bp, Homo sapiens
ctggctgtgcctgcttctgt

SEQ ID NO: 6154426 - DNA, 19 bp, Homo sapiens
ctggctgtggaggcctgat

SEQ ID NO: 6154427 - DNA, 22 bp, Homo sapiens
ctctccttgggctcctggctgc

SEQ ID NO: 6154428 - DNA, 17 bp, Homo sapiens
ctctcctttctccctgc

SEQ ID NO: 6154429 - DNA, 21 bp, Homo sapiens
ctctcctttctccctgcagcc

SEQ ID NO: 6154430 - DNA, 23 bp, Homo sapiens
ctctcctttctccctgcagcctt

SEQ ID NO: 6154431 - DNA, 16 bp, Homo sapiens
ctctcctttctttttc

SEQ ID NO: 6154432 - DNA, 12 bp, Homo sapiens
ctctcctttgat

SEQ ID NO: 6154433 - DNA, 13 bp, Homo sapiens
ctctcctttgtag

SEQ ID NO: 6154434 - DNA, 13 bp, Homo sapiens
ctctcctttgtat

SEQ ID NO: 6154435 - DNA, 19 bp, Homo sapiens
ctctcctttgtgtggctgc

SEQ ID NO: 6154436 - DNA, 11 bp, Homo sapiens
ctctccttttc

SEQ ID NO: 6154437 - DNA, 20 bp, Homo sapiens
ctctccttttccttaccata

SEQ ID NO: 6154438 - DNA, 19 bp, Homo sapiens
ctctccttttcttttgtta

SEQ ID NO: 6154439 - DNA, 20 bp, Homo sapiens
ctctcctttttctcttcaca

SEQ ID NO: 6154440 - DNA, 18 bp, Homo sapiens
ctctcgaccggccctgca

SEQ ID NO: 6154441 - DNA, 14 bp, Homo sapiens
ctctcgaccttctg

SEQ ID NO: 6154442 - DNA, 23 bp, Homo sapiens
ctctcgagttctcctatcttctc

SEQ ID NO: 6154443 - DNA, 20 bp, Homo sapiens
ctctcgcaagagggtctctt

SEQ ID NO: 6154444 - DNA, 15 bp, Homo sapiens
ctctcgcacacctct

SEQ ID NO: 6154445 - DNA, 15 bp, Homo sapiens
ctctcgcatcttccc

SEQ ID NO: 6154446 - DNA, 16 bp, Homo sapiens
ctctcgcatcttccca

SEQ ID NO: 6154447 - DNA, 18 bp, Homo sapiens
ctctcgccccatccctgc

SEQ ID NO: 6154448 - DNA, 21 bp, Homo sapiens
ctctcgccccatccctgcttg

SEQ ID NO: 6154449 - DNA, 22 bp, Homo sapiens
ctctcgcctcaggctttttcca

SEQ ID NO: 6154450 - DNA, 15 bp, Homo sapiens
ctctcgctcccctct

SEQ ID NO: 6154451 - DNA, 14 bp, Homo sapiens
ctctcgctctctct

SEQ ID NO: 6154452 - DNA, 15 bp, Homo sapiens
ctctcgctgcgtcct

SEQ ID NO: 6154453 - DNA, 18 bp, Homo sapiens
ctctcgctgcgtcctcat

SEQ ID NO: 6154454 - DNA, 21 bp, Homo sapiens
ctctcgcttcctcagcctcca

SEQ ID NO: 6154455 - DNA, 12 bp, Homo sapiens
ctctcggaactg

SEQ ID NO: 6154456 - DNA, 23 bp, Homo sapiens
ctctcggaactgcatgctgctgg

SEQ ID NO: 6154457 - DNA, 18 bp, Homo sapiens
ctctcggaaggctggctg

SEQ ID NO: 6154458 - DNA, 14 bp, Homo sapiens
ctctcggagccctc

SEQ ID NO: 6154459 - DNA, 17 bp, Homo sapiens
ctctcggagccctcaga

SEQ ID NO: 6154460 - DNA, 15 bp, Homo sapiens
ctctcggcccctgtc

SEQ ID NO: 6154461 - DNA, 23 bp, Homo sapiens
ctctcggcccctgtctgttccca

SEQ ID NO: 6154462 - DNA, 16 bp, Homo sapiens
ctctcggctccccatg

SEQ ID NO: 6154463 - DNA, 15 bp, Homo sapiens
ctctcggctggaaga

SEQ ID NO: 6154464 - DNA, 19 bp, Homo sapiens
ctctcgggactagctgcct

SEQ ID NO: 6154465 - DNA, 21 bp, Homo sapiens
ctctcgggactagctgccttc

SEQ ID NO: 6154466 - DNA, 13 bp, Homo sapiens
ctctcgggagccc

SEQ ID NO: 6154467 - DNA, 16 bp, Homo sapiens
ctctcgggccccccac

SEQ ID NO: 6154468 - DNA, 20 bp, Homo sapiens
ctctcggggcgacccctcag

SEQ ID NO: 6154469 - DNA, 18 bp, Homo sapiens
ctctcgggtgccctgcat

SEQ ID NO: 6154470 - DNA, 14 bp, Homo sapiens
ctctcggtgctcca

SEQ ID NO: 6154471 - DNA, 20 bp, Homo sapiens
ctctcgtgatatgctgcttg

SEQ ID NO: 6154472 - DNA, 23 bp, Homo sapiens
ctctcgtgatatgctgcttgtga

SEQ ID NO: 6154473 - DNA, 13 bp, Homo sapiens
ctctcgttctcct

SEQ ID NO: 6154474 - DNA, 14 bp, Homo sapiens
ctctcgttctcctt

SEQ ID NO: 6154475 - DNA, 18 bp, Homo sapiens
ctctctaaaaataaaatg

SEQ ID NO: 6154476 - DNA, 18 bp, Homo sapiens
ctctctaacctcctttac

SEQ ID NO: 6154477 - DNA, 14 bp, Homo sapiens
ctctctaagaaaag

SEQ ID NO: 6154478 - DNA, 20 bp, Homo sapiens
ctctctaagacaaatgcagt

SEQ ID NO: 6154479 - DNA, 21 bp, Homo sapiens
ctctctaagccacagcttctt

SEQ ID NO: 6154480 - DNA, 20 bp, Homo sapiens
ctctctaatggcccctccat

SEQ ID NO: 6154481 - DNA, 13 bp, Homo sapiens
ctctctacagtgc

SEQ ID NO: 6154482 - DNA, 15 bp, Homo sapiens
ctctctaccagtcta

SEQ ID NO: 6154483 - DNA, 13 bp, Homo sapiens
ctctctacccagc

SEQ ID NO: 6154484 - DNA, 19 bp, Homo sapiens
ctctctacccagcccatct

SEQ ID NO: 6154485 - DNA, 14 bp, Homo sapiens
ctctctacctccac

SEQ ID NO: 6154486 - DNA, 16 bp, Homo sapiens
ctctctacctccaccc

SEQ ID NO: 6154487 - DNA, 17 bp, Homo sapiens
ctctctacctccaccct

SEQ ID NO: 6154488 - DNA, 15 bp, Homo sapiens
ctctctactcagatg

SEQ ID NO: 6154489 - DNA, 19 bp, Homo sapiens
ctctctactcctacctcag

SEQ ID NO: 6154490 - DNA, 22 bp, Homo sapiens
ctctctactcctacctcagcct

SEQ ID NO: 6154491 - DNA, 17 bp, Homo sapiens
ctctctactgctggact

SEQ ID NO: 6154492 - DNA, 14 bp, Homo sapiens
ctctctagaacctt

SEQ ID NO: 6154493 - DNA, 15 bp, Homo sapiens
ctctctagaatgagc

SEQ ID NO: 6154494 - DNA, 19 bp, Homo sapiens
ctctctagaatgagcaaga

SEQ ID NO: 6154495 - DNA, 15 bp, Homo sapiens
ctctctagctcccca

SEQ ID NO: 6154496 - DNA, 22 bp, Homo sapiens
ctctctaggagggagccttgtg

SEQ ID NO: 6154497 - DNA, 19 bp, Homo sapiens
ctctctaggcctctccagt

SEQ ID NO: 6154498 - DNA, 22 bp, Homo sapiens
ctctctataagtgttcagtgtt

SEQ ID NO: 6154499 - DNA, 22 bp, Homo sapiens
ctctctatatatacatgtatag

SEQ ID NO: 6154500 - DNA, 14 bp, Homo sapiens
ctctctatcctctc

SEQ ID NO: 6154501 - DNA, 21 bp, Homo sapiens
ctctctatgcaaaatgtctgt

SEQ ID NO: 6154502 - DNA, 18 bp, Homo sapiens
ctctctatggtaaagata

SEQ ID NO: 6154503 - DNA, 19 bp, Homo sapiens
ctctctattccctcagcct

SEQ ID NO: 6154504 - DNA, 20 bp, Homo sapiens
ctctctattccctcagccta

SEQ ID NO: 6154505 - DNA, 21 bp, Homo sapiens
ctctctattccctcagcctaa

SEQ ID NO: 6154506 - DNA, 20 bp, Homo sapiens
ctctctattctggaagagcg

SEQ ID NO: 6154507 - DNA, 20 bp, Homo sapiens
ctctctattgaccaccagtt

SEQ ID NO: 6154508 - DNA, 13 bp, Homo sapiens
ctctctattgtca

SEQ ID NO: 6154509 - DNA, 22 bp, Homo sapiens
ctctctatttccccctttcttc

SEQ ID NO: 6154510 - DNA, 14 bp, Homo sapiens
ctctctcacacaca

SEQ ID NO: 6154511 - DNA, 15 bp, Homo sapiens
ctctctcaccagcct

SEQ ID NO: 6154512 - DNA, 16 bp, Homo sapiens
ctctctcaccagcctt

SEQ ID NO: 6154513 - DNA, 16 bp, Homo sapiens
ctctctcacccaccag

SEQ ID NO: 6154514 - DNA, 13 bp, Homo sapiens
ctctctcacccag

SEQ ID NO: 6154515 - DNA, 15 bp, Homo sapiens
ctctctcacccagcc

SEQ ID NO: 6154516 - DNA, 14 bp, Homo sapiens
ctctctcactcctt

SEQ ID NO: 6154517 - DNA, 13 bp, Homo sapiens
ctctctcagagca

SEQ ID NO: 6154518 - DNA, 17 bp, Homo sapiens
ctctctcagagcatctg

SEQ ID NO: 6154519 - DNA, 20 bp, Homo sapiens
ctctctcagagcatctggct

SEQ ID NO: 6154520 - DNA, 23 bp, Homo sapiens
ctctctcagagcatctggctgtt

SEQ ID NO: 6154521 - DNA, 13 bp, Homo sapiens
ctctctcagcaca

SEQ ID NO: 6154522 - DNA, 14 bp, Homo sapiens
ctctctcagcacag

SEQ ID NO: 6154523 - DNA, 16 bp, Homo sapiens
ctctctcagcacagcc

SEQ ID NO: 6154524 - DNA, 21 bp, Homo sapiens
ctctctcagcccaggtctcct

SEQ ID NO: 6154525 - DNA, 14 bp, Homo sapiens
ctctctcagcccca

SEQ ID NO: 6154526 - DNA, 21 bp, Homo sapiens
ctctctcataccctccctccc

SEQ ID NO: 6154527 - DNA, 19 bp, Homo sapiens
ctctctcatatcactgaag

SEQ ID NO: 6154528 - DNA, 20 bp, Homo sapiens
ctctctcatatcactgaagg

SEQ ID NO: 6154529 - DNA, 14 bp, Homo sapiens
ctctctcatcttgt

SEQ ID NO: 6154530 - DNA, 11 bp, Homo sapiens
ctctctcatgt

SEQ ID NO: 6154531 - DNA, 18 bp, Homo sapiens
ctctctccacacggagct

SEQ ID NO: 6154532 - DNA, 12 bp, Homo sapiens
ctctctccaccc

SEQ ID NO: 6154533 - DNA, 13 bp, Homo sapiens
ctctctccacccc

SEQ ID NO: 6154534 - DNA, 16 bp, Homo sapiens
ctctctccacccccca

SEQ ID NO: 6154535 - DNA, 17 bp, Homo sapiens
ctctctccaccccccac

SEQ ID NO: 6154536 - DNA, 21 bp, Homo sapiens
ctctctccaccccccacgtct

SEQ ID NO: 6154537 - DNA, 14 bp, Homo sapiens
ctctctccacccta

SEQ ID NO: 6154538 - DNA, 15 bp, Homo sapiens
ctctctccactaccc

SEQ ID NO: 6154539 - DNA, 12 bp, Homo sapiens
ctctctccagga

SEQ ID NO: 6154540 - DNA, 14 bp, Homo sapiens
ctctctccaggagg

SEQ ID NO: 6154541 - DNA, 14 bp, Homo sapiens
ctctctccaggtca

SEQ ID NO: 6154542 - DNA, 17 bp, Homo sapiens
ctctctccagtcttcca

SEQ ID NO: 6154543 - DNA, 21 bp, Homo sapiens
ctctctccatcagaggacacc

SEQ ID NO: 6154544 - DNA, 15 bp, Homo sapiens
ctctctccatccctc

SEQ ID NO: 6154545 - DNA, 19 bp, Homo sapiens
ctctctccatttggaatta

SEQ ID NO: 6154546 - DNA, 12 bp, Homo sapiens
ctctctcccacc

SEQ ID NO: 6154547 - DNA, 12 bp, Homo sapiens
ctctctcccagt

SEQ ID NO: 6154548 - DNA, 14 bp, Homo sapiens
ctctctcccatgga

SEQ ID NO: 6154549 - DNA, 22 bp, Homo sapiens
ctctctcccctcaaagtctgca

SEQ ID NO: 6154550 - DNA, 21 bp, Homo sapiens
ctctctcccctctgcaacccc

SEQ ID NO: 6154551 - DNA, 15 bp, Homo sapiens
ctctctccctacctc

SEQ ID NO: 6154552 - DNA, 21 bp, Homo sapiens
ctctctccctacctccctcct

SEQ ID NO: 6154553 - DNA, 17 bp, Homo sapiens
ctctctccctccactcc

SEQ ID NO: 6154554 - DNA, 13 bp, Homo sapiens
ctctctccctctg

SEQ ID NO: 6154555 - DNA, 15 bp, Homo sapiens
ctctctccctctgtc

SEQ ID NO: 6154556 - DNA, 12 bp, Homo sapiens
ctctctccctgc

SEQ ID NO: 6154557 - DNA, 13 bp, Homo sapiens
ctctctccctgcc

SEQ ID NO: 6154558 - DNA, 13 bp, Homo sapiens
ctctctccctgtc

SEQ ID NO: 6154559 - DNA, 14 bp, Homo sapiens
ctctctccctgtca

SEQ ID NO: 6154560 - DNA, 12 bp, Homo sapiens
ctctctccgccc

SEQ ID NO: 6154561 - DNA, 16 bp, Homo sapiens
ctctctcctcaggacc

SEQ ID NO: 6154562 - DNA, 13 bp, Homo sapiens
ctctctcctccct

SEQ ID NO: 6154563 - DNA, 14 bp, Homo sapiens
ctctctcctcctgc

SEQ ID NO: 6154564 - DNA, 17 bp, Homo sapiens
ctctctcctcctgccca

SEQ ID NO: 6154565 - DNA, 16 bp, Homo sapiens
ctctctcctggactgg

SEQ ID NO: 6154566 - DNA, 13 bp, Homo sapiens
ctctctcctggag

SEQ ID NO: 6154567 - DNA, 14 bp, Homo sapiens
ctctctcctggagt

SEQ ID NO: 6154568 - DNA, 12 bp, Homo sapiens
ctctctcctggt

SEQ ID NO: 6154569 - DNA, 13 bp, Homo sapiens
ctctctcctggtg

SEQ ID NO: 6154570 - DNA, 14 bp, Homo sapiens
ctctctcctggtgt

SEQ ID NO: 6154571 - DNA, 19 bp, Homo sapiens
ctctctcctggtgtgggta

SEQ ID NO: 6154572 - DNA, 20 bp, Homo sapiens
ctctctcctgtactttttcc

SEQ ID NO: 6154573 - DNA, 22 bp, Homo sapiens
ctctctcctgtttcccttccct

SEQ ID NO: 6154574 - DNA, 21 bp, Homo sapiens
ctctctcgaccttctggtatc

SEQ ID NO: 6154575 - DNA, 23 bp, Homo sapiens
ctctctcggccccctcaccccag

SEQ ID NO: 6154576 - DNA, 14 bp, Homo sapiens
ctctctctatatat

SEQ ID NO: 6154577 - DNA, 9 bp, Homo sapiens
ctctctctc

SEQ ID NO: 6154578 - DNA, 14 bp, Homo sapiens
ctctctctcctcag

SEQ ID NO: 6154579 - DNA, 14 bp, Homo sapiens
ctctctctcgctgc

SEQ ID NO: 6154580 - DNA, 15 bp, Homo sapiens
ctctctctctcctca

SEQ ID NO: 6154581 - DNA, 13 bp, Homo sapiens
ctctctctctcgc

SEQ ID NO: 6154582 - DNA, 15 bp, Homo sapiens
ctctctctctcgctc

SEQ ID NO: 6154583 - DNA, 14 bp, Homo sapiens
ctctctctctctct

SEQ ID NO: 6154584 - DNA, 14 bp, Homo sapiens
ctctctctctgttc

SEQ ID NO: 6154585 - DNA, 13 bp, Homo sapiens
ctctctctctttg

SEQ ID NO: 6154586 - DNA, 14 bp, Homo sapiens
ctctctctcttttc

SEQ ID NO: 6154587 - DNA, 14 bp, Homo sapiens
ctctctctcttttt

SEQ ID NO: 6154588 - DNA, 15 bp, Homo sapiens
ctctctctctttttc

SEQ ID NO: 6154589 - DNA, 12 bp, Homo sapiens
ctctctctgagg

SEQ ID NO: 6154590 - DNA, 13 bp, Homo sapiens
ctctctctgcccc

SEQ ID NO: 6154591 - DNA, 14 bp, Homo sapiens
ctctctctgcctga

SEQ ID NO: 6154592 - DNA, 12 bp, Homo sapiens
ctctctctgctc

SEQ ID NO: 6154593 - DNA, 14 bp, Homo sapiens
ctctctctgctcca

SEQ ID NO: 6154594 - DNA, 12 bp, Homo sapiens
ctctctctgggt

SEQ ID NO: 6154595 - DNA, 14 bp, Homo sapiens
ctctctctgggtca

SEQ ID NO: 6154596 - DNA, 14 bp, Homo sapiens
ctctctctgtccct

SEQ ID NO: 6154597 - DNA, 13 bp, Homo sapiens
ctctctctgtgtc

SEQ ID NO: 6154598 - DNA, 14 bp, Homo sapiens
ctctctctgttcca

SEQ ID NO: 6154599 - DNA, 9 bp, Homo sapiens
ctctctctt

SEQ ID NO: 6154600 - DNA, 10 bp, Homo sapiens
ctctctcttt

SEQ ID NO: 6154601 - DNA, 14 bp, Homo sapiens
ctctctcttttcat

SEQ ID NO: 6154602 - DNA, 22 bp, Homo sapiens
ctctctcttttccctcctttcc

SEQ ID NO: 6154603 - DNA, 14 bp, Homo sapiens
ctctctcttttcct

SEQ ID NO: 6154604 - DNA, 14 bp, Homo sapiens
ctctctcttttcta

SEQ ID NO: 6154605 - DNA, 12 bp, Homo sapiens
ctctctgaacac

SEQ ID NO: 6154606 - DNA, 17 bp, Homo sapiens
ctctctgaacacacatt

SEQ ID NO: 6154607 - DNA, 12 bp, Homo sapiens
ctctctgacaaa

SEQ ID NO: 6154608 - DNA, 15 bp, Homo sapiens
ctctctgacatatgc

SEQ ID NO: 6154609 - DNA, 21 bp, Homo sapiens
ctctctgacgcttgtgacagt

SEQ ID NO: 6154610 - DNA, 16 bp, Homo sapiens
ctctctgagactcttt

SEQ ID NO: 6154611 - DNA, 20 bp, Homo sapiens
ctggctgtggaggcctgatg

SEQ ID NO: 6154612 - DNA, 22 bp, Homo sapiens
ctggctgtggaggcctgatgct

SEQ ID NO: 6154613 - DNA, 23 bp, Homo sapiens
ctggctgtggaggcctgatgctg

SEQ ID NO: 6154614 - DNA, 21 bp, Homo sapiens
ctggctgtggcccctccttct

SEQ ID NO: 6154615 - DNA, 18 bp, Homo sapiens
ctggctgtggcctaacct

SEQ ID NO: 6154616 - DNA, 12 bp, Homo sapiens
ctggctgtgggc

SEQ ID NO: 6154617 - DNA, 14 bp, Homo sapiens
ctggctgtgggctc

SEQ ID NO: 6154618 - DNA, 19 bp, Homo sapiens
ctggctgtgggctcccttc

SEQ ID NO: 6154619 - DNA, 21 bp, Homo sapiens
ctggctgtgggctcccttcct

SEQ ID NO: 6154620 - DNA, 15 bp, Homo sapiens
ctggctgtgtcctct

SEQ ID NO: 6154621 - DNA, 12 bp, Homo sapiens
ctggctgtgtgg

SEQ ID NO: 6154622 - DNA, 15 bp, Homo sapiens
ctggctgtgttgccc

SEQ ID NO: 6154623 - DNA, 14 bp, Homo sapiens
ctggctgttctgat

SEQ ID NO: 6154624 - DNA, 22 bp, Homo sapiens
ctggctgttggcccctctgctg

SEQ ID NO: 6154625 - DNA, 20 bp, Homo sapiens
ctggctgtttgatagcagaa

SEQ ID NO: 6154626 - DNA, 17 bp, Homo sapiens
ctggcttaaacaacacc

SEQ ID NO: 6154627 - DNA, 19 bp, Homo sapiens
ctggcttacctatctgtgg

SEQ ID NO: 6154628 - DNA, 13 bp, Homo sapiens
ctggcttatgctc

SEQ ID NO: 6154629 - DNA, 15 bp, Homo sapiens
ctggcttatgctcag

SEQ ID NO: 6154630 - DNA, 12 bp, Homo sapiens
ctggcttattta

SEQ ID NO: 6154631 - DNA, 21 bp, Homo sapiens
ctggcttcaccatcaatcctg

SEQ ID NO: 6154632 - DNA, 19 bp, Homo sapiens
ctggcttcaccgcattcca

SEQ ID NO: 6154633 - DNA, 21 bp, Homo sapiens
ctggcttcaccgcattccagg

SEQ ID NO: 6154634 - DNA, 22 bp, Homo sapiens
ctggcttcaccgcattccaggg

SEQ ID NO: 6154635 - DNA, 16 bp, Homo sapiens
ctggcttccaaggctc

SEQ ID NO: 6154636 - DNA, 17 bp, Homo sapiens
ctggcttccagcgggcc

SEQ ID NO: 6154637 - DNA, 18 bp, Homo sapiens
ctggcttccagcttcagg

SEQ ID NO: 6154638 - DNA, 20 bp, Homo sapiens
ctggcttccagcttcaggca

SEQ ID NO: 6154639 - DNA, 22 bp, Homo sapiens
ctggcttccagcttcaggcacc

SEQ ID NO: 6154640 - DNA, 14 bp, Homo sapiens
ctggcttccaggta

SEQ ID NO: 6154641 - DNA, 17 bp, Homo sapiens
ctggcttccatcagtgg

SEQ ID NO: 6154642 - DNA, 14 bp, Homo sapiens
ctggcttcccagga

SEQ ID NO: 6154643 - DNA, 16 bp, Homo sapiens
ctggcttcccaggacc

SEQ ID NO: 6154644 - DNA, 19 bp, Homo sapiens
ctggcttcccaggaccctg

SEQ ID NO: 6154645 - DNA, 20 bp, Homo sapiens
ctggcttcccatccccagcg

SEQ ID NO: 6154646 - DNA, 22 bp, Homo sapiens
ctggcttcccatccccagcgat

SEQ ID NO: 6154647 - DNA, 21 bp, Homo sapiens
ctggcttccccttcagacctt

SEQ ID NO: 6154648 - DNA, 23 bp, Homo sapiens
ctggcttccccttcagaccttgc

SEQ ID NO: 6154649 - DNA, 17 bp, Homo sapiens
ctggcttccctaaactg

SEQ ID NO: 6154650 - DNA, 19 bp, Homo sapiens
ctggcttccctaaactgca

SEQ ID NO: 6154651 - DNA, 20 bp, Homo sapiens
ctggcttccctaaactgcag

SEQ ID NO: 6154652 - DNA, 12 bp, Homo sapiens
ctggcttccctg

SEQ ID NO: 6154653 - DNA, 14 bp, Homo sapiens
ctggcttccctgcc

SEQ ID NO: 6154654 - DNA, 16 bp, Homo sapiens
ctggcttcctagccta

SEQ ID NO: 6154655 - DNA, 13 bp, Homo sapiens
ctggcttctagat

SEQ ID NO: 6154656 - DNA, 15 bp, Homo sapiens
ctggcttctctcttt

SEQ ID NO: 6154657 - DNA, 22 bp, Homo sapiens
ctggcttctctcttttcctcct

SEQ ID NO: 6154658 - DNA, 16 bp, Homo sapiens
ctggcttctgcttcat

SEQ ID NO: 6154659 - DNA, 18 bp, Homo sapiens
ctggcttctgcttgtcat

SEQ ID NO: 6154660 - DNA, 20 bp, Homo sapiens
ctggcttctggagcccttgg

SEQ ID NO: 6154661 - DNA, 13 bp, Homo sapiens
ctggcttctggcc

SEQ ID NO: 6154662 - DNA, 17 bp, Homo sapiens
ctggcttctggccagga

SEQ ID NO: 6154663 - DNA, 19 bp, Homo sapiens
ctggcttctggccaggaag

SEQ ID NO: 6154664 - DNA, 13 bp, Homo sapiens
ctggcttctgtgc

SEQ ID NO: 6154665 - DNA, 14 bp, Homo sapiens
ctggcttctgtgca

SEQ ID NO: 6154666 - DNA, 16 bp, Homo sapiens
ctggcttctgtggggc

SEQ ID NO: 6154667 - DNA, 21 bp, Homo sapiens
ctggcttgaaggactgcagac

SEQ ID NO: 6154668 - DNA, 22 bp, Homo sapiens
ctggcttgaaggactgcagaca

SEQ ID NO: 6154669 - DNA, 16 bp, Homo sapiens
ctggcttgagtgaatt

SEQ ID NO: 6154670 - DNA, 14 bp, Homo sapiens
ctggcttgccccag

SEQ ID NO: 6154671 - DNA, 17 bp, Homo sapiens
ctggcttgccccaggac

SEQ ID NO: 6154672 - DNA, 13 bp, Homo sapiens
ctggcttgctcca

SEQ ID NO: 6154673 - DNA, 17 bp, Homo sapiens
ctggcttgctccagggt

SEQ ID NO: 6154674 - DNA, 18 bp, Homo sapiens
ctggcttgctccagggtc

SEQ ID NO: 6154675 - DNA, 23 bp, Homo sapiens
ctggcttgctcccgccccagggt

SEQ ID NO: 6154676 - DNA, 15 bp, Homo sapiens
ctggcttgctgtggc

SEQ ID NO: 6154677 - DNA, 14 bp, Homo sapiens
ctggcttgcttgcc

SEQ ID NO: 6154678 - DNA, 14 bp, Homo sapiens
ctggcttggagtgg

SEQ ID NO: 6154679 - DNA, 23 bp, Homo sapiens
ctggcttggccacaacctgaaag

SEQ ID NO: 6154680 - DNA, 18 bp, Homo sapiens
ctggcttggccacagcca

SEQ ID NO: 6154681 - DNA, 19 bp, Homo sapiens
ctggcttgtcggagcaagt

SEQ ID NO: 6154682 - DNA, 17 bp, Homo sapiens
ctggcttgttgtaaagc

SEQ ID NO: 6154683 - DNA, 16 bp, Homo sapiens
ctggcttgtttgattt

SEQ ID NO: 6154684 - DNA, 22 bp, Homo sapiens
ctggctttcattttctctcagg

SEQ ID NO: 6154685 - DNA, 19 bp, Homo sapiens
ctggctttcccaggagatg

SEQ ID NO: 6154686 - DNA, 16 bp, Homo sapiens
ctggctttcctgctgg

SEQ ID NO: 6154687 - DNA, 15 bp, Homo sapiens
ctggctttctccgac

SEQ ID NO: 6154688 - DNA, 15 bp, Homo sapiens
ctggctttctctctg

SEQ ID NO: 6154689 - DNA, 20 bp, Homo sapiens
ctggctttgaaacctcaggg

SEQ ID NO: 6154690 - DNA, 14 bp, Homo sapiens
ctggctttgagaag

SEQ ID NO: 6154691 - DNA, 19 bp, Homo sapiens
ctggctttgcccaacctca

SEQ ID NO: 6154692 - DNA, 14 bp, Homo sapiens
ctggctttgcctct

SEQ ID NO: 6154693 - DNA, 16 bp, Homo sapiens
ctggctttgcctcttc

SEQ ID NO: 6154694 - DNA, 22 bp, Homo sapiens
ctggctttggaatgctccaggc

SEQ ID NO: 6154695 - DNA, 14 bp, Homo sapiens
ctggctttggcact

SEQ ID NO: 6154696 - DNA, 20 bp, Homo sapiens
ctggctttggcactctctgc

SEQ ID NO: 6154697 - DNA, 15 bp, Homo sapiens
ctggctttggcgccc

SEQ ID NO: 6154698 - DNA, 22 bp, Homo sapiens
ctggctttgggaaagcccagac

SEQ ID NO: 6154699 - DNA, 15 bp, Homo sapiens
ctggctttgtcccac

SEQ ID NO: 6154700 - DNA, 20 bp, Homo sapiens
ctggctttgtcccacagctt

SEQ ID NO: 6154701 - DNA, 16 bp, Homo sapiens
ctggctttgtctctag

SEQ ID NO: 6154702 - DNA, 18 bp, Homo sapiens
ctggctttgtctctagcc

SEQ ID NO: 6154703 - DNA, 14 bp, Homo sapiens
ctggcttttaagcc

SEQ ID NO: 6154704 - DNA, 22 bp, Homo sapiens
ctggcttttattaatgcacttt

SEQ ID NO: 6154705 - DNA, 18 bp, Homo sapiens
ctggcttttatttaaaga

SEQ ID NO: 6154706 - DNA, 16 bp, Homo sapiens
ctggcttttcacccca

SEQ ID NO: 6154707 - DNA, 15 bp, Homo sapiens
ctggcttttcactgc

SEQ ID NO: 6154708 - DNA, 19 bp, Homo sapiens
ctggcttttcactgctggc

SEQ ID NO: 6154709 - DNA, 20 bp, Homo sapiens
ctggcttttcactgctggct

SEQ ID NO: 6154710 - DNA, 12 bp, Homo sapiens
ctggcttttctg

SEQ ID NO: 6154711 - DNA, 22 bp, Homo sapiens
ctggcttttctggctggggatg

SEQ ID NO: 6154712 - DNA, 21 bp, Homo sapiens
ctggcttttgcctgtaagaaa

SEQ ID NO: 6154713 - DNA, 15 bp, Homo sapiens
ctggctttttaactc

SEQ ID NO: 6154714 - DNA, 21 bp, Homo sapiens
ctggctttttctgccactgag

SEQ ID NO: 6154715 - DNA, 22 bp, Homo sapiens
ctggctttttctgccactgagg

SEQ ID NO: 6154716 - DNA, 16 bp, Homo sapiens
ctgggaaaagggcagg

SEQ ID NO: 6154717 - DNA, 20 bp, Homo sapiens
ctgggaaaagggcaggagcc

SEQ ID NO: 6154718 - DNA, 23 bp, Homo sapiens
ctgggaaaagggcaggagcctag

SEQ ID NO: 6154719 - DNA, 9 bp, Homo sapiens
ctgggaaac

SEQ ID NO: 6154720 - DNA, 18 bp, Homo sapiens
ctgggaaacactccttgc

SEQ ID NO: 6154721 - DNA, 19 bp, Homo sapiens
ctgggaaacactccttgca

SEQ ID NO: 6154722 - DNA, 21 bp, Homo sapiens
ctgggaaaccccttctctgtg

SEQ ID NO: 6154723 - DNA, 18 bp, Homo sapiens
ctgggaaaccctctccat

SEQ ID NO: 6154724 - DNA, 17 bp, Homo sapiens
ctgggaaagcagagtgg

SEQ ID NO: 6154725 - DNA, 17 bp, Homo sapiens
ctgggaaagcataaagc

SEQ ID NO: 6154726 - DNA, 14 bp, Homo sapiens
ctgggaaaggaaaa

SEQ ID NO: 6154727 - DNA, 20 bp, Homo sapiens
ctgggaaaggacccacccat

SEQ ID NO: 6154728 - DNA, 20 bp, Homo sapiens
ctgggaaagggattttcagc

SEQ ID NO: 6154729 - DNA, 21 bp, Homo sapiens
ctgggaaaggggttgtcaaga

SEQ ID NO: 6154730 - DNA, 11 bp, Homo sapiens
ctgggaaaggt

SEQ ID NO: 6154731 - DNA, 13 bp, Homo sapiens
ctgggaaaggtgc

SEQ ID NO: 6154732 - DNA, 22 bp, Homo sapiens
ctgggaaaggtgctcaaagatg

SEQ ID NO: 6154733 - DNA, 16 bp, Homo sapiens
ctgggaaatattccct

SEQ ID NO: 6154734 - DNA, 19 bp, Homo sapiens
ctgggaaatgagaaggcag

SEQ ID NO: 6154735 - DNA, 20 bp, Homo sapiens
ctgggaaatgagatcccaga

SEQ ID NO: 6154736 - DNA, 17 bp, Homo sapiens
ctgggaaatgcagaaat

SEQ ID NO: 6154737 - DNA, 22 bp, Homo sapiens
ctgggaaattgaagtgtcttct

SEQ ID NO: 6154738 - DNA, 21 bp, Homo sapiens
ctgggaaattgctccattcct

SEQ ID NO: 6154739 - DNA, 13 bp, Homo sapiens
ctgggaaatttaa

SEQ ID NO: 6154740 - DNA, 22 bp, Homo sapiens
ctgggaaatttctacttatcct

SEQ ID NO: 6154741 - DNA, 17 bp, Homo sapiens
ctgggaacacagccagt

SEQ ID NO: 6154742 - DNA, 17 bp, Homo sapiens
ctgggaacacagttctg

SEQ ID NO: 6154743 - DNA, 14 bp, Homo sapiens
ctgggaacagaact

SEQ ID NO: 6154744 - DNA, 14 bp, Homo sapiens
ctgggaacaggccc

SEQ ID NO: 6154745 - DNA, 16 bp, Homo sapiens
ctgggaacatgaccca

SEQ ID NO: 6154746 - DNA, 19 bp, Homo sapiens
ctgggaacatgacccagcc

SEQ ID NO: 6154747 - DNA, 21 bp, Homo sapiens
ctgggaacatgacccagcctg

SEQ ID NO: 6154748 - DNA, 15 bp, Homo sapiens
ctgggaaccaagggc

SEQ ID NO: 6154749 - DNA, 23 bp, Homo sapiens
ctgggaaccaagggccctcactc

SEQ ID NO: 6154750 - DNA, 18 bp, Homo sapiens
ctgggaaccactcccacc

SEQ ID NO: 6154751 - DNA, 18 bp, Homo sapiens
ctgggaaccatgaagctg

SEQ ID NO: 6154752 - DNA, 13 bp, Homo sapiens
ctgggaaccccgc

SEQ ID NO: 6154753 - DNA, 17 bp, Homo sapiens
ctgggaaccccgcagcc

SEQ ID NO: 6154754 - DNA, 19 bp, Homo sapiens
ctgggaacccctttcccac

SEQ ID NO: 6154755 - DNA, 18 bp, Homo sapiens
ctgggaacccgactgtga

SEQ ID NO: 6154756 - DNA, 22 bp, Homo sapiens
ctgggaacccgactgtgaaagt

SEQ ID NO: 6154757 - DNA, 18 bp, Homo sapiens
ctgggaaccgccctcctg

SEQ ID NO: 6154758 - DNA, 16 bp, Homo sapiens
ctgggaacctcccaga

SEQ ID NO: 6154759 - DNA, 18 bp, Homo sapiens
ctgggaacctcccagagg

SEQ ID NO: 6154760 - DNA, 22 bp, Homo sapiens
ctgggaacctcccagaggtcca

SEQ ID NO: 6154761 - DNA, 23 bp, Homo sapiens
ctgggaacctcccagaggtccag

SEQ ID NO: 6154762 - DNA, 13 bp, Homo sapiens
ctgggaacctcct

SEQ ID NO: 6154763 - DNA, 18 bp, Homo sapiens
ctgggaacctccttacct

SEQ ID NO: 6154764 - DNA, 20 bp, Homo sapiens
ctgggaacctccttacctgg

SEQ ID NO: 6154765 - DNA, 23 bp, Homo sapiens
ctgggaacctccttacctggagt

SEQ ID NO: 6154766 - DNA, 19 bp, Homo sapiens
ctgggaaccttcctgtctt

SEQ ID NO: 6154767 - DNA, 23 bp, Homo sapiens
ctgggaacgtgtgtccaggctct

SEQ ID NO: 6154768 - DNA, 17 bp, Homo sapiens
ctgggaactcacctggg

SEQ ID NO: 6154769 - DNA, 20 bp, Homo sapiens
ctgggaactcacctggggct

SEQ ID NO: 6154770 - DNA, 17 bp, Homo sapiens
ctgggaactcatctggt

SEQ ID NO: 6154771 - DNA, 19 bp, Homo sapiens
ctgggaactgcagacctgt

SEQ ID NO: 6154772 - DNA, 20 bp, Homo sapiens
ctgggaactgcagacctgtc

SEQ ID NO: 6154773 - DNA, 21 bp, Homo sapiens
ctgggaactgcagacctgtcc

SEQ ID NO: 6154774 - DNA, 22 bp, Homo sapiens
ctgggaactgggccagcagagc

SEQ ID NO: 6154775 - DNA, 22 bp, Homo sapiens
ctgggaagaaagtaggagtggc

SEQ ID NO: 6154776 - DNA, 14 bp, Homo sapiens
ctgggaagagctcc

SEQ ID NO: 6154777 - DNA, 22 bp, Homo sapiens
ctgggaagataggctctgcaca

SEQ ID NO: 6154778 - DNA, 24 bp, Homo sapiens
ctgggaagataggctctgcacaga

SEQ ID NO: 6154779 - DNA, 19 bp, Homo sapiens
ctgggaagatgctggcccc

SEQ ID NO: 6154780 - DNA, 17 bp, Homo sapiens
ctgggaagcattacttt

SEQ ID NO: 6154781 - DNA, 22 bp, Homo sapiens
ctgggaagcccggactgaccaa

SEQ ID NO: 6154782 - DNA, 15 bp, Homo sapiens
ctgggaagctcccac

SEQ ID NO: 6154783 - DNA, 21 bp, Homo sapiens
ctgggaagctcccaccccact

SEQ ID NO: 6154784 - DNA, 18 bp, Homo sapiens
ctgggaagcttgagcctc

SEQ ID NO: 6154785 - DNA, 19 bp, Homo sapiens
ctgggaagcttgagcctcc

SEQ ID NO: 6154786 - DNA, 12 bp, Homo sapiens
ctgggaaggaaa

SEQ ID NO: 6154787 - DNA, 14 bp, Homo sapiens
aaattatgtataaa

SEQ ID NO: 6154788 - DNA, 19 bp, Homo sapiens
aaattatgtataaacataa

SEQ ID NO: 6154789 - DNA, 20 bp, Homo sapiens
aaattatgtgacattttaca

SEQ ID NO: 6154790 - DNA, 23 bp, Homo sapiens
aaattatgtttatataaatgctt

SEQ ID NO: 6154791 - DNA, 22 bp, Homo sapiens
aaattatgttttactgttcatt

SEQ ID NO: 6154792 - DNA, 15 bp, Homo sapiens
aaattattaaaggaa

SEQ ID NO: 6154793 - DNA, 15 bp, Homo sapiens
aaattattaattgtc

SEQ ID NO: 6154794 - DNA, 20 bp, Homo sapiens
aaattattaattgtcctgtg

SEQ ID NO: 6154795 - DNA, 22 bp, Homo sapiens
aaattattaattgtcctgtgtc

SEQ ID NO: 6154796 - DNA, 23 bp, Homo sapiens
aaattattaattgtcctgtgtct

SEQ ID NO: 6154797 - DNA, 18 bp, Homo sapiens
aaattattaatttatgca

SEQ ID NO: 6154798 - DNA, 12 bp, Homo sapiens
aaattattacat

SEQ ID NO: 6154799 - DNA, 13 bp, Homo sapiens
aaattattacttt

SEQ ID NO: 6154800 - DNA, 17 bp, Homo sapiens
aaattattagaacattc

SEQ ID NO: 6154801 - DNA, 19 bp, Homo sapiens
aaattattagagattttct

SEQ ID NO: 6154802 - DNA, 17 bp, Homo sapiens
aaattattatttagctt

SEQ ID NO: 6154803 - DNA, 13 bp, Homo sapiens
aaattattcagaa

SEQ ID NO: 6154804 - DNA, 16 bp, Homo sapiens
aaattattcagttaag

SEQ ID NO: 6154805 - DNA, 14 bp, Homo sapiens
aaattattctagtc

SEQ ID NO: 6154806 - DNA, 18 bp, Homo sapiens
aaattattgatacaacag

SEQ ID NO: 6154807 - DNA, 19 bp, Homo sapiens
aaattattgatgattttgt

SEQ ID NO: 6154808 - DNA, 19 bp, Homo sapiens
aaattattggtatatttgt

SEQ ID NO: 6154809 - DNA, 13 bp, Homo sapiens
aaattattgtaaa

SEQ ID NO: 6154810 - DNA, 19 bp, Homo sapiens
aaattattgtaaacttttt

SEQ ID NO: 6154811 - DNA, 20 bp, Homo sapiens
aaattattgtaaactttttc

SEQ ID NO: 6154812 - DNA, 13 bp, Homo sapiens
aaattatttaaac

SEQ ID NO: 6154813 - DNA, 20 bp, Homo sapiens
aaattatttaatatgcatct

SEQ ID NO: 6154814 - DNA, 16 bp, Homo sapiens
aaattatttattactt

SEQ ID NO: 6154815 - DNA, 14 bp, Homo sapiens
aaattatttcatac

SEQ ID NO: 6154816 - DNA, 13 bp, Homo sapiens
aaattatttctta

SEQ ID NO: 6154817 - DNA, 20 bp, Homo sapiens
aaattatttcttaattatta

SEQ ID NO: 6154818 - DNA, 16 bp, Homo sapiens
aaattatttgtgtaat

SEQ ID NO: 6154819 - DNA, 16 bp, Homo sapiens
aaattattttaaacaa

SEQ ID NO: 6154820 - DNA, 15 bp, Homo sapiens
aaattattttaaatt

SEQ ID NO: 6154821 - DNA, 20 bp, Homo sapiens
aaattattttaaattataag

SEQ ID NO: 6154822 - DNA, 21 bp, Homo sapiens
aaattattttaatattttgta

SEQ ID NO: 6154823 - DNA, 22 bp, Homo sapiens
aaattattttatcacaaactta

SEQ ID NO: 6154824 - DNA, 17 bp, Homo sapiens
aaattattttatgtcat

SEQ ID NO: 6154825 - DNA, 22 bp, Homo sapiens
aaattattttgttcatacatat

SEQ ID NO: 6154826 - DNA, 21 bp, Homo sapiens
aaattatttttttttttgttc

SEQ ID NO: 6154827 - DNA, 19 bp, Homo sapiens
aaattcaaaacctgcagtt

SEQ ID NO: 6154828 - DNA, 12 bp, Homo sapiens
aaattcaaaaga

SEQ ID NO: 6154829 - DNA, 16 bp, Homo sapiens
aaattcaaaagtattg

SEQ ID NO: 6154830 - DNA, 23 bp, Homo sapiens
aaattcaaaccatttaattcata

SEQ ID NO: 6154831 - DNA, 11 bp, Homo sapiens
aaattcaaata

SEQ ID NO: 6154832 - DNA, 17 bp, Homo sapiens
aaattcaacacttattt

SEQ ID NO: 6154833 - DNA, 13 bp, Homo sapiens
aaattcaaccaca

SEQ ID NO: 6154834 - DNA, 13 bp, Homo sapiens
aaattcaagaagt

SEQ ID NO: 6154835 - DNA, 18 bp, Homo sapiens
aaattcaagagctagaaa

SEQ ID NO: 6154836 - DNA, 22 bp, Homo sapiens
aaattcaaggccacaaaaacaa

SEQ ID NO: 6154837 - DNA, 23 bp, Homo sapiens
aaattcaaggccacaaaaacaat

SEQ ID NO: 6154838 - DNA, 17 bp, Homo sapiens
aaattcaataaaaacct

SEQ ID NO: 6154839 - DNA, 18 bp, Homo sapiens
aaattcaataatcttaaa

SEQ ID NO: 6154840 - DNA, 15 bp, Homo sapiens
aaattcacaaacttt

SEQ ID NO: 6154841 - DNA, 16 bp, Homo sapiens
aaattcacataataaa

SEQ ID NO: 6154842 - DNA, 18 bp, Homo sapiens
aaattcacgttctagtga

SEQ ID NO: 6154843 - DNA, 19 bp, Homo sapiens
aaattcactgtttcactga

SEQ ID NO: 6154844 - DNA, 22 bp, Homo sapiens
aaattcactgtttcactgaaat

SEQ ID NO: 6154845 - DNA, 14 bp, Homo sapiens
aaattcacttctat

SEQ ID NO: 6154846 - DNA, 15 bp, Homo sapiens
aaattcactttcatt

SEQ ID NO: 6154847 - DNA, 16 bp, Homo sapiens
aaattcagacaacatt

SEQ ID NO: 6154848 - DNA, 15 bp, Homo sapiens
aaattcagagtcctt

SEQ ID NO: 6154849 - DNA, 20 bp, Homo sapiens
aaattcagatatatttttca

SEQ ID NO: 6154850 - DNA, 16 bp, Homo sapiens
aaattcagatcaaaat

SEQ ID NO: 6154851 - DNA, 21 bp, Homo sapiens
aaattcagcaaaccattttta

SEQ ID NO: 6154852 - DNA, 12 bp, Homo sapiens
aaattcagctcc

SEQ ID NO: 6154853 - DNA, 9 bp, Homo sapiens
aaattcagg

SEQ ID NO: 6154854 - DNA, 12 bp, Homo sapiens
aaattcaggaag

SEQ ID NO: 6154855 - DNA, 23 bp, Homo sapiens
aaattcaggtacagaaaacatgt

SEQ ID NO: 6154856 - DNA, 18 bp, Homo sapiens
aaattcaggtctgtatgt

SEQ ID NO: 6154857 - DNA, 23 bp, Homo sapiens
aaattcaggtctgtatgtcatgg

SEQ ID NO: 6154858 - DNA, 11 bp, Homo sapiens
aaattcaggtg

SEQ ID NO: 6154859 - DNA, 22 bp, Homo sapiens
aaattcagtcttttctctgaaa

SEQ ID NO: 6154860 - DNA, 13 bp, Homo sapiens
aaattcagtttca

SEQ ID NO: 6154861 - DNA, 14 bp, Homo sapiens
aaattcagtttcat

SEQ ID NO: 6154862 - DNA, 17 bp, Homo sapiens
aaattcagtttttgtat

SEQ ID NO: 6154863 - DNA, 15 bp, Homo sapiens
aaattcatataaaag

SEQ ID NO: 6154864 - DNA, 18 bp, Homo sapiens
aaattcatataaagtgca

SEQ ID NO: 6154865 - DNA, 21 bp, Homo sapiens
aaattcatggcatgcttaaat

SEQ ID NO: 6154866 - DNA, 17 bp, Homo sapiens
aaattcatggctttttc

SEQ ID NO: 6154867 - DNA, 14 bp, Homo sapiens
aaattcattaaaga

SEQ ID NO: 6154868 - DNA, 13 bp, Homo sapiens
aaattcattccat

SEQ ID NO: 6154869 - DNA, 16 bp, Homo sapiens
aaattcattccatttg

SEQ ID NO: 6154870 - DNA, 14 bp, Homo sapiens
aaattcattttatt

SEQ ID NO: 6154871 - DNA, 13 bp, Homo sapiens
aaattcatttttt

SEQ ID NO: 6154872 - DNA, 19 bp, Homo sapiens
aaattcattttttaaattc

SEQ ID NO: 6154873 - DNA, 17 bp, Homo sapiens
aaattccaaagtctcta

SEQ ID NO: 6154874 - DNA, 18 bp, Homo sapiens
aaattccaactcctgatg

SEQ ID NO: 6154875 - DNA, 16 bp, Homo sapiens
aaattccacccctcct

SEQ ID NO: 6154876 - DNA, 17 bp, Homo sapiens
aaattccacccctcctt

SEQ ID NO: 6154877 - DNA, 13 bp, Homo sapiens
aaattccactgga

SEQ ID NO: 6154878 - DNA, 17 bp, Homo sapiens
aaattccagaaaggata

SEQ ID NO: 6154879 - DNA, 11 bp, Homo sapiens
aaattccagta

SEQ ID NO: 6154880 - DNA, 22 bp, Homo sapiens
aaattccagttatttatttcca

SEQ ID NO: 6154881 - DNA, 20 bp, Homo sapiens
aaattccagttgcaattcat

SEQ ID NO: 6154882 - DNA, 22 bp, Homo sapiens
aaattccattagagagtggcaa

SEQ ID NO: 6154883 - DNA, 12 bp, Homo sapiens
aaattccattat

SEQ ID NO: 6154884 - DNA, 20 bp, Homo sapiens
aaattccatttacttgatca

SEQ ID NO: 6154885 - DNA, 15 bp, Homo sapiens
aaattcccaaatatt

SEQ ID NO: 6154886 - DNA, 19 bp, Homo sapiens
aaattcccaacctgctcat

SEQ ID NO: 6154887 - DNA, 16 bp, Homo sapiens
aaattccccaccctga

SEQ ID NO: 6154888 - DNA, 14 bp, Homo sapiens
aaattccccttccc

SEQ ID NO: 6154889 - DNA, 19 bp, Homo sapiens
aaattccccttcccaaccc

SEQ ID NO: 6154890 - DNA, 12 bp, Homo sapiens
aaattccctggg

SEQ ID NO: 6154891 - DNA, 16 bp, Homo sapiens
aaattcccttcatctg

SEQ ID NO: 6154892 - DNA, 19 bp, Homo sapiens
aaattccgattagaccttt

SEQ ID NO: 6154893 - DNA, 21 bp, Homo sapiens
aaattccgattagacctttat

SEQ ID NO: 6154894 - DNA, 16 bp, Homo sapiens
aaattcctaattctat

SEQ ID NO: 6154895 - DNA, 15 bp, Homo sapiens
aaattcctattgtga

SEQ ID NO: 6154896 - DNA, 17 bp, Homo sapiens
aaattcctattgtgatt

SEQ ID NO: 6154897 - DNA, 17 bp, Homo sapiens
aaattcctccttccccc

SEQ ID NO: 6154898 - DNA, 14 bp, Homo sapiens
aaattcctctttgc

SEQ ID NO: 6154899 - DNA, 14 bp, Homo sapiens
aaattcctgtagca

SEQ ID NO: 6154900 - DNA, 23 bp, Homo sapiens
aaattcctgtgttcaatatttag

SEQ ID NO: 6154901 - DNA, 14 bp, Homo sapiens
aaattcctgttgtc

SEQ ID NO: 6154902 - DNA, 13 bp, Homo sapiens
aaattccttgccc

SEQ ID NO: 6154903 - DNA, 19 bp, Homo sapiens
aaattccttgccccacagt

SEQ ID NO: 6154904 - DNA, 20 bp, Homo sapiens
aaattccttgccccacagtt

SEQ ID NO: 6154905 - DNA, 15 bp, Homo sapiens
aaattcctttcagag

SEQ ID NO: 6154906 - DNA, 19 bp, Homo sapiens
aaattcctttcagagtttt

SEQ ID NO: 6154907 - DNA, 19 bp, Homo sapiens
aaattcgcatgtttaatgt

SEQ ID NO: 6154908 - DNA, 18 bp, Homo sapiens
aaattcgccccattttct

SEQ ID NO: 6154909 - DNA, 19 bp, Homo sapiens
aaattcgcccgagctgttt

SEQ ID NO: 6154910 - DNA, 18 bp, Homo sapiens
aaattctactaagttatt

SEQ ID NO: 6154911 - DNA, 16 bp, Homo sapiens
aaattctagtctctga

SEQ ID NO: 6154912 - DNA, 16 bp, Homo sapiens
aaattctataaaaacc

SEQ ID NO: 6154913 - DNA, 22 bp, Homo sapiens
aaattctataggaacatatgaa

SEQ ID NO: 6154914 - DNA, 21 bp, Homo sapiens
aaattctatgttaaatactgt

SEQ ID NO: 6154915 - DNA, 21 bp, Homo sapiens
aaattctattctgatcttatt

SEQ ID NO: 6154916 - DNA, 14 bp, Homo sapiens
aaattctattgaaa

SEQ ID NO: 6154917 - DNA, 17 bp, Homo sapiens
aaattctattgaaaaca

SEQ ID NO: 6154918 - DNA, 15 bp, Homo sapiens
aaattctcaaaatac

SEQ ID NO: 6154919 - DNA, 16 bp, Homo sapiens
aaattctcagagtgtt

SEQ ID NO: 6154920 - DNA, 16 bp, Homo sapiens
aaattctccaacccaa

SEQ ID NO: 6154921 - DNA, 12 bp, Homo sapiens
aaattctccact

SEQ ID NO: 6154922 - DNA, 13 bp, Homo sapiens
aaattctcctgga

SEQ ID NO: 6154923 - DNA, 18 bp, Homo sapiens
aaattctctatgtacaga

SEQ ID NO: 6154924 - DNA, 17 bp, Homo sapiens
aaattctctcaagactt

SEQ ID NO: 6154925 - DNA, 12 bp, Homo sapiens
aaattctctcct

SEQ ID NO: 6154926 - DNA, 23 bp, Homo sapiens
aaattctctcctaatgatgactt

SEQ ID NO: 6154927 - DNA, 22 bp, Homo sapiens
aaattctcttaatcactactgt

SEQ ID NO: 6154928 - DNA, 23 bp, Homo sapiens
aaattctcttaatcactactgta

SEQ ID NO: 6154929 - DNA, 15 bp, Homo sapiens
aaattctcttctttt

SEQ ID NO: 6154930 - DNA, 19 bp, Homo sapiens
aaattctgaaaactgaatg

SEQ ID NO: 6154931 - DNA, 15 bp, Homo sapiens
aaattctgaatgcaa

SEQ ID NO: 6154932 - DNA, 13 bp, Homo sapiens
aaattctgaattt

SEQ ID NO: 6154933 - DNA, 14 bp, Homo sapiens
aaattctgaatttg

SEQ ID NO: 6154934 - DNA, 17 bp, Homo sapiens
aaattctgaatttgcaa

SEQ ID NO: 6154935 - DNA, 21 bp, Homo sapiens
aaattctgaatttgcaaagta

SEQ ID NO: 6154936 - DNA, 22 bp, Homo sapiens
aaattctgaatttgcaaagtac

SEQ ID NO: 6154937 - DNA, 16 bp, Homo sapiens
aaattctgaattttgg

SEQ ID NO: 6154938 - DNA, 19 bp, Homo sapiens
aaattctgatgtttctgtg

SEQ ID NO: 6154939 - DNA, 20 bp, Homo sapiens
aaattctgatgtttctgtga

SEQ ID NO: 6154940 - DNA, 21 bp, Homo sapiens
aaattctgatgtttctgtgaa

SEQ ID NO: 6154941 - DNA, 14 bp, Homo sapiens
aaattctgattatt

SEQ ID NO: 6154942 - DNA, 12 bp, Homo sapiens
aaattctgattt

SEQ ID NO: 6154943 - DNA, 16 bp, Homo sapiens
aaattctgatttcttt

SEQ ID NO: 6154944 - DNA, 20 bp, Homo sapiens
aaattctgatttcttttcac

SEQ ID NO: 6154945 - DNA, 20 bp, Homo sapiens
aaattctgcaagtttctgtt

SEQ ID NO: 6154946 - DNA, 15 bp, Homo sapiens
aaattctgctcagat

SEQ ID NO: 6154947 - DNA, 21 bp, Homo sapiens
aaattctgggtgaaacccttt

SEQ ID NO: 6154948 - DNA, 20 bp, Homo sapiens
aaattctgggttcatttgtg

SEQ ID NO: 6154949 - DNA, 16 bp, Homo sapiens
aaattctgtctctgga

SEQ ID NO: 6154950 - DNA, 17 bp, Homo sapiens
aaattctgtggcagttt

SEQ ID NO: 6154951 - DNA, 21 bp, Homo sapiens
aaattctgttagctgctcact

SEQ ID NO: 6154952 - DNA, 18 bp, Homo sapiens
aaattctgttgttccatt

SEQ ID NO: 6154953 - DNA, 17 bp, Homo sapiens
aaattctgttttgtaaa

SEQ ID NO: 6154954 - DNA, 15 bp, Homo sapiens
aaattctgtttttaa

SEQ ID NO: 6154955 - DNA, 19 bp, Homo sapiens
aaattctgtttttaaaaat

SEQ ID NO: 6154956 - DNA, 16 bp, Homo sapiens
aaattcttactctgga

SEQ ID NO: 6154957 - DNA, 23 bp, Homo sapiens
aaattcttctgaactcaaactga

SEQ ID NO: 6154958 - DNA, 17 bp, Homo sapiens
aaattcttgaagttcat

SEQ ID NO: 6154959 - DNA, 15 bp, Homo sapiens
aaattcttgaataaa

SEQ ID NO: 6154960 - DNA, 15 bp, Homo sapiens
aaattcttgcaaagt

SEQ ID NO: 6154961 - DNA, 18 bp, Homo sapiens
aaattcttgcaaagtatc

SEQ ID NO: 6154962 - DNA, 21 bp, Homo sapiens
aaattcttggttattctgcca

SEQ ID NO: 6154963 - DNA, 17 bp, Homo sapiens
aaattctttagtactca

SEQ ID NO: 6154964 - DNA, 17 bp, Homo sapiens
aaattctttatttctgt

SEQ ID NO: 6154965 - DNA, 22 bp, Homo sapiens
aaattctttcacttgatgtttg

SEQ ID NO: 6154966 - DNA, 15 bp, Homo sapiens
aaattctttcatgag

SEQ ID NO: 6154967 - DNA, 21 bp, Homo sapiens
ctctctgagactctttagagc

SEQ ID NO: 6154968 - DNA, 17 bp, Homo sapiens
ctctctgagctggggag

SEQ ID NO: 6154969 - DNA, 12 bp, Homo sapiens
ctctctgaggca

SEQ ID NO: 6154970 - DNA, 22 bp, Homo sapiens
ctctctgaggcaaggcccagac

SEQ ID NO: 6154971 - DNA, 19 bp, Homo sapiens
ctctctgagggggtggggg

SEQ ID NO: 6154972 - DNA, 14 bp, Homo sapiens
ctctctgagtacat

SEQ ID NO: 6154973 - DNA, 14 bp, Homo sapiens
ctctctgagtcaaa

SEQ ID NO: 6154974 - DNA, 23 bp, Homo sapiens
ctctctgagtcaaatccagtggt

SEQ ID NO: 6154975 - DNA, 18 bp, Homo sapiens
ctctctgagtcctggccc

SEQ ID NO: 6154976 - DNA, 14 bp, Homo sapiens
ctctctgagtctgg

SEQ ID NO: 6154977 - DNA, 18 bp, Homo sapiens
ctctctgatgtcccagtg

SEQ ID NO: 6154978 - DNA, 21 bp, Homo sapiens
ctctctgatgtcccagtgctc

SEQ ID NO: 6154979 - DNA, 16 bp, Homo sapiens
ctctctgcagccagcc

SEQ ID NO: 6154980 - DNA, 19 bp, Homo sapiens
ctctctgcagccagcccag

SEQ ID NO: 6154981 - DNA, 20 bp, Homo sapiens
ctctctgcagccagcccagc

SEQ ID NO: 6154982 - DNA, 12 bp, Homo sapiens
ctctctgcagct

SEQ ID NO: 6154983 - DNA, 16 bp, Homo sapiens
ctctctgcagctgccg

SEQ ID NO: 6154984 - DNA, 19 bp, Homo sapiens
ctctctgcagtcctccggg

SEQ ID NO: 6154985 - DNA, 14 bp, Homo sapiens
ctctctgccattct

SEQ ID NO: 6154986 - DNA, 16 bp, Homo sapiens
ctctctgccccaccca

SEQ ID NO: 6154987 - DNA, 19 bp, Homo sapiens
ctctctgcccctgatcact

SEQ ID NO: 6154988 - DNA, 13 bp, Homo sapiens
ctctctgccctct

SEQ ID NO: 6154989 - DNA, 14 bp, Homo sapiens
ctctctgccctctc

SEQ ID NO: 6154990 - DNA, 12 bp, Homo sapiens
ctctctgccctg

SEQ ID NO: 6154991 - DNA, 12 bp, Homo sapiens
ctctctgcctct

SEQ ID NO: 6154992 - DNA, 15 bp, Homo sapiens
ctctctgcctgctgg

SEQ ID NO: 6154993 - DNA, 16 bp, Homo sapiens
ctctctgcctgctggg

SEQ ID NO: 6154994 - DNA, 15 bp, Homo sapiens
ctctctgcctgcttc

SEQ ID NO: 6154995 - DNA, 14 bp, Homo sapiens
ctctctgcctgtga

SEQ ID NO: 6154996 - DNA, 21 bp, Homo sapiens
ctctctgctcagtgatctcac

SEQ ID NO: 6154997 - DNA, 15 bp, Homo sapiens
ctctctgctcatggg

SEQ ID NO: 6154998 - DNA, 16 bp, Homo sapiens
ctctctgctcatgggt

SEQ ID NO: 6154999 - DNA, 14 bp, Homo sapiens
ctctctgctccaga

SEQ ID NO: 6155000 - DNA, 16 bp, Homo sapiens
ctctctgctccagaga

SEQ ID NO: 6155001 - DNA, 18 bp, Homo sapiens
ctctctgctccttcactg

SEQ ID NO: 6155002 - DNA, 16 bp, Homo sapiens
ctctctgctctagcca

SEQ ID NO: 6155003 - DNA, 12 bp, Homo sapiens
ctctctgctctg

SEQ ID NO: 6155004 - DNA, 12 bp, Homo sapiens
ctctctgctgag

SEQ ID NO: 6155005 - DNA, 20 bp, Homo sapiens
ctctctgctgagctgggccc

SEQ ID NO: 6155006 - DNA, 13 bp, Homo sapiens
ctctctgctgtac

SEQ ID NO: 6155007 - DNA, 19 bp, Homo sapiens
ctctctggaaagaggctct

SEQ ID NO: 6155008 - DNA, 21 bp, Homo sapiens
ctctctggaaagaggctctgg

SEQ ID NO: 6155009 - DNA, 16 bp, Homo sapiens
ctctctggaaaggagg

SEQ ID NO: 6155010 - DNA, 20 bp, Homo sapiens
ctctctggaagccctggaga

SEQ ID NO: 6155011 - DNA, 22 bp, Homo sapiens
ctctctggaaggttttgcttct

SEQ ID NO: 6155012 - DNA, 13 bp, Homo sapiens
ctctctggacctg

SEQ ID NO: 6155013 - DNA, 10 bp, Homo sapiens
ctctctggag

SEQ ID NO: 6155014 - DNA, 13 bp, Homo sapiens
ctctctggagccc

SEQ ID NO: 6155015 - DNA, 14 bp, Homo sapiens
ctctctggctcagg

SEQ ID NO: 6155016 - DNA, 15 bp, Homo sapiens
ctctctggctcaggt

SEQ ID NO: 6155017 - DNA, 18 bp, Homo sapiens
ctctctggctcaggtgtg

SEQ ID NO: 6155018 - DNA, 14 bp, Homo sapiens
ctctctggcttctc

SEQ ID NO: 6155019 - DNA, 15 bp, Homo sapiens
ctctctggcttctct

SEQ ID NO: 6155020 - DNA, 16 bp, Homo sapiens
ctctctggcttctctc

SEQ ID NO: 6155021 - DNA, 18 bp, Homo sapiens
ctctctggcttctctctt

SEQ ID NO: 6155022 - DNA, 19 bp, Homo sapiens
ctctctggcttctctcttt

SEQ ID NO: 6155023 - DNA, 13 bp, Homo sapiens
ctctctgggacct

SEQ ID NO: 6155024 - DNA, 16 bp, Homo sapiens
ctctctgggacctcct

SEQ ID NO: 6155025 - DNA, 17 bp, Homo sapiens
ctctctgggacctcctt

SEQ ID NO: 6155026 - DNA, 21 bp, Homo sapiens
ctctctgggactctcctcctc

SEQ ID NO: 6155027 - DNA, 19 bp, Homo sapiens
ctctctgggcacccggtcc

SEQ ID NO: 6155028 - DNA, 21 bp, Homo sapiens
ctctctgggcctgggttccag

SEQ ID NO: 6155029 - DNA, 22 bp, Homo sapiens
ctctctggggaagtcaggggag

SEQ ID NO: 6155030 - DNA, 18 bp, Homo sapiens
ctctctggggccacacag

SEQ ID NO: 6155031 - DNA, 20 bp, Homo sapiens
ctctctggggccacacagaa

SEQ ID NO: 6155032 - DNA, 17 bp, Homo sapiens
ctctctggggccctggg

SEQ ID NO: 6155033 - DNA, 20 bp, Homo sapiens
ctctctggggccctgggcct

SEQ ID NO: 6155034 - DNA, 22 bp, Homo sapiens
ctctctggggccctgggcctca

SEQ ID NO: 6155035 - DNA, 19 bp, Homo sapiens
ctctctggtcttttttccc

SEQ ID NO: 6155036 - DNA, 16 bp, Homo sapiens
ctctctggtggctggg

SEQ ID NO: 6155037 - DNA, 19 bp, Homo sapiens
ctctctggtggctgggctg

SEQ ID NO: 6155038 - DNA, 17 bp, Homo sapiens
ctctctgtccaatctgc

SEQ ID NO: 6155039 - DNA, 18 bp, Homo sapiens
ctctctgtcccttgctgt

SEQ ID NO: 6155040 - DNA, 20 bp, Homo sapiens
ctctctgtcttctctccact

SEQ ID NO: 6155041 - DNA, 16 bp, Homo sapiens
ctctctgtggctccaa

SEQ ID NO: 6155042 - DNA, 17 bp, Homo sapiens
ctctctgtggctccaac

SEQ ID NO: 6155043 - DNA, 16 bp, Homo sapiens
ctctctgtggggctga

SEQ ID NO: 6155044 - DNA, 23 bp, Homo sapiens
ctctctgtggtggttcattccac

SEQ ID NO: 6155045 - DNA, 19 bp, Homo sapiens
ctctctgtgtccgtgtgga

SEQ ID NO: 6155046 - DNA, 17 bp, Homo sapiens
ctctctgtgtctttctc

SEQ ID NO: 6155047 - DNA, 13 bp, Homo sapiens
ctctctgtgtggc

SEQ ID NO: 6155048 - DNA, 21 bp, Homo sapiens
ctctctgtgtggcaaacattt

SEQ ID NO: 6155049 - DNA, 13 bp, Homo sapiens
ctctctgttccaa

SEQ ID NO: 6155050 - DNA, 19 bp, Homo sapiens
ctctctgttccaagtgtgt

SEQ ID NO: 6155051 - DNA, 12 bp, Homo sapiens
ctctctgttccc

SEQ ID NO: 6155052 - DNA, 14 bp, Homo sapiens
ctctctgttccctt

SEQ ID NO: 6155053 - DNA, 15 bp, Homo sapiens
ctctctgttcccttc

SEQ ID NO: 6155054 - DNA, 18 bp, Homo sapiens
ctctctgttcccttcctc

SEQ ID NO: 6155055 - DNA, 18 bp, Homo sapiens
ctctctgttctcttgctt

SEQ ID NO: 6155056 - DNA, 23 bp, Homo sapiens
ctctctgttgcgctcccgcattt

SEQ ID NO: 6155057 - DNA, 15 bp, Homo sapiens
ctctctgtttaccct

SEQ ID NO: 6155058 - DNA, 21 bp, Homo sapiens
ctctctgttttgtgccagtgc

SEQ ID NO: 6155059 - DNA, 20 bp, Homo sapiens
ctctcttaggagcagagctc

SEQ ID NO: 6155060 - DNA, 22 bp, Homo sapiens
ctctcttagttcttaccttttg

SEQ ID NO: 6155061 - DNA, 19 bp, Homo sapiens
ctctcttatagaatattta

SEQ ID NO: 6155062 - DNA, 18 bp, Homo sapiens
ctctcttcaatctctgga

SEQ ID NO: 6155063 - DNA, 22 bp, Homo sapiens
ctctcttcagactctcagccca

SEQ ID NO: 6155064 - DNA, 13 bp, Homo sapiens
ctctcttcaggag

SEQ ID NO: 6155065 - DNA, 14 bp, Homo sapiens
ctctcttccacagt

SEQ ID NO: 6155066 - DNA, 13 bp, Homo sapiens
ctctcttcccctt

SEQ ID NO: 6155067 - DNA, 12 bp, Homo sapiens
ctctcttccctt

SEQ ID NO: 6155068 - DNA, 15 bp, Homo sapiens
ctctcttccctttcc

SEQ ID NO: 6155069 - DNA, 22 bp, Homo sapiens
ctctcttcccttttttttctgg

SEQ ID NO: 6155070 - DNA, 15 bp, Homo sapiens
ctctcttcctatccc

SEQ ID NO: 6155071 - DNA, 15 bp, Homo sapiens
ctctcttcctccact

SEQ ID NO: 6155072 - DNA, 11 bp, Homo sapiens
ctctcttcctg

SEQ ID NO: 6155073 - DNA, 13 bp, Homo sapiens
ctctcttcctgcc

SEQ ID NO: 6155074 - DNA, 14 bp, Homo sapiens
ctctcttcctgccc

SEQ ID NO: 6155075 - DNA, 12 bp, Homo sapiens
ctctcttcctgt

SEQ ID NO: 6155076 - DNA, 12 bp, Homo sapiens
ctctcttccttt

SEQ ID NO: 6155077 - DNA, 14 bp, Homo sapiens
ctctcttcctttca

SEQ ID NO: 6155078 - DNA, 16 bp, Homo sapiens
ctctcttcctttcatt

SEQ ID NO: 6155079 - DNA, 22 bp, Homo sapiens
ctctcttcggtcgtatccacct

SEQ ID NO: 6155080 - DNA, 18 bp, Homo sapiens
ctctcttcgtcctgatcc

SEQ ID NO: 6155081 - DNA, 12 bp, Homo sapiens
ctctcttctctc

SEQ ID NO: 6155082 - DNA, 16 bp, Homo sapiens
ctctcttctctccagc

SEQ ID NO: 6155083 - DNA, 22 bp, Homo sapiens
ctctcttctctccccttttcct

SEQ ID NO: 6155084 - DNA, 22 bp, Homo sapiens
ctctcttctgcacagctcctcc

SEQ ID NO: 6155085 - DNA, 12 bp, Homo sapiens
ctctcttctgct

SEQ ID NO: 6155086 - DNA, 15 bp, Homo sapiens
ctctcttctgctcca

SEQ ID NO: 6155087 - DNA, 16 bp, Homo sapiens
ctctcttctgctccac

SEQ ID NO: 6155088 - DNA, 17 bp, Homo sapiens
ctctcttctgctccacc

SEQ ID NO: 6155089 - DNA, 18 bp, Homo sapiens
ctctcttctgctccaccc

SEQ ID NO: 6155090 - DNA, 22 bp, Homo sapiens
ctctcttctggctttctgagca

SEQ ID NO: 6155091 - DNA, 13 bp, Homo sapiens
ctctcttctgtgt

SEQ ID NO: 6155092 - DNA, 13 bp, Homo sapiens
ctctcttcttact

SEQ ID NO: 6155093 - DNA, 15 bp, Homo sapiens
ctctcttcttactgt

SEQ ID NO: 6155094 - DNA, 18 bp, Homo sapiens
ctctcttcttattaccca

SEQ ID NO: 6155095 - DNA, 21 bp, Homo sapiens
ctctcttcttattacccaaac

SEQ ID NO: 6155096 - DNA, 18 bp, Homo sapiens
ctctcttgaaccccaaat

SEQ ID NO: 6155097 - DNA, 21 bp, Homo sapiens
ctctcttgaaccccaaatgct

SEQ ID NO: 6155098 - DNA, 14 bp, Homo sapiens
ctctcttgaccctg

SEQ ID NO: 6155099 - DNA, 18 bp, Homo sapiens
ctctcttgaccctgtcac

SEQ ID NO: 6155100 - DNA, 14 bp, Homo sapiens
ctctcttgcacccg

SEQ ID NO: 6155101 - DNA, 14 bp, Homo sapiens
ctctcttgccagca

SEQ ID NO: 6155102 - DNA, 14 bp, Homo sapiens
ctctcttgcccctt

SEQ ID NO: 6155103 - DNA, 19 bp, Homo sapiens
ctctcttgcctgaggggaa

SEQ ID NO: 6155104 - DNA, 13 bp, Homo sapiens
ctctcttgccttt

SEQ ID NO: 6155105 - DNA, 17 bp, Homo sapiens
ctctcttggaactgcac

SEQ ID NO: 6155106 - DNA, 22 bp, Homo sapiens
ctctcttggaattagatgttta

SEQ ID NO: 6155107 - DNA, 23 bp, Homo sapiens
ctctcttggaattagatgtttat

SEQ ID NO: 6155108 - DNA, 13 bp, Homo sapiens
ctctcttggaccc

SEQ ID NO: 6155109 - DNA, 17 bp, Homo sapiens
ctctcttggacccacct

SEQ ID NO: 6155110 - DNA, 23 bp, Homo sapiens
ctctcttggacccacctgtgggg

SEQ ID NO: 6155111 - DNA, 16 bp, Homo sapiens
ctctcttggaccctgg

SEQ ID NO: 6155112 - DNA, 20 bp, Homo sapiens
ctctcttggaccctgggagt

SEQ ID NO: 6155113 - DNA, 23 bp, Homo sapiens
ctctcttggactccctccccacc

SEQ ID NO: 6155114 - DNA, 14 bp, Homo sapiens
ctctcttggctatt

SEQ ID NO: 6155115 - DNA, 19 bp, Homo sapiens
ctctcttggctattgacca

SEQ ID NO: 6155116 - DNA, 17 bp, Homo sapiens
ctctcttgggccaagcc

SEQ ID NO: 6155117 - DNA, 23 bp, Homo sapiens
ctctcttgggccaagccagctgc

SEQ ID NO: 6155118 - DNA, 13 bp, Homo sapiens
ctctcttggtctc

SEQ ID NO: 6155119 - DNA, 15 bp, Homo sapiens
ctctcttggtctctt

SEQ ID NO: 6155120 - DNA, 14 bp, Homo sapiens
ctctcttgtcacat

SEQ ID NO: 6155121 - DNA, 17 bp, Homo sapiens
ctctctttatacagctg

SEQ ID NO: 6155122 - DNA, 11 bp, Homo sapiens
ctctctttcct

SEQ ID NO: 6155123 - DNA, 15 bp, Homo sapiens
ctctctttccttctt

SEQ ID NO: 6155124 - DNA, 11 bp, Homo sapiens
ctctctttctc

SEQ ID NO: 6155125 - DNA, 21 bp, Homo sapiens
ctctctttctcaaagaggggg

SEQ ID NO: 6155126 - DNA, 15 bp, Homo sapiens
ctctctttcttttgt

SEQ ID NO: 6155127 - DNA, 16 bp, Homo sapiens
ctctctttgcatggat

SEQ ID NO: 6155128 - DNA, 18 bp, Homo sapiens
ctctctttgcatggattt

SEQ ID NO: 6155129 - DNA, 15 bp, Homo sapiens
ctctctttggactct

SEQ ID NO: 6155130 - DNA, 16 bp, Homo sapiens
ctctctttggactctc

SEQ ID NO: 6155131 - DNA, 17 bp, Homo sapiens
ctctctttgggaatgtt

SEQ ID NO: 6155132 - DNA, 12 bp, Homo sapiens
ctctctttgtcc

SEQ ID NO: 6155133 - DNA, 12 bp, Homo sapiens
ctctctttgtta

SEQ ID NO: 6155134 - DNA, 15 bp, Homo sapiens
ctctcttttcattgt

SEQ ID NO: 6155135 - DNA, 15 bp, Homo sapiens
ctctcttttccccgc

SEQ ID NO: 6155136 - DNA, 16 bp, Homo sapiens
ctctcttttccccgcc

SEQ ID NO: 6155137 - DNA, 16 bp, Homo sapiens
ctctcttttcctctct

SEQ ID NO: 6155138 - DNA, 19 bp, Homo sapiens
ctctcttttcctctctctc

SEQ ID NO: 6155139 - DNA, 18 bp, Homo sapiens
ctctcttttcctctctgt

SEQ ID NO: 6155140 - DNA, 22 bp, Homo sapiens
ctctcttttctgtacttcctga

SEQ ID NO: 6155141 - DNA, 22 bp, Homo sapiens
ctctcttttgaggtccctgtat

SEQ ID NO: 6155142 - DNA, 16 bp, Homo sapiens
ctctgaaaacaagaga

SEQ ID NO: 6155143 - DNA, 24 bp, Homo sapiens
ctctgaaaacaagagactgcttga

SEQ ID NO: 6155144 - DNA, 23 bp, Homo sapiens
ctctgaaaagcaattgccctgta

SEQ ID NO: 6155145 - DNA, 21 bp, Homo sapiens
ctctgaaaatatttttttcta

SEQ ID NO: 6155146 - DNA, 22 bp, Homo sapiens
ctctgaaaatatttttttctag

SEQ ID NO: 6155147 - DNA, 15 bp, Homo sapiens
ctctgaaacagctgc

SEQ ID NO: 6155148 - DNA, 13 bp, Homo sapiens
ctgggaaggagga

SEQ ID NO: 6155149 - DNA, 20 bp, Homo sapiens
ctgggaaggagggagctgct

SEQ ID NO: 6155150 - DNA, 21 bp, Homo sapiens
ctgggaaggagggagctgctc

SEQ ID NO: 6155151 - DNA, 14 bp, Homo sapiens
ctgggaaggccagc

SEQ ID NO: 6155152 - DNA, 19 bp, Homo sapiens
ctgggaaggccagccttgt

SEQ ID NO: 6155153 - DNA, 14 bp, Homo sapiens
ctgggaaggctaag

SEQ ID NO: 6155154 - DNA, 13 bp, Homo sapiens
ctgggaagggaag

SEQ ID NO: 6155155 - DNA, 16 bp, Homo sapiens
ctgggaagggaaggaa

SEQ ID NO: 6155156 - DNA, 22 bp, Homo sapiens
ctgggaagggacatctgttctt

SEQ ID NO: 6155157 - DNA, 14 bp, Homo sapiens
ctgggaagggagag

SEQ ID NO: 6155158 - DNA, 17 bp, Homo sapiens
ctgggaagggagagggc

SEQ ID NO: 6155159 - DNA, 20 bp, Homo sapiens
ctgggaagggagagggcctc

SEQ ID NO: 6155160 - DNA, 23 bp, Homo sapiens
ctgggaaggggaacacagaccag

SEQ ID NO: 6155161 - DNA, 20 bp, Homo sapiens
ctgggaaggggcgtgtccct

SEQ ID NO: 6155162 - DNA, 14 bp, Homo sapiens
ctgggaagggggca

SEQ ID NO: 6155163 - DNA, 15 bp, Homo sapiens
ctgggaaggggtgcc

SEQ ID NO: 6155164 - DNA, 21 bp, Homo sapiens
ctgggaaggggtgccctctgg

SEQ ID NO: 6155165 - DNA, 19 bp, Homo sapiens
ctgggaaggttccatgaag

SEQ ID NO: 6155166 - DNA, 16 bp, Homo sapiens
ctgggaagtcctagcc

SEQ ID NO: 6155167 - DNA, 19 bp, Homo sapiens
ctgggaagtcctagcccct

SEQ ID NO: 6155168 - DNA, 18 bp, Homo sapiens
ctgggaataagtgccagg

SEQ ID NO: 6155169 - DNA, 15 bp, Homo sapiens
ctgggaatacatctg

SEQ ID NO: 6155170 - DNA, 15 bp, Homo sapiens
ctgggaatcatgtcc

SEQ ID NO: 6155171 - DNA, 16 bp, Homo sapiens
ctgggaatcatgtcca

SEQ ID NO: 6155172 - DNA, 15 bp, Homo sapiens
ctgggaatcctgctg

SEQ ID NO: 6155173 - DNA, 17 bp, Homo sapiens
ctgggaatctaagtggg

SEQ ID NO: 6155174 - DNA, 20 bp, Homo sapiens
ctgggaatggaggggcagag

SEQ ID NO: 6155175 - DNA, 14 bp, Homo sapiens
ctgggaatgggaga

SEQ ID NO: 6155176 - DNA, 15 bp, Homo sapiens
ctgggaatggggaca

SEQ ID NO: 6155177 - DNA, 18 bp, Homo sapiens
ctgggaatggggacacgg

SEQ ID NO: 6155178 - DNA, 14 bp, Homo sapiens
ctgggaatgtatag

SEQ ID NO: 6155179 - DNA, 23 bp, Homo sapiens
ctgggaatgtatagtatttgaaa

SEQ ID NO: 6155180 - DNA, 18 bp, Homo sapiens
ctgggaatgtattattct

SEQ ID NO: 6155181 - DNA, 22 bp, Homo sapiens
ctgggaatgtattattctgcag

SEQ ID NO: 6155182 - DNA, 23 bp, Homo sapiens
ctgggaatgtcctgtagagagag

SEQ ID NO: 6155183 - DNA, 18 bp, Homo sapiens
ctgggacaactgctccca

SEQ ID NO: 6155184 - DNA, 16 bp, Homo sapiens
ctgggacaagcaggcc

SEQ ID NO: 6155185 - DNA, 14 bp, Homo sapiens
ctgggacacacaca

SEQ ID NO: 6155186 - DNA, 13 bp, Homo sapiens
ctgggacacagtt

SEQ ID NO: 6155187 - DNA, 22 bp, Homo sapiens
ctgggacactgtgtggccctgg

SEQ ID NO: 6155188 - DNA, 19 bp, Homo sapiens
ctgggacacttccctgggc

SEQ ID NO: 6155189 - DNA, 15 bp, Homo sapiens
ctgggacagcccagg

SEQ ID NO: 6155190 - DNA, 17 bp, Homo sapiens
ctgggacagctggctgg

SEQ ID NO: 6155191 - DNA, 18 bp, Homo sapiens
ctgggacagctggctggg

SEQ ID NO: 6155192 - DNA, 10 bp, Homo sapiens
ctgggacagg

SEQ ID NO: 6155193 - DNA, 14 bp, Homo sapiens
ctgggaccaacctg

SEQ ID NO: 6155194 - DNA, 22 bp, Homo sapiens
ctgggaccacaggttcatgcca

SEQ ID NO: 6155195 - DNA, 16 bp, Homo sapiens
ctgggaccacgtgaga

SEQ ID NO: 6155196 - DNA, 18 bp, Homo sapiens
ctgggaccagagccagat

SEQ ID NO: 6155197 - DNA, 18 bp, Homo sapiens
ctgggaccaggcaccagg

SEQ ID NO: 6155198 - DNA, 14 bp, Homo sapiens
ctgggaccaggctc

SEQ ID NO: 6155199 - DNA, 14 bp, Homo sapiens
ctgggaccagggca

SEQ ID NO: 6155200 - DNA, 15 bp, Homo sapiens
ctgggaccagggcat

SEQ ID NO: 6155201 - DNA, 18 bp, Homo sapiens
ctgggacccacagaactt

SEQ ID NO: 6155202 - DNA, 13 bp, Homo sapiens
ctgggacccactc

SEQ ID NO: 6155203 - DNA, 15 bp, Homo sapiens
ctgggacccactccg

SEQ ID NO: 6155204 - DNA, 12 bp, Homo sapiens
ctgggacccagc

SEQ ID NO: 6155205 - DNA, 22 bp, Homo sapiens
ctgggacccagctactctgtcc

SEQ ID NO: 6155206 - DNA, 23 bp, Homo sapiens
ctgggacccagctactctgtcca

SEQ ID NO: 6155207 - DNA, 21 bp, Homo sapiens
ctgggaccccccccccccccg

SEQ ID NO: 6155208 - DNA, 23 bp, Homo sapiens
ctgggacccctcccaacctcaat

SEQ ID NO: 6155209 - DNA, 19 bp, Homo sapiens
ctgggacccttaggatggg

SEQ ID NO: 6155210 - DNA, 14 bp, Homo sapiens
ctgggaccctttcc

SEQ ID NO: 6155211 - DNA, 19 bp, Homo sapiens
ctgggaccctttccttcct

SEQ ID NO: 6155212 - DNA, 23 bp, Homo sapiens
ctgggaccctttccttccttccc

SEQ ID NO: 6155213 - DNA, 22 bp, Homo sapiens
ctgggaccgctacaccactctg

SEQ ID NO: 6155214 - DNA, 24 bp, Homo sapiens
ctgggaccgctacaccactctggc

SEQ ID NO: 6155215 - DNA, 17 bp, Homo sapiens
ctgggaccgtgcgagct

SEQ ID NO: 6155216 - DNA, 22 bp, Homo sapiens
ctgggacctaatgctggcctga

SEQ ID NO: 6155217 - DNA, 19 bp, Homo sapiens
ctgggacctatacagaaca

SEQ ID NO: 6155218 - DNA, 20 bp, Homo sapiens
ctgggacctatacagaacag

SEQ ID NO: 6155219 - DNA, 21 bp, Homo sapiens
ctgggacctccccagcccagg

SEQ ID NO: 6155220 - DNA, 14 bp, Homo sapiens
ctgggacctcctta

SEQ ID NO: 6155221 - DNA, 16 bp, Homo sapiens
ctgggacctgatttat

SEQ ID NO: 6155222 - DNA, 14 bp, Homo sapiens
ctgggacctgtgtt

SEQ ID NO: 6155223 - DNA, 20 bp, Homo sapiens
ctgggacctttagtggtggc

SEQ ID NO: 6155224 - DNA, 16 bp, Homo sapiens
ctgggacgctctgctg

SEQ ID NO: 6155225 - DNA, 19 bp, Homo sapiens
ctgggacggaccagcatct

SEQ ID NO: 6155226 - DNA, 20 bp, Homo sapiens
ctgggacgtggacatgcctc

SEQ ID NO: 6155227 - DNA, 21 bp, Homo sapiens
ctgggacgtggacatgcctca

SEQ ID NO: 6155228 - DNA, 15 bp, Homo sapiens
ctgggacgtggctca

SEQ ID NO: 6155229 - DNA, 18 bp, Homo sapiens
ctgggacgtggctcagcc

SEQ ID NO: 6155230 - DNA, 20 bp, Homo sapiens
ctgggacgtggctcagccag

SEQ ID NO: 6155231 - DNA, 22 bp, Homo sapiens
ctgggactaaagccaggaacag

SEQ ID NO: 6155232 - DNA, 13 bp, Homo sapiens
ctgggactacagg

SEQ ID NO: 6155233 - DNA, 16 bp, Homo sapiens
ctgggactacaggcac

SEQ ID NO: 6155234 - DNA, 16 bp, Homo sapiens
ctgggactacaggcgc

SEQ ID NO: 6155235 - DNA, 22 bp, Homo sapiens
ctgggactacaggctcatgcca

SEQ ID NO: 6155236 - DNA, 17 bp, Homo sapiens
ctgggactacaggtgtg

SEQ ID NO: 6155237 - DNA, 23 bp, Homo sapiens
ctgggactataggcatgcgccac

SEQ ID NO: 6155238 - DNA, 23 bp, Homo sapiens
ctgggactcagttcttggcctgc

SEQ ID NO: 6155239 - DNA, 15 bp, Homo sapiens
ctgggactccaggtc

SEQ ID NO: 6155240 - DNA, 19 bp, Homo sapiens
ctgggactcccagcagagc

SEQ ID NO: 6155241 - DNA, 13 bp, Homo sapiens
ctgggactcctgg

SEQ ID NO: 6155242 - DNA, 14 bp, Homo sapiens
ctgggactcctggt

SEQ ID NO: 6155243 - DNA, 16 bp, Homo sapiens
ctgggactctcctcct

SEQ ID NO: 6155244 - DNA, 21 bp, Homo sapiens
ctgggactctcctcctcccct

SEQ ID NO: 6155245 - DNA, 14 bp, Homo sapiens
ctgggactgagcca

SEQ ID NO: 6155246 - DNA, 15 bp, Homo sapiens
ctgggactgagccag

SEQ ID NO: 6155247 - DNA, 14 bp, Homo sapiens
ctgggactgcaggc

SEQ ID NO: 6155248 - DNA, 13 bp, Homo sapiens
ctgggactggcca

SEQ ID NO: 6155249 - DNA, 17 bp, Homo sapiens
ctgggactgtgcctggc

SEQ ID NO: 6155250 - DNA, 18 bp, Homo sapiens
ctgggactgtgcctggct

SEQ ID NO: 6155251 - DNA, 14 bp, Homo sapiens
ctgggacttccatg

SEQ ID NO: 6155252 - DNA, 19 bp, Homo sapiens
ctgggactttcccacccag

SEQ ID NO: 6155253 - DNA, 16 bp, Homo sapiens
ctgggagaaaagccag

SEQ ID NO: 6155254 - DNA, 15 bp, Homo sapiens
ctgggagaaagacca

SEQ ID NO: 6155255 - DNA, 18 bp, Homo sapiens
ctgggagaaatctggctt

SEQ ID NO: 6155256 - DNA, 21 bp, Homo sapiens
ctgggagaaatctggcttctg

SEQ ID NO: 6155257 - DNA, 17 bp, Homo sapiens
ctgggagaaatgaaaaa

SEQ ID NO: 6155258 - DNA, 12 bp, Homo sapiens
ctgggagaacct

SEQ ID NO: 6155259 - DNA, 16 bp, Homo sapiens
ctgggagaacctcagg

SEQ ID NO: 6155260 - DNA, 18 bp, Homo sapiens
ctgggagaacctcaggct

SEQ ID NO: 6155261 - DNA, 12 bp, Homo sapiens
ctgggagaagag

SEQ ID NO: 6155262 - DNA, 15 bp, Homo sapiens
ctgggagaaggtgct

SEQ ID NO: 6155263 - DNA, 19 bp, Homo sapiens
ctgggagaaggtgcttggg

SEQ ID NO: 6155264 - DNA, 13 bp, Homo sapiens
ctgggagagaagt

SEQ ID NO: 6155265 - DNA, 12 bp, Homo sapiens
ctgggagagcca

SEQ ID NO: 6155266 - DNA, 15 bp, Homo sapiens
ctgggagagccagct

SEQ ID NO: 6155267 - DNA, 12 bp, Homo sapiens
ctgggagagcct

SEQ ID NO: 6155268 - DNA, 15 bp, Homo sapiens
ctgggagagcctggc

SEQ ID NO: 6155269 - DNA, 19 bp, Homo sapiens
ctgggagagcctggcaagg

SEQ ID NO: 6155270 - DNA, 17 bp, Homo sapiens
ctgggagagccttccag

SEQ ID NO: 6155271 - DNA, 21 bp, Homo sapiens
ctgggagagccttccaggggt

SEQ ID NO: 6155272 - DNA, 14 bp, Homo sapiens
ctgggagaggcagc

SEQ ID NO: 6155273 - DNA, 15 bp, Homo sapiens
ctgggagaggcagcc

SEQ ID NO: 6155274 - DNA, 18 bp, Homo sapiens
ctgggagaggtgccagca

SEQ ID NO: 6155275 - DNA, 19 bp, Homo sapiens
ctgggagaggtgccagcaa

SEQ ID NO: 6155276 - DNA, 18 bp, Homo sapiens
ctgggagagtccttagcc

SEQ ID NO: 6155277 - DNA, 13 bp, Homo sapiens
ctgggagagtgag

SEQ ID NO: 6155278 - DNA, 14 bp, Homo sapiens
ctgggagagtgagg

SEQ ID NO: 6155279 - DNA, 14 bp, Homo sapiens
ctgggagatgcagc

SEQ ID NO: 6155280 - DNA, 18 bp, Homo sapiens
ctgggagatgcagctgga

SEQ ID NO: 6155281 - DNA, 20 bp, Homo sapiens
ctgggagatgctctctgagg

SEQ ID NO: 6155282 - DNA, 21 bp, Homo sapiens
ctgggagatgctctctgaggc

SEQ ID NO: 6155283 - DNA, 15 bp, Homo sapiens
ctgggagatgctggg

SEQ ID NO: 6155284 - DNA, 15 bp, Homo sapiens
ctgggagattcaagg

SEQ ID NO: 6155285 - DNA, 13 bp, Homo sapiens
ctgggagcagaaa

SEQ ID NO: 6155286 - DNA, 14 bp, Homo sapiens
ctgggagcagaaca

SEQ ID NO: 6155287 - DNA, 18 bp, Homo sapiens
ctgggagcatagcagagg

SEQ ID NO: 6155288 - DNA, 15 bp, Homo sapiens
ctgggagccacgcct

SEQ ID NO: 6155289 - DNA, 18 bp, Homo sapiens
ctgggagccacttctccc

SEQ ID NO: 6155290 - DNA, 13 bp, Homo sapiens
ctgggagccaggg

SEQ ID NO: 6155291 - DNA, 12 bp, Homo sapiens
ctgggagccagt

SEQ ID NO: 6155292 - DNA, 15 bp, Homo sapiens
ctgggagccagtcct

SEQ ID NO: 6155293 - DNA, 16 bp, Homo sapiens
ctgggagcccccagcc

SEQ ID NO: 6155294 - DNA, 20 bp, Homo sapiens
ctgggagcccccagcctgtc

SEQ ID NO: 6155295 - DNA, 21 bp, Homo sapiens
ctgggagcccccagcctgtca

SEQ ID NO: 6155296 - DNA, 18 bp, Homo sapiens
ctgggagccgcctgcttc

SEQ ID NO: 6155297 - DNA, 16 bp, Homo sapiens
ctgggagcctacccac

SEQ ID NO: 6155298 - DNA, 22 bp, Homo sapiens
ctgggagcctacccacccccag

SEQ ID NO: 6155299 - DNA, 21 bp, Homo sapiens
ctgggagctccactctgcttc

SEQ ID NO: 6155300 - DNA, 13 bp, Homo sapiens
ctgggagctctgc

SEQ ID NO: 6155301 - DNA, 15 bp, Homo sapiens
ctgggagcttccgct

SEQ ID NO: 6155302 - DNA, 18 bp, Homo sapiens
ctgggaggaaccgagggg

SEQ ID NO: 6155303 - DNA, 13 bp, Homo sapiens
ctgggaggaagca

SEQ ID NO: 6155304 - DNA, 14 bp, Homo sapiens
ctgggaggaagcag

SEQ ID NO: 6155305 - DNA, 14 bp, Homo sapiens
ctgggaggaaggac

SEQ ID NO: 6155306 - DNA, 23 bp, Homo sapiens
ctgggaggaagggatgggccccg

SEQ ID NO: 6155307 - DNA, 17 bp, Homo sapiens
ctgggaggaatggacag

SEQ ID NO: 6155308 - DNA, 12 bp, Homo sapiens
ctgggaggacag

SEQ ID NO: 6155309 - DNA, 15 bp, Homo sapiens
ctgggaggacaggca

SEQ ID NO: 6155310 - DNA, 19 bp, Homo sapiens
ctgggaggacaggcaggcc

SEQ ID NO: 6155311 - DNA, 21 bp, Homo sapiens
ctgggaggacaggcaggccag

SEQ ID NO: 6155312 - DNA, 15 bp, Homo sapiens
ctgggaggagcccct

SEQ ID NO: 6155313 - DNA, 18 bp, Homo sapiens
ctgggaggagcccctgga

SEQ ID NO: 6155314 - DNA, 14 bp, Homo sapiens
ctgggaggagggag

SEQ ID NO: 6155315 - DNA, 17 bp, Homo sapiens
ctgggaggagggagagg

SEQ ID NO: 6155316 - DNA, 15 bp, Homo sapiens
ctgggaggaggggga

SEQ ID NO: 6155317 - DNA, 17 bp, Homo sapiens
ctgggaggagggggagg

SEQ ID NO: 6155318 - DNA, 21 bp, Homo sapiens
ctgggaggatcctgagctgct

SEQ ID NO: 6155319 - DNA, 18 bp, Homo sapiens
ctgggaggatcctggaga

SEQ ID NO: 6155320 - DNA, 12 bp, Homo sapiens
ctgggaggcagg

SEQ ID NO: 6155321 - DNA, 19 bp, Homo sapiens
ctgggaggcagggctctcc

SEQ ID NO: 6155322 - DNA, 16 bp, Homo sapiens
ctgggaggcagtgatg

SEQ ID NO: 6155323 - DNA, 14 bp, Homo sapiens
ctgggaggccctgg

SEQ ID NO: 6155324 - DNA, 17 bp, Homo sapiens
ctgggaggccctggcag

SEQ ID NO: 6155325 - DNA, 18 bp, Homo sapiens
ctgggaggccctggcaga

SEQ ID NO: 6155326 - DNA, 16 bp, Homo sapiens
ctgggaggctcccctt

SEQ ID NO: 6155327 - DNA, 17 bp, Homo sapiens
ctgggaggctccccttc

SEQ ID NO: 6155328 - DNA, 16 bp, Homo sapiens
ctctgaaacagctgcc

SEQ ID NO: 6155329 - DNA, 18 bp, Homo sapiens
ctctgaaacagctgcctt

SEQ ID NO: 6155330 - DNA, 17 bp, Homo sapiens
ctctgaaagctgcttct

SEQ ID NO: 6155331 - DNA, 16 bp, Homo sapiens
ctctgaaagttgtaca

SEQ ID NO: 6155332 - DNA, 18 bp, Homo sapiens
ctctgaaagttgtacatg

SEQ ID NO: 6155333 - DNA, 22 bp, Homo sapiens
ctctgaaagttgtacatgaaat

SEQ ID NO: 6155334 - DNA, 16 bp, Homo sapiens
ctctgaaatctgaaga

SEQ ID NO: 6155335 - DNA, 15 bp, Homo sapiens
ctctgaaatcttccc

SEQ ID NO: 6155336 - DNA, 19 bp, Homo sapiens
ctctgaacacacacgccag

SEQ ID NO: 6155337 - DNA, 21 bp, Homo sapiens
ctctgaacacacacgccagct

SEQ ID NO: 6155338 - DNA, 14 bp, Homo sapiens
ctctgaacacaggc

SEQ ID NO: 6155339 - DNA, 16 bp, Homo sapiens
ctctgaacacaggcag

SEQ ID NO: 6155340 - DNA, 18 bp, Homo sapiens
ctctgaacacaggcagct

SEQ ID NO: 6155341 - DNA, 19 bp, Homo sapiens
ctctgaacacaggcagctt

SEQ ID NO: 6155342 - DNA, 22 bp, Homo sapiens
ctctgaacacaggcagctttct

SEQ ID NO: 6155343 - DNA, 12 bp, Homo sapiens
ctctgaacacat

SEQ ID NO: 6155344 - DNA, 15 bp, Homo sapiens
ctctgaactgctgct

SEQ ID NO: 6155345 - DNA, 16 bp, Homo sapiens
ctctgaactgctgctg

SEQ ID NO: 6155346 - DNA, 17 bp, Homo sapiens
ctctgaactgctgctgg

SEQ ID NO: 6155347 - DNA, 15 bp, Homo sapiens
ctctgaacttcagct

SEQ ID NO: 6155348 - DNA, 19 bp, Homo sapiens
ctctgaacttcagctagag

SEQ ID NO: 6155349 - DNA, 13 bp, Homo sapiens
ctctgaactttgg

SEQ ID NO: 6155350 - DNA, 19 bp, Homo sapiens
ctctgaagaactctctgga

SEQ ID NO: 6155351 - DNA, 23 bp, Homo sapiens
ctctgaagagaccttggctgctc

SEQ ID NO: 6155352 - DNA, 18 bp, Homo sapiens
ctctgaagagatacccac

SEQ ID NO: 6155353 - DNA, 23 bp, Homo sapiens
ctctgaagagtgggtttcacaag

SEQ ID NO: 6155354 - DNA, 18 bp, Homo sapiens
ctctgaagatgatcattt

SEQ ID NO: 6155355 - DNA, 18 bp, Homo sapiens
ctctgaagcaaggcggtg

SEQ ID NO: 6155356 - DNA, 23 bp, Homo sapiens
ctctgaagcaaggcggtggactt

SEQ ID NO: 6155357 - DNA, 14 bp, Homo sapiens
ctctgaagcatgtt

SEQ ID NO: 6155358 - DNA, 17 bp, Homo sapiens
ctctgaagcatgtttca

SEQ ID NO: 6155359 - DNA, 20 bp, Homo sapiens
ctctgaagcatgtttcatgt

SEQ ID NO: 6155360 - DNA, 17 bp, Homo sapiens
ctctgaagccacaaata

SEQ ID NO: 6155361 - DNA, 18 bp, Homo sapiens
ctctgaagcgtgatttta

SEQ ID NO: 6155362 - DNA, 19 bp, Homo sapiens
ctctgaagctaattgtact

SEQ ID NO: 6155363 - DNA, 15 bp, Homo sapiens
ctctgaaggacattg

SEQ ID NO: 6155364 - DNA, 22 bp, Homo sapiens
ctctgaaggacattgcggacag

SEQ ID NO: 6155365 - DNA, 15 bp, Homo sapiens
ctctgaaggaggcca

SEQ ID NO: 6155366 - DNA, 14 bp, Homo sapiens
ctctgaaggatcct

SEQ ID NO: 6155367 - DNA, 13 bp, Homo sapiens
ctctgaagggagg

SEQ ID NO: 6155368 - DNA, 13 bp, Homo sapiens
ctctgaagtcaca

SEQ ID NO: 6155369 - DNA, 17 bp, Homo sapiens
ctctgaagtcccttcct

SEQ ID NO: 6155370 - DNA, 24 bp, Homo sapiens
ctctgaagtcccttcctgtcctgc

SEQ ID NO: 6155371 - DNA, 16 bp, Homo sapiens
ctctgaagttggacag

SEQ ID NO: 6155372 - DNA, 22 bp, Homo sapiens
ctctgaataaatacccattgaa

SEQ ID NO: 6155373 - DNA, 22 bp, Homo sapiens
ctctgaatagttaaaaattaaa

SEQ ID NO: 6155374 - DNA, 12 bp, Homo sapiens
ctctgaatcaaa

SEQ ID NO: 6155375 - DNA, 23 bp, Homo sapiens
ctctgaatcaaaagctgaaattc

SEQ ID NO: 6155376 - DNA, 21 bp, Homo sapiens
ctctgaatctctcaaaatgtg

SEQ ID NO: 6155377 - DNA, 17 bp, Homo sapiens
ctctgaatgccccataa

SEQ ID NO: 6155378 - DNA, 19 bp, Homo sapiens
ctctgaatgctatttgtgt

SEQ ID NO: 6155379 - DNA, 16 bp, Homo sapiens
ctctgaatgggagcca

SEQ ID NO: 6155380 - DNA, 17 bp, Homo sapiens
ctctgaatgtcccagag

SEQ ID NO: 6155381 - DNA, 20 bp, Homo sapiens
ctctgaattagtccttgctt

SEQ ID NO: 6155382 - DNA, 21 bp, Homo sapiens
ctctgaattagtccttgcttg

SEQ ID NO: 6155383 - DNA, 21 bp, Homo sapiens
ctctgaatttacttccttgca

SEQ ID NO: 6155384 - DNA, 22 bp, Homo sapiens
ctctgaatttatctttgataac

SEQ ID NO: 6155385 - DNA, 14 bp, Homo sapiens
ctctgaattttaaa

SEQ ID NO: 6155386 - DNA, 15 bp, Homo sapiens
ctctgaattttcaga

SEQ ID NO: 6155387 - DNA, 15 bp, Homo sapiens
ctctgacaaagccca

SEQ ID NO: 6155388 - DNA, 13 bp, Homo sapiens
ctctgacaaagct

SEQ ID NO: 6155389 - DNA, 14 bp, Homo sapiens
ctctgacaaagtgg

SEQ ID NO: 6155390 - DNA, 14 bp, Homo sapiens
ctctgacaaagtgt

SEQ ID NO: 6155391 - DNA, 22 bp, Homo sapiens
ctctgacaacagacttctgaaa

SEQ ID NO: 6155392 - DNA, 19 bp, Homo sapiens
ctctgacaagctggccaaa

SEQ ID NO: 6155393 - DNA, 22 bp, Homo sapiens
ctctgacaagctggccaaagtc

SEQ ID NO: 6155394 - DNA, 23 bp, Homo sapiens
ctctgacaagctggccaaagtca

SEQ ID NO: 6155395 - DNA, 14 bp, Homo sapiens
ctctgacaagggct

SEQ ID NO: 6155396 - DNA, 16 bp, Homo sapiens
ctctgacaagggctga

SEQ ID NO: 6155397 - DNA, 14 bp, Homo sapiens
ctctgacacacagc

SEQ ID NO: 6155398 - DNA, 19 bp, Homo sapiens
ctctgacacacagctctgt

SEQ ID NO: 6155399 - DNA, 23 bp, Homo sapiens
ctctgacagattgacagggactt

SEQ ID NO: 6155400 - DNA, 12 bp, Homo sapiens
ctctgacagcag

SEQ ID NO: 6155401 - DNA, 19 bp, Homo sapiens
ctctgacagcagcctgtga

SEQ ID NO: 6155402 - DNA, 12 bp, Homo sapiens
ctctgacagctc

SEQ ID NO: 6155403 - DNA, 21 bp, Homo sapiens
ctctgacagctgtcctgagct

SEQ ID NO: 6155404 - DNA, 18 bp, Homo sapiens
ctctgacagtccacaggg

SEQ ID NO: 6155405 - DNA, 20 bp, Homo sapiens
ctctgacagtccacaggggc

SEQ ID NO: 6155406 - DNA, 17 bp, Homo sapiens
ctctgacataaacccat

SEQ ID NO: 6155407 - DNA, 22 bp, Homo sapiens
ctctgacataaacccatctgta

SEQ ID NO: 6155408 - DNA, 14 bp, Homo sapiens
ctctgacatccctt

SEQ ID NO: 6155409 - DNA, 18 bp, Homo sapiens
ctctgacatcccttcctg

SEQ ID NO: 6155410 - DNA, 19 bp, Homo sapiens
ctctgacatcccttcctgg

SEQ ID NO: 6155411 - DNA, 20 bp, Homo sapiens
ctctgaccacttgaggcctg

SEQ ID NO: 6155412 - DNA, 22 bp, Homo sapiens
ctctgaccagaagacaaaggcc

SEQ ID NO: 6155413 - DNA, 18 bp, Homo sapiens
ctctgacccacagcctcc

SEQ ID NO: 6155414 - DNA, 13 bp, Homo sapiens
ctctgacccctcc

SEQ ID NO: 6155415 - DNA, 14 bp, Homo sapiens
ctctgacccctcct

SEQ ID NO: 6155416 - DNA, 15 bp, Homo sapiens
ctctgacccctgcct

SEQ ID NO: 6155417 - DNA, 13 bp, Homo sapiens
ctctgaccctggg

SEQ ID NO: 6155418 - DNA, 22 bp, Homo sapiens
ctctgaccgaaacagcgctggg

SEQ ID NO: 6155419 - DNA, 18 bp, Homo sapiens
ctctgacctcctctgggc

SEQ ID NO: 6155420 - DNA, 23 bp, Homo sapiens
ctctgacctcctctgggccctgt

SEQ ID NO: 6155421 - DNA, 13 bp, Homo sapiens
ctctgacctctgc

SEQ ID NO: 6155422 - DNA, 14 bp, Homo sapiens
ctctgacctctgct

SEQ ID NO: 6155423 - DNA, 19 bp, Homo sapiens
ctctgacctctgctgagtg

SEQ ID NO: 6155424 - DNA, 15 bp, Homo sapiens
ctctgacctgcactg

SEQ ID NO: 6155425 - DNA, 23 bp, Homo sapiens
ctctgacctgcccccgctctgcc

SEQ ID NO: 6155426 - DNA, 19 bp, Homo sapiens
ctctgaccttccagagccc

SEQ ID NO: 6155427 - DNA, 21 bp, Homo sapiens
ctctgacgcaccactgccaat

SEQ ID NO: 6155428 - DNA, 21 bp, Homo sapiens
ctctgacgtagaaagatcctt

SEQ ID NO: 6155429 - DNA, 19 bp, Homo sapiens
ctctgactagtagatttct

SEQ ID NO: 6155430 - DNA, 14 bp, Homo sapiens
ctctgactcagggc

SEQ ID NO: 6155431 - DNA, 21 bp, Homo sapiens
ctctgactcagggctcctggg

SEQ ID NO: 6155432 - DNA, 14 bp, Homo sapiens
ctctgactctgagt

SEQ ID NO: 6155433 - DNA, 15 bp, Homo sapiens
ctctgactctgagtc

SEQ ID NO: 6155434 - DNA, 20 bp, Homo sapiens
ctctgacttaagcaaaagaa

SEQ ID NO: 6155435 - DNA, 22 bp, Homo sapiens
ctctgacttaagcaaaagaaaa

SEQ ID NO: 6155436 - DNA, 13 bp, Homo sapiens
ctctgacttctgc

SEQ ID NO: 6155437 - DNA, 18 bp, Homo sapiens
ctctgacttctgcctgga

SEQ ID NO: 6155438 - DNA, 22 bp, Homo sapiens
ctctgagaaccaaaagatgcct

SEQ ID NO: 6155439 - DNA, 13 bp, Homo sapiens
ctctgagaagaca

SEQ ID NO: 6155440 - DNA, 18 bp, Homo sapiens
ctctgagaagaggagccc

SEQ ID NO: 6155441 - DNA, 18 bp, Homo sapiens
ctctgagaagaggtcctt

SEQ ID NO: 6155442 - DNA, 13 bp, Homo sapiens
ctctgagacacac

SEQ ID NO: 6155443 - DNA, 16 bp, Homo sapiens
ctctgagaccaaaatt

SEQ ID NO: 6155444 - DNA, 18 bp, Homo sapiens
ctctgagactaaatgaga

SEQ ID NO: 6155445 - DNA, 23 bp, Homo sapiens
ctctgagactcgcgacaatgcaa

SEQ ID NO: 6155446 - DNA, 18 bp, Homo sapiens
ctctgagactctttagag

SEQ ID NO: 6155447 - DNA, 23 bp, Homo sapiens
ctctgagagcacagcgtttacat

SEQ ID NO: 6155448 - DNA, 23 bp, Homo sapiens
ctctgagagcatcaggcctagag

SEQ ID NO: 6155449 - DNA, 13 bp, Homo sapiens
ctctgagaggccc

SEQ ID NO: 6155450 - DNA, 15 bp, Homo sapiens
ctctgagaggccctg

SEQ ID NO: 6155451 - DNA, 13 bp, Homo sapiens
ctctgagagtcta

SEQ ID NO: 6155452 - DNA, 17 bp, Homo sapiens
ctctgagagtctagatt

SEQ ID NO: 6155453 - DNA, 18 bp, Homo sapiens
ctctgagagtctagattc

SEQ ID NO: 6155454 - DNA, 14 bp, Homo sapiens
ctctgagatgatgc

SEQ ID NO: 6155455 - DNA, 16 bp, Homo sapiens
ctctgagatgtggaga

SEQ ID NO: 6155456 - DNA, 17 bp, Homo sapiens
ctctgagatgtggagac

SEQ ID NO: 6155457 - DNA, 17 bp, Homo sapiens
ctctgagattctaagag

SEQ ID NO: 6155458 - DNA, 16 bp, Homo sapiens
ctctgagatttcacag

SEQ ID NO: 6155459 - DNA, 22 bp, Homo sapiens
ctctgagcagacagggcgtcct

SEQ ID NO: 6155460 - DNA, 21 bp, Homo sapiens
ctctgagcagcctctgccagg

SEQ ID NO: 6155461 - DNA, 18 bp, Homo sapiens
ctctgagcaggggcaggc

SEQ ID NO: 6155462 - DNA, 23 bp, Homo sapiens
ctctgagcatatgttccatgcct

SEQ ID NO: 6155463 - DNA, 13 bp, Homo sapiens
ctctgagccaagg

SEQ ID NO: 6155464 - DNA, 16 bp, Homo sapiens
ctctgagccaagggag

SEQ ID NO: 6155465 - DNA, 22 bp, Homo sapiens
ctctgagccaagggagggaagg

SEQ ID NO: 6155466 - DNA, 23 bp, Homo sapiens
ctctgagccaagggagggaaggg

SEQ ID NO: 6155467 - DNA, 14 bp, Homo sapiens
ctctgagccacaga

SEQ ID NO: 6155468 - DNA, 23 bp, Homo sapiens
ctctgagccaccgcgagggcctg

SEQ ID NO: 6155469 - DNA, 15 bp, Homo sapiens
ctctgagccactgga

SEQ ID NO: 6155470 - DNA, 14 bp, Homo sapiens
ctctgagccagatt

SEQ ID NO: 6155471 - DNA, 15 bp, Homo sapiens
ctctgagccagatta

SEQ ID NO: 6155472 - DNA, 19 bp, Homo sapiens
ctctgagccagattacagg

SEQ ID NO: 6155473 - DNA, 12 bp, Homo sapiens
ctctgagccagg

SEQ ID NO: 6155474 - DNA, 23 bp, Homo sapiens
ctctgagccaggagcctcctgac

SEQ ID NO: 6155475 - DNA, 14 bp, Homo sapiens
ctctgagcccaagc

SEQ ID NO: 6155476 - DNA, 12 bp, Homo sapiens
ctctgagcccag

SEQ ID NO: 6155477 - DNA, 19 bp, Homo sapiens
ctctgagcccagctgcctg

SEQ ID NO: 6155478 - DNA, 14 bp, Homo sapiens
ctctgagcccaggc

SEQ ID NO: 6155479 - DNA, 15 bp, Homo sapiens
ctctgagcccaggcc

SEQ ID NO: 6155480 - DNA, 16 bp, Homo sapiens
ctctgagcccaggccg

SEQ ID NO: 6155481 - DNA, 21 bp, Homo sapiens
ctctgagcccatgttctgccc

SEQ ID NO: 6155482 - DNA, 15 bp, Homo sapiens
ctctgagccccctgt

SEQ ID NO: 6155483 - DNA, 12 bp, Homo sapiens
ctctgagccctc

SEQ ID NO: 6155484 - DNA, 18 bp, Homo sapiens
ctctgagccgcagggcct

SEQ ID NO: 6155485 - DNA, 22 bp, Homo sapiens
ctctgagccgcagggcctgcta

SEQ ID NO: 6155486 - DNA, 13 bp, Homo sapiens
ctctgagcgcctc

SEQ ID NO: 6155487 - DNA, 14 bp, Homo sapiens
ctctgagctgctca

SEQ ID NO: 6155488 - DNA, 15 bp, Homo sapiens
ctctgagctgctcac

SEQ ID NO: 6155489 - DNA, 13 bp, Homo sapiens
ctctgagctgtca

SEQ ID NO: 6155490 - DNA, 15 bp, Homo sapiens
ctctgagctgtgcag

SEQ ID NO: 6155491 - DNA, 23 bp, Homo sapiens
ctctgagcttctaaactgaagct

SEQ ID NO: 6155492 - DNA, 17 bp, Homo sapiens
ctctgaggaagcagttg

SEQ ID NO: 6155493 - DNA, 18 bp, Homo sapiens
ctctgaggaagcagttgg

SEQ ID NO: 6155494 - DNA, 23 bp, Homo sapiens
ctctgaggaagcagttggggccc

SEQ ID NO: 6155495 - DNA, 14 bp, Homo sapiens
ctctgaggacacta

SEQ ID NO: 6155496 - DNA, 20 bp, Homo sapiens
ctctgaggacagaggccggg

SEQ ID NO: 6155497 - DNA, 15 bp, Homo sapiens
ctctgaggagcccac

SEQ ID NO: 6155498 - DNA, 16 bp, Homo sapiens
ctctgaggagcccacg

SEQ ID NO: 6155499 - DNA, 20 bp, Homo sapiens
ctctgaggagcccacggggc

SEQ ID NO: 6155500 - DNA, 19 bp, Homo sapiens
ctctgaggatgatgtactt

SEQ ID NO: 6155501 - DNA, 12 bp, Homo sapiens
ctctgaggcaag

SEQ ID NO: 6155502 - DNA, 17 bp, Homo sapiens
ctctgaggcaaggccca

SEQ ID NO: 6155503 - DNA, 18 bp, Homo sapiens
ctctgaggcaaggcccag

SEQ ID NO: 6155504 - DNA, 21 bp, Homo sapiens
ctctgaggcaaggcccagacc

SEQ ID NO: 6155505 - DNA, 13 bp, Homo sapiens
ctctgaggcactc

SEQ ID NO: 6155506 - DNA, 16 bp, Homo sapiens
ctgggaggctctggag

SEQ ID NO: 6155507 - DNA, 20 bp, Homo sapiens
ctgggaggctctggagccca

SEQ ID NO: 6155508 - DNA, 16 bp, Homo sapiens
ctgggaggctgcagcc

SEQ ID NO: 6155509 - DNA, 18 bp, Homo sapiens
ctgggaggctgcagccag

SEQ ID NO: 6155510 - DNA, 19 bp, Homo sapiens
ctgggaggctgcagccagg

SEQ ID NO: 6155511 - DNA, 23 bp, Homo sapiens
ctgggaggctgcagccaggcctc

SEQ ID NO: 6155512 - DNA, 22 bp, Homo sapiens
ctgggagggacatgcttagcag

SEQ ID NO: 6155513 - DNA, 13 bp, Homo sapiens
ctgggagggaggg

SEQ ID NO: 6155514 - DNA, 15 bp, Homo sapiens
ctgggagggaggggg

SEQ ID NO: 6155515 - DNA, 16 bp, Homo sapiens
ctgggagggaggggga

SEQ ID NO: 6155516 - DNA, 11 bp, Homo sapiens
ctgggagggca

SEQ ID NO: 6155517 - DNA, 13 bp, Homo sapiens
ctgggagggccca

SEQ ID NO: 6155518 - DNA, 15 bp, Homo sapiens
ctgggagggctgaac

SEQ ID NO: 6155519 - DNA, 20 bp, Homo sapiens
ctgggagggggacccgtgga

SEQ ID NO: 6155520 - DNA, 13 bp, Homo sapiens
ctgggagggggct

SEQ ID NO: 6155521 - DNA, 17 bp, Homo sapiens
ctgggaggggtgctgcc

SEQ ID NO: 6155522 - DNA, 19 bp, Homo sapiens
ctgggagggtggttcctgt

SEQ ID NO: 6155523 - DNA, 18 bp, Homo sapiens
ctgggagggttcccctgg

SEQ ID NO: 6155524 - DNA, 21 bp, Homo sapiens
ctgggagggttcccctggcct

SEQ ID NO: 6155525 - DNA, 22 bp, Homo sapiens
ctgggagggttcccctggcctt

SEQ ID NO: 6155526 - DNA, 15 bp, Homo sapiens
ctgggaggtagaagg

SEQ ID NO: 6155527 - DNA, 22 bp, Homo sapiens
ctgggaggtcccagggccctag

SEQ ID NO: 6155528 - DNA, 23 bp, Homo sapiens
ctgggaggtcccagggccctaga

SEQ ID NO: 6155529 - DNA, 20 bp, Homo sapiens
ctgggaggttaaaaagaaaa

SEQ ID NO: 6155530 - DNA, 22 bp, Homo sapiens
ctgggaggttgggaggctgtgg

SEQ ID NO: 6155531 - DNA, 21 bp, Homo sapiens
ctgggaggttggtttaatgca

SEQ ID NO: 6155532 - DNA, 21 bp, Homo sapiens
ctgggagtagttgtctttcct

SEQ ID NO: 6155533 - DNA, 18 bp, Homo sapiens
ctgggagtcagagccctg

SEQ ID NO: 6155534 - DNA, 17 bp, Homo sapiens
ctgggagtcaggcccgg

SEQ ID NO: 6155535 - DNA, 18 bp, Homo sapiens
ctgggagtcctgtcagct

SEQ ID NO: 6155536 - DNA, 18 bp, Homo sapiens
ctgggagtccttacctcg

SEQ ID NO: 6155537 - DNA, 19 bp, Homo sapiens
ctgggagtggaagaaggga

SEQ ID NO: 6155538 - DNA, 21 bp, Homo sapiens
ctgggagtgtccttagtgtat

SEQ ID NO: 6155539 - DNA, 15 bp, Homo sapiens
ctgggagtgtgggct

SEQ ID NO: 6155540 - DNA, 17 bp, Homo sapiens
ctgggagtgtgggctgc

SEQ ID NO: 6155541 - DNA, 16 bp, Homo sapiens
ctgggagtgtgtggtg

SEQ ID NO: 6155542 - DNA, 22 bp, Homo sapiens
ctgggagtgttcccgtgcctgg

SEQ ID NO: 6155543 - DNA, 15 bp, Homo sapiens
ctgggagtgttctgt

SEQ ID NO: 6155544 - DNA, 18 bp, Homo sapiens
ctgggagttttgattgca

SEQ ID NO: 6155545 - DNA, 22 bp, Homo sapiens
ctgggataactggccagccata

SEQ ID NO: 6155546 - DNA, 22 bp, Homo sapiens
ctgggatagtttgggggaactt

SEQ ID NO: 6155547 - DNA, 22 bp, Homo sapiens
ctgggatatatggaggattctt

SEQ ID NO: 6155548 - DNA, 15 bp, Homo sapiens
ctgggatatggctgc

SEQ ID NO: 6155549 - DNA, 18 bp, Homo sapiens
ctgggatatggctgccca

SEQ ID NO: 6155550 - DNA, 20 bp, Homo sapiens
ctgggatatggctgcccagg

SEQ ID NO: 6155551 - DNA, 21 bp, Homo sapiens
ctgggatatggctgcccagga

SEQ ID NO: 6155552 - DNA, 22 bp, Homo sapiens
ctgggatatggctgcccaggag

SEQ ID NO: 6155553 - DNA, 22 bp, Homo sapiens
ctgggatcacaggtgtcagcca

SEQ ID NO: 6155554 - DNA, 20 bp, Homo sapiens
ctgggatcacatgtggactt

SEQ ID NO: 6155555 - DNA, 15 bp, Homo sapiens
ctgggatcagtgggg

SEQ ID NO: 6155556 - DNA, 21 bp, Homo sapiens
ctgggatccgagggcccctct

SEQ ID NO: 6155557 - DNA, 13 bp, Homo sapiens
ctgggatcctaag

SEQ ID NO: 6155558 - DNA, 20 bp, Homo sapiens
ctgggatcctgactaagcct

SEQ ID NO: 6155559 - DNA, 22 bp, Homo sapiens
ctgggatcctgactaagccttt

SEQ ID NO: 6155560 - DNA, 22 bp, Homo sapiens
ctgggatcggggtggggacagg

SEQ ID NO: 6155561 - DNA, 21 bp, Homo sapiens
ctgggatctggcacactccct

SEQ ID NO: 6155562 - DNA, 15 bp, Homo sapiens
ctgggatctggtggt

SEQ ID NO: 6155563 - DNA, 19 bp, Homo sapiens
ctgggatctgttttctgga

SEQ ID NO: 6155564 - DNA, 21 bp, Homo sapiens
ctgggatctgttttctggaag

SEQ ID NO: 6155565 - DNA, 22 bp, Homo sapiens
ctgggatctgttttctggaagt

SEQ ID NO: 6155566 - DNA, 17 bp, Homo sapiens
ctgggatgacaggtgtg

SEQ ID NO: 6155567 - DNA, 21 bp, Homo sapiens
ctgggatgacaggtgtgagcc

SEQ ID NO: 6155568 - DNA, 23 bp, Homo sapiens
ctgggatgacaggtgtgagccac

SEQ ID NO: 6155569 - DNA, 22 bp, Homo sapiens
ctgggatgagccgctgtgagcc

SEQ ID NO: 6155570 - DNA, 21 bp, Homo sapiens
ctgggatgaggggtgctgggt

SEQ ID NO: 6155571 - DNA, 24 bp, Homo sapiens
ctgggatgataataatgcctacct

SEQ ID NO: 6155572 - DNA, 17 bp, Homo sapiens
ctgggatgcaggcatgc

SEQ ID NO: 6155573 - DNA, 14 bp, Homo sapiens
ctgggatgcagtga

SEQ ID NO: 6155574 - DNA, 15 bp, Homo sapiens
ctgggatgcctcacc

SEQ ID NO: 6155575 - DNA, 18 bp, Homo sapiens
ctgggatgctagccccag

SEQ ID NO: 6155576 - DNA, 20 bp, Homo sapiens
ctgggatgctagccccagag

SEQ ID NO: 6155577 - DNA, 22 bp, Homo sapiens
ctgggatgctagccccagagat

SEQ ID NO: 6155578 - DNA, 16 bp, Homo sapiens
ctgggatgctgaccca

SEQ ID NO: 6155579 - DNA, 18 bp, Homo sapiens
ctgggatgctgacccagg

SEQ ID NO: 6155580 - DNA, 17 bp, Homo sapiens
ctgggatggaacctcag

SEQ ID NO: 6155581 - DNA, 18 bp, Homo sapiens
ctgggatggacaggaaag

SEQ ID NO: 6155582 - DNA, 23 bp, Homo sapiens
ctgggatggacgctgccgggaga

SEQ ID NO: 6155583 - DNA, 19 bp, Homo sapiens
ctgggatgggaccagggat

SEQ ID NO: 6155584 - DNA, 20 bp, Homo sapiens
ctgggatgggaccagggatg

SEQ ID NO: 6155585 - DNA, 14 bp, Homo sapiens
ctgggatgtagaac

SEQ ID NO: 6155586 - DNA, 14 bp, Homo sapiens
ctgggatgtccaca

SEQ ID NO: 6155587 - DNA, 21 bp, Homo sapiens
ctgggatgtggtattggtgct

SEQ ID NO: 6155588 - DNA, 22 bp, Homo sapiens
ctgggatgtggtattggtgctt

SEQ ID NO: 6155589 - DNA, 19 bp, Homo sapiens
ctgggatgtttctgtcaca

SEQ ID NO: 6155590 - DNA, 14 bp, Homo sapiens
ctgggattaagaaa

SEQ ID NO: 6155591 - DNA, 20 bp, Homo sapiens
ctgggattaaggcgtgagcc

SEQ ID NO: 6155592 - DNA, 18 bp, Homo sapiens
ctgggattacagacatga

SEQ ID NO: 6155593 - DNA, 20 bp, Homo sapiens
ctgggattacagacatgagc

SEQ ID NO: 6155594 - DNA, 13 bp, Homo sapiens
ctgggattacagg

SEQ ID NO: 6155595 - DNA, 22 bp, Homo sapiens
ctgggattacaggcatgtgcca

SEQ ID NO: 6155596 - DNA, 15 bp, Homo sapiens
ctgggattacaggct

SEQ ID NO: 6155597 - DNA, 21 bp, Homo sapiens
ctgggattacaggctcctgcc

SEQ ID NO: 6155598 - DNA, 22 bp, Homo sapiens
ctgggattacaggctcctgcca

SEQ ID NO: 6155599 - DNA, 23 bp, Homo sapiens
ctgggattacaggctcctgccac

SEQ ID NO: 6155600 - DNA, 16 bp, Homo sapiens
ctgggattacaggtgt

SEQ ID NO: 6155601 - DNA, 17 bp, Homo sapiens
ctgggattacaggtgtg

SEQ ID NO: 6155602 - DNA, 17 bp, Homo sapiens
ctgggattataggcatg

SEQ ID NO: 6155603 - DNA, 22 bp, Homo sapiens
ctgggattatataggcatgagc

SEQ ID NO: 6155604 - DNA, 14 bp, Homo sapiens
ctgggattattctt

SEQ ID NO: 6155605 - DNA, 23 bp, Homo sapiens
ctgggattcaggaaaaggcctgg

SEQ ID NO: 6155606 - DNA, 23 bp, Homo sapiens
ctgggattccttagactcttttc

SEQ ID NO: 6155607 - DNA, 21 bp, Homo sapiens
ctgggattggctgtgaactga

SEQ ID NO: 6155608 - DNA, 19 bp, Homo sapiens
ctgggattgtgggcatgag

SEQ ID NO: 6155609 - DNA, 17 bp, Homo sapiens
ctgggatttacacttga

SEQ ID NO: 6155610 - DNA, 15 bp, Homo sapiens
ctgggcaaacagagc

SEQ ID NO: 6155611 - DNA, 18 bp, Homo sapiens
ctgggcaaacccttctct

SEQ ID NO: 6155612 - DNA, 19 bp, Homo sapiens
ctgggcaaacccttctctt

SEQ ID NO: 6155613 - DNA, 22 bp, Homo sapiens
ctgggcaaacccttctcttctc

SEQ ID NO: 6155614 - DNA, 18 bp, Homo sapiens
ctgggcaacactgcagga

SEQ ID NO: 6155615 - DNA, 16 bp, Homo sapiens
ctgggcaacagagcaa

SEQ ID NO: 6155616 - DNA, 22 bp, Homo sapiens
ctgggcaacatagtgagaccct

SEQ ID NO: 6155617 - DNA, 16 bp, Homo sapiens
ctgggcaagagatggg

SEQ ID NO: 6155618 - DNA, 19 bp, Homo sapiens
ctgggcaagagatgggaca

SEQ ID NO: 6155619 - DNA, 16 bp, Homo sapiens
ctgggcaagaggaaaa

SEQ ID NO: 6155620 - DNA, 22 bp, Homo sapiens
ctgggcaaggaaaaagaaaata

SEQ ID NO: 6155621 - DNA, 15 bp, Homo sapiens
ctgggcaaggtgagg

SEQ ID NO: 6155622 - DNA, 16 bp, Homo sapiens
ctgggcaaggtgaggg

SEQ ID NO: 6155623 - DNA, 17 bp, Homo sapiens
ctgggcaaggtgggtga

SEQ ID NO: 6155624 - DNA, 21 bp, Homo sapiens
ctgggcaagtggatggcccag

SEQ ID NO: 6155625 - DNA, 18 bp, Homo sapiens
ctgggcaatgaaaccaaa

SEQ ID NO: 6155626 - DNA, 17 bp, Homo sapiens
ctgggcaatgaggcaga

SEQ ID NO: 6155627 - DNA, 17 bp, Homo sapiens
ctgggcaatgcagtgca

SEQ ID NO: 6155628 - DNA, 21 bp, Homo sapiens
ctgggcaatggccaggggcca

SEQ ID NO: 6155629 - DNA, 13 bp, Homo sapiens
ctgggcacaaaca

SEQ ID NO: 6155630 - DNA, 20 bp, Homo sapiens
ctgggcacaagcagggcact

SEQ ID NO: 6155631 - DNA, 22 bp, Homo sapiens
ctgggcacacgcctcccactgg

SEQ ID NO: 6155632 - DNA, 17 bp, Homo sapiens
ctgggcacactctgcca

SEQ ID NO: 6155633 - DNA, 17 bp, Homo sapiens
ctgggcacagattgaag

SEQ ID NO: 6155634 - DNA, 21 bp, Homo sapiens
ctgggcacagattgaagaatc

SEQ ID NO: 6155635 - DNA, 15 bp, Homo sapiens
ctgggcacaggccgt

SEQ ID NO: 6155636 - DNA, 14 bp, Homo sapiens
ctgggcacagtgct

SEQ ID NO: 6155637 - DNA, 17 bp, Homo sapiens
ctgggcacagtgctgcc

SEQ ID NO: 6155638 - DNA, 19 bp, Homo sapiens
ctgggcacagtgctgcccc

SEQ ID NO: 6155639 - DNA, 20 bp, Homo sapiens
ctgggcacagtgctgcccct

SEQ ID NO: 6155640 - DNA, 15 bp, Homo sapiens
ctgggcacagtgggc

SEQ ID NO: 6155641 - DNA, 22 bp, Homo sapiens
ctgggcacagtgggcctgtgtg

SEQ ID NO: 6155642 - DNA, 23 bp, Homo sapiens
ctgggcacagtgggcctgtgtgt

SEQ ID NO: 6155643 - DNA, 17 bp, Homo sapiens
ctgggcaccagcatttg

SEQ ID NO: 6155644 - DNA, 22 bp, Homo sapiens
ctgggcaccccaggcagctcct

SEQ ID NO: 6155645 - DNA, 14 bp, Homo sapiens
ctgggcacccctgc

SEQ ID NO: 6155646 - DNA, 15 bp, Homo sapiens
ctgggcacccctgcc

SEQ ID NO: 6155647 - DNA, 21 bp, Homo sapiens
ctgggcacccctgcctcctgc

SEQ ID NO: 6155648 - DNA, 22 bp, Homo sapiens
ctgggcaccctgcaggcaggca

SEQ ID NO: 6155649 - DNA, 23 bp, Homo sapiens
ctgggcaccctgcaggcaggcag

SEQ ID NO: 6155650 - DNA, 19 bp, Homo sapiens
ctgggcaccgggaccccct

SEQ ID NO: 6155651 - DNA, 20 bp, Homo sapiens
ctgggcaccgtgtcctcctc

SEQ ID NO: 6155652 - DNA, 22 bp, Homo sapiens
ctgggcaccgtgtcctcctctg

SEQ ID NO: 6155653 - DNA, 17 bp, Homo sapiens
ctgggcacctctagtgc

SEQ ID NO: 6155654 - DNA, 17 bp, Homo sapiens
ctgggcacctgcgcaca

SEQ ID NO: 6155655 - DNA, 20 bp, Homo sapiens
ctgggcacctgcgcacaggt

SEQ ID NO: 6155656 - DNA, 21 bp, Homo sapiens
ctgggcacctgcgcacaggtg

SEQ ID NO: 6155657 - DNA, 22 bp, Homo sapiens
ctgggcacctgcgcacaggtgg

SEQ ID NO: 6155658 - DNA, 19 bp, Homo sapiens
ctgggcacctggggagtgg

SEQ ID NO: 6155659 - DNA, 20 bp, Homo sapiens
ctgggcacctggggagtggg

SEQ ID NO: 6155660 - DNA, 16 bp, Homo sapiens
ctgggcacgcctgctg

SEQ ID NO: 6155661 - DNA, 17 bp, Homo sapiens
ctgggcactagctagat

SEQ ID NO: 6155662 - DNA, 21 bp, Homo sapiens
ctgggcactagctagatgctt

SEQ ID NO: 6155663 - DNA, 14 bp, Homo sapiens
ctgggcactgctcc

SEQ ID NO: 6155664 - DNA, 22 bp, Homo sapiens
ctgggcactgctccaagggaca

SEQ ID NO: 6155665 - DNA, 17 bp, Homo sapiens
ctgggcactgctctcac

SEQ ID NO: 6155666 - DNA, 18 bp, Homo sapiens
ctgggcactgggcactag

SEQ ID NO: 6155667 - DNA, 14 bp, Homo sapiens
ctgggcactggggc

SEQ ID NO: 6155668 - DNA, 12 bp, Homo sapiens
ctgggcacttcc

SEQ ID NO: 6155669 - DNA, 22 bp, Homo sapiens
ctgggcacttccctgctgcctg

SEQ ID NO: 6155670 - DNA, 17 bp, Homo sapiens
ctgggcagaaggccaag

SEQ ID NO: 6155671 - DNA, 16 bp, Homo sapiens
ctgggcagacaggtgg

SEQ ID NO: 6155672 - DNA, 17 bp, Homo sapiens
ctgggcagagcctgtcc

SEQ ID NO: 6155673 - DNA, 18 bp, Homo sapiens
ctgggcagagcctgtccc

SEQ ID NO: 6155674 - DNA, 12 bp, Homo sapiens
ctgggcagagga

SEQ ID NO: 6155675 - DNA, 13 bp, Homo sapiens
ctgggcagaggaa

SEQ ID NO: 6155676 - DNA, 14 bp, Homo sapiens
ctgggcagagggga

SEQ ID NO: 6155677 - DNA, 18 bp, Homo sapiens
ctgggcagaggggagagg

SEQ ID NO: 6155678 - DNA, 23 bp, Homo sapiens
ctgggcagaggggagaggaagca

SEQ ID NO: 6155679 - DNA, 19 bp, Homo sapiens
ctgggcagatgaaaagcta

SEQ ID NO: 6155680 - DNA, 13 bp, Homo sapiens
ctctgaggccagc

SEQ ID NO: 6155681 - DNA, 14 bp, Homo sapiens
ctctgaggccagcc

SEQ ID NO: 6155682 - DNA, 19 bp, Homo sapiens
ctctgaggccagcctggcc

SEQ ID NO: 6155683 - DNA, 14 bp, Homo sapiens
ctctgaggcctcac

SEQ ID NO: 6155684 - DNA, 15 bp, Homo sapiens
ctctgaggcctcact

SEQ ID NO: 6155685 - DNA, 10 bp, Homo sapiens
ctctgaggcg

SEQ ID NO: 6155686 - DNA, 19 bp, Homo sapiens
ctctgaggcgccccaaccc

SEQ ID NO: 6155687 - DNA, 15 bp, Homo sapiens
ctctgaggctcagcc

SEQ ID NO: 6155688 - DNA, 18 bp, Homo sapiens
ctctgaggcttccagaga

SEQ ID NO: 6155689 - DNA, 17 bp, Homo sapiens
ctctgagggagaggctg

SEQ ID NO: 6155690 - DNA, 12 bp, Homo sapiens
ctctgagggctt

SEQ ID NO: 6155691 - DNA, 13 bp, Homo sapiens
ctctgagggcttc

SEQ ID NO: 6155692 - DNA, 20 bp, Homo sapiens
ctctgaggggaggcacctcc

SEQ ID NO: 6155693 - DNA, 16 bp, Homo sapiens
ctctgaggggaggggg

SEQ ID NO: 6155694 - DNA, 13 bp, Homo sapiens
ctctgaggggcac

SEQ ID NO: 6155695 - DNA, 22 bp, Homo sapiens
ctctgagggtgatggggctgag

SEQ ID NO: 6155696 - DNA, 19 bp, Homo sapiens
ctctgaggtcaataaagca

SEQ ID NO: 6155697 - DNA, 16 bp, Homo sapiens
ctctgaggtctcacct

SEQ ID NO: 6155698 - DNA, 21 bp, Homo sapiens
ctctgaggtctcaccttcgcc

SEQ ID NO: 6155699 - DNA, 15 bp, Homo sapiens
ctctgaggtgcctgt

SEQ ID NO: 6155700 - DNA, 19 bp, Homo sapiens
ctctgaggtgcctgtccca

SEQ ID NO: 6155701 - DNA, 14 bp, Homo sapiens
ctctgagtagcttt

SEQ ID NO: 6155702 - DNA, 22 bp, Homo sapiens
ctctgagtagggcaatggaaat

SEQ ID NO: 6155703 - DNA, 18 bp, Homo sapiens
ctctgagtcaaatccagt

SEQ ID NO: 6155704 - DNA, 20 bp, Homo sapiens
ctctgagtcaaatccagtgg

SEQ ID NO: 6155705 - DNA, 23 bp, Homo sapiens
ctctgagtcagctgaccccctcc

SEQ ID NO: 6155706 - DNA, 13 bp, Homo sapiens
ctctgagtcctca

SEQ ID NO: 6155707 - DNA, 14 bp, Homo sapiens
ctctgagtcctcat

SEQ ID NO: 6155708 - DNA, 16 bp, Homo sapiens
ctctgagtctctgaat

SEQ ID NO: 6155709 - DNA, 18 bp, Homo sapiens
ctctgagtctggactttg

SEQ ID NO: 6155710 - DNA, 15 bp, Homo sapiens
ctctgagtggaggaa

SEQ ID NO: 6155711 - DNA, 18 bp, Homo sapiens
ctctgagtggtggttcct

SEQ ID NO: 6155712 - DNA, 15 bp, Homo sapiens
ctctgagtgtctctg

SEQ ID NO: 6155713 - DNA, 18 bp, Homo sapiens
ctctgagtgtctctgcct

SEQ ID NO: 6155714 - DNA, 19 bp, Homo sapiens
ctctgagtgttttatgaga

SEQ ID NO: 6155715 - DNA, 13 bp, Homo sapiens
ctctgagttctgg

SEQ ID NO: 6155716 - DNA, 17 bp, Homo sapiens
ctctgagtttaccattt

SEQ ID NO: 6155717 - DNA, 22 bp, Homo sapiens
ctctgatacacagtaattgtga

SEQ ID NO: 6155718 - DNA, 15 bp, Homo sapiens
ctctgatacagaaaa

SEQ ID NO: 6155719 - DNA, 15 bp, Homo sapiens
ctctgataggccaag

SEQ ID NO: 6155720 - DNA, 14 bp, Homo sapiens
ctctgatatgggac

SEQ ID NO: 6155721 - DNA, 19 bp, Homo sapiens
ctctgatcacaacttttct

SEQ ID NO: 6155722 - DNA, 17 bp, Homo sapiens
ctctgatcacatcccct

SEQ ID NO: 6155723 - DNA, 17 bp, Homo sapiens
ctctgatccttcttcct

SEQ ID NO: 6155724 - DNA, 15 bp, Homo sapiens
ctctgatctgtgcag

SEQ ID NO: 6155725 - DNA, 11 bp, Homo sapiens
ctctgatgcag

SEQ ID NO: 6155726 - DNA, 14 bp, Homo sapiens
ctctgatgcagaaa

SEQ ID NO: 6155727 - DNA, 14 bp, Homo sapiens
ctctgatgcagctt

SEQ ID NO: 6155728 - DNA, 15 bp, Homo sapiens
ctctgatgcatcaga

SEQ ID NO: 6155729 - DNA, 16 bp, Homo sapiens
ctctgatggcactttt

SEQ ID NO: 6155730 - DNA, 19 bp, Homo sapiens
ctctgatggcacttttgag

SEQ ID NO: 6155731 - DNA, 22 bp, Homo sapiens
ctctgatggttcttcacctcct

SEQ ID NO: 6155732 - DNA, 16 bp, Homo sapiens
ctctgatgtattttgt

SEQ ID NO: 6155733 - DNA, 14 bp, Homo sapiens
ctctgatgtcccag

SEQ ID NO: 6155734 - DNA, 17 bp, Homo sapiens
ctctgattagaaaggaa

SEQ ID NO: 6155735 - DNA, 21 bp, Homo sapiens
ctctgattagttgacagtatt

SEQ ID NO: 6155736 - DNA, 23 bp, Homo sapiens
ctctgattagttgacagtattaa

SEQ ID NO: 6155737 - DNA, 19 bp, Homo sapiens
ctctgattcacctcttcct

SEQ ID NO: 6155738 - DNA, 22 bp, Homo sapiens
ctctgattcacctcttcctctg

SEQ ID NO: 6155739 - DNA, 14 bp, Homo sapiens
ctctgattctatgt

SEQ ID NO: 6155740 - DNA, 16 bp, Homo sapiens
ctctgattctatgtaa

SEQ ID NO: 6155741 - DNA, 19 bp, Homo sapiens
ctctgattggaatttctgg

SEQ ID NO: 6155742 - DNA, 15 bp, Homo sapiens
ctctgattggctgga

SEQ ID NO: 6155743 - DNA, 21 bp, Homo sapiens
ctctgattgggtcagctggct

SEQ ID NO: 6155744 - DNA, 15 bp, Homo sapiens
ctctgatttccttcc

SEQ ID NO: 6155745 - DNA, 18 bp, Homo sapiens
ctctgatttgcaaaaaaa

SEQ ID NO: 6155746 - DNA, 15 bp, Homo sapiens
ctctgattttcaaag

SEQ ID NO: 6155747 - DNA, 15 bp, Homo sapiens
ctctgcaaactgcct

SEQ ID NO: 6155748 - DNA, 20 bp, Homo sapiens
ctctgcaaagactagatcct

SEQ ID NO: 6155749 - DNA, 21 bp, Homo sapiens
ctctgcaaagatgattttgct

SEQ ID NO: 6155750 - DNA, 18 bp, Homo sapiens
ctctgcaaaggcctgggc

SEQ ID NO: 6155751 - DNA, 21 bp, Homo sapiens
ctctgcaactgaatacttgaa

SEQ ID NO: 6155752 - DNA, 15 bp, Homo sapiens
ctctgcaactgcaag

SEQ ID NO: 6155753 - DNA, 19 bp, Homo sapiens
ctctgcaactgcaagaaag

SEQ ID NO: 6155754 - DNA, 17 bp, Homo sapiens
ctctgcaagaagaaatc

SEQ ID NO: 6155755 - DNA, 17 bp, Homo sapiens
ctctgcaagagggggca

SEQ ID NO: 6155756 - DNA, 16 bp, Homo sapiens
ctctgcaagtgctcag

SEQ ID NO: 6155757 - DNA, 18 bp, Homo sapiens
ctctgcaagtgctcaggg

SEQ ID NO: 6155758 - DNA, 22 bp, Homo sapiens
ctctgcaagtgctcagggaaat

SEQ ID NO: 6155759 - DNA, 17 bp, Homo sapiens
ctctgcaagtgtctgga

SEQ ID NO: 6155760 - DNA, 17 bp, Homo sapiens
ctctgcaatcttctcag

SEQ ID NO: 6155761 - DNA, 12 bp, Homo sapiens
ctctgcaatgct

SEQ ID NO: 6155762 - DNA, 13 bp, Homo sapiens
ctctgcaatgctt

SEQ ID NO: 6155763 - DNA, 20 bp, Homo sapiens
ctctgcaatgcttctgtagc

SEQ ID NO: 6155764 - DNA, 22 bp, Homo sapiens
ctctgcaatgcttctgtagctt

SEQ ID NO: 6155765 - DNA, 17 bp, Homo sapiens
ctctgcaatgggcactg

SEQ ID NO: 6155766 - DNA, 16 bp, Homo sapiens
ctctgcaattcccctc

SEQ ID NO: 6155767 - DNA, 17 bp, Homo sapiens
ctctgcaattcccctct

SEQ ID NO: 6155768 - DNA, 19 bp, Homo sapiens
ctctgcaattcccctctgc

SEQ ID NO: 6155769 - DNA, 21 bp, Homo sapiens
ctctgcaattcccctctgctg

SEQ ID NO: 6155770 - DNA, 22 bp, Homo sapiens
ctctgcaattcccctctgctgc

SEQ ID NO: 6155771 - DNA, 23 bp, Homo sapiens
ctctgcaattcccctctgctgct

SEQ ID NO: 6155772 - DNA, 20 bp, Homo sapiens
ctctgcaattttactgtgaa

SEQ ID NO: 6155773 - DNA, 17 bp, Homo sapiens
ctctgcacaagctgcac

SEQ ID NO: 6155774 - DNA, 19 bp, Homo sapiens
ctctgcacaagctgcaccc

SEQ ID NO: 6155775 - DNA, 20 bp, Homo sapiens
ctctgcacaagctgcaccct

SEQ ID NO: 6155776 - DNA, 21 bp, Homo sapiens
ctctgcacaagctgcaccctc

SEQ ID NO: 6155777 - DNA, 20 bp, Homo sapiens
ctctgcacaccctccagaga

SEQ ID NO: 6155778 - DNA, 16 bp, Homo sapiens
ctctgcacagacaagc

SEQ ID NO: 6155779 - DNA, 15 bp, Homo sapiens
ctctgcacatgtctt

SEQ ID NO: 6155780 - DNA, 16 bp, Homo sapiens
ctctgcacatgtcttg

SEQ ID NO: 6155781 - DNA, 18 bp, Homo sapiens
ctctgcacatgtcttgta

SEQ ID NO: 6155782 - DNA, 17 bp, Homo sapiens
ctctgcacccacgtgca

SEQ ID NO: 6155783 - DNA, 17 bp, Homo sapiens
ctctgcacccagaacag

SEQ ID NO: 6155784 - DNA, 21 bp, Homo sapiens
ctctgcacctgtaggatattg

SEQ ID NO: 6155785 - DNA, 23 bp, Homo sapiens
ctctgcacgtgcacacacctgca

SEQ ID NO: 6155786 - DNA, 14 bp, Homo sapiens
ctctgcactaagag

SEQ ID NO: 6155787 - DNA, 15 bp, Homo sapiens
ctctgcactactcct

SEQ ID NO: 6155788 - DNA, 23 bp, Homo sapiens
ctctgcactactcctctgcagtg

SEQ ID NO: 6155789 - DNA, 16 bp, Homo sapiens
ctctgcactactgaca

SEQ ID NO: 6155790 - DNA, 22 bp, Homo sapiens
ctctgcactactgacatgtggg

SEQ ID NO: 6155791 - DNA, 20 bp, Homo sapiens
ctctgcactccatggccacc

SEQ ID NO: 6155792 - DNA, 20 bp, Homo sapiens
ctctgcactcccacctgaca

SEQ ID NO: 6155793 - DNA, 23 bp, Homo sapiens
ctctgcactcccacctgacacac

SEQ ID NO: 6155794 - DNA, 14 bp, Homo sapiens
ctctgcactcccct

SEQ ID NO: 6155795 - DNA, 15 bp, Homo sapiens
ctctgcactcccctg

SEQ ID NO: 6155796 - DNA, 20 bp, Homo sapiens
ctctgcactcccctgctggg

SEQ ID NO: 6155797 - DNA, 14 bp, Homo sapiens
ctctgcagaacagt

SEQ ID NO: 6155798 - DNA, 18 bp, Homo sapiens
ctctgcagacttcccagc

SEQ ID NO: 6155799 - DNA, 19 bp, Homo sapiens
ctctgcagacttcccagct

SEQ ID NO: 6155800 - DNA, 19 bp, Homo sapiens
ctctgcagatagtgcctct

SEQ ID NO: 6155801 - DNA, 22 bp, Homo sapiens
ctctgcagatagtgcctctgca

SEQ ID NO: 6155802 - DNA, 18 bp, Homo sapiens
ctctgcagcaataaagca

SEQ ID NO: 6155803 - DNA, 13 bp, Homo sapiens
ctctgcagcacat

SEQ ID NO: 6155804 - DNA, 13 bp, Homo sapiens
ctctgcagccagc

SEQ ID NO: 6155805 - DNA, 16 bp, Homo sapiens
ctctgcagccagccca

SEQ ID NO: 6155806 - DNA, 11 bp, Homo sapiens
ctctgcagccc

SEQ ID NO: 6155807 - DNA, 22 bp, Homo sapiens
ctctgcagcccacagaggacag

SEQ ID NO: 6155808 - DNA, 13 bp, Homo sapiens
ctctgcagcccag

SEQ ID NO: 6155809 - DNA, 14 bp, Homo sapiens
ctctgcagcccatt

SEQ ID NO: 6155810 - DNA, 22 bp, Homo sapiens
ctctgcagcccattcccaaggg

SEQ ID NO: 6155811 - DNA, 19 bp, Homo sapiens
ctctgcagcctcagagaca

SEQ ID NO: 6155812 - DNA, 12 bp, Homo sapiens
ctctgcagcctg

SEQ ID NO: 6155813 - DNA, 15 bp, Homo sapiens
ctctgcagcctgagc

SEQ ID NO: 6155814 - DNA, 17 bp, Homo sapiens
ctctgcagcctgagctc

SEQ ID NO: 6155815 - DNA, 18 bp, Homo sapiens
ctctgcagcctgagctcc

SEQ ID NO: 6155816 - DNA, 20 bp, Homo sapiens
ctctgcaggaaatggctgtg

SEQ ID NO: 6155817 - DNA, 12 bp, Homo sapiens
ctctgcaggaca

SEQ ID NO: 6155818 - DNA, 15 bp, Homo sapiens
ctctgcaggcacctt

SEQ ID NO: 6155819 - DNA, 13 bp, Homo sapiens
ctctgcaggcaga

SEQ ID NO: 6155820 - DNA, 14 bp, Homo sapiens
ctctgcaggcagcc

SEQ ID NO: 6155821 - DNA, 17 bp, Homo sapiens
ctctgcaggcagccttg

SEQ ID NO: 6155822 - DNA, 20 bp, Homo sapiens
ctctgcaggcagccttgccc

SEQ ID NO: 6155823 - DNA, 21 bp, Homo sapiens
ctctgcaggcagccttgccca

SEQ ID NO: 6155824 - DNA, 17 bp, Homo sapiens
ctctgcaggctggggag

SEQ ID NO: 6155825 - DNA, 18 bp, Homo sapiens
ctctgcaggctggggagg

SEQ ID NO: 6155826 - DNA, 19 bp, Homo sapiens
ctctgcagggcagcctgtg

SEQ ID NO: 6155827 - DNA, 21 bp, Homo sapiens
ctctgcagggtgaagcaccag

SEQ ID NO: 6155828 - DNA, 22 bp, Homo sapiens
ctctgcaggtccctaataaagc

SEQ ID NO: 6155829 - DNA, 23 bp, Homo sapiens
ctctgcaggtccctaataaagct

SEQ ID NO: 6155830 - DNA, 15 bp, Homo sapiens
ctctgcagtcccagc

SEQ ID NO: 6155831 - DNA, 20 bp, Homo sapiens
ctctgcagtccgtgggctgg

SEQ ID NO: 6155832 - DNA, 20 bp, Homo sapiens
ctctgcagtcctcggcagct

SEQ ID NO: 6155833 - DNA, 21 bp, Homo sapiens
ctctgcagtcctggccccctc

SEQ ID NO: 6155834 - DNA, 18 bp, Homo sapiens
ctctgcagtcgcttgcca

SEQ ID NO: 6155835 - DNA, 14 bp, Homo sapiens
ctctgcagtgtcca

SEQ ID NO: 6155836 - DNA, 17 bp, Homo sapiens
ctctgcagtgtggcaag

SEQ ID NO: 6155837 - DNA, 12 bp, Homo sapiens
ctctgcagtttt

SEQ ID NO: 6155838 - DNA, 15 bp, Homo sapiens
ctctgcataccaggg

SEQ ID NO: 6155839 - DNA, 16 bp, Homo sapiens
ctctgcatagacaaag

SEQ ID NO: 6155840 - DNA, 18 bp, Homo sapiens
ctctgcatcctctggagc

SEQ ID NO: 6155841 - DNA, 20 bp, Homo sapiens
ctctgcatcctctggagcca

SEQ ID NO: 6155842 - DNA, 22 bp, Homo sapiens
ctctgcatctactcccaagtat

SEQ ID NO: 6155843 - DNA, 12 bp, Homo sapiens
ctctgcatctga

SEQ ID NO: 6155844 - DNA, 13 bp, Homo sapiens
ctctgcatctgac

SEQ ID NO: 6155845 - DNA, 15 bp, Homo sapiens
ctctgcatctgactc

SEQ ID NO: 6155846 - DNA, 21 bp, Homo sapiens
ctctgcatgattagtgcaata

SEQ ID NO: 6155847 - DNA, 16 bp, Homo sapiens
ctctgcatgcggccca

SEQ ID NO: 6155848 - DNA, 17 bp, Homo sapiens
ctctgcatgcggcccag

SEQ ID NO: 6155849 - DNA, 22 bp, Homo sapiens
ctctgcatgcggcccagcccgg

SEQ ID NO: 6155850 - DNA, 13 bp, Homo sapiens
ctctgcatgctcc

SEQ ID NO: 6155851 - DNA, 14 bp, Homo sapiens
ctctgcatgctcct

SEQ ID NO: 6155852 - DNA, 19 bp, Homo sapiens
ctctgcatgctcctctgcc

SEQ ID NO: 6155853 - DNA, 15 bp, Homo sapiens
ctctgcatgttttcc

SEQ ID NO: 6155854 - DNA, 20 bp, Homo sapiens
ctctgcatgttttttttaaa

SEQ ID NO: 6155855 - DNA, 10 bp, Homo sapiens
ctctgcattg

SEQ ID NO: 6155856 - DNA, 17 bp, Homo sapiens
ctctgcattgacctgga

SEQ ID NO: 6155857 - DNA, 19 bp, Homo sapiens
ctctgcatttgtctattct

SEQ ID NO: 6155858 - DNA, 22 bp, Homo sapiens
ctctgcatttgtctattctcca

SEQ ID NO: 6155859 - DNA, 19 bp, Homo sapiens
ctgggcagatgtcccccac

SEQ ID NO: 6155860 - DNA, 13 bp, Homo sapiens
ctgggcagcaagg

SEQ ID NO: 6155861 - DNA, 14 bp, Homo sapiens
ctgggcagcagcat

SEQ ID NO: 6155862 - DNA, 15 bp, Homo sapiens
ctgggcagccaggct

SEQ ID NO: 6155863 - DNA, 17 bp, Homo sapiens
ctgggcagccaggctgc

SEQ ID NO: 6155864 - DNA, 16 bp, Homo sapiens
ctgggcagcccagaga

SEQ ID NO: 6155865 - DNA, 13 bp, Homo sapiens
ctgggcagcccca

SEQ ID NO: 6155866 - DNA, 15 bp, Homo sapiens
ctgggcagccccaga

SEQ ID NO: 6155867 - DNA, 22 bp, Homo sapiens
ctgggcagccccagagagagga

SEQ ID NO: 6155868 - DNA, 23 bp, Homo sapiens
ctgggcagccgttttcctcatcc

SEQ ID NO: 6155869 - DNA, 13 bp, Homo sapiens
ctgggcagcctgc

SEQ ID NO: 6155870 - DNA, 14 bp, Homo sapiens
ctgggcagcctgct

SEQ ID NO: 6155871 - DNA, 23 bp, Homo sapiens
ctgggcagcctgctttggccttt

SEQ ID NO: 6155872 - DNA, 13 bp, Homo sapiens
ctgggcagccttg

SEQ ID NO: 6155873 - DNA, 11 bp, Homo sapiens
ctgggcagcta

SEQ ID NO: 6155874 - DNA, 13 bp, Homo sapiens
ctgggcagctgcc

SEQ ID NO: 6155875 - DNA, 22 bp, Homo sapiens
ctgggcagctgcctcccctcct

SEQ ID NO: 6155876 - DNA, 17 bp, Homo sapiens
ctgggcagcttgagagg

SEQ ID NO: 6155877 - DNA, 18 bp, Homo sapiens
ctgggcagcttgggctgg

SEQ ID NO: 6155878 - DNA, 19 bp, Homo sapiens
ctgggcagcttgggctggc

SEQ ID NO: 6155879 - DNA, 14 bp, Homo sapiens
ctgggcagggcagg

SEQ ID NO: 6155880 - DNA, 16 bp, Homo sapiens
ctgggcagggccctgt

SEQ ID NO: 6155881 - DNA, 18 bp, Homo sapiens
ctgggcagggccctgtgg

SEQ ID NO: 6155882 - DNA, 20 bp, Homo sapiens
ctgggcagggccctgtggct

SEQ ID NO: 6155883 - DNA, 17 bp, Homo sapiens
ctgggcagggccgcagg

SEQ ID NO: 6155884 - DNA, 19 bp, Homo sapiens
ctgggcagggccgcagggc

SEQ ID NO: 6155885 - DNA, 15 bp, Homo sapiens
ctgggcagggcctgg

SEQ ID NO: 6155886 - DNA, 16 bp, Homo sapiens
ctgggcaggtcctggg

SEQ ID NO: 6155887 - DNA, 18 bp, Homo sapiens
ctgggcaggtcctgggga

SEQ ID NO: 6155888 - DNA, 21 bp, Homo sapiens
ctgggcaggtcctggggaggc

SEQ ID NO: 6155889 - DNA, 22 bp, Homo sapiens
ctgggcaggtcctggggaggct

SEQ ID NO: 6155890 - DNA, 22 bp, Homo sapiens
ctgggcaggttcctggggccgc

SEQ ID NO: 6155891 - DNA, 23 bp, Homo sapiens
ctgggcaggttcctggggccgcc

SEQ ID NO: 6155892 - DNA, 20 bp, Homo sapiens
ctgggcaggttggtgggggc

SEQ ID NO: 6155893 - DNA, 21 bp, Homo sapiens
ctgggcagtcgtaagggttgc

SEQ ID NO: 6155894 - DNA, 19 bp, Homo sapiens
ctgggcagtcttttgtgtc

SEQ ID NO: 6155895 - DNA, 18 bp, Homo sapiens
ctgggcagtgagtgccat

SEQ ID NO: 6155896 - DNA, 22 bp, Homo sapiens
ctgggcagtgagtgccatgctt

SEQ ID NO: 6155897 - DNA, 16 bp, Homo sapiens
ctgggcagtgccacag

SEQ ID NO: 6155898 - DNA, 21 bp, Homo sapiens
ctgggcagtgccacagcctgc

SEQ ID NO: 6155899 - DNA, 13 bp, Homo sapiens
ctgggcagtgccc

SEQ ID NO: 6155900 - DNA, 21 bp, Homo sapiens
ctgggcagtgcccaccatgca

SEQ ID NO: 6155901 - DNA, 14 bp, Homo sapiens
ctgggcagtgtggc

SEQ ID NO: 6155902 - DNA, 16 bp, Homo sapiens
ctgggcagtgtggcct

SEQ ID NO: 6155903 - DNA, 16 bp, Homo sapiens
ctgggcatcccagctt

SEQ ID NO: 6155904 - DNA, 17 bp, Homo sapiens
ctgggcatcccagcttg

SEQ ID NO: 6155905 - DNA, 20 bp, Homo sapiens
ctgggcatcccagcttgccc

SEQ ID NO: 6155906 - DNA, 21 bp, Homo sapiens
ctgggcatcccagcttgcccc

SEQ ID NO: 6155907 - DNA, 15 bp, Homo sapiens
ctgggcatccccagc

SEQ ID NO: 6155908 - DNA, 15 bp, Homo sapiens
ctgggcatctcgtgc

SEQ ID NO: 6155909 - DNA, 16 bp, Homo sapiens
ctgggcatctggccct

SEQ ID NO: 6155910 - DNA, 20 bp, Homo sapiens
ctgggcatctggccctgctg

SEQ ID NO: 6155911 - DNA, 17 bp, Homo sapiens
ctgggcatcttctggct

SEQ ID NO: 6155912 - DNA, 21 bp, Homo sapiens
ctgggcatgccatgtctgagc

SEQ ID NO: 6155913 - DNA, 20 bp, Homo sapiens
ctgggcatgggtccagggcc

SEQ ID NO: 6155914 - DNA, 13 bp, Homo sapiens
ctgggcatgtttg

SEQ ID NO: 6155915 - DNA, 21 bp, Homo sapiens
ctgggcatgtttgtctgtgtg

SEQ ID NO: 6155916 - DNA, 17 bp, Homo sapiens
ctgggcattagcaaggc

SEQ ID NO: 6155917 - DNA, 22 bp, Homo sapiens
ctgggcattagcaaggcagagc

SEQ ID NO: 6155918 - DNA, 16 bp, Homo sapiens
ctgggcatttcaatcc

SEQ ID NO: 6155919 - DNA, 12 bp, Homo sapiens
ctgggcattttc

SEQ ID NO: 6155920 - DNA, 15 bp, Homo sapiens
ctgggcattttcctc

SEQ ID NO: 6155921 - DNA, 16 bp, Homo sapiens
ctgggcattttcctcc

SEQ ID NO: 6155922 - DNA, 18 bp, Homo sapiens
ctgggcattttcctcctc

SEQ ID NO: 6155923 - DNA, 22 bp, Homo sapiens
ctgggccaaaagggcagccagg

SEQ ID NO: 6155924 - DNA, 23 bp, Homo sapiens
ctgggccaaaagggcagccaggg

SEQ ID NO: 6155925 - DNA, 19 bp, Homo sapiens
ctgggccaactcacctgag

SEQ ID NO: 6155926 - DNA, 19 bp, Homo sapiens
ctgggccaagccagggatg

SEQ ID NO: 6155927 - DNA, 23 bp, Homo sapiens
ctgggccaaggactccaaagccg

SEQ ID NO: 6155928 - DNA, 20 bp, Homo sapiens
ctgggccaattcaatacaaa

SEQ ID NO: 6155929 - DNA, 23 bp, Homo sapiens
ctgggccaattcaatacaaacaa

SEQ ID NO: 6155930 - DNA, 18 bp, Homo sapiens
ctgggccacagccccgat

SEQ ID NO: 6155931 - DNA, 13 bp, Homo sapiens
ctgggccaccagc

SEQ ID NO: 6155932 - DNA, 14 bp, Homo sapiens
ctgggccaccaggg

SEQ ID NO: 6155933 - DNA, 15 bp, Homo sapiens
ctgggccaccaggga

SEQ ID NO: 6155934 - DNA, 11 bp, Homo sapiens
ctgggccaccc

SEQ ID NO: 6155935 - DNA, 15 bp, Homo sapiens
ctgggccacctccta

SEQ ID NO: 6155936 - DNA, 16 bp, Homo sapiens
ctgggccacctcctac

SEQ ID NO: 6155937 - DNA, 19 bp, Homo sapiens
ctgggccacctcctacccc

SEQ ID NO: 6155938 - DNA, 16 bp, Homo sapiens
ctgggccacgccggcc

SEQ ID NO: 6155939 - DNA, 17 bp, Homo sapiens
ctgggccactcctcttc

SEQ ID NO: 6155940 - DNA, 18 bp, Homo sapiens
ctgggccagatgctgggc

SEQ ID NO: 6155941 - DNA, 13 bp, Homo sapiens
ctgggccagcaga

SEQ ID NO: 6155942 - DNA, 15 bp, Homo sapiens
ctgggccagcccagg

SEQ ID NO: 6155943 - DNA, 15 bp, Homo sapiens
ctgggccagcctcag

SEQ ID NO: 6155944 - DNA, 19 bp, Homo sapiens
ctgggccagcctcagctca

SEQ ID NO: 6155945 - DNA, 20 bp, Homo sapiens
ctgggccagcctcagctcag

SEQ ID NO: 6155946 - DNA, 17 bp, Homo sapiens
ctgggccagcggggctg

SEQ ID NO: 6155947 - DNA, 19 bp, Homo sapiens
ctgggccagcggggctgct

SEQ ID NO: 6155948 - DNA, 12 bp, Homo sapiens
ctgggccaggca

SEQ ID NO: 6155949 - DNA, 15 bp, Homo sapiens
ctgggccaggcaggc

SEQ ID NO: 6155950 - DNA, 21 bp, Homo sapiens
ctgggccagggaaacaaagtt

SEQ ID NO: 6155951 - DNA, 20 bp, Homo sapiens
ctgggccagggatctctcta

SEQ ID NO: 6155952 - DNA, 23 bp, Homo sapiens
ctgggccagtcaacggggggctc

SEQ ID NO: 6155953 - DNA, 22 bp, Homo sapiens
ctgggccagtggcactctgtgt

SEQ ID NO: 6155954 - DNA, 17 bp, Homo sapiens
ctgggccagtggctggg

SEQ ID NO: 6155955 - DNA, 12 bp, Homo sapiens
ctgggccatcct

SEQ ID NO: 6155956 - DNA, 17 bp, Homo sapiens
ctgggccatccttccgc

SEQ ID NO: 6155957 - DNA, 16 bp, Homo sapiens
ctgggccatgcgaggg

SEQ ID NO: 6155958 - DNA, 11 bp, Homo sapiens
ctgggccatgg

SEQ ID NO: 6155959 - DNA, 13 bp, Homo sapiens
ctgggccatgggt

SEQ ID NO: 6155960 - DNA, 19 bp, Homo sapiens
ctgggccatgtccaaagag

SEQ ID NO: 6155961 - DNA, 23 bp, Homo sapiens
ctgggccatgtccaaagaggctg

SEQ ID NO: 6155962 - DNA, 20 bp, Homo sapiens
ctgggccatgttgtgcctcc

SEQ ID NO: 6155963 - DNA, 17 bp, Homo sapiens
ctgggcccaaccctgtc

SEQ ID NO: 6155964 - DNA, 12 bp, Homo sapiens
ctgggcccaagt

SEQ ID NO: 6155965 - DNA, 19 bp, Homo sapiens
ctgggcccacagagcctgg

SEQ ID NO: 6155966 - DNA, 20 bp, Homo sapiens
ctgggcccacagagcctggc

SEQ ID NO: 6155967 - DNA, 14 bp, Homo sapiens
ctgggcccacagcc

SEQ ID NO: 6155968 - DNA, 15 bp, Homo sapiens
ctgggcccacatccg

SEQ ID NO: 6155969 - DNA, 18 bp, Homo sapiens
ctgggcccacccaagcag

SEQ ID NO: 6155970 - DNA, 23 bp, Homo sapiens
ctgggcccacccaagcaggaggc

SEQ ID NO: 6155971 - DNA, 15 bp, Homo sapiens
ctgggcccagaggag

SEQ ID NO: 6155972 - DNA, 22 bp, Homo sapiens
ctgggcccagaggcacagccgg

SEQ ID NO: 6155973 - DNA, 23 bp, Homo sapiens
ctgggcccagcaggggccctcac

SEQ ID NO: 6155974 - DNA, 11 bp, Homo sapiens
ctgggcccagg

SEQ ID NO: 6155975 - DNA, 17 bp, Homo sapiens
ctgggcccaggcagcac

SEQ ID NO: 6155976 - DNA, 21 bp, Homo sapiens
ctgggcccaggcagcacctgg

SEQ ID NO: 6155977 - DNA, 15 bp, Homo sapiens
ctgggcccaggcagg

SEQ ID NO: 6155978 - DNA, 17 bp, Homo sapiens
ctgggcccaggcaggtc

SEQ ID NO: 6155979 - DNA, 19 bp, Homo sapiens
ctgggcccaggcccagcct

SEQ ID NO: 6155980 - DNA, 20 bp, Homo sapiens
ctgggcccaggcccagcctc

SEQ ID NO: 6155981 - DNA, 17 bp, Homo sapiens
ctgggcccaggctctgg

SEQ ID NO: 6155982 - DNA, 19 bp, Homo sapiens
ctgggcccatctccctgct

SEQ ID NO: 6155983 - DNA, 21 bp, Homo sapiens
ctgggcccatctccctgcttt

SEQ ID NO: 6155984 - DNA, 18 bp, Homo sapiens
ctgggccccaccacctag

SEQ ID NO: 6155985 - DNA, 16 bp, Homo sapiens
ctgggccccactggac

SEQ ID NO: 6155986 - DNA, 17 bp, Homo sapiens
ctgggccccactggaca

SEQ ID NO: 6155987 - DNA, 18 bp, Homo sapiens
ctgggccccactggacaa

SEQ ID NO: 6155988 - DNA, 21 bp, Homo sapiens
ctgggccccagaaagcctcag

SEQ ID NO: 6155989 - DNA, 13 bp, Homo sapiens
ctgggccccagcc

SEQ ID NO: 6155990 - DNA, 15 bp, Homo sapiens
ctgggccccagccca

SEQ ID NO: 6155991 - DNA, 18 bp, Homo sapiens
ctgggccccagcccaccc

SEQ ID NO: 6155992 - DNA, 21 bp, Homo sapiens
ctgggccccagcccaccctcc

SEQ ID NO: 6155993 - DNA, 15 bp, Homo sapiens
ctgggccccagttgt

SEQ ID NO: 6155994 - DNA, 12 bp, Homo sapiens
ctgggcccccag

SEQ ID NO: 6155995 - DNA, 17 bp, Homo sapiens
ctgggcccccagagacc

SEQ ID NO: 6155996 - DNA, 23 bp, Homo sapiens
ctgggcccccagcctggccagac

SEQ ID NO: 6155997 - DNA, 17 bp, Homo sapiens
ctgggccccccagctca

SEQ ID NO: 6155998 - DNA, 18 bp, Homo sapiens
ctgggccccctgggagag

SEQ ID NO: 6155999 - DNA, 16 bp, Homo sapiens
ctgggccccgcctcaa

SEQ ID NO: 6156000 - DNA, 13 bp, Homo sapiens
ctgggcccctcag

SEQ ID NO: 6156001 - DNA, 14 bp, Homo sapiens
ctgggcccctcagg

SEQ ID NO: 6156002 - DNA, 21 bp, Homo sapiens
ctgggcccctcatctgctcag

SEQ ID NO: 6156003 - DNA, 16 bp, Homo sapiens
ctgggcccctccacgc

SEQ ID NO: 6156004 - DNA, 13 bp, Homo sapiens
ctgggcccctccc

SEQ ID NO: 6156005 - DNA, 19 bp, Homo sapiens
ctgggcccctcccctcaga

SEQ ID NO: 6156006 - DNA, 16 bp, Homo sapiens
ctgggcccctccctac

SEQ ID NO: 6156007 - DNA, 22 bp, Homo sapiens
ctgggcccctccctacctcaac

SEQ ID NO: 6156008 - DNA, 15 bp, Homo sapiens
ctgggcccctgctca

SEQ ID NO: 6156009 - DNA, 14 bp, Homo sapiens
ctgggcccctggga

SEQ ID NO: 6156010 - DNA, 14 bp, Homo sapiens
ctgggcccgagcct

SEQ ID NO: 6156011 - DNA, 20 bp, Homo sapiens
ctgggcccgagggtcccaag

SEQ ID NO: 6156012 - DNA, 16 bp, Homo sapiens
ctgggcccgctttgcc

SEQ ID NO: 6156013 - DNA, 18 bp, Homo sapiens
ctgggcccggaagggctt

SEQ ID NO: 6156014 - DNA, 18 bp, Homo sapiens
ctgggcccgggcaggcca

SEQ ID NO: 6156015 - DNA, 13 bp, Homo sapiens
ctgggccctaggc

SEQ ID NO: 6156016 - DNA, 14 bp, Homo sapiens
ctgggccctctctt

SEQ ID NO: 6156017 - DNA, 18 bp, Homo sapiens
ctgggccctctttccctg

SEQ ID NO: 6156018 - DNA, 22 bp, Homo sapiens
ctgggccctgacattggagcct

SEQ ID NO: 6156019 - DNA, 16 bp, Homo sapiens
ctgggccctgagccag

SEQ ID NO: 6156020 - DNA, 13 bp, Homo sapiens
ctgggccctgagt

SEQ ID NO: 6156021 - DNA, 14 bp, Homo sapiens
ctgggccctgcagg

SEQ ID NO: 6156022 - DNA, 15 bp, Homo sapiens
ctgggccctgcagga

SEQ ID NO: 6156023 - DNA, 22 bp, Homo sapiens
ctgggccctgcaggaggcctgg

SEQ ID NO: 6156024 - DNA, 13 bp, Homo sapiens
ctgggccctgcct

SEQ ID NO: 6156025 - DNA, 18 bp, Homo sapiens
ctgggccctgcctgcagc

SEQ ID NO: 6156026 - DNA, 21 bp, Homo sapiens
ctgggccctgcctgcagccag

SEQ ID NO: 6156027 - DNA, 23 bp, Homo sapiens
ctgggccctggaggaattcagct

SEQ ID NO: 6156028 - DNA, 15 bp, Homo sapiens
ctgggccctgggctg

SEQ ID NO: 6156029 - DNA, 16 bp, Homo sapiens
ctgggccctgggctga

SEQ ID NO: 6156030 - DNA, 18 bp, Homo sapiens
ctgggccctgggctgatg

SEQ ID NO: 6156031 - DNA, 19 bp, Homo sapiens
ctgggccctgggctggcac

SEQ ID NO: 6156032 - DNA, 20 bp, Homo sapiens
ctgggccctggggcctgtac

SEQ ID NO: 6156033 - DNA, 19 bp, Homo sapiens
ctgggccctggggctgccc

SEQ ID NO: 6156034 - DNA, 22 bp, Homo sapiens
ctgggccctggggctgccctcg

SEQ ID NO: 6156035 - DNA, 13 bp, Homo sapiens
ctgggccctgggt

SEQ ID NO: 6156036 - DNA, 15 bp, Homo sapiens
ctgggccctggttcc

SEQ ID NO: 6156037 - DNA, 21 bp, Homo sapiens
ctgggccctggttcccccagg

SEQ ID NO: 6156038 - DNA, 12 bp, Homo sapiens
ctctgccaaagc

SEQ ID NO: 6156039 - DNA, 19 bp, Homo sapiens
ctctgccaaaggatgtgat

SEQ ID NO: 6156040 - DNA, 21 bp, Homo sapiens
ctctgccaacatgaggacaga

SEQ ID NO: 6156041 - DNA, 23 bp, Homo sapiens
ctctgccaacatgaggacagaag

SEQ ID NO: 6156042 - DNA, 23 bp, Homo sapiens
ctctgccaacttcttcagagctg

SEQ ID NO: 6156043 - DNA, 20 bp, Homo sapiens
ctctgccaatgtgggctgcc

SEQ ID NO: 6156044 - DNA, 23 bp, Homo sapiens
ctctgccaatgtgggctgcccct

SEQ ID NO: 6156045 - DNA, 14 bp, Homo sapiens
ctctgccacactct

SEQ ID NO: 6156046 - DNA, 15 bp, Homo sapiens
ctctgccacactctg

SEQ ID NO: 6156047 - DNA, 19 bp, Homo sapiens
ctctgccacagcaaggctg

SEQ ID NO: 6156048 - DNA, 19 bp, Homo sapiens
ctctgccaccaccccataa

SEQ ID NO: 6156049 - DNA, 14 bp, Homo sapiens
ctctgccaccagag

SEQ ID NO: 6156050 - DNA, 23 bp, Homo sapiens
ctctgccaccagagaccgtcctc

SEQ ID NO: 6156051 - DNA, 15 bp, Homo sapiens
ctctgccacccactc

SEQ ID NO: 6156052 - DNA, 12 bp, Homo sapiens
ctctgccacctc

SEQ ID NO: 6156053 - DNA, 23 bp, Homo sapiens
ctctgccagaagatcccctcagg

SEQ ID NO: 6156054 - DNA, 18 bp, Homo sapiens
ctctgccagcaggaataa

SEQ ID NO: 6156055 - DNA, 16 bp, Homo sapiens
ctctgccagccctgca

SEQ ID NO: 6156056 - DNA, 18 bp, Homo sapiens
ctctgccagctccacagg

SEQ ID NO: 6156057 - DNA, 19 bp, Homo sapiens
ctctgccagctccacaggg

SEQ ID NO: 6156058 - DNA, 14 bp, Homo sapiens
ctctgccaggcctg

SEQ ID NO: 6156059 - DNA, 22 bp, Homo sapiens
ctctgccagggcagtgctagtg

SEQ ID NO: 6156060 - DNA, 23 bp, Homo sapiens
ctctgccagtcgggagagccagg

SEQ ID NO: 6156061 - DNA, 21 bp, Homo sapiens
ctctgccagtggatcccctgc

SEQ ID NO: 6156062 - DNA, 13 bp, Homo sapiens
ctctgccatcagc

SEQ ID NO: 6156063 - DNA, 21 bp, Homo sapiens
ctctgccatcagcccctgctg

SEQ ID NO: 6156064 - DNA, 15 bp, Homo sapiens
ctctgccatcctccc

SEQ ID NO: 6156065 - DNA, 16 bp, Homo sapiens
ctctgccatcctccct

SEQ ID NO: 6156066 - DNA, 19 bp, Homo sapiens
ctctgccatcctccctgtt

SEQ ID NO: 6156067 - DNA, 19 bp, Homo sapiens
ctctgccatgaactggagg

SEQ ID NO: 6156068 - DNA, 16 bp, Homo sapiens
ctctgccatgcccaga

SEQ ID NO: 6156069 - DNA, 20 bp, Homo sapiens
ctctgccatggccttggcag

SEQ ID NO: 6156070 - DNA, 16 bp, Homo sapiens
ctctgccatgtggcag

SEQ ID NO: 6156071 - DNA, 16 bp, Homo sapiens
ctctgccattctgtgc

SEQ ID NO: 6156072 - DNA, 18 bp, Homo sapiens
ctctgccattctgtgcag

SEQ ID NO: 6156073 - DNA, 14 bp, Homo sapiens
ctctgcccaccctc

SEQ ID NO: 6156074 - DNA, 17 bp, Homo sapiens
ctctgcccacctctctt

SEQ ID NO: 6156075 - DNA, 11 bp, Homo sapiens
ctctgcccact

SEQ ID NO: 6156076 - DNA, 14 bp, Homo sapiens
ctctgcccagagct

SEQ ID NO: 6156077 - DNA, 17 bp, Homo sapiens
ctctgcccagagctggg

SEQ ID NO: 6156078 - DNA, 19 bp, Homo sapiens
ctctgcccagagctgggtg

SEQ ID NO: 6156079 - DNA, 20 bp, Homo sapiens
ctctgcccagagctgggtga

SEQ ID NO: 6156080 - DNA, 20 bp, Homo sapiens
ctctgcccagccggagggac

SEQ ID NO: 6156081 - DNA, 17 bp, Homo sapiens
ctctgcccagcctgccc

SEQ ID NO: 6156082 - DNA, 14 bp, Homo sapiens
ctctgcccagcttg

SEQ ID NO: 6156083 - DNA, 15 bp, Homo sapiens
ctctgcccagcttgg

SEQ ID NO: 6156084 - DNA, 22 bp, Homo sapiens
ctctgcccagcttttcattgct

SEQ ID NO: 6156085 - DNA, 21 bp, Homo sapiens
ctctgcccaggcaaggaacag

SEQ ID NO: 6156086 - DNA, 14 bp, Homo sapiens
ctctgcccaggcac

SEQ ID NO: 6156087 - DNA, 15 bp, Homo sapiens
ctctgcccagggagt

SEQ ID NO: 6156088 - DNA, 19 bp, Homo sapiens
ctctgcccatgcctaaagc

SEQ ID NO: 6156089 - DNA, 20 bp, Homo sapiens
ctctgcccatgcctaaagcc

SEQ ID NO: 6156090 - DNA, 14 bp, Homo sapiens
ctctgccccaagca

SEQ ID NO: 6156091 - DNA, 15 bp, Homo sapiens
ctctgccccaagcag

SEQ ID NO: 6156092 - DNA, 17 bp, Homo sapiens
ctctgccccaagcagcc

SEQ ID NO: 6156093 - DNA, 14 bp, Homo sapiens
ctctgccccaagcc

SEQ ID NO: 6156094 - DNA, 15 bp, Homo sapiens
ctctgccccaagccc

SEQ ID NO: 6156095 - DNA, 16 bp, Homo sapiens
ctctgccccaagcccc

SEQ ID NO: 6156096 - DNA, 18 bp, Homo sapiens
ctctgccccaagccccca

SEQ ID NO: 6156097 - DNA, 18 bp, Homo sapiens
ctctgccccaaggggccc

SEQ ID NO: 6156098 - DNA, 21 bp, Homo sapiens
ctctgccccaaggggcccaca

SEQ ID NO: 6156099 - DNA, 12 bp, Homo sapiens
ctctgccccaat

SEQ ID NO: 6156100 - DNA, 13 bp, Homo sapiens
ctctgccccacat

SEQ ID NO: 6156101 - DNA, 16 bp, Homo sapiens
ctctgccccaccttgc

SEQ ID NO: 6156102 - DNA, 21 bp, Homo sapiens
ctctgccccaccttgccaggg

SEQ ID NO: 6156103 - DNA, 22 bp, Homo sapiens
ctctgccccaccttgccagggc

SEQ ID NO: 6156104 - DNA, 20 bp, Homo sapiens
ctctgccccacgctgtggcc

SEQ ID NO: 6156105 - DNA, 11 bp, Homo sapiens
ctctgccccag

SEQ ID NO: 6156106 - DNA, 16 bp, Homo sapiens
ctctgccccagaggcc

SEQ ID NO: 6156107 - DNA, 20 bp, Homo sapiens
ctctgccccagaggcctctc

SEQ ID NO: 6156108 - DNA, 13 bp, Homo sapiens
ctctgccccagcc

SEQ ID NO: 6156109 - DNA, 17 bp, Homo sapiens
ctctgccccagcctgtc

SEQ ID NO: 6156110 - DNA, 13 bp, Homo sapiens
ctctgccccagct

SEQ ID NO: 6156111 - DNA, 19 bp, Homo sapiens
ctctgccccagctctggct

SEQ ID NO: 6156112 - DNA, 13 bp, Homo sapiens
ctctgccccagtc

SEQ ID NO: 6156113 - DNA, 23 bp, Homo sapiens
ctctgccccatcattgcacctgc

SEQ ID NO: 6156114 - DNA, 15 bp, Homo sapiens
ctctgccccatcctc

SEQ ID NO: 6156115 - DNA, 10 bp, Homo sapiens
ctctgccccc

SEQ ID NO: 6156116 - DNA, 20 bp, Homo sapiens
ctctgccccccaagttcaag

SEQ ID NO: 6156117 - DNA, 22 bp, Homo sapiens
ctctgcccccgcgggttctaga

SEQ ID NO: 6156118 - DNA, 14 bp, Homo sapiens
ctctgcccccgctg

SEQ ID NO: 6156119 - DNA, 15 bp, Homo sapiens
ctctgccccctcccc

SEQ ID NO: 6156120 - DNA, 18 bp, Homo sapiens
ctctgccccctcccccat

SEQ ID NO: 6156121 - DNA, 19 bp, Homo sapiens
ctctgccccctcccccatg

SEQ ID NO: 6156122 - DNA, 17 bp, Homo sapiens
ctctgccccctcccccg

SEQ ID NO: 6156123 - DNA, 12 bp, Homo sapiens
ctctgccccctg

SEQ ID NO: 6156124 - DNA, 14 bp, Homo sapiens
ctctgcccctcagg

SEQ ID NO: 6156125 - DNA, 23 bp, Homo sapiens
ctctgcccctcagggggccagct

SEQ ID NO: 6156126 - DNA, 18 bp, Homo sapiens
ctctgcccctcccaaccc

SEQ ID NO: 6156127 - DNA, 22 bp, Homo sapiens
ctctgcccctcccaacccagcc

SEQ ID NO: 6156128 - DNA, 23 bp, Homo sapiens
ctctgcccctcccaacccagccg

SEQ ID NO: 6156129 - DNA, 19 bp, Homo sapiens
ctctgcccctcccccagcc

SEQ ID NO: 6156130 - DNA, 18 bp, Homo sapiens
ctctgcccctccgtcccc

SEQ ID NO: 6156131 - DNA, 22 bp, Homo sapiens
ctctgcccctccgtccccaggg

SEQ ID NO: 6156132 - DNA, 19 bp, Homo sapiens
ctctgcccctcttccctgg

SEQ ID NO: 6156133 - DNA, 11 bp, Homo sapiens
ctctgcccctg

SEQ ID NO: 6156134 - DNA, 15 bp, Homo sapiens
ctctgcccctggacc

SEQ ID NO: 6156135 - DNA, 20 bp, Homo sapiens
ctctgcccctggacctggga

SEQ ID NO: 6156136 - DNA, 17 bp, Homo sapiens
ctctgccccttccccat

SEQ ID NO: 6156137 - DNA, 20 bp, Homo sapiens
ctctgccccttctgtttcca

SEQ ID NO: 6156138 - DNA, 14 bp, Homo sapiens
ctctgccccttggg

SEQ ID NO: 6156139 - DNA, 20 bp, Homo sapiens
ctctgccccttgggcatcca

SEQ ID NO: 6156140 - DNA, 23 bp, Homo sapiens
ctctgccccttgggcctcccact

SEQ ID NO: 6156141 - DNA, 14 bp, Homo sapiens
ctctgcccgggagc

SEQ ID NO: 6156142 - DNA, 20 bp, Homo sapiens
ctctgccctaatgcgcaggc

SEQ ID NO: 6156143 - DNA, 23 bp, Homo sapiens
ctctgccctccaagaccttctcc

SEQ ID NO: 6156144 - DNA, 16 bp, Homo sapiens
ctctgccctccctggc

SEQ ID NO: 6156145 - DNA, 16 bp, Homo sapiens
ctctgccctctagagc

SEQ ID NO: 6156146 - DNA, 18 bp, Homo sapiens
ctctgccctctccctgtg

SEQ ID NO: 6156147 - DNA, 12 bp, Homo sapiens
ctctgccctctg

SEQ ID NO: 6156148 - DNA, 17 bp, Homo sapiens
ctctgccctctgctcta

SEQ ID NO: 6156149 - DNA, 17 bp, Homo sapiens
ctctgccctctgctgct

SEQ ID NO: 6156150 - DNA, 15 bp, Homo sapiens
ctctgccctgccctg

SEQ ID NO: 6156151 - DNA, 20 bp, Homo sapiens
ctctgccctgccctggccac

SEQ ID NO: 6156152 - DNA, 16 bp, Homo sapiens
ctctgccctgcctccc

SEQ ID NO: 6156153 - DNA, 17 bp, Homo sapiens
ctctgccctgcctccct

SEQ ID NO: 6156154 - DNA, 12 bp, Homo sapiens
ctctgccctgcg

SEQ ID NO: 6156155 - DNA, 15 bp, Homo sapiens
ctctgccctggaaag

SEQ ID NO: 6156156 - DNA, 14 bp, Homo sapiens
ctctgccctggatt

SEQ ID NO: 6156157 - DNA, 16 bp, Homo sapiens
ctctgccctggctgtg

SEQ ID NO: 6156158 - DNA, 14 bp, Homo sapiens
ctctgccctgtata

SEQ ID NO: 6156159 - DNA, 14 bp, Homo sapiens
ctctgccctgtgta

SEQ ID NO: 6156160 - DNA, 12 bp, Homo sapiens
ctctgcccttcc

SEQ ID NO: 6156161 - DNA, 17 bp, Homo sapiens
ctctgcccttcccctcc

SEQ ID NO: 6156162 - DNA, 19 bp, Homo sapiens
ctctgcccttgttccctag

SEQ ID NO: 6156163 - DNA, 20 bp, Homo sapiens
ctctgccgaccgcctgcttc

SEQ ID NO: 6156164 - DNA, 18 bp, Homo sapiens
ctctgccgcaatacagga

SEQ ID NO: 6156165 - DNA, 22 bp, Homo sapiens
ctctgccgccgcccgctgggga

SEQ ID NO: 6156166 - DNA, 16 bp, Homo sapiens
ctctgccgcctgcgtt

SEQ ID NO: 6156167 - DNA, 16 bp, Homo sapiens
ctctgccgctgccatg

SEQ ID NO: 6156168 - DNA, 22 bp, Homo sapiens
ctctgccgctgccatgctttga

SEQ ID NO: 6156169 - DNA, 15 bp, Homo sapiens
ctctgccggctcttt

SEQ ID NO: 6156170 - DNA, 16 bp, Homo sapiens
ctctgccggtccccca

SEQ ID NO: 6156171 - DNA, 19 bp, Homo sapiens
ctctgccggtcccccatgc

SEQ ID NO: 6156172 - DNA, 21 bp, Homo sapiens
ctctgccggtcgggcagccag

SEQ ID NO: 6156173 - DNA, 19 bp, Homo sapiens
ctctgcctaaccatgggct

SEQ ID NO: 6156174 - DNA, 14 bp, Homo sapiens
ctctgcctacagcc

SEQ ID NO: 6156175 - DNA, 19 bp, Homo sapiens
ctctgcctcaccgcttccc

SEQ ID NO: 6156176 - DNA, 13 bp, Homo sapiens
ctctgcctcacct

SEQ ID NO: 6156177 - DNA, 12 bp, Homo sapiens
ctctgcctcaga

SEQ ID NO: 6156178 - DNA, 14 bp, Homo sapiens
ctctgcctcatcct

SEQ ID NO: 6156179 - DNA, 15 bp, Homo sapiens
ctctgcctcatcctc

SEQ ID NO: 6156180 - DNA, 16 bp, Homo sapiens
ctctgcctccaccctc

SEQ ID NO: 6156181 - DNA, 22 bp, Homo sapiens
ctctgcctccaccctcctcctc

SEQ ID NO: 6156182 - DNA, 13 bp, Homo sapiens
ctctgcctccagg

SEQ ID NO: 6156183 - DNA, 14 bp, Homo sapiens
ctctgcctccagga

SEQ ID NO: 6156184 - DNA, 14 bp, Homo sapiens
ctctgcctccaggt

SEQ ID NO: 6156185 - DNA, 13 bp, Homo sapiens
ctctgcctcccaa

SEQ ID NO: 6156186 - DNA, 14 bp, Homo sapiens
ctctgcctcccagg

SEQ ID NO: 6156187 - DNA, 16 bp, Homo sapiens
ctctgcctcccaggtt

SEQ ID NO: 6156188 - DNA, 16 bp, Homo sapiens
ctctgcctcccatcac

SEQ ID NO: 6156189 - DNA, 17 bp, Homo sapiens
ctctgcctccctctcca

SEQ ID NO: 6156190 - DNA, 16 bp, Homo sapiens
ctctgcctcctcccca

SEQ ID NO: 6156191 - DNA, 22 bp, Homo sapiens
ctctgcctcctggtttcctttc

SEQ ID NO: 6156192 - DNA, 20 bp, Homo sapiens
ctctgcctctaactccctcc

SEQ ID NO: 6156193 - DNA, 16 bp, Homo sapiens
ctctgcctctaaggcc

SEQ ID NO: 6156194 - DNA, 22 bp, Homo sapiens
ctctgcctctaaggccaaggcc

SEQ ID NO: 6156195 - DNA, 23 bp, Homo sapiens
ctctgcctctaaggccaaggcct

SEQ ID NO: 6156196 - DNA, 16 bp, Homo sapiens
ctctgcctctagtccc

SEQ ID NO: 6156197 - DNA, 13 bp, Homo sapiens
ctctgcctctctt

SEQ ID NO: 6156198 - DNA, 19 bp, Homo sapiens
ctctgcctctcttcttccc

SEQ ID NO: 6156199 - DNA, 14 bp, Homo sapiens
ctctgcctctgaca

SEQ ID NO: 6156200 - DNA, 13 bp, Homo sapiens
ctctgcctctggg

SEQ ID NO: 6156201 - DNA, 16 bp, Homo sapiens
ctctgcctctgggcag

SEQ ID NO: 6156202 - DNA, 10 bp, Homo sapiens
ctctgcctga

SEQ ID NO: 6156203 - DNA, 18 bp, Homo sapiens
ctctgcctgaaatgttac

SEQ ID NO: 6156204 - DNA, 21 bp, Homo sapiens
ctctgcctgaagtcacacagt

SEQ ID NO: 6156205 - DNA, 14 bp, Homo sapiens
ctctgcctgacaag

SEQ ID NO: 6156206 - DNA, 17 bp, Homo sapiens
ctctgcctgacaaggcc

SEQ ID NO: 6156207 - DNA, 19 bp, Homo sapiens
ctctgcctgacagcatcct

SEQ ID NO: 6156208 - DNA, 13 bp, Homo sapiens
ctctgcctgcact

SEQ ID NO: 6156209 - DNA, 22 bp, Homo sapiens
ctctgcctgcactccctggcct

SEQ ID NO: 6156210 - DNA, 22 bp, Homo sapiens
ctctgcctgcattctgccgtgt

SEQ ID NO: 6156211 - DNA, 13 bp, Homo sapiens
ctctgcctgcccc

SEQ ID NO: 6156212 - DNA, 15 bp, Homo sapiens
ctctgcctgccccgc

SEQ ID NO: 6156213 - DNA, 12 bp, Homo sapiens
ctctgcctgctg

SEQ ID NO: 6156214 - DNA, 15 bp, Homo sapiens
ctctgcctgctgggc

SEQ ID NO: 6156215 - DNA, 17 bp, Homo sapiens
ctctgcctgcttcctgg

SEQ ID NO: 6156216 - DNA, 18 bp, Homo sapiens
ctctgcctgcttcctgga

SEQ ID NO: 6156217 - DNA, 19 bp, Homo sapiens
ctctgcctgcttcctggac

SEQ ID NO: 6156218 - DNA, 14 bp, Homo sapiens
ctgggccctgtcca

SEQ ID NO: 6156219 - DNA, 22 bp, Homo sapiens
ctgggccctgtcgcccctcctt

SEQ ID NO: 6156220 - DNA, 18 bp, Homo sapiens
ctgggcccttcctggcta

SEQ ID NO: 6156221 - DNA, 19 bp, Homo sapiens
ctgggcccttcctggctag

SEQ ID NO: 6156222 - DNA, 23 bp, Homo sapiens
ctgggccgaggcgcgtttgtgca

SEQ ID NO: 6156223 - DNA, 14 bp, Homo sapiens
ctgggccgcaaggg

SEQ ID NO: 6156224 - DNA, 18 bp, Homo sapiens
ctgggccgcaagggcctg

SEQ ID NO: 6156225 - DNA, 22 bp, Homo sapiens
ctgggccgcaagggcctggacg

SEQ ID NO: 6156226 - DNA, 22 bp, Homo sapiens
ctgggccgcgtgccgggccccc

SEQ ID NO: 6156227 - DNA, 16 bp, Homo sapiens
ctgggccggccagcct

SEQ ID NO: 6156228 - DNA, 18 bp, Homo sapiens
ctgggccggctgagtggc

SEQ ID NO: 6156229 - DNA, 15 bp, Homo sapiens
ctgggccgggcccag

SEQ ID NO: 6156230 - DNA, 18 bp, Homo sapiens
ctgggccgggcccagggc

SEQ ID NO: 6156231 - DNA, 20 bp, Homo sapiens
ctgggccgggcccagggcct

SEQ ID NO: 6156232 - DNA, 17 bp, Homo sapiens
ctgggccgggcctgggg

SEQ ID NO: 6156233 - DNA, 18 bp, Homo sapiens
ctgggccgtatctccggc

SEQ ID NO: 6156234 - DNA, 22 bp, Homo sapiens
ctgggccgtggcacagctggga

SEQ ID NO: 6156235 - DNA, 17 bp, Homo sapiens
ctgggcctaggccagga

SEQ ID NO: 6156236 - DNA, 19 bp, Homo sapiens
ctgggcctcagcctccagg

SEQ ID NO: 6156237 - DNA, 11 bp, Homo sapiens
ctgggcctcca

SEQ ID NO: 6156238 - DNA, 14 bp, Homo sapiens
ctgggcctccacct

SEQ ID NO: 6156239 - DNA, 15 bp, Homo sapiens
ctgggcctcccctgg

SEQ ID NO: 6156240 - DNA, 14 bp, Homo sapiens
ctgggcctcccgtc

SEQ ID NO: 6156241 - DNA, 20 bp, Homo sapiens
ctgggcctcctcacaacatg

SEQ ID NO: 6156242 - DNA, 21 bp, Homo sapiens
ctgggcctcctcctagctgga

SEQ ID NO: 6156243 - DNA, 24 bp, Homo sapiens
ctgggcctcctctaacaggggctg

SEQ ID NO: 6156244 - DNA, 15 bp, Homo sapiens
ctgggcctcctgcct

SEQ ID NO: 6156245 - DNA, 19 bp, Homo sapiens
ctgggcctcctgcctccgg

SEQ ID NO: 6156246 - DNA, 16 bp, Homo sapiens
ctgggcctcctgggaa

SEQ ID NO: 6156247 - DNA, 12 bp, Homo sapiens
ctgggcctcctt

SEQ ID NO: 6156248 - DNA, 17 bp, Homo sapiens
ctgggcctcggacccca

SEQ ID NO: 6156249 - DNA, 20 bp, Homo sapiens
ctgggcctctgactctgagt

SEQ ID NO: 6156250 - DNA, 17 bp, Homo sapiens
ctgggcctctgatgttc

SEQ ID NO: 6156251 - DNA, 13 bp, Homo sapiens
ctgggcctgagcc

SEQ ID NO: 6156252 - DNA, 12 bp, Homo sapiens
ctgggcctgagg

SEQ ID NO: 6156253 - DNA, 17 bp, Homo sapiens
ctgggcctgagggtcca

SEQ ID NO: 6156254 - DNA, 22 bp, Homo sapiens
ctgggcctgagggtccacctgg

SEQ ID NO: 6156255 - DNA, 12 bp, Homo sapiens
ctgggcctgatg

SEQ ID NO: 6156256 - DNA, 14 bp, Homo sapiens
ctgggcctgatgga

SEQ ID NO: 6156257 - DNA, 23 bp, Homo sapiens
ctgggcctgatggagaggagaac

SEQ ID NO: 6156258 - DNA, 19 bp, Homo sapiens
ctgggcctgatggtggggc

SEQ ID NO: 6156259 - DNA, 20 bp, Homo sapiens
ctgggcctgatggtggggcc

SEQ ID NO: 6156260 - DNA, 16 bp, Homo sapiens
ctgggcctgcctcacc

SEQ ID NO: 6156261 - DNA, 13 bp, Homo sapiens
ctgggcctgctgc

SEQ ID NO: 6156262 - DNA, 15 bp, Homo sapiens
ctgggcctgctgctg

SEQ ID NO: 6156263 - DNA, 17 bp, Homo sapiens
ctgggcctgctgctgag

SEQ ID NO: 6156264 - DNA, 18 bp, Homo sapiens
ctgggcctgctgctgaga

SEQ ID NO: 6156265 - DNA, 20 bp, Homo sapiens
ctgggcctgctgctgagaac

SEQ ID NO: 6156266 - DNA, 22 bp, Homo sapiens
ctgggcctgctgctgagaacct

SEQ ID NO: 6156267 - DNA, 19 bp, Homo sapiens
ctgggcctgcttttccagg

SEQ ID NO: 6156268 - DNA, 23 bp, Homo sapiens
ctgggcctgcttttccaggatcc

SEQ ID NO: 6156269 - DNA, 23 bp, Homo sapiens
ctgggcctggctccctcactctc

SEQ ID NO: 6156270 - DNA, 16 bp, Homo sapiens
ctgggcctgggctagg

SEQ ID NO: 6156271 - DNA, 12 bp, Homo sapiens
ctgggcctgggg

SEQ ID NO: 6156272 - DNA, 13 bp, Homo sapiens
ctgggcctggggt

SEQ ID NO: 6156273 - DNA, 14 bp, Homo sapiens
ctgggcctggggtg

SEQ ID NO: 6156274 - DNA, 11 bp, Homo sapiens
ctgggcctggt

SEQ ID NO: 6156275 - DNA, 14 bp, Homo sapiens
ctgggcctggtctc

SEQ ID NO: 6156276 - DNA, 15 bp, Homo sapiens
ctgggcctggtctca

SEQ ID NO: 6156277 - DNA, 19 bp, Homo sapiens
ctgggcctggtctcaccct

SEQ ID NO: 6156278 - DNA, 13 bp, Homo sapiens
ctgggcctgtccc

SEQ ID NO: 6156279 - DNA, 13 bp, Homo sapiens
ctgggcctgtctc

SEQ ID NO: 6156280 - DNA, 16 bp, Homo sapiens
ctgggcctgtctcaga

SEQ ID NO: 6156281 - DNA, 18 bp, Homo sapiens
ctgggcctgtctcagatt

SEQ ID NO: 6156282 - DNA, 14 bp, Homo sapiens
ctgggcctgtgcac

SEQ ID NO: 6156283 - DNA, 15 bp, Homo sapiens
ctgggcctgtgcagc

SEQ ID NO: 6156284 - DNA, 18 bp, Homo sapiens
ctgggcctgtgcagcagc

SEQ ID NO: 6156285 - DNA, 23 bp, Homo sapiens
ctgggcctgtgcagcagcccagc

SEQ ID NO: 6156286 - DNA, 20 bp, Homo sapiens
ctgggccttacctcccctgc

SEQ ID NO: 6156287 - DNA, 22 bp, Homo sapiens
ctgggccttacctcccctgcca

SEQ ID NO: 6156288 - DNA, 24 bp, Homo sapiens
ctgggccttacctcccctgccagg

SEQ ID NO: 6156289 - DNA, 18 bp, Homo sapiens
ctgggccttaggaagagc

SEQ ID NO: 6156290 - DNA, 20 bp, Homo sapiens
ctgggccttctcagctctcc

SEQ ID NO: 6156291 - DNA, 23 bp, Homo sapiens
ctgggccttctcagctctccacc

SEQ ID NO: 6156292 - DNA, 11 bp, Homo sapiens
ctgggccttgg

SEQ ID NO: 6156293 - DNA, 13 bp, Homo sapiens
ctgggccttggct

SEQ ID NO: 6156294 - DNA, 18 bp, Homo sapiens
ctgggccttggctgggcc

SEQ ID NO: 6156295 - DNA, 19 bp, Homo sapiens
ctgggccttggctgggcct

SEQ ID NO: 6156296 - DNA, 23 bp, Homo sapiens
ctgggccttgtgtgctggcttcc

SEQ ID NO: 6156297 - DNA, 19 bp, Homo sapiens
ctgggcctttccagagaac

SEQ ID NO: 6156298 - DNA, 23 bp, Homo sapiens
ctgggcctttcctgtgccaacct

SEQ ID NO: 6156299 - DNA, 15 bp, Homo sapiens
ctgggcgacagagca

SEQ ID NO: 6156300 - DNA, 20 bp, Homo sapiens
ctgggcgagcccctccttct

SEQ ID NO: 6156301 - DNA, 19 bp, Homo sapiens
ctgggcgcaagcgacacag

SEQ ID NO: 6156302 - DNA, 22 bp, Homo sapiens
ctgggcgccggttccacgtggg

SEQ ID NO: 6156303 - DNA, 20 bp, Homo sapiens
ctgggcgcggtggctcacgc

SEQ ID NO: 6156304 - DNA, 14 bp, Homo sapiens
ctgggcgctggtcc

SEQ ID NO: 6156305 - DNA, 22 bp, Homo sapiens
ctgggcggcgggcggctgggtc

SEQ ID NO: 6156306 - DNA, 16 bp, Homo sapiens
ctgggcggggccgcag

SEQ ID NO: 6156307 - DNA, 22 bp, Homo sapiens
ctgggcggggccgcagccacac

SEQ ID NO: 6156308 - DNA, 20 bp, Homo sapiens
ctgggcggggctcgaggctg

SEQ ID NO: 6156309 - DNA, 18 bp, Homo sapiens
ctgggcgtccagctcagc

SEQ ID NO: 6156310 - DNA, 12 bp, Homo sapiens
ctgggcgtctga

SEQ ID NO: 6156311 - DNA, 19 bp, Homo sapiens
ctgggcgtctgagctgggg

SEQ ID NO: 6156312 - DNA, 20 bp, Homo sapiens
ctgggcgtctgagctggggt

SEQ ID NO: 6156313 - DNA, 16 bp, Homo sapiens
ctgggcgtgtgtgaca

SEQ ID NO: 6156314 - DNA, 17 bp, Homo sapiens
ctgggcgtgtgtgacac

SEQ ID NO: 6156315 - DNA, 19 bp, Homo sapiens
ctgggctacagaaaccaca

SEQ ID NO: 6156316 - DNA, 18 bp, Homo sapiens
ctgggctactgccactgt

SEQ ID NO: 6156317 - DNA, 19 bp, Homo sapiens
ctgggctagaggctgagca

SEQ ID NO: 6156318 - DNA, 20 bp, Homo sapiens
ctgggctagaggctgagcac

SEQ ID NO: 6156319 - DNA, 22 bp, Homo sapiens
ctgggctagggagaatgcagag

SEQ ID NO: 6156320 - DNA, 23 bp, Homo sapiens
ctgggctagggagaatgcagaga

SEQ ID NO: 6156321 - DNA, 15 bp, Homo sapiens
ctgggctaggggaca

SEQ ID NO: 6156322 - DNA, 18 bp, Homo sapiens
ctgggctaggtagaaaaa

SEQ ID NO: 6156323 - DNA, 15 bp, Homo sapiens
ctgggctatggacac

SEQ ID NO: 6156324 - DNA, 17 bp, Homo sapiens
ctgggctatggacacag

SEQ ID NO: 6156325 - DNA, 20 bp, Homo sapiens
ctgggctatggacacagggt

SEQ ID NO: 6156326 - DNA, 22 bp, Homo sapiens
ctgggctattgctgctgcccct

SEQ ID NO: 6156327 - DNA, 21 bp, Homo sapiens
ctgggctcaagcaatcctcct

SEQ ID NO: 6156328 - DNA, 24 bp, Homo sapiens
ctgggctcaagcaatcctcctgag

SEQ ID NO: 6156329 - DNA, 15 bp, Homo sapiens
ctgggctcaagcttt

SEQ ID NO: 6156330 - DNA, 19 bp, Homo sapiens
ctgggctcacaccagccct

SEQ ID NO: 6156331 - DNA, 20 bp, Homo sapiens
ctgggctcacaccagccctg

SEQ ID NO: 6156332 - DNA, 21 bp, Homo sapiens
ctgggctcacaccagccctgg

SEQ ID NO: 6156333 - DNA, 22 bp, Homo sapiens
ctgggctcacaccagccctggt

SEQ ID NO: 6156334 - DNA, 14 bp, Homo sapiens
ctgggctcacaggc

SEQ ID NO: 6156335 - DNA, 12 bp, Homo sapiens
ctgggctcacta

SEQ ID NO: 6156336 - DNA, 12 bp, Homo sapiens
ctgggctcagac

SEQ ID NO: 6156337 - DNA, 23 bp, Homo sapiens
ctgggctcagctcagctcccaca

SEQ ID NO: 6156338 - DNA, 18 bp, Homo sapiens
ctgggctcagggagggag

SEQ ID NO: 6156339 - DNA, 13 bp, Homo sapiens
ctgggctcagggc

SEQ ID NO: 6156340 - DNA, 20 bp, Homo sapiens
ctgggctcagggctggagtg

SEQ ID NO: 6156341 - DNA, 14 bp, Homo sapiens
ctgggctccacaca

SEQ ID NO: 6156342 - DNA, 21 bp, Homo sapiens
ctgggctccacacagcagtgt

SEQ ID NO: 6156343 - DNA, 23 bp, Homo sapiens
ctgggctccacacagcagtgtcc

SEQ ID NO: 6156344 - DNA, 17 bp, Homo sapiens
ctgggctccccccagtg

SEQ ID NO: 6156345 - DNA, 18 bp, Homo sapiens
ctgggctcccgggcccca

SEQ ID NO: 6156346 - DNA, 21 bp, Homo sapiens
ctgggctcccgggccccacag

SEQ ID NO: 6156347 - DNA, 19 bp, Homo sapiens
ctgggctcccgtgtatctg

SEQ ID NO: 6156348 - DNA, 14 bp, Homo sapiens
ctgggctccctctt

SEQ ID NO: 6156349 - DNA, 17 bp, Homo sapiens
ctgggctccctcttgtg

SEQ ID NO: 6156350 - DNA, 16 bp, Homo sapiens
ctgggctccctgatga

SEQ ID NO: 6156351 - DNA, 18 bp, Homo sapiens
ctgggctccctgatgaca

SEQ ID NO: 6156352 - DNA, 14 bp, Homo sapiens
ctgggctccctgga

SEQ ID NO: 6156353 - DNA, 22 bp, Homo sapiens
ctgggctccctttaagccaaga

SEQ ID NO: 6156354 - DNA, 22 bp, Homo sapiens
ctgggctccggaggactcacca

SEQ ID NO: 6156355 - DNA, 21 bp, Homo sapiens
ctgggctcctaaccttcctgt

SEQ ID NO: 6156356 - DNA, 11 bp, Homo sapiens
ctgggctcctc

SEQ ID NO: 6156357 - DNA, 13 bp, Homo sapiens
ctgggctcctctt

SEQ ID NO: 6156358 - DNA, 15 bp, Homo sapiens
ctgggctcctcttgg

SEQ ID NO: 6156359 - DNA, 13 bp, Homo sapiens
ctgggctcctgga

SEQ ID NO: 6156360 - DNA, 20 bp, Homo sapiens
ctgggctctaaggtactgtg

SEQ ID NO: 6156361 - DNA, 14 bp, Homo sapiens
ctgggctctcaccc

SEQ ID NO: 6156362 - DNA, 17 bp, Homo sapiens
ctgggctctcacccagt

SEQ ID NO: 6156363 - DNA, 13 bp, Homo sapiens
ctgggctctccac

SEQ ID NO: 6156364 - DNA, 15 bp, Homo sapiens
ctgggctctccacct

SEQ ID NO: 6156365 - DNA, 21 bp, Homo sapiens
ctgggctctccacctcagcct

SEQ ID NO: 6156366 - DNA, 14 bp, Homo sapiens
ctgggctctgagga

SEQ ID NO: 6156367 - DNA, 15 bp, Homo sapiens
ctgggctctgccacc

SEQ ID NO: 6156368 - DNA, 21 bp, Homo sapiens
ctgggctctgccaccctacct

SEQ ID NO: 6156369 - DNA, 12 bp, Homo sapiens
ctgggctctgga

SEQ ID NO: 6156370 - DNA, 13 bp, Homo sapiens
ctgggctctggac

SEQ ID NO: 6156371 - DNA, 14 bp, Homo sapiens
ctgggctctggacc

SEQ ID NO: 6156372 - DNA, 18 bp, Homo sapiens
ctgggctctggacctcag

SEQ ID NO: 6156373 - DNA, 19 bp, Homo sapiens
ctgggctctggacctcagg

SEQ ID NO: 6156374 - DNA, 20 bp, Homo sapiens
ctgggctctggacctcagga

SEQ ID NO: 6156375 - DNA, 17 bp, Homo sapiens
ctgggctctggactcca

SEQ ID NO: 6156376 - DNA, 14 bp, Homo sapiens
ctgggctctggctc

SEQ ID NO: 6156377 - DNA, 15 bp, Homo sapiens
ctgggctctgggagc

SEQ ID NO: 6156378 - DNA, 12 bp, Homo sapiens
ctgggctctggt

SEQ ID NO: 6156379 - DNA, 14 bp, Homo sapiens
ctgggctctggtct

SEQ ID NO: 6156380 - DNA, 14 bp, Homo sapiens
ctgggctctggtgg

SEQ ID NO: 6156381 - DNA, 19 bp, Homo sapiens
ctgggctctgtcttcctgg

SEQ ID NO: 6156382 - DNA, 14 bp, Homo sapiens
ctgggctctgtggg

SEQ ID NO: 6156383 - DNA, 18 bp, Homo sapiens
ctgggctctgtgggctgc

SEQ ID NO: 6156384 - DNA, 18 bp, Homo sapiens
ctgggctgaacactccaa

SEQ ID NO: 6156385 - DNA, 19 bp, Homo sapiens
ctgggctgaatgacagtga

SEQ ID NO: 6156386 - DNA, 12 bp, Homo sapiens
ctgggctgactg

SEQ ID NO: 6156387 - DNA, 15 bp, Homo sapiens
ctgggctgactggga

SEQ ID NO: 6156388 - DNA, 13 bp, Homo sapiens
ctgggctgagaga

SEQ ID NO: 6156389 - DNA, 12 bp, Homo sapiens
ctgggctgagcc

SEQ ID NO: 6156390 - DNA, 13 bp, Homo sapiens
ctgggctgagcca

SEQ ID NO: 6156391 - DNA, 15 bp, Homo sapiens
ctgggctgaggaggc

SEQ ID NO: 6156392 - DNA, 12 bp, Homo sapiens
ctgggctgaggg

SEQ ID NO: 6156393 - DNA, 13 bp, Homo sapiens
ctgggctgaggga

SEQ ID NO: 6156394 - DNA, 16 bp, Homo sapiens
ctgggctgagggagcc

SEQ ID NO: 6156395 - DNA, 23 bp, Homo sapiens
ctgggctgagggagcctggcccc

SEQ ID NO: 6156396 - DNA, 14 bp, Homo sapiens
ctgggctgcagaga

SEQ ID NO: 6156397 - DNA, 11 bp, Homo sapiens
ctctgcctgga

SEQ ID NO: 6156398 - DNA, 17 bp, Homo sapiens
ctctgcctggagcaggg

SEQ ID NO: 6156399 - DNA, 18 bp, Homo sapiens
ctctgcctggagcagggg

SEQ ID NO: 6156400 - DNA, 15 bp, Homo sapiens
ctctgcctgggatgc

SEQ ID NO: 6156401 - DNA, 17 bp, Homo sapiens
ctctgcctgggatgccc

SEQ ID NO: 6156402 - DNA, 22 bp, Homo sapiens
ctctgcctgggatgggctccca

SEQ ID NO: 6156403 - DNA, 16 bp, Homo sapiens
ctctgcctgtccctct

SEQ ID NO: 6156404 - DNA, 19 bp, Homo sapiens
ctctgcctgtccctctcag

SEQ ID NO: 6156405 - DNA, 15 bp, Homo sapiens
ctctgcctgtgcccg

SEQ ID NO: 6156406 - DNA, 17 bp, Homo sapiens
ctctgcctgtgcccgct

SEQ ID NO: 6156407 - DNA, 23 bp, Homo sapiens
ctctgcctgtgcccgctgcgctg

SEQ ID NO: 6156408 - DNA, 17 bp, Homo sapiens
ctctgcctgttcctccc

SEQ ID NO: 6156409 - DNA, 18 bp, Homo sapiens
ctctgccttcaggcttct

SEQ ID NO: 6156410 - DNA, 13 bp, Homo sapiens
ctctgccttccag

SEQ ID NO: 6156411 - DNA, 14 bp, Homo sapiens
ctctgccttccagg

SEQ ID NO: 6156412 - DNA, 15 bp, Homo sapiens
ctctgccttccaggc

SEQ ID NO: 6156413 - DNA, 21 bp, Homo sapiens
ctctgccttgatggagaagga

SEQ ID NO: 6156414 - DNA, 20 bp, Homo sapiens
ctctgccttgcacaaaaagc

SEQ ID NO: 6156415 - DNA, 15 bp, Homo sapiens
ctctgccttgccctc

SEQ ID NO: 6156416 - DNA, 14 bp, Homo sapiens
ctctgccttgcctt

SEQ ID NO: 6156417 - DNA, 23 bp, Homo sapiens
ctctgcctttatgatgctaagct

SEQ ID NO: 6156418 - DNA, 15 bp, Homo sapiens
ctctgcctttgctct

SEQ ID NO: 6156419 - DNA, 17 bp, Homo sapiens
ctctgcctttgtgctct

SEQ ID NO: 6156420 - DNA, 19 bp, Homo sapiens
ctctgcgacgatccccatg

SEQ ID NO: 6156421 - DNA, 14 bp, Homo sapiens
ctctgcgagcaaca

SEQ ID NO: 6156422 - DNA, 22 bp, Homo sapiens
ctctgcgagcaacagtgccccc

SEQ ID NO: 6156423 - DNA, 13 bp, Homo sapiens
ctctgcgccaggc

SEQ ID NO: 6156424 - DNA, 14 bp, Homo sapiens
ctctgcgccaggca

SEQ ID NO: 6156425 - DNA, 13 bp, Homo sapiens
ctctgcgccccag

SEQ ID NO: 6156426 - DNA, 18 bp, Homo sapiens
ctctgcgcctctccactg

SEQ ID NO: 6156427 - DNA, 15 bp, Homo sapiens
ctctgcgctgaggcc

SEQ ID NO: 6156428 - DNA, 14 bp, Homo sapiens
ctctgcggacccca

SEQ ID NO: 6156429 - DNA, 15 bp, Homo sapiens
ctctgcggaccccag

SEQ ID NO: 6156430 - DNA, 20 bp, Homo sapiens
ctctgcggaccccagctgtg

SEQ ID NO: 6156431 - DNA, 18 bp, Homo sapiens
ctctgcggagcacactgg

SEQ ID NO: 6156432 - DNA, 19 bp, Homo sapiens
ctctgcggccactgcgcca

SEQ ID NO: 6156433 - DNA, 19 bp, Homo sapiens
ctctgcggcccgggccgac

SEQ ID NO: 6156434 - DNA, 21 bp, Homo sapiens
ctctgcgggaggctggggccc

SEQ ID NO: 6156435 - DNA, 24 bp, Homo sapiens
ctctgcggggcagggccttcctgg

SEQ ID NO: 6156436 - DNA, 20 bp, Homo sapiens
ctctgcgtcccactgagtct

SEQ ID NO: 6156437 - DNA, 17 bp, Homo sapiens
ctctgcgtcccccagcc

SEQ ID NO: 6156438 - DNA, 19 bp, Homo sapiens
ctctgcgtcccccagccct

SEQ ID NO: 6156439 - DNA, 22 bp, Homo sapiens
ctctgcgtcccccagccctcag

SEQ ID NO: 6156440 - DNA, 23 bp, Homo sapiens
ctctgcgtcccccagccctcagg

SEQ ID NO: 6156441 - DNA, 22 bp, Homo sapiens
ctctgcgtgcagggacaaagag

SEQ ID NO: 6156442 - DNA, 21 bp, Homo sapiens
ctctgcgtggcgcaggtgcca

SEQ ID NO: 6156443 - DNA, 18 bp, Homo sapiens
ctctgcgttggcttctcc

SEQ ID NO: 6156444 - DNA, 20 bp, Homo sapiens
ctctgcgttggcttctccct

SEQ ID NO: 6156445 - DNA, 23 bp, Homo sapiens
ctctgcgttggcttctccctggg

SEQ ID NO: 6156446 - DNA, 16 bp, Homo sapiens
ctctgctactgaggca

SEQ ID NO: 6156447 - DNA, 12 bp, Homo sapiens
ctctgctagact

SEQ ID NO: 6156448 - DNA, 18 bp, Homo sapiens
ctctgctagatttctaca

SEQ ID NO: 6156449 - DNA, 23 bp, Homo sapiens
ctctgctatatataaaacggtgc

SEQ ID NO: 6156450 - DNA, 15 bp, Homo sapiens
ctctgctatgagtgt

SEQ ID NO: 6156451 - DNA, 15 bp, Homo sapiens
ctctgctatgcattt

SEQ ID NO: 6156452 - DNA, 19 bp, Homo sapiens
ctctgctatgcattttctt

SEQ ID NO: 6156453 - DNA, 21 bp, Homo sapiens
ctctgctatgcattttcttca

SEQ ID NO: 6156454 - DNA, 17 bp, Homo sapiens
ctctgctatgtctgtga

SEQ ID NO: 6156455 - DNA, 18 bp, Homo sapiens
ctctgctattaggccagc

SEQ ID NO: 6156456 - DNA, 19 bp, Homo sapiens
ctctgctatttctcttgct

SEQ ID NO: 6156457 - DNA, 13 bp, Homo sapiens
ctctgctcaggcc

SEQ ID NO: 6156458 - DNA, 15 bp, Homo sapiens
ctctgctcaggcctc

SEQ ID NO: 6156459 - DNA, 23 bp, Homo sapiens
ctctgctcaggcctccctagcac

SEQ ID NO: 6156460 - DNA, 16 bp, Homo sapiens
ctctgctcagggccgc

SEQ ID NO: 6156461 - DNA, 21 bp, Homo sapiens
ctctgctcagtgatctcactt

SEQ ID NO: 6156462 - DNA, 22 bp, Homo sapiens
ctctgctccaaccgggatggga

SEQ ID NO: 6156463 - DNA, 12 bp, Homo sapiens
ctctgctccacc

SEQ ID NO: 6156464 - DNA, 14 bp, Homo sapiens
ctctgctccaccac

SEQ ID NO: 6156465 - DNA, 19 bp, Homo sapiens
ctctgctccaccacatcct

SEQ ID NO: 6156466 - DNA, 19 bp, Homo sapiens
ctctgctccacctttcagc

SEQ ID NO: 6156467 - DNA, 15 bp, Homo sapiens
ctctgctccagactc

SEQ ID NO: 6156468 - DNA, 13 bp, Homo sapiens
ctctgctccagca

SEQ ID NO: 6156469 - DNA, 15 bp, Homo sapiens
ctctgctccagcaac

SEQ ID NO: 6156470 - DNA, 12 bp, Homo sapiens
ctctgctcccag

SEQ ID NO: 6156471 - DNA, 14 bp, Homo sapiens
ctctgctcccagcc

SEQ ID NO: 6156472 - DNA, 12 bp, Homo sapiens
ctctgctccctc

SEQ ID NO: 6156473 - DNA, 13 bp, Homo sapiens
ctctgctccctct

SEQ ID NO: 6156474 - DNA, 11 bp, Homo sapiens
ctctgctccta

SEQ ID NO: 6156475 - DNA, 15 bp, Homo sapiens
ctctgctcgccttag

SEQ ID NO: 6156476 - DNA, 14 bp, Homo sapiens
ctctgctctaccat

SEQ ID NO: 6156477 - DNA, 12 bp, Homo sapiens
ctctgctctagc

SEQ ID NO: 6156478 - DNA, 15 bp, Homo sapiens
ctctgctctagccag

SEQ ID NO: 6156479 - DNA, 17 bp, Homo sapiens
ctctgctctagccagga

SEQ ID NO: 6156480 - DNA, 19 bp, Homo sapiens
ctctgctctagccaggagt

SEQ ID NO: 6156481 - DNA, 15 bp, Homo sapiens
ctctgctctatgcca

SEQ ID NO: 6156482 - DNA, 19 bp, Homo sapiens
ctctgctctatgccaggct

SEQ ID NO: 6156483 - DNA, 15 bp, Homo sapiens
ctctgctctcctcgg

SEQ ID NO: 6156484 - DNA, 21 bp, Homo sapiens
ctctgctctcctcgggccctg

SEQ ID NO: 6156485 - DNA, 14 bp, Homo sapiens
ctctgctctgatgc

SEQ ID NO: 6156486 - DNA, 13 bp, Homo sapiens
ctctgctctgcac

SEQ ID NO: 6156487 - DNA, 12 bp, Homo sapiens
ctctgctctgcc

SEQ ID NO: 6156488 - DNA, 13 bp, Homo sapiens
ctctgctctgctc

SEQ ID NO: 6156489 - DNA, 14 bp, Homo sapiens
ctctgctgaatgca

SEQ ID NO: 6156490 - DNA, 16 bp, Homo sapiens
ctctgctgaatgtaaa

SEQ ID NO: 6156491 - DNA, 16 bp, Homo sapiens
ctctgctgacagacac

SEQ ID NO: 6156492 - DNA, 17 bp, Homo sapiens
ctctgctgacagacaca

SEQ ID NO: 6156493 - DNA, 20 bp, Homo sapiens
ctctgctgacagacacaggc

SEQ ID NO: 6156494 - DNA, 21 bp, Homo sapiens
ctctgctgacagacacaggcc

SEQ ID NO: 6156495 - DNA, 14 bp, Homo sapiens
ctctgctgacttct

SEQ ID NO: 6156496 - DNA, 16 bp, Homo sapiens
ctctgctgacttctga

SEQ ID NO: 6156497 - DNA, 21 bp, Homo sapiens
ctctgctgagcagcccagcac

SEQ ID NO: 6156498 - DNA, 23 bp, Homo sapiens
ctctgctgagcggtactaaacgg

SEQ ID NO: 6156499 - DNA, 20 bp, Homo sapiens
ctctgctgagctgggcccag

SEQ ID NO: 6156500 - DNA, 20 bp, Homo sapiens
ctctgctgaggccagaggaa

SEQ ID NO: 6156501 - DNA, 21 bp, Homo sapiens
ctctgctgagtgctgggcact

SEQ ID NO: 6156502 - DNA, 21 bp, Homo sapiens
ctctgctgatgacccccccag

SEQ ID NO: 6156503 - DNA, 15 bp, Homo sapiens
ctctgctgcatcccc

SEQ ID NO: 6156504 - DNA, 12 bp, Homo sapiens
ctctgctgccca

SEQ ID NO: 6156505 - DNA, 13 bp, Homo sapiens
ctctgctgcccac

SEQ ID NO: 6156506 - DNA, 17 bp, Homo sapiens
ctctgctgcccacggcc

SEQ ID NO: 6156507 - DNA, 12 bp, Homo sapiens
ctctgctgcccc

SEQ ID NO: 6156508 - DNA, 13 bp, Homo sapiens
ctctgctgccccc

SEQ ID NO: 6156509 - DNA, 18 bp, Homo sapiens
ctctgctgcccccttccc

SEQ ID NO: 6156510 - DNA, 22 bp, Homo sapiens
ctctgctgcccccttccccagc

SEQ ID NO: 6156511 - DNA, 11 bp, Homo sapiens
ctctgctgccg

SEQ ID NO: 6156512 - DNA, 21 bp, Homo sapiens
ctctgctgccgccccacccag

SEQ ID NO: 6156513 - DNA, 15 bp, Homo sapiens
ctctgctgccgccct

SEQ ID NO: 6156514 - DNA, 20 bp, Homo sapiens
ctctgctgccggctctgggc

SEQ ID NO: 6156515 - DNA, 17 bp, Homo sapiens
ctctgctgcctctgtgg

SEQ ID NO: 6156516 - DNA, 19 bp, Homo sapiens
ctctgctgcctctgtggaa

SEQ ID NO: 6156517 - DNA, 15 bp, Homo sapiens
ctctgctgcctgtac

SEQ ID NO: 6156518 - DNA, 13 bp, Homo sapiens
ctctgctgctcat

SEQ ID NO: 6156519 - DNA, 14 bp, Homo sapiens
ctctgctgctctga

SEQ ID NO: 6156520 - DNA, 14 bp, Homo sapiens
ctctgctgctgccc

SEQ ID NO: 6156521 - DNA, 15 bp, Homo sapiens
ctctgctgctgcccg

SEQ ID NO: 6156522 - DNA, 16 bp, Homo sapiens
ctctgctgctggctgg

SEQ ID NO: 6156523 - DNA, 21 bp, Homo sapiens
ctctgctgctgtccctccccc

SEQ ID NO: 6156524 - DNA, 20 bp, Homo sapiens
ctctgctgcttctgggcctg

SEQ ID NO: 6156525 - DNA, 21 bp, Homo sapiens
ctctgctgcttctgggcctga

SEQ ID NO: 6156526 - DNA, 20 bp, Homo sapiens
ctctgctggaaggggcagca

SEQ ID NO: 6156527 - DNA, 16 bp, Homo sapiens
ctctgctggaatagga

SEQ ID NO: 6156528 - DNA, 14 bp, Homo sapiens
ctctgctggcctgg

SEQ ID NO: 6156529 - DNA, 15 bp, Homo sapiens
ctctgctggctcagg

SEQ ID NO: 6156530 - DNA, 16 bp, Homo sapiens
ctctgctggctcagga

SEQ ID NO: 6156531 - DNA, 12 bp, Homo sapiens
ctctgctgggtc

SEQ ID NO: 6156532 - DNA, 21 bp, Homo sapiens
ctctgctgtattgatatcact

SEQ ID NO: 6156533 - DNA, 15 bp, Homo sapiens
ctctgcttaaacaaa

SEQ ID NO: 6156534 - DNA, 18 bp, Homo sapiens
ctctgcttactttttata

SEQ ID NO: 6156535 - DNA, 15 bp, Homo sapiens
ctctgcttccagttg

SEQ ID NO: 6156536 - DNA, 23 bp, Homo sapiens
ctctgcttccatggcttcctgag

SEQ ID NO: 6156537 - DNA, 15 bp, Homo sapiens
ctctgcttccgttcc

SEQ ID NO: 6156538 - DNA, 22 bp, Homo sapiens
ctctgcttccgttcctccccct

SEQ ID NO: 6156539 - DNA, 14 bp, Homo sapiens
ctctgcttcctcag

SEQ ID NO: 6156540 - DNA, 16 bp, Homo sapiens
ctctgcttcctgagct

SEQ ID NO: 6156541 - DNA, 19 bp, Homo sapiens
ctctgcttctcggggtcca

SEQ ID NO: 6156542 - DNA, 23 bp, Homo sapiens
ctctgcttctcggggtccagtgc

SEQ ID NO: 6156543 - DNA, 12 bp, Homo sapiens
ctctgcttctct

SEQ ID NO: 6156544 - DNA, 13 bp, Homo sapiens
ctctgcttctctg

SEQ ID NO: 6156545 - DNA, 16 bp, Homo sapiens
ctctgcttctttgcct

SEQ ID NO: 6156546 - DNA, 19 bp, Homo sapiens
ctctgcttgacaacatctg

SEQ ID NO: 6156547 - DNA, 17 bp, Homo sapiens
ctctgcttgagtcaggt

SEQ ID NO: 6156548 - DNA, 14 bp, Homo sapiens
ctctgcttgccagc

SEQ ID NO: 6156549 - DNA, 14 bp, Homo sapiens
ctctgcttgccatc

SEQ ID NO: 6156550 - DNA, 17 bp, Homo sapiens
ctctgcttgccatccct

SEQ ID NO: 6156551 - DNA, 18 bp, Homo sapiens
ctctgcttgccgaaactg

SEQ ID NO: 6156552 - DNA, 22 bp, Homo sapiens
ctctgcttgccgactggctgtg

SEQ ID NO: 6156553 - DNA, 15 bp, Homo sapiens
ctctgcttggcttcc

SEQ ID NO: 6156554 - DNA, 16 bp, Homo sapiens
ctctgctttccttttc

SEQ ID NO: 6156555 - DNA, 21 bp, Homo sapiens
ctctgctttccttttctctgc

SEQ ID NO: 6156556 - DNA, 20 bp, Homo sapiens
ctctgctttctcctgtagca

SEQ ID NO: 6156557 - DNA, 15 bp, Homo sapiens
ctctgctttggaaat

SEQ ID NO: 6156558 - DNA, 21 bp, Homo sapiens
ctctgcttttccattctgggt

SEQ ID NO: 6156559 - DNA, 22 bp, Homo sapiens
ctctgcttttccattctgggtg

SEQ ID NO: 6156560 - DNA, 18 bp, Homo sapiens
ctctgcttttgcacacct

SEQ ID NO: 6156561 - DNA, 21 bp, Homo sapiens
ctctggaaaggggggagctgg

SEQ ID NO: 6156562 - DNA, 20 bp, Homo sapiens
ctctggaaccatcctctgtt

SEQ ID NO: 6156563 - DNA, 21 bp, Homo sapiens
ctctggaaccatcctctgtta

SEQ ID NO: 6156564 - DNA, 14 bp, Homo sapiens
ctctggaacccccc

SEQ ID NO: 6156565 - DNA, 21 bp, Homo sapiens
ctctggaaccccccaggccct

SEQ ID NO: 6156566 - DNA, 23 bp, Homo sapiens
ctctggaactgattgctcccagg

SEQ ID NO: 6156567 - DNA, 19 bp, Homo sapiens
ctctggaagccccccacct

SEQ ID NO: 6156568 - DNA, 16 bp, Homo sapiens
ctctggaagcctgctg

SEQ ID NO: 6156569 - DNA, 15 bp, Homo sapiens
ctctggaagcctgga

SEQ ID NO: 6156570 - DNA, 20 bp, Homo sapiens
ctctggaaggccccttccct

SEQ ID NO: 6156571 - DNA, 18 bp, Homo sapiens
ctctggaaggggcagccc

SEQ ID NO: 6156572 - DNA, 20 bp, Homo sapiens
ctctggaaggggcagccctg

SEQ ID NO: 6156573 - DNA, 21 bp, Homo sapiens
ctctggaaggggcagccctga

SEQ ID NO: 6156574 - DNA, 19 bp, Homo sapiens
ctctggaataaagttgcag

SEQ ID NO: 6156575 - DNA, 15 bp, Homo sapiens
ctctggaatgcactg

SEQ ID NO: 6156576 - DNA, 16 bp, Homo sapiens
ctctggaatgcactga

SEQ ID NO: 6156577 - DNA, 15 bp, Homo sapiens
ctgggctgccaccag

SEQ ID NO: 6156578 - DNA, 17 bp, Homo sapiens
ctgggctgccatgtgaa

SEQ ID NO: 6156579 - DNA, 12 bp, Homo sapiens
ctgggctgcctc

SEQ ID NO: 6156580 - DNA, 22 bp, Homo sapiens
ctgggctgcgggaggccctggc

SEQ ID NO: 6156581 - DNA, 23 bp, Homo sapiens
ctgggctgcgggaggccctggcc

SEQ ID NO: 6156582 - DNA, 15 bp, Homo sapiens
ctgggctgctcctga

SEQ ID NO: 6156583 - DNA, 19 bp, Homo sapiens
ctgggctgctggggcaggg

SEQ ID NO: 6156584 - DNA, 14 bp, Homo sapiens
ctgggctggactgg

SEQ ID NO: 6156585 - DNA, 17 bp, Homo sapiens
ctgggctggatgagctc

SEQ ID NO: 6156586 - DNA, 18 bp, Homo sapiens
ctgggctggcacagcccc

SEQ ID NO: 6156587 - DNA, 20 bp, Homo sapiens
ctgggctggcacagcccctg

SEQ ID NO: 6156588 - DNA, 21 bp, Homo sapiens
ctgggctggcacagcccctgg

SEQ ID NO: 6156589 - DNA, 22 bp, Homo sapiens
ctgggctggcacagcccctgga

SEQ ID NO: 6156590 - DNA, 14 bp, Homo sapiens
ctgggctggcagag

SEQ ID NO: 6156591 - DNA, 15 bp, Homo sapiens
ctgggctggccagtt

SEQ ID NO: 6156592 - DNA, 22 bp, Homo sapiens
ctgggctggccagttggaacca

SEQ ID NO: 6156593 - DNA, 13 bp, Homo sapiens
ctgggctggcgct

SEQ ID NO: 6156594 - DNA, 14 bp, Homo sapiens
ctgggctggcgctt

SEQ ID NO: 6156595 - DNA, 20 bp, Homo sapiens
ctgggctggcgcttggatct

SEQ ID NO: 6156596 - DNA, 16 bp, Homo sapiens
ctgggctggcggccat

SEQ ID NO: 6156597 - DNA, 16 bp, Homo sapiens
ctgggctggctccctc

SEQ ID NO: 6156598 - DNA, 12 bp, Homo sapiens
ctgggctggctg

SEQ ID NO: 6156599 - DNA, 14 bp, Homo sapiens
ctgggctggctgcc

SEQ ID NO: 6156600 - DNA, 22 bp, Homo sapiens
ctgggctggctgccttctgcgg

SEQ ID NO: 6156601 - DNA, 15 bp, Homo sapiens
ctgggctggctgctc

SEQ ID NO: 6156602 - DNA, 17 bp, Homo sapiens
ctgggctggctgctcct

SEQ ID NO: 6156603 - DNA, 12 bp, Homo sapiens
ctgggctgggaa

SEQ ID NO: 6156604 - DNA, 14 bp, Homo sapiens
ctgggctgggagaa

SEQ ID NO: 6156605 - DNA, 17 bp, Homo sapiens
ctgggctgggcacctga

SEQ ID NO: 6156606 - DNA, 15 bp, Homo sapiens
ctgggctgggcagcc

SEQ ID NO: 6156607 - DNA, 16 bp, Homo sapiens
ctgggctgggccctct

SEQ ID NO: 6156608 - DNA, 21 bp, Homo sapiens
ctgggctgggcccttcctggc

SEQ ID NO: 6156609 - DNA, 13 bp, Homo sapiens
ctgggctgggctg

SEQ ID NO: 6156610 - DNA, 16 bp, Homo sapiens
ctgggctgggctgagc

SEQ ID NO: 6156611 - DNA, 19 bp, Homo sapiens
ctgggctgggctgagcccc

SEQ ID NO: 6156612 - DNA, 18 bp, Homo sapiens
ctgggctggggaggacct

SEQ ID NO: 6156613 - DNA, 13 bp, Homo sapiens
ctgggctggggcc

SEQ ID NO: 6156614 - DNA, 18 bp, Homo sapiens
ctgggctggggccacctt

SEQ ID NO: 6156615 - DNA, 15 bp, Homo sapiens
ctgggctggggcctg

SEQ ID NO: 6156616 - DNA, 18 bp, Homo sapiens
ctgggctggggcctgatg

SEQ ID NO: 6156617 - DNA, 20 bp, Homo sapiens
ctgggctggggcctgatggg

SEQ ID NO: 6156618 - DNA, 18 bp, Homo sapiens
ctgggctgggtgcgaccc

SEQ ID NO: 6156619 - DNA, 18 bp, Homo sapiens
ctgggctgggtgctggga

SEQ ID NO: 6156620 - DNA, 18 bp, Homo sapiens
ctgggctgggtggcacac

SEQ ID NO: 6156621 - DNA, 23 bp, Homo sapiens
ctgggctgggtggcacaccaccc

SEQ ID NO: 6156622 - DNA, 22 bp, Homo sapiens
ctgggctgggtggcccctgtct

SEQ ID NO: 6156623 - DNA, 22 bp, Homo sapiens
ctgggctgggtttgctgtcttg

SEQ ID NO: 6156624 - DNA, 21 bp, Homo sapiens
ctgggctggtggctcccggag

SEQ ID NO: 6156625 - DNA, 11 bp, Homo sapiens
ctgggctgtcc

SEQ ID NO: 6156626 - DNA, 18 bp, Homo sapiens
ctgggctgtccagcctta

SEQ ID NO: 6156627 - DNA, 12 bp, Homo sapiens
ctgggctgtctc

SEQ ID NO: 6156628 - DNA, 15 bp, Homo sapiens
ctgggctgtgctgct

SEQ ID NO: 6156629 - DNA, 12 bp, Homo sapiens
ctgggctgtgtg

SEQ ID NO: 6156630 - DNA, 13 bp, Homo sapiens
ctgggctgttggc

SEQ ID NO: 6156631 - DNA, 18 bp, Homo sapiens
ctgggctgttggctgggg

SEQ ID NO: 6156632 - DNA, 22 bp, Homo sapiens
ctgggctgttgtgtctggagcc

SEQ ID NO: 6156633 - DNA, 14 bp, Homo sapiens
ctgggctgttgttc

SEQ ID NO: 6156634 - DNA, 22 bp, Homo sapiens
ctgggcttaattcccccaagca

SEQ ID NO: 6156635 - DNA, 22 bp, Homo sapiens
ctgggcttcagggtatcccaga

SEQ ID NO: 6156636 - DNA, 17 bp, Homo sapiens
ctgggcttcagtggcag

SEQ ID NO: 6156637 - DNA, 20 bp, Homo sapiens
ctgggcttcattccggactg

SEQ ID NO: 6156638 - DNA, 17 bp, Homo sapiens
ctgggcttcattctgga

SEQ ID NO: 6156639 - DNA, 19 bp, Homo sapiens
ctgggcttcattctggaaa

SEQ ID NO: 6156640 - DNA, 22 bp, Homo sapiens
ctgggcttccacagtgtgaaga

SEQ ID NO: 6156641 - DNA, 12 bp, Homo sapiens
ctgggcttcctg

SEQ ID NO: 6156642 - DNA, 15 bp, Homo sapiens
ctgggcttcctggag

SEQ ID NO: 6156643 - DNA, 16 bp, Homo sapiens
ctgggcttcctggagc

SEQ ID NO: 6156644 - DNA, 19 bp, Homo sapiens
ctgggcttcctggagcaga

SEQ ID NO: 6156645 - DNA, 13 bp, Homo sapiens
ctgggcttggcct

SEQ ID NO: 6156646 - DNA, 14 bp, Homo sapiens
ctgggcttggcctg

SEQ ID NO: 6156647 - DNA, 15 bp, Homo sapiens
ctgggcttggcctgc

SEQ ID NO: 6156648 - DNA, 16 bp, Homo sapiens
ctgggcttggcctgga

SEQ ID NO: 6156649 - DNA, 14 bp, Homo sapiens
ctgggcttggctct

SEQ ID NO: 6156650 - DNA, 13 bp, Homo sapiens
ctgggcttgggga

SEQ ID NO: 6156651 - DNA, 20 bp, Homo sapiens
ctgggcttggggaccagagc

SEQ ID NO: 6156652 - DNA, 23 bp, Homo sapiens
ctgggcttggggtgtggggtggg

SEQ ID NO: 6156653 - DNA, 18 bp, Homo sapiens
ctgggctttctcctggag

SEQ ID NO: 6156654 - DNA, 19 bp, Homo sapiens
ctgggctttctcctggaga

SEQ ID NO: 6156655 - DNA, 20 bp, Homo sapiens
ctgggctttctcctggagat

SEQ ID NO: 6156656 - DNA, 22 bp, Homo sapiens
ctgggctttggggctggtggga

SEQ ID NO: 6156657 - DNA, 16 bp, Homo sapiens
ctggggaaaaaaaaga

SEQ ID NO: 6156658 - DNA, 22 bp, Homo sapiens
ctggggaaaaaaaagagactgg

SEQ ID NO: 6156659 - DNA, 17 bp, Homo sapiens
ctggggaaactggccat

SEQ ID NO: 6156660 - DNA, 16 bp, Homo sapiens
ctggggaaagacactg

SEQ ID NO: 6156661 - DNA, 18 bp, Homo sapiens
ctggggaaagacactgcc

SEQ ID NO: 6156662 - DNA, 19 bp, Homo sapiens
ctggggaaagacactgcct

SEQ ID NO: 6156663 - DNA, 21 bp, Homo sapiens
ctggggaaagacactgcctgg

SEQ ID NO: 6156664 - DNA, 22 bp, Homo sapiens
ctggggaaagacactgcctggg

SEQ ID NO: 6156665 - DNA, 19 bp, Homo sapiens
ctggggaaagacgccttca

SEQ ID NO: 6156666 - DNA, 14 bp, Homo sapiens
ctggggaaagggga

SEQ ID NO: 6156667 - DNA, 17 bp, Homo sapiens
ctggggaaataacagct

SEQ ID NO: 6156668 - DNA, 22 bp, Homo sapiens
ctggggaaataacagctgtggc

SEQ ID NO: 6156669 - DNA, 19 bp, Homo sapiens
ctggggaacagagcgggcc

SEQ ID NO: 6156670 - DNA, 18 bp, Homo sapiens
ctggggaacgttctcttt

SEQ ID NO: 6156671 - DNA, 17 bp, Homo sapiens
ctggggaagacagtggc

SEQ ID NO: 6156672 - DNA, 22 bp, Homo sapiens
ctggggaagaggatgagcagag

SEQ ID NO: 6156673 - DNA, 17 bp, Homo sapiens
ctggggaagaggccttg

SEQ ID NO: 6156674 - DNA, 19 bp, Homo sapiens
ctggggaagaggccttggg

SEQ ID NO: 6156675 - DNA, 17 bp, Homo sapiens
ctggggaagatggagca

SEQ ID NO: 6156676 - DNA, 11 bp, Homo sapiens
ctggggaagga

SEQ ID NO: 6156677 - DNA, 16 bp, Homo sapiens
ctggggaaggaccaac

SEQ ID NO: 6156678 - DNA, 13 bp, Homo sapiens
ctggggaaggaga

SEQ ID NO: 6156679 - DNA, 15 bp, Homo sapiens
ctggggaaggagcca

SEQ ID NO: 6156680 - DNA, 23 bp, Homo sapiens
ctggggaagggaaccagccctcc

SEQ ID NO: 6156681 - DNA, 22 bp, Homo sapiens
ctggggaagtacgtcccagcgg

SEQ ID NO: 6156682 - DNA, 24 bp, Homo sapiens
ctggggaagtacgtcccagcggcc

SEQ ID NO: 6156683 - DNA, 12 bp, Homo sapiens
ctggggaagtca

SEQ ID NO: 6156684 - DNA, 18 bp, Homo sapiens
ctggggaagtcaggggag

SEQ ID NO: 6156685 - DNA, 16 bp, Homo sapiens
ctggggaatgctccca

SEQ ID NO: 6156686 - DNA, 17 bp, Homo sapiens
ctggggaatgctcccag

SEQ ID NO: 6156687 - DNA, 18 bp, Homo sapiens
ctggggaatgctcccagc

SEQ ID NO: 6156688 - DNA, 19 bp, Homo sapiens
ctggggacacacattctgc

SEQ ID NO: 6156689 - DNA, 15 bp, Homo sapiens
ctggggacagagcca

SEQ ID NO: 6156690 - DNA, 16 bp, Homo sapiens
ctggggacagagccac

SEQ ID NO: 6156691 - DNA, 19 bp, Homo sapiens
ctggggacagcttcctcac

SEQ ID NO: 6156692 - DNA, 12 bp, Homo sapiens
ctggggaccaag

SEQ ID NO: 6156693 - DNA, 18 bp, Homo sapiens
ctggggaccaggagctag

SEQ ID NO: 6156694 - DNA, 12 bp, Homo sapiens
ctggggacccac

SEQ ID NO: 6156695 - DNA, 20 bp, Homo sapiens
ctggggacccacccagcccc

SEQ ID NO: 6156696 - DNA, 22 bp, Homo sapiens
ctggggacccacccagcccctc

SEQ ID NO: 6156697 - DNA, 15 bp, Homo sapiens
ctggggacccagact

SEQ ID NO: 6156698 - DNA, 23 bp, Homo sapiens
ctggggaccccaacctcagaggc

SEQ ID NO: 6156699 - DNA, 19 bp, Homo sapiens
ctggggacccgctgggggc

SEQ ID NO: 6156700 - DNA, 21 bp, Homo sapiens
ctggggacccgctgggggctg

SEQ ID NO: 6156701 - DNA, 23 bp, Homo sapiens
ctggggacccgctgggggctggc

SEQ ID NO: 6156702 - DNA, 20 bp, Homo sapiens
ctggggaccctccagaggtg

SEQ ID NO: 6156703 - DNA, 19 bp, Homo sapiens
ctggggaccggttcccaca

SEQ ID NO: 6156704 - DNA, 15 bp, Homo sapiens
ctggggacctggttt

SEQ ID NO: 6156705 - DNA, 22 bp, Homo sapiens
ctggggacggagcactgtgcag

SEQ ID NO: 6156706 - DNA, 17 bp, Homo sapiens
ctggggacggggggccc

SEQ ID NO: 6156707 - DNA, 19 bp, Homo sapiens
ctggggacggggggcccca

SEQ ID NO: 6156708 - DNA, 22 bp, Homo sapiens
ctggggacggggggccccagtc

SEQ ID NO: 6156709 - DNA, 22 bp, Homo sapiens
ctggggacgttgctgagccagc

SEQ ID NO: 6156710 - DNA, 13 bp, Homo sapiens
ctggggactcagg

SEQ ID NO: 6156711 - DNA, 14 bp, Homo sapiens
ctggggactcaggg

SEQ ID NO: 6156712 - DNA, 12 bp, Homo sapiens
ctggggactcct

SEQ ID NO: 6156713 - DNA, 23 bp, Homo sapiens
ctggggactcctcaaaccacttg

SEQ ID NO: 6156714 - DNA, 15 bp, Homo sapiens
ctggggactctggca

SEQ ID NO: 6156715 - DNA, 18 bp, Homo sapiens
ctggggactctggcacag

SEQ ID NO: 6156716 - DNA, 14 bp, Homo sapiens
ctggggactgcatt

SEQ ID NO: 6156717 - DNA, 19 bp, Homo sapiens
ctggggactgttccaaagc

SEQ ID NO: 6156718 - DNA, 20 bp, Homo sapiens
ctggggacttcaactgccca

SEQ ID NO: 6156719 - DNA, 23 bp, Homo sapiens
ctggggacttcaactgcccagca

SEQ ID NO: 6156720 - DNA, 16 bp, Homo sapiens
ctggggacttctcact

SEQ ID NO: 6156721 - DNA, 14 bp, Homo sapiens
ctggggacttggcc

SEQ ID NO: 6156722 - DNA, 15 bp, Homo sapiens
ctggggacttggcct

SEQ ID NO: 6156723 - DNA, 19 bp, Homo sapiens
ctggggagaaagaggggcc

SEQ ID NO: 6156724 - DNA, 22 bp, Homo sapiens
ctggggagaaagaggggcctga

SEQ ID NO: 6156725 - DNA, 15 bp, Homo sapiens
ctggggagaaagtag

SEQ ID NO: 6156726 - DNA, 20 bp, Homo sapiens
ctggggagaacccttcctgc

SEQ ID NO: 6156727 - DNA, 15 bp, Homo sapiens
ctggggagaccgagt

SEQ ID NO: 6156728 - DNA, 20 bp, Homo sapiens
ctggggagagcggctggaga

SEQ ID NO: 6156729 - DNA, 21 bp, Homo sapiens
ctggggagagcggctggagaa

SEQ ID NO: 6156730 - DNA, 22 bp, Homo sapiens
ctggggagagcggctggagaaa

SEQ ID NO: 6156731 - DNA, 17 bp, Homo sapiens
ctggggagatgggggct

SEQ ID NO: 6156732 - DNA, 11 bp, Homo sapiens
ctggggagcag

SEQ ID NO: 6156733 - DNA, 15 bp, Homo sapiens
ctggggagcagctga

SEQ ID NO: 6156734 - DNA, 21 bp, Homo sapiens
ctggggagcaggcagccagca

SEQ ID NO: 6156735 - DNA, 16 bp, Homo sapiens
ctggggagccaaaggc

SEQ ID NO: 6156736 - DNA, 20 bp, Homo sapiens
ctggggagcccgtctcagtg

SEQ ID NO: 6156737 - DNA, 15 bp, Homo sapiens
ctggggagccctcag

SEQ ID NO: 6156738 - DNA, 16 bp, Homo sapiens
ctggggagccctcagg

SEQ ID NO: 6156739 - DNA, 19 bp, Homo sapiens
ctggggagccctcaggctc

SEQ ID NO: 6156740 - DNA, 20 bp, Homo sapiens
ctggggagccctcaggctcc

SEQ ID NO: 6156741 - DNA, 21 bp, Homo sapiens
ctggggagccctcaggctccc

SEQ ID NO: 6156742 - DNA, 20 bp, Homo sapiens
ctggggagcgaaagtttctt

SEQ ID NO: 6156743 - DNA, 12 bp, Homo sapiens
ctggggagctgt

SEQ ID NO: 6156744 - DNA, 21 bp, Homo sapiens
ctggggaggaagggccaggag

SEQ ID NO: 6156745 - DNA, 21 bp, Homo sapiens
ctggggaggaatcctggacca

SEQ ID NO: 6156746 - DNA, 22 bp, Homo sapiens
ctggggaggaatcctggaccaa

SEQ ID NO: 6156747 - DNA, 16 bp, Homo sapiens
ctggggaggacaaagg

SEQ ID NO: 6156748 - DNA, 21 bp, Homo sapiens
ctggggaggaccagggccctg

SEQ ID NO: 6156749 - DNA, 18 bp, Homo sapiens
ctggggaggacccctgcc

SEQ ID NO: 6156750 - DNA, 21 bp, Homo sapiens
ctggggaggacccctgccctc

SEQ ID NO: 6156751 - DNA, 14 bp, Homo sapiens
ctggggaggacctg

SEQ ID NO: 6156752 - DNA, 12 bp, Homo sapiens
ctggggaggagc

SEQ ID NO: 6156753 - DNA, 13 bp, Homo sapiens
ctggggaggcagg

SEQ ID NO: 6156754 - DNA, 18 bp, Homo sapiens
ctggggaggctgaggcag

SEQ ID NO: 6156755 - DNA, 16 bp, Homo sapiens
ctctggaatgcatggg

SEQ ID NO: 6156756 - DNA, 17 bp, Homo sapiens
ctctggaatgtttttcc

SEQ ID NO: 6156757 - DNA, 17 bp, Homo sapiens
ctctggacacttgctca

SEQ ID NO: 6156758 - DNA, 20 bp, Homo sapiens
ctctggacagatgggtgtcc

SEQ ID NO: 6156759 - DNA, 20 bp, Homo sapiens
ctctggacagcagaagcctc

SEQ ID NO: 6156760 - DNA, 14 bp, Homo sapiens
ctctggacagccag

SEQ ID NO: 6156761 - DNA, 13 bp, Homo sapiens
ctctggacagctt

SEQ ID NO: 6156762 - DNA, 14 bp, Homo sapiens
ctctggacagcttg

SEQ ID NO: 6156763 - DNA, 15 bp, Homo sapiens
ctctggacagcttga

SEQ ID NO: 6156764 - DNA, 15 bp, Homo sapiens
ctctggacaggcatg

SEQ ID NO: 6156765 - DNA, 23 bp, Homo sapiens
ctctggacatgatttagggaagc

SEQ ID NO: 6156766 - DNA, 16 bp, Homo sapiens
ctctggaccaaccctg

SEQ ID NO: 6156767 - DNA, 19 bp, Homo sapiens
ctctggaccaaggagcatc

SEQ ID NO: 6156768 - DNA, 23 bp, Homo sapiens
ctctggaccatacgcggaggagt

SEQ ID NO: 6156769 - DNA, 15 bp, Homo sapiens
ctctggaccatgctg

SEQ ID NO: 6156770 - DNA, 20 bp, Homo sapiens
ctctggaccatgctgagaca

SEQ ID NO: 6156771 - DNA, 14 bp, Homo sapiens
ctctggaccccagg

SEQ ID NO: 6156772 - DNA, 18 bp, Homo sapiens
ctctggacctcaggaggg

SEQ ID NO: 6156773 - DNA, 19 bp, Homo sapiens
ctctggacctcaggagggc

SEQ ID NO: 6156774 - DNA, 20 bp, Homo sapiens
ctctggacctcaggagggca

SEQ ID NO: 6156775 - DNA, 22 bp, Homo sapiens
ctctggacctcaggagggcagg

SEQ ID NO: 6156776 - DNA, 17 bp, Homo sapiens
ctctggacctcagtttc

SEQ ID NO: 6156777 - DNA, 21 bp, Homo sapiens
ctctggacctcggtgatgcct

SEQ ID NO: 6156778 - DNA, 20 bp, Homo sapiens
ctctggacctgaccagactg

SEQ ID NO: 6156779 - DNA, 21 bp, Homo sapiens
ctctggacctgcccccgcatc

SEQ ID NO: 6156780 - DNA, 16 bp, Homo sapiens
ctctggacggcaggct

SEQ ID NO: 6156781 - DNA, 10 bp, Homo sapiens
ctctggactc

SEQ ID NO: 6156782 - DNA, 23 bp, Homo sapiens
ctctggactccacggatgcgtgg

SEQ ID NO: 6156783 - DNA, 14 bp, Homo sapiens
ctctggactctaaa

SEQ ID NO: 6156784 - DNA, 16 bp, Homo sapiens
ctctggactctaaaga

SEQ ID NO: 6156785 - DNA, 22 bp, Homo sapiens
ctctggactggaaagcacaaga

SEQ ID NO: 6156786 - DNA, 14 bp, Homo sapiens
ctctggactggcta

SEQ ID NO: 6156787 - DNA, 15 bp, Homo sapiens
ctctggactgggaag

SEQ ID NO: 6156788 - DNA, 17 bp, Homo sapiens
ctctggactgggaaggg

SEQ ID NO: 6156789 - DNA, 12 bp, Homo sapiens
ctctggactgtg

SEQ ID NO: 6156790 - DNA, 23 bp, Homo sapiens
ctctggactttctctaataataa

SEQ ID NO: 6156791 - DNA, 13 bp, Homo sapiens
ctctggagaacag

SEQ ID NO: 6156792 - DNA, 18 bp, Homo sapiens
ctctggagaacagtggtt

SEQ ID NO: 6156793 - DNA, 18 bp, Homo sapiens
ctctggagaaggcctgga

SEQ ID NO: 6156794 - DNA, 15 bp, Homo sapiens
ctctggagacagccc

SEQ ID NO: 6156795 - DNA, 16 bp, Homo sapiens
ctctggagacagcccc

SEQ ID NO: 6156796 - DNA, 15 bp, Homo sapiens
ctctggagagaaaca

SEQ ID NO: 6156797 - DNA, 12 bp, Homo sapiens
ctctggagagcc

SEQ ID NO: 6156798 - DNA, 15 bp, Homo sapiens
ctctggagagcctgc

SEQ ID NO: 6156799 - DNA, 16 bp, Homo sapiens
ctctggagagcctgca

SEQ ID NO: 6156800 - DNA, 19 bp, Homo sapiens
ctctggagcaagccctgac

SEQ ID NO: 6156801 - DNA, 11 bp, Homo sapiens
ctctggagcag

SEQ ID NO: 6156802 - DNA, 15 bp, Homo sapiens
ctctggagcatttct

SEQ ID NO: 6156803 - DNA, 17 bp, Homo sapiens
ctctggagccaaggcag

SEQ ID NO: 6156804 - DNA, 18 bp, Homo sapiens
ctctggagccaaggcaga

SEQ ID NO: 6156805 - DNA, 12 bp, Homo sapiens
ctctggagccag

SEQ ID NO: 6156806 - DNA, 14 bp, Homo sapiens
ctctggagcccctc

SEQ ID NO: 6156807 - DNA, 13 bp, Homo sapiens
ctctggaggcctc

SEQ ID NO: 6156808 - DNA, 21 bp, Homo sapiens
ctctggaggcctctggccctc

SEQ ID NO: 6156809 - DNA, 17 bp, Homo sapiens
ctctggaggcctctggg

SEQ ID NO: 6156810 - DNA, 20 bp, Homo sapiens
ctctggagggctatggcctc

SEQ ID NO: 6156811 - DNA, 19 bp, Homo sapiens
ctctggaggggtgtggctc

SEQ ID NO: 6156812 - DNA, 19 bp, Homo sapiens
ctctggaggtgctgctcta

SEQ ID NO: 6156813 - DNA, 20 bp, Homo sapiens
ctctggatatttgcacttat

SEQ ID NO: 6156814 - DNA, 21 bp, Homo sapiens
ctctggatatttgcacttatg

SEQ ID NO: 6156815 - DNA, 20 bp, Homo sapiens
ctctggatcccgttcagaaa

SEQ ID NO: 6156816 - DNA, 22 bp, Homo sapiens
ctctggatcctgctgtggcctc

SEQ ID NO: 6156817 - DNA, 22 bp, Homo sapiens
ctctggatctagaagggaccat

SEQ ID NO: 6156818 - DNA, 17 bp, Homo sapiens
ctctggatgaaggcaaa

SEQ ID NO: 6156819 - DNA, 19 bp, Homo sapiens
ctctggatgaaggcaaaaa

SEQ ID NO: 6156820 - DNA, 19 bp, Homo sapiens
ctctggatgcctgattgcc

SEQ ID NO: 6156821 - DNA, 22 bp, Homo sapiens
ctctggatggaacgggcatggg

SEQ ID NO: 6156822 - DNA, 13 bp, Homo sapiens
ctctggatggcac

SEQ ID NO: 6156823 - DNA, 16 bp, Homo sapiens
ctctggatggcaccag

SEQ ID NO: 6156824 - DNA, 17 bp, Homo sapiens
ctctggattaggtctct

SEQ ID NO: 6156825 - DNA, 20 bp, Homo sapiens
ctctggattatattatgaag

SEQ ID NO: 6156826 - DNA, 15 bp, Homo sapiens
ctctggattcagcct

SEQ ID NO: 6156827 - DNA, 18 bp, Homo sapiens
ctctggattcagccttct

SEQ ID NO: 6156828 - DNA, 22 bp, Homo sapiens
ctctggattggagatagggaaa

SEQ ID NO: 6156829 - DNA, 15 bp, Homo sapiens
ctctggcaaatgatg

SEQ ID NO: 6156830 - DNA, 20 bp, Homo sapiens
ctctggcaccatcagcctgt

SEQ ID NO: 6156831 - DNA, 22 bp, Homo sapiens
ctctggcaccatcagcctgttc

SEQ ID NO: 6156832 - DNA, 21 bp, Homo sapiens
ctctggcactccagaacaaac

SEQ ID NO: 6156833 - DNA, 16 bp, Homo sapiens
ctctggcagcaccgcc

SEQ ID NO: 6156834 - DNA, 22 bp, Homo sapiens
ctctggcagcaccgcctcttcc

SEQ ID NO: 6156835 - DNA, 14 bp, Homo sapiens
ctctggcagccaca

SEQ ID NO: 6156836 - DNA, 14 bp, Homo sapiens
ctctggcagcctca

SEQ ID NO: 6156837 - DNA, 19 bp, Homo sapiens
ctctggcagcctcagaggc

SEQ ID NO: 6156838 - DNA, 15 bp, Homo sapiens
ctctggcagctcaga

SEQ ID NO: 6156839 - DNA, 19 bp, Homo sapiens
ctctggcagctcagagagg

SEQ ID NO: 6156840 - DNA, 16 bp, Homo sapiens
ctctggcaggtggcca

SEQ ID NO: 6156841 - DNA, 23 bp, Homo sapiens
ctctggcaggtggccagggctcc

SEQ ID NO: 6156842 - DNA, 18 bp, Homo sapiens
ctctggcattagaattat

SEQ ID NO: 6156843 - DNA, 23 bp, Homo sapiens
ctctggcattagaattatttaaa

SEQ ID NO: 6156844 - DNA, 19 bp, Homo sapiens
ctctggccaaatatgcact

SEQ ID NO: 6156845 - DNA, 22 bp, Homo sapiens
ctctggccaaatatgcactttc

SEQ ID NO: 6156846 - DNA, 21 bp, Homo sapiens
ctctggccaagggccagacag

SEQ ID NO: 6156847 - DNA, 12 bp, Homo sapiens
ctctggccacaa

SEQ ID NO: 6156848 - DNA, 21 bp, Homo sapiens
ctctggccacaatcctcccca

SEQ ID NO: 6156849 - DNA, 22 bp, Homo sapiens
ctctggccacaatcctccccac

SEQ ID NO: 6156850 - DNA, 13 bp, Homo sapiens
ctctggccaccct

SEQ ID NO: 6156851 - DNA, 14 bp, Homo sapiens
ctctggccaccctg

SEQ ID NO: 6156852 - DNA, 16 bp, Homo sapiens
ctctggccagacggcc

SEQ ID NO: 6156853 - DNA, 19 bp, Homo sapiens
ctctggcccagaaagcctc

SEQ ID NO: 6156854 - DNA, 13 bp, Homo sapiens
ctctggccccaag

SEQ ID NO: 6156855 - DNA, 14 bp, Homo sapiens
ctctggccccaagg

SEQ ID NO: 6156856 - DNA, 18 bp, Homo sapiens
ctctggccccaggcttgt

SEQ ID NO: 6156857 - DNA, 23 bp, Homo sapiens
ctctggcccctcacccaccatgg

SEQ ID NO: 6156858 - DNA, 13 bp, Homo sapiens
ctctggccctggc

SEQ ID NO: 6156859 - DNA, 14 bp, Homo sapiens
ctctggccctggcc

SEQ ID NO: 6156860 - DNA, 12 bp, Homo sapiens
ctctggccctgt

SEQ ID NO: 6156861 - DNA, 14 bp, Homo sapiens
ctctggccctgttg

SEQ ID NO: 6156862 - DNA, 15 bp, Homo sapiens
ctctggcccttggaa

SEQ ID NO: 6156863 - DNA, 15 bp, Homo sapiens
ctctggcctcccacc

SEQ ID NO: 6156864 - DNA, 17 bp, Homo sapiens
ctctggcctcccacccg

SEQ ID NO: 6156865 - DNA, 15 bp, Homo sapiens
ctctggcctcctggg

SEQ ID NO: 6156866 - DNA, 12 bp, Homo sapiens
ctctggcctggg

SEQ ID NO: 6156867 - DNA, 13 bp, Homo sapiens
ctctggcctggga

SEQ ID NO: 6156868 - DNA, 14 bp, Homo sapiens
ctctggcctgggaa

SEQ ID NO: 6156869 - DNA, 22 bp, Homo sapiens
ctctggccttggttcctccagc

SEQ ID NO: 6156870 - DNA, 23 bp, Homo sapiens
ctctggccttggttcctccagca

SEQ ID NO: 6156871 - DNA, 15 bp, Homo sapiens
ctctggccttttcct

SEQ ID NO: 6156872 - DNA, 16 bp, Homo sapiens
ctctggcggcttcctg

SEQ ID NO: 6156873 - DNA, 22 bp, Homo sapiens
ctctggcggcttcctgtccact

SEQ ID NO: 6156874 - DNA, 23 bp, Homo sapiens
ctctggcggtggccacagcgtgc

SEQ ID NO: 6156875 - DNA, 13 bp, Homo sapiens
ctctggctactcc

SEQ ID NO: 6156876 - DNA, 17 bp, Homo sapiens
ctctggctagagccgag

SEQ ID NO: 6156877 - DNA, 19 bp, Homo sapiens
ctctggctagagccgaggg

SEQ ID NO: 6156878 - DNA, 14 bp, Homo sapiens
ctctggctagaggc

SEQ ID NO: 6156879 - DNA, 18 bp, Homo sapiens
ctctggctcacagactgg

SEQ ID NO: 6156880 - DNA, 18 bp, Homo sapiens
ctctggctcagcccggga

SEQ ID NO: 6156881 - DNA, 13 bp, Homo sapiens
ctctggctccaga

SEQ ID NO: 6156882 - DNA, 14 bp, Homo sapiens
ctctggctccagaa

SEQ ID NO: 6156883 - DNA, 20 bp, Homo sapiens
ctctggctccagaggacctg

SEQ ID NO: 6156884 - DNA, 15 bp, Homo sapiens
ctctggctccagctg

SEQ ID NO: 6156885 - DNA, 22 bp, Homo sapiens
ctctggctccagctggccggga

SEQ ID NO: 6156886 - DNA, 13 bp, Homo sapiens
ctctggctcccca

SEQ ID NO: 6156887 - DNA, 15 bp, Homo sapiens
ctctggctccccaag

SEQ ID NO: 6156888 - DNA, 22 bp, Homo sapiens
ctctggctccgaaaaactttgt

SEQ ID NO: 6156889 - DNA, 15 bp, Homo sapiens
ctctggctctaggac

SEQ ID NO: 6156890 - DNA, 21 bp, Homo sapiens
ctctggctctaggacccccag

SEQ ID NO: 6156891 - DNA, 11 bp, Homo sapiens
ctctggctctg

SEQ ID NO: 6156892 - DNA, 17 bp, Homo sapiens
ctctggctctgcctcag

SEQ ID NO: 6156893 - DNA, 17 bp, Homo sapiens
ctctggctgaaccctgt

SEQ ID NO: 6156894 - DNA, 18 bp, Homo sapiens
ctctggctgaaccctgtg

SEQ ID NO: 6156895 - DNA, 21 bp, Homo sapiens
ctctggctgaaccctgtgctg

SEQ ID NO: 6156896 - DNA, 19 bp, Homo sapiens
ctctggctgactaaatttg

SEQ ID NO: 6156897 - DNA, 11 bp, Homo sapiens
ctctggctgcc

SEQ ID NO: 6156898 - DNA, 13 bp, Homo sapiens
ctctggctgcctg

SEQ ID NO: 6156899 - DNA, 13 bp, Homo sapiens
ctctggctggcta

SEQ ID NO: 6156900 - DNA, 23 bp, Homo sapiens
ctctggctggctaactggaagca

SEQ ID NO: 6156901 - DNA, 13 bp, Homo sapiens
ctctggctgggga

SEQ ID NO: 6156902 - DNA, 13 bp, Homo sapiens
ctctggctggtct

SEQ ID NO: 6156903 - DNA, 15 bp, Homo sapiens
ctctggctggtcttc

SEQ ID NO: 6156904 - DNA, 21 bp, Homo sapiens
ctctggctggtttggaatgct

SEQ ID NO: 6156905 - DNA, 19 bp, Homo sapiens
ctctggctgtaaggctcta

SEQ ID NO: 6156906 - DNA, 15 bp, Homo sapiens
ctctggcttagaaat

SEQ ID NO: 6156907 - DNA, 17 bp, Homo sapiens
ctctggcttagaaattt

SEQ ID NO: 6156908 - DNA, 18 bp, Homo sapiens
ctctggcttcaaaaagcc

SEQ ID NO: 6156909 - DNA, 22 bp, Homo sapiens
ctctggcttcaaaaagccacag

SEQ ID NO: 6156910 - DNA, 14 bp, Homo sapiens
ctctggcttcccat

SEQ ID NO: 6156911 - DNA, 22 bp, Homo sapiens
ctctggcttccctaaactgcag

SEQ ID NO: 6156912 - DNA, 15 bp, Homo sapiens
ctctggcttccctgc

SEQ ID NO: 6156913 - DNA, 18 bp, Homo sapiens
ctctggcttccctgccca

SEQ ID NO: 6156914 - DNA, 19 bp, Homo sapiens
ctctggcttccctgcccaa

SEQ ID NO: 6156915 - DNA, 23 bp, Homo sapiens
ctctggcttccctgcccaatcct

SEQ ID NO: 6156916 - DNA, 13 bp, Homo sapiens
ctctggcttctct

SEQ ID NO: 6156917 - DNA, 14 bp, Homo sapiens
ctctggcttctctc

SEQ ID NO: 6156918 - DNA, 21 bp, Homo sapiens
ctctggcttctctcttttcct

SEQ ID NO: 6156919 - DNA, 20 bp, Homo sapiens
ctctggcttgacagcatgag

SEQ ID NO: 6156920 - DNA, 20 bp, Homo sapiens
ctctggcttgccccaggact

SEQ ID NO: 6156921 - DNA, 16 bp, Homo sapiens
ctctggcttggcctat

SEQ ID NO: 6156922 - DNA, 13 bp, Homo sapiens
ctctgggaacctc

SEQ ID NO: 6156923 - DNA, 15 bp, Homo sapiens
ctctgggaacctccc

SEQ ID NO: 6156924 - DNA, 18 bp, Homo sapiens
ctctgggaacctcccaga

SEQ ID NO: 6156925 - DNA, 13 bp, Homo sapiens
ctctgggaactga

SEQ ID NO: 6156926 - DNA, 15 bp, Homo sapiens
ctctgggacccacag

SEQ ID NO: 6156927 - DNA, 17 bp, Homo sapiens
ctctgggacccacagaa

SEQ ID NO: 6156928 - DNA, 14 bp, Homo sapiens
ctctgggaccccag

SEQ ID NO: 6156929 - DNA, 22 bp, Homo sapiens
ctctgggacgtggacatgcctc

SEQ ID NO: 6156930 - DNA, 14 bp, Homo sapiens
ctctgggagaaaat

SEQ ID NO: 6156931 - DNA, 20 bp, Homo sapiens
ctctgggagaaaatcatcaa

SEQ ID NO: 6156932 - DNA, 14 bp, Homo sapiens
ctctgggagacttt

SEQ ID NO: 6156933 - DNA, 12 bp, Homo sapiens
ctctgggagagc

SEQ ID NO: 6156934 - DNA, 15 bp, Homo sapiens
ctctgggagcccaga

SEQ ID NO: 6156935 - DNA, 20 bp, Homo sapiens
ctggggaggctgaggcagga

SEQ ID NO: 6156936 - DNA, 14 bp, Homo sapiens
ctggggagggacac

SEQ ID NO: 6156937 - DNA, 15 bp, Homo sapiens
ctggggagggacaca

SEQ ID NO: 6156938 - DNA, 16 bp, Homo sapiens
ctggggagggagagat

SEQ ID NO: 6156939 - DNA, 17 bp, Homo sapiens
ctggggagggctgcagt

SEQ ID NO: 6156940 - DNA, 16 bp, Homo sapiens
ctggggaggggctccg

SEQ ID NO: 6156941 - DNA, 17 bp, Homo sapiens
ctggggagggggtacct

SEQ ID NO: 6156942 - DNA, 23 bp, Homo sapiens
ctggggagggtcaagggctgggg

SEQ ID NO: 6156943 - DNA, 21 bp, Homo sapiens
ctggggaggtgggaggccagg

SEQ ID NO: 6156944 - DNA, 12 bp, Homo sapiens
ctggggagtccc

SEQ ID NO: 6156945 - DNA, 17 bp, Homo sapiens
ctggggagtgagcttgg

SEQ ID NO: 6156946 - DNA, 15 bp, Homo sapiens
ctggggagtgctgga

SEQ ID NO: 6156947 - DNA, 20 bp, Homo sapiens
ctggggagtggttaggcagc

SEQ ID NO: 6156948 - DNA, 19 bp, Homo sapiens
ctggggatcttcccacagg

SEQ ID NO: 6156949 - DNA, 12 bp, Homo sapiens
ctggggatgcgc

SEQ ID NO: 6156950 - DNA, 22 bp, Homo sapiens
ctggggatggagaatgccagcc

SEQ ID NO: 6156951 - DNA, 15 bp, Homo sapiens
ctggggatggtggca

SEQ ID NO: 6156952 - DNA, 22 bp, Homo sapiens
ctggggatgtctctcatgacca

SEQ ID NO: 6156953 - DNA, 18 bp, Homo sapiens
ctggggatgtgctttgtg

SEQ ID NO: 6156954 - DNA, 16 bp, Homo sapiens
ctggggatgtgggagg

SEQ ID NO: 6156955 - DNA, 20 bp, Homo sapiens
ctggggattgggagggacag

SEQ ID NO: 6156956 - DNA, 21 bp, Homo sapiens
ctggggattgggagggacagg

SEQ ID NO: 6156957 - DNA, 22 bp, Homo sapiens
ctggggattgggagggacaggg

SEQ ID NO: 6156958 - DNA, 22 bp, Homo sapiens
ctggggattgggcccctgccag

SEQ ID NO: 6156959 - DNA, 17 bp, Homo sapiens
ctggggatttctgggat

SEQ ID NO: 6156960 - DNA, 17 bp, Homo sapiens
ctggggcaactgagagc

SEQ ID NO: 6156961 - DNA, 21 bp, Homo sapiens
ctggggcaaggggcagccagc

SEQ ID NO: 6156962 - DNA, 16 bp, Homo sapiens
ctggggcaagtccctg

SEQ ID NO: 6156963 - DNA, 21 bp, Homo sapiens
ctggggcaagtccctgactct

SEQ ID NO: 6156964 - DNA, 14 bp, Homo sapiens
ctggggcacggcgg

SEQ ID NO: 6156965 - DNA, 13 bp, Homo sapiens
ctggggcactccc

SEQ ID NO: 6156966 - DNA, 18 bp, Homo sapiens
ctggggcactcccccagg

SEQ ID NO: 6156967 - DNA, 21 bp, Homo sapiens
ctggggcacttggcagcgcgg

SEQ ID NO: 6156968 - DNA, 18 bp, Homo sapiens
ctggggcagacaataaac

SEQ ID NO: 6156969 - DNA, 15 bp, Homo sapiens
ctggggcagagcttg

SEQ ID NO: 6156970 - DNA, 20 bp, Homo sapiens
ctggggcagaggggcagccg

SEQ ID NO: 6156971 - DNA, 14 bp, Homo sapiens
ctggggcagagtgg

SEQ ID NO: 6156972 - DNA, 15 bp, Homo sapiens
ctggggcagagtgga

SEQ ID NO: 6156973 - DNA, 22 bp, Homo sapiens
ctggggcagagtggagcccagg

SEQ ID NO: 6156974 - DNA, 13 bp, Homo sapiens
ctggggcaggacc

SEQ ID NO: 6156975 - DNA, 13 bp, Homo sapiens
ctggggcaggctc

SEQ ID NO: 6156976 - DNA, 14 bp, Homo sapiens
ctggggcaggctct

SEQ ID NO: 6156977 - DNA, 17 bp, Homo sapiens
ctggggcaggctgggcc

SEQ ID NO: 6156978 - DNA, 21 bp, Homo sapiens
ctggggcaggctgggccatgt

SEQ ID NO: 6156979 - DNA, 22 bp, Homo sapiens
ctggggcagggcccagggaggt

SEQ ID NO: 6156980 - DNA, 16 bp, Homo sapiens
ctggggcaggggcctg

SEQ ID NO: 6156981 - DNA, 21 bp, Homo sapiens
ctggggcaggggcctgggccg

SEQ ID NO: 6156982 - DNA, 23 bp, Homo sapiens
ctggggcaggggcctgggccggc

SEQ ID NO: 6156983 - DNA, 15 bp, Homo sapiens
ctggggcagtcacct

SEQ ID NO: 6156984 - DNA, 13 bp, Homo sapiens
ctggggcatccca

SEQ ID NO: 6156985 - DNA, 18 bp, Homo sapiens
ctggggcatcctgtgcca

SEQ ID NO: 6156986 - DNA, 20 bp, Homo sapiens
ctggggcatggcaaatcagg

SEQ ID NO: 6156987 - DNA, 15 bp, Homo sapiens
ctggggccaaataaa

SEQ ID NO: 6156988 - DNA, 16 bp, Homo sapiens
ctggggccaaataaag

SEQ ID NO: 6156989 - DNA, 16 bp, Homo sapiens
ctggggccaagaggaa

SEQ ID NO: 6156990 - DNA, 22 bp, Homo sapiens
ctggggccacaaatcaaagcaa

SEQ ID NO: 6156991 - DNA, 15 bp, Homo sapiens
ctggggccacacaga

SEQ ID NO: 6156992 - DNA, 16 bp, Homo sapiens
ctggggccaccatccc

SEQ ID NO: 6156993 - DNA, 17 bp, Homo sapiens
ctggggccaccatccct

SEQ ID NO: 6156994 - DNA, 18 bp, Homo sapiens
ctggggccaccatccctg

SEQ ID NO: 6156995 - DNA, 15 bp, Homo sapiens
ctggggccacctttg

SEQ ID NO: 6156996 - DNA, 18 bp, Homo sapiens
ctggggccacctttgtgc

SEQ ID NO: 6156997 - DNA, 14 bp, Homo sapiens
ctggggccagaggc

SEQ ID NO: 6156998 - DNA, 13 bp, Homo sapiens
ctggggccagccc

SEQ ID NO: 6156999 - DNA, 16 bp, Homo sapiens
ctggggccagcccctc

SEQ ID NO: 6157000 - DNA, 17 bp, Homo sapiens
ctggggccagcccctcc

SEQ ID NO: 6157001 - DNA, 20 bp, Homo sapiens
ctggggccagcccctccccg

SEQ ID NO: 6157002 - DNA, 23 bp, Homo sapiens
ctggggcccaagttgcagtgagc

SEQ ID NO: 6157003 - DNA, 13 bp, Homo sapiens
ctggggcccagcc

SEQ ID NO: 6157004 - DNA, 15 bp, Homo sapiens
ctggggcccaggaag

SEQ ID NO: 6157005 - DNA, 17 bp, Homo sapiens
ctggggcccaggaagcc

SEQ ID NO: 6157006 - DNA, 20 bp, Homo sapiens
ctggggcccaggaagcccac

SEQ ID NO: 6157007 - DNA, 13 bp, Homo sapiens
ctggggccccatc

SEQ ID NO: 6157008 - DNA, 17 bp, Homo sapiens
ctggggcccgcctgcca

SEQ ID NO: 6157009 - DNA, 18 bp, Homo sapiens
ctggggcccgcctgccac

SEQ ID NO: 6157010 - DNA, 21 bp, Homo sapiens
ctggggccctcagctcctggg

SEQ ID NO: 6157011 - DNA, 13 bp, Homo sapiens
ctggggccctggg

SEQ ID NO: 6157012 - DNA, 11 bp, Homo sapiens
ctggggccctt

SEQ ID NO: 6157013 - DNA, 19 bp, Homo sapiens
ctggggccgaggggccagg

SEQ ID NO: 6157014 - DNA, 14 bp, Homo sapiens
ctggggccgcctgc

SEQ ID NO: 6157015 - DNA, 15 bp, Homo sapiens
ctggggccgcctgcc

SEQ ID NO: 6157016 - DNA, 16 bp, Homo sapiens
ctggggccgcctgccc

SEQ ID NO: 6157017 - DNA, 22 bp, Homo sapiens
ctggggccgcctgccctgcctt

SEQ ID NO: 6157018 - DNA, 23 bp, Homo sapiens
ctggggccgcctgccctgccttg

SEQ ID NO: 6157019 - DNA, 15 bp, Homo sapiens
ctggggccggggctg

SEQ ID NO: 6157020 - DNA, 16 bp, Homo sapiens
ctggggccggggctgc

SEQ ID NO: 6157021 - DNA, 16 bp, Homo sapiens
ctggggccggtagagg

SEQ ID NO: 6157022 - DNA, 17 bp, Homo sapiens
ctggggccggttttcct

SEQ ID NO: 6157023 - DNA, 19 bp, Homo sapiens
ctggggcctagactctgta

SEQ ID NO: 6157024 - DNA, 22 bp, Homo sapiens
ctggggcctatcagtgtgcccc

SEQ ID NO: 6157025 - DNA, 13 bp, Homo sapiens
ctggggcctcaga

SEQ ID NO: 6157026 - DNA, 15 bp, Homo sapiens
ctggggcctcagacg

SEQ ID NO: 6157027 - DNA, 19 bp, Homo sapiens
ctggggcctccagaagctg

SEQ ID NO: 6157028 - DNA, 19 bp, Homo sapiens
ctggggcctcggagcctca

SEQ ID NO: 6157029 - DNA, 19 bp, Homo sapiens
ctggggcctgactgctcag

SEQ ID NO: 6157030 - DNA, 20 bp, Homo sapiens
ctggggcctgactgctcaga

SEQ ID NO: 6157031 - DNA, 15 bp, Homo sapiens
ctggggcctggactg

SEQ ID NO: 6157032 - DNA, 14 bp, Homo sapiens
ctggggcctggaga

SEQ ID NO: 6157033 - DNA, 15 bp, Homo sapiens
ctggggcctggagag

SEQ ID NO: 6157034 - DNA, 16 bp, Homo sapiens
ctggggcctggagagg

SEQ ID NO: 6157035 - DNA, 21 bp, Homo sapiens
ctggggcctggagaggggcct

SEQ ID NO: 6157036 - DNA, 20 bp, Homo sapiens
ctggggcctggaggcccaga

SEQ ID NO: 6157037 - DNA, 13 bp, Homo sapiens
ctggggcctggca

SEQ ID NO: 6157038 - DNA, 15 bp, Homo sapiens
ctggggcctggccta

SEQ ID NO: 6157039 - DNA, 16 bp, Homo sapiens
ctggggcctggcctat

SEQ ID NO: 6157040 - DNA, 21 bp, Homo sapiens
ctggggcctggcctatttaag

SEQ ID NO: 6157041 - DNA, 18 bp, Homo sapiens
ctggggcctgtactgcct

SEQ ID NO: 6157042 - DNA, 19 bp, Homo sapiens
ctggggcctgtactgcctg

SEQ ID NO: 6157043 - DNA, 21 bp, Homo sapiens
ctggggcctgtactgcctgct

SEQ ID NO: 6157044 - DNA, 22 bp, Homo sapiens
ctggggcctgtactgcctgctt

SEQ ID NO: 6157045 - DNA, 23 bp, Homo sapiens
ctggggcctgtactgcctgcttg

SEQ ID NO: 6157046 - DNA, 17 bp, Homo sapiens
ctggggccttcctggct

SEQ ID NO: 6157047 - DNA, 21 bp, Homo sapiens
ctggggccttcctggctttgg

SEQ ID NO: 6157048 - DNA, 17 bp, Homo sapiens
ctggggcgggcagccag

SEQ ID NO: 6157049 - DNA, 16 bp, Homo sapiens
ctggggcggtcaataa

SEQ ID NO: 6157050 - DNA, 14 bp, Homo sapiens
ctggggcgtgggga

SEQ ID NO: 6157051 - DNA, 15 bp, Homo sapiens
ctggggcgtggggag

SEQ ID NO: 6157052 - DNA, 22 bp, Homo sapiens
ctggggctcacggggcctccaa

SEQ ID NO: 6157053 - DNA, 16 bp, Homo sapiens
ctggggctcagagccg

SEQ ID NO: 6157054 - DNA, 20 bp, Homo sapiens
ctggggctcagccctgagct

SEQ ID NO: 6157055 - DNA, 12 bp, Homo sapiens
ctggggctccct

SEQ ID NO: 6157056 - DNA, 13 bp, Homo sapiens
ctggggctccctc

SEQ ID NO: 6157057 - DNA, 18 bp, Homo sapiens
ctggggctccctctctgg

SEQ ID NO: 6157058 - DNA, 19 bp, Homo sapiens
ctggggctcctttctccag

SEQ ID NO: 6157059 - DNA, 19 bp, Homo sapiens
ctggggctctaacgcctga

SEQ ID NO: 6157060 - DNA, 14 bp, Homo sapiens
ctggggctctctga

SEQ ID NO: 6157061 - DNA, 20 bp, Homo sapiens
ctggggctgaacatgcctgc

SEQ ID NO: 6157062 - DNA, 13 bp, Homo sapiens
ctggggctgaagg

SEQ ID NO: 6157063 - DNA, 22 bp, Homo sapiens
ctggggctgacacccaggcccg

SEQ ID NO: 6157064 - DNA, 15 bp, Homo sapiens
ctggggctgagcttt

SEQ ID NO: 6157065 - DNA, 13 bp, Homo sapiens
ctggggctgagtc

SEQ ID NO: 6157066 - DNA, 16 bp, Homo sapiens
ctggggctgatctcag

SEQ ID NO: 6157067 - DNA, 17 bp, Homo sapiens
ctggggctgatctcagg

SEQ ID NO: 6157068 - DNA, 19 bp, Homo sapiens
ctggggctgccagcctgag

SEQ ID NO: 6157069 - DNA, 13 bp, Homo sapiens
ctggggctgccgt

SEQ ID NO: 6157070 - DNA, 15 bp, Homo sapiens
ctggggctgctcccc

SEQ ID NO: 6157071 - DNA, 16 bp, Homo sapiens
ctggggctgctcccct

SEQ ID NO: 6157072 - DNA, 12 bp, Homo sapiens
ctggggctgctg

SEQ ID NO: 6157073 - DNA, 16 bp, Homo sapiens
ctggggctgctggcct

SEQ ID NO: 6157074 - DNA, 15 bp, Homo sapiens
ctggggctgctgtga

SEQ ID NO: 6157075 - DNA, 13 bp, Homo sapiens
ctggggctggcac

SEQ ID NO: 6157076 - DNA, 19 bp, Homo sapiens
ctggggctggcaccagcag

SEQ ID NO: 6157077 - DNA, 21 bp, Homo sapiens
ctggggctggcaccagcaggc

SEQ ID NO: 6157078 - DNA, 14 bp, Homo sapiens
ctggggctggcttt

SEQ ID NO: 6157079 - DNA, 21 bp, Homo sapiens
ctggggctggtcctgggagcc

SEQ ID NO: 6157080 - DNA, 17 bp, Homo sapiens
ctggggctggtgaggcc

SEQ ID NO: 6157081 - DNA, 16 bp, Homo sapiens
ctggggctgtgttttg

SEQ ID NO: 6157082 - DNA, 17 bp, Homo sapiens
ctggggcttatgggtgg

SEQ ID NO: 6157083 - DNA, 18 bp, Homo sapiens
ctggggcttatgggtggc

SEQ ID NO: 6157084 - DNA, 22 bp, Homo sapiens
ctggggcttcaccagtctgtct

SEQ ID NO: 6157085 - DNA, 16 bp, Homo sapiens
ctggggcttctcctga

SEQ ID NO: 6157086 - DNA, 21 bp, Homo sapiens
ctggggcttctttctgctggc

SEQ ID NO: 6157087 - DNA, 22 bp, Homo sapiens
ctggggcttctttctgctggct

SEQ ID NO: 6157088 - DNA, 16 bp, Homo sapiens
ctggggcttgcaagag

SEQ ID NO: 6157089 - DNA, 19 bp, Homo sapiens
ctggggcttgcaagaggag

SEQ ID NO: 6157090 - DNA, 17 bp, Homo sapiens
ctggggcttgtcctgtg

SEQ ID NO: 6157091 - DNA, 21 bp, Homo sapiens
ctggggcttgtcctgtgcttg

SEQ ID NO: 6157092 - DNA, 13 bp, Homo sapiens
ctggggctttgcc

SEQ ID NO: 6157093 - DNA, 19 bp, Homo sapiens
ctggggctttgccttgcag

SEQ ID NO: 6157094 - DNA, 21 bp, Homo sapiens
ctggggctttgccttgcagcc

SEQ ID NO: 6157095 - DNA, 17 bp, Homo sapiens
ctggggcttttgtgcca

SEQ ID NO: 6157096 - DNA, 20 bp, Homo sapiens
ctggggcttttgtgccagga

SEQ ID NO: 6157097 - DNA, 13 bp, Homo sapiens
ctgggggaaaaag

SEQ ID NO: 6157098 - DNA, 19 bp, Homo sapiens
ctgggggaaggcaggagcc

SEQ ID NO: 6157099 - DNA, 13 bp, Homo sapiens
ctgggggaagggt

SEQ ID NO: 6157100 - DNA, 16 bp, Homo sapiens
ctgggggaagggtggt

SEQ ID NO: 6157101 - DNA, 21 bp, Homo sapiens
ctgggggacactgtggcagca

SEQ ID NO: 6157102 - DNA, 15 bp, Homo sapiens
ctgggggacagagaa

SEQ ID NO: 6157103 - DNA, 20 bp, Homo sapiens
ctgggggacccaatgtagga

SEQ ID NO: 6157104 - DNA, 17 bp, Homo sapiens
ctgggggacccctggct

SEQ ID NO: 6157105 - DNA, 23 bp, Homo sapiens
ctgggggacccctggctctgggc

SEQ ID NO: 6157106 - DNA, 13 bp, Homo sapiens
ctgggggactggg

SEQ ID NO: 6157107 - DNA, 17 bp, Homo sapiens
ctgggggactggggggc

SEQ ID NO: 6157108 - DNA, 11 bp, Homo sapiens
ctgggggaggc

SEQ ID NO: 6157109 - DNA, 15 bp, Homo sapiens
ctgggggaggcaggg

SEQ ID NO: 6157110 - DNA, 23 bp, Homo sapiens
ctgggggaggcagggctggaatg

SEQ ID NO: 6157111 - DNA, 17 bp, Homo sapiens
ctgggggaggccatcca

SEQ ID NO: 6157112 - DNA, 21 bp, Homo sapiens
ctgggggaggcttccagctca

SEQ ID NO: 6157113 - DNA, 16 bp, Homo sapiens
ctgggggagggactgc

SEQ ID NO: 6157114 - DNA, 13 bp, Homo sapiens
ctctgggatctgc

SEQ ID NO: 6157115 - DNA, 17 bp, Homo sapiens
ctctgggatctgccaac

SEQ ID NO: 6157116 - DNA, 22 bp, Homo sapiens
ctctgggatgtgtagccttctc

SEQ ID NO: 6157117 - DNA, 22 bp, Homo sapiens
ctctgggatttatgctcatgaa

SEQ ID NO: 6157118 - DNA, 20 bp, Homo sapiens
ctctgggatttgcccacgta

SEQ ID NO: 6157119 - DNA, 18 bp, Homo sapiens
ctctgggcacaagcaggg

SEQ ID NO: 6157120 - DNA, 12 bp, Homo sapiens
ctctgggcacag

SEQ ID NO: 6157121 - DNA, 13 bp, Homo sapiens
ctctgggcacagt

SEQ ID NO: 6157122 - DNA, 12 bp, Homo sapiens
ctctgggcagct

SEQ ID NO: 6157123 - DNA, 11 bp, Homo sapiens
ctctgggcagg

SEQ ID NO: 6157124 - DNA, 15 bp, Homo sapiens
ctctgggcagtgtgg

SEQ ID NO: 6157125 - DNA, 18 bp, Homo sapiens
ctctgggcagtgtggcct

SEQ ID NO: 6157126 - DNA, 23 bp, Homo sapiens
ctctgggccaagtcaaagacatt

SEQ ID NO: 6157127 - DNA, 19 bp, Homo sapiens
ctctgggccaggttggaaa

SEQ ID NO: 6157128 - DNA, 23 bp, Homo sapiens
ctctgggccatgccaggccagag

SEQ ID NO: 6157129 - DNA, 16 bp, Homo sapiens
ctctgggcccagagag

SEQ ID NO: 6157130 - DNA, 19 bp, Homo sapiens
ctctgggccctgcaggagg

SEQ ID NO: 6157131 - DNA, 21 bp, Homo sapiens
ctctgggccgggcctggggct

SEQ ID NO: 6157132 - DNA, 10 bp, Homo sapiens
ctctgggcct

SEQ ID NO: 6157133 - DNA, 17 bp, Homo sapiens
ctctgggcctcagtttc

SEQ ID NO: 6157134 - DNA, 13 bp, Homo sapiens
ctctgggcctctt

SEQ ID NO: 6157135 - DNA, 22 bp, Homo sapiens
ctctgggcctgagggtccacct

SEQ ID NO: 6157136 - DNA, 13 bp, Homo sapiens
ctctgggcctggg

SEQ ID NO: 6157137 - DNA, 15 bp, Homo sapiens
ctctgggcctgtgtg

SEQ ID NO: 6157138 - DNA, 15 bp, Homo sapiens
ctctgggcctgttct

SEQ ID NO: 6157139 - DNA, 20 bp, Homo sapiens
ctctgggctatggacacagg

SEQ ID NO: 6157140 - DNA, 21 bp, Homo sapiens
ctctgggctatggacacaggg

SEQ ID NO: 6157141 - DNA, 17 bp, Homo sapiens
ctctgggctcacaccag

SEQ ID NO: 6157142 - DNA, 14 bp, Homo sapiens
ctctgggctcaggg

SEQ ID NO: 6157143 - DNA, 20 bp, Homo sapiens
ctctgggctcagggctggag

SEQ ID NO: 6157144 - DNA, 22 bp, Homo sapiens
ctctgggctcagggctggagtg

SEQ ID NO: 6157145 - DNA, 12 bp, Homo sapiens
ctctgggctgag

SEQ ID NO: 6157146 - DNA, 14 bp, Homo sapiens
ctctgggctgagga

SEQ ID NO: 6157147 - DNA, 15 bp, Homo sapiens
ctctgggctggatga

SEQ ID NO: 6157148 - DNA, 21 bp, Homo sapiens
ctctgggctggatgagctccc

SEQ ID NO: 6157149 - DNA, 15 bp, Homo sapiens
ctctgggctggctgc

SEQ ID NO: 6157150 - DNA, 23 bp, Homo sapiens
ctctgggctgtaacgtggcactg

SEQ ID NO: 6157151 - DNA, 10 bp, Homo sapiens
ctctgggctt

SEQ ID NO: 6157152 - DNA, 21 bp, Homo sapiens
ctctggggaagatggagcagg

SEQ ID NO: 6157153 - DNA, 20 bp, Homo sapiens
ctctggggaagggaaccagc

SEQ ID NO: 6157154 - DNA, 23 bp, Homo sapiens
ctctggggaagggaaccagccct

SEQ ID NO: 6157155 - DNA, 23 bp, Homo sapiens
ctctggggaagtcaggggagaag

SEQ ID NO: 6157156 - DNA, 10 bp, Homo sapiens
ctctggggac

SEQ ID NO: 6157157 - DNA, 23 bp, Homo sapiens
ctctggggacagcttcctcacac

SEQ ID NO: 6157158 - DNA, 19 bp, Homo sapiens
ctctggggaccccaacctc

SEQ ID NO: 6157159 - DNA, 22 bp, Homo sapiens
ctctggggacccgctgggggct

SEQ ID NO: 6157160 - DNA, 11 bp, Homo sapiens
ctctggggatg

SEQ ID NO: 6157161 - DNA, 18 bp, Homo sapiens
ctctggggatttctggga

SEQ ID NO: 6157162 - DNA, 19 bp, Homo sapiens
ctctggggatttctgggat

SEQ ID NO: 6157163 - DNA, 15 bp, Homo sapiens
ctctggggcagagct

SEQ ID NO: 6157164 - DNA, 14 bp, Homo sapiens
ctctggggcaggac

SEQ ID NO: 6157165 - DNA, 15 bp, Homo sapiens
ctctggggcaggacc

SEQ ID NO: 6157166 - DNA, 21 bp, Homo sapiens
ctctggggcaggaccactagc

SEQ ID NO: 6157167 - DNA, 17 bp, Homo sapiens
ctctggggccacacaga

SEQ ID NO: 6157168 - DNA, 20 bp, Homo sapiens
ctctggggccacacagaaac

SEQ ID NO: 6157169 - DNA, 14 bp, Homo sapiens
ctctggggccctgg

SEQ ID NO: 6157170 - DNA, 15 bp, Homo sapiens
ctctggggccctggg

SEQ ID NO: 6157171 - DNA, 16 bp, Homo sapiens
ctctggggccctgggc

SEQ ID NO: 6157172 - DNA, 16 bp, Homo sapiens
ctctggggcgcggcca

SEQ ID NO: 6157173 - DNA, 15 bp, Homo sapiens
ctctggggctcagcc

SEQ ID NO: 6157174 - DNA, 17 bp, Homo sapiens
ctctggggctcagccct

SEQ ID NO: 6157175 - DNA, 14 bp, Homo sapiens
ctctggggctctag

SEQ ID NO: 6157176 - DNA, 23 bp, Homo sapiens
ctctggggctggcaccagcaggc

SEQ ID NO: 6157177 - DNA, 19 bp, Homo sapiens
ctctggggcttgtcctgtg

SEQ ID NO: 6157178 - DNA, 17 bp, Homo sapiens
ctctgggggacccaggt

SEQ ID NO: 6157179 - DNA, 15 bp, Homo sapiens
ctctgggggaggcag

SEQ ID NO: 6157180 - DNA, 16 bp, Homo sapiens
ctctgggggaggcagg

SEQ ID NO: 6157181 - DNA, 18 bp, Homo sapiens
ctctgggggaggcagggc

SEQ ID NO: 6157182 - DNA, 22 bp, Homo sapiens
ctctgggggaggcagggctgga

SEQ ID NO: 6157183 - DNA, 13 bp, Homo sapiens
ctctgggggctct

SEQ ID NO: 6157184 - DNA, 21 bp, Homo sapiens
ctctgggggctctggccaagg

SEQ ID NO: 6157185 - DNA, 16 bp, Homo sapiens
ctctggggggttgcct

SEQ ID NO: 6157186 - DNA, 13 bp, Homo sapiens
ctctgggggtcct

SEQ ID NO: 6157187 - DNA, 20 bp, Homo sapiens
ctctggggtcccccatcccc

SEQ ID NO: 6157188 - DNA, 21 bp, Homo sapiens
ctctggggtgcagcttcaccc

SEQ ID NO: 6157189 - DNA, 18 bp, Homo sapiens
ctctggggtgctgcctga

SEQ ID NO: 6157190 - DNA, 12 bp, Homo sapiens
ctctggggtggg

SEQ ID NO: 6157191 - DNA, 19 bp, Homo sapiens
ctctgggtacctgcaagca

SEQ ID NO: 6157192 - DNA, 23 bp, Homo sapiens
ctctgggtacctgcaagcagaac

SEQ ID NO: 6157193 - DNA, 22 bp, Homo sapiens
ctctgggtcccggggtgcattt

SEQ ID NO: 6157194 - DNA, 18 bp, Homo sapiens
ctctgggtctcagtgtcc

SEQ ID NO: 6157195 - DNA, 22 bp, Homo sapiens
ctctgggtctgattttctcact

SEQ ID NO: 6157196 - DNA, 15 bp, Homo sapiens
ctctgggtctggcca

SEQ ID NO: 6157197 - DNA, 17 bp, Homo sapiens
ctctgggtcttggccat

SEQ ID NO: 6157198 - DNA, 21 bp, Homo sapiens
ctctgggtgagtggctgacag

SEQ ID NO: 6157199 - DNA, 22 bp, Homo sapiens
ctctgggtgagtggctgacaga

SEQ ID NO: 6157200 - DNA, 16 bp, Homo sapiens
ctctgggtgctgccct

SEQ ID NO: 6157201 - DNA, 17 bp, Homo sapiens
ctctgggtgctgccctg

SEQ ID NO: 6157202 - DNA, 22 bp, Homo sapiens
ctctgggtggaagtgcccagcc

SEQ ID NO: 6157203 - DNA, 14 bp, Homo sapiens
ctctgggtgggcgg

SEQ ID NO: 6157204 - DNA, 15 bp, Homo sapiens
ctctgggtgggcggg

SEQ ID NO: 6157205 - DNA, 14 bp, Homo sapiens
ctctgggtgggcgt

SEQ ID NO: 6157206 - DNA, 19 bp, Homo sapiens
ctctgggttccagcagagg

SEQ ID NO: 6157207 - DNA, 16 bp, Homo sapiens
ctctgggttttgggat

SEQ ID NO: 6157208 - DNA, 21 bp, Homo sapiens
ctctggtaaagttacactttt

SEQ ID NO: 6157209 - DNA, 19 bp, Homo sapiens
ctctggtacgaatctcatc

SEQ ID NO: 6157210 - DNA, 21 bp, Homo sapiens
ctctggtatctaattctttaa

SEQ ID NO: 6157211 - DNA, 12 bp, Homo sapiens
ctctggtccaca

SEQ ID NO: 6157212 - DNA, 14 bp, Homo sapiens
ctctggtccacact

SEQ ID NO: 6157213 - DNA, 18 bp, Homo sapiens
ctctggtccacactagaa

SEQ ID NO: 6157214 - DNA, 16 bp, Homo sapiens
ctctggtccatagaga

SEQ ID NO: 6157215 - DNA, 14 bp, Homo sapiens
ctctggtcctacca

SEQ ID NO: 6157216 - DNA, 18 bp, Homo sapiens
ctctggtcctcggagctg

SEQ ID NO: 6157217 - DNA, 20 bp, Homo sapiens
ctctggtcgctcctgcccac

SEQ ID NO: 6157218 - DNA, 16 bp, Homo sapiens
ctctggtgacaccagc

SEQ ID NO: 6157219 - DNA, 18 bp, Homo sapiens
ctctggtgacaccagcct

SEQ ID NO: 6157220 - DNA, 20 bp, Homo sapiens
ctctggtgacaccagccttt

SEQ ID NO: 6157221 - DNA, 23 bp, Homo sapiens
ctctggtgagtcttggcggcagc

SEQ ID NO: 6157222 - DNA, 17 bp, Homo sapiens
ctctggtgataaggaca

SEQ ID NO: 6157223 - DNA, 22 bp, Homo sapiens
ctctggtgcacgcctgagcgtc

SEQ ID NO: 6157224 - DNA, 10 bp, Homo sapiens
ctctggtgcc

SEQ ID NO: 6157225 - DNA, 13 bp, Homo sapiens
ctctggtgcctcc

SEQ ID NO: 6157226 - DNA, 17 bp, Homo sapiens
ctctggtggaacctgca

SEQ ID NO: 6157227 - DNA, 23 bp, Homo sapiens
ctctggtggccactgagctggct

SEQ ID NO: 6157228 - DNA, 15 bp, Homo sapiens
ctctggtggctcctc

SEQ ID NO: 6157229 - DNA, 19 bp, Homo sapiens
ctctggtggctcctcctag

SEQ ID NO: 6157230 - DNA, 14 bp, Homo sapiens
ctctggtggctgcc

SEQ ID NO: 6157231 - DNA, 10 bp, Homo sapiens
ctctggtggg

SEQ ID NO: 6157232 - DNA, 17 bp, Homo sapiens
ctctggtgggaaaatgt

SEQ ID NO: 6157233 - DNA, 15 bp, Homo sapiens
ctctggtgtctttga

SEQ ID NO: 6157234 - DNA, 19 bp, Homo sapiens
ctctggtgtttattataaa

SEQ ID NO: 6157235 - DNA, 15 bp, Homo sapiens
ctctggttatctaat

SEQ ID NO: 6157236 - DNA, 15 bp, Homo sapiens
ctctggttcctccag

SEQ ID NO: 6157237 - DNA, 12 bp, Homo sapiens
ctctggttgcct

SEQ ID NO: 6157238 - DNA, 14 bp, Homo sapiens
ctctggtttctgtg

SEQ ID NO: 6157239 - DNA, 15 bp, Homo sapiens
ctctggtttctgtgt

SEQ ID NO: 6157240 - DNA, 18 bp, Homo sapiens
ctctggtttctgtgtgtc

SEQ ID NO: 6157241 - DNA, 20 bp, Homo sapiens
ctctggtttggggcgaggca

SEQ ID NO: 6157242 - DNA, 18 bp, Homo sapiens
ctctggttttcctctgct

SEQ ID NO: 6157243 - DNA, 20 bp, Homo sapiens
ctctggttttctggtggggc

SEQ ID NO: 6157244 - DNA, 23 bp, Homo sapiens
ctctgtaaaaacactgaaaaatt

SEQ ID NO: 6157245 - DNA, 13 bp, Homo sapiens
ctctgtaaaacac

SEQ ID NO: 6157246 - DNA, 14 bp, Homo sapiens
ctctgtaaaacaca

SEQ ID NO: 6157247 - DNA, 14 bp, Homo sapiens
ctctgtaaaacgca

SEQ ID NO: 6157248 - DNA, 15 bp, Homo sapiens
ctctgtaaaacgcac

SEQ ID NO: 6157249 - DNA, 13 bp, Homo sapiens
ctctgtaaaagtg

SEQ ID NO: 6157250 - DNA, 24 bp, Homo sapiens
ctctgtaaccacctctctgtcttt

SEQ ID NO: 6157251 - DNA, 11 bp, Homo sapiens
ctctgtaatta

SEQ ID NO: 6157252 - DNA, 18 bp, Homo sapiens
ctctgtaattgaatatta

SEQ ID NO: 6157253 - DNA, 17 bp, Homo sapiens
ctctgtacagagcccac

SEQ ID NO: 6157254 - DNA, 21 bp, Homo sapiens
ctctgtacagagcccacgccc

SEQ ID NO: 6157255 - DNA, 14 bp, Homo sapiens
ctctgtaccgcccg

SEQ ID NO: 6157256 - DNA, 20 bp, Homo sapiens
ctctgtaccgcccggcagcc

SEQ ID NO: 6157257 - DNA, 21 bp, Homo sapiens
ctctgtaccgcccggcagccc

SEQ ID NO: 6157258 - DNA, 23 bp, Homo sapiens
ctctgtaccgcccggcagcccct

SEQ ID NO: 6157259 - DNA, 22 bp, Homo sapiens
ctctgtagcaaatttgtttaat

SEQ ID NO: 6157260 - DNA, 15 bp, Homo sapiens
ctctgtagccacctc

SEQ ID NO: 6157261 - DNA, 18 bp, Homo sapiens
ctctgtagccacctcctt

SEQ ID NO: 6157262 - DNA, 12 bp, Homo sapiens
ctctgtagcctg

SEQ ID NO: 6157263 - DNA, 15 bp, Homo sapiens
ctctgtagcctggtc

SEQ ID NO: 6157264 - DNA, 22 bp, Homo sapiens
ctctgtagcctggtctgtgcat

SEQ ID NO: 6157265 - DNA, 18 bp, Homo sapiens
ctctgtaggcacagagct

SEQ ID NO: 6157266 - DNA, 22 bp, Homo sapiens
ctctgtagggaactctggggtc

SEQ ID NO: 6157267 - DNA, 17 bp, Homo sapiens
ctctgtagttacattta

SEQ ID NO: 6157268 - DNA, 20 bp, Homo sapiens
ctctgtataagttgaaggaa

SEQ ID NO: 6157269 - DNA, 18 bp, Homo sapiens
ctctgtatagaaatctaa

SEQ ID NO: 6157270 - DNA, 20 bp, Homo sapiens
ctctgtatagaaatctaaaa

SEQ ID NO: 6157271 - DNA, 14 bp, Homo sapiens
ctctgtatattggg

SEQ ID NO: 6157272 - DNA, 15 bp, Homo sapiens
ctctgtatattgggc

SEQ ID NO: 6157273 - DNA, 21 bp, Homo sapiens
ctctgtatattgggctcagag

SEQ ID NO: 6157274 - DNA, 14 bp, Homo sapiens
ctctgtattctgca

SEQ ID NO: 6157275 - DNA, 15 bp, Homo sapiens
ctctgtcaatgaaaa

SEQ ID NO: 6157276 - DNA, 15 bp, Homo sapiens
ctctgtcaattgtac

SEQ ID NO: 6157277 - DNA, 17 bp, Homo sapiens
ctctgtcaattgtacgc

SEQ ID NO: 6157278 - DNA, 18 bp, Homo sapiens
ctctgtcacatccaactg

SEQ ID NO: 6157279 - DNA, 17 bp, Homo sapiens
ctctgtcacgttctgga

SEQ ID NO: 6157280 - DNA, 21 bp, Homo sapiens
ctctgtcacgttctggaacat

SEQ ID NO: 6157281 - DNA, 18 bp, Homo sapiens
ctctgtcactgcaggcac

SEQ ID NO: 6157282 - DNA, 23 bp, Homo sapiens
ctctgtcagatgggaagacatga

SEQ ID NO: 6157283 - DNA, 15 bp, Homo sapiens
ctctgtcagccagcc

SEQ ID NO: 6157284 - DNA, 17 bp, Homo sapiens
ctctgtcagtcacagcc

SEQ ID NO: 6157285 - DNA, 14 bp, Homo sapiens
ctctgtcagtgtga

SEQ ID NO: 6157286 - DNA, 18 bp, Homo sapiens
ctctgtcagtttgtgaag

SEQ ID NO: 6157287 - DNA, 16 bp, Homo sapiens
ctctgtcatcactccc

SEQ ID NO: 6157288 - DNA, 17 bp, Homo sapiens
ctctgtcatcactccct

SEQ ID NO: 6157289 - DNA, 20 bp, Homo sapiens
ctctgtccaactctgtattt

SEQ ID NO: 6157290 - DNA, 13 bp, Homo sapiens
ctctgtccactct

SEQ ID NO: 6157291 - DNA, 23 bp, Homo sapiens
ctctgtccacttgtgggtcctgg

SEQ ID NO: 6157292 - DNA, 15 bp, Homo sapiens
ctctgtccagccagc

SEQ ID NO: 6157293 - DNA, 19 bp, Homo sapiens
ctgggggaggtccaagcag

SEQ ID NO: 6157294 - DNA, 13 bp, Homo sapiens
ctgggggagtgga

SEQ ID NO: 6157295 - DNA, 18 bp, Homo sapiens
ctgggggataccagctga

SEQ ID NO: 6157296 - DNA, 20 bp, Homo sapiens
ctgggggatagaggggctgc

SEQ ID NO: 6157297 - DNA, 18 bp, Homo sapiens
ctgggggatgcaaataaa

SEQ ID NO: 6157298 - DNA, 21 bp, Homo sapiens
ctgggggattcctgagctggc

SEQ ID NO: 6157299 - DNA, 20 bp, Homo sapiens
ctgggggcaaaatcagaatg

SEQ ID NO: 6157300 - DNA, 18 bp, Homo sapiens
ctgggggcaaaggtttga

SEQ ID NO: 6157301 - DNA, 18 bp, Homo sapiens
ctgggggcacaagactga

SEQ ID NO: 6157302 - DNA, 14 bp, Homo sapiens
ctgggggcacagga

SEQ ID NO: 6157303 - DNA, 23 bp, Homo sapiens
ctgggggcagaactcctacctga

SEQ ID NO: 6157304 - DNA, 12 bp, Homo sapiens
ctgggggcagat

SEQ ID NO: 6157305 - DNA, 14 bp, Homo sapiens
ctgggggcagctgt

SEQ ID NO: 6157306 - DNA, 17 bp, Homo sapiens
ctgggggcaggacaaca

SEQ ID NO: 6157307 - DNA, 13 bp, Homo sapiens
ctgggggcagtga

SEQ ID NO: 6157308 - DNA, 14 bp, Homo sapiens
ctgggggcatcctg

SEQ ID NO: 6157309 - DNA, 15 bp, Homo sapiens
ctgggggcatcctgc

SEQ ID NO: 6157310 - DNA, 15 bp, Homo sapiens
ctgggggccagctcc

SEQ ID NO: 6157311 - DNA, 19 bp, Homo sapiens
ctgggggccagctggtgct

SEQ ID NO: 6157312 - DNA, 18 bp, Homo sapiens
ctgggggccagggctgga

SEQ ID NO: 6157313 - DNA, 17 bp, Homo sapiens
ctgggggccatgagctc

SEQ ID NO: 6157314 - DNA, 18 bp, Homo sapiens
ctgggggccatgagctcc

SEQ ID NO: 6157315 - DNA, 20 bp, Homo sapiens
ctgggggcccattctgcatg

SEQ ID NO: 6157316 - DNA, 19 bp, Homo sapiens
ctgggggccgcagaggatc

SEQ ID NO: 6157317 - DNA, 17 bp, Homo sapiens
ctgggggcctcagtgcc

SEQ ID NO: 6157318 - DNA, 15 bp, Homo sapiens
ctgggggcctctgcc

SEQ ID NO: 6157319 - DNA, 12 bp, Homo sapiens
ctgggggcctgg

SEQ ID NO: 6157320 - DNA, 15 bp, Homo sapiens
ctgggggcctggctg

SEQ ID NO: 6157321 - DNA, 18 bp, Homo sapiens
ctgggggcctggctggct

SEQ ID NO: 6157322 - DNA, 15 bp, Homo sapiens
ctgggggcggccagc

SEQ ID NO: 6157323 - DNA, 18 bp, Homo sapiens
ctgggggcggccagccct

SEQ ID NO: 6157324 - DNA, 23 bp, Homo sapiens
ctgggggctccccttgcccttcc

SEQ ID NO: 6157325 - DNA, 14 bp, Homo sapiens
ctgggggctctggc

SEQ ID NO: 6157326 - DNA, 16 bp, Homo sapiens
ctgggggctctggcca

SEQ ID NO: 6157327 - DNA, 18 bp, Homo sapiens
ctgggggctgaggagcag

SEQ ID NO: 6157328 - DNA, 14 bp, Homo sapiens
ctgggggctgcagg

SEQ ID NO: 6157329 - DNA, 17 bp, Homo sapiens
ctgggggctgcagggct

SEQ ID NO: 6157330 - DNA, 19 bp, Homo sapiens
ctgggggctgcagggctgg

SEQ ID NO: 6157331 - DNA, 13 bp, Homo sapiens
ctgggggctggac

SEQ ID NO: 6157332 - DNA, 19 bp, Homo sapiens
ctgggggctggacctgctg

SEQ ID NO: 6157333 - DNA, 15 bp, Homo sapiens
ctgggggctggctcc

SEQ ID NO: 6157334 - DNA, 20 bp, Homo sapiens
ctgggggctggctcccaggg

SEQ ID NO: 6157335 - DNA, 20 bp, Homo sapiens
ctgggggcttttgccactcc

SEQ ID NO: 6157336 - DNA, 23 bp, Homo sapiens
ctggggggaaaaagaccaggtct

SEQ ID NO: 6157337 - DNA, 21 bp, Homo sapiens
ctggggggaaggcgatgtggt

SEQ ID NO: 6157338 - DNA, 21 bp, Homo sapiens
ctggggggacccagtgcagaa

SEQ ID NO: 6157339 - DNA, 13 bp, Homo sapiens
ctggggggcacag

SEQ ID NO: 6157340 - DNA, 13 bp, Homo sapiens
ctggggggcaggc

SEQ ID NO: 6157341 - DNA, 16 bp, Homo sapiens
ctggggggcagtggtg

SEQ ID NO: 6157342 - DNA, 15 bp, Homo sapiens
ctggggggccaccat

SEQ ID NO: 6157343 - DNA, 18 bp, Homo sapiens
ctggggggcctgaaagca

SEQ ID NO: 6157344 - DNA, 19 bp, Homo sapiens
ctggggggctgtcctgagc

SEQ ID NO: 6157345 - DNA, 17 bp, Homo sapiens
ctggggggctttggcct

SEQ ID NO: 6157346 - DNA, 17 bp, Homo sapiens
ctggggggtggccaggc

SEQ ID NO: 6157347 - DNA, 19 bp, Homo sapiens
ctggggggtggccaggccg

SEQ ID NO: 6157348 - DNA, 16 bp, Homo sapiens
ctggggggtggggagg

SEQ ID NO: 6157349 - DNA, 19 bp, Homo sapiens
ctggggggtggggaggagg

SEQ ID NO: 6157350 - DNA, 23 bp, Homo sapiens
ctggggggtggggaggaggaagc

SEQ ID NO: 6157351 - DNA, 15 bp, Homo sapiens
ctggggggttggcag

SEQ ID NO: 6157352 - DNA, 19 bp, Homo sapiens
ctggggggttggcagccca

SEQ ID NO: 6157353 - DNA, 18 bp, Homo sapiens
ctgggggtggacatctga

SEQ ID NO: 6157354 - DNA, 13 bp, Homo sapiens
ctgggggtggcag

SEQ ID NO: 6157355 - DNA, 14 bp, Homo sapiens
ctgggggtggcagg

SEQ ID NO: 6157356 - DNA, 14 bp, Homo sapiens
ctgggggtgggcca

SEQ ID NO: 6157357 - DNA, 21 bp, Homo sapiens
ctgggggtggggctcctacct

SEQ ID NO: 6157358 - DNA, 22 bp, Homo sapiens
ctggggtaaaattgagtttcag

SEQ ID NO: 6157359 - DNA, 18 bp, Homo sapiens
ctggggtaagcggaataa

SEQ ID NO: 6157360 - DNA, 20 bp, Homo sapiens
ctggggtaagcggaataaac

SEQ ID NO: 6157361 - DNA, 23 bp, Homo sapiens
ctggggtacaaggggcccagtgc

SEQ ID NO: 6157362 - DNA, 19 bp, Homo sapiens
ctggggtacacagtgagag

SEQ ID NO: 6157363 - DNA, 12 bp, Homo sapiens
ctggggtacagg

SEQ ID NO: 6157364 - DNA, 16 bp, Homo sapiens
ctggggtaggctgctc

SEQ ID NO: 6157365 - DNA, 23 bp, Homo sapiens
ctggggtaggctgctccctgagg

SEQ ID NO: 6157366 - DNA, 20 bp, Homo sapiens
ctggggtaggctgtctgtgc

SEQ ID NO: 6157367 - DNA, 22 bp, Homo sapiens
ctggggtaggctgtctgtgcca

SEQ ID NO: 6157368 - DNA, 22 bp, Homo sapiens
ctggggtagttggtgagcagag

SEQ ID NO: 6157369 - DNA, 15 bp, Homo sapiens
ctggggtatgtgtgt

SEQ ID NO: 6157370 - DNA, 20 bp, Homo sapiens
ctggggtatgtgtgtgtggg

SEQ ID NO: 6157371 - DNA, 23 bp, Homo sapiens
ctggggtcattttgactggcttg

SEQ ID NO: 6157372 - DNA, 13 bp, Homo sapiens
ctggggtcccagc

SEQ ID NO: 6157373 - DNA, 20 bp, Homo sapiens
ctggggtcccagcagctgcc

SEQ ID NO: 6157374 - DNA, 13 bp, Homo sapiens
ctggggtcccccc

SEQ ID NO: 6157375 - DNA, 23 bp, Homo sapiens
ctggggtccgtcttcacactgcg

SEQ ID NO: 6157376 - DNA, 18 bp, Homo sapiens
ctggggtcctggggcctc

SEQ ID NO: 6157377 - DNA, 19 bp, Homo sapiens
ctggggtcctggggcctcg

SEQ ID NO: 6157378 - DNA, 17 bp, Homo sapiens
ctggggtctctctccct

SEQ ID NO: 6157379 - DNA, 20 bp, Homo sapiens
ctggggtctctgagcagtgg

SEQ ID NO: 6157380 - DNA, 13 bp, Homo sapiens
ctggggtctggag

SEQ ID NO: 6157381 - DNA, 13 bp, Homo sapiens
ctggggtgaatac

SEQ ID NO: 6157382 - DNA, 16 bp, Homo sapiens
ctggggtgagagagga

SEQ ID NO: 6157383 - DNA, 19 bp, Homo sapiens
ctggggtgagagaggaaag

SEQ ID NO: 6157384 - DNA, 18 bp, Homo sapiens
ctggggtgagcctgactg

SEQ ID NO: 6157385 - DNA, 23 bp, Homo sapiens
ctggggtgagcctgactgccagg

SEQ ID NO: 6157386 - DNA, 14 bp, Homo sapiens
ctggggtgagggag

SEQ ID NO: 6157387 - DNA, 16 bp, Homo sapiens
ctggggtgagggagtt

SEQ ID NO: 6157388 - DNA, 19 bp, Homo sapiens
ctggggtgatagaacaaga

SEQ ID NO: 6157389 - DNA, 12 bp, Homo sapiens
ctggggtgcagg

SEQ ID NO: 6157390 - DNA, 17 bp, Homo sapiens
ctggggtgcatcctcct

SEQ ID NO: 6157391 - DNA, 18 bp, Homo sapiens
ctggggtgccgcctgccc

SEQ ID NO: 6157392 - DNA, 22 bp, Homo sapiens
ctggggtgccttcactgggcca

SEQ ID NO: 6157393 - DNA, 23 bp, Homo sapiens
ctggggtgccttcactgggccag

SEQ ID NO: 6157394 - DNA, 11 bp, Homo sapiens
ctggggtggcc

SEQ ID NO: 6157395 - DNA, 16 bp, Homo sapiens
ctggggtggccaccag

SEQ ID NO: 6157396 - DNA, 13 bp, Homo sapiens
ctggggtggccag

SEQ ID NO: 6157397 - DNA, 14 bp, Homo sapiens
ctggggtggccagg

SEQ ID NO: 6157398 - DNA, 15 bp, Homo sapiens
ctggggtggcctcaa

SEQ ID NO: 6157399 - DNA, 16 bp, Homo sapiens
ctggggtggcctcaag

SEQ ID NO: 6157400 - DNA, 18 bp, Homo sapiens
ctggggtgggacagggag

SEQ ID NO: 6157401 - DNA, 23 bp, Homo sapiens
ctggggtgggacagggagggccg

SEQ ID NO: 6157402 - DNA, 21 bp, Homo sapiens
ctggggtgggagggggcaggg

SEQ ID NO: 6157403 - DNA, 22 bp, Homo sapiens
ctggggtgggagggggcagggg

SEQ ID NO: 6157404 - DNA, 23 bp, Homo sapiens
ctggggtgggagggggcaggggg

SEQ ID NO: 6157405 - DNA, 23 bp, Homo sapiens
ctggggtgggagggtctgcaggg

SEQ ID NO: 6157406 - DNA, 23 bp, Homo sapiens
ctggggtgggagtaacagggcag

SEQ ID NO: 6157407 - DNA, 18 bp, Homo sapiens
ctggggtgggatctgagc

SEQ ID NO: 6157408 - DNA, 21 bp, Homo sapiens
ctggggtgggatctgagctcc

SEQ ID NO: 6157409 - DNA, 16 bp, Homo sapiens
ctggggtgggcagttt

SEQ ID NO: 6157410 - DNA, 18 bp, Homo sapiens
ctggggtgggcagttttt

SEQ ID NO: 6157411 - DNA, 14 bp, Homo sapiens
ctggggtgggccct

SEQ ID NO: 6157412 - DNA, 17 bp, Homo sapiens
ctggggtggggacctca

SEQ ID NO: 6157413 - DNA, 19 bp, Homo sapiens
ctggggtggggacctcagg

SEQ ID NO: 6157414 - DNA, 20 bp, Homo sapiens
ctggggtggggatagggagc

SEQ ID NO: 6157415 - DNA, 14 bp, Homo sapiens
ctggggtggggtca

SEQ ID NO: 6157416 - DNA, 17 bp, Homo sapiens
ctggggtgggtgtgagc

SEQ ID NO: 6157417 - DNA, 21 bp, Homo sapiens
ctggggtgggtttagcaggct

SEQ ID NO: 6157418 - DNA, 21 bp, Homo sapiens
ctggggtggttggaggcctgg

SEQ ID NO: 6157419 - DNA, 22 bp, Homo sapiens
ctggggtggttggaggcctggt

SEQ ID NO: 6157420 - DNA, 16 bp, Homo sapiens
ctggggtgtgggaggc

SEQ ID NO: 6157421 - DNA, 20 bp, Homo sapiens
ctggggtgttagtggcaccg

SEQ ID NO: 6157422 - DNA, 19 bp, Homo sapiens
ctggggttcaagcccaggc

SEQ ID NO: 6157423 - DNA, 15 bp, Homo sapiens
ctggggttcagcccc

SEQ ID NO: 6157424 - DNA, 16 bp, Homo sapiens
ctggggttgattccca

SEQ ID NO: 6157425 - DNA, 14 bp, Homo sapiens
ctggggttgccaga

SEQ ID NO: 6157426 - DNA, 15 bp, Homo sapiens
ctggggttgccagag

SEQ ID NO: 6157427 - DNA, 17 bp, Homo sapiens
ctggggttgccagaggc

SEQ ID NO: 6157428 - DNA, 20 bp, Homo sapiens
ctggggttgccagaggccct

SEQ ID NO: 6157429 - DNA, 21 bp, Homo sapiens
ctggggttgccagaggccctg

SEQ ID NO: 6157430 - DNA, 22 bp, Homo sapiens
ctggggttgccagaggccctgg

SEQ ID NO: 6157431 - DNA, 15 bp, Homo sapiens
ctggggttgccctgg

SEQ ID NO: 6157432 - DNA, 15 bp, Homo sapiens
ctggggttgtcagct

SEQ ID NO: 6157433 - DNA, 17 bp, Homo sapiens
ctggggttgtccccgct

SEQ ID NO: 6157434 - DNA, 17 bp, Homo sapiens
ctggggtttagaacccc

SEQ ID NO: 6157435 - DNA, 20 bp, Homo sapiens
ctggggtttccacacaggcc

SEQ ID NO: 6157436 - DNA, 21 bp, Homo sapiens
ctggggtttccacacaggccc

SEQ ID NO: 6157437 - DNA, 22 bp, Homo sapiens
ctggggtttccacacaggccca

SEQ ID NO: 6157438 - DNA, 21 bp, Homo sapiens
ctggggtttgaccacccacct

SEQ ID NO: 6157439 - DNA, 17 bp, Homo sapiens
ctgggtaagaagaaagc

SEQ ID NO: 6157440 - DNA, 23 bp, Homo sapiens
ctgggtaagaagaaagcaaaagc

SEQ ID NO: 6157441 - DNA, 22 bp, Homo sapiens
ctgggtaagaagggtgggagtg

SEQ ID NO: 6157442 - DNA, 18 bp, Homo sapiens
ctgggtaatgaaacaaag

SEQ ID NO: 6157443 - DNA, 23 bp, Homo sapiens
ctgggtaatttataaagaaaaat

SEQ ID NO: 6157444 - DNA, 21 bp, Homo sapiens
ctgggtacaagagatgggatg

SEQ ID NO: 6157445 - DNA, 16 bp, Homo sapiens
ctgggtacaagagcca

SEQ ID NO: 6157446 - DNA, 16 bp, Homo sapiens
ctgggtaccaggccac

SEQ ID NO: 6157447 - DNA, 20 bp, Homo sapiens
ctgggtacccaaaacacatt

SEQ ID NO: 6157448 - DNA, 18 bp, Homo sapiens
ctgggtacccaagtgaag

SEQ ID NO: 6157449 - DNA, 16 bp, Homo sapiens
ctgggtacgagggatg

SEQ ID NO: 6157450 - DNA, 21 bp, Homo sapiens
ctgggtacttgtggacacagc

SEQ ID NO: 6157451 - DNA, 23 bp, Homo sapiens
ctgggtacttgtggacacagctc

SEQ ID NO: 6157452 - DNA, 21 bp, Homo sapiens
ctgggtagaagccacccttcc

SEQ ID NO: 6157453 - DNA, 22 bp, Homo sapiens
ctgggtagaagccacccttccc

SEQ ID NO: 6157454 - DNA, 17 bp, Homo sapiens
ctgggtagcgggggagg

SEQ ID NO: 6157455 - DNA, 22 bp, Homo sapiens
ctgggtaggaaaattagaagca

SEQ ID NO: 6157456 - DNA, 23 bp, Homo sapiens
ctgggtaggaaaattagaagcaa

SEQ ID NO: 6157457 - DNA, 17 bp, Homo sapiens
ctgggtaggaaagagga

SEQ ID NO: 6157458 - DNA, 19 bp, Homo sapiens
ctgggtaggaaagaggaag

SEQ ID NO: 6157459 - DNA, 14 bp, Homo sapiens
ctgggtaggcaggt

SEQ ID NO: 6157460 - DNA, 22 bp, Homo sapiens
ctgggtaggcaggtgtcttgga

SEQ ID NO: 6157461 - DNA, 15 bp, Homo sapiens
ctgggtaggttctga

SEQ ID NO: 6157462 - DNA, 22 bp, Homo sapiens
ctgggtagtgctttaagaatga

SEQ ID NO: 6157463 - DNA, 19 bp, Homo sapiens
ctgggtataagcagagagg

SEQ ID NO: 6157464 - DNA, 22 bp, Homo sapiens
ctgggtatcccctgcctcctgc

SEQ ID NO: 6157465 - DNA, 19 bp, Homo sapiens
ctgggtatgaggctggggc

SEQ ID NO: 6157466 - DNA, 16 bp, Homo sapiens
ctgggtatgcgtttca

SEQ ID NO: 6157467 - DNA, 15 bp, Homo sapiens
ctgggtattggaaat

SEQ ID NO: 6157468 - DNA, 20 bp, Homo sapiens
ctgggtcaaaagagccctgg

SEQ ID NO: 6157469 - DNA, 14 bp, Homo sapiens
ctctgtccaggcac

SEQ ID NO: 6157470 - DNA, 19 bp, Homo sapiens
ctctgtccaggcactgaga

SEQ ID NO: 6157471 - DNA, 15 bp, Homo sapiens
ctctgtccaggccac

SEQ ID NO: 6157472 - DNA, 17 bp, Homo sapiens
ctctgtccaggccactg

SEQ ID NO: 6157473 - DNA, 14 bp, Homo sapiens
ctctgtccagggct

SEQ ID NO: 6157474 - DNA, 21 bp, Homo sapiens
ctctgtccatttatccacagg

SEQ ID NO: 6157475 - DNA, 16 bp, Homo sapiens
ctctgtcccaccccta

SEQ ID NO: 6157476 - DNA, 17 bp, Homo sapiens
ctctgtcccacccctag

SEQ ID NO: 6157477 - DNA, 18 bp, Homo sapiens
ctctgtcccacccctagc

SEQ ID NO: 6157478 - DNA, 22 bp, Homo sapiens
ctctgtcccacccctagccacc

SEQ ID NO: 6157479 - DNA, 22 bp, Homo sapiens
ctctgtcccacttggcatcagc

SEQ ID NO: 6157480 - DNA, 18 bp, Homo sapiens
ctctgtcccattccctgg

SEQ ID NO: 6157481 - DNA, 22 bp, Homo sapiens
ctctgtccccaccccatgggcc

SEQ ID NO: 6157482 - DNA, 13 bp, Homo sapiens
ctctgtccccagc

SEQ ID NO: 6157483 - DNA, 15 bp, Homo sapiens
ctctgtccccaggcc

SEQ ID NO: 6157484 - DNA, 18 bp, Homo sapiens
ctctgtccccaggtcctg

SEQ ID NO: 6157485 - DNA, 18 bp, Homo sapiens
ctctgtcccccaggctgg

SEQ ID NO: 6157486 - DNA, 14 bp, Homo sapiens
ctctgtccccttct

SEQ ID NO: 6157487 - DNA, 13 bp, Homo sapiens
ctctgtccctctc

SEQ ID NO: 6157488 - DNA, 13 bp, Homo sapiens
ctctgtccctctt

SEQ ID NO: 6157489 - DNA, 20 bp, Homo sapiens
ctctgtccctctttgcctgt

SEQ ID NO: 6157490 - DNA, 14 bp, Homo sapiens
ctctgtccctgtaa

SEQ ID NO: 6157491 - DNA, 16 bp, Homo sapiens
ctctgtccctgtcctt

SEQ ID NO: 6157492 - DNA, 17 bp, Homo sapiens
ctctgtccgtctgtcct

SEQ ID NO: 6157493 - DNA, 20 bp, Homo sapiens
ctctgtccgtctgtcctgcg

SEQ ID NO: 6157494 - DNA, 17 bp, Homo sapiens
ctctgtccgtgcccctt

SEQ ID NO: 6157495 - DNA, 20 bp, Homo sapiens
ctctgtcctcccatcccctc

SEQ ID NO: 6157496 - DNA, 20 bp, Homo sapiens
ctctgtcctctgtcagtcat

SEQ ID NO: 6157497 - DNA, 21 bp, Homo sapiens
ctctgtcctcttggccatcct

SEQ ID NO: 6157498 - DNA, 16 bp, Homo sapiens
ctctgtcctgcttctg

SEQ ID NO: 6157499 - DNA, 21 bp, Homo sapiens
ctctgtcctggcccgggagcc

SEQ ID NO: 6157500 - DNA, 13 bp, Homo sapiens
ctctgtcctggga

SEQ ID NO: 6157501 - DNA, 15 bp, Homo sapiens
ctctgtcctgggagt

SEQ ID NO: 6157502 - DNA, 22 bp, Homo sapiens
ctctgtcctgggagtgagctgg

SEQ ID NO: 6157503 - DNA, 22 bp, Homo sapiens
ctctgtccttcccccagcacaa

SEQ ID NO: 6157504 - DNA, 16 bp, Homo sapiens
ctctgtcgcccaggct

SEQ ID NO: 6157505 - DNA, 17 bp, Homo sapiens
ctctgtcgcccaggctg

SEQ ID NO: 6157506 - DNA, 18 bp, Homo sapiens
ctctgtcgcccagtctgg

SEQ ID NO: 6157507 - DNA, 19 bp, Homo sapiens
ctctgtcgcccagtctgga

SEQ ID NO: 6157508 - DNA, 18 bp, Homo sapiens
ctctgtcgcccatgctgg

SEQ ID NO: 6157509 - DNA, 20 bp, Homo sapiens
ctctgtcgcccatgctggag

SEQ ID NO: 6157510 - DNA, 22 bp, Homo sapiens
ctctgtctaccatctccctcga

SEQ ID NO: 6157511 - DNA, 16 bp, Homo sapiens
ctctgtctacccagtg

SEQ ID NO: 6157512 - DNA, 18 bp, Homo sapiens
ctctgtctagcatgccaa

SEQ ID NO: 6157513 - DNA, 13 bp, Homo sapiens
ctctgtctaggac

SEQ ID NO: 6157514 - DNA, 22 bp, Homo sapiens
ctctgtctaggactgcagtgtg

SEQ ID NO: 6157515 - DNA, 23 bp, Homo sapiens
ctctgtctaggactgcagtgtgg

SEQ ID NO: 6157516 - DNA, 10 bp, Homo sapiens
ctctgtctca

SEQ ID NO: 6157517 - DNA, 14 bp, Homo sapiens
ctctgtctcatcca

SEQ ID NO: 6157518 - DNA, 22 bp, Homo sapiens
ctctgtctcatcctcctggaac

SEQ ID NO: 6157519 - DNA, 23 bp, Homo sapiens
ctctgtctcatgtgtgctcttct

SEQ ID NO: 6157520 - DNA, 14 bp, Homo sapiens
ctctgtctccaggc

SEQ ID NO: 6157521 - DNA, 18 bp, Homo sapiens
ctctgtctcccaggctgc

SEQ ID NO: 6157522 - DNA, 19 bp, Homo sapiens
ctctgtctcccaggctgga

SEQ ID NO: 6157523 - DNA, 13 bp, Homo sapiens
ctctgtctcgagc

SEQ ID NO: 6157524 - DNA, 22 bp, Homo sapiens
ctctgtctcgagcgccctgcag

SEQ ID NO: 6157525 - DNA, 22 bp, Homo sapiens
ctctgtctctcctagcccctct

SEQ ID NO: 6157526 - DNA, 16 bp, Homo sapiens
ctctgtctctgctctt

SEQ ID NO: 6157527 - DNA, 21 bp, Homo sapiens
ctctgtctctgctcttgcctg

SEQ ID NO: 6157528 - DNA, 22 bp, Homo sapiens
ctctgtctgagtaagaaacaga

SEQ ID NO: 6157529 - DNA, 14 bp, Homo sapiens
ctctgtctgccctc

SEQ ID NO: 6157530 - DNA, 14 bp, Homo sapiens
ctctgtctgccctt

SEQ ID NO: 6157531 - DNA, 17 bp, Homo sapiens
ctctgtctgctcaatgc

SEQ ID NO: 6157532 - DNA, 16 bp, Homo sapiens
ctctgtctggccaggg

SEQ ID NO: 6157533 - DNA, 21 bp, Homo sapiens
ctctgtctggccagggaggag

SEQ ID NO: 6157534 - DNA, 14 bp, Homo sapiens
ctctgtctggggct

SEQ ID NO: 6157535 - DNA, 15 bp, Homo sapiens
ctctgtctgtctctc

SEQ ID NO: 6157536 - DNA, 18 bp, Homo sapiens
ctctgtctgtctctcccc

SEQ ID NO: 6157537 - DNA, 19 bp, Homo sapiens
ctctgtctgtctctccccc

SEQ ID NO: 6157538 - DNA, 13 bp, Homo sapiens
ctctgtcttaaag

SEQ ID NO: 6157539 - DNA, 22 bp, Homo sapiens
ctctgtcttcaggctctgccca

SEQ ID NO: 6157540 - DNA, 17 bp, Homo sapiens
ctctgtcttctggactg

SEQ ID NO: 6157541 - DNA, 23 bp, Homo sapiens
ctctgtcttctttgcccacaatg

SEQ ID NO: 6157542 - DNA, 19 bp, Homo sapiens
ctctgtcttggtaggtttg

SEQ ID NO: 6157543 - DNA, 16 bp, Homo sapiens
ctctgtcttttctcct

SEQ ID NO: 6157544 - DNA, 19 bp, Homo sapiens
ctctgtcttttctcctccg

SEQ ID NO: 6157545 - DNA, 21 bp, Homo sapiens
ctctgtcttttggagaaccag

SEQ ID NO: 6157546 - DNA, 18 bp, Homo sapiens
ctctgtgaaccctatgag

SEQ ID NO: 6157547 - DNA, 23 bp, Homo sapiens
ctctgtgaacgatttagaaagaa

SEQ ID NO: 6157548 - DNA, 17 bp, Homo sapiens
ctctgtgaactgtgtgt

SEQ ID NO: 6157549 - DNA, 18 bp, Homo sapiens
ctctgtgaagcattcgag

SEQ ID NO: 6157550 - DNA, 17 bp, Homo sapiens
ctctgtgaatacaatta

SEQ ID NO: 6157551 - DNA, 19 bp, Homo sapiens
ctctgtgaatacaattaaa

SEQ ID NO: 6157552 - DNA, 19 bp, Homo sapiens
ctctgtgaccaatgtcttg

SEQ ID NO: 6157553 - DNA, 24 bp, Homo sapiens
ctctgtgacctcaggcactagcct

SEQ ID NO: 6157554 - DNA, 21 bp, Homo sapiens
ctctgtgactcgcttagctga

SEQ ID NO: 6157555 - DNA, 19 bp, Homo sapiens
ctctgtgagaaggtttatt

SEQ ID NO: 6157556 - DNA, 21 bp, Homo sapiens
ctctgtgagaaggtttattgt

SEQ ID NO: 6157557 - DNA, 17 bp, Homo sapiens
ctctgtgagactcgaga

SEQ ID NO: 6157558 - DNA, 22 bp, Homo sapiens
ctctgtgagccccacagccctg

SEQ ID NO: 6157559 - DNA, 24 bp, Homo sapiens
ctctgtgagccccacagccctgct

SEQ ID NO: 6157560 - DNA, 18 bp, Homo sapiens
ctctgtgatctaagcagt

SEQ ID NO: 6157561 - DNA, 17 bp, Homo sapiens
ctctgtgattacataga

SEQ ID NO: 6157562 - DNA, 22 bp, Homo sapiens
ctctgtgcaggagccagtcctg

SEQ ID NO: 6157563 - DNA, 23 bp, Homo sapiens
ctctgtgcaggtgctgccttgag

SEQ ID NO: 6157564 - DNA, 20 bp, Homo sapiens
ctctgtgccagagcctgggg

SEQ ID NO: 6157565 - DNA, 13 bp, Homo sapiens
ctctgtgccaggg

SEQ ID NO: 6157566 - DNA, 19 bp, Homo sapiens
ctctgtgccagggcagcat

SEQ ID NO: 6157567 - DNA, 20 bp, Homo sapiens
ctctgtgccagggcagcatt

SEQ ID NO: 6157568 - DNA, 21 bp, Homo sapiens
ctctgtgccagggcagcattt

SEQ ID NO: 6157569 - DNA, 22 bp, Homo sapiens
ctctgtgcccacggtctgagct

SEQ ID NO: 6157570 - DNA, 23 bp, Homo sapiens
ctctgtgcccatgggcactgctg

SEQ ID NO: 6157571 - DNA, 19 bp, Homo sapiens
ctctgtgcccggtgccatc

SEQ ID NO: 6157572 - DNA, 21 bp, Homo sapiens
ctctgtgcccggtgccatctt

SEQ ID NO: 6157573 - DNA, 13 bp, Homo sapiens
ctctgtgcctggg

SEQ ID NO: 6157574 - DNA, 14 bp, Homo sapiens
ctctgtgcctggga

SEQ ID NO: 6157575 - DNA, 14 bp, Homo sapiens
ctctgtgccttggt

SEQ ID NO: 6157576 - DNA, 10 bp, Homo sapiens
ctctgtgctc

SEQ ID NO: 6157577 - DNA, 15 bp, Homo sapiens
ctctgtgctccctcg

SEQ ID NO: 6157578 - DNA, 14 bp, Homo sapiens
ctctgtgctgagca

SEQ ID NO: 6157579 - DNA, 16 bp, Homo sapiens
ctctgtgctggccagc

SEQ ID NO: 6157580 - DNA, 14 bp, Homo sapiens
ctctgtgctgtgga

SEQ ID NO: 6157581 - DNA, 11 bp, Homo sapiens
ctctgtgcttc

SEQ ID NO: 6157582 - DNA, 13 bp, Homo sapiens
ctctgtgcttcga

SEQ ID NO: 6157583 - DNA, 22 bp, Homo sapiens
ctctgtgcttttaaatgcataa

SEQ ID NO: 6157584 - DNA, 19 bp, Homo sapiens
ctctgtggaaaagccatct

SEQ ID NO: 6157585 - DNA, 16 bp, Homo sapiens
ctctgtggcaaaaaga

SEQ ID NO: 6157586 - DNA, 19 bp, Homo sapiens
ctctgtggcattgaaatga

SEQ ID NO: 6157587 - DNA, 13 bp, Homo sapiens
ctctgtggccagc

SEQ ID NO: 6157588 - DNA, 14 bp, Homo sapiens
ctctgtggccagcc

SEQ ID NO: 6157589 - DNA, 20 bp, Homo sapiens
ctctgtggccagcctggcat

SEQ ID NO: 6157590 - DNA, 16 bp, Homo sapiens
ctctgtggccagctgc

SEQ ID NO: 6157591 - DNA, 20 bp, Homo sapiens
ctctgtggccagctgcatct

SEQ ID NO: 6157592 - DNA, 21 bp, Homo sapiens
ctctgtggccagctgcatctg

SEQ ID NO: 6157593 - DNA, 14 bp, Homo sapiens
ctctgtggccagga

SEQ ID NO: 6157594 - DNA, 23 bp, Homo sapiens
ctctgtggccaggagccctggcc

SEQ ID NO: 6157595 - DNA, 16 bp, Homo sapiens
ctctgtggcctgtctc

SEQ ID NO: 6157596 - DNA, 16 bp, Homo sapiens
ctctgtggcgagccat

SEQ ID NO: 6157597 - DNA, 13 bp, Homo sapiens
ctctgtggctcca

SEQ ID NO: 6157598 - DNA, 17 bp, Homo sapiens
ctctgtggctccaaccc

SEQ ID NO: 6157599 - DNA, 20 bp, Homo sapiens
ctctgtggctccaggccaaa

SEQ ID NO: 6157600 - DNA, 13 bp, Homo sapiens
ctctgtgggctgc

SEQ ID NO: 6157601 - DNA, 13 bp, Homo sapiens
ctctgtggggcca

SEQ ID NO: 6157602 - DNA, 17 bp, Homo sapiens
ctctgtgggtctctgga

SEQ ID NO: 6157603 - DNA, 18 bp, Homo sapiens
ctctgtgggtctctggaa

SEQ ID NO: 6157604 - DNA, 20 bp, Homo sapiens
ctctgtgggtctctggaaga

SEQ ID NO: 6157605 - DNA, 17 bp, Homo sapiens
ctctgtgggtgatgggg

SEQ ID NO: 6157606 - DNA, 20 bp, Homo sapiens
ctctgtggtaagagatatgc

SEQ ID NO: 6157607 - DNA, 18 bp, Homo sapiens
ctctgtggtcacagaggg

SEQ ID NO: 6157608 - DNA, 13 bp, Homo sapiens
ctctgtggtccct

SEQ ID NO: 6157609 - DNA, 16 bp, Homo sapiens
ctctgtggtgtctgcc

SEQ ID NO: 6157610 - DNA, 22 bp, Homo sapiens
ctctgtgtaaccagctcagtgt

SEQ ID NO: 6157611 - DNA, 15 bp, Homo sapiens
ctctgtgtacatgtg

SEQ ID NO: 6157612 - DNA, 15 bp, Homo sapiens
ctctgtgtatatctc

SEQ ID NO: 6157613 - DNA, 14 bp, Homo sapiens
ctctgtgtatttat

SEQ ID NO: 6157614 - DNA, 19 bp, Homo sapiens
ctctgtgtatttatataaa

SEQ ID NO: 6157615 - DNA, 22 bp, Homo sapiens
ctctgtgtatttatataaaaat

SEQ ID NO: 6157616 - DNA, 18 bp, Homo sapiens
ctctgtgtatttgctttt

SEQ ID NO: 6157617 - DNA, 16 bp, Homo sapiens
ctctgtgtcactggct

SEQ ID NO: 6157618 - DNA, 17 bp, Homo sapiens
ctctgtgtcactggctg

SEQ ID NO: 6157619 - DNA, 18 bp, Homo sapiens
ctctgtgtcactggctgc

SEQ ID NO: 6157620 - DNA, 20 bp, Homo sapiens
ctctgtgtcactggctgcct

SEQ ID NO: 6157621 - DNA, 22 bp, Homo sapiens
ctctgtgtcagcatctttgccc

SEQ ID NO: 6157622 - DNA, 20 bp, Homo sapiens
ctctgtgtcaggtggggcag

SEQ ID NO: 6157623 - DNA, 21 bp, Homo sapiens
ctctgtgtcaggtggggcagc

SEQ ID NO: 6157624 - DNA, 17 bp, Homo sapiens
ctctgtgtcctctcccc

SEQ ID NO: 6157625 - DNA, 14 bp, Homo sapiens
ctctgtgtccttcc

SEQ ID NO: 6157626 - DNA, 16 bp, Homo sapiens
ctctgtgtccttccct

SEQ ID NO: 6157627 - DNA, 17 bp, Homo sapiens
ctctgtgtccttccctg

SEQ ID NO: 6157628 - DNA, 15 bp, Homo sapiens
ctctgtgtctaagat

SEQ ID NO: 6157629 - DNA, 18 bp, Homo sapiens
ctctgtgtctaagattct

SEQ ID NO: 6157630 - DNA, 19 bp, Homo sapiens
ctctgtgtctaagattcta

SEQ ID NO: 6157631 - DNA, 21 bp, Homo sapiens
ctctgtgtctaagattctaga

SEQ ID NO: 6157632 - DNA, 23 bp, Homo sapiens
ctctgtgtctaagattctagatc

SEQ ID NO: 6157633 - DNA, 14 bp, Homo sapiens
ctctgtgtctggca

SEQ ID NO: 6157634 - DNA, 15 bp, Homo sapiens
ctctgtgtctggcag

SEQ ID NO: 6157635 - DNA, 17 bp, Homo sapiens
ctctgtgtctggcaggc

SEQ ID NO: 6157636 - DNA, 15 bp, Homo sapiens
ctctgtgtgagagag

SEQ ID NO: 6157637 - DNA, 15 bp, Homo sapiens
ctctgtgtgcacaaa

SEQ ID NO: 6157638 - DNA, 13 bp, Homo sapiens
ctctgtgtggcaa

SEQ ID NO: 6157639 - DNA, 19 bp, Homo sapiens
ctctgtgtggcaaacattt

SEQ ID NO: 6157640 - DNA, 20 bp, Homo sapiens
ctctgtgtggctgtgcaatt

SEQ ID NO: 6157641 - DNA, 21 bp, Homo sapiens
ctctgtgtggctgtgcaattt

SEQ ID NO: 6157642 - DNA, 21 bp, Homo sapiens
ctctgtgtgggaaaatggcag

SEQ ID NO: 6157643 - DNA, 16 bp, Homo sapiens
ctctgtgtgtgtatga

SEQ ID NO: 6157644 - DNA, 22 bp, Homo sapiens
ctctgtgttcccagaggcaggc

SEQ ID NO: 6157645 - DNA, 20 bp, Homo sapiens
ctctgtgttgtgaatgtcat

SEQ ID NO: 6157646 - DNA, 23 bp, Homo sapiens
ctgggtcaaaagagccctggctc

SEQ ID NO: 6157647 - DNA, 22 bp, Homo sapiens
ctgggtcaaagtggtacaggaa

SEQ ID NO: 6157648 - DNA, 19 bp, Homo sapiens
ctgggtcacaggaaggaaa

SEQ ID NO: 6157649 - DNA, 22 bp, Homo sapiens
ctgggtcaccttcctgggcagc

SEQ ID NO: 6157650 - DNA, 18 bp, Homo sapiens
ctgggtcacgctcaagga

SEQ ID NO: 6157651 - DNA, 19 bp, Homo sapiens
ctgggtcagacccatctct

SEQ ID NO: 6157652 - DNA, 11 bp, Homo sapiens
ctgggtcaggg

SEQ ID NO: 6157653 - DNA, 18 bp, Homo sapiens
ctgggtcatgcactgagg

SEQ ID NO: 6157654 - DNA, 15 bp, Homo sapiens
ctgggtccaaataaa

SEQ ID NO: 6157655 - DNA, 20 bp, Homo sapiens
ctgggtccaaataaaaacta

SEQ ID NO: 6157656 - DNA, 23 bp, Homo sapiens
ctgggtccaattgtggcacttgg

SEQ ID NO: 6157657 - DNA, 13 bp, Homo sapiens
ctgggtccagaag

SEQ ID NO: 6157658 - DNA, 13 bp, Homo sapiens
ctgggtccatatc

SEQ ID NO: 6157659 - DNA, 16 bp, Homo sapiens
ctgggtccatcctggt

SEQ ID NO: 6157660 - DNA, 16 bp, Homo sapiens
ctgggtcccagcctgg

SEQ ID NO: 6157661 - DNA, 15 bp, Homo sapiens
ctgggtcccagggct

SEQ ID NO: 6157662 - DNA, 18 bp, Homo sapiens
ctgggtcccagggctggc

SEQ ID NO: 6157663 - DNA, 16 bp, Homo sapiens
ctgggtccccagccct

SEQ ID NO: 6157664 - DNA, 13 bp, Homo sapiens
ctgggtccccctc

SEQ ID NO: 6157665 - DNA, 16 bp, Homo sapiens
ctgggtccccctcctg

SEQ ID NO: 6157666 - DNA, 19 bp, Homo sapiens
ctgggtccccctcctgcac

SEQ ID NO: 6157667 - DNA, 20 bp, Homo sapiens
ctgggtccccctcctgcacg

SEQ ID NO: 6157668 - DNA, 13 bp, Homo sapiens
ctgggtccctgct

SEQ ID NO: 6157669 - DNA, 17 bp, Homo sapiens
ctgggtccctgctcccc

SEQ ID NO: 6157670 - DNA, 18 bp, Homo sapiens
ctgggtccgtctgagtgg

SEQ ID NO: 6157671 - DNA, 21 bp, Homo sapiens
ctgggtcctaattaccagtct

SEQ ID NO: 6157672 - DNA, 21 bp, Homo sapiens
ctgggtcctcggccctgtagc

SEQ ID NO: 6157673 - DNA, 23 bp, Homo sapiens
ctgggtcctcggccctgtagccc

SEQ ID NO: 6157674 - DNA, 16 bp, Homo sapiens
ctgggtcctctgcagt

SEQ ID NO: 6157675 - DNA, 13 bp, Homo sapiens
ctgggtcctgcct

SEQ ID NO: 6157676 - DNA, 18 bp, Homo sapiens
ctgggtcctgcctgcagt

SEQ ID NO: 6157677 - DNA, 14 bp, Homo sapiens
ctgggtccttcctg

SEQ ID NO: 6157678 - DNA, 23 bp, Homo sapiens
ctgggtccttgcacccctcactc

SEQ ID NO: 6157679 - DNA, 14 bp, Homo sapiens
ctgggtccttggct

SEQ ID NO: 6157680 - DNA, 22 bp, Homo sapiens
ctgggtcgcccctcctcgggcg

SEQ ID NO: 6157681 - DNA, 15 bp, Homo sapiens
ctgggtcgccctgga

SEQ ID NO: 6157682 - DNA, 17 bp, Homo sapiens
ctgggtcgccctggact

SEQ ID NO: 6157683 - DNA, 18 bp, Homo sapiens
ctgggtcgccctggactg

SEQ ID NO: 6157684 - DNA, 22 bp, Homo sapiens
ctgggtcgccctggactgtgtg

SEQ ID NO: 6157685 - DNA, 17 bp, Homo sapiens
ctgggtcggccctgccc

SEQ ID NO: 6157686 - DNA, 23 bp, Homo sapiens
ctgggtcgggacagaccagcagc

SEQ ID NO: 6157687 - DNA, 17 bp, Homo sapiens
ctgggtctaccaggaac

SEQ ID NO: 6157688 - DNA, 19 bp, Homo sapiens
ctgggtctactcaaacact

SEQ ID NO: 6157689 - DNA, 23 bp, Homo sapiens
ctgggtctatgtaggcccctggt

SEQ ID NO: 6157690 - DNA, 19 bp, Homo sapiens
ctgggtctcaccggctctc

SEQ ID NO: 6157691 - DNA, 22 bp, Homo sapiens
ctgggtctccctttccatggca

SEQ ID NO: 6157692 - DNA, 22 bp, Homo sapiens
ctgggtctcgctttgttgccca

SEQ ID NO: 6157693 - DNA, 13 bp, Homo sapiens
ctgggtctctaat

SEQ ID NO: 6157694 - DNA, 14 bp, Homo sapiens
ctgggtctgaggcc

SEQ ID NO: 6157695 - DNA, 17 bp, Homo sapiens
ctgggtctgaggcccct

SEQ ID NO: 6157696 - DNA, 17 bp, Homo sapiens
ctgggtctgattttctc

SEQ ID NO: 6157697 - DNA, 18 bp, Homo sapiens
ctgggtctggatgggagg

SEQ ID NO: 6157698 - DNA, 15 bp, Homo sapiens
ctgggtctggccagg

SEQ ID NO: 6157699 - DNA, 18 bp, Homo sapiens
ctgggtctggccagggct

SEQ ID NO: 6157700 - DNA, 14 bp, Homo sapiens
ctgggtctgggttt

SEQ ID NO: 6157701 - DNA, 16 bp, Homo sapiens
ctgggtcttggccatg

SEQ ID NO: 6157702 - DNA, 19 bp, Homo sapiens
ctgggtgacagagcaagac

SEQ ID NO: 6157703 - DNA, 19 bp, Homo sapiens
ctgggtgacagagtgagtg

SEQ ID NO: 6157704 - DNA, 20 bp, Homo sapiens
ctgggtgaccgactacccca

SEQ ID NO: 6157705 - DNA, 19 bp, Homo sapiens
ctgggtgagaatcctgcct

SEQ ID NO: 6157706 - DNA, 20 bp, Homo sapiens
ctgggtgagaatcctgcctc

SEQ ID NO: 6157707 - DNA, 22 bp, Homo sapiens
ctgggtgagaatcctgcctctc

SEQ ID NO: 6157708 - DNA, 14 bp, Homo sapiens
ctgggtgagaccca

SEQ ID NO: 6157709 - DNA, 16 bp, Homo sapiens
ctgggtgagccaagga

SEQ ID NO: 6157710 - DNA, 23 bp, Homo sapiens
ctgggtgagctgagatggagtcc

SEQ ID NO: 6157711 - DNA, 15 bp, Homo sapiens
ctgggtgagtggctg

SEQ ID NO: 6157712 - DNA, 13 bp, Homo sapiens
ctgggtgatctgc

SEQ ID NO: 6157713 - DNA, 20 bp, Homo sapiens
ctgggtgatggaaactgcca

SEQ ID NO: 6157714 - DNA, 13 bp, Homo sapiens
ctgggtgatttct

SEQ ID NO: 6157715 - DNA, 14 bp, Homo sapiens
ctgggtgcagctgg

SEQ ID NO: 6157716 - DNA, 14 bp, Homo sapiens
ctgggtgcaggagc

SEQ ID NO: 6157717 - DNA, 15 bp, Homo sapiens
ctgggtgcccacagc

SEQ ID NO: 6157718 - DNA, 23 bp, Homo sapiens
ctgggtgcccacagcccgcatgc

SEQ ID NO: 6157719 - DNA, 12 bp, Homo sapiens
ctgggtgccctg

SEQ ID NO: 6157720 - DNA, 13 bp, Homo sapiens
ctgggtgccctga

SEQ ID NO: 6157721 - DNA, 16 bp, Homo sapiens
ctgggtgccctgaaag

SEQ ID NO: 6157722 - DNA, 17 bp, Homo sapiens
ctgggtgccctgaaagg

SEQ ID NO: 6157723 - DNA, 21 bp, Homo sapiens
ctgggtgccgggctgcacaga

SEQ ID NO: 6157724 - DNA, 14 bp, Homo sapiens
ctgggtgcctccca

SEQ ID NO: 6157725 - DNA, 14 bp, Homo sapiens
ctgggtgcctcctc

SEQ ID NO: 6157726 - DNA, 19 bp, Homo sapiens
ctgggtgcctgcagcgcct

SEQ ID NO: 6157727 - DNA, 13 bp, Homo sapiens
ctgggtgcgagtg

SEQ ID NO: 6157728 - DNA, 14 bp, Homo sapiens
ctgggtgctactgg

SEQ ID NO: 6157729 - DNA, 14 bp, Homo sapiens
ctgggtgctcaggg

SEQ ID NO: 6157730 - DNA, 15 bp, Homo sapiens
ctgggtgctccctac

SEQ ID NO: 6157731 - DNA, 16 bp, Homo sapiens
ctgggtgctgatcctt

SEQ ID NO: 6157732 - DNA, 23 bp, Homo sapiens
ctgggtggaactctcctgctcct

SEQ ID NO: 6157733 - DNA, 20 bp, Homo sapiens
ctgggtggaagtgcccagcc

SEQ ID NO: 6157734 - DNA, 23 bp, Homo sapiens
ctgggtggacatggcccctgtga

SEQ ID NO: 6157735 - DNA, 13 bp, Homo sapiens
ctgggtggagcag

SEQ ID NO: 6157736 - DNA, 18 bp, Homo sapiens
ctgggtggagcaggactc

SEQ ID NO: 6157737 - DNA, 20 bp, Homo sapiens
ctgggtggagcaggactccc

SEQ ID NO: 6157738 - DNA, 17 bp, Homo sapiens
ctgggtggatgtgagca

SEQ ID NO: 6157739 - DNA, 21 bp, Homo sapiens
ctgggtggatgtgagcagaag

SEQ ID NO: 6157740 - DNA, 16 bp, Homo sapiens
ctgggtggcacaccac

SEQ ID NO: 6157741 - DNA, 18 bp, Homo sapiens
ctgggtggcaccagcagc

SEQ ID NO: 6157742 - DNA, 22 bp, Homo sapiens
ctgggtggcaccagcagcctgg

SEQ ID NO: 6157743 - DNA, 14 bp, Homo sapiens
ctgggtggcactgc

SEQ ID NO: 6157744 - DNA, 14 bp, Homo sapiens
ctgggtggcagggg

SEQ ID NO: 6157745 - DNA, 12 bp, Homo sapiens
ctgggtggccca

SEQ ID NO: 6157746 - DNA, 15 bp, Homo sapiens
ctgggtggcccatcc

SEQ ID NO: 6157747 - DNA, 17 bp, Homo sapiens
ctgggtggccggccctg

SEQ ID NO: 6157748 - DNA, 19 bp, Homo sapiens
ctgggtggccggccctgcc

SEQ ID NO: 6157749 - DNA, 21 bp, Homo sapiens
ctgggtggccggccctgcccc

SEQ ID NO: 6157750 - DNA, 23 bp, Homo sapiens
ctgggtggccggccctgcccccc

SEQ ID NO: 6157751 - DNA, 13 bp, Homo sapiens
ctgggtggcctcg

SEQ ID NO: 6157752 - DNA, 17 bp, Homo sapiens
ctgggtggctactctgt

SEQ ID NO: 6157753 - DNA, 19 bp, Homo sapiens
ctgggtggctactctgtgc

SEQ ID NO: 6157754 - DNA, 20 bp, Homo sapiens
ctgggtggctactctgtgcc

SEQ ID NO: 6157755 - DNA, 22 bp, Homo sapiens
ctgggtggctactctgtgccag

SEQ ID NO: 6157756 - DNA, 17 bp, Homo sapiens
ctgggtggctcactcag

SEQ ID NO: 6157757 - DNA, 12 bp, Homo sapiens
ctgggtggctcc

SEQ ID NO: 6157758 - DNA, 13 bp, Homo sapiens
ctgggtggctcct

SEQ ID NO: 6157759 - DNA, 24 bp, Homo sapiens
ctgggtggctcctgccactgacct

SEQ ID NO: 6157760 - DNA, 14 bp, Homo sapiens
ctgggtgggacagc

SEQ ID NO: 6157761 - DNA, 15 bp, Homo sapiens
ctgggtgggacagcc

SEQ ID NO: 6157762 - DNA, 14 bp, Homo sapiens
ctgggtgggcccag

SEQ ID NO: 6157763 - DNA, 18 bp, Homo sapiens
ctgggtgggcggggcact

SEQ ID NO: 6157764 - DNA, 22 bp, Homo sapiens
ctgggtgggcgtggcctgcata

SEQ ID NO: 6157765 - DNA, 21 bp, Homo sapiens
ctgggtggggcagcacacctc

SEQ ID NO: 6157766 - DNA, 14 bp, Homo sapiens
ctgggtggggccca

SEQ ID NO: 6157767 - DNA, 15 bp, Homo sapiens
ctgggtggggcccag

SEQ ID NO: 6157768 - DNA, 20 bp, Homo sapiens
ctgggtggggcccaggcccg

SEQ ID NO: 6157769 - DNA, 17 bp, Homo sapiens
ctgggtggggctgctcc

SEQ ID NO: 6157770 - DNA, 20 bp, Homo sapiens
ctgggtggggctgctcctcc

SEQ ID NO: 6157771 - DNA, 18 bp, Homo sapiens
ctgggtgggtggtgggga

SEQ ID NO: 6157772 - DNA, 19 bp, Homo sapiens
ctgggtgggtggtggggag

SEQ ID NO: 6157773 - DNA, 20 bp, Homo sapiens
ctgggtgggtggtggggagg

SEQ ID NO: 6157774 - DNA, 22 bp, Homo sapiens
ctgggtgggtggtggggagggg

SEQ ID NO: 6157775 - DNA, 12 bp, Homo sapiens
ctgggtggtacc

SEQ ID NO: 6157776 - DNA, 20 bp, Homo sapiens
ctgggtggtattctggtagg

SEQ ID NO: 6157777 - DNA, 13 bp, Homo sapiens
ctgggtggtcagc

SEQ ID NO: 6157778 - DNA, 18 bp, Homo sapiens
ctgggtggtttggttttt

SEQ ID NO: 6157779 - DNA, 20 bp, Homo sapiens
ctgggtggttttttccccct

SEQ ID NO: 6157780 - DNA, 21 bp, Homo sapiens
ctgggtgtaaaacctggagat

SEQ ID NO: 6157781 - DNA, 16 bp, Homo sapiens
ctgggtgtaaacacat

SEQ ID NO: 6157782 - DNA, 19 bp, Homo sapiens
ctgggtgtattaggactgg

SEQ ID NO: 6157783 - DNA, 19 bp, Homo sapiens
ctgggtgtcaagtgcctgc

SEQ ID NO: 6157784 - DNA, 22 bp, Homo sapiens
ctgggtgtcaagtgcctgcacc

SEQ ID NO: 6157785 - DNA, 19 bp, Homo sapiens
ctgggtgtccgccatccag

SEQ ID NO: 6157786 - DNA, 21 bp, Homo sapiens
ctgggtgtccgccatccaggg

SEQ ID NO: 6157787 - DNA, 21 bp, Homo sapiens
ctgggtgtgacctgacacctg

SEQ ID NO: 6157788 - DNA, 22 bp, Homo sapiens
ctgggtgtgacctgacacctgc

SEQ ID NO: 6157789 - DNA, 18 bp, Homo sapiens
ctgggtgtgactgattcc

SEQ ID NO: 6157790 - DNA, 18 bp, Homo sapiens
ctgggtgtgctccaggct

SEQ ID NO: 6157791 - DNA, 22 bp, Homo sapiens
ctgggtgtggccccgcagtgcc

SEQ ID NO: 6157792 - DNA, 13 bp, Homo sapiens
ctgggtgtggcct

SEQ ID NO: 6157793 - DNA, 15 bp, Homo sapiens
ctgggtgtggcgcag

SEQ ID NO: 6157794 - DNA, 15 bp, Homo sapiens
ctgggtgttgaccac

SEQ ID NO: 6157795 - DNA, 20 bp, Homo sapiens
ctgggtgttttcaaatgtca

SEQ ID NO: 6157796 - DNA, 19 bp, Homo sapiens
ctgggtgttttcagaaaga

SEQ ID NO: 6157797 - DNA, 21 bp, Homo sapiens
ctgggttaaatattttgctaa

SEQ ID NO: 6157798 - DNA, 14 bp, Homo sapiens
ctgggttaacaaat

SEQ ID NO: 6157799 - DNA, 21 bp, Homo sapiens
ctgggttaacagtaaatatac

SEQ ID NO: 6157800 - DNA, 23 bp, Homo sapiens
ctgggttaatggctagtactgta

SEQ ID NO: 6157801 - DNA, 18 bp, Homo sapiens
ctgggttaattcatttgg

SEQ ID NO: 6157802 - DNA, 16 bp, Homo sapiens
ctgggttagactgcca

SEQ ID NO: 6157803 - DNA, 18 bp, Homo sapiens
ctgggttagactgccagc

SEQ ID NO: 6157804 - DNA, 21 bp, Homo sapiens
ctgggttagactgccagctct

SEQ ID NO: 6157805 - DNA, 14 bp, Homo sapiens
ctgggttaggtggc

SEQ ID NO: 6157806 - DNA, 20 bp, Homo sapiens
ctgggttatttttgtccctg

SEQ ID NO: 6157807 - DNA, 21 bp, Homo sapiens
ctgggttatttttgtccctgc

SEQ ID NO: 6157808 - DNA, 23 bp, Homo sapiens
ctgggttatttttgtccctgctc

SEQ ID NO: 6157809 - DNA, 22 bp, Homo sapiens
ctgggttcaagcaatcctccta

SEQ ID NO: 6157810 - DNA, 21 bp, Homo sapiens
ctgggttcacgtaatcctcct

SEQ ID NO: 6157811 - DNA, 18 bp, Homo sapiens
ctgggttcactgcaacct

SEQ ID NO: 6157812 - DNA, 20 bp, Homo sapiens
ctgggttcactgcaacctcc

SEQ ID NO: 6157813 - DNA, 16 bp, Homo sapiens
ctgggttcatttgtga

SEQ ID NO: 6157814 - DNA, 17 bp, Homo sapiens
ctgggttccaatcctgg

SEQ ID NO: 6157815 - DNA, 21 bp, Homo sapiens
ctgggttcccactcccggcct

SEQ ID NO: 6157816 - DNA, 14 bp, Homo sapiens
ctgggttccccact

SEQ ID NO: 6157817 - DNA, 20 bp, Homo sapiens
ctgggttccctttccttcca

SEQ ID NO: 6157818 - DNA, 21 bp, Homo sapiens
ctgggttccctttccttccat

SEQ ID NO: 6157819 - DNA, 14 bp, Homo sapiens
ctgggttccgggag

SEQ ID NO: 6157820 - DNA, 15 bp, Homo sapiens
ctgggttccgggagg

SEQ ID NO: 6157821 - DNA, 18 bp, Homo sapiens
ctgggttcgttggggaca

SEQ ID NO: 6157822 - DNA, 16 bp, Homo sapiens
ctgggttctacccagg

SEQ ID NO: 6157823 - DNA, 14 bp, Homo sapiens
ctctgtgtttaaaa

SEQ ID NO: 6157824 - DNA, 19 bp, Homo sapiens
ctctgtgtttgttcctaca

SEQ ID NO: 6157825 - DNA, 13 bp, Homo sapiens
ctctgtgttttgt

SEQ ID NO: 6157826 - DNA, 15 bp, Homo sapiens
ctctgttaacatcta

SEQ ID NO: 6157827 - DNA, 19 bp, Homo sapiens
ctctgttaacatctagcct

SEQ ID NO: 6157828 - DNA, 16 bp, Homo sapiens
ctctgttaaggttgaa

SEQ ID NO: 6157829 - DNA, 20 bp, Homo sapiens
ctctgttaataatctcacat

SEQ ID NO: 6157830 - DNA, 13 bp, Homo sapiens
ctctgttaatgtg

SEQ ID NO: 6157831 - DNA, 16 bp, Homo sapiens
ctctgttacatcctgc

SEQ ID NO: 6157832 - DNA, 22 bp, Homo sapiens
ctctgttacccagggtggagtg

SEQ ID NO: 6157833 - DNA, 21 bp, Homo sapiens
ctctgttacccgcagatcctg

SEQ ID NO: 6157834 - DNA, 17 bp, Homo sapiens
ctctgttaggtccattt

SEQ ID NO: 6157835 - DNA, 21 bp, Homo sapiens
ctctgttaggtccattttcta

SEQ ID NO: 6157836 - DNA, 19 bp, Homo sapiens
ctctgttatcagctgggca

SEQ ID NO: 6157837 - DNA, 21 bp, Homo sapiens
ctctgttatgcaagcacaaat

SEQ ID NO: 6157838 - DNA, 19 bp, Homo sapiens
ctctgttatgtactgtact

SEQ ID NO: 6157839 - DNA, 18 bp, Homo sapiens
ctctgttcacagtctctg

SEQ ID NO: 6157840 - DNA, 14 bp, Homo sapiens
ctctgttcagtaac

SEQ ID NO: 6157841 - DNA, 14 bp, Homo sapiens
ctctgttcagtgta

SEQ ID NO: 6157842 - DNA, 15 bp, Homo sapiens
ctctgttcagtgtaa

SEQ ID NO: 6157843 - DNA, 15 bp, Homo sapiens
ctctgttcattcctc

SEQ ID NO: 6157844 - DNA, 17 bp, Homo sapiens
ctctgttcattcctcca

SEQ ID NO: 6157845 - DNA, 13 bp, Homo sapiens
ctctgttccaagt

SEQ ID NO: 6157846 - DNA, 23 bp, Homo sapiens
ctctgttccatgcaactggagtt

SEQ ID NO: 6157847 - DNA, 16 bp, Homo sapiens
ctctgttccccaccca

SEQ ID NO: 6157848 - DNA, 19 bp, Homo sapiens
ctctgttcccttcctcacc

SEQ ID NO: 6157849 - DNA, 14 bp, Homo sapiens
ctctgttcctggct

SEQ ID NO: 6157850 - DNA, 22 bp, Homo sapiens
ctctgttcctggctcagcctca

SEQ ID NO: 6157851 - DNA, 15 bp, Homo sapiens
ctctgttccttctct

SEQ ID NO: 6157852 - DNA, 22 bp, Homo sapiens
ctctgttcctttctctgggctt

SEQ ID NO: 6157853 - DNA, 15 bp, Homo sapiens
ctctgttctctcccc

SEQ ID NO: 6157854 - DNA, 24 bp, Homo sapiens
ctctgttctctcccctcacatcct

SEQ ID NO: 6157855 - DNA, 14 bp, Homo sapiens
ctctgttctcttgc

SEQ ID NO: 6157856 - DNA, 16 bp, Homo sapiens
ctctgttctcttgctt

SEQ ID NO: 6157857 - DNA, 19 bp, Homo sapiens
ctctgttctgcacacagca

SEQ ID NO: 6157858 - DNA, 22 bp, Homo sapiens
ctctgttctgctcccagatgcc

SEQ ID NO: 6157859 - DNA, 17 bp, Homo sapiens
ctctgttctggtggccc

SEQ ID NO: 6157860 - DNA, 19 bp, Homo sapiens
ctctgttcttcctcagcca

SEQ ID NO: 6157861 - DNA, 14 bp, Homo sapiens
ctctgttgaccagg

SEQ ID NO: 6157862 - DNA, 17 bp, Homo sapiens
ctctgttgaccaggctg

SEQ ID NO: 6157863 - DNA, 22 bp, Homo sapiens
ctctgttgaccaggctggagtg

SEQ ID NO: 6157864 - DNA, 16 bp, Homo sapiens
ctctgttgccagactg

SEQ ID NO: 6157865 - DNA, 17 bp, Homo sapiens
ctctgttgcccaagctg

SEQ ID NO: 6157866 - DNA, 17 bp, Homo sapiens
ctctgttgcccaggctg

SEQ ID NO: 6157867 - DNA, 20 bp, Homo sapiens
ctctgttgcccaggctggag

SEQ ID NO: 6157868 - DNA, 15 bp, Homo sapiens
ctctgttgcctcctc

SEQ ID NO: 6157869 - DNA, 19 bp, Homo sapiens
ctctgttgcctcctctctc

SEQ ID NO: 6157870 - DNA, 23 bp, Homo sapiens
ctctgttgcctcctctctccctg

SEQ ID NO: 6157871 - DNA, 21 bp, Homo sapiens
ctctgttgctggtcttctcag

SEQ ID NO: 6157872 - DNA, 18 bp, Homo sapiens
ctctgttggtccactgtg

SEQ ID NO: 6157873 - DNA, 21 bp, Homo sapiens
ctctgttggtctgccttctgc

SEQ ID NO: 6157874 - DNA, 23 bp, Homo sapiens
ctctgttggtctgccttctgctg

SEQ ID NO: 6157875 - DNA, 20 bp, Homo sapiens
ctctgttgtagaaaaactat

SEQ ID NO: 6157876 - DNA, 21 bp, Homo sapiens
ctctgttgtcctccccttggg

SEQ ID NO: 6157877 - DNA, 22 bp, Homo sapiens
ctctgttgtgttcgttcttgtt

SEQ ID NO: 6157878 - DNA, 19 bp, Homo sapiens
ctctgttgtttggttcagg

SEQ ID NO: 6157879 - DNA, 21 bp, Homo sapiens
ctctgttgtttggttcaggga

SEQ ID NO: 6157880 - DNA, 15 bp, Homo sapiens
ctctgtttaccctcc

SEQ ID NO: 6157881 - DNA, 13 bp, Homo sapiens
ctctgtttcctga

SEQ ID NO: 6157882 - DNA, 15 bp, Homo sapiens
ctctgtttcttcctt

SEQ ID NO: 6157883 - DNA, 16 bp, Homo sapiens
ctctgtttgctcaccc

SEQ ID NO: 6157884 - DNA, 24 bp, Homo sapiens
ctctgtttgctcacccaggacctc

SEQ ID NO: 6157885 - DNA, 13 bp, Homo sapiens
ctctgtttgcttg

SEQ ID NO: 6157886 - DNA, 18 bp, Homo sapiens
ctctgtttgtgggactgg

SEQ ID NO: 6157887 - DNA, 20 bp, Homo sapiens
ctctgtttgtttggctgtcc

SEQ ID NO: 6157888 - DNA, 22 bp, Homo sapiens
ctctgttttacaagttggagtc

SEQ ID NO: 6157889 - DNA, 14 bp, Homo sapiens
ctctgttttgcttt

SEQ ID NO: 6157890 - DNA, 13 bp, Homo sapiens
ctctgttttgtaa

SEQ ID NO: 6157891 - DNA, 16 bp, Homo sapiens
ctcttaaaaaataaaa

SEQ ID NO: 6157892 - DNA, 20 bp, Homo sapiens
ctcttaaagaaaacccaccc

SEQ ID NO: 6157893 - DNA, 19 bp, Homo sapiens
ctcttaaatctcttaaact

SEQ ID NO: 6157894 - DNA, 22 bp, Homo sapiens
ctcttaaatctcttaaactctc

SEQ ID NO: 6157895 - DNA, 21 bp, Homo sapiens
ctcttaaatgaagtgcccact

SEQ ID NO: 6157896 - DNA, 14 bp, Homo sapiens
ctcttaaattatat

SEQ ID NO: 6157897 - DNA, 17 bp, Homo sapiens
ctcttaactgaagaaag

SEQ ID NO: 6157898 - DNA, 14 bp, Homo sapiens
ctcttaagacacta

SEQ ID NO: 6157899 - DNA, 12 bp, Homo sapiens
ctcttaagccat

SEQ ID NO: 6157900 - DNA, 15 bp, Homo sapiens
ctcttaagctgccca

SEQ ID NO: 6157901 - DNA, 16 bp, Homo sapiens
ctcttaagctgcccaa

SEQ ID NO: 6157902 - DNA, 21 bp, Homo sapiens
ctcttaagtcctaaaagttct

SEQ ID NO: 6157903 - DNA, 14 bp, Homo sapiens
ctcttaagtttctc

SEQ ID NO: 6157904 - DNA, 22 bp, Homo sapiens
ctcttaagtttctcagctccca

SEQ ID NO: 6157905 - DNA, 18 bp, Homo sapiens
ctcttaatattgagaatc

SEQ ID NO: 6157906 - DNA, 20 bp, Homo sapiens
ctcttaatattgagaatcag

SEQ ID NO: 6157907 - DNA, 14 bp, Homo sapiens
ctcttaatctgtgt

SEQ ID NO: 6157908 - DNA, 17 bp, Homo sapiens
ctcttaatgatgttatc

SEQ ID NO: 6157909 - DNA, 21 bp, Homo sapiens
ctcttaatgccacggcagcca

SEQ ID NO: 6157910 - DNA, 21 bp, Homo sapiens
ctcttaatgtctcaaaataaa

SEQ ID NO: 6157911 - DNA, 13 bp, Homo sapiens
ctcttaatgttgc

SEQ ID NO: 6157912 - DNA, 20 bp, Homo sapiens
ctcttaattttaaagaccca

SEQ ID NO: 6157913 - DNA, 13 bp, Homo sapiens
ctcttacatctcc

SEQ ID NO: 6157914 - DNA, 13 bp, Homo sapiens
ctcttacatgtat

SEQ ID NO: 6157915 - DNA, 18 bp, Homo sapiens
ctcttaccaaaacagatg

SEQ ID NO: 6157916 - DNA, 18 bp, Homo sapiens
ctcttaccgtagcctccg

SEQ ID NO: 6157917 - DNA, 21 bp, Homo sapiens
ctcttacctgttatttatcaa

SEQ ID NO: 6157918 - DNA, 18 bp, Homo sapiens
ctcttacgcccaaccctt

SEQ ID NO: 6157919 - DNA, 18 bp, Homo sapiens
ctcttacggctatctagt

SEQ ID NO: 6157920 - DNA, 22 bp, Homo sapiens
ctcttacgtggagagtgcactg

SEQ ID NO: 6157921 - DNA, 19 bp, Homo sapiens
ctcttactaaccaccattt

SEQ ID NO: 6157922 - DNA, 14 bp, Homo sapiens
ctcttactctttcc

SEQ ID NO: 6157923 - DNA, 15 bp, Homo sapiens
ctcttactctttcct

SEQ ID NO: 6157924 - DNA, 18 bp, Homo sapiens
ctcttacttcccccaccc

SEQ ID NO: 6157925 - DNA, 20 bp, Homo sapiens
ctcttacttcccccaccctg

SEQ ID NO: 6157926 - DNA, 16 bp, Homo sapiens
ctcttacttgatagac

SEQ ID NO: 6157927 - DNA, 14 bp, Homo sapiens
ctcttacttgccaa

SEQ ID NO: 6157928 - DNA, 14 bp, Homo sapiens
ctcttactttcagt

SEQ ID NO: 6157929 - DNA, 23 bp, Homo sapiens
ctcttactttcctttccccagcc

SEQ ID NO: 6157930 - DNA, 14 bp, Homo sapiens
ctcttactttgctt

SEQ ID NO: 6157931 - DNA, 15 bp, Homo sapiens
ctcttactttttgta

SEQ ID NO: 6157932 - DNA, 19 bp, Homo sapiens
ctcttactttttgtaaatg

SEQ ID NO: 6157933 - DNA, 21 bp, Homo sapiens
ctcttactttttgtaaatgct

SEQ ID NO: 6157934 - DNA, 13 bp, Homo sapiens
ctcttagaaaaac

SEQ ID NO: 6157935 - DNA, 13 bp, Homo sapiens
ctcttagaaaata

SEQ ID NO: 6157936 - DNA, 21 bp, Homo sapiens
ctcttagaaaataaatacaag

SEQ ID NO: 6157937 - DNA, 13 bp, Homo sapiens
ctcttagaaatac

SEQ ID NO: 6157938 - DNA, 15 bp, Homo sapiens
ctcttagaacattgt

SEQ ID NO: 6157939 - DNA, 15 bp, Homo sapiens
ctcttagaagccatg

SEQ ID NO: 6157940 - DNA, 21 bp, Homo sapiens
ctcttagactcgcctatctta

SEQ ID NO: 6157941 - DNA, 15 bp, Homo sapiens
ctcttagagaataag

SEQ ID NO: 6157942 - DNA, 19 bp, Homo sapiens
ctcttagagattttcattt

SEQ ID NO: 6157943 - DNA, 15 bp, Homo sapiens
ctcttagatgcagtt

SEQ ID NO: 6157944 - DNA, 16 bp, Homo sapiens
ctcttagattgggcca

SEQ ID NO: 6157945 - DNA, 21 bp, Homo sapiens
ctcttagcattttaattagat

SEQ ID NO: 6157946 - DNA, 16 bp, Homo sapiens
ctcttagctactgtat

SEQ ID NO: 6157947 - DNA, 13 bp, Homo sapiens
ctcttagctatgt

SEQ ID NO: 6157948 - DNA, 17 bp, Homo sapiens
ctcttagctcccctcca

SEQ ID NO: 6157949 - DNA, 18 bp, Homo sapiens
ctcttagctcccctccaa

SEQ ID NO: 6157950 - DNA, 17 bp, Homo sapiens
ctcttagcttttctgca

SEQ ID NO: 6157951 - DNA, 18 bp, Homo sapiens
ctcttaggatatttgagt

SEQ ID NO: 6157952 - DNA, 17 bp, Homo sapiens
ctcttaggcactttggg

SEQ ID NO: 6157953 - DNA, 14 bp, Homo sapiens
ctcttagtccacaa

SEQ ID NO: 6157954 - DNA, 22 bp, Homo sapiens
ctcttagtccctcttaggagta

SEQ ID NO: 6157955 - DNA, 15 bp, Homo sapiens
ctcttagtgcccgcc

SEQ ID NO: 6157956 - DNA, 20 bp, Homo sapiens
ctcttagtgcccgcctagga

SEQ ID NO: 6157957 - DNA, 18 bp, Homo sapiens
ctcttataacttctgaag

SEQ ID NO: 6157958 - DNA, 22 bp, Homo sapiens
ctcttatagaatatttattacc

SEQ ID NO: 6157959 - DNA, 18 bp, Homo sapiens
ctcttatatctatatttt

SEQ ID NO: 6157960 - DNA, 17 bp, Homo sapiens
ctcttatatttttctgg

SEQ ID NO: 6157961 - DNA, 17 bp, Homo sapiens
ctcttatcctctctctc

SEQ ID NO: 6157962 - DNA, 22 bp, Homo sapiens
ctcttatcctctctctcttcta

SEQ ID NO: 6157963 - DNA, 23 bp, Homo sapiens
ctcttatctcagtcatgcataaa

SEQ ID NO: 6157964 - DNA, 18 bp, Homo sapiens
ctcttatctcatcctttc

SEQ ID NO: 6157965 - DNA, 22 bp, Homo sapiens
ctcttatctcatcctttcctct

SEQ ID NO: 6157966 - DNA, 12 bp, Homo sapiens
ctcttatgaaat

SEQ ID NO: 6157967 - DNA, 14 bp, Homo sapiens
ctcttatgaaatgg

SEQ ID NO: 6157968 - DNA, 13 bp, Homo sapiens
ctcttatgctgta

SEQ ID NO: 6157969 - DNA, 21 bp, Homo sapiens
ctcttatggatgtccccagca

SEQ ID NO: 6157970 - DNA, 15 bp, Homo sapiens
ctcttatgggctggg

SEQ ID NO: 6157971 - DNA, 20 bp, Homo sapiens
ctcttatgtacctcttttag

SEQ ID NO: 6157972 - DNA, 18 bp, Homo sapiens
ctcttattccaggagaag

SEQ ID NO: 6157973 - DNA, 14 bp, Homo sapiens
ctcttattctaata

SEQ ID NO: 6157974 - DNA, 23 bp, Homo sapiens
ctcttattctttacaaaatgaat

SEQ ID NO: 6157975 - DNA, 14 bp, Homo sapiens
ctcttattgcctca

SEQ ID NO: 6157976 - DNA, 20 bp, Homo sapiens
ctcttattgcctcacttcag

SEQ ID NO: 6157977 - DNA, 22 bp, Homo sapiens
ctcttattgcctcacttcaggt

SEQ ID NO: 6157978 - DNA, 15 bp, Homo sapiens
ctcttattgttcttt

SEQ ID NO: 6157979 - DNA, 22 bp, Homo sapiens
ctcttatttatagaatttaata

SEQ ID NO: 6157980 - DNA, 14 bp, Homo sapiens
ctcttatttctgaa

SEQ ID NO: 6157981 - DNA, 19 bp, Homo sapiens
ctcttatttttgtaccata

SEQ ID NO: 6157982 - DNA, 21 bp, Homo sapiens
ctcttattttttaaaaaattt

SEQ ID NO: 6157983 - DNA, 15 bp, Homo sapiens
ctcttcaaatgcctg

SEQ ID NO: 6157984 - DNA, 17 bp, Homo sapiens
ctcttcaaattagaaga

SEQ ID NO: 6157985 - DNA, 17 bp, Homo sapiens
ctcttcaagcatcctca

SEQ ID NO: 6157986 - DNA, 14 bp, Homo sapiens
ctcttcaaggccaa

SEQ ID NO: 6157987 - DNA, 14 bp, Homo sapiens
ctcttcaataaacc

SEQ ID NO: 6157988 - DNA, 18 bp, Homo sapiens
ctcttcaataaaccacaa

SEQ ID NO: 6157989 - DNA, 12 bp, Homo sapiens
ctcttcaatgaa

SEQ ID NO: 6157990 - DNA, 21 bp, Homo sapiens
ctcttcacatctcccccatag

SEQ ID NO: 6157991 - DNA, 13 bp, Homo sapiens
ctcttcaccagga

SEQ ID NO: 6157992 - DNA, 18 bp, Homo sapiens
ctcttcaccccccactca

SEQ ID NO: 6157993 - DNA, 21 bp, Homo sapiens
ctcttcaccccggcaggccct

SEQ ID NO: 6157994 - DNA, 22 bp, Homo sapiens
ctcttcacccctacactgtgaa

SEQ ID NO: 6157995 - DNA, 21 bp, Homo sapiens
ctcttcactgctacatgtgct

SEQ ID NO: 6157996 - DNA, 17 bp, Homo sapiens
ctcttcactgtggccac

SEQ ID NO: 6157997 - DNA, 20 bp, Homo sapiens
ctcttcactgtggccacagc

SEQ ID NO: 6157998 - DNA, 23 bp, Homo sapiens
ctcttcacttcctccagaagcct

SEQ ID NO: 6157999 - DNA, 15 bp, Homo sapiens
ctcttcacttggcca

SEQ ID NO: 6158000 - DNA, 11 bp, Homo sapiens
ctcttcagaaa

SEQ ID NO: 6158001 - DNA, 17 bp, Homo sapiens
ctgggttctacccaggt

SEQ ID NO: 6158002 - DNA, 14 bp, Homo sapiens
ctgggttctgactc

SEQ ID NO: 6158003 - DNA, 17 bp, Homo sapiens
ctgggttcttaaccaga

SEQ ID NO: 6158004 - DNA, 20 bp, Homo sapiens
ctgggttgcgggacagagta

SEQ ID NO: 6158005 - DNA, 20 bp, Homo sapiens
ctgggttggagggaaccacc

SEQ ID NO: 6158006 - DNA, 22 bp, Homo sapiens
ctgggttggagggaaccaccag

SEQ ID NO: 6158007 - DNA, 18 bp, Homo sapiens
ctgggttggcgcaccctc

SEQ ID NO: 6158008 - DNA, 14 bp, Homo sapiens
ctgggttgggatca

SEQ ID NO: 6158009 - DNA, 16 bp, Homo sapiens
ctgggttgggatcagg

SEQ ID NO: 6158010 - DNA, 14 bp, Homo sapiens
ctgggttgggggca

SEQ ID NO: 6158011 - DNA, 23 bp, Homo sapiens
ctgggttgggggcactcagccac

SEQ ID NO: 6158012 - DNA, 13 bp, Homo sapiens
ctgggttggtgca

SEQ ID NO: 6158013 - DNA, 16 bp, Homo sapiens
ctgggttggtgcacag

SEQ ID NO: 6158014 - DNA, 22 bp, Homo sapiens
ctgggttggtgcacagtgattt

SEQ ID NO: 6158015 - DNA, 18 bp, Homo sapiens
ctgggttgtcactgagac

SEQ ID NO: 6158016 - DNA, 15 bp, Homo sapiens
ctgggttgttgcaga

SEQ ID NO: 6158017 - DNA, 18 bp, Homo sapiens
ctgggttgtttccaggag

SEQ ID NO: 6158018 - DNA, 19 bp, Homo sapiens
ctgggttgtttccaggaga

SEQ ID NO: 6158019 - DNA, 22 bp, Homo sapiens
ctgggttgtttccaggagaaag

SEQ ID NO: 6158020 - DNA, 14 bp, Homo sapiens
ctgggtttaaagat

SEQ ID NO: 6158021 - DNA, 23 bp, Homo sapiens
ctgggtttacaacaaacactgtg

SEQ ID NO: 6158022 - DNA, 22 bp, Homo sapiens
ctgggtttattacatggcagtg

SEQ ID NO: 6158023 - DNA, 17 bp, Homo sapiens
ctgggtttccagggcac

SEQ ID NO: 6158024 - DNA, 18 bp, Homo sapiens
ctgggtttccagggcaca

SEQ ID NO: 6158025 - DNA, 14 bp, Homo sapiens
ctgggtttcctgca

SEQ ID NO: 6158026 - DNA, 18 bp, Homo sapiens
ctgggtttcctgcaggca

SEQ ID NO: 6158027 - DNA, 17 bp, Homo sapiens
ctgggtttctagaggtc

SEQ ID NO: 6158028 - DNA, 16 bp, Homo sapiens
ctgggtttgaagctgc

SEQ ID NO: 6158029 - DNA, 16 bp, Homo sapiens
ctgggtttgcccagtc

SEQ ID NO: 6158030 - DNA, 18 bp, Homo sapiens
ctgggtttgcccagtcct

SEQ ID NO: 6158031 - DNA, 20 bp, Homo sapiens
ctgggtttggaccccagctg

SEQ ID NO: 6158032 - DNA, 23 bp, Homo sapiens
ctgggtttggaccccagctggga

SEQ ID NO: 6158033 - DNA, 16 bp, Homo sapiens
ctgggtttggcaggca

SEQ ID NO: 6158034 - DNA, 14 bp, Homo sapiens
ctgggtttggccca

SEQ ID NO: 6158035 - DNA, 16 bp, Homo sapiens
ctgggtttgggagcca

SEQ ID NO: 6158036 - DNA, 19 bp, Homo sapiens
ctgggtttgggagccagga

SEQ ID NO: 6158037 - DNA, 21 bp, Homo sapiens
ctgggtttgggagccaggact

SEQ ID NO: 6158038 - DNA, 16 bp, Homo sapiens
ctgggtttgggcagtg

SEQ ID NO: 6158039 - DNA, 19 bp, Homo sapiens
ctgggtttgggcagtggag

SEQ ID NO: 6158040 - DNA, 21 bp, Homo sapiens
ctgggtttgggcagtggagag

SEQ ID NO: 6158041 - DNA, 19 bp, Homo sapiens
ctgggtttgttcctggggc

SEQ ID NO: 6158042 - DNA, 12 bp, Homo sapiens
ctgggttttcta

SEQ ID NO: 6158043 - DNA, 20 bp, Homo sapiens
ctgggttttcttaaccatct

SEQ ID NO: 6158044 - DNA, 17 bp, Homo sapiens
ctgggttttgcctctgc

SEQ ID NO: 6158045 - DNA, 13 bp, Homo sapiens
ctgggttttgtag

SEQ ID NO: 6158046 - DNA, 15 bp, Homo sapiens
ctgggttttgtctct

SEQ ID NO: 6158047 - DNA, 19 bp, Homo sapiens
ctggtaaaagggatacaca

SEQ ID NO: 6158048 - DNA, 13 bp, Homo sapiens
ctggtaaaatgaa

SEQ ID NO: 6158049 - DNA, 19 bp, Homo sapiens
ctggtaaaatgaagaattt

SEQ ID NO: 6158050 - DNA, 23 bp, Homo sapiens
ctggtaaaattaagcacactaaa

SEQ ID NO: 6158051 - DNA, 13 bp, Homo sapiens
ctggtaaaccaag

SEQ ID NO: 6158052 - DNA, 16 bp, Homo sapiens
ctggtaaactatttgt

SEQ ID NO: 6158053 - DNA, 21 bp, Homo sapiens
ctggtaaagaaaagcctcagc

SEQ ID NO: 6158054 - DNA, 21 bp, Homo sapiens
ctggtaaagttacacttttat

SEQ ID NO: 6158055 - DNA, 22 bp, Homo sapiens
ctggtaaagttacacttttatt

SEQ ID NO: 6158056 - DNA, 18 bp, Homo sapiens
ctggtaacagttcatgtt

SEQ ID NO: 6158057 - DNA, 16 bp, Homo sapiens
ctggtaacctgtggtg

SEQ ID NO: 6158058 - DNA, 22 bp, Homo sapiens
ctggtaactggaaggccttcca

SEQ ID NO: 6158059 - DNA, 14 bp, Homo sapiens
ctggtaagaaaaag

SEQ ID NO: 6158060 - DNA, 18 bp, Homo sapiens
ctggtaagaaaaagcaaa

SEQ ID NO: 6158061 - DNA, 19 bp, Homo sapiens
ctggtaagactgctggttg

SEQ ID NO: 6158062 - DNA, 13 bp, Homo sapiens
ctggtaaggctgg

SEQ ID NO: 6158063 - DNA, 14 bp, Homo sapiens
ctggtaagggacct

SEQ ID NO: 6158064 - DNA, 23 bp, Homo sapiens
ctggtaagtaatgagggctgagt

SEQ ID NO: 6158065 - DNA, 13 bp, Homo sapiens
ctggtaagttgga

SEQ ID NO: 6158066 - DNA, 14 bp, Homo sapiens
ctggtaatagctgt

SEQ ID NO: 6158067 - DNA, 15 bp, Homo sapiens
ctggtaatcttgctc

SEQ ID NO: 6158068 - DNA, 12 bp, Homo sapiens
ctggtaattatc

SEQ ID NO: 6158069 - DNA, 18 bp, Homo sapiens
ctggtaattcctctccag

SEQ ID NO: 6158070 - DNA, 16 bp, Homo sapiens
ctggtaattgtacaat

SEQ ID NO: 6158071 - DNA, 21 bp, Homo sapiens
ctggtaatttgtatctgaagg

SEQ ID NO: 6158072 - DNA, 16 bp, Homo sapiens
ctggtacaacggaggc

SEQ ID NO: 6158073 - DNA, 15 bp, Homo sapiens
ctggtacaatccttt

SEQ ID NO: 6158074 - DNA, 22 bp, Homo sapiens
ctggtacagcagggtcttgctg

SEQ ID NO: 6158075 - DNA, 13 bp, Homo sapiens
ctggtacccagcc

SEQ ID NO: 6158076 - DNA, 17 bp, Homo sapiens
ctggtacccagccatct

SEQ ID NO: 6158077 - DNA, 22 bp, Homo sapiens
ctggtacccagccatctgccca

SEQ ID NO: 6158078 - DNA, 15 bp, Homo sapiens
ctggtaccctcctgg

SEQ ID NO: 6158079 - DNA, 16 bp, Homo sapiens
ctggtaccctcctggc

SEQ ID NO: 6158080 - DNA, 14 bp, Homo sapiens
ctggtacctgccct

SEQ ID NO: 6158081 - DNA, 22 bp, Homo sapiens
ctggtacgaatctcatccctca

SEQ ID NO: 6158082 - DNA, 21 bp, Homo sapiens
ctggtactattgtgaccacag

SEQ ID NO: 6158083 - DNA, 15 bp, Homo sapiens
ctggtactcaagcca

SEQ ID NO: 6158084 - DNA, 19 bp, Homo sapiens
ctggtactccctctcagga

SEQ ID NO: 6158085 - DNA, 21 bp, Homo sapiens
ctggtactctgccactttatt

SEQ ID NO: 6158086 - DNA, 15 bp, Homo sapiens
ctggtactgacccag

SEQ ID NO: 6158087 - DNA, 20 bp, Homo sapiens
ctggtacttagagtttctgt

SEQ ID NO: 6158088 - DNA, 23 bp, Homo sapiens
ctggtagaaaaaggggcctgagt

SEQ ID NO: 6158089 - DNA, 21 bp, Homo sapiens
ctggtagaagggaaagcccat

SEQ ID NO: 6158090 - DNA, 20 bp, Homo sapiens
ctggtagacacaggatagat

SEQ ID NO: 6158091 - DNA, 20 bp, Homo sapiens
ctggtagagacccccaggcc

SEQ ID NO: 6158092 - DNA, 13 bp, Homo sapiens
ctggtagagcagg

SEQ ID NO: 6158093 - DNA, 21 bp, Homo sapiens
ctggtagcacatgtctgtcct

SEQ ID NO: 6158094 - DNA, 15 bp, Homo sapiens
ctggtagcagcaggc

SEQ ID NO: 6158095 - DNA, 21 bp, Homo sapiens
ctggtagcagcaggctcaggc

SEQ ID NO: 6158096 - DNA, 23 bp, Homo sapiens
ctggtagcatgaccttttggcct

SEQ ID NO: 6158097 - DNA, 13 bp, Homo sapiens
ctggtagctcagg

SEQ ID NO: 6158098 - DNA, 16 bp, Homo sapiens
ctggtagctgagggga

SEQ ID NO: 6158099 - DNA, 13 bp, Homo sapiens
ctggtaggaaagc

SEQ ID NO: 6158100 - DNA, 23 bp, Homo sapiens
ctggtaggaaagggcaagtcttt

SEQ ID NO: 6158101 - DNA, 22 bp, Homo sapiens
ctggtaggaggaggcatggaaa

SEQ ID NO: 6158102 - DNA, 19 bp, Homo sapiens
ctggtagggatatggcagg

SEQ ID NO: 6158103 - DNA, 13 bp, Homo sapiens
ctggtaggtctgg

SEQ ID NO: 6158104 - DNA, 23 bp, Homo sapiens
ctggtaggtctggattttcaaag

SEQ ID NO: 6158105 - DNA, 14 bp, Homo sapiens
ctggtaggttctgt

SEQ ID NO: 6158106 - DNA, 16 bp, Homo sapiens
ctggtaggttgggaca

SEQ ID NO: 6158107 - DNA, 22 bp, Homo sapiens
ctggtaggttgggacaccaggg

SEQ ID NO: 6158108 - DNA, 16 bp, Homo sapiens
ctggtagtgtagctgt

SEQ ID NO: 6158109 - DNA, 19 bp, Homo sapiens
ctggtagttcattgtaaat

SEQ ID NO: 6158110 - DNA, 15 bp, Homo sapiens
ctggtatactatcat

SEQ ID NO: 6158111 - DNA, 18 bp, Homo sapiens
ctggtatatccaaaagct

SEQ ID NO: 6158112 - DNA, 22 bp, Homo sapiens
ctggtatcctcatcatgatgga

SEQ ID NO: 6158113 - DNA, 14 bp, Homo sapiens
ctggtatctcagaa

SEQ ID NO: 6158114 - DNA, 15 bp, Homo sapiens
ctggtatctcagaaa

SEQ ID NO: 6158115 - DNA, 17 bp, Homo sapiens
ctggtatctcagaaagt

SEQ ID NO: 6158116 - DNA, 22 bp, Homo sapiens
ctggtatctcagaaagtgcctg

SEQ ID NO: 6158117 - DNA, 12 bp, Homo sapiens
ctggtatctgca

SEQ ID NO: 6158118 - DNA, 18 bp, Homo sapiens
ctggtatggctgcagtcc

SEQ ID NO: 6158119 - DNA, 20 bp, Homo sapiens
ctggtatggtgctaatattt

SEQ ID NO: 6158120 - DNA, 15 bp, Homo sapiens
ctggtatgtgcctgc

SEQ ID NO: 6158121 - DNA, 21 bp, Homo sapiens
ctggtatgtgcctgcgttctg

SEQ ID NO: 6158122 - DNA, 13 bp, Homo sapiens
ctggtattaaatg

SEQ ID NO: 6158123 - DNA, 19 bp, Homo sapiens
ctggtattaaatgccaagg

SEQ ID NO: 6158124 - DNA, 19 bp, Homo sapiens
ctggtattattatgttctt

SEQ ID NO: 6158125 - DNA, 12 bp, Homo sapiens
ctggtattcaca

SEQ ID NO: 6158126 - DNA, 22 bp, Homo sapiens
ctggtattcacagaaagctaga

SEQ ID NO: 6158127 - DNA, 15 bp, Homo sapiens
ctggtattcctgcct

SEQ ID NO: 6158128 - DNA, 17 bp, Homo sapiens
ctggtattcctgcctcc

SEQ ID NO: 6158129 - DNA, 20 bp, Homo sapiens
ctggtattcctttatgtatc

SEQ ID NO: 6158130 - DNA, 14 bp, Homo sapiens
ctggtattctctct

SEQ ID NO: 6158131 - DNA, 16 bp, Homo sapiens
ctggtatttggagcaa

SEQ ID NO: 6158132 - DNA, 13 bp, Homo sapiens
ctggtcaaagaaa

SEQ ID NO: 6158133 - DNA, 21 bp, Homo sapiens
ctggtcaaccccacaagcacc

SEQ ID NO: 6158134 - DNA, 21 bp, Homo sapiens
ctggtcaacccgctgcttcca

SEQ ID NO: 6158135 - DNA, 20 bp, Homo sapiens
ctggtcaacttgagcatgtt

SEQ ID NO: 6158136 - DNA, 22 bp, Homo sapiens
ctggtcaagttgagatttttaa

SEQ ID NO: 6158137 - DNA, 14 bp, Homo sapiens
ctggtcacacaagg

SEQ ID NO: 6158138 - DNA, 17 bp, Homo sapiens
ctggtcacacaaggaac

SEQ ID NO: 6158139 - DNA, 20 bp, Homo sapiens
ctggtcacacaaggaactct

SEQ ID NO: 6158140 - DNA, 15 bp, Homo sapiens
ctggtcacagcctcc

SEQ ID NO: 6158141 - DNA, 18 bp, Homo sapiens
ctggtcaccaaggcagtg

SEQ ID NO: 6158142 - DNA, 12 bp, Homo sapiens
ctggtcaccctg

SEQ ID NO: 6158143 - DNA, 18 bp, Homo sapiens
ctggtcaccgagactcag

SEQ ID NO: 6158144 - DNA, 21 bp, Homo sapiens
ctggtcaccgagactcagcct

SEQ ID NO: 6158145 - DNA, 22 bp, Homo sapiens
ctggtcaccgagactcagcctc

SEQ ID NO: 6158146 - DNA, 18 bp, Homo sapiens
ctggtcacctaggaagcc

SEQ ID NO: 6158147 - DNA, 23 bp, Homo sapiens
ctggtcacctaggaagcctcaga

SEQ ID NO: 6158148 - DNA, 20 bp, Homo sapiens
ctggtcaccttgcactcctc

SEQ ID NO: 6158149 - DNA, 22 bp, Homo sapiens
ctggtcaccttgcactcctcac

SEQ ID NO: 6158150 - DNA, 12 bp, Homo sapiens
ctggtcactctg

SEQ ID NO: 6158151 - DNA, 16 bp, Homo sapiens
ctggtcactctgccct

SEQ ID NO: 6158152 - DNA, 22 bp, Homo sapiens
ctggtcactgccatggaggcac

SEQ ID NO: 6158153 - DNA, 23 bp, Homo sapiens
ctggtcacttcaaacatgccctc

SEQ ID NO: 6158154 - DNA, 15 bp, Homo sapiens
ctggtcacttcttct

SEQ ID NO: 6158155 - DNA, 17 bp, Homo sapiens
ctggtcacttcttctgt

SEQ ID NO: 6158156 - DNA, 21 bp, Homo sapiens
ctggtcagaaccggcctggag

SEQ ID NO: 6158157 - DNA, 13 bp, Homo sapiens
ctggtcagagacg

SEQ ID NO: 6158158 - DNA, 18 bp, Homo sapiens
ctggtcagagacggcaga

SEQ ID NO: 6158159 - DNA, 16 bp, Homo sapiens
ctggtcagagagacct

SEQ ID NO: 6158160 - DNA, 21 bp, Homo sapiens
ctggtcagagccacagggtct

SEQ ID NO: 6158161 - DNA, 14 bp, Homo sapiens
ctggtcagcagagc

SEQ ID NO: 6158162 - DNA, 16 bp, Homo sapiens
ctggtcagctgcccca

SEQ ID NO: 6158163 - DNA, 15 bp, Homo sapiens
ctggtcaggcaatgc

SEQ ID NO: 6158164 - DNA, 16 bp, Homo sapiens
ctggtcaggcccactg

SEQ ID NO: 6158165 - DNA, 17 bp, Homo sapiens
ctggtcaggcccactgc

SEQ ID NO: 6158166 - DNA, 13 bp, Homo sapiens
ctggtcagggcag

SEQ ID NO: 6158167 - DNA, 17 bp, Homo sapiens
ctggtcaggtatttcag

SEQ ID NO: 6158168 - DNA, 13 bp, Homo sapiens
ctggtcaggtccc

SEQ ID NO: 6158169 - DNA, 19 bp, Homo sapiens
ctggtcagtctttgctcag

SEQ ID NO: 6158170 - DNA, 16 bp, Homo sapiens
ctggtcagttttcaca

SEQ ID NO: 6158171 - DNA, 12 bp, Homo sapiens
ctggtcatcctg

SEQ ID NO: 6158172 - DNA, 22 bp, Homo sapiens
ctggtcatccttggtgctcttg

SEQ ID NO: 6158173 - DNA, 14 bp, Homo sapiens
ctggtccacactag

SEQ ID NO: 6158174 - DNA, 15 bp, Homo sapiens
ctggtccacactaga

SEQ ID NO: 6158175 - DNA, 22 bp, Homo sapiens
ctggtccacactagaaagaagc

SEQ ID NO: 6158176 - DNA, 13 bp, Homo sapiens
ctggtccacaggg

SEQ ID NO: 6158177 - DNA, 16 bp, Homo sapiens
ctggtccacagggcac

SEQ ID NO: 6158178 - DNA, 22 bp, Homo sapiens
ctggtccacagggcacctgcca

SEQ ID NO: 6158179 - DNA, 23 bp, Homo sapiens
ctcttcagaatatggacaaagaa

SEQ ID NO: 6158180 - DNA, 22 bp, Homo sapiens
ctcttcagacacacggggcacc

SEQ ID NO: 6158181 - DNA, 17 bp, Homo sapiens
ctcttcagactctcagc

SEQ ID NO: 6158182 - DNA, 23 bp, Homo sapiens
ctcttcagactctcagcccagaa

SEQ ID NO: 6158183 - DNA, 20 bp, Homo sapiens
ctcttcagccccttctcccc

SEQ ID NO: 6158184 - DNA, 13 bp, Homo sapiens
ctcttcagctgct

SEQ ID NO: 6158185 - DNA, 18 bp, Homo sapiens
ctcttcagctgctgacaa

SEQ ID NO: 6158186 - DNA, 18 bp, Homo sapiens
ctcttcaggcctccctct

SEQ ID NO: 6158187 - DNA, 19 bp, Homo sapiens
ctcttcaggttgtaaaaaa

SEQ ID NO: 6158188 - DNA, 20 bp, Homo sapiens
ctcttcagtgactcctgctg

SEQ ID NO: 6158189 - DNA, 17 bp, Homo sapiens
ctcttcagtgtgttgac

SEQ ID NO: 6158190 - DNA, 20 bp, Homo sapiens
ctcttcagttaagcctttgg

SEQ ID NO: 6158191 - DNA, 18 bp, Homo sapiens
ctcttcagttaattctta

SEQ ID NO: 6158192 - DNA, 14 bp, Homo sapiens
ctcttcatctaata

SEQ ID NO: 6158193 - DNA, 17 bp, Homo sapiens
ctcttcatgtctattcc

SEQ ID NO: 6158194 - DNA, 13 bp, Homo sapiens
ctcttcatttctg

SEQ ID NO: 6158195 - DNA, 21 bp, Homo sapiens
ctcttcattttgagtctcagg

SEQ ID NO: 6158196 - DNA, 14 bp, Homo sapiens
ctcttccaaagctc

SEQ ID NO: 6158197 - DNA, 17 bp, Homo sapiens
ctcttccaaaggcagcg

SEQ ID NO: 6158198 - DNA, 11 bp, Homo sapiens
ctcttccaaat

SEQ ID NO: 6158199 - DNA, 12 bp, Homo sapiens
ctcttccacagt

SEQ ID NO: 6158200 - DNA, 22 bp, Homo sapiens
ctcttccacagtggcgggccca

SEQ ID NO: 6158201 - DNA, 19 bp, Homo sapiens
ctcttccaccagagcaggg

SEQ ID NO: 6158202 - DNA, 22 bp, Homo sapiens
ctcttccaccagagcaggggct

SEQ ID NO: 6158203 - DNA, 18 bp, Homo sapiens
ctcttccacctctgggga

SEQ ID NO: 6158204 - DNA, 13 bp, Homo sapiens
ctcttccagaatc

SEQ ID NO: 6158205 - DNA, 13 bp, Homo sapiens
ctcttccagagtc

SEQ ID NO: 6158206 - DNA, 21 bp, Homo sapiens
ctcttccagctgcttcaggga

SEQ ID NO: 6158207 - DNA, 14 bp, Homo sapiens
ctcttccagcttct

SEQ ID NO: 6158208 - DNA, 14 bp, Homo sapiens
ctcttccaggcagc

SEQ ID NO: 6158209 - DNA, 15 bp, Homo sapiens
ctcttccaggcagcc

SEQ ID NO: 6158210 - DNA, 22 bp, Homo sapiens
ctcttccagtcttcctgacact

SEQ ID NO: 6158211 - DNA, 23 bp, Homo sapiens
ctcttccagtcttcctgacactt

SEQ ID NO: 6158212 - DNA, 17 bp, Homo sapiens
ctcttccattccctttc

SEQ ID NO: 6158213 - DNA, 20 bp, Homo sapiens
ctcttccatttcttccacga

SEQ ID NO: 6158214 - DNA, 22 bp, Homo sapiens
ctcttcccaagtcctcgccccc

SEQ ID NO: 6158215 - DNA, 10 bp, Homo sapiens
ctcttcccac

SEQ ID NO: 6158216 - DNA, 17 bp, Homo sapiens
ctcttcccaccaactct

SEQ ID NO: 6158217 - DNA, 21 bp, Homo sapiens
ctcttcccaccaactctctct

SEQ ID NO: 6158218 - DNA, 13 bp, Homo sapiens
ctcttcccagaaa

SEQ ID NO: 6158219 - DNA, 13 bp, Homo sapiens
ctcttcccagagt

SEQ ID NO: 6158220 - DNA, 12 bp, Homo sapiens
ctcttcccaggc

SEQ ID NO: 6158221 - DNA, 14 bp, Homo sapiens
ctcttcccaggcct

SEQ ID NO: 6158222 - DNA, 16 bp, Homo sapiens
ctcttccccagacgcc

SEQ ID NO: 6158223 - DNA, 21 bp, Homo sapiens
ctcttccccagacgcctggct

SEQ ID NO: 6158224 - DNA, 14 bp, Homo sapiens
ctcttccccagaga

SEQ ID NO: 6158225 - DNA, 13 bp, Homo sapiens
ctcttccccatct

SEQ ID NO: 6158226 - DNA, 19 bp, Homo sapiens
ctcttcccccatgtgcctg

SEQ ID NO: 6158227 - DNA, 17 bp, Homo sapiens
ctcttccccctctccca

SEQ ID NO: 6158228 - DNA, 20 bp, Homo sapiens
ctcttccccctctcccagtt

SEQ ID NO: 6158229 - DNA, 13 bp, Homo sapiens
ctcttcccccttc

SEQ ID NO: 6158230 - DNA, 14 bp, Homo sapiens
ctcttcccccttcc

SEQ ID NO: 6158231 - DNA, 16 bp, Homo sapiens
ctcttcccccttccaa

SEQ ID NO: 6158232 - DNA, 14 bp, Homo sapiens
ctcttcccctagac

SEQ ID NO: 6158233 - DNA, 22 bp, Homo sapiens
ctcttcccctagacctccccct

SEQ ID NO: 6158234 - DNA, 12 bp, Homo sapiens
ctcttcccctct

SEQ ID NO: 6158235 - DNA, 16 bp, Homo sapiens
ctcttccccttccctt

SEQ ID NO: 6158236 - DNA, 17 bp, Homo sapiens
ctcttccccttcctgtt

SEQ ID NO: 6158237 - DNA, 20 bp, Homo sapiens
ctcttccccttcctgtttca

SEQ ID NO: 6158238 - DNA, 21 bp, Homo sapiens
ctcttccccttcctgtttcag

SEQ ID NO: 6158239 - DNA, 14 bp, Homo sapiens
ctcttcccctttcc

SEQ ID NO: 6158240 - DNA, 15 bp, Homo sapiens
ctcttccctcagtcc

SEQ ID NO: 6158241 - DNA, 17 bp, Homo sapiens
ctcttccctcagtccca

SEQ ID NO: 6158242 - DNA, 15 bp, Homo sapiens
ctcttccctcagttt

SEQ ID NO: 6158243 - DNA, 15 bp, Homo sapiens
ctcttccctctccct

SEQ ID NO: 6158244 - DNA, 16 bp, Homo sapiens
ctcttccctctcgctc

SEQ ID NO: 6158245 - DNA, 18 bp, Homo sapiens
ctcttccctctcgctccc

SEQ ID NO: 6158246 - DNA, 19 bp, Homo sapiens
ctcttccctctcgctcccc

SEQ ID NO: 6158247 - DNA, 16 bp, Homo sapiens
ctcttccctctgattt

SEQ ID NO: 6158248 - DNA, 14 bp, Homo sapiens
ctcttccctctggg

SEQ ID NO: 6158249 - DNA, 15 bp, Homo sapiens
ctcttccctgacctc

SEQ ID NO: 6158250 - DNA, 12 bp, Homo sapiens
ctcttccctggg

SEQ ID NO: 6158251 - DNA, 13 bp, Homo sapiens
ctcttccctggga

SEQ ID NO: 6158252 - DNA, 14 bp, Homo sapiens
ctcttccctgggaa

SEQ ID NO: 6158253 - DNA, 17 bp, Homo sapiens
ctcttcccttcccagac

SEQ ID NO: 6158254 - DNA, 15 bp, Homo sapiens
ctcttcccttgctca

SEQ ID NO: 6158255 - DNA, 19 bp, Homo sapiens
ctcttcccttgctcatgag

SEQ ID NO: 6158256 - DNA, 21 bp, Homo sapiens
ctcttccctttccccagcatc

SEQ ID NO: 6158257 - DNA, 13 bp, Homo sapiens
ctcttcccttttt

SEQ ID NO: 6158258 - DNA, 16 bp, Homo sapiens
ctcttccgactctttc

SEQ ID NO: 6158259 - DNA, 15 bp, Homo sapiens
ctcttccgagctgct

SEQ ID NO: 6158260 - DNA, 19 bp, Homo sapiens
ctcttccggagatgtagca

SEQ ID NO: 6158261 - DNA, 18 bp, Homo sapiens
ctcttccgggcagaaaca

SEQ ID NO: 6158262 - DNA, 17 bp, Homo sapiens
ctcttccgtgcatccca

SEQ ID NO: 6158263 - DNA, 15 bp, Homo sapiens
ctcttcctacccaac

SEQ ID NO: 6158264 - DNA, 20 bp, Homo sapiens
ctcttcctacccaaccactc

SEQ ID NO: 6158265 - DNA, 19 bp, Homo sapiens
ctcttcctaccctgcctcc

SEQ ID NO: 6158266 - DNA, 19 bp, Homo sapiens
ctcttcctagatctgcagg

SEQ ID NO: 6158267 - DNA, 22 bp, Homo sapiens
ctcttcctagatctgcaggctg

SEQ ID NO: 6158268 - DNA, 22 bp, Homo sapiens
ctcttcctaggccacgtccagg

SEQ ID NO: 6158269 - DNA, 19 bp, Homo sapiens
ctcttcctccaaagcctgg

SEQ ID NO: 6158270 - DNA, 16 bp, Homo sapiens
ctcttcctcctcccaa

SEQ ID NO: 6158271 - DNA, 17 bp, Homo sapiens
ctcttcctcctcccaag

SEQ ID NO: 6158272 - DNA, 14 bp, Homo sapiens
ctcttcctcctgac

SEQ ID NO: 6158273 - DNA, 12 bp, Homo sapiens
ctcttcctctga

SEQ ID NO: 6158274 - DNA, 21 bp, Homo sapiens
ctcttcctctgcaggacacag

SEQ ID NO: 6158275 - DNA, 15 bp, Homo sapiens
ctcttcctctgggca

SEQ ID NO: 6158276 - DNA, 16 bp, Homo sapiens
ctcttcctctgggcag

SEQ ID NO: 6158277 - DNA, 13 bp, Homo sapiens
ctcttcctctggt

SEQ ID NO: 6158278 - DNA, 15 bp, Homo sapiens
ctcttcctctgttct

SEQ ID NO: 6158279 - DNA, 12 bp, Homo sapiens
ctcttcctgatt

SEQ ID NO: 6158280 - DNA, 14 bp, Homo sapiens
ctcttcctgcccct

SEQ ID NO: 6158281 - DNA, 17 bp, Homo sapiens
ctcttcctgcccctctt

SEQ ID NO: 6158282 - DNA, 19 bp, Homo sapiens
ctcttcctgcccctctttc

SEQ ID NO: 6158283 - DNA, 22 bp, Homo sapiens
ctcttcctgcccctctttctct

SEQ ID NO: 6158284 - DNA, 18 bp, Homo sapiens
ctcttcctggaataaaca

SEQ ID NO: 6158285 - DNA, 13 bp, Homo sapiens
ctcttcctggacc

SEQ ID NO: 6158286 - DNA, 18 bp, Homo sapiens
ctcttcctggacctgagt

SEQ ID NO: 6158287 - DNA, 15 bp, Homo sapiens
ctcttcctggagccc

SEQ ID NO: 6158288 - DNA, 12 bp, Homo sapiens
ctcttcctgtcc

SEQ ID NO: 6158289 - DNA, 12 bp, Homo sapiens
ctcttcctgtct

SEQ ID NO: 6158290 - DNA, 18 bp, Homo sapiens
ctcttcctgtctggcttc

SEQ ID NO: 6158291 - DNA, 22 bp, Homo sapiens
ctcttccttcccccatcccctt

SEQ ID NO: 6158292 - DNA, 23 bp, Homo sapiens
ctcttccttctctactcatgcca

SEQ ID NO: 6158293 - DNA, 18 bp, Homo sapiens
ctcttccttgctgtgtca

SEQ ID NO: 6158294 - DNA, 19 bp, Homo sapiens
ctcttcctttatcccctcc

SEQ ID NO: 6158295 - DNA, 12 bp, Homo sapiens
ctcttcctttcc

SEQ ID NO: 6158296 - DNA, 13 bp, Homo sapiens
ctcttcgcctttc

SEQ ID NO: 6158297 - DNA, 16 bp, Homo sapiens
ctcttcgcctttccca

SEQ ID NO: 6158298 - DNA, 20 bp, Homo sapiens
ctcttcgcctttcccaccct

SEQ ID NO: 6158299 - DNA, 21 bp, Homo sapiens
ctcttcgcctttcccaccctc

SEQ ID NO: 6158300 - DNA, 21 bp, Homo sapiens
ctcttcgcgcccgcccctgca

SEQ ID NO: 6158301 - DNA, 23 bp, Homo sapiens
ctcttcgcgcccgcccctgcagc

SEQ ID NO: 6158302 - DNA, 16 bp, Homo sapiens
ctcttcgctgtgatgc

SEQ ID NO: 6158303 - DNA, 16 bp, Homo sapiens
ctcttcggccctcaga

SEQ ID NO: 6158304 - DNA, 19 bp, Homo sapiens
ctcttcggtggccttgagt

SEQ ID NO: 6158305 - DNA, 15 bp, Homo sapiens
ctcttcggtgttctt

SEQ ID NO: 6158306 - DNA, 14 bp, Homo sapiens
ctcttctaacccaa

SEQ ID NO: 6158307 - DNA, 22 bp, Homo sapiens
ctcttctacctcttccaggaag

SEQ ID NO: 6158308 - DNA, 14 bp, Homo sapiens
ctcttctactcact

SEQ ID NO: 6158309 - DNA, 22 bp, Homo sapiens
ctcttctactcacttttcccac

SEQ ID NO: 6158310 - DNA, 13 bp, Homo sapiens
ctcttctacttgt

SEQ ID NO: 6158311 - DNA, 17 bp, Homo sapiens
ctcttctatgtattttg

SEQ ID NO: 6158312 - DNA, 17 bp, Homo sapiens
ctcttctatttaaaaaa

SEQ ID NO: 6158313 - DNA, 19 bp, Homo sapiens
ctcttctatttaaaaaata

SEQ ID NO: 6158314 - DNA, 17 bp, Homo sapiens
ctcttctattttgtaaa

SEQ ID NO: 6158315 - DNA, 19 bp, Homo sapiens
ctcttctattttgtaaact

SEQ ID NO: 6158316 - DNA, 14 bp, Homo sapiens
ctcttctcaagtgc

SEQ ID NO: 6158317 - DNA, 16 bp, Homo sapiens
ctcttctcactttcct

SEQ ID NO: 6158318 - DNA, 15 bp, Homo sapiens
ctcttctcagagcag

SEQ ID NO: 6158319 - DNA, 15 bp, Homo sapiens
ctcttctcatttcac

SEQ ID NO: 6158320 - DNA, 22 bp, Homo sapiens
ctcttctccacgtctttcctgc

SEQ ID NO: 6158321 - DNA, 13 bp, Homo sapiens
ctcttctccaggc

SEQ ID NO: 6158322 - DNA, 13 bp, Homo sapiens
ctcttctccattc

SEQ ID NO: 6158323 - DNA, 17 bp, Homo sapiens
ctcttctccattcccta

SEQ ID NO: 6158324 - DNA, 14 bp, Homo sapiens
ctcttctcccagaa

SEQ ID NO: 6158325 - DNA, 15 bp, Homo sapiens
ctcttctcccagaat

SEQ ID NO: 6158326 - DNA, 22 bp, Homo sapiens
ctcttctcccagaatcccagcc

SEQ ID NO: 6158327 - DNA, 16 bp, Homo sapiens
ctcttctccccagagt

SEQ ID NO: 6158328 - DNA, 13 bp, Homo sapiens
ctcttctcccccc

SEQ ID NO: 6158329 - DNA, 14 bp, Homo sapiens
ctcttctccccttc

SEQ ID NO: 6158330 - DNA, 20 bp, Homo sapiens
ctcttctccccttccatttc

SEQ ID NO: 6158331 - DNA, 15 bp, Homo sapiens
ctcttctcctcagct

SEQ ID NO: 6158332 - DNA, 19 bp, Homo sapiens
ctcttctcctctggcttcc

SEQ ID NO: 6158333 - DNA, 12 bp, Homo sapiens
ctcttctcctgt

SEQ ID NO: 6158334 - DNA, 20 bp, Homo sapiens
ctcttctcctgtgttccctt

SEQ ID NO: 6158335 - DNA, 15 bp, Homo sapiens
ctcttctcctttcac

SEQ ID NO: 6158336 - DNA, 13 bp, Homo sapiens
ctcttctcggctc

SEQ ID NO: 6158337 - DNA, 17 bp, Homo sapiens
ctcttctcggctcaggc

SEQ ID NO: 6158338 - DNA, 19 bp, Homo sapiens
ctcttctcggctcaggctc

SEQ ID NO: 6158339 - DNA, 14 bp, Homo sapiens
ctcttctctcaacc

SEQ ID NO: 6158340 - DNA, 22 bp, Homo sapiens
ctcttctctcaaccttggcctt

SEQ ID NO: 6158341 - DNA, 13 bp, Homo sapiens
ctcttctctcaga

SEQ ID NO: 6158342 - DNA, 14 bp, Homo sapiens
ctcttctctcagac

SEQ ID NO: 6158343 - DNA, 23 bp, Homo sapiens
ctcttctctcagaccgtcttcct

SEQ ID NO: 6158344 - DNA, 12 bp, Homo sapiens
ctcttctctcct

SEQ ID NO: 6158345 - DNA, 17 bp, Homo sapiens
ctcttctctcctcccct

SEQ ID NO: 6158346 - DNA, 21 bp, Homo sapiens
ctcttctctcctttctccctg

SEQ ID NO: 6158347 - DNA, 14 bp, Homo sapiens
ctcttctctctgct

SEQ ID NO: 6158348 - DNA, 14 bp, Homo sapiens
ctcttctctgcaat

SEQ ID NO: 6158349 - DNA, 14 bp, Homo sapiens
ctcttctcttcctg

SEQ ID NO: 6158350 - DNA, 16 bp, Homo sapiens
ctcttctcttctttgg

SEQ ID NO: 6158351 - DNA, 16 bp, Homo sapiens
ctcttctgacgtgcct

SEQ ID NO: 6158352 - DNA, 12 bp, Homo sapiens
ctcttctgagct

SEQ ID NO: 6158353 - DNA, 13 bp, Homo sapiens
ctcttctgagcta

SEQ ID NO: 6158354 - DNA, 14 bp, Homo sapiens
ctcttctgcaagcc

SEQ ID NO: 6158355 - DNA, 17 bp, Homo sapiens
ctcttctgccagcctcc

SEQ ID NO: 6158356 - DNA, 21 bp, Homo sapiens
ctcttctgccggccctggggc

SEQ ID NO: 6158357 - DNA, 20 bp, Homo sapiens
ctcttctgcttaggagagac

SEQ ID NO: 6158358 - DNA, 22 bp, Homo sapiens
ctcttctggagatggaagcttg

SEQ ID NO: 6158359 - DNA, 11 bp, Homo sapiens
ctcttctggct

SEQ ID NO: 6158360 - DNA, 17 bp, Homo sapiens
ctcttctgggcgtctga

SEQ ID NO: 6158361 - DNA, 16 bp, Homo sapiens
ctggtccagctctgac

SEQ ID NO: 6158362 - DNA, 22 bp, Homo sapiens
ctggtccagctctgacatccct

SEQ ID NO: 6158363 - DNA, 17 bp, Homo sapiens
ctggtccaggcatgggt

SEQ ID NO: 6158364 - DNA, 20 bp, Homo sapiens
ctggtccaggcatgggtccc

SEQ ID NO: 6158365 - DNA, 15 bp, Homo sapiens
ctggtccagggaagc

SEQ ID NO: 6158366 - DNA, 14 bp, Homo sapiens
ctggtcccactcag

SEQ ID NO: 6158367 - DNA, 20 bp, Homo sapiens
ctggtccccactgctgagct

SEQ ID NO: 6158368 - DNA, 19 bp, Homo sapiens
ctggtcccccatgggctgc

SEQ ID NO: 6158369 - DNA, 12 bp, Homo sapiens
ctggtcccctcc

SEQ ID NO: 6158370 - DNA, 13 bp, Homo sapiens
ctggtcccctcct

SEQ ID NO: 6158371 - DNA, 14 bp, Homo sapiens
ctggtcccctcctt

SEQ ID NO: 6158372 - DNA, 19 bp, Homo sapiens
ctggtcccggggccagcac

SEQ ID NO: 6158373 - DNA, 9 bp, Homo sapiens
ctggtccct

SEQ ID NO: 6158374 - DNA, 18 bp, Homo sapiens
ctggtccctcgtccacag

SEQ ID NO: 6158375 - DNA, 13 bp, Homo sapiens
ctggtccctctga

SEQ ID NO: 6158376 - DNA, 15 bp, Homo sapiens
ctggtccctctgagg

SEQ ID NO: 6158377 - DNA, 17 bp, Homo sapiens
ctggtccctctgaggca

SEQ ID NO: 6158378 - DNA, 14 bp, Homo sapiens
ctggtccctgccct

SEQ ID NO: 6158379 - DNA, 22 bp, Homo sapiens
ctggtccctgccctcccctgct

SEQ ID NO: 6158380 - DNA, 14 bp, Homo sapiens
ctggtccctggaaa

SEQ ID NO: 6158381 - DNA, 15 bp, Homo sapiens
ctggtccctggtcct

SEQ ID NO: 6158382 - DNA, 19 bp, Homo sapiens
ctggtccctggtccttcac

SEQ ID NO: 6158383 - DNA, 20 bp, Homo sapiens
ctggtccctggtccttcact

SEQ ID NO: 6158384 - DNA, 19 bp, Homo sapiens
ctggtccgagctgaggact

SEQ ID NO: 6158385 - DNA, 23 bp, Homo sapiens
ctggtccgagctgaggactctgc

SEQ ID NO: 6158386 - DNA, 16 bp, Homo sapiens
ctggtccggacactcc

SEQ ID NO: 6158387 - DNA, 20 bp, Homo sapiens
ctggtccgtgcgggaaattc

SEQ ID NO: 6158388 - DNA, 23 bp, Homo sapiens
ctggtccgtgcgggaaattcagt

SEQ ID NO: 6158389 - DNA, 15 bp, Homo sapiens
ctggtccgtgggacg

SEQ ID NO: 6158390 - DNA, 19 bp, Homo sapiens
ctggtccgtgggacggtgc

SEQ ID NO: 6158391 - DNA, 15 bp, Homo sapiens
ctggtcctgaccagg

SEQ ID NO: 6158392 - DNA, 14 bp, Homo sapiens
ctggtcctgcacat

SEQ ID NO: 6158393 - DNA, 20 bp, Homo sapiens
ctggtcctggacacctccca

SEQ ID NO: 6158394 - DNA, 15 bp, Homo sapiens
ctggtcctggcctcc

SEQ ID NO: 6158395 - DNA, 13 bp, Homo sapiens
ctggtcctggctg

SEQ ID NO: 6158396 - DNA, 16 bp, Homo sapiens
ctggtcctggctgcac

SEQ ID NO: 6158397 - DNA, 22 bp, Homo sapiens
ctggtcctggctgcactcttga

SEQ ID NO: 6158398 - DNA, 13 bp, Homo sapiens
ctggtcctgtgga

SEQ ID NO: 6158399 - DNA, 14 bp, Homo sapiens
ctggtcctgttttc

SEQ ID NO: 6158400 - DNA, 17 bp, Homo sapiens
ctggtccttaccagaga

SEQ ID NO: 6158401 - DNA, 19 bp, Homo sapiens
ctggtccttaccagagacg

SEQ ID NO: 6158402 - DNA, 16 bp, Homo sapiens
ctggtccttagtaaat

SEQ ID NO: 6158403 - DNA, 15 bp, Homo sapiens
ctggtccttcactgg

SEQ ID NO: 6158404 - DNA, 17 bp, Homo sapiens
ctggtccttcactggcg

SEQ ID NO: 6158405 - DNA, 20 bp, Homo sapiens
ctggtccttctgaccccact

SEQ ID NO: 6158406 - DNA, 22 bp, Homo sapiens
ctggtcctttttggtcgaggag

SEQ ID NO: 6158407 - DNA, 14 bp, Homo sapiens
ctggtcgccttcca

SEQ ID NO: 6158408 - DNA, 13 bp, Homo sapiens
ctggtcgctcctg

SEQ ID NO: 6158409 - DNA, 15 bp, Homo sapiens
ctggtcgctcctgcc

SEQ ID NO: 6158410 - DNA, 16 bp, Homo sapiens
ctggtcgctcctgccc

SEQ ID NO: 6158411 - DNA, 14 bp, Homo sapiens
ctggtcggagaggg

SEQ ID NO: 6158412 - DNA, 19 bp, Homo sapiens
ctggtcgtgaactcctgag

SEQ ID NO: 6158413 - DNA, 15 bp, Homo sapiens
ctggtctaagaatga

SEQ ID NO: 6158414 - DNA, 19 bp, Homo sapiens
ctggtctaatttattaatc

SEQ ID NO: 6158415 - DNA, 15 bp, Homo sapiens
ctggtctacactggt

SEQ ID NO: 6158416 - DNA, 17 bp, Homo sapiens
ctggtctacctgagatc

SEQ ID NO: 6158417 - DNA, 17 bp, Homo sapiens
ctggtctactctagaag

SEQ ID NO: 6158418 - DNA, 19 bp, Homo sapiens
ctggtctataccttaagaa

SEQ ID NO: 6158419 - DNA, 17 bp, Homo sapiens
ctggtctattttgattt

SEQ ID NO: 6158420 - DNA, 21 bp, Homo sapiens
ctggtctcaaactcctgggct

SEQ ID NO: 6158421 - DNA, 22 bp, Homo sapiens
ctggtctcaaacttgtggcctc

SEQ ID NO: 6158422 - DNA, 16 bp, Homo sapiens
ctggtctcaccctgga

SEQ ID NO: 6158423 - DNA, 17 bp, Homo sapiens
ctggtctcaccctggag

SEQ ID NO: 6158424 - DNA, 18 bp, Homo sapiens
ctggtctcaccctggagg

SEQ ID NO: 6158425 - DNA, 14 bp, Homo sapiens
ctggtctcagcagc

SEQ ID NO: 6158426 - DNA, 20 bp, Homo sapiens
ctggtctcagcagcgaccac

SEQ ID NO: 6158427 - DNA, 21 bp, Homo sapiens
ctggtctccgtggcacttgta

SEQ ID NO: 6158428 - DNA, 16 bp, Homo sapiens
ctggtctcctcagcct

SEQ ID NO: 6158429 - DNA, 14 bp, Homo sapiens
ctggtctcctccca

SEQ ID NO: 6158430 - DNA, 22 bp, Homo sapiens
ctggtctcctcccaaaatacta

SEQ ID NO: 6158431 - DNA, 22 bp, Homo sapiens
ctggtctcctctttgttttgtt

SEQ ID NO: 6158432 - DNA, 20 bp, Homo sapiens
ctggtctcgaactcctgacc

SEQ ID NO: 6158433 - DNA, 18 bp, Homo sapiens
ctggtctcgaactcctgg

SEQ ID NO: 6158434 - DNA, 19 bp, Homo sapiens
ctggtctcgaactcctggc

SEQ ID NO: 6158435 - DNA, 23 bp, Homo sapiens
ctggtctcgtgttcgctggctga

SEQ ID NO: 6158436 - DNA, 18 bp, Homo sapiens
ctggtctctacataaaat

SEQ ID NO: 6158437 - DNA, 15 bp, Homo sapiens
ctggtctctaggcct

SEQ ID NO: 6158438 - DNA, 16 bp, Homo sapiens
ctggtctctaggcctg

SEQ ID NO: 6158439 - DNA, 18 bp, Homo sapiens
ctggtctctaggcctgaa

SEQ ID NO: 6158440 - DNA, 19 bp, Homo sapiens
ctggtctctaggcctgaac

SEQ ID NO: 6158441 - DNA, 17 bp, Homo sapiens
ctggtctctaggctggg

SEQ ID NO: 6158442 - DNA, 15 bp, Homo sapiens
ctggtctctggctct

SEQ ID NO: 6158443 - DNA, 18 bp, Homo sapiens
ctggtctgaggatgtaga

SEQ ID NO: 6158444 - DNA, 13 bp, Homo sapiens
ctggtctgcacct

SEQ ID NO: 6158445 - DNA, 17 bp, Homo sapiens
ctggtctgccaggggct

SEQ ID NO: 6158446 - DNA, 17 bp, Homo sapiens
ctggtctgcgccttggg

SEQ ID NO: 6158447 - DNA, 12 bp, Homo sapiens
ctggtctggagc

SEQ ID NO: 6158448 - DNA, 17 bp, Homo sapiens
ctggtctggagccccta

SEQ ID NO: 6158449 - DNA, 18 bp, Homo sapiens
ctggtctggagtcccacc

SEQ ID NO: 6158450 - DNA, 12 bp, Homo sapiens
ctggtctgggag

SEQ ID NO: 6158451 - DNA, 13 bp, Homo sapiens
ctggtctgggagt

SEQ ID NO: 6158452 - DNA, 14 bp, Homo sapiens
ctggtctggtcagg

SEQ ID NO: 6158453 - DNA, 12 bp, Homo sapiens
ctggtctgtctt

SEQ ID NO: 6158454 - DNA, 13 bp, Homo sapiens
ctggtctgtggag

SEQ ID NO: 6158455 - DNA, 19 bp, Homo sapiens
ctggtctgtggagatggac

SEQ ID NO: 6158456 - DNA, 17 bp, Homo sapiens
ctggtctgtgtgtgttc

SEQ ID NO: 6158457 - DNA, 18 bp, Homo sapiens
ctggtctgtgtgtgttct

SEQ ID NO: 6158458 - DNA, 21 bp, Homo sapiens
ctggtctgtgtgtgttcttca

SEQ ID NO: 6158459 - DNA, 19 bp, Homo sapiens
ctggtcttagatgcagcga

SEQ ID NO: 6158460 - DNA, 18 bp, Homo sapiens
ctggtcttatttgtaaag

SEQ ID NO: 6158461 - DNA, 16 bp, Homo sapiens
ctggtcttcactgcca

SEQ ID NO: 6158462 - DNA, 23 bp, Homo sapiens
ctggtcttcactttcctcagttg

SEQ ID NO: 6158463 - DNA, 20 bp, Homo sapiens
ctggtcttccttacctggaa

SEQ ID NO: 6158464 - DNA, 16 bp, Homo sapiens
ctggtcttcctttttg

SEQ ID NO: 6158465 - DNA, 18 bp, Homo sapiens
ctggtcttgaagtcctgg

SEQ ID NO: 6158466 - DNA, 22 bp, Homo sapiens
ctggtcttgaagtcctggcttc

SEQ ID NO: 6158467 - DNA, 16 bp, Homo sapiens
ctggtctttagcccca

SEQ ID NO: 6158468 - DNA, 15 bp, Homo sapiens
ctggtcttttctcct

SEQ ID NO: 6158469 - DNA, 17 bp, Homo sapiens
ctggtcttttgggagtg

SEQ ID NO: 6158470 - DNA, 21 bp, Homo sapiens
ctggtgaaagagtaaaaccaa

SEQ ID NO: 6158471 - DNA, 23 bp, Homo sapiens
ctggtgaaagagtaaaaccaaag

SEQ ID NO: 6158472 - DNA, 19 bp, Homo sapiens
ctggtgaacactgtgacca

SEQ ID NO: 6158473 - DNA, 20 bp, Homo sapiens
ctggtgaagctcacttctgg

SEQ ID NO: 6158474 - DNA, 18 bp, Homo sapiens
ctggtgaatcacctggct

SEQ ID NO: 6158475 - DNA, 19 bp, Homo sapiens
ctggtgaatcacctggctg

SEQ ID NO: 6158476 - DNA, 18 bp, Homo sapiens
ctggtgacaggcagacac

SEQ ID NO: 6158477 - DNA, 13 bp, Homo sapiens
ctggtgaccagac

SEQ ID NO: 6158478 - DNA, 18 bp, Homo sapiens
ctggtgaccggcctggac

SEQ ID NO: 6158479 - DNA, 15 bp, Homo sapiens
ctggtgacctcctgt

SEQ ID NO: 6158480 - DNA, 16 bp, Homo sapiens
ctggtgacctcctgtc

SEQ ID NO: 6158481 - DNA, 17 bp, Homo sapiens
ctggtgacctcctgtca

SEQ ID NO: 6158482 - DNA, 23 bp, Homo sapiens
ctggtgactcgggggctgtctca

SEQ ID NO: 6158483 - DNA, 13 bp, Homo sapiens
ctggtgactgcag

SEQ ID NO: 6158484 - DNA, 15 bp, Homo sapiens
ctggtgactttcctc

SEQ ID NO: 6158485 - DNA, 23 bp, Homo sapiens
ctggtgactttcctctttggtct

SEQ ID NO: 6158486 - DNA, 16 bp, Homo sapiens
ctggtgactttgggga

SEQ ID NO: 6158487 - DNA, 18 bp, Homo sapiens
ctggtgactttggggaca

SEQ ID NO: 6158488 - DNA, 20 bp, Homo sapiens
ctggtgactttggggacagg

SEQ ID NO: 6158489 - DNA, 15 bp, Homo sapiens
ctggtgagaaaatat

SEQ ID NO: 6158490 - DNA, 14 bp, Homo sapiens
ctggtgagaactga

SEQ ID NO: 6158491 - DNA, 20 bp, Homo sapiens
ctggtgagaccccgcactgc

SEQ ID NO: 6158492 - DNA, 22 bp, Homo sapiens
ctggtgagagaagaaaacattt

SEQ ID NO: 6158493 - DNA, 22 bp, Homo sapiens
ctggtgagagggccgggcagag

SEQ ID NO: 6158494 - DNA, 21 bp, Homo sapiens
ctggtgagatacccagagaga

SEQ ID NO: 6158495 - DNA, 13 bp, Homo sapiens
ctggtgagcatta

SEQ ID NO: 6158496 - DNA, 17 bp, Homo sapiens
ctggtgaggacaaggta

SEQ ID NO: 6158497 - DNA, 16 bp, Homo sapiens
ctggtgaggcccagcc

SEQ ID NO: 6158498 - DNA, 20 bp, Homo sapiens
ctggtgaggccggccctgcc

SEQ ID NO: 6158499 - DNA, 13 bp, Homo sapiens
ctggtgaggcctt

SEQ ID NO: 6158500 - DNA, 17 bp, Homo sapiens
ctggtgaggccttgctc

SEQ ID NO: 6158501 - DNA, 13 bp, Homo sapiens
ctggtgaggtggc

SEQ ID NO: 6158502 - DNA, 18 bp, Homo sapiens
ctggtgaggtggcccagg

SEQ ID NO: 6158503 - DNA, 19 bp, Homo sapiens
ctggtgagtaacttagaaa

SEQ ID NO: 6158504 - DNA, 24 bp, Homo sapiens
ctggtgagtcaccacttcagggct

SEQ ID NO: 6158505 - DNA, 18 bp, Homo sapiens
ctggtgagtgcaagagcc

SEQ ID NO: 6158506 - DNA, 15 bp, Homo sapiens
ctggtgatatatctc

SEQ ID NO: 6158507 - DNA, 21 bp, Homo sapiens
ctggtgatgcgcagttgctgt

SEQ ID NO: 6158508 - DNA, 19 bp, Homo sapiens
ctggtgatgttgaaatatg

SEQ ID NO: 6158509 - DNA, 22 bp, Homo sapiens
ctggtgatgttgaaatatgcat

SEQ ID NO: 6158510 - DNA, 17 bp, Homo sapiens
ctggtgcaaattcagaa

SEQ ID NO: 6158511 - DNA, 19 bp, Homo sapiens
ctggtgcacaggtttgttt

SEQ ID NO: 6158512 - DNA, 17 bp, Homo sapiens
ctggtgcacgcctgagc

SEQ ID NO: 6158513 - DNA, 19 bp, Homo sapiens
ctggtgcactggccccacc

SEQ ID NO: 6158514 - DNA, 19 bp, Homo sapiens
ctggtgcactttgtaaatt

SEQ ID NO: 6158515 - DNA, 23 bp, Homo sapiens
ctggtgcagaggtgagcagagga

SEQ ID NO: 6158516 - DNA, 13 bp, Homo sapiens
ctggtgcagggcc

SEQ ID NO: 6158517 - DNA, 21 bp, Homo sapiens
ctggtgcatgacaagtactgt

SEQ ID NO: 6158518 - DNA, 15 bp, Homo sapiens
ctggtgcatgttctt

SEQ ID NO: 6158519 - DNA, 16 bp, Homo sapiens
ctggtgcatgttcttt

SEQ ID NO: 6158520 - DNA, 15 bp, Homo sapiens
ctggtgcattacaga

SEQ ID NO: 6158521 - DNA, 16 bp, Homo sapiens
ctggtgcattctgttt

SEQ ID NO: 6158522 - DNA, 19 bp, Homo sapiens
ctggtgcattgctgtgtga

SEQ ID NO: 6158523 - DNA, 21 bp, Homo sapiens
ctggtgccaaatagccccaga

SEQ ID NO: 6158524 - DNA, 23 bp, Homo sapiens
ctggtgccaaatgaagattttta

SEQ ID NO: 6158525 - DNA, 21 bp, Homo sapiens
ctggtgccaatcctgtaggca

SEQ ID NO: 6158526 - DNA, 18 bp, Homo sapiens
ctggtgcccacagcaggg

SEQ ID NO: 6158527 - DNA, 19 bp, Homo sapiens
ctggtgcccaccagctggc

SEQ ID NO: 6158528 - DNA, 21 bp, Homo sapiens
ctggtgcccaccagctggctc

SEQ ID NO: 6158529 - DNA, 12 bp, Homo sapiens
ctggtgccccac

SEQ ID NO: 6158530 - DNA, 15 bp, Homo sapiens
ctggtgccccacagc

SEQ ID NO: 6158531 - DNA, 15 bp, Homo sapiens
ctggtgccccacctg

SEQ ID NO: 6158532 - DNA, 16 bp, Homo sapiens
ctggtgccccacctgc

SEQ ID NO: 6158533 - DNA, 21 bp, Homo sapiens
ctggtgccccacctgcctggt

SEQ ID NO: 6158534 - DNA, 22 bp, Homo sapiens
ctggtgcccccagacagctgct

SEQ ID NO: 6158535 - DNA, 12 bp, Homo sapiens
ctggtgcccctc

SEQ ID NO: 6158536 - DNA, 18 bp, Homo sapiens
ctggtgcccctcgccagc

SEQ ID NO: 6158537 - DNA, 24 bp, Homo sapiens
ctggtgcccctcgccagcttctcc

SEQ ID NO: 6158538 - DNA, 23 bp, Homo sapiens
ctggtgccctaacctctgagtca

SEQ ID NO: 6158539 - DNA, 23 bp, Homo sapiens
ctcttctggggcaggctgggcca

SEQ ID NO: 6158540 - DNA, 12 bp, Homo sapiens
ctcttctggtgt

SEQ ID NO: 6158541 - DNA, 22 bp, Homo sapiens
ctcttctgtattttttttttcc

SEQ ID NO: 6158542 - DNA, 16 bp, Homo sapiens
ctcttctgtcatcccg

SEQ ID NO: 6158543 - DNA, 13 bp, Homo sapiens
ctcttctgtccat

SEQ ID NO: 6158544 - DNA, 16 bp, Homo sapiens
ctcttctgtcccaagt

SEQ ID NO: 6158545 - DNA, 21 bp, Homo sapiens
ctcttctgtcccaagtctcca

SEQ ID NO: 6158546 - DNA, 23 bp, Homo sapiens
ctcttctgtgggtgacccaggtc

SEQ ID NO: 6158547 - DNA, 12 bp, Homo sapiens
ctcttctgtgtt

SEQ ID NO: 6158548 - DNA, 15 bp, Homo sapiens
ctcttctgttctcaa

SEQ ID NO: 6158549 - DNA, 13 bp, Homo sapiens
ctcttcttaatgt

SEQ ID NO: 6158550 - DNA, 22 bp, Homo sapiens
ctcttcttaatgtacatagtgc

SEQ ID NO: 6158551 - DNA, 16 bp, Homo sapiens
ctcttcttattaccca

SEQ ID NO: 6158552 - DNA, 20 bp, Homo sapiens
ctcttcttccaggtagctga

SEQ ID NO: 6158553 - DNA, 12 bp, Homo sapiens
ctcttcttcctc

SEQ ID NO: 6158554 - DNA, 12 bp, Homo sapiens
ctcttcttcctt

SEQ ID NO: 6158555 - DNA, 14 bp, Homo sapiens
ctcttcttctgaag

SEQ ID NO: 6158556 - DNA, 17 bp, Homo sapiens
ctcttcttcttcagaag

SEQ ID NO: 6158557 - DNA, 19 bp, Homo sapiens
ctcttcttctttccttcca

SEQ ID NO: 6158558 - DNA, 14 bp, Homo sapiens
ctcttcttctttct

SEQ ID NO: 6158559 - DNA, 23 bp, Homo sapiens
ctcttcttgaacactcatgctga

SEQ ID NO: 6158560 - DNA, 22 bp, Homo sapiens
ctcttctttaaagggatggcaa

SEQ ID NO: 6158561 - DNA, 12 bp, Homo sapiens
ctcttctttaga

SEQ ID NO: 6158562 - DNA, 24 bp, Homo sapiens
ctcttctttatactgtaatttagt

SEQ ID NO: 6158563 - DNA, 17 bp, Homo sapiens
ctcttctttattgcact

SEQ ID NO: 6158564 - DNA, 21 bp, Homo sapiens
ctcttctttattgcactagga

SEQ ID NO: 6158565 - DNA, 22 bp, Homo sapiens
ctcttctttcagacttgccatg

SEQ ID NO: 6158566 - DNA, 19 bp, Homo sapiens
ctcttctttcatttcttct

SEQ ID NO: 6158567 - DNA, 15 bp, Homo sapiens
ctcttctttccattc

SEQ ID NO: 6158568 - DNA, 14 bp, Homo sapiens
ctcttctttcccaa

SEQ ID NO: 6158569 - DNA, 15 bp, Homo sapiens
ctcttctttcccaaa

SEQ ID NO: 6158570 - DNA, 21 bp, Homo sapiens
ctcttctttgggatgctattt

SEQ ID NO: 6158571 - DNA, 14 bp, Homo sapiens
ctcttgaaaagttc

SEQ ID NO: 6158572 - DNA, 21 bp, Homo sapiens
ctcttgaaaagttcagggacc

SEQ ID NO: 6158573 - DNA, 16 bp, Homo sapiens
ctcttgaaacctgatg

SEQ ID NO: 6158574 - DNA, 12 bp, Homo sapiens
ctcttgaacatt

SEQ ID NO: 6158575 - DNA, 22 bp, Homo sapiens
ctcttgaaccccaaatgctctc

SEQ ID NO: 6158576 - DNA, 15 bp, Homo sapiens
ctcttgaactcctga

SEQ ID NO: 6158577 - DNA, 20 bp, Homo sapiens
ctcttgaagatgctgaaaca

SEQ ID NO: 6158578 - DNA, 16 bp, Homo sapiens
ctcttgaagtccagga

SEQ ID NO: 6158579 - DNA, 15 bp, Homo sapiens
ctcttgaatttttga

SEQ ID NO: 6158580 - DNA, 15 bp, Homo sapiens
ctcttgacagtctga

SEQ ID NO: 6158581 - DNA, 14 bp, Homo sapiens
ctcttgaccaggct

SEQ ID NO: 6158582 - DNA, 13 bp, Homo sapiens
ctcttgaccctgc

SEQ ID NO: 6158583 - DNA, 14 bp, Homo sapiens
ctcttgaccctgca

SEQ ID NO: 6158584 - DNA, 21 bp, Homo sapiens
ctcttgaccctgtcacttgct

SEQ ID NO: 6158585 - DNA, 15 bp, Homo sapiens
ctcttgactggctca

SEQ ID NO: 6158586 - DNA, 22 bp, Homo sapiens
ctcttgacttagacctatactg

SEQ ID NO: 6158587 - DNA, 17 bp, Homo sapiens
ctcttgagagctcaggc

SEQ ID NO: 6158588 - DNA, 15 bp, Homo sapiens
ctcttgagcctggga

SEQ ID NO: 6158589 - DNA, 14 bp, Homo sapiens
ctcttgagctggcc

SEQ ID NO: 6158590 - DNA, 15 bp, Homo sapiens
ctcttgagctggcct

SEQ ID NO: 6158591 - DNA, 16 bp, Homo sapiens
ctcttgagctggcctc

SEQ ID NO: 6158592 - DNA, 17 bp, Homo sapiens
ctcttgaggccaggagt

SEQ ID NO: 6158593 - DNA, 17 bp, Homo sapiens
ctcttgagttcctctgc

SEQ ID NO: 6158594 - DNA, 13 bp, Homo sapiens
ctcttgagttgtt

SEQ ID NO: 6158595 - DNA, 23 bp, Homo sapiens
ctcttgagtttgtcgctcatgtg

SEQ ID NO: 6158596 - DNA, 15 bp, Homo sapiens
ctcttgataaaggag

SEQ ID NO: 6158597 - DNA, 19 bp, Homo sapiens
ctcttgatacccccctctg

SEQ ID NO: 6158598 - DNA, 20 bp, Homo sapiens
ctcttgatgccaccttcaga

SEQ ID NO: 6158599 - DNA, 15 bp, Homo sapiens
ctcttgattataaat

SEQ ID NO: 6158600 - DNA, 17 bp, Homo sapiens
ctcttgattataaatgt

SEQ ID NO: 6158601 - DNA, 17 bp, Homo sapiens
ctcttgatttgggtgga

SEQ ID NO: 6158602 - DNA, 12 bp, Homo sapiens
ctcttgcaatgc

SEQ ID NO: 6158603 - DNA, 20 bp, Homo sapiens
ctcttgcaccaaattatctt

SEQ ID NO: 6158604 - DNA, 19 bp, Homo sapiens
ctcttgcacccgcctctcc

SEQ ID NO: 6158605 - DNA, 20 bp, Homo sapiens
ctcttgcacccgcctctccc

SEQ ID NO: 6158606 - DNA, 21 bp, Homo sapiens
ctcttgcacccgcctctcccg

SEQ ID NO: 6158607 - DNA, 15 bp, Homo sapiens
ctcttgcagagaagc

SEQ ID NO: 6158608 - DNA, 17 bp, Homo sapiens
ctcttgcagagaagcct

SEQ ID NO: 6158609 - DNA, 17 bp, Homo sapiens
ctcttgcaggctgagtc

SEQ ID NO: 6158610 - DNA, 21 bp, Homo sapiens
ctcttgcatcctcctcccaac

SEQ ID NO: 6158611 - DNA, 18 bp, Homo sapiens
ctcttgcatctgggccag

SEQ ID NO: 6158612 - DNA, 17 bp, Homo sapiens
ctcttgccacatcttga

SEQ ID NO: 6158613 - DNA, 16 bp, Homo sapiens
ctcttgccactgcctc

SEQ ID NO: 6158614 - DNA, 20 bp, Homo sapiens
ctcttgccactgcctcttcc

SEQ ID NO: 6158615 - DNA, 16 bp, Homo sapiens
ctcttgccagcctcct

SEQ ID NO: 6158616 - DNA, 19 bp, Homo sapiens
ctcttgccagcctccttgc

SEQ ID NO: 6158617 - DNA, 13 bp, Homo sapiens
ctcttgccagctc

SEQ ID NO: 6158618 - DNA, 19 bp, Homo sapiens
ctcttgccatcctgatgga

SEQ ID NO: 6158619 - DNA, 18 bp, Homo sapiens
ctcttgccccaaatcaca

SEQ ID NO: 6158620 - DNA, 19 bp, Homo sapiens
ctcttgccccaacccccag

SEQ ID NO: 6158621 - DNA, 16 bp, Homo sapiens
ctcttgccccccaccc

SEQ ID NO: 6158622 - DNA, 19 bp, Homo sapiens
ctcttgccccccaccccag

SEQ ID NO: 6158623 - DNA, 14 bp, Homo sapiens
ctcttgccccttgt

SEQ ID NO: 6158624 - DNA, 17 bp, Homo sapiens
ctcttgccccttgtcct

SEQ ID NO: 6158625 - DNA, 18 bp, Homo sapiens
ctcttgcccgtcggccct

SEQ ID NO: 6158626 - DNA, 14 bp, Homo sapiens
ctcttgcccttccc

SEQ ID NO: 6158627 - DNA, 15 bp, Homo sapiens
ctcttgcccttccct

SEQ ID NO: 6158628 - DNA, 20 bp, Homo sapiens
ctcttgcccttccctgtccc

SEQ ID NO: 6158629 - DNA, 21 bp, Homo sapiens
ctcttgcccttccctgtccct

SEQ ID NO: 6158630 - DNA, 18 bp, Homo sapiens
ctcttgcctcaacctccc

SEQ ID NO: 6158631 - DNA, 18 bp, Homo sapiens
ctcttgcctgccactgtg

SEQ ID NO: 6158632 - DNA, 12 bp, Homo sapiens
ctcttgcctgta

SEQ ID NO: 6158633 - DNA, 18 bp, Homo sapiens
ctcttgcctttccacctg

SEQ ID NO: 6158634 - DNA, 17 bp, Homo sapiens
ctcttgcgggcctggac

SEQ ID NO: 6158635 - DNA, 18 bp, Homo sapiens
ctcttgcgtgtcaatttc

SEQ ID NO: 6158636 - DNA, 21 bp, Homo sapiens
ctcttgctaatcagtgtctca

SEQ ID NO: 6158637 - DNA, 22 bp, Homo sapiens
ctcttgctaatcagtgtctcac

SEQ ID NO: 6158638 - DNA, 16 bp, Homo sapiens
ctcttgctattggaat

SEQ ID NO: 6158639 - DNA, 13 bp, Homo sapiens
ctcttgctcactc

SEQ ID NO: 6158640 - DNA, 15 bp, Homo sapiens
ctcttgctcagagct

SEQ ID NO: 6158641 - DNA, 12 bp, Homo sapiens
ctcttgctctcg

SEQ ID NO: 6158642 - DNA, 15 bp, Homo sapiens
ctcttgctctcgacc

SEQ ID NO: 6158643 - DNA, 14 bp, Homo sapiens
ctcttgctctcttg

SEQ ID NO: 6158644 - DNA, 16 bp, Homo sapiens
ctcttgctgaaagcca

SEQ ID NO: 6158645 - DNA, 20 bp, Homo sapiens
ctcttgctgtttaccgccca

SEQ ID NO: 6158646 - DNA, 13 bp, Homo sapiens
ctcttgcttgtca

SEQ ID NO: 6158647 - DNA, 16 bp, Homo sapiens
ctcttgctttatacta

SEQ ID NO: 6158648 - DNA, 22 bp, Homo sapiens
ctcttgctttggtcttcttcca

SEQ ID NO: 6158649 - DNA, 18 bp, Homo sapiens
ctcttggaaaataagaca

SEQ ID NO: 6158650 - DNA, 20 bp, Homo sapiens
ctcttggaaatgttaagaaa

SEQ ID NO: 6158651 - DNA, 19 bp, Homo sapiens
ctcttggacaacagctctc

SEQ ID NO: 6158652 - DNA, 20 bp, Homo sapiens
ctcttggacaacagctctcg

SEQ ID NO: 6158653 - DNA, 15 bp, Homo sapiens
ctcttggacccacct

SEQ ID NO: 6158654 - DNA, 12 bp, Homo sapiens
ctcttggacctc

SEQ ID NO: 6158655 - DNA, 20 bp, Homo sapiens
ctcttggactccctccccac

SEQ ID NO: 6158656 - DNA, 13 bp, Homo sapiens
ctcttggagaagt

SEQ ID NO: 6158657 - DNA, 15 bp, Homo sapiens
ctcttggagaagtct

SEQ ID NO: 6158658 - DNA, 21 bp, Homo sapiens
ctcttggagaagtctcagcta

SEQ ID NO: 6158659 - DNA, 17 bp, Homo sapiens
ctcttggagcctctttt

SEQ ID NO: 6158660 - DNA, 23 bp, Homo sapiens
ctcttggagcctctttttccttc

SEQ ID NO: 6158661 - DNA, 23 bp, Homo sapiens
ctcttggagctgagatgagcccc

SEQ ID NO: 6158662 - DNA, 15 bp, Homo sapiens
ctcttggagctgtga

SEQ ID NO: 6158663 - DNA, 17 bp, Homo sapiens
ctcttggataccagctc

SEQ ID NO: 6158664 - DNA, 21 bp, Homo sapiens
ctcttggataccagctcaggg

SEQ ID NO: 6158665 - DNA, 22 bp, Homo sapiens
ctcttggatgggacatttttgt

SEQ ID NO: 6158666 - DNA, 20 bp, Homo sapiens
ctcttggcaagatgtttctt

SEQ ID NO: 6158667 - DNA, 17 bp, Homo sapiens
ctcttggccagagctga

SEQ ID NO: 6158668 - DNA, 22 bp, Homo sapiens
ctcttggccatccttctgtgta

SEQ ID NO: 6158669 - DNA, 13 bp, Homo sapiens
ctcttggcctctg

SEQ ID NO: 6158670 - DNA, 14 bp, Homo sapiens
ctcttggcctctgc

SEQ ID NO: 6158671 - DNA, 18 bp, Homo sapiens
ctcttggcctctgctttc

SEQ ID NO: 6158672 - DNA, 16 bp, Homo sapiens
ctcttggcctttgcat

SEQ ID NO: 6158673 - DNA, 21 bp, Homo sapiens
ctcttggctatttctgtgtcc

SEQ ID NO: 6158674 - DNA, 17 bp, Homo sapiens
ctcttggctgacccctc

SEQ ID NO: 6158675 - DNA, 15 bp, Homo sapiens
ctcttggctggaccc

SEQ ID NO: 6158676 - DNA, 20 bp, Homo sapiens
ctcttggctggacccagcca

SEQ ID NO: 6158677 - DNA, 18 bp, Homo sapiens
ctcttggcttccagaagg

SEQ ID NO: 6158678 - DNA, 12 bp, Homo sapiens
ctcttggcttct

SEQ ID NO: 6158679 - DNA, 17 bp, Homo sapiens
ctcttggcttctcagcc

SEQ ID NO: 6158680 - DNA, 19 bp, Homo sapiens
ctcttggcttctcagcccc

SEQ ID NO: 6158681 - DNA, 23 bp, Homo sapiens
ctcttggctttgtcacttttcct

SEQ ID NO: 6158682 - DNA, 14 bp, Homo sapiens
ctcttggctttgtt

SEQ ID NO: 6158683 - DNA, 14 bp, Homo sapiens
ctcttgggaagcag

SEQ ID NO: 6158684 - DNA, 19 bp, Homo sapiens
ctcttgggaagtgtgttta

SEQ ID NO: 6158685 - DNA, 20 bp, Homo sapiens
ctcttgggagacgtccaccc

SEQ ID NO: 6158686 - DNA, 22 bp, Homo sapiens
ctcttgggcaatattctctgta

SEQ ID NO: 6158687 - DNA, 15 bp, Homo sapiens
ctcttgggccaagcc

SEQ ID NO: 6158688 - DNA, 20 bp, Homo sapiens
ctcttgggccaagccagctg

SEQ ID NO: 6158689 - DNA, 21 bp, Homo sapiens
ctcttgggccaagccagctgc

SEQ ID NO: 6158690 - DNA, 23 bp, Homo sapiens
ctcttgggcctgacctccagtcc

SEQ ID NO: 6158691 - DNA, 16 bp, Homo sapiens
ctcttgggctgagact

SEQ ID NO: 6158692 - DNA, 17 bp, Homo sapiens
ctcttgggctgagactg

SEQ ID NO: 6158693 - DNA, 18 bp, Homo sapiens
ctcttgggctgagactgg

SEQ ID NO: 6158694 - DNA, 20 bp, Homo sapiens
ctcttggggaaggggacaga

SEQ ID NO: 6158695 - DNA, 17 bp, Homo sapiens
ctcttggggaaggggca

SEQ ID NO: 6158696 - DNA, 21 bp, Homo sapiens
ctcttggggacatgggtcgcc

SEQ ID NO: 6158697 - DNA, 14 bp, Homo sapiens
ctcttggggaccaa

SEQ ID NO: 6158698 - DNA, 16 bp, Homo sapiens
ctcttgggtcagagaa

SEQ ID NO: 6158699 - DNA, 15 bp, Homo sapiens
ctcttgggtgggaca

SEQ ID NO: 6158700 - DNA, 17 bp, Homo sapiens
ctcttggtccctggaag

SEQ ID NO: 6158701 - DNA, 13 bp, Homo sapiens
ctcttggtcctgc

SEQ ID NO: 6158702 - DNA, 18 bp, Homo sapiens
ctcttggtcctgctgcag

SEQ ID NO: 6158703 - DNA, 19 bp, Homo sapiens
ctcttggtcctgctgcagt

SEQ ID NO: 6158704 - DNA, 21 bp, Homo sapiens
ctcttggtctctttctttcca

SEQ ID NO: 6158705 - DNA, 21 bp, Homo sapiens
ctcttggtgggtgtggccagc

SEQ ID NO: 6158706 - DNA, 13 bp, Homo sapiens
ctcttggtgtctg

SEQ ID NO: 6158707 - DNA, 21 bp, Homo sapiens
ctcttggtgtgattgcacaga

SEQ ID NO: 6158708 - DNA, 15 bp, Homo sapiens
ctcttgtaaaaagag

SEQ ID NO: 6158709 - DNA, 14 bp, Homo sapiens
ctcttgtaaataaa

SEQ ID NO: 6158710 - DNA, 23 bp, Homo sapiens
ctcttgtaagattttgaaaacta

SEQ ID NO: 6158711 - DNA, 21 bp, Homo sapiens
ctcttgtaagtcatctactta

SEQ ID NO: 6158712 - DNA, 23 bp, Homo sapiens
ctcttgtacagttaactctccca

SEQ ID NO: 6158713 - DNA, 16 bp, Homo sapiens
ctcttgtaccagccca

SEQ ID NO: 6158714 - DNA, 15 bp, Homo sapiens
ctcttgtatacttgt

SEQ ID NO: 6158715 - DNA, 21 bp, Homo sapiens
ctcttgtatccctagtgctcc

SEQ ID NO: 6158716 - DNA, 22 bp, Homo sapiens
ctcttgtattgctccattttct

SEQ ID NO: 6158717 - DNA, 15 bp, Homo sapiens
ctggtgccctgagac

SEQ ID NO: 6158718 - DNA, 17 bp, Homo sapiens
ctggtgccctggatgcc

SEQ ID NO: 6158719 - DNA, 19 bp, Homo sapiens
ctggtgccctggcccagcc

SEQ ID NO: 6158720 - DNA, 13 bp, Homo sapiens
ctggtgccctggt

SEQ ID NO: 6158721 - DNA, 20 bp, Homo sapiens
ctggtgccgaagtgtttctg

SEQ ID NO: 6158722 - DNA, 17 bp, Homo sapiens
ctggtgcctatttattc

SEQ ID NO: 6158723 - DNA, 19 bp, Homo sapiens
ctggtgcctctcacttcgt

SEQ ID NO: 6158724 - DNA, 13 bp, Homo sapiens
ctggtgcctctgt

SEQ ID NO: 6158725 - DNA, 15 bp, Homo sapiens
ctggtgcctctgtgc

SEQ ID NO: 6158726 - DNA, 21 bp, Homo sapiens
ctggtgcctgagcccctcaga

SEQ ID NO: 6158727 - DNA, 15 bp, Homo sapiens
ctggtgcctgcaggc

SEQ ID NO: 6158728 - DNA, 15 bp, Homo sapiens
ctggtgcctggctct

SEQ ID NO: 6158729 - DNA, 17 bp, Homo sapiens
ctggtgcgaccccccac

SEQ ID NO: 6158730 - DNA, 19 bp, Homo sapiens
ctggtgcgaccccccaccc

SEQ ID NO: 6158731 - DNA, 21 bp, Homo sapiens
ctggtgcgaccccccaccccc

SEQ ID NO: 6158732 - DNA, 15 bp, Homo sapiens
ctggtgcggctggcc

SEQ ID NO: 6158733 - DNA, 15 bp, Homo sapiens
ctggtgcgggcctgg

SEQ ID NO: 6158734 - DNA, 18 bp, Homo sapiens
ctggtgcgggcctggccc

SEQ ID NO: 6158735 - DNA, 17 bp, Homo sapiens
ctggtgctactccatgc

SEQ ID NO: 6158736 - DNA, 13 bp, Homo sapiens
ctggtgctactgt

SEQ ID NO: 6158737 - DNA, 19 bp, Homo sapiens
ctggtgctataggctggag

SEQ ID NO: 6158738 - DNA, 21 bp, Homo sapiens
ctggtgctataggctggagaa

SEQ ID NO: 6158739 - DNA, 14 bp, Homo sapiens
ctggtgctcctgcc

SEQ ID NO: 6158740 - DNA, 18 bp, Homo sapiens
ctggtgctcctgcccagc

SEQ ID NO: 6158741 - DNA, 20 bp, Homo sapiens
ctggtgctgccacacttcag

SEQ ID NO: 6158742 - DNA, 22 bp, Homo sapiens
ctggtgctgccacacttcaggc

SEQ ID NO: 6158743 - DNA, 14 bp, Homo sapiens
ctggtgctgccgag

SEQ ID NO: 6158744 - DNA, 16 bp, Homo sapiens
ctggtgctgccgaggg

SEQ ID NO: 6158745 - DNA, 21 bp, Homo sapiens
ctggtgctgccgagggctggc

SEQ ID NO: 6158746 - DNA, 19 bp, Homo sapiens
ctggtgctgcctctacctg

SEQ ID NO: 6158747 - DNA, 14 bp, Homo sapiens
ctggtgctgctgct

SEQ ID NO: 6158748 - DNA, 14 bp, Homo sapiens
ctggtgctggaggt

SEQ ID NO: 6158749 - DNA, 12 bp, Homo sapiens
ctggtgctgtgg

SEQ ID NO: 6158750 - DNA, 16 bp, Homo sapiens
ctggtgcttagttttt

SEQ ID NO: 6158751 - DNA, 12 bp, Homo sapiens
ctggtgctttag

SEQ ID NO: 6158752 - DNA, 21 bp, Homo sapiens
ctggtggaaagcgattcactg

SEQ ID NO: 6158753 - DNA, 22 bp, Homo sapiens
ctggtggaaagcgattcactgt

SEQ ID NO: 6158754 - DNA, 21 bp, Homo sapiens
ctggtggacagacccagggtg

SEQ ID NO: 6158755 - DNA, 17 bp, Homo sapiens
ctggtggacagtcctgg

SEQ ID NO: 6158756 - DNA, 16 bp, Homo sapiens
ctggtggaccacaggc

SEQ ID NO: 6158757 - DNA, 21 bp, Homo sapiens
ctggtggagaaagcactgacc

SEQ ID NO: 6158758 - DNA, 21 bp, Homo sapiens
ctggtggagaactctggcttt

SEQ ID NO: 6158759 - DNA, 16 bp, Homo sapiens
ctggtggaggaagggc

SEQ ID NO: 6158760 - DNA, 19 bp, Homo sapiens
ctggtggaggaagggctgg

SEQ ID NO: 6158761 - DNA, 16 bp, Homo sapiens
ctggtggaggagctga

SEQ ID NO: 6158762 - DNA, 19 bp, Homo sapiens
ctggtggaggagctgaggg

SEQ ID NO: 6158763 - DNA, 22 bp, Homo sapiens
ctggtggaggcttcttgcccag

SEQ ID NO: 6158764 - DNA, 15 bp, Homo sapiens
ctggtggattgttct

SEQ ID NO: 6158765 - DNA, 18 bp, Homo sapiens
ctggtggattgttctagt

SEQ ID NO: 6158766 - DNA, 18 bp, Homo sapiens
ctggtggcaccagatgca

SEQ ID NO: 6158767 - DNA, 19 bp, Homo sapiens
ctggtggcaccagatgcaa

SEQ ID NO: 6158768 - DNA, 22 bp, Homo sapiens
ctggtggcaccagatgcaacct

SEQ ID NO: 6158769 - DNA, 21 bp, Homo sapiens
ctggtggcagctcacctctcc

SEQ ID NO: 6158770 - DNA, 23 bp, Homo sapiens
ctggtggcagctcacctctccct

SEQ ID NO: 6158771 - DNA, 14 bp, Homo sapiens
ctggtggcagctgc

SEQ ID NO: 6158772 - DNA, 15 bp, Homo sapiens
ctggtggcagctgcg

SEQ ID NO: 6158773 - DNA, 14 bp, Homo sapiens
ctggtggcagtggg

SEQ ID NO: 6158774 - DNA, 19 bp, Homo sapiens
ctggtggcagtgggagctg

SEQ ID NO: 6158775 - DNA, 21 bp, Homo sapiens
ctggtggccaagcctgccccg

SEQ ID NO: 6158776 - DNA, 22 bp, Homo sapiens
ctggtggccactgagctggctg

SEQ ID NO: 6158777 - DNA, 21 bp, Homo sapiens
ctggtggccatgtcgcctgcc

SEQ ID NO: 6158778 - DNA, 11 bp, Homo sapiens
ctggtggccca

SEQ ID NO: 6158779 - DNA, 14 bp, Homo sapiens
ctggtggcccagct

SEQ ID NO: 6158780 - DNA, 13 bp, Homo sapiens
ctggtggcccagg

SEQ ID NO: 6158781 - DNA, 14 bp, Homo sapiens
ctggtggcccagga

SEQ ID NO: 6158782 - DNA, 22 bp, Homo sapiens
ctggtggccccgtttctggtgg

SEQ ID NO: 6158783 - DNA, 23 bp, Homo sapiens
ctggtggccccttctatgcccag

SEQ ID NO: 6158784 - DNA, 21 bp, Homo sapiens
ctggtggcccgacagcctggc

SEQ ID NO: 6158785 - DNA, 18 bp, Homo sapiens
ctggtggccctctcccct

SEQ ID NO: 6158786 - DNA, 20 bp, Homo sapiens
ctggtggccctctcccctgc

SEQ ID NO: 6158787 - DNA, 17 bp, Homo sapiens
ctggtggccctgtgcct

SEQ ID NO: 6158788 - DNA, 20 bp, Homo sapiens
ctggtggccctgtgcctggg

SEQ ID NO: 6158789 - DNA, 15 bp, Homo sapiens
ctggtggcctgcccc

SEQ ID NO: 6158790 - DNA, 19 bp, Homo sapiens
ctggtggcctgccccagct

SEQ ID NO: 6158791 - DNA, 20 bp, Homo sapiens
ctggtggccttctgctgccc

SEQ ID NO: 6158792 - DNA, 17 bp, Homo sapiens
ctggtggctcctcctag

SEQ ID NO: 6158793 - DNA, 14 bp, Homo sapiens
ctggtggctgccag

SEQ ID NO: 6158794 - DNA, 12 bp, Homo sapiens
ctggtggctgga

SEQ ID NO: 6158795 - DNA, 14 bp, Homo sapiens
ctggtggctggagg

SEQ ID NO: 6158796 - DNA, 16 bp, Homo sapiens
ctggtggctggaggca

SEQ ID NO: 6158797 - DNA, 13 bp, Homo sapiens
ctggtggctgggc

SEQ ID NO: 6158798 - DNA, 14 bp, Homo sapiens
ctggtggctgggct

SEQ ID NO: 6158799 - DNA, 17 bp, Homo sapiens
ctggtggcttaagtgag

SEQ ID NO: 6158800 - DNA, 19 bp, Homo sapiens
ctggtgggaaggccggcag

SEQ ID NO: 6158801 - DNA, 22 bp, Homo sapiens
ctggtgggacaacaaagaggac

SEQ ID NO: 6158802 - DNA, 18 bp, Homo sapiens
ctggtgggacagtggtga

SEQ ID NO: 6158803 - DNA, 15 bp, Homo sapiens
ctggtgggagcacct

SEQ ID NO: 6158804 - DNA, 18 bp, Homo sapiens
ctggtgggagcacctgcc

SEQ ID NO: 6158805 - DNA, 14 bp, Homo sapiens
ctggtgggaggccc

SEQ ID NO: 6158806 - DNA, 22 bp, Homo sapiens
ctggtgggaggcccggggccct

SEQ ID NO: 6158807 - DNA, 22 bp, Homo sapiens
ctggtgggaggggcgcccacct

SEQ ID NO: 6158808 - DNA, 19 bp, Homo sapiens
ctggtgggataggagggtg

SEQ ID NO: 6158809 - DNA, 12 bp, Homo sapiens
ctggtgggcctc

SEQ ID NO: 6158810 - DNA, 13 bp, Homo sapiens
ctggtgggcctcg

SEQ ID NO: 6158811 - DNA, 20 bp, Homo sapiens
ctggtgggctggccgctgtg

SEQ ID NO: 6158812 - DNA, 21 bp, Homo sapiens
ctggtggggataggccagccg

SEQ ID NO: 6158813 - DNA, 22 bp, Homo sapiens
ctggtggggataggccagccgc

SEQ ID NO: 6158814 - DNA, 17 bp, Homo sapiens
ctggtggggcagaaagg

SEQ ID NO: 6158815 - DNA, 14 bp, Homo sapiens
ctggtggggcagct

SEQ ID NO: 6158816 - DNA, 15 bp, Homo sapiens
ctggtggggcagctc

SEQ ID NO: 6158817 - DNA, 16 bp, Homo sapiens
ctggtggggctgagcc

SEQ ID NO: 6158818 - DNA, 17 bp, Homo sapiens
ctggtggggctgagcct

SEQ ID NO: 6158819 - DNA, 19 bp, Homo sapiens
ctggtggggctgagcctga

SEQ ID NO: 6158820 - DNA, 21 bp, Homo sapiens
ctggtggggctgtcctgctgc

SEQ ID NO: 6158821 - DNA, 17 bp, Homo sapiens
ctggtgggtcagcccag

SEQ ID NO: 6158822 - DNA, 16 bp, Homo sapiens
ctggtgggtccagggg

SEQ ID NO: 6158823 - DNA, 17 bp, Homo sapiens
ctggtgggtccaggggc

SEQ ID NO: 6158824 - DNA, 22 bp, Homo sapiens
ctggtgggtccaggggcccctc

SEQ ID NO: 6158825 - DNA, 16 bp, Homo sapiens
ctggtgggtctgagct

SEQ ID NO: 6158826 - DNA, 22 bp, Homo sapiens
ctggtgggtgaaagaaatcatg

SEQ ID NO: 6158827 - DNA, 21 bp, Homo sapiens
ctggtgggtgcctaggcctgg

SEQ ID NO: 6158828 - DNA, 15 bp, Homo sapiens
ctggtgggtggagtc

SEQ ID NO: 6158829 - DNA, 22 bp, Homo sapiens
ctggtgggtggagtcaggcttc

SEQ ID NO: 6158830 - DNA, 17 bp, Homo sapiens
ctggtgggtggcccaga

SEQ ID NO: 6158831 - DNA, 19 bp, Homo sapiens
ctggtgggtggtgtcctga

SEQ ID NO: 6158832 - DNA, 22 bp, Homo sapiens
ctggtgggtggtgtcctgaagc

SEQ ID NO: 6158833 - DNA, 15 bp, Homo sapiens
ctggtggtattttca

SEQ ID NO: 6158834 - DNA, 19 bp, Homo sapiens
ctggtggtcacaggctgtg

SEQ ID NO: 6158835 - DNA, 16 bp, Homo sapiens
ctggtggtcagatgca

SEQ ID NO: 6158836 - DNA, 16 bp, Homo sapiens
ctggtggtcagcccta

SEQ ID NO: 6158837 - DNA, 21 bp, Homo sapiens
ctggtggtgcagccttcccct

SEQ ID NO: 6158838 - DNA, 18 bp, Homo sapiens
ctggtggttaaggccagg

SEQ ID NO: 6158839 - DNA, 16 bp, Homo sapiens
ctggtggttatttaac

SEQ ID NO: 6158840 - DNA, 20 bp, Homo sapiens
ctggtggttcactcttggag

SEQ ID NO: 6158841 - DNA, 21 bp, Homo sapiens
ctggtggttcactcttggagc

SEQ ID NO: 6158842 - DNA, 15 bp, Homo sapiens
ctggtggttgctgtt

SEQ ID NO: 6158843 - DNA, 21 bp, Homo sapiens
ctggtggtttcacggtgccag

SEQ ID NO: 6158844 - DNA, 22 bp, Homo sapiens
ctggtggtttgatcatttctgc

SEQ ID NO: 6158845 - DNA, 18 bp, Homo sapiens
ctggtggtttgattgttt

SEQ ID NO: 6158846 - DNA, 23 bp, Homo sapiens
ctggtggtttgattgtttacagg

SEQ ID NO: 6158847 - DNA, 20 bp, Homo sapiens
ctggtggttttcagagcagg

SEQ ID NO: 6158848 - DNA, 17 bp, Homo sapiens
ctggtggtttttgctct

SEQ ID NO: 6158849 - DNA, 23 bp, Homo sapiens
ctggtgtaaaaaacaaacatttg

SEQ ID NO: 6158850 - DNA, 17 bp, Homo sapiens
ctggtgtaatctcaatg

SEQ ID NO: 6158851 - DNA, 20 bp, Homo sapiens
ctggtgtaatctcaatgcaa

SEQ ID NO: 6158852 - DNA, 19 bp, Homo sapiens
ctggtgtagctacagagaa

SEQ ID NO: 6158853 - DNA, 23 bp, Homo sapiens
ctggtgtagctacagagaaacca

SEQ ID NO: 6158854 - DNA, 15 bp, Homo sapiens
ctggtgtaggaagtt

SEQ ID NO: 6158855 - DNA, 20 bp, Homo sapiens
ctggtgtaggaagttttttc

SEQ ID NO: 6158856 - DNA, 16 bp, Homo sapiens
ctggtgtcaccccaga

SEQ ID NO: 6158857 - DNA, 17 bp, Homo sapiens
ctggtgtcagcccctct

SEQ ID NO: 6158858 - DNA, 20 bp, Homo sapiens
ctggtgtcagcccctcttcc

SEQ ID NO: 6158859 - DNA, 20 bp, Homo sapiens
ctggtgtcatggtgaccacc

SEQ ID NO: 6158860 - DNA, 22 bp, Homo sapiens
ctggtgtccagcatggatgaaa

SEQ ID NO: 6158861 - DNA, 22 bp, Homo sapiens
ctggtgtccccttcccctgctg

SEQ ID NO: 6158862 - DNA, 18 bp, Homo sapiens
ctggtgtccctgcctggc

SEQ ID NO: 6158863 - DNA, 19 bp, Homo sapiens
ctggtgtccctgcctggcc

SEQ ID NO: 6158864 - DNA, 14 bp, Homo sapiens
ctggtgtcctgacc

SEQ ID NO: 6158865 - DNA, 13 bp, Homo sapiens
ctggtgtctagtt

SEQ ID NO: 6158866 - DNA, 18 bp, Homo sapiens
ctggtgtctagtttgcat

SEQ ID NO: 6158867 - DNA, 23 bp, Homo sapiens
ctggtgtctgctttctccattgt

SEQ ID NO: 6158868 - DNA, 18 bp, Homo sapiens
ctggtgtcttgagaccag

SEQ ID NO: 6158869 - DNA, 17 bp, Homo sapiens
ctggtgtgaactcaccc

SEQ ID NO: 6158870 - DNA, 23 bp, Homo sapiens
ctggtgtgaggaccatgctgtga

SEQ ID NO: 6158871 - DNA, 21 bp, Homo sapiens
ctggtgtgggtaaagggacag

SEQ ID NO: 6158872 - DNA, 19 bp, Homo sapiens
ctggtgtggtacagagaag

SEQ ID NO: 6158873 - DNA, 15 bp, Homo sapiens
ctggtgttaacagaa

SEQ ID NO: 6158874 - DNA, 23 bp, Homo sapiens
ctggtgttaatgagtatatgtaa

SEQ ID NO: 6158875 - DNA, 22 bp, Homo sapiens
ctggtgtttatgtgaacattcc

SEQ ID NO: 6158876 - DNA, 12 bp, Homo sapiens
ctggtgtttatt

SEQ ID NO: 6158877 - DNA, 19 bp, Homo sapiens
ctggtgtttcagcatacat

SEQ ID NO: 6158878 - DNA, 22 bp, Homo sapiens
ctggtgtttctagcactggcct

SEQ ID NO: 6158879 - DNA, 13 bp, Homo sapiens
ctggtgtttcttg

SEQ ID NO: 6158880 - DNA, 14 bp, Homo sapiens
ctggtgtttgtcat

SEQ ID NO: 6158881 - DNA, 18 bp, Homo sapiens
ctggtgttttatttccta

SEQ ID NO: 6158882 - DNA, 15 bp, Homo sapiens
ctggtgtttttctct

SEQ ID NO: 6158883 - DNA, 16 bp, Homo sapiens
ctggtgtttttctctc

SEQ ID NO: 6158884 - DNA, 20 bp, Homo sapiens
ctggtgtttttctctctgga

SEQ ID NO: 6158885 - DNA, 22 bp, Homo sapiens
ctggtgtttttctctctggacc

SEQ ID NO: 6158886 - DNA, 19 bp, Homo sapiens
ctggttaaaaaacaaatgt

SEQ ID NO: 6158887 - DNA, 12 bp, Homo sapiens
ctggttaaatta

SEQ ID NO: 6158888 - DNA, 22 bp, Homo sapiens
ctggttaaccttgaagtgactg

SEQ ID NO: 6158889 - DNA, 23 bp, Homo sapiens
ctggttaatatttataggtcact

SEQ ID NO: 6158890 - DNA, 15 bp, Homo sapiens
ctggttaatggcagc

SEQ ID NO: 6158891 - DNA, 22 bp, Homo sapiens
ctggttaattccataaccccag

SEQ ID NO: 6158892 - DNA, 16 bp, Homo sapiens
ctggttacctggagaa

SEQ ID NO: 6158893 - DNA, 23 bp, Homo sapiens
ctcttgtattgctccattttctt

SEQ ID NO: 6158894 - DNA, 22 bp, Homo sapiens
ctcttgtcagtgtagacacagg

SEQ ID NO: 6158895 - DNA, 17 bp, Homo sapiens
ctcttgtcattctcatc

SEQ ID NO: 6158896 - DNA, 20 bp, Homo sapiens
ctcttgtcatttttaatatt

SEQ ID NO: 6158897 - DNA, 18 bp, Homo sapiens
ctcttgtcccacgtgtct

SEQ ID NO: 6158898 - DNA, 13 bp, Homo sapiens
ctcttgtcccttg

SEQ ID NO: 6158899 - DNA, 14 bp, Homo sapiens
ctcttgtcccttgg

SEQ ID NO: 6158900 - DNA, 15 bp, Homo sapiens
ctcttgtcccttggc

SEQ ID NO: 6158901 - DNA, 21 bp, Homo sapiens
ctcttgtccctttccctacct

SEQ ID NO: 6158902 - DNA, 21 bp, Homo sapiens
ctcttgtcctcagtccattta

SEQ ID NO: 6158903 - DNA, 20 bp, Homo sapiens
ctcttgtcctggcccttcag

SEQ ID NO: 6158904 - DNA, 16 bp, Homo sapiens
ctcttgtcctttaata

SEQ ID NO: 6158905 - DNA, 12 bp, Homo sapiens
ctcttgtctccc

SEQ ID NO: 6158906 - DNA, 15 bp, Homo sapiens
ctcttgtctgaggga

SEQ ID NO: 6158907 - DNA, 13 bp, Homo sapiens
ctcttgtctggct

SEQ ID NO: 6158908 - DNA, 17 bp, Homo sapiens
ctcttgtcttcctattt

SEQ ID NO: 6158909 - DNA, 21 bp, Homo sapiens
ctcttgtcttcctatttcaga

SEQ ID NO: 6158910 - DNA, 23 bp, Homo sapiens
ctcttgtcttcctatttcagaag

SEQ ID NO: 6158911 - DNA, 23 bp, Homo sapiens
ctcttgtgaatattgtggctccc

SEQ ID NO: 6158912 - DNA, 20 bp, Homo sapiens
ctcttgtgacgtgcactgtg

SEQ ID NO: 6158913 - DNA, 23 bp, Homo sapiens
ctcttgtgatgtttgctcagagg

SEQ ID NO: 6158914 - DNA, 14 bp, Homo sapiens
ctcttgtgatttct

SEQ ID NO: 6158915 - DNA, 17 bp, Homo sapiens
ctcttgtgatttcttta

SEQ ID NO: 6158916 - DNA, 22 bp, Homo sapiens
ctcttgtgatttctttaaaaga

SEQ ID NO: 6158917 - DNA, 21 bp, Homo sapiens
ctcttgtgcaaggtggccttt

SEQ ID NO: 6158918 - DNA, 12 bp, Homo sapiens
ctcttgtgcatt

SEQ ID NO: 6158919 - DNA, 20 bp, Homo sapiens
ctcttgtgctgagtcccctc

SEQ ID NO: 6158920 - DNA, 14 bp, Homo sapiens
ctcttgtgctggat

SEQ ID NO: 6158921 - DNA, 22 bp, Homo sapiens
ctcttgtgtaactaatttgtgg

SEQ ID NO: 6158922 - DNA, 19 bp, Homo sapiens
ctcttgtgttcagaagaat

SEQ ID NO: 6158923 - DNA, 20 bp, Homo sapiens
ctcttgttgcactaaaaagt

SEQ ID NO: 6158924 - DNA, 15 bp, Homo sapiens
ctcttgttgcccagg

SEQ ID NO: 6158925 - DNA, 20 bp, Homo sapiens
ctcttgtttaaaaaaagaaa

SEQ ID NO: 6158926 - DNA, 11 bp, Homo sapiens
ctcttgtttct

SEQ ID NO: 6158927 - DNA, 14 bp, Homo sapiens
ctcttgtttctgtt

SEQ ID NO: 6158928 - DNA, 16 bp, Homo sapiens
ctcttgtttctgttta

SEQ ID NO: 6158929 - DNA, 18 bp, Homo sapiens
ctcttgtttctgtttagt

SEQ ID NO: 6158930 - DNA, 16 bp, Homo sapiens
ctcttgttttcagttt

SEQ ID NO: 6158931 - DNA, 13 bp, Homo sapiens
ctcttgttttgtt

SEQ ID NO: 6158932 - DNA, 23 bp, Homo sapiens
ctctttaaaaaaaatagaagcta

SEQ ID NO: 6158933 - DNA, 14 bp, Homo sapiens
ctctttaaaacaaa

SEQ ID NO: 6158934 - DNA, 17 bp, Homo sapiens
ctctttaaaacaaaaca

SEQ ID NO: 6158935 - DNA, 13 bp, Homo sapiens
ctctttaaaggca

SEQ ID NO: 6158936 - DNA, 17 bp, Homo sapiens
ctctttaacagctttct

SEQ ID NO: 6158937 - DNA, 16 bp, Homo sapiens
ctctttaactcaggac

SEQ ID NO: 6158938 - DNA, 18 bp, Homo sapiens
ctctttaactcaggactc

SEQ ID NO: 6158939 - DNA, 22 bp, Homo sapiens
ctctttaactcaggactccagc

SEQ ID NO: 6158940 - DNA, 21 bp, Homo sapiens
ctctttaactgtgtgaccagc

SEQ ID NO: 6158941 - DNA, 17 bp, Homo sapiens
ctctttaacttgtaata

SEQ ID NO: 6158942 - DNA, 19 bp, Homo sapiens
ctctttaagggcatgcctt

SEQ ID NO: 6158943 - DNA, 20 bp, Homo sapiens
ctctttaagggcatgccttg

SEQ ID NO: 6158944 - DNA, 16 bp, Homo sapiens
ctctttaagttttgat

SEQ ID NO: 6158945 - DNA, 17 bp, Homo sapiens
ctctttaagttttgatt

SEQ ID NO: 6158946 - DNA, 14 bp, Homo sapiens
ctctttaataaatt

SEQ ID NO: 6158947 - DNA, 18 bp, Homo sapiens
ctctttaatgctgtcttt

SEQ ID NO: 6158948 - DNA, 20 bp, Homo sapiens
ctctttaatgtcacaggcag

SEQ ID NO: 6158949 - DNA, 23 bp, Homo sapiens
ctctttaatgtcacaggcaggtc

SEQ ID NO: 6158950 - DNA, 15 bp, Homo sapiens
ctctttaccttctaa

SEQ ID NO: 6158951 - DNA, 20 bp, Homo sapiens
ctctttactcccttcctggc

SEQ ID NO: 6158952 - DNA, 16 bp, Homo sapiens
ctctttacttcctttc

SEQ ID NO: 6158953 - DNA, 21 bp, Homo sapiens
ctctttagagcagctttggga

SEQ ID NO: 6158954 - DNA, 21 bp, Homo sapiens
ctctttagagttagactgttg

SEQ ID NO: 6158955 - DNA, 14 bp, Homo sapiens
ctctttaggagaaa

SEQ ID NO: 6158956 - DNA, 16 bp, Homo sapiens
ctctttagtataattg

SEQ ID NO: 6158957 - DNA, 18 bp, Homo sapiens
ctctttagtgttctgttt

SEQ ID NO: 6158958 - DNA, 23 bp, Homo sapiens
ctctttagttgatttaaactctt

SEQ ID NO: 6158959 - DNA, 13 bp, Homo sapiens
ctctttatagtgc

SEQ ID NO: 6158960 - DNA, 22 bp, Homo sapiens
ctctttatgataacaacactgt

SEQ ID NO: 6158961 - DNA, 19 bp, Homo sapiens
ctctttatgcttgcttggg

SEQ ID NO: 6158962 - DNA, 20 bp, Homo sapiens
ctctttatgcttgcttgggg

SEQ ID NO: 6158963 - DNA, 19 bp, Homo sapiens
ctctttatttctagcagag

SEQ ID NO: 6158964 - DNA, 22 bp, Homo sapiens
ctctttattttcccctatcatt

SEQ ID NO: 6158965 - DNA, 16 bp, Homo sapiens
ctctttatttttctct

SEQ ID NO: 6158966 - DNA, 14 bp, Homo sapiens
ctctttcaaagaaa

SEQ ID NO: 6158967 - DNA, 18 bp, Homo sapiens
ctctttcaaagaaatcca

SEQ ID NO: 6158968 - DNA, 14 bp, Homo sapiens
ctctttcaaattat

SEQ ID NO: 6158969 - DNA, 20 bp, Homo sapiens
ctctttcaataaatgtatca

SEQ ID NO: 6158970 - DNA, 21 bp, Homo sapiens
ctctttcaattgcagatgcca

SEQ ID NO: 6158971 - DNA, 14 bp, Homo sapiens
ctctttcacattgt

SEQ ID NO: 6158972 - DNA, 15 bp, Homo sapiens
ctctttcaccctgcc

SEQ ID NO: 6158973 - DNA, 16 bp, Homo sapiens
ctctttcactcaggct

SEQ ID NO: 6158974 - DNA, 15 bp, Homo sapiens
ctctttcagaaaaca

SEQ ID NO: 6158975 - DNA, 13 bp, Homo sapiens
ctctttcagctcc

SEQ ID NO: 6158976 - DNA, 14 bp, Homo sapiens
ctctttcagtctac

SEQ ID NO: 6158977 - DNA, 14 bp, Homo sapiens
ctctttcatctttt

SEQ ID NO: 6158978 - DNA, 15 bp, Homo sapiens
ctctttcatctttta

SEQ ID NO: 6158979 - DNA, 13 bp, Homo sapiens
ctctttccaccat

SEQ ID NO: 6158980 - DNA, 17 bp, Homo sapiens
ctctttccacttgccct

SEQ ID NO: 6158981 - DNA, 22 bp, Homo sapiens
ctctttccagtggatcataaga

SEQ ID NO: 6158982 - DNA, 18 bp, Homo sapiens
ctctttccatgacatcaa

SEQ ID NO: 6158983 - DNA, 18 bp, Homo sapiens
ctctttcccacccagcct

SEQ ID NO: 6158984 - DNA, 22 bp, Homo sapiens
ctctttcccaccctccacctct

SEQ ID NO: 6158985 - DNA, 16 bp, Homo sapiens
ctctttccccaaggac

SEQ ID NO: 6158986 - DNA, 14 bp, Homo sapiens
ctctttccccacct

SEQ ID NO: 6158987 - DNA, 15 bp, Homo sapiens
ctctttccccacctc

SEQ ID NO: 6158988 - DNA, 18 bp, Homo sapiens
ctctttcccctcctttgt

SEQ ID NO: 6158989 - DNA, 17 bp, Homo sapiens
ctctttccctcccttcc

SEQ ID NO: 6158990 - DNA, 12 bp, Homo sapiens
ctctttccctgc

SEQ ID NO: 6158991 - DNA, 17 bp, Homo sapiens
ctctttccgactgccca

SEQ ID NO: 6158992 - DNA, 14 bp, Homo sapiens
ctctttcctaaagc

SEQ ID NO: 6158993 - DNA, 17 bp, Homo sapiens
ctctttcctaaagccaa

SEQ ID NO: 6158994 - DNA, 19 bp, Homo sapiens
ctctttcctatttcagtgt

SEQ ID NO: 6158995 - DNA, 15 bp, Homo sapiens
ctctttcctcatttc

SEQ ID NO: 6158996 - DNA, 21 bp, Homo sapiens
ctctttcctgcccttttcctg

SEQ ID NO: 6158997 - DNA, 13 bp, Homo sapiens
ctctttcctgtgc

SEQ ID NO: 6158998 - DNA, 16 bp, Homo sapiens
ctctttccttcttgcc

SEQ ID NO: 6158999 - DNA, 19 bp, Homo sapiens
ctctttcgtcacccttgga

SEQ ID NO: 6159000 - DNA, 22 bp, Homo sapiens
ctctttctaagagacctgaact

SEQ ID NO: 6159001 - DNA, 23 bp, Homo sapiens
ctctttctaagagacctgaactg

SEQ ID NO: 6159002 - DNA, 17 bp, Homo sapiens
ctctttctatgcccgtg

SEQ ID NO: 6159003 - DNA, 18 bp, Homo sapiens
ctctttctccttagtctt

SEQ ID NO: 6159004 - DNA, 15 bp, Homo sapiens
ctctttctctcccca

SEQ ID NO: 6159005 - DNA, 16 bp, Homo sapiens
ctctttctctccttct

SEQ ID NO: 6159006 - DNA, 17 bp, Homo sapiens
ctctttctctcttccct

SEQ ID NO: 6159007 - DNA, 14 bp, Homo sapiens
ctctttctctcttt

SEQ ID NO: 6159008 - DNA, 13 bp, Homo sapiens
ctctttctctgag

SEQ ID NO: 6159009 - DNA, 15 bp, Homo sapiens
ctctttctctgccag

SEQ ID NO: 6159010 - DNA, 17 bp, Homo sapiens
ctctttctctgccagtg

SEQ ID NO: 6159011 - DNA, 18 bp, Homo sapiens
ctctttctctgccagtga

SEQ ID NO: 6159012 - DNA, 14 bp, Homo sapiens
ctctttctctttct

SEQ ID NO: 6159013 - DNA, 16 bp, Homo sapiens
ctctttctgagtgcct

SEQ ID NO: 6159014 - DNA, 17 bp, Homo sapiens
ctctttctgagtgcctt

SEQ ID NO: 6159015 - DNA, 18 bp, Homo sapiens
ctctttctgagtgccttc

SEQ ID NO: 6159016 - DNA, 23 bp, Homo sapiens
ctctttctgagtgccttctgtgg

SEQ ID NO: 6159017 - DNA, 13 bp, Homo sapiens
ctctttctgtata

SEQ ID NO: 6159018 - DNA, 14 bp, Homo sapiens
ctctttctgtatat

SEQ ID NO: 6159019 - DNA, 12 bp, Homo sapiens
ctctttctgttt

SEQ ID NO: 6159020 - DNA, 21 bp, Homo sapiens
ctctttcttataatactctgt

SEQ ID NO: 6159021 - DNA, 23 bp, Homo sapiens
ctctttcttattttgtaataaac

SEQ ID NO: 6159022 - DNA, 20 bp, Homo sapiens
ctctttcttccactaccctc

SEQ ID NO: 6159023 - DNA, 14 bp, Homo sapiens
ctctttcttccttt

SEQ ID NO: 6159024 - DNA, 17 bp, Homo sapiens
ctctttcttcctttact

SEQ ID NO: 6159025 - DNA, 15 bp, Homo sapiens
ctctttcttcctttc

SEQ ID NO: 6159026 - DNA, 20 bp, Homo sapiens
ctctttcttctctctttgtc

SEQ ID NO: 6159027 - DNA, 18 bp, Homo sapiens
ctctttcttctctgctgc

SEQ ID NO: 6159028 - DNA, 19 bp, Homo sapiens
ctctttcttcttccacaca

SEQ ID NO: 6159029 - DNA, 13 bp, Homo sapiens
ctctttcttgttt

SEQ ID NO: 6159030 - DNA, 18 bp, Homo sapiens
ctctttcttgtttgtcag

SEQ ID NO: 6159031 - DNA, 17 bp, Homo sapiens
ctctttctttcaataaa

SEQ ID NO: 6159032 - DNA, 12 bp, Homo sapiens
ctctttctttcc

SEQ ID NO: 6159033 - DNA, 16 bp, Homo sapiens
ctctttctttccaaag

SEQ ID NO: 6159034 - DNA, 19 bp, Homo sapiens
ctctttctttctctttctg

SEQ ID NO: 6159035 - DNA, 12 bp, Homo sapiens
ctctttcttttc

SEQ ID NO: 6159036 - DNA, 15 bp, Homo sapiens
ctctttcttttgtgc

SEQ ID NO: 6159037 - DNA, 18 bp, Homo sapiens
ctctttgaaaattcttgt

SEQ ID NO: 6159038 - DNA, 11 bp, Homo sapiens
ctctttgaaac

SEQ ID NO: 6159039 - DNA, 22 bp, Homo sapiens
ctctttgaagaaaagaaaaaac

SEQ ID NO: 6159040 - DNA, 23 bp, Homo sapiens
ctctttgacaattcctagataaa

SEQ ID NO: 6159041 - DNA, 23 bp, Homo sapiens
ctctttgacgggaggcctcagtt

SEQ ID NO: 6159042 - DNA, 19 bp, Homo sapiens
ctctttgactgtcagcaag

SEQ ID NO: 6159043 - DNA, 17 bp, Homo sapiens
ctctttgagaccccagt

SEQ ID NO: 6159044 - DNA, 19 bp, Homo sapiens
ctctttgagaccccagtgc

SEQ ID NO: 6159045 - DNA, 22 bp, Homo sapiens
ctctttgagaccccagtgcctg

SEQ ID NO: 6159046 - DNA, 22 bp, Homo sapiens
ctctttgagataatacattccg

SEQ ID NO: 6159047 - DNA, 13 bp, Homo sapiens
ctctttgatgtca

SEQ ID NO: 6159048 - DNA, 16 bp, Homo sapiens
ctctttgattatttgc

SEQ ID NO: 6159049 - DNA, 17 bp, Homo sapiens
ctctttgattatttgca

SEQ ID NO: 6159050 - DNA, 20 bp, Homo sapiens
ctctttgcaactcctgtaat

SEQ ID NO: 6159051 - DNA, 17 bp, Homo sapiens
ctctttgccatttcttc

SEQ ID NO: 6159052 - DNA, 17 bp, Homo sapiens
ctctttgccctgaggct

SEQ ID NO: 6159053 - DNA, 14 bp, Homo sapiens
ctctttgcctgtgt

SEQ ID NO: 6159054 - DNA, 16 bp, Homo sapiens
ctctttgcctgtgtga

SEQ ID NO: 6159055 - DNA, 19 bp, Homo sapiens
ctctttgctacaataaatg

SEQ ID NO: 6159056 - DNA, 13 bp, Homo sapiens
ctctttgctgcag

SEQ ID NO: 6159057 - DNA, 12 bp, Homo sapiens
ctctttgctgtt

SEQ ID NO: 6159058 - DNA, 12 bp, Homo sapiens
ctctttgctttc

SEQ ID NO: 6159059 - DNA, 20 bp, Homo sapiens
ctctttgctttgctttctgc

SEQ ID NO: 6159060 - DNA, 22 bp, Homo sapiens
ctctttgctttgctttctgctc

SEQ ID NO: 6159061 - DNA, 13 bp, Homo sapiens
ctctttggctatt

SEQ ID NO: 6159062 - DNA, 16 bp, Homo sapiens
ctctttggctgaaatt

SEQ ID NO: 6159063 - DNA, 15 bp, Homo sapiens
ctctttgggaatgtt

SEQ ID NO: 6159064 - DNA, 20 bp, Homo sapiens
ctctttgggaatgtttgtct

SEQ ID NO: 6159065 - DNA, 12 bp, Homo sapiens
ctctttggggca

SEQ ID NO: 6159066 - DNA, 18 bp, Homo sapiens
ctctttggggctcctttc

SEQ ID NO: 6159067 - DNA, 21 bp, Homo sapiens
ctctttggtctacactgtgct

SEQ ID NO: 6159068 - DNA, 22 bp, Homo sapiens
ctctttggtctacactgtgctg

SEQ ID NO: 6159069 - DNA, 23 bp, Homo sapiens
ctctttggtctacactgtgctga

SEQ ID NO: 6159070 - DNA, 23 bp, Homo sapiens
ctctttggtctattttctgcaga

SEQ ID NO: 6159071 - DNA, 18 bp, Homo sapiens
ctctttgtaatttaatga

SEQ ID NO: 6159072 - DNA, 19 bp, Homo sapiens
ctggttacctgttccattg

SEQ ID NO: 6159073 - DNA, 14 bp, Homo sapiens
ctggttactcagct

SEQ ID NO: 6159074 - DNA, 21 bp, Homo sapiens
ctggttactcagctccctgga

SEQ ID NO: 6159075 - DNA, 15 bp, Homo sapiens
ctggttactcagggt

SEQ ID NO: 6159076 - DNA, 23 bp, Homo sapiens
ctggttactcagggttcatctgt

SEQ ID NO: 6159077 - DNA, 14 bp, Homo sapiens
ctggttactctggt

SEQ ID NO: 6159078 - DNA, 13 bp, Homo sapiens
ctggttagcagag

SEQ ID NO: 6159079 - DNA, 16 bp, Homo sapiens
ctggttaggatggcag

SEQ ID NO: 6159080 - DNA, 22 bp, Homo sapiens
ctggttataacagcaaatgaaa

SEQ ID NO: 6159081 - DNA, 23 bp, Homo sapiens
ctggttatagttgatatgtaaca

SEQ ID NO: 6159082 - DNA, 20 bp, Homo sapiens
ctggttattgatgtggccct

SEQ ID NO: 6159083 - DNA, 14 bp, Homo sapiens
ctggttatttattt

SEQ ID NO: 6159084 - DNA, 18 bp, Homo sapiens
ctggttcaaagtaaagca

SEQ ID NO: 6159085 - DNA, 16 bp, Homo sapiens
ctggttcagacacagc

SEQ ID NO: 6159086 - DNA, 13 bp, Homo sapiens
ctggttcaggctc

SEQ ID NO: 6159087 - DNA, 20 bp, Homo sapiens
ctggttcagggttggcccct

SEQ ID NO: 6159088 - DNA, 22 bp, Homo sapiens
ctggttccaaaccagtttattc

SEQ ID NO: 6159089 - DNA, 15 bp, Homo sapiens
ctggttccactcagc

SEQ ID NO: 6159090 - DNA, 13 bp, Homo sapiens
ctggttccagggt

SEQ ID NO: 6159091 - DNA, 22 bp, Homo sapiens
ctggttccagggtccctctgtg

SEQ ID NO: 6159092 - DNA, 23 bp, Homo sapiens
ctggttccagggtccctctgtgt

SEQ ID NO: 6159093 - DNA, 21 bp, Homo sapiens
ctggttccatttttcctctgt

SEQ ID NO: 6159094 - DNA, 18 bp, Homo sapiens
ctggttcccaccattccc

SEQ ID NO: 6159095 - DNA, 22 bp, Homo sapiens
ctggttcccccaggaccctgag

SEQ ID NO: 6159096 - DNA, 18 bp, Homo sapiens
ctggttccctctttcctg

SEQ ID NO: 6159097 - DNA, 21 bp, Homo sapiens
ctggttccctctttcctgtgc

SEQ ID NO: 6159098 - DNA, 15 bp, Homo sapiens
ctggttccctgctgc

SEQ ID NO: 6159099 - DNA, 19 bp, Homo sapiens
ctggttccctgctgcgctg

SEQ ID NO: 6159100 - DNA, 21 bp, Homo sapiens
ctggttccctgctgcgctgct

SEQ ID NO: 6159101 - DNA, 18 bp, Homo sapiens
ctggttccgccaggcgct

SEQ ID NO: 6159102 - DNA, 19 bp, Homo sapiens
ctggttccgccaggcgctg

SEQ ID NO: 6159103 - DNA, 17 bp, Homo sapiens
ctggttcctagatgtgt

SEQ ID NO: 6159104 - DNA, 18 bp, Homo sapiens
ctggttcctagatgtgtt

SEQ ID NO: 6159105 - DNA, 17 bp, Homo sapiens
ctggttcctccagccac

SEQ ID NO: 6159106 - DNA, 17 bp, Homo sapiens
ctggttcctctctccca

SEQ ID NO: 6159107 - DNA, 19 bp, Homo sapiens
ctggttcctctctcccacc

SEQ ID NO: 6159108 - DNA, 16 bp, Homo sapiens
ctggttcctgactggc

SEQ ID NO: 6159109 - DNA, 17 bp, Homo sapiens
ctggttcctgctgtcct

SEQ ID NO: 6159110 - DNA, 20 bp, Homo sapiens
ctggttccttaagtggctgt

SEQ ID NO: 6159111 - DNA, 14 bp, Homo sapiens
ctggttcctttcat

SEQ ID NO: 6159112 - DNA, 16 bp, Homo sapiens
ctggttcctttcatct

SEQ ID NO: 6159113 - DNA, 19 bp, Homo sapiens
ctggttcctttcatctctc

SEQ ID NO: 6159114 - DNA, 16 bp, Homo sapiens
ctggttcgtgccatgc

SEQ ID NO: 6159115 - DNA, 18 bp, Homo sapiens
ctggttctccatccccat

SEQ ID NO: 6159116 - DNA, 14 bp, Homo sapiens
ctggttctgaggcc

SEQ ID NO: 6159117 - DNA, 17 bp, Homo sapiens
ctggttctgagttctgg

SEQ ID NO: 6159118 - DNA, 15 bp, Homo sapiens
ctggttctgcaatga

SEQ ID NO: 6159119 - DNA, 22 bp, Homo sapiens
ctggttctgtctagactggcct

SEQ ID NO: 6159120 - DNA, 23 bp, Homo sapiens
ctggttctgtgtcctctgcctgg

SEQ ID NO: 6159121 - DNA, 17 bp, Homo sapiens
ctggttctgtgttgaaa

SEQ ID NO: 6159122 - DNA, 23 bp, Homo sapiens
ctggttctgttttctaaaggagc

SEQ ID NO: 6159123 - DNA, 16 bp, Homo sapiens
ctggttcttgccttcc

SEQ ID NO: 6159124 - DNA, 17 bp, Homo sapiens
ctggttgagaaacattg

SEQ ID NO: 6159125 - DNA, 19 bp, Homo sapiens
ctggttgagtgtgtggtct

SEQ ID NO: 6159126 - DNA, 21 bp, Homo sapiens
ctggttgatttgtaacacagt

SEQ ID NO: 6159127 - DNA, 12 bp, Homo sapiens
ctggttgcatgg

SEQ ID NO: 6159128 - DNA, 22 bp, Homo sapiens
ctggttgccacatcttagcaag

SEQ ID NO: 6159129 - DNA, 13 bp, Homo sapiens
ctggttgcctcat

SEQ ID NO: 6159130 - DNA, 17 bp, Homo sapiens
ctggttgcctcatggcc

SEQ ID NO: 6159131 - DNA, 19 bp, Homo sapiens
ctggttgcctcccccgcct

SEQ ID NO: 6159132 - DNA, 12 bp, Homo sapiens
ctggttgcctct

SEQ ID NO: 6159133 - DNA, 15 bp, Homo sapiens
ctggttgcctctctt

SEQ ID NO: 6159134 - DNA, 21 bp, Homo sapiens
ctggttgctgggcctcattct

SEQ ID NO: 6159135 - DNA, 13 bp, Homo sapiens
ctggttgctgtgt

SEQ ID NO: 6159136 - DNA, 19 bp, Homo sapiens
ctggttgcttcagacctga

SEQ ID NO: 6159137 - DNA, 23 bp, Homo sapiens
ctggttggagagctagaacctgg

SEQ ID NO: 6159138 - DNA, 23 bp, Homo sapiens
ctggttggcatttgctggcctgg

SEQ ID NO: 6159139 - DNA, 17 bp, Homo sapiens
ctggttgggcagccaga

SEQ ID NO: 6159140 - DNA, 19 bp, Homo sapiens
ctggttgggggcaccatct

SEQ ID NO: 6159141 - DNA, 16 bp, Homo sapiens
ctggttggtgctttgt

SEQ ID NO: 6159142 - DNA, 19 bp, Homo sapiens
ctggttggtgttcttccca

SEQ ID NO: 6159143 - DNA, 14 bp, Homo sapiens
ctggttgtaaaaga

SEQ ID NO: 6159144 - DNA, 13 bp, Homo sapiens
ctggttgtatttc

SEQ ID NO: 6159145 - DNA, 15 bp, Homo sapiens
ctggttgtcattttt

SEQ ID NO: 6159146 - DNA, 16 bp, Homo sapiens
ctggttgtccaggtct

SEQ ID NO: 6159147 - DNA, 20 bp, Homo sapiens
ctggttgtctagtcattgtc

SEQ ID NO: 6159148 - DNA, 11 bp, Homo sapiens
ctggttgtctg

SEQ ID NO: 6159149 - DNA, 14 bp, Homo sapiens
ctggttgtctgaac

SEQ ID NO: 6159150 - DNA, 19 bp, Homo sapiens
ctggttgtctgaacccagg

SEQ ID NO: 6159151 - DNA, 20 bp, Homo sapiens
ctggttgtctgaacccaggc

SEQ ID NO: 6159152 - DNA, 13 bp, Homo sapiens
ctggttgttcctg

SEQ ID NO: 6159153 - DNA, 20 bp, Homo sapiens
ctggttgttcctgcatcccg

SEQ ID NO: 6159154 - DNA, 21 bp, Homo sapiens
ctggttgtttctgttccaaat

SEQ ID NO: 6159155 - DNA, 14 bp, Homo sapiens
ctggtttaatgttt

SEQ ID NO: 6159156 - DNA, 13 bp, Homo sapiens
ctggtttacaaat

SEQ ID NO: 6159157 - DNA, 16 bp, Homo sapiens
ctggtttacagatgtt

SEQ ID NO: 6159158 - DNA, 13 bp, Homo sapiens
ctggtttataata

SEQ ID NO: 6159159 - DNA, 19 bp, Homo sapiens
ctggtttcaaactcctgac

SEQ ID NO: 6159160 - DNA, 14 bp, Homo sapiens
ctggtttcaccagc

SEQ ID NO: 6159161 - DNA, 23 bp, Homo sapiens
ctggtttcatttctactgtgact

SEQ ID NO: 6159162 - DNA, 20 bp, Homo sapiens
ctggtttccccagggaagga

SEQ ID NO: 6159163 - DNA, 23 bp, Homo sapiens
ctggtttcccggtgacacatcca

SEQ ID NO: 6159164 - DNA, 13 bp, Homo sapiens
ctggtttcctgcc

SEQ ID NO: 6159165 - DNA, 17 bp, Homo sapiens
ctggtttcctgcccagc

SEQ ID NO: 6159166 - DNA, 22 bp, Homo sapiens
ctggtttcctgcccagcctggg

SEQ ID NO: 6159167 - DNA, 22 bp, Homo sapiens
ctggtttcctgccctgggaggc

SEQ ID NO: 6159168 - DNA, 13 bp, Homo sapiens
ctggtttcctggc

SEQ ID NO: 6159169 - DNA, 13 bp, Homo sapiens
ctggtttcctttc

SEQ ID NO: 6159170 - DNA, 17 bp, Homo sapiens
ctggtttctcctggtag

SEQ ID NO: 6159171 - DNA, 12 bp, Homo sapiens
ctggtttcttcc

SEQ ID NO: 6159172 - DNA, 23 bp, Homo sapiens
ctggtttcttttaatgtgaggaa

SEQ ID NO: 6159173 - DNA, 21 bp, Homo sapiens
ctggtttgaaagatgcagtgg

SEQ ID NO: 6159174 - DNA, 17 bp, Homo sapiens
ctggtttgaagaatgtt

SEQ ID NO: 6159175 - DNA, 21 bp, Homo sapiens
ctggtttgactccgctggagg

SEQ ID NO: 6159176 - DNA, 23 bp, Homo sapiens
ctggtttgcaaagaccacctcca

SEQ ID NO: 6159177 - DNA, 17 bp, Homo sapiens
ctggtttgcaagaatga

SEQ ID NO: 6159178 - DNA, 16 bp, Homo sapiens
ctggtttgcagctgtt

SEQ ID NO: 6159179 - DNA, 14 bp, Homo sapiens
ctggtttgcccaga

SEQ ID NO: 6159180 - DNA, 19 bp, Homo sapiens
ctggtttgccggtggtgca

SEQ ID NO: 6159181 - DNA, 16 bp, Homo sapiens
ctggtttgttccctgt

SEQ ID NO: 6159182 - DNA, 21 bp, Homo sapiens
ctggtttgtttctcaagcgct

SEQ ID NO: 6159183 - DNA, 13 bp, Homo sapiens
ctggttttaacaa

SEQ ID NO: 6159184 - DNA, 18 bp, Homo sapiens
ctggttttacttacaaaa

SEQ ID NO: 6159185 - DNA, 20 bp, Homo sapiens
ctggttttacttacaaaaat

SEQ ID NO: 6159186 - DNA, 13 bp, Homo sapiens
ctggttttatctt

SEQ ID NO: 6159187 - DNA, 17 bp, Homo sapiens
ctggttttcacattaga

SEQ ID NO: 6159188 - DNA, 12 bp, Homo sapiens
ctggttttcatt

SEQ ID NO: 6159189 - DNA, 21 bp, Homo sapiens
ctggttttctagcccctctgg

SEQ ID NO: 6159190 - DNA, 15 bp, Homo sapiens
ctggttttctctgat

SEQ ID NO: 6159191 - DNA, 20 bp, Homo sapiens
ctggttttcttgccaccctc

SEQ ID NO: 6159192 - DNA, 22 bp, Homo sapiens
ctggttttcttgccaccctctg

SEQ ID NO: 6159193 - DNA, 23 bp, Homo sapiens
ctggttttcttgccaccctctgg

SEQ ID NO: 6159194 - DNA, 18 bp, Homo sapiens
ctggttttgatggctggg

SEQ ID NO: 6159195 - DNA, 19 bp, Homo sapiens
ctggttttgatggctgggt

SEQ ID NO: 6159196 - DNA, 23 bp, Homo sapiens
ctggttttggcatctctgtccca

SEQ ID NO: 6159197 - DNA, 19 bp, Homo sapiens
ctggttttgtaagatgctg

SEQ ID NO: 6159198 - DNA, 20 bp, Homo sapiens
ctggttttgtaagatgctgg

SEQ ID NO: 6159199 - DNA, 21 bp, Homo sapiens
ctggttttgtaagatgctggg

SEQ ID NO: 6159200 - DNA, 17 bp, Homo sapiens
ctggttttgtacactgc

SEQ ID NO: 6159201 - DNA, 20 bp, Homo sapiens
ctggtttttaaccattgtct

SEQ ID NO: 6159202 - DNA, 14 bp, Homo sapiens
ctggtttttcagtt

SEQ ID NO: 6159203 - DNA, 14 bp, Homo sapiens
ctggtttttctcaa

SEQ ID NO: 6159204 - DNA, 18 bp, Homo sapiens
ctggtttttctgttccct

SEQ ID NO: 6159205 - DNA, 19 bp, Homo sapiens
ctgtaaaaaaaaaaaagtt

SEQ ID NO: 6159206 - DNA, 13 bp, Homo sapiens
ctgtaaaaaagaa

SEQ ID NO: 6159207 - DNA, 18 bp, Homo sapiens
ctgtaaaaaagaaaaaca

SEQ ID NO: 6159208 - DNA, 13 bp, Homo sapiens
ctgtaaaaaatgg

SEQ ID NO: 6159209 - DNA, 22 bp, Homo sapiens
ctgtaaaaacacaaatgtgtac

SEQ ID NO: 6159210 - DNA, 20 bp, Homo sapiens
ctgtaaaaacactgaaaaat

SEQ ID NO: 6159211 - DNA, 22 bp, Homo sapiens
ctgtaaaaacactgaaaaatta

SEQ ID NO: 6159212 - DNA, 15 bp, Homo sapiens
ctgtaaaaactgtgg

SEQ ID NO: 6159213 - DNA, 21 bp, Homo sapiens
ctgtaaaaagagagaaaactt

SEQ ID NO: 6159214 - DNA, 18 bp, Homo sapiens
ctgtaaaactaaacatac

SEQ ID NO: 6159215 - DNA, 14 bp, Homo sapiens
ctgtaaaagaaaaa

SEQ ID NO: 6159216 - DNA, 19 bp, Homo sapiens
ctgtaaaagagcctagttt

SEQ ID NO: 6159217 - DNA, 18 bp, Homo sapiens
ctgtaaaagattaaactg

SEQ ID NO: 6159218 - DNA, 18 bp, Homo sapiens
ctgtaaaagttactaata

SEQ ID NO: 6159219 - DNA, 18 bp, Homo sapiens
ctgtaaaagttataataa

SEQ ID NO: 6159220 - DNA, 17 bp, Homo sapiens
ctgtaaaataaaaggtc

SEQ ID NO: 6159221 - DNA, 13 bp, Homo sapiens
ctgtaaaatacat

SEQ ID NO: 6159222 - DNA, 20 bp, Homo sapiens
ctgtaaaatacatggtatct

SEQ ID NO: 6159223 - DNA, 19 bp, Homo sapiens
ctgtaaaatagtctcattg

SEQ ID NO: 6159224 - DNA, 22 bp, Homo sapiens
ctgtaaaatagtctcattgcca

SEQ ID NO: 6159225 - DNA, 15 bp, Homo sapiens
ctgtaaaatagtttt

SEQ ID NO: 6159226 - DNA, 10 bp, Homo sapiens
ctgtaaaatc

SEQ ID NO: 6159227 - DNA, 15 bp, Homo sapiens
ctgtaaaatccattt

SEQ ID NO: 6159228 - DNA, 20 bp, Homo sapiens
ctgtaaaatccatttaatca

SEQ ID NO: 6159229 - DNA, 11 bp, Homo sapiens
ctgtaaaatct

SEQ ID NO: 6159230 - DNA, 16 bp, Homo sapiens
ctgtaaaatgaaatta

SEQ ID NO: 6159231 - DNA, 20 bp, Homo sapiens
ctgtaaaatgcaaaaaatct

SEQ ID NO: 6159232 - DNA, 22 bp, Homo sapiens
ctgtaaaatgcatgattttgta

SEQ ID NO: 6159233 - DNA, 13 bp, Homo sapiens
ctgtaaaatggaa

SEQ ID NO: 6159234 - DNA, 16 bp, Homo sapiens
ctgtaaaatggagaca

SEQ ID NO: 6159235 - DNA, 19 bp, Homo sapiens
ctgtaaaatgggtatattg

SEQ ID NO: 6159236 - DNA, 15 bp, Homo sapiens
ctgtaaaatgtggga

SEQ ID NO: 6159237 - DNA, 14 bp, Homo sapiens
ctgtaaaatttgtg

SEQ ID NO: 6159238 - DNA, 24 bp, Homo sapiens
ctgtaaacacaggggacacagctt

SEQ ID NO: 6159239 - DNA, 15 bp, Homo sapiens
ctgtaaacactcagc

SEQ ID NO: 6159240 - DNA, 18 bp, Homo sapiens
ctgtaaacatagatagtg

SEQ ID NO: 6159241 - DNA, 22 bp, Homo sapiens
ctgtaaacatagatagtgcttt

SEQ ID NO: 6159242 - DNA, 17 bp, Homo sapiens
ctgtaaacccctgggta

SEQ ID NO: 6159243 - DNA, 18 bp, Homo sapiens
ctgtaaacccctgggtaa

SEQ ID NO: 6159244 - DNA, 20 bp, Homo sapiens
ctgtaaacctctcgagggca

SEQ ID NO: 6159245 - DNA, 13 bp, Homo sapiens
ctgtaaactgtgt

SEQ ID NO: 6159246 - DNA, 19 bp, Homo sapiens
ctgtaaactttatcactta

SEQ ID NO: 6159247 - DNA, 12 bp, Homo sapiens
ctgtaaactttt

SEQ ID NO: 6159248 - DNA, 17 bp, Homo sapiens
ctgtaaacttttatacc

SEQ ID NO: 6159249 - DNA, 18 bp, Homo sapiens
ctgtaaagaaagagagaa

SEQ ID NO: 6159250 - DNA, 21 bp, Homo sapiens
ctctttgtagctaacagtgaa

SEQ ID NO: 6159251 - DNA, 22 bp, Homo sapiens
ctctttgtagctaacagtgaag

SEQ ID NO: 6159252 - DNA, 14 bp, Homo sapiens
ctctttgtcctgaa

SEQ ID NO: 6159253 - DNA, 15 bp, Homo sapiens
ctctttgtcctgaat

SEQ ID NO: 6159254 - DNA, 14 bp, Homo sapiens
ctctttgtctaaaa

SEQ ID NO: 6159255 - DNA, 17 bp, Homo sapiens
ctctttgtctaaaacaa

SEQ ID NO: 6159256 - DNA, 21 bp, Homo sapiens
ctctttgtctaaaacaataaa

SEQ ID NO: 6159257 - DNA, 14 bp, Homo sapiens
ctctttgtgcagtg

SEQ ID NO: 6159258 - DNA, 18 bp, Homo sapiens
ctctttgtggggcttggc

SEQ ID NO: 6159259 - DNA, 20 bp, Homo sapiens
ctctttgtggggcttggcgt

SEQ ID NO: 6159260 - DNA, 15 bp, Homo sapiens
ctctttgtgtgtctc

SEQ ID NO: 6159261 - DNA, 20 bp, Homo sapiens
ctctttgttcagttgactta

SEQ ID NO: 6159262 - DNA, 16 bp, Homo sapiens
ctctttgttcatcatt

SEQ ID NO: 6159263 - DNA, 20 bp, Homo sapiens
ctctttgttcttcctgtctc

SEQ ID NO: 6159264 - DNA, 18 bp, Homo sapiens
ctctttgtttctgtttct

SEQ ID NO: 6159265 - DNA, 20 bp, Homo sapiens
ctctttgtttctgtttcttg

SEQ ID NO: 6159266 - DNA, 21 bp, Homo sapiens
ctcttttaaaatatcctgtaa

SEQ ID NO: 6159267 - DNA, 19 bp, Homo sapiens
ctcttttaatggcatttct

SEQ ID NO: 6159268 - DNA, 12 bp, Homo sapiens
ctcttttaccaa

SEQ ID NO: 6159269 - DNA, 14 bp, Homo sapiens
ctcttttaccctgg

SEQ ID NO: 6159270 - DNA, 17 bp, Homo sapiens
ctcttttacctgctgct

SEQ ID NO: 6159271 - DNA, 15 bp, Homo sapiens
ctcttttagtcattt

SEQ ID NO: 6159272 - DNA, 22 bp, Homo sapiens
ctcttttatatttgtaggagaa

SEQ ID NO: 6159273 - DNA, 23 bp, Homo sapiens
ctcttttatatttgtaggagaaa

SEQ ID NO: 6159274 - DNA, 17 bp, Homo sapiens
ctcttttatctcctgaa

SEQ ID NO: 6159275 - DNA, 14 bp, Homo sapiens
ctcttttcaaaaca

SEQ ID NO: 6159276 - DNA, 13 bp, Homo sapiens
ctcttttcacagc

SEQ ID NO: 6159277 - DNA, 15 bp, Homo sapiens
ctcttttcacagcaa

SEQ ID NO: 6159278 - DNA, 11 bp, Homo sapiens
ctcttttcatt

SEQ ID NO: 6159279 - DNA, 16 bp, Homo sapiens
ctcttttcattgtgta

SEQ ID NO: 6159280 - DNA, 20 bp, Homo sapiens
ctcttttccaaacacaggca

SEQ ID NO: 6159281 - DNA, 14 bp, Homo sapiens
ctcttttccactcc

SEQ ID NO: 6159282 - DNA, 14 bp, Homo sapiens
ctcttttccccgcc

SEQ ID NO: 6159283 - DNA, 21 bp, Homo sapiens
ctcttttcccctttcctgtcc

SEQ ID NO: 6159284 - DNA, 18 bp, Homo sapiens
ctcttttccctcctttcc

SEQ ID NO: 6159285 - DNA, 11 bp, Homo sapiens
ctcttttccta

SEQ ID NO: 6159286 - DNA, 12 bp, Homo sapiens
ctcttttcctag

SEQ ID NO: 6159287 - DNA, 14 bp, Homo sapiens
ctcttttcctctct

SEQ ID NO: 6159288 - DNA, 16 bp, Homo sapiens
ctcttttcctctctgt

SEQ ID NO: 6159289 - DNA, 18 bp, Homo sapiens
ctcttttcctctctgtct

SEQ ID NO: 6159290 - DNA, 18 bp, Homo sapiens
ctcttttcctggcagctg

SEQ ID NO: 6159291 - DNA, 19 bp, Homo sapiens
ctcttttctaagtggcgtg

SEQ ID NO: 6159292 - DNA, 14 bp, Homo sapiens
ctcttttctatttt

SEQ ID NO: 6159293 - DNA, 15 bp, Homo sapiens
ctcttttctattttg

SEQ ID NO: 6159294 - DNA, 12 bp, Homo sapiens
ctcttttctctg

SEQ ID NO: 6159295 - DNA, 14 bp, Homo sapiens
ctcttttctctgtg

SEQ ID NO: 6159296 - DNA, 14 bp, Homo sapiens
ctcttttctgcatc

SEQ ID NO: 6159297 - DNA, 15 bp, Homo sapiens
ctcttttctgcatca

SEQ ID NO: 6159298 - DNA, 19 bp, Homo sapiens
ctcttttctggtaattttg

SEQ ID NO: 6159299 - DNA, 15 bp, Homo sapiens
ctcttttctgtactt

SEQ ID NO: 6159300 - DNA, 12 bp, Homo sapiens
ctcttttctttc

SEQ ID NO: 6159301 - DNA, 14 bp, Homo sapiens
ctcttttctttctg

SEQ ID NO: 6159302 - DNA, 14 bp, Homo sapiens
ctcttttgaaagta

SEQ ID NO: 6159303 - DNA, 23 bp, Homo sapiens
ctcttttgaatgttaagaataac

SEQ ID NO: 6159304 - DNA, 16 bp, Homo sapiens
ctcttttgctctctca

SEQ ID NO: 6159305 - DNA, 12 bp, Homo sapiens
ctcttttgctta

SEQ ID NO: 6159306 - DNA, 11 bp, Homo sapiens
ctcttttggac

SEQ ID NO: 6159307 - DNA, 21 bp, Homo sapiens
ctcttttgggatctaactgtt

SEQ ID NO: 6159308 - DNA, 24 bp, Homo sapiens
ctcttttgtattgtttctacaata

SEQ ID NO: 6159309 - DNA, 18 bp, Homo sapiens
ctcttttgtgagaagatg

SEQ ID NO: 6159310 - DNA, 19 bp, Homo sapiens
ctcttttgtgatgaacata

SEQ ID NO: 6159311 - DNA, 19 bp, Homo sapiens
ctcttttgttaaataatat

SEQ ID NO: 6159312 - DNA, 11 bp, Homo sapiens
ctctttttaag

SEQ ID NO: 6159313 - DNA, 22 bp, Homo sapiens
ctctttttaaggacactggggt

SEQ ID NO: 6159314 - DNA, 14 bp, Homo sapiens
ctctttttcagagc

SEQ ID NO: 6159315 - DNA, 21 bp, Homo sapiens
ctctttttccatcataattct

SEQ ID NO: 6159316 - DNA, 14 bp, Homo sapiens
ctctttttccttct

SEQ ID NO: 6159317 - DNA, 22 bp, Homo sapiens
ctctttttcgtataatcttgta

SEQ ID NO: 6159318 - DNA, 13 bp, Homo sapiens
ctctttttctcac

SEQ ID NO: 6159319 - DNA, 13 bp, Homo sapiens
ctctttttctctg

SEQ ID NO: 6159320 - DNA, 15 bp, Homo sapiens
ctctttttctctgta

SEQ ID NO: 6159321 - DNA, 17 bp, Homo sapiens
ctctttttctctgtata

SEQ ID NO: 6159322 - DNA, 14 bp, Homo sapiens
ctctttttcttttc

SEQ ID NO: 6159323 - DNA, 17 bp, Homo sapiens
ctctttttgggctcctt

SEQ ID NO: 6159324 - DNA, 21 bp, Homo sapiens
ctctttttgggctcctttttc

SEQ ID NO: 6159325 - DNA, 20 bp, Homo sapiens
ctctttttggtaataacaaa

SEQ ID NO: 6159326 - DNA, 15 bp, Homo sapiens
ctcttttttactcat

SEQ ID NO: 6159327 - DNA, 15 bp, Homo sapiens
ctcttttttagctct

SEQ ID NO: 6159328 - DNA, 20 bp, Homo sapiens
ctcttttttcaactggctgg

SEQ ID NO: 6159329 - DNA, 21 bp, Homo sapiens
ctcttttttgtttgtttcttt

SEQ ID NO: 6159330 - DNA, 22 bp, Homo sapiens
ctctttttttaaaaagttgata

SEQ ID NO: 6159331 - DNA, 16 bp, Homo sapiens
ctctttttttaaaagg

SEQ ID NO: 6159332 - DNA, 22 bp, Homo sapiens
ctctttttttaagtgcttacat

SEQ ID NO: 6159333 - DNA, 16 bp, Homo sapiens
ctctttttttcttttc

SEQ ID NO: 6159334 - DNA, 19 bp, Homo sapiens
ctctttttttggcccaggc

SEQ ID NO: 6159335 - DNA, 21 bp, Homo sapiens
ctctttttttttttttttaaa

SEQ ID NO: 6159336 - DNA, 19 bp, Homo sapiens
ctgaaaaaaacatatccaa

SEQ ID NO: 6159337 - DNA, 14 bp, Homo sapiens
ctgaaaaaaagttt

SEQ ID NO: 6159338 - DNA, 13 bp, Homo sapiens
ctgaaaaaactat

SEQ ID NO: 6159339 - DNA, 15 bp, Homo sapiens
ctgaaaaaatatatg

SEQ ID NO: 6159340 - DNA, 19 bp, Homo sapiens
ctgaaaaactgatcaaaaa

SEQ ID NO: 6159341 - DNA, 14 bp, Homo sapiens
ctgaaaaactgttg

SEQ ID NO: 6159342 - DNA, 12 bp, Homo sapiens
ctgaaaaagaaa

SEQ ID NO: 6159343 - DNA, 13 bp, Homo sapiens
ctgaaaaagacat

SEQ ID NO: 6159344 - DNA, 16 bp, Homo sapiens
ctgaaaaagacataaa

SEQ ID NO: 6159345 - DNA, 23 bp, Homo sapiens
ctgaaaaagacataaaacagaat

SEQ ID NO: 6159346 - DNA, 19 bp, Homo sapiens
ctgaaaaagtagattgagt

SEQ ID NO: 6159347 - DNA, 13 bp, Homo sapiens
ctgaaaaatatct

SEQ ID NO: 6159348 - DNA, 17 bp, Homo sapiens
ctgaaaaatcacatcct

SEQ ID NO: 6159349 - DNA, 13 bp, Homo sapiens
ctgaaaaatgtca

SEQ ID NO: 6159350 - DNA, 19 bp, Homo sapiens
ctgaaaacacaaacaacaa

SEQ ID NO: 6159351 - DNA, 12 bp, Homo sapiens
ctgaaaaccagt

SEQ ID NO: 6159352 - DNA, 21 bp, Homo sapiens
ctgaaaaccagtcttctccct

SEQ ID NO: 6159353 - DNA, 22 bp, Homo sapiens
ctgaaaaccatctggcctggcc

SEQ ID NO: 6159354 - DNA, 17 bp, Homo sapiens
ctgaaaacccagagagg

SEQ ID NO: 6159355 - DNA, 23 bp, Homo sapiens
ctgaaaacccaggccacaaatgt

SEQ ID NO: 6159356 - DNA, 18 bp, Homo sapiens
ctgaaaacctaccagcca

SEQ ID NO: 6159357 - DNA, 17 bp, Homo sapiens
ctgaaaacctctcctca

SEQ ID NO: 6159358 - DNA, 11 bp, Homo sapiens
ctgaaaactaa

SEQ ID NO: 6159359 - DNA, 21 bp, Homo sapiens
ctgaaaactaatgtactgtac

SEQ ID NO: 6159360 - DNA, 13 bp, Homo sapiens
ctgaaaactggaa

SEQ ID NO: 6159361 - DNA, 14 bp, Homo sapiens
ctgaaaactgtaaa

SEQ ID NO: 6159362 - DNA, 16 bp, Homo sapiens
ctgaaaactgtaaata

SEQ ID NO: 6159363 - DNA, 19 bp, Homo sapiens
ctgaaaactgtaaatacaa

SEQ ID NO: 6159364 - DNA, 17 bp, Homo sapiens
ctgaaaacttagccaga

SEQ ID NO: 6159365 - DNA, 11 bp, Homo sapiens
ctgaaaagaaa

SEQ ID NO: 6159366 - DNA, 13 bp, Homo sapiens
ctgaaaagaaata

SEQ ID NO: 6159367 - DNA, 18 bp, Homo sapiens
ctgaaaagaaggaatata

SEQ ID NO: 6159368 - DNA, 13 bp, Homo sapiens
ctgaaaaggaacg

SEQ ID NO: 6159369 - DNA, 22 bp, Homo sapiens
ctgaaaaggaggtatctagcaa

SEQ ID NO: 6159370 - DNA, 18 bp, Homo sapiens
ctgaaaaggatcgaggca

SEQ ID NO: 6159371 - DNA, 10 bp, Homo sapiens
ctgaaaaggg

SEQ ID NO: 6159372 - DNA, 20 bp, Homo sapiens
ctgaaaagggcactcccaac

SEQ ID NO: 6159373 - DNA, 11 bp, Homo sapiens
ctgaaaagtgc

SEQ ID NO: 6159374 - DNA, 20 bp, Homo sapiens
ctgaaaataacagaattctg

SEQ ID NO: 6159375 - DNA, 15 bp, Homo sapiens
ctgaaaatacatttc

SEQ ID NO: 6159376 - DNA, 20 bp, Homo sapiens
ctgaaaatagaacttgcctt

SEQ ID NO: 6159377 - DNA, 15 bp, Homo sapiens
ctgaaaatagcagga

SEQ ID NO: 6159378 - DNA, 13 bp, Homo sapiens
ctgaaaatataac

SEQ ID NO: 6159379 - DNA, 17 bp, Homo sapiens
ctgaaaatattctactg

SEQ ID NO: 6159380 - DNA, 19 bp, Homo sapiens
ctgaaaatatttttttcta

SEQ ID NO: 6159381 - DNA, 16 bp, Homo sapiens
ctgaaaatcaaagtaa

SEQ ID NO: 6159382 - DNA, 13 bp, Homo sapiens
ctgaaaatcacta

SEQ ID NO: 6159383 - DNA, 13 bp, Homo sapiens
ctgaaaatccaat

SEQ ID NO: 6159384 - DNA, 20 bp, Homo sapiens
ctgaaaatcgagtttttcct

SEQ ID NO: 6159385 - DNA, 15 bp, Homo sapiens
ctgaaaatctaatat

SEQ ID NO: 6159386 - DNA, 16 bp, Homo sapiens
ctgaaaatctaatatt

SEQ ID NO: 6159387 - DNA, 13 bp, Homo sapiens
ctgaaaatgaaag

SEQ ID NO: 6159388 - DNA, 18 bp, Homo sapiens
ctgaaaatgcaaagctga

SEQ ID NO: 6159389 - DNA, 13 bp, Homo sapiens
ctgaaaatgtgct

SEQ ID NO: 6159390 - DNA, 12 bp, Homo sapiens
ctgaaaatgttg

SEQ ID NO: 6159391 - DNA, 21 bp, Homo sapiens
ctgaaaatgttgttatgctat

SEQ ID NO: 6159392 - DNA, 17 bp, Homo sapiens
ctgaaaattatttaaac

SEQ ID NO: 6159393 - DNA, 13 bp, Homo sapiens
ctgaaaattccaa

SEQ ID NO: 6159394 - DNA, 17 bp, Homo sapiens
ctgaaaatttatataac

SEQ ID NO: 6159395 - DNA, 19 bp, Homo sapiens
ctgaaacacgaaacttgtt

SEQ ID NO: 6159396 - DNA, 17 bp, Homo sapiens
ctgaaacactggacctg

SEQ ID NO: 6159397 - DNA, 14 bp, Homo sapiens
ctgaaacagcctct

SEQ ID NO: 6159398 - DNA, 11 bp, Homo sapiens
ctgaaacagct

SEQ ID NO: 6159399 - DNA, 14 bp, Homo sapiens
ctgaaacagctgcc

SEQ ID NO: 6159400 - DNA, 15 bp, Homo sapiens
ctgaaacagctgcct

SEQ ID NO: 6159401 - DNA, 22 bp, Homo sapiens
ctgaaacagctgccttagcttc

SEQ ID NO: 6159402 - DNA, 23 bp, Homo sapiens
ctgaaacagctgccttagcttca

SEQ ID NO: 6159403 - DNA, 20 bp, Homo sapiens
ctgaaacaggccctctgtgg

SEQ ID NO: 6159404 - DNA, 20 bp, Homo sapiens
ctgaaacattcacacagggc

SEQ ID NO: 6159405 - DNA, 20 bp, Homo sapiens
ctgaaacattccgaagaggg

SEQ ID NO: 6159406 - DNA, 21 bp, Homo sapiens
ctgaaacatttgacacataaa

SEQ ID NO: 6159407 - DNA, 15 bp, Homo sapiens
ctgaaaccagaagac

SEQ ID NO: 6159408 - DNA, 18 bp, Homo sapiens
ctgaaaccagaagactgg

SEQ ID NO: 6159409 - DNA, 22 bp, Homo sapiens
ctgaaaccagaagactggatca

SEQ ID NO: 6159410 - DNA, 12 bp, Homo sapiens
ctgaaaccattt

SEQ ID NO: 6159411 - DNA, 19 bp, Homo sapiens
ctgaaacccaaagccctgg

SEQ ID NO: 6159412 - DNA, 15 bp, Homo sapiens
ctgaaacccacagat

SEQ ID NO: 6159413 - DNA, 21 bp, Homo sapiens
ctgaaacccatttacttagga

SEQ ID NO: 6159414 - DNA, 20 bp, Homo sapiens
ctgaaacccgccctcagggg

SEQ ID NO: 6159415 - DNA, 22 bp, Homo sapiens
ctgaaacccgccctcaggggcc

SEQ ID NO: 6159416 - DNA, 14 bp, Homo sapiens
ctgaaacctctgtt

SEQ ID NO: 6159417 - DNA, 16 bp, Homo sapiens
ctgaaacctcttccta

SEQ ID NO: 6159418 - DNA, 17 bp, Homo sapiens
ctgaaacctcttcctag

SEQ ID NO: 6159419 - DNA, 16 bp, Homo sapiens
ctgaaacgagaagtgc

SEQ ID NO: 6159420 - DNA, 20 bp, Homo sapiens
ctgaaacgagaagtgccctt

SEQ ID NO: 6159421 - DNA, 21 bp, Homo sapiens
ctgaaacgagaagtgccctta

SEQ ID NO: 6159422 - DNA, 13 bp, Homo sapiens
ctgaaacggcccc

SEQ ID NO: 6159423 - DNA, 15 bp, Homo sapiens
ctgaaactaatgaaa

SEQ ID NO: 6159424 - DNA, 17 bp, Homo sapiens
ctgaaactactgtatct

SEQ ID NO: 6159425 - DNA, 12 bp, Homo sapiens
ctgaaactatat

SEQ ID NO: 6159426 - DNA, 22 bp, Homo sapiens
ctgaaactcacacaactaggaa

SEQ ID NO: 6159427 - DNA, 15 bp, Homo sapiens
ctgaaactcccttgt

SEQ ID NO: 6159428 - DNA, 20 bp, Homo sapiens
ctgaaactggcttccccact

SEQ ID NO: 6159429 - DNA, 22 bp, Homo sapiens
ctgaaactggcttccccactcc

SEQ ID NO: 6159430 - DNA, 22 bp, Homo sapiens
ctgaaactggttttaagtgctt

SEQ ID NO: 6159431 - DNA, 20 bp, Homo sapiens
ctgtaaagaaagagagaaaa

SEQ ID NO: 6159432 - DNA, 23 bp, Homo sapiens
ctgtaaagaaagagagaaaataa

SEQ ID NO: 6159433 - DNA, 23 bp, Homo sapiens
ctgtaaagagacctacctcaggt

SEQ ID NO: 6159434 - DNA, 12 bp, Homo sapiens
ctgtaaagatgt

SEQ ID NO: 6159435 - DNA, 19 bp, Homo sapiens
ctgtaaaggtcaacaataa

SEQ ID NO: 6159436 - DNA, 21 bp, Homo sapiens
ctgtaaagtctgagtaagaaa

SEQ ID NO: 6159437 - DNA, 19 bp, Homo sapiens
ctgtaaataaaatgtgtac

SEQ ID NO: 6159438 - DNA, 22 bp, Homo sapiens
ctgtaaataaaatgtgtacagt

SEQ ID NO: 6159439 - DNA, 21 bp, Homo sapiens
ctgtaaataatgtgcactgaa

SEQ ID NO: 6159440 - DNA, 16 bp, Homo sapiens
ctgtaaatacaaaata

SEQ ID NO: 6159441 - DNA, 22 bp, Homo sapiens
ctgtaaatacatcctttttctg

SEQ ID NO: 6159442 - DNA, 15 bp, Homo sapiens
ctgtaaataccattg

SEQ ID NO: 6159443 - DNA, 21 bp, Homo sapiens
ctgtaaatagttttaaatatg

SEQ ID NO: 6159444 - DNA, 22 bp, Homo sapiens
ctgtaaatagttttaaatatga

SEQ ID NO: 6159445 - DNA, 16 bp, Homo sapiens
ctgtaaatatccacag

SEQ ID NO: 6159446 - DNA, 18 bp, Homo sapiens
ctgtaaatatccacagac

SEQ ID NO: 6159447 - DNA, 16 bp, Homo sapiens
ctgtaaatatcccaga

SEQ ID NO: 6159448 - DNA, 21 bp, Homo sapiens
ctgtaaatatcccagagaaca

SEQ ID NO: 6159449 - DNA, 23 bp, Homo sapiens
ctgtaaatatcccagagaacaat

SEQ ID NO: 6159450 - DNA, 14 bp, Homo sapiens
ctgtaaatatccct

SEQ ID NO: 6159451 - DNA, 14 bp, Homo sapiens
ctgtaaatatgttt

SEQ ID NO: 6159452 - DNA, 18 bp, Homo sapiens
ctgtaaatatgtttgtgc

SEQ ID NO: 6159453 - DNA, 18 bp, Homo sapiens
ctgtaaatatttcataaa

SEQ ID NO: 6159454 - DNA, 21 bp, Homo sapiens
ctgtaaatcaagaccaaagag

SEQ ID NO: 6159455 - DNA, 14 bp, Homo sapiens
ctgtaaatcacttg

SEQ ID NO: 6159456 - DNA, 15 bp, Homo sapiens
ctgtaaatcacttgt

SEQ ID NO: 6159457 - DNA, 16 bp, Homo sapiens
ctgtaaatcacttgta

SEQ ID NO: 6159458 - DNA, 17 bp, Homo sapiens
ctgtaaatcacttgtaa

SEQ ID NO: 6159459 - DNA, 19 bp, Homo sapiens
ctgtaaatcacttgtaaat

SEQ ID NO: 6159460 - DNA, 20 bp, Homo sapiens
ctgtaaatcacttgtaaata

SEQ ID NO: 6159461 - DNA, 15 bp, Homo sapiens
ctgtaaatcataatg

SEQ ID NO: 6159462 - DNA, 16 bp, Homo sapiens
ctgtaaatcataatgt

SEQ ID NO: 6159463 - DNA, 21 bp, Homo sapiens
ctgtaaatcctagacttgaaa

SEQ ID NO: 6159464 - DNA, 17 bp, Homo sapiens
ctgtaaatctaacatta

SEQ ID NO: 6159465 - DNA, 18 bp, Homo sapiens
ctgtaaatctacacacgg

SEQ ID NO: 6159466 - DNA, 18 bp, Homo sapiens
ctgtaaatgtattcattc

SEQ ID NO: 6159467 - DNA, 19 bp, Homo sapiens
ctgtaaatgtattcattct

SEQ ID NO: 6159468 - DNA, 13 bp, Homo sapiens
ctgtaaatgtgac

SEQ ID NO: 6159469 - DNA, 16 bp, Homo sapiens
ctgtaaattattttaa

SEQ ID NO: 6159470 - DNA, 14 bp, Homo sapiens
ctgtaaattgaact

SEQ ID NO: 6159471 - DNA, 15 bp, Homo sapiens
ctgtaaattgaactt

SEQ ID NO: 6159472 - DNA, 16 bp, Homo sapiens
ctgtaaattgaacttc

SEQ ID NO: 6159473 - DNA, 21 bp, Homo sapiens
ctgtaaatttttgttctttta

SEQ ID NO: 6159474 - DNA, 16 bp, Homo sapiens
ctgtaacaagccagat

SEQ ID NO: 6159475 - DNA, 15 bp, Homo sapiens
ctgtaacaatgtaat

SEQ ID NO: 6159476 - DNA, 21 bp, Homo sapiens
ctgtaacacaagccacagaag

SEQ ID NO: 6159477 - DNA, 21 bp, Homo sapiens
ctgtaacacagctgagagact

SEQ ID NO: 6159478 - DNA, 16 bp, Homo sapiens
ctgtaacactcctctg

SEQ ID NO: 6159479 - DNA, 17 bp, Homo sapiens
ctgtaacaggtattttg

SEQ ID NO: 6159480 - DNA, 11 bp, Homo sapiens
ctgtaacatat

SEQ ID NO: 6159481 - DNA, 17 bp, Homo sapiens
ctgtaacatatatgaaa

SEQ ID NO: 6159482 - DNA, 16 bp, Homo sapiens
ctgtaacccccaagga

SEQ ID NO: 6159483 - DNA, 19 bp, Homo sapiens
ctgtaacccttgaatttct

SEQ ID NO: 6159484 - DNA, 22 bp, Homo sapiens
ctgtaacccttgaatttctaga

SEQ ID NO: 6159485 - DNA, 15 bp, Homo sapiens
ctgtaacctcttcag

SEQ ID NO: 6159486 - DNA, 19 bp, Homo sapiens
ctgtaacctcttcagaggc

SEQ ID NO: 6159487 - DNA, 22 bp, Homo sapiens
ctgtaacctcttcagaggccct

SEQ ID NO: 6159488 - DNA, 14 bp, Homo sapiens
ctgtaacctgctgg

SEQ ID NO: 6159489 - DNA, 20 bp, Homo sapiens
ctgtaacgggtcgtgctcat

SEQ ID NO: 6159490 - DNA, 15 bp, Homo sapiens
ctgtaacgtgtgctg

SEQ ID NO: 6159491 - DNA, 17 bp, Homo sapiens
ctgtaactaaaggaatc

SEQ ID NO: 6159492 - DNA, 15 bp, Homo sapiens
ctgtaactcagacat

SEQ ID NO: 6159493 - DNA, 15 bp, Homo sapiens
ctgtaactctaaaag

SEQ ID NO: 6159494 - DNA, 20 bp, Homo sapiens
ctgtaactctcaattccctg

SEQ ID NO: 6159495 - DNA, 14 bp, Homo sapiens
ctgtaactgagaga

SEQ ID NO: 6159496 - DNA, 17 bp, Homo sapiens
ctgtaactgagagaaag

SEQ ID NO: 6159497 - DNA, 14 bp, Homo sapiens
ctgtaactgcatta

SEQ ID NO: 6159498 - DNA, 22 bp, Homo sapiens
ctgtaactgcattagaaaccat

SEQ ID NO: 6159499 - DNA, 15 bp, Homo sapiens
ctgtaactgccaggc

SEQ ID NO: 6159500 - DNA, 16 bp, Homo sapiens
ctgtaactgccaggct

SEQ ID NO: 6159501 - DNA, 14 bp, Homo sapiens
ctgtaactgcccag

SEQ ID NO: 6159502 - DNA, 20 bp, Homo sapiens
ctgtaactgctcagagcttt

SEQ ID NO: 6159503 - DNA, 19 bp, Homo sapiens
ctgtaactgctgagccact

SEQ ID NO: 6159504 - DNA, 22 bp, Homo sapiens
ctgtaactggtagtgttcagta

SEQ ID NO: 6159505 - DNA, 15 bp, Homo sapiens
ctgtaacttaaaata

SEQ ID NO: 6159506 - DNA, 16 bp, Homo sapiens
ctgtaacttccaaata

SEQ ID NO: 6159507 - DNA, 23 bp, Homo sapiens
ctgtaacttgatccatttctaat

SEQ ID NO: 6159508 - DNA, 20 bp, Homo sapiens
ctgtaagaaaatatcacttg

SEQ ID NO: 6159509 - DNA, 21 bp, Homo sapiens
ctgtaagaaacctactgccca

SEQ ID NO: 6159510 - DNA, 20 bp, Homo sapiens
ctgtaagaagagactgggaa

SEQ ID NO: 6159511 - DNA, 23 bp, Homo sapiens
ctgtaagaagagactgggaagat

SEQ ID NO: 6159512 - DNA, 12 bp, Homo sapiens
ctgtaagacatt

SEQ ID NO: 6159513 - DNA, 19 bp, Homo sapiens
ctgtaagacgtatgtaaca

SEQ ID NO: 6159514 - DNA, 21 bp, Homo sapiens
ctgtaagactcattccctaga

SEQ ID NO: 6159515 - DNA, 19 bp, Homo sapiens
ctgtaagatgttgttttag

SEQ ID NO: 6159516 - DNA, 19 bp, Homo sapiens
ctgtaagattttattttca

SEQ ID NO: 6159517 - DNA, 22 bp, Homo sapiens
ctgtaagcacctgggctgagga

SEQ ID NO: 6159518 - DNA, 23 bp, Homo sapiens
ctgtaagcacctgggctgaggag

SEQ ID NO: 6159519 - DNA, 19 bp, Homo sapiens
ctgtaagcagattacaata

SEQ ID NO: 6159520 - DNA, 17 bp, Homo sapiens
ctgtaagcctatatata

SEQ ID NO: 6159521 - DNA, 15 bp, Homo sapiens
ctgtaagctccatga

SEQ ID NO: 6159522 - DNA, 20 bp, Homo sapiens
ctgtaagctctttgaaacaa

SEQ ID NO: 6159523 - DNA, 14 bp, Homo sapiens
ctgtaagctgaagt

SEQ ID NO: 6159524 - DNA, 17 bp, Homo sapiens
ctgtaagctttgttctg

SEQ ID NO: 6159525 - DNA, 18 bp, Homo sapiens
ctgtaagctttgttctgg

SEQ ID NO: 6159526 - DNA, 20 bp, Homo sapiens
ctgtaagctttgttctggga

SEQ ID NO: 6159527 - DNA, 23 bp, Homo sapiens
ctgtaagcttttaagaaaaacaa

SEQ ID NO: 6159528 - DNA, 16 bp, Homo sapiens
ctgtaaggaaatgtta

SEQ ID NO: 6159529 - DNA, 15 bp, Homo sapiens
ctgtaaggaactgga

SEQ ID NO: 6159530 - DNA, 15 bp, Homo sapiens
ctgtaaggactcagt

SEQ ID NO: 6159531 - DNA, 20 bp, Homo sapiens
ctgtaaggctctagatcata

SEQ ID NO: 6159532 - DNA, 13 bp, Homo sapiens
ctgtaagggcagt

SEQ ID NO: 6159533 - DNA, 16 bp, Homo sapiens
ctgtaagggcagtgcc

SEQ ID NO: 6159534 - DNA, 12 bp, Homo sapiens
ctgtaaggggca

SEQ ID NO: 6159535 - DNA, 21 bp, Homo sapiens
ctgtaaggtgcttgctcccca

SEQ ID NO: 6159536 - DNA, 17 bp, Homo sapiens
ctgtaagtgtagctcaa

SEQ ID NO: 6159537 - DNA, 21 bp, Homo sapiens
ctgtaagttacatgaaggcag

SEQ ID NO: 6159538 - DNA, 22 bp, Homo sapiens
ctgtaataaactcatttctagc

SEQ ID NO: 6159539 - DNA, 20 bp, Homo sapiens
ctgtaataaagatgattgtg

SEQ ID NO: 6159540 - DNA, 14 bp, Homo sapiens
ctgtaataaatatg

SEQ ID NO: 6159541 - DNA, 15 bp, Homo sapiens
ctgtaataaatatga

SEQ ID NO: 6159542 - DNA, 14 bp, Homo sapiens
ctgtaataatacct

SEQ ID NO: 6159543 - DNA, 15 bp, Homo sapiens
ctgtaataatacctc

SEQ ID NO: 6159544 - DNA, 16 bp, Homo sapiens
ctgtaataatacctca

SEQ ID NO: 6159545 - DNA, 17 bp, Homo sapiens
ctgtaataatacctcaa

SEQ ID NO: 6159546 - DNA, 18 bp, Homo sapiens
ctgtaataatattttaga

SEQ ID NO: 6159547 - DNA, 20 bp, Homo sapiens
ctgtaatactaagtcctcag

SEQ ID NO: 6159548 - DNA, 19 bp, Homo sapiens
ctgtaatagatcagcatcc

SEQ ID NO: 6159549 - DNA, 20 bp, Homo sapiens
ctgtaatagatcagcatcca

SEQ ID NO: 6159550 - DNA, 22 bp, Homo sapiens
ctgtaatagttcagtagaatta

SEQ ID NO: 6159551 - DNA, 15 bp, Homo sapiens
ctgtaatatataatc

SEQ ID NO: 6159552 - DNA, 15 bp, Homo sapiens
ctgtaatatctattt

SEQ ID NO: 6159553 - DNA, 13 bp, Homo sapiens
ctgtaatatcttt

SEQ ID NO: 6159554 - DNA, 22 bp, Homo sapiens
ctgtaatatttacaatgtatta

SEQ ID NO: 6159555 - DNA, 15 bp, Homo sapiens
ctgtaatcaaaagga

SEQ ID NO: 6159556 - DNA, 17 bp, Homo sapiens
ctgtaatcaaaaggagg

SEQ ID NO: 6159557 - DNA, 20 bp, Homo sapiens
ctgtaatcaatatcccaaca

SEQ ID NO: 6159558 - DNA, 16 bp, Homo sapiens
ctgtaatcaggcaagg

SEQ ID NO: 6159559 - DNA, 17 bp, Homo sapiens
ctgtaatcaggcaagga

SEQ ID NO: 6159560 - DNA, 19 bp, Homo sapiens
ctgtaatcaggcaaggagg

SEQ ID NO: 6159561 - DNA, 21 bp, Homo sapiens
ctgtaatcaggcaaggaggag

SEQ ID NO: 6159562 - DNA, 19 bp, Homo sapiens
ctgtaatcagttatgccgt

SEQ ID NO: 6159563 - DNA, 16 bp, Homo sapiens
ctgtaatcccagaact

SEQ ID NO: 6159564 - DNA, 17 bp, Homo sapiens
ctgtaatcccagcactt

SEQ ID NO: 6159565 - DNA, 19 bp, Homo sapiens
ctgtaatcccagcactttg

SEQ ID NO: 6159566 - DNA, 14 bp, Homo sapiens
ctgtaatcccagct

SEQ ID NO: 6159567 - DNA, 20 bp, Homo sapiens
ctgtaatcctagcactttgg

SEQ ID NO: 6159568 - DNA, 14 bp, Homo sapiens
ctgtaatcctagct

SEQ ID NO: 6159569 - DNA, 20 bp, Homo sapiens
ctgtaatcgccctactattc

SEQ ID NO: 6159570 - DNA, 14 bp, Homo sapiens
ctgtaatctatgaa

SEQ ID NO: 6159571 - DNA, 17 bp, Homo sapiens
ctgtaatcttgttgata

SEQ ID NO: 6159572 - DNA, 15 bp, Homo sapiens
ctgtaatctttttct

SEQ ID NO: 6159573 - DNA, 20 bp, Homo sapiens
ctgtaatgaaccgctgaata

SEQ ID NO: 6159574 - DNA, 21 bp, Homo sapiens
ctgtaatgaaccgctgaatat

SEQ ID NO: 6159575 - DNA, 16 bp, Homo sapiens
ctgtaatgacaaaaga

SEQ ID NO: 6159576 - DNA, 16 bp, Homo sapiens
ctgtaatgaggaaaaa

SEQ ID NO: 6159577 - DNA, 17 bp, Homo sapiens
ctgtaatgcactcctgc

SEQ ID NO: 6159578 - DNA, 20 bp, Homo sapiens
ctgtaatgctgcctcaggac

SEQ ID NO: 6159579 - DNA, 22 bp, Homo sapiens
ctgtaatgctgcctcaggaccc

SEQ ID NO: 6159580 - DNA, 14 bp, Homo sapiens
ctgtaatgtaaata

SEQ ID NO: 6159581 - DNA, 16 bp, Homo sapiens
ctgtaatgtaaataaa

SEQ ID NO: 6159582 - DNA, 20 bp, Homo sapiens
ctgtaatgtgaatctatgct

SEQ ID NO: 6159583 - DNA, 19 bp, Homo sapiens
ctgtaatgttaaactcttt

SEQ ID NO: 6159584 - DNA, 16 bp, Homo sapiens
ctgtaatgttaataat

SEQ ID NO: 6159585 - DNA, 15 bp, Homo sapiens
ctgtaatgttaatat

SEQ ID NO: 6159586 - DNA, 19 bp, Homo sapiens
ctgtaattaaactagttta

SEQ ID NO: 6159587 - DNA, 18 bp, Homo sapiens
ctgtaattaagtaaacca

SEQ ID NO: 6159588 - DNA, 17 bp, Homo sapiens
ctgtaattaatattcct

SEQ ID NO: 6159589 - DNA, 18 bp, Homo sapiens
ctgtaattaatattccta

SEQ ID NO: 6159590 - DNA, 14 bp, Homo sapiens
ctgtaattacaact

SEQ ID NO: 6159591 - DNA, 14 bp, Homo sapiens
ctgtaattacatat

SEQ ID NO: 6159592 - DNA, 20 bp, Homo sapiens
ctgtaattacatatttgact

SEQ ID NO: 6159593 - DNA, 18 bp, Homo sapiens
ctgtaattatatctaaaa

SEQ ID NO: 6159594 - DNA, 17 bp, Homo sapiens
ctgtaattatttgaatg

SEQ ID NO: 6159595 - DNA, 24 bp, Homo sapiens
ctgtaattcattgagcagttagct

SEQ ID NO: 6159596 - DNA, 22 bp, Homo sapiens
ctgtaattcttctcctttgtca

SEQ ID NO: 6159597 - DNA, 14 bp, Homo sapiens
ctgtaattgcaaaa

SEQ ID NO: 6159598 - DNA, 13 bp, Homo sapiens
ctgtaattgtaat

SEQ ID NO: 6159599 - DNA, 16 bp, Homo sapiens
ctgtaattgtgtgtga

SEQ ID NO: 6159600 - DNA, 13 bp, Homo sapiens
ctgtaatttaatt

SEQ ID NO: 6159601 - DNA, 13 bp, Homo sapiens
ctgtaatttagtt

SEQ ID NO: 6159602 - DNA, 18 bp, Homo sapiens
ctgtaatttcagctagtt

SEQ ID NO: 6159603 - DNA, 18 bp, Homo sapiens
ctgtaatttgtgatacaa

SEQ ID NO: 6159604 - DNA, 22 bp, Homo sapiens
ctgtaatttgtgatacaatgct

SEQ ID NO: 6159605 - DNA, 21 bp, Homo sapiens
ctgtaattttgtttgtaatcc

SEQ ID NO: 6159606 - DNA, 23 bp, Homo sapiens
ctgtacaaaaaaatcttccaatt

SEQ ID NO: 6159607 - DNA, 13 bp, Homo sapiens
ctgtacaaaaaca

SEQ ID NO: 6159608 - DNA, 23 bp, Homo sapiens
ctgaaactgtggggcttacagaa

SEQ ID NO: 6159609 - DNA, 17 bp, Homo sapiens
ctgaaacttacacacaa

SEQ ID NO: 6159610 - DNA, 15 bp, Homo sapiens
ctgaaacttttctaa

SEQ ID NO: 6159611 - DNA, 21 bp, Homo sapiens
ctgaaagaaacagttaacttt

SEQ ID NO: 6159612 - DNA, 13 bp, Homo sapiens
ctgaaagaaacta

SEQ ID NO: 6159613 - DNA, 19 bp, Homo sapiens
ctgaaagaacatggacttg

SEQ ID NO: 6159614 - DNA, 12 bp, Homo sapiens
ctgaaagaagaa

SEQ ID NO: 6159615 - DNA, 19 bp, Homo sapiens
ctgaaagaagaaaacagta

SEQ ID NO: 6159616 - DNA, 20 bp, Homo sapiens
ctgaaagaagaacagctgtt

SEQ ID NO: 6159617 - DNA, 23 bp, Homo sapiens
ctgaaagaagaacagctgttcct

SEQ ID NO: 6159618 - DNA, 16 bp, Homo sapiens
ctgaaagacagaatgt

SEQ ID NO: 6159619 - DNA, 18 bp, Homo sapiens
ctgaaagacagaatgtca

SEQ ID NO: 6159620 - DNA, 21 bp, Homo sapiens
ctgaaagactgaagaaagtgt

SEQ ID NO: 6159621 - DNA, 14 bp, Homo sapiens
ctgaaagacttgaa

SEQ ID NO: 6159622 - DNA, 17 bp, Homo sapiens
ctgaaagaggaatgaag

SEQ ID NO: 6159623 - DNA, 14 bp, Homo sapiens
ctgaaagaggctga

SEQ ID NO: 6159624 - DNA, 17 bp, Homo sapiens
ctgaaagagtctttctt

SEQ ID NO: 6159625 - DNA, 20 bp, Homo sapiens
ctgaaagatatgtatatttt

SEQ ID NO: 6159626 - DNA, 23 bp, Homo sapiens
ctgaaagatatgtatatttttga

SEQ ID NO: 6159627 - DNA, 19 bp, Homo sapiens
ctgaaagatctctgtcaca

SEQ ID NO: 6159628 - DNA, 14 bp, Homo sapiens
ctgaaagcaacagc

SEQ ID NO: 6159629 - DNA, 16 bp, Homo sapiens
ctgaaagcacaggaga

SEQ ID NO: 6159630 - DNA, 16 bp, Homo sapiens
ctgaaagcaggatgaa

SEQ ID NO: 6159631 - DNA, 15 bp, Homo sapiens
ctgaaagccaaggca

SEQ ID NO: 6159632 - DNA, 21 bp, Homo sapiens
ctgaaagccacgttccttact

SEQ ID NO: 6159633 - DNA, 21 bp, Homo sapiens
ctgaaagccagcaaagcctcc

SEQ ID NO: 6159634 - DNA, 22 bp, Homo sapiens
ctgaaagccagcaaagcctcca

SEQ ID NO: 6159635 - DNA, 14 bp, Homo sapiens
ctgaaagccagctg

SEQ ID NO: 6159636 - DNA, 13 bp, Homo sapiens
ctgaaagcctgtc

SEQ ID NO: 6159637 - DNA, 14 bp, Homo sapiens
ctgaaagcctgtct

SEQ ID NO: 6159638 - DNA, 15 bp, Homo sapiens
ctgaaagcctgtctc

SEQ ID NO: 6159639 - DNA, 18 bp, Homo sapiens
ctgaaagcctgtctcttt

SEQ ID NO: 6159640 - DNA, 21 bp, Homo sapiens
ctgaaagcctgtctctttcca

SEQ ID NO: 6159641 - DNA, 22 bp, Homo sapiens
ctgaaagcctgtctctttccac

SEQ ID NO: 6159642 - DNA, 18 bp, Homo sapiens
ctgaaagcggctgcctcc

SEQ ID NO: 6159643 - DNA, 14 bp, Homo sapiens
ctgaaagctgcttc

SEQ ID NO: 6159644 - DNA, 15 bp, Homo sapiens
ctgaaagctgcttct

SEQ ID NO: 6159645 - DNA, 18 bp, Homo sapiens
ctgaaagctggtggcaga

SEQ ID NO: 6159646 - DNA, 13 bp, Homo sapiens
ctgaaagctgttg

SEQ ID NO: 6159647 - DNA, 20 bp, Homo sapiens
ctgaaaggaaatacacttct

SEQ ID NO: 6159648 - DNA, 21 bp, Homo sapiens
ctgaaaggaaatacacttctt

SEQ ID NO: 6159649 - DNA, 16 bp, Homo sapiens
ctgaaaggaacactgg

SEQ ID NO: 6159650 - DNA, 13 bp, Homo sapiens
ctgaaaggagaca

SEQ ID NO: 6159651 - DNA, 14 bp, Homo sapiens
ctgaaaggagacat

SEQ ID NO: 6159652 - DNA, 22 bp, Homo sapiens
ctgaaaggagacattgctctat

SEQ ID NO: 6159653 - DNA, 24 bp, Homo sapiens
ctgaaaggagacattgctctatgt

SEQ ID NO: 6159654 - DNA, 17 bp, Homo sapiens
ctgaaaggccagcagct

SEQ ID NO: 6159655 - DNA, 23 bp, Homo sapiens
ctgaaaggccagcagctgatgct

SEQ ID NO: 6159656 - DNA, 21 bp, Homo sapiens
ctgaaagggaaggacagctgt

SEQ ID NO: 6159657 - DNA, 21 bp, Homo sapiens
ctgaaagggaaggagacacat

SEQ ID NO: 6159658 - DNA, 15 bp, Homo sapiens
ctgaaagggagcccc

SEQ ID NO: 6159659 - DNA, 16 bp, Homo sapiens
ctgaaagggagcccct

SEQ ID NO: 6159660 - DNA, 20 bp, Homo sapiens
ctgaaagggatggccacaag

SEQ ID NO: 6159661 - DNA, 16 bp, Homo sapiens
ctgaaaggtgctttct

SEQ ID NO: 6159662 - DNA, 15 bp, Homo sapiens
ctgaaagtaatttca

SEQ ID NO: 6159663 - DNA, 17 bp, Homo sapiens
ctgaaagtaatttcaag

SEQ ID NO: 6159664 - DNA, 23 bp, Homo sapiens
ctgaaagtaatttcaagaatgtt

SEQ ID NO: 6159665 - DNA, 18 bp, Homo sapiens
ctgaaagtcctgctttcc

SEQ ID NO: 6159666 - DNA, 19 bp, Homo sapiens
ctgaaagtcctgctttcct

SEQ ID NO: 6159667 - DNA, 23 bp, Homo sapiens
ctgaaagtctgtggcccaagaga

SEQ ID NO: 6159668 - DNA, 23 bp, Homo sapiens
ctgaaagtgaaagtccagaaact

SEQ ID NO: 6159669 - DNA, 16 bp, Homo sapiens
ctgaaagtgacagaga

SEQ ID NO: 6159670 - DNA, 17 bp, Homo sapiens
ctgaaagtgacagagac

SEQ ID NO: 6159671 - DNA, 12 bp, Homo sapiens
ctgaaagtgtgt

SEQ ID NO: 6159672 - DNA, 11 bp, Homo sapiens
ctgaaagtgtt

SEQ ID NO: 6159673 - DNA, 13 bp, Homo sapiens
ctgaaagtgtttt

SEQ ID NO: 6159674 - DNA, 14 bp, Homo sapiens
ctgaaagtgtttta

SEQ ID NO: 6159675 - DNA, 15 bp, Homo sapiens
ctgaaagtgttttac

SEQ ID NO: 6159676 - DNA, 21 bp, Homo sapiens
ctgaaagtgttttactctttt

SEQ ID NO: 6159677 - DNA, 22 bp, Homo sapiens
ctgaaagtgttttactcttttt

SEQ ID NO: 6159678 - DNA, 23 bp, Homo sapiens
ctgaaagtgttttactctttttc

SEQ ID NO: 6159679 - DNA, 13 bp, Homo sapiens
ctgaaagttaccc

SEQ ID NO: 6159680 - DNA, 16 bp, Homo sapiens
ctgaaagttgtacatg

SEQ ID NO: 6159681 - DNA, 15 bp, Homo sapiens
ctgaaagttttgata

SEQ ID NO: 6159682 - DNA, 17 bp, Homo sapiens
ctgaaagttttgtaaaa

SEQ ID NO: 6159683 - DNA, 18 bp, Homo sapiens
ctgaaataaaaaattatg

SEQ ID NO: 6159684 - DNA, 17 bp, Homo sapiens
ctgaaataaacactggt

SEQ ID NO: 6159685 - DNA, 19 bp, Homo sapiens
ctgaaataaacctgcactg

SEQ ID NO: 6159686 - DNA, 22 bp, Homo sapiens
ctgaaataaacctgcactgaaa

SEQ ID NO: 6159687 - DNA, 21 bp, Homo sapiens
ctgaaataatatatttcttct

SEQ ID NO: 6159688 - DNA, 14 bp, Homo sapiens
ctgaaatacaacca

SEQ ID NO: 6159689 - DNA, 17 bp, Homo sapiens
ctgaaatagagtgaatt

SEQ ID NO: 6159690 - DNA, 18 bp, Homo sapiens
ctgaaataggaaacaagt

SEQ ID NO: 6159691 - DNA, 20 bp, Homo sapiens
ctgaaatatattttaaatgt

SEQ ID NO: 6159692 - DNA, 14 bp, Homo sapiens
ctgaaatatccagg

SEQ ID NO: 6159693 - DNA, 22 bp, Homo sapiens
ctgaaatattttcttccttctc

SEQ ID NO: 6159694 - DNA, 18 bp, Homo sapiens
ctgaaatcccaacaaaaa

SEQ ID NO: 6159695 - DNA, 13 bp, Homo sapiens
ctgaaatcctggt

SEQ ID NO: 6159696 - DNA, 21 bp, Homo sapiens
ctgaaatcttcccatgcattc

SEQ ID NO: 6159697 - DNA, 17 bp, Homo sapiens
ctgaaatgacatttcac

SEQ ID NO: 6159698 - DNA, 20 bp, Homo sapiens
ctgaaatgacatttcactaa

SEQ ID NO: 6159699 - DNA, 22 bp, Homo sapiens
ctgaaatgccaagtgcctgctt

SEQ ID NO: 6159700 - DNA, 17 bp, Homo sapiens
ctgaaatgccttacttt

SEQ ID NO: 6159701 - DNA, 23 bp, Homo sapiens
ctgaaatgccttactttgtatga

SEQ ID NO: 6159702 - DNA, 17 bp, Homo sapiens
ctgaaatgctttagcat

SEQ ID NO: 6159703 - DNA, 14 bp, Homo sapiens
ctgaaatggcctgt

SEQ ID NO: 6159704 - DNA, 23 bp, Homo sapiens
ctgaaatggggctactgtttcag

SEQ ID NO: 6159705 - DNA, 13 bp, Homo sapiens
ctgaaatgtcagt

SEQ ID NO: 6159706 - DNA, 18 bp, Homo sapiens
ctgaaatgtcagttctga

SEQ ID NO: 6159707 - DNA, 19 bp, Homo sapiens
ctgaaatgtcagttctgat

SEQ ID NO: 6159708 - DNA, 20 bp, Homo sapiens
ctgaaatgtcagttctgata

SEQ ID NO: 6159709 - DNA, 11 bp, Homo sapiens
ctgaaatgtgt

SEQ ID NO: 6159710 - DNA, 19 bp, Homo sapiens
ctgaaatgtgtgtgatgtg

SEQ ID NO: 6159711 - DNA, 14 bp, Homo sapiens
ctgaaatgtttcca

SEQ ID NO: 6159712 - DNA, 14 bp, Homo sapiens
ctgaaatgtttgga

SEQ ID NO: 6159713 - DNA, 13 bp, Homo sapiens
ctgaaattaaaga

SEQ ID NO: 6159714 - DNA, 20 bp, Homo sapiens
ctgaaattaatttgtgaatt

SEQ ID NO: 6159715 - DNA, 17 bp, Homo sapiens
ctgaaattacatattgc

SEQ ID NO: 6159716 - DNA, 15 bp, Homo sapiens
ctgaaattactttaa

SEQ ID NO: 6159717 - DNA, 21 bp, Homo sapiens
ctgaaattactttaacatttt

SEQ ID NO: 6159718 - DNA, 16 bp, Homo sapiens
ctgaaattagtgtttt

SEQ ID NO: 6159719 - DNA, 17 bp, Homo sapiens
ctgaaattagtgttttc

SEQ ID NO: 6159720 - DNA, 19 bp, Homo sapiens
ctgaaattagtgttttcat

SEQ ID NO: 6159721 - DNA, 20 bp, Homo sapiens
ctgaaattagtgttttcatt

SEQ ID NO: 6159722 - DNA, 19 bp, Homo sapiens
ctgaaattatatatataca

SEQ ID NO: 6159723 - DNA, 18 bp, Homo sapiens
ctgaaattatgtcaaatg

SEQ ID NO: 6159724 - DNA, 15 bp, Homo sapiens
ctgaaattattttct

SEQ ID NO: 6159725 - DNA, 20 bp, Homo sapiens
ctgaaattcacagaagccta

SEQ ID NO: 6159726 - DNA, 22 bp, Homo sapiens
ctgaaattcacagaagcctagg

SEQ ID NO: 6159727 - DNA, 17 bp, Homo sapiens
ctgaaattccaaagtct

SEQ ID NO: 6159728 - DNA, 19 bp, Homo sapiens
ctgaaattccagtttagga

SEQ ID NO: 6159729 - DNA, 16 bp, Homo sapiens
ctgaaattctcctgga

SEQ ID NO: 6159730 - DNA, 20 bp, Homo sapiens
ctgaaattctcctggaggtc

SEQ ID NO: 6159731 - DNA, 15 bp, Homo sapiens
ctgaaattgaaaagt

SEQ ID NO: 6159732 - DNA, 23 bp, Homo sapiens
ctgaaattgagaatccagtttct

SEQ ID NO: 6159733 - DNA, 19 bp, Homo sapiens
ctgaaattggtgggaagca

SEQ ID NO: 6159734 - DNA, 20 bp, Homo sapiens
ctgaaattggtgggaagcaa

SEQ ID NO: 6159735 - DNA, 22 bp, Homo sapiens
ctgaaatttaaactgcaatgcc

SEQ ID NO: 6159736 - DNA, 18 bp, Homo sapiens
ctgaaatttattcacata

SEQ ID NO: 6159737 - DNA, 14 bp, Homo sapiens
ctgaaatttcagat

SEQ ID NO: 6159738 - DNA, 12 bp, Homo sapiens
ctgaaatttccc

SEQ ID NO: 6159739 - DNA, 18 bp, Homo sapiens
ctgaaatttctcattagt

SEQ ID NO: 6159740 - DNA, 15 bp, Homo sapiens
ctgaaatttgctata

SEQ ID NO: 6159741 - DNA, 17 bp, Homo sapiens
ctgaaatttgctatata

SEQ ID NO: 6159742 - DNA, 18 bp, Homo sapiens
ctgaaatttgctatataa

SEQ ID NO: 6159743 - DNA, 20 bp, Homo sapiens
ctgaaatttgctatataatt

SEQ ID NO: 6159744 - DNA, 21 bp, Homo sapiens
ctgaaatttgttatacttcaa

SEQ ID NO: 6159745 - DNA, 22 bp, Homo sapiens
ctgaaatttgttatacttcaaa

SEQ ID NO: 6159746 - DNA, 13 bp, Homo sapiens
ctgaaattttaga

SEQ ID NO: 6159747 - DNA, 13 bp, Homo sapiens
ctgaaattttcta

SEQ ID NO: 6159748 - DNA, 14 bp, Homo sapiens
ctgaaattttctag

SEQ ID NO: 6159749 - DNA, 16 bp, Homo sapiens
ctgaaatttttcttct

SEQ ID NO: 6159750 - DNA, 19 bp, Homo sapiens
ctgaaatttttttcctaag

SEQ ID NO: 6159751 - DNA, 11 bp, Homo sapiens
ctgaacaaaaa

SEQ ID NO: 6159752 - DNA, 13 bp, Homo sapiens
ctgaacaaaaaaa

SEQ ID NO: 6159753 - DNA, 16 bp, Homo sapiens
ctgaacaaaacctaca

SEQ ID NO: 6159754 - DNA, 22 bp, Homo sapiens
ctgaacaaacactgaatcatgt

SEQ ID NO: 6159755 - DNA, 21 bp, Homo sapiens
ctgaacaaagtgctagacttt

SEQ ID NO: 6159756 - DNA, 15 bp, Homo sapiens
ctgaacaagaaagag

SEQ ID NO: 6159757 - DNA, 17 bp, Homo sapiens
ctgaacaaggggcctcc

SEQ ID NO: 6159758 - DNA, 19 bp, Homo sapiens
ctgaacaaggggcctccaa

SEQ ID NO: 6159759 - DNA, 17 bp, Homo sapiens
ctgaacaatattttctc

SEQ ID NO: 6159760 - DNA, 14 bp, Homo sapiens
ctgaacaattacct

SEQ ID NO: 6159761 - DNA, 17 bp, Homo sapiens
ctgaacacaaccagagg

SEQ ID NO: 6159762 - DNA, 22 bp, Homo sapiens
ctgaacacacacgccagctcct

SEQ ID NO: 6159763 - DNA, 13 bp, Homo sapiens
ctgaacacacatt

SEQ ID NO: 6159764 - DNA, 14 bp, Homo sapiens
ctgaacacaggcag

SEQ ID NO: 6159765 - DNA, 15 bp, Homo sapiens
ctgaacacagtgtct

SEQ ID NO: 6159766 - DNA, 17 bp, Homo sapiens
ctgaacacagtgtctgt

SEQ ID NO: 6159767 - DNA, 18 bp, Homo sapiens
ctgaacacatactagaaa

SEQ ID NO: 6159768 - DNA, 19 bp, Homo sapiens
ctgaacacatactagaaag

SEQ ID NO: 6159769 - DNA, 12 bp, Homo sapiens
ctgaacacatgt

SEQ ID NO: 6159770 - DNA, 16 bp, Homo sapiens
ctgaacacatgtgtat

SEQ ID NO: 6159771 - DNA, 18 bp, Homo sapiens
ctgaacaccattgaaggc

SEQ ID NO: 6159772 - DNA, 22 bp, Homo sapiens
ctgaacacttattgctttgaaa

SEQ ID NO: 6159773 - DNA, 17 bp, Homo sapiens
ctgaacagaccggggtg

SEQ ID NO: 6159774 - DNA, 16 bp, Homo sapiens
ctgaacagatgtaaat

SEQ ID NO: 6159775 - DNA, 13 bp, Homo sapiens
ctgaacaggaaag

SEQ ID NO: 6159776 - DNA, 13 bp, Homo sapiens
ctgaacaggctgg

SEQ ID NO: 6159777 - DNA, 13 bp, Homo sapiens
ctgaacaggttct

SEQ ID NO: 6159778 - DNA, 14 bp, Homo sapiens
ctgaacagtgctct

SEQ ID NO: 6159779 - DNA, 21 bp, Homo sapiens
ctgaacagtgctctgcctcta

SEQ ID NO: 6159780 - DNA, 12 bp, Homo sapiens
ctgaacagtgga

SEQ ID NO: 6159781 - DNA, 19 bp, Homo sapiens
ctgaacataacttctcatg

SEQ ID NO: 6159782 - DNA, 17 bp, Homo sapiens
ctgaacatccttccttc

SEQ ID NO: 6159783 - DNA, 15 bp, Homo sapiens
ctgaacatctgagtc

SEQ ID NO: 6159784 - DNA, 13 bp, Homo sapiens
ctgaacatgcctg

SEQ ID NO: 6159785 - DNA, 14 bp, Homo sapiens
ctgaacatgcctgc

SEQ ID NO: 6159786 - DNA, 18 bp, Homo sapiens
ctgaacatgcctgccaaa

SEQ ID NO: 6159787 - DNA, 20 bp, Homo sapiens
ctgtacaaaagggacatgaa

SEQ ID NO: 6159788 - DNA, 14 bp, Homo sapiens
ctgtacaaaatggt

SEQ ID NO: 6159789 - DNA, 17 bp, Homo sapiens
ctgtacaaagggaagca

SEQ ID NO: 6159790 - DNA, 18 bp, Homo sapiens
ctgtacaaagggaagcag

SEQ ID NO: 6159791 - DNA, 13 bp, Homo sapiens
ctgtacaaagtag

SEQ ID NO: 6159792 - DNA, 20 bp, Homo sapiens
ctgtacaaataatagcaatg

SEQ ID NO: 6159793 - DNA, 19 bp, Homo sapiens
ctgtacaaatataagaata

SEQ ID NO: 6159794 - DNA, 23 bp, Homo sapiens
ctgtacaagggagaaaagctgta

SEQ ID NO: 6159795 - DNA, 11 bp, Homo sapiens
ctgtacaataa

SEQ ID NO: 6159796 - DNA, 21 bp, Homo sapiens
ctgtacaatatttaaaattta

SEQ ID NO: 6159797 - DNA, 22 bp, Homo sapiens
ctgtacaatcatgaacagctct

SEQ ID NO: 6159798 - DNA, 20 bp, Homo sapiens
ctgtacacaactcactcctt

SEQ ID NO: 6159799 - DNA, 12 bp, Homo sapiens
ctgtacacacac

SEQ ID NO: 6159800 - DNA, 15 bp, Homo sapiens
ctgtacacacacaga

SEQ ID NO: 6159801 - DNA, 20 bp, Homo sapiens
ctgtacacacacagacacac

SEQ ID NO: 6159802 - DNA, 13 bp, Homo sapiens
ctgtacacaccct

SEQ ID NO: 6159803 - DNA, 22 bp, Homo sapiens
ctgtacacaccctccagcacag

SEQ ID NO: 6159804 - DNA, 21 bp, Homo sapiens
ctgtacacatttcttaaaaca

SEQ ID NO: 6159805 - DNA, 16 bp, Homo sapiens
ctgtacacgtgtcctg

SEQ ID NO: 6159806 - DNA, 18 bp, Homo sapiens
ctgtacacgtgtcctgta

SEQ ID NO: 6159807 - DNA, 19 bp, Homo sapiens
ctgtacactgaatatttat

SEQ ID NO: 6159808 - DNA, 21 bp, Homo sapiens
ctgtacactgacttgagacca

SEQ ID NO: 6159809 - DNA, 13 bp, Homo sapiens
ctgtacactgccc

SEQ ID NO: 6159810 - DNA, 20 bp, Homo sapiens
ctgtacagaatttccactgt

SEQ ID NO: 6159811 - DNA, 14 bp, Homo sapiens
ctgtacagagactc

SEQ ID NO: 6159812 - DNA, 15 bp, Homo sapiens
ctgtacagagactct

SEQ ID NO: 6159813 - DNA, 18 bp, Homo sapiens
ctgtacagagactctatt

SEQ ID NO: 6159814 - DNA, 14 bp, Homo sapiens
ctgtacagagccca

SEQ ID NO: 6159815 - DNA, 22 bp, Homo sapiens
ctgtacagagcccacgccccca

SEQ ID NO: 6159816 - DNA, 23 bp, Homo sapiens
ctgtacagagcccacgcccccac

SEQ ID NO: 6159817 - DNA, 21 bp, Homo sapiens
ctgtacagagccgtaaaaact

SEQ ID NO: 6159818 - DNA, 16 bp, Homo sapiens
ctgtacagatcaagaa

SEQ ID NO: 6159819 - DNA, 22 bp, Homo sapiens
ctgtacaggaaggtgcctggcc

SEQ ID NO: 6159820 - DNA, 11 bp, Homo sapiens
ctgtacagggg

SEQ ID NO: 6159821 - DNA, 12 bp, Homo sapiens
ctgtacagtatt

SEQ ID NO: 6159822 - DNA, 23 bp, Homo sapiens
ctgtacagtctgtcttctgtata

SEQ ID NO: 6159823 - DNA, 16 bp, Homo sapiens
ctgtacagtgtctttt

SEQ ID NO: 6159824 - DNA, 21 bp, Homo sapiens
ctgtacagttttgtggactga

SEQ ID NO: 6159825 - DNA, 15 bp, Homo sapiens
ctgtacataattgca

SEQ ID NO: 6159826 - DNA, 19 bp, Homo sapiens
ctgtacataattgcatgaa

SEQ ID NO: 6159827 - DNA, 13 bp, Homo sapiens
ctgtacatacatt

SEQ ID NO: 6159828 - DNA, 16 bp, Homo sapiens
ctgtacatacattgta

SEQ ID NO: 6159829 - DNA, 18 bp, Homo sapiens
ctgtacatacattgtata

SEQ ID NO: 6159830 - DNA, 18 bp, Homo sapiens
ctgtacatacgtgttcta

SEQ ID NO: 6159831 - DNA, 13 bp, Homo sapiens
ctgtacatactgg

SEQ ID NO: 6159832 - DNA, 15 bp, Homo sapiens
ctgtacatactggcc

SEQ ID NO: 6159833 - DNA, 22 bp, Homo sapiens
ctgtacatactggcctctgtga

SEQ ID NO: 6159834 - DNA, 23 bp, Homo sapiens
ctgtacatactggcctctgtgat

SEQ ID NO: 6159835 - DNA, 16 bp, Homo sapiens
ctgtacatactttttg

SEQ ID NO: 6159836 - DNA, 19 bp, Homo sapiens
ctgtacatagatgtatcat

SEQ ID NO: 6159837 - DNA, 16 bp, Homo sapiens
ctgtacatagtccttt

SEQ ID NO: 6159838 - DNA, 16 bp, Homo sapiens
ctgtacatatctttga

SEQ ID NO: 6159839 - DNA, 19 bp, Homo sapiens
ctgtacatattactgttgc

SEQ ID NO: 6159840 - DNA, 21 bp, Homo sapiens
ctgtacatcagacaattgcat

SEQ ID NO: 6159841 - DNA, 23 bp, Homo sapiens
ctgtacatgctatgctgaagaca

SEQ ID NO: 6159842 - DNA, 21 bp, Homo sapiens
ctgtacatgttcttgtcataa

SEQ ID NO: 6159843 - DNA, 16 bp, Homo sapiens
ctgtacattatgaaga

SEQ ID NO: 6159844 - DNA, 18 bp, Homo sapiens
ctgtacattatgaagaat

SEQ ID NO: 6159845 - DNA, 14 bp, Homo sapiens
ctgtacattgtgag

SEQ ID NO: 6159846 - DNA, 19 bp, Homo sapiens
ctgtacattgtgagctctg

SEQ ID NO: 6159847 - DNA, 14 bp, Homo sapiens
ctgtacatttaaaa

SEQ ID NO: 6159848 - DNA, 17 bp, Homo sapiens
ctgtacatttgcaatta

SEQ ID NO: 6159849 - DNA, 18 bp, Homo sapiens
ctgtacatttgcaattag

SEQ ID NO: 6159850 - DNA, 21 bp, Homo sapiens
ctgtacattttttttcaagtg

SEQ ID NO: 6159851 - DNA, 21 bp, Homo sapiens
ctgtaccaaatctgacatatt

SEQ ID NO: 6159852 - DNA, 20 bp, Homo sapiens
ctgtaccaagccccttggcc

SEQ ID NO: 6159853 - DNA, 15 bp, Homo sapiens
ctgtaccacatctgc

SEQ ID NO: 6159854 - DNA, 16 bp, Homo sapiens
ctgtaccagttaattt

SEQ ID NO: 6159855 - DNA, 13 bp, Homo sapiens
ctgtaccatattc

SEQ ID NO: 6159856 - DNA, 23 bp, Homo sapiens
ctgtaccatgtgctacaggggcc

SEQ ID NO: 6159857 - DNA, 17 bp, Homo sapiens
ctgtacccaatttaatt

SEQ ID NO: 6159858 - DNA, 20 bp, Homo sapiens
ctgtacccaccccagcacag

SEQ ID NO: 6159859 - DNA, 16 bp, Homo sapiens
ctgtacccagatgcct

SEQ ID NO: 6159860 - DNA, 20 bp, Homo sapiens
ctgtacccagatgcctacaa

SEQ ID NO: 6159861 - DNA, 14 bp, Homo sapiens
ctgtacccagccac

SEQ ID NO: 6159862 - DNA, 15 bp, Homo sapiens
ctgtacccagccacc

SEQ ID NO: 6159863 - DNA, 16 bp, Homo sapiens
ctgtacccagccacct

SEQ ID NO: 6159864 - DNA, 22 bp, Homo sapiens
ctgtacccagccaccttcctga

SEQ ID NO: 6159865 - DNA, 23 bp, Homo sapiens
ctgtacccagccaccttcctgac

SEQ ID NO: 6159866 - DNA, 23 bp, Homo sapiens
ctgtacccagctccttttgtccc

SEQ ID NO: 6159867 - DNA, 16 bp, Homo sapiens
ctgtacccttccacct

SEQ ID NO: 6159868 - DNA, 19 bp, Homo sapiens
ctgtaccgcccggcagccc

SEQ ID NO: 6159869 - DNA, 15 bp, Homo sapiens
ctgtacctcatccca

SEQ ID NO: 6159870 - DNA, 23 bp, Homo sapiens
ctgtacctgtaggaaacagaaaa

SEQ ID NO: 6159871 - DNA, 17 bp, Homo sapiens
ctgtacctgttcctccc

SEQ ID NO: 6159872 - DNA, 15 bp, Homo sapiens
ctgtacctttctgac

SEQ ID NO: 6159873 - DNA, 22 bp, Homo sapiens
ctgtaccttttgaggagcccca

SEQ ID NO: 6159874 - DNA, 17 bp, Homo sapiens
ctgtacgaaaaagagca

SEQ ID NO: 6159875 - DNA, 19 bp, Homo sapiens
ctgtacgaaaaagagcata

SEQ ID NO: 6159876 - DNA, 18 bp, Homo sapiens
ctgtacgtactgcatttg

SEQ ID NO: 6159877 - DNA, 16 bp, Homo sapiens
ctgtacgtctgacagg

SEQ ID NO: 6159878 - DNA, 22 bp, Homo sapiens
ctgtactaaagtaacgcaataa

SEQ ID NO: 6159879 - DNA, 15 bp, Homo sapiens
ctgtactaacccagt

SEQ ID NO: 6159880 - DNA, 21 bp, Homo sapiens
ctgtactaacccagtctttct

SEQ ID NO: 6159881 - DNA, 22 bp, Homo sapiens
ctgtactaacccagtctttctt

SEQ ID NO: 6159882 - DNA, 20 bp, Homo sapiens
ctgtactactcctaattatt

SEQ ID NO: 6159883 - DNA, 14 bp, Homo sapiens
ctgtactactgcct

SEQ ID NO: 6159884 - DNA, 18 bp, Homo sapiens
ctgtactaggattagaaa

SEQ ID NO: 6159885 - DNA, 21 bp, Homo sapiens
ctgtactaggattagaaaatt

SEQ ID NO: 6159886 - DNA, 15 bp, Homo sapiens
ctgtactatctagtg

SEQ ID NO: 6159887 - DNA, 16 bp, Homo sapiens
ctgtactattgcagac

SEQ ID NO: 6159888 - DNA, 15 bp, Homo sapiens
ctgtactcagagcag

SEQ ID NO: 6159889 - DNA, 16 bp, Homo sapiens
ctgtactcagagcaga

SEQ ID NO: 6159890 - DNA, 18 bp, Homo sapiens
ctgtactcagagcagagc

SEQ ID NO: 6159891 - DNA, 19 bp, Homo sapiens
ctgtactcagagcagagca

SEQ ID NO: 6159892 - DNA, 17 bp, Homo sapiens
ctgtactcgcttgtgca

SEQ ID NO: 6159893 - DNA, 18 bp, Homo sapiens
ctgtactctggggtgctg

SEQ ID NO: 6159894 - DNA, 23 bp, Homo sapiens
ctgtactctggggtgctgcctga

SEQ ID NO: 6159895 - DNA, 16 bp, Homo sapiens
ctgtactcttgctgat

SEQ ID NO: 6159896 - DNA, 19 bp, Homo sapiens
ctgtactgagcactgaacc

SEQ ID NO: 6159897 - DNA, 20 bp, Homo sapiens
ctgtactgatactattcaat

SEQ ID NO: 6159898 - DNA, 21 bp, Homo sapiens
ctgtactgatactattcaatg

SEQ ID NO: 6159899 - DNA, 22 bp, Homo sapiens
ctgtactgatactattcaatgc

SEQ ID NO: 6159900 - DNA, 23 bp, Homo sapiens
ctgtactgatactattcaatgca

SEQ ID NO: 6159901 - DNA, 14 bp, Homo sapiens
ctgtactgattcaa

SEQ ID NO: 6159902 - DNA, 12 bp, Homo sapiens
ctgtactgcctg

SEQ ID NO: 6159903 - DNA, 14 bp, Homo sapiens
ctgtactgcctgct

SEQ ID NO: 6159904 - DNA, 15 bp, Homo sapiens
ctgtactgcctgctt

SEQ ID NO: 6159905 - DNA, 16 bp, Homo sapiens
ctgtactgctcaggct

SEQ ID NO: 6159906 - DNA, 18 bp, Homo sapiens
ctgtactggagagcaaca

SEQ ID NO: 6159907 - DNA, 13 bp, Homo sapiens
ctgtactggccaa

SEQ ID NO: 6159908 - DNA, 16 bp, Homo sapiens
ctgtactggccagtgt

SEQ ID NO: 6159909 - DNA, 12 bp, Homo sapiens
ctgtactgtaat

SEQ ID NO: 6159910 - DNA, 20 bp, Homo sapiens
ctgtactgttctgtgtcttt

SEQ ID NO: 6159911 - DNA, 14 bp, Homo sapiens
ctgtactgttttct

SEQ ID NO: 6159912 - DNA, 16 bp, Homo sapiens
ctgtacttaataaatt

SEQ ID NO: 6159913 - DNA, 18 bp, Homo sapiens
ctgtacttaataaattca

SEQ ID NO: 6159914 - DNA, 21 bp, Homo sapiens
ctgtacttattttccaataaa

SEQ ID NO: 6159915 - DNA, 20 bp, Homo sapiens
ctgtacttcaagttaaagtg

SEQ ID NO: 6159916 - DNA, 22 bp, Homo sapiens
ctgtacttcactgtcaggaaga

SEQ ID NO: 6159917 - DNA, 21 bp, Homo sapiens
ctgtacttcagtatgtgtcaa

SEQ ID NO: 6159918 - DNA, 20 bp, Homo sapiens
ctgtacttgatttttcaaag

SEQ ID NO: 6159919 - DNA, 20 bp, Homo sapiens
ctgtacttgctcttgatgcc

SEQ ID NO: 6159920 - DNA, 21 bp, Homo sapiens
ctgtacttgctcttgatgcct

SEQ ID NO: 6159921 - DNA, 17 bp, Homo sapiens
ctgtacttggtccaact

SEQ ID NO: 6159922 - DNA, 21 bp, Homo sapiens
ctgtacttggtccaactgcaa

SEQ ID NO: 6159923 - DNA, 17 bp, Homo sapiens
ctgtacttgtcctcagc

SEQ ID NO: 6159924 - DNA, 18 bp, Homo sapiens
ctgtacttgtcctcagct

SEQ ID NO: 6159925 - DNA, 15 bp, Homo sapiens
ctgtactttcccagg

SEQ ID NO: 6159926 - DNA, 18 bp, Homo sapiens
ctgtactttcccaggttg

SEQ ID NO: 6159927 - DNA, 19 bp, Homo sapiens
ctgtactttcccaggttga

SEQ ID NO: 6159928 - DNA, 19 bp, Homo sapiens
ctgtactttgattcacatg

SEQ ID NO: 6159929 - DNA, 24 bp, Homo sapiens
ctgtactttgattcacatgttttc

SEQ ID NO: 6159930 - DNA, 15 bp, Homo sapiens
ctgtactttgccatt

SEQ ID NO: 6159931 - DNA, 13 bp, Homo sapiens
ctgtactttttgt

SEQ ID NO: 6159932 - DNA, 16 bp, Homo sapiens
ctgtacttttttcaaa

SEQ ID NO: 6159933 - DNA, 18 bp, Homo sapiens
ctgtacttttttcaaata

SEQ ID NO: 6159934 - DNA, 19 bp, Homo sapiens
ctgtacttttttcaaatat

SEQ ID NO: 6159935 - DNA, 20 bp, Homo sapiens
ctgtacttttttcaaatatt

SEQ ID NO: 6159936 - DNA, 22 bp, Homo sapiens
ctgtacttttttcaaatattga

SEQ ID NO: 6159937 - DNA, 20 bp, Homo sapiens
ctgtagaaaagaaaacattt

SEQ ID NO: 6159938 - DNA, 22 bp, Homo sapiens
ctgtagaaaagaaaacatttaa

SEQ ID NO: 6159939 - DNA, 19 bp, Homo sapiens
ctgtagaaaagggaactga

SEQ ID NO: 6159940 - DNA, 20 bp, Homo sapiens
ctgtagaaacacataacaaa

SEQ ID NO: 6159941 - DNA, 13 bp, Homo sapiens
ctgtagaaagaat

SEQ ID NO: 6159942 - DNA, 22 bp, Homo sapiens
ctgtagaaagaatgtgttgcct

SEQ ID NO: 6159943 - DNA, 14 bp, Homo sapiens
ctgtagaaaggaaa

SEQ ID NO: 6159944 - DNA, 21 bp, Homo sapiens
ctgtagaaaggttgattctca

SEQ ID NO: 6159945 - DNA, 22 bp, Homo sapiens
ctgtagaaaggttgattctcat

SEQ ID NO: 6159946 - DNA, 14 bp, Homo sapiens
ctgtagaaatattg

SEQ ID NO: 6159947 - DNA, 17 bp, Homo sapiens
ctgtagaaatggttgta

SEQ ID NO: 6159948 - DNA, 19 bp, Homo sapiens
ctgtagaaatggttgtatt

SEQ ID NO: 6159949 - DNA, 20 bp, Homo sapiens
ctgtagaaatggttgtatta

SEQ ID NO: 6159950 - DNA, 21 bp, Homo sapiens
ctgtagaactctgcaggcaga

SEQ ID NO: 6159951 - DNA, 22 bp, Homo sapiens
ctgtagaactctgcaggcagat

SEQ ID NO: 6159952 - DNA, 19 bp, Homo sapiens
ctgtagaactgattttaca

SEQ ID NO: 6159953 - DNA, 19 bp, Homo sapiens
ctgtagaatagcctgtggc

SEQ ID NO: 6159954 - DNA, 20 bp, Homo sapiens
ctgtagaatagcctgtggcc

SEQ ID NO: 6159955 - DNA, 16 bp, Homo sapiens
ctgtagaatcaattta

SEQ ID NO: 6159956 - DNA, 17 bp, Homo sapiens
ctgtagaatgctgtaga

SEQ ID NO: 6159957 - DNA, 18 bp, Homo sapiens
ctgtagaatgctgtagaa

SEQ ID NO: 6159958 - DNA, 12 bp, Homo sapiens
ctgtagacactc

SEQ ID NO: 6159959 - DNA, 13 bp, Homo sapiens
ctgtagacactct

SEQ ID NO: 6159960 - DNA, 20 bp, Homo sapiens
ctgtagacactctgacaagc

SEQ ID NO: 6159961 - DNA, 15 bp, Homo sapiens
ctgtagacaggaaag

SEQ ID NO: 6159962 - DNA, 15 bp, Homo sapiens
ctgtagacatctgtc

SEQ ID NO: 6159963 - DNA, 20 bp, Homo sapiens
ctgaacatgtttacaggttt

SEQ ID NO: 6159964 - DNA, 19 bp, Homo sapiens
ctgaacattagttgcacta

SEQ ID NO: 6159965 - DNA, 20 bp, Homo sapiens
ctgaacattagttgcactaa

SEQ ID NO: 6159966 - DNA, 15 bp, Homo sapiens
ctgaacattccagag

SEQ ID NO: 6159967 - DNA, 11 bp, Homo sapiens
ctgaacattgt

SEQ ID NO: 6159968 - DNA, 18 bp, Homo sapiens
ctgaacattgttctgaac

SEQ ID NO: 6159969 - DNA, 20 bp, Homo sapiens
ctgaacatttagtaccctgc

SEQ ID NO: 6159970 - DNA, 23 bp, Homo sapiens
ctgaacatttagtaccctgcagg

SEQ ID NO: 6159971 - DNA, 23 bp, Homo sapiens
ctgaacatttggaaaccatgcac

SEQ ID NO: 6159972 - DNA, 14 bp, Homo sapiens
ctgaacatttttaa

SEQ ID NO: 6159973 - DNA, 17 bp, Homo sapiens
ctgaaccaaattgcact

SEQ ID NO: 6159974 - DNA, 22 bp, Homo sapiens
ctgaaccaaattgcactgaagt

SEQ ID NO: 6159975 - DNA, 19 bp, Homo sapiens
ctgaaccaacagaagcaga

SEQ ID NO: 6159976 - DNA, 16 bp, Homo sapiens
ctgaaccaatagaaag

SEQ ID NO: 6159977 - DNA, 14 bp, Homo sapiens
ctgaaccacagaaa

SEQ ID NO: 6159978 - DNA, 20 bp, Homo sapiens
ctgaaccaccaacagagaaa

SEQ ID NO: 6159979 - DNA, 21 bp, Homo sapiens
ctgaaccacgaggctgccccc

SEQ ID NO: 6159980 - DNA, 22 bp, Homo sapiens
ctgaaccacgaggctgccccca

SEQ ID NO: 6159981 - DNA, 11 bp, Homo sapiens
ctgaaccactg

SEQ ID NO: 6159982 - DNA, 20 bp, Homo sapiens
ctgaaccactgtggccttct

SEQ ID NO: 6159983 - DNA, 14 bp, Homo sapiens
ctgaaccactttgc

SEQ ID NO: 6159984 - DNA, 19 bp, Homo sapiens
ctgaaccagagctggaaca

SEQ ID NO: 6159985 - DNA, 14 bp, Homo sapiens
ctgaaccagtccag

SEQ ID NO: 6159986 - DNA, 18 bp, Homo sapiens
ctgaaccagtcctgctgc

SEQ ID NO: 6159987 - DNA, 14 bp, Homo sapiens
ctgaacccacacct

SEQ ID NO: 6159988 - DNA, 17 bp, Homo sapiens
ctgaacccacacctggg

SEQ ID NO: 6159989 - DNA, 21 bp, Homo sapiens
ctgaacccagagtcaggaaga

SEQ ID NO: 6159990 - DNA, 12 bp, Homo sapiens
ctgaacccagct

SEQ ID NO: 6159991 - DNA, 13 bp, Homo sapiens
ctgaacccagctg

SEQ ID NO: 6159992 - DNA, 21 bp, Homo sapiens
ctgaacccagctgtgcccctc

SEQ ID NO: 6159993 - DNA, 22 bp, Homo sapiens
ctgaacccagctgtgcccctcc

SEQ ID NO: 6159994 - DNA, 17 bp, Homo sapiens
ctgaacccaggcagctg

SEQ ID NO: 6159995 - DNA, 21 bp, Homo sapiens
ctgaacccaggcagctggcag

SEQ ID NO: 6159996 - DNA, 14 bp, Homo sapiens
ctgaaccccagagg

SEQ ID NO: 6159997 - DNA, 14 bp, Homo sapiens
ctgaaccccagggc

SEQ ID NO: 6159998 - DNA, 20 bp, Homo sapiens
ctgaaccccatgggcttgga

SEQ ID NO: 6159999 - DNA, 19 bp, Homo sapiens
ctgaaccccccccccccgc

SEQ ID NO: 6160000 - DNA, 15 bp, Homo sapiens
ctgaaccccctccag

SEQ ID NO: 6160001 - DNA, 16 bp, Homo sapiens
ctgaacccctccctcc

SEQ ID NO: 6160002 - DNA, 15 bp, Homo sapiens
ctgaaccctcagcct

SEQ ID NO: 6160003 - DNA, 19 bp, Homo sapiens
ctgaaccctcagccttgac

SEQ ID NO: 6160004 - DNA, 13 bp, Homo sapiens
ctgaaccctgtgc

SEQ ID NO: 6160005 - DNA, 18 bp, Homo sapiens
ctgaaccctgtgctggtg

SEQ ID NO: 6160006 - DNA, 20 bp, Homo sapiens
ctgaaccctgtgctggtgtc

SEQ ID NO: 6160007 - DNA, 19 bp, Homo sapiens
ctgaaccgactgaccctga

SEQ ID NO: 6160008 - DNA, 17 bp, Homo sapiens
ctgaaccgcacagctca

SEQ ID NO: 6160009 - DNA, 18 bp, Homo sapiens
ctgaaccgtgtgctcctc

SEQ ID NO: 6160010 - DNA, 13 bp, Homo sapiens
ctgaacctcagtt

SEQ ID NO: 6160011 - DNA, 15 bp, Homo sapiens
ctgaacctcagtttc

SEQ ID NO: 6160012 - DNA, 17 bp, Homo sapiens
ctgaacctcagtttcct

SEQ ID NO: 6160013 - DNA, 18 bp, Homo sapiens
ctgaacctcagtttcctc

SEQ ID NO: 6160014 - DNA, 19 bp, Homo sapiens
ctgaacctcagtttcctca

SEQ ID NO: 6160015 - DNA, 19 bp, Homo sapiens
ctgaacctggaaatgatgt

SEQ ID NO: 6160016 - DNA, 20 bp, Homo sapiens
ctgaacctggaaatgatgtt

SEQ ID NO: 6160017 - DNA, 16 bp, Homo sapiens
ctgaacctgtcttttg

SEQ ID NO: 6160018 - DNA, 21 bp, Homo sapiens
ctgaaccttcctgtctcccag

SEQ ID NO: 6160019 - DNA, 16 bp, Homo sapiens
ctgaaccttgagcaaa

SEQ ID NO: 6160020 - DNA, 18 bp, Homo sapiens
ctgaaccttgagcaaatt

SEQ ID NO: 6160021 - DNA, 16 bp, Homo sapiens
ctgaacctttcaaaat

SEQ ID NO: 6160022 - DNA, 12 bp, Homo sapiens
ctgaacctttgt

SEQ ID NO: 6160023 - DNA, 20 bp, Homo sapiens
ctgaacgacagtcccagttc

SEQ ID NO: 6160024 - DNA, 23 bp, Homo sapiens
ctgaacgtttccccgaagagtca

SEQ ID NO: 6160025 - DNA, 23 bp, Homo sapiens
ctgaacgtttggttcaaatgtgt

SEQ ID NO: 6160026 - DNA, 17 bp, Homo sapiens
ctgaacgttttcttctt

SEQ ID NO: 6160027 - DNA, 19 bp, Homo sapiens
ctgaactaaagtgctgcac

SEQ ID NO: 6160028 - DNA, 23 bp, Homo sapiens
ctgaactaagttttgtgtgtata

SEQ ID NO: 6160029 - DNA, 23 bp, Homo sapiens
ctgaactacaagtgtaggccacc

SEQ ID NO: 6160030 - DNA, 17 bp, Homo sapiens
ctgaactattttaaata

SEQ ID NO: 6160031 - DNA, 18 bp, Homo sapiens
ctgaactcaaactgagga

SEQ ID NO: 6160032 - DNA, 17 bp, Homo sapiens
ctgaactcaagctgcgt

SEQ ID NO: 6160033 - DNA, 19 bp, Homo sapiens
ctgaactcacagactgctg

SEQ ID NO: 6160034 - DNA, 15 bp, Homo sapiens
ctgaactcaggatgg

SEQ ID NO: 6160035 - DNA, 22 bp, Homo sapiens
ctgaactccaccgaccaactgc

SEQ ID NO: 6160036 - DNA, 23 bp, Homo sapiens
ctgaactccaccgaccaactgcc

SEQ ID NO: 6160037 - DNA, 18 bp, Homo sapiens
ctgaactccttccccact

SEQ ID NO: 6160038 - DNA, 20 bp, Homo sapiens
ctgaactcgcttctctgtga

SEQ ID NO: 6160039 - DNA, 17 bp, Homo sapiens
ctgaactctaagcagaa

SEQ ID NO: 6160040 - DNA, 18 bp, Homo sapiens
ctgaactctcaaaagtct

SEQ ID NO: 6160041 - DNA, 18 bp, Homo sapiens
ctgaactcttaggcacat

SEQ ID NO: 6160042 - DNA, 14 bp, Homo sapiens
ctgaactcttcaga

SEQ ID NO: 6160043 - DNA, 17 bp, Homo sapiens
ctgaactcttcagaaca

SEQ ID NO: 6160044 - DNA, 15 bp, Homo sapiens
ctgaactgacaatga

SEQ ID NO: 6160045 - DNA, 14 bp, Homo sapiens
ctgaactgagaagg

SEQ ID NO: 6160046 - DNA, 13 bp, Homo sapiens
ctgaactgagccc

SEQ ID NO: 6160047 - DNA, 14 bp, Homo sapiens
ctgaactgagcccc

SEQ ID NO: 6160048 - DNA, 18 bp, Homo sapiens
ctgaactgagccccagcg

SEQ ID NO: 6160049 - DNA, 13 bp, Homo sapiens
ctgaactgagcct

SEQ ID NO: 6160050 - DNA, 12 bp, Homo sapiens
ctgaactgagga

SEQ ID NO: 6160051 - DNA, 17 bp, Homo sapiens
ctgaactgaggccttgt

SEQ ID NO: 6160052 - DNA, 18 bp, Homo sapiens
ctgaactgaggccttgtg

SEQ ID NO: 6160053 - DNA, 19 bp, Homo sapiens
ctgaactgatgggtttctc

SEQ ID NO: 6160054 - DNA, 15 bp, Homo sapiens
ctgaactgctgctgg

SEQ ID NO: 6160055 - DNA, 19 bp, Homo sapiens
ctgaactggagctgctaag

SEQ ID NO: 6160056 - DNA, 20 bp, Homo sapiens
ctgaactggccgctgggaga

SEQ ID NO: 6160057 - DNA, 17 bp, Homo sapiens
ctgaactggtagaaaaa

SEQ ID NO: 6160058 - DNA, 22 bp, Homo sapiens
ctgaactggtagaaaaacatct

SEQ ID NO: 6160059 - DNA, 12 bp, Homo sapiens
ctgaactgtgaa

SEQ ID NO: 6160060 - DNA, 16 bp, Homo sapiens
ctgaactgtgagtcct

SEQ ID NO: 6160061 - DNA, 20 bp, Homo sapiens
ctgaactgtgcatcaaccag

SEQ ID NO: 6160062 - DNA, 11 bp, Homo sapiens
ctgaactgttt

SEQ ID NO: 6160063 - DNA, 13 bp, Homo sapiens
ctgaactgtttgg

SEQ ID NO: 6160064 - DNA, 14 bp, Homo sapiens
ctgaactgtttggt

SEQ ID NO: 6160065 - DNA, 17 bp, Homo sapiens
ctgaacttccaagctcc

SEQ ID NO: 6160066 - DNA, 23 bp, Homo sapiens
ctgaactttcattggatttttgt

SEQ ID NO: 6160067 - DNA, 19 bp, Homo sapiens
ctgaactttctccctcatc

SEQ ID NO: 6160068 - DNA, 12 bp, Homo sapiens
ctgaactttgct

SEQ ID NO: 6160069 - DNA, 13 bp, Homo sapiens
ctgaactttggag

SEQ ID NO: 6160070 - DNA, 21 bp, Homo sapiens
ctgaactttgggaagccttta

SEQ ID NO: 6160071 - DNA, 22 bp, Homo sapiens
ctgaacttttaatgaactttga

SEQ ID NO: 6160072 - DNA, 21 bp, Homo sapiens
ctgaacttttggctaacagaa

SEQ ID NO: 6160073 - DNA, 13 bp, Homo sapiens
ctgaagaaaaaat

SEQ ID NO: 6160074 - DNA, 14 bp, Homo sapiens
ctgaagaaaaaatc

SEQ ID NO: 6160075 - DNA, 21 bp, Homo sapiens
ctgaagaaaaggttcttcttg

SEQ ID NO: 6160076 - DNA, 20 bp, Homo sapiens
ctgaagaaaatccttcagca

SEQ ID NO: 6160077 - DNA, 16 bp, Homo sapiens
ctgaagaaacaaggca

SEQ ID NO: 6160078 - DNA, 12 bp, Homo sapiens
ctgaagaaacac

SEQ ID NO: 6160079 - DNA, 20 bp, Homo sapiens
ctgaagaaatctttccagtt

SEQ ID NO: 6160080 - DNA, 13 bp, Homo sapiens
ctgaagaacagta

SEQ ID NO: 6160081 - DNA, 14 bp, Homo sapiens
ctgaagaaccagtc

SEQ ID NO: 6160082 - DNA, 15 bp, Homo sapiens
ctgaagaaccagtcc

SEQ ID NO: 6160083 - DNA, 21 bp, Homo sapiens
ctgaagaagcacttctgctgc

SEQ ID NO: 6160084 - DNA, 12 bp, Homo sapiens
ctgaagaagttt

SEQ ID NO: 6160085 - DNA, 15 bp, Homo sapiens
ctgaagaatgaagac

SEQ ID NO: 6160086 - DNA, 21 bp, Homo sapiens
ctgaagacaaaccactgtaca

SEQ ID NO: 6160087 - DNA, 21 bp, Homo sapiens
ctgaagacaattatcaaccac

SEQ ID NO: 6160088 - DNA, 14 bp, Homo sapiens
ctgaagacaggcac

SEQ ID NO: 6160089 - DNA, 17 bp, Homo sapiens
ctgaagacaggcacaaa

SEQ ID NO: 6160090 - DNA, 17 bp, Homo sapiens
ctgaagaccatggattt

SEQ ID NO: 6160091 - DNA, 15 bp, Homo sapiens
ctgaagacctttaat

SEQ ID NO: 6160092 - DNA, 22 bp, Homo sapiens
ctgaagacgagcatccccctcc

SEQ ID NO: 6160093 - DNA, 23 bp, Homo sapiens
ctgaagacgccgtctccatggca

SEQ ID NO: 6160094 - DNA, 21 bp, Homo sapiens
ctgaagactagttatatattc

SEQ ID NO: 6160095 - DNA, 14 bp, Homo sapiens
ctgaagactctgca

SEQ ID NO: 6160096 - DNA, 15 bp, Homo sapiens
ctgaagactgagaac

SEQ ID NO: 6160097 - DNA, 16 bp, Homo sapiens
ctgaagactgcacagg

SEQ ID NO: 6160098 - DNA, 23 bp, Homo sapiens
ctgaagactgctatcagtctctt

SEQ ID NO: 6160099 - DNA, 20 bp, Homo sapiens
ctgaagagaccttggctgct

SEQ ID NO: 6160100 - DNA, 15 bp, Homo sapiens
ctgaagagaggaaac

SEQ ID NO: 6160101 - DNA, 12 bp, Homo sapiens
ctgaagagcaag

SEQ ID NO: 6160102 - DNA, 12 bp, Homo sapiens
ctgaagagcatt

SEQ ID NO: 6160103 - DNA, 18 bp, Homo sapiens
ctgaagagcctgaagctg

SEQ ID NO: 6160104 - DNA, 12 bp, Homo sapiens
ctgaagagctct

SEQ ID NO: 6160105 - DNA, 13 bp, Homo sapiens
ctgaagagctctt

SEQ ID NO: 6160106 - DNA, 20 bp, Homo sapiens
ctgaagaggaagaggaggag

SEQ ID NO: 6160107 - DNA, 16 bp, Homo sapiens
ctgaagaggcaagaga

SEQ ID NO: 6160108 - DNA, 23 bp, Homo sapiens
ctgaagaggcgggccagccaggc

SEQ ID NO: 6160109 - DNA, 14 bp, Homo sapiens
ctgaagaggcttct

SEQ ID NO: 6160110 - DNA, 19 bp, Homo sapiens
ctgaagaggcttctcctgt

SEQ ID NO: 6160111 - DNA, 21 bp, Homo sapiens
ctgaagagtatccttccttca

SEQ ID NO: 6160112 - DNA, 16 bp, Homo sapiens
ctgaagagtatttgaa

SEQ ID NO: 6160113 - DNA, 15 bp, Homo sapiens
ctgaagagtcctctg

SEQ ID NO: 6160114 - DNA, 19 bp, Homo sapiens
ctgaagatacatgtctttc

SEQ ID NO: 6160115 - DNA, 21 bp, Homo sapiens
ctgaagatacatgtctttctc

SEQ ID NO: 6160116 - DNA, 17 bp, Homo sapiens
ctgaagatagaagaaaa

SEQ ID NO: 6160117 - DNA, 23 bp, Homo sapiens
ctgaagatataactattgcccag

SEQ ID NO: 6160118 - DNA, 17 bp, Homo sapiens
ctgaagatattccaact

SEQ ID NO: 6160119 - DNA, 15 bp, Homo sapiens
ctgaagatcagaaca

SEQ ID NO: 6160120 - DNA, 15 bp, Homo sapiens
ctgaagatcagagct

SEQ ID NO: 6160121 - DNA, 17 bp, Homo sapiens
ctgaagatcagagctgc

SEQ ID NO: 6160122 - DNA, 16 bp, Homo sapiens
ctgaagatccccaact

SEQ ID NO: 6160123 - DNA, 23 bp, Homo sapiens
ctgaagatgcccctgctccctct

SEQ ID NO: 6160124 - DNA, 15 bp, Homo sapiens
ctgaagatgccttga

SEQ ID NO: 6160125 - DNA, 15 bp, Homo sapiens
ctgaagatggagggg

SEQ ID NO: 6160126 - DNA, 15 bp, Homo sapiens
ctgaagatgggagcc

SEQ ID NO: 6160127 - DNA, 17 bp, Homo sapiens
ctgaagatgggagcctt

SEQ ID NO: 6160128 - DNA, 18 bp, Homo sapiens
ctgaagattcagtttaag

SEQ ID NO: 6160129 - DNA, 23 bp, Homo sapiens
ctgaagattcagtttaagagttt

SEQ ID NO: 6160130 - DNA, 16 bp, Homo sapiens
ctgaagattgtttatc

SEQ ID NO: 6160131 - DNA, 17 bp, Homo sapiens
ctgaagatttcagaggc

SEQ ID NO: 6160132 - DNA, 20 bp, Homo sapiens
ctgaagatttccatttgtca

SEQ ID NO: 6160133 - DNA, 15 bp, Homo sapiens
ctgaagcaaatacca

SEQ ID NO: 6160134 - DNA, 15 bp, Homo sapiens
ctgaagcacagcacc

SEQ ID NO: 6160135 - DNA, 18 bp, Homo sapiens
ctgaagcagttcagaagg

SEQ ID NO: 6160136 - DNA, 13 bp, Homo sapiens
ctgaagcatgttt

SEQ ID NO: 6160137 - DNA, 16 bp, Homo sapiens
ctgaagccaaatgaaa

SEQ ID NO: 6160138 - DNA, 17 bp, Homo sapiens
ctgaagccaaatgaaac

SEQ ID NO: 6160139 - DNA, 22 bp, Homo sapiens
ctgaagccacacagcccagaag

SEQ ID NO: 6160140 - DNA, 24 bp, Homo sapiens
ctgaagccacacagcccagaaggc

SEQ ID NO: 6160141 - DNA, 14 bp, Homo sapiens
ctgaagccacctct

SEQ ID NO: 6160142 - DNA, 15 bp, Homo sapiens
ctgtagactgccatc

SEQ ID NO: 6160143 - DNA, 23 bp, Homo sapiens
ctgtagacttctggttgtatttc

SEQ ID NO: 6160144 - DNA, 12 bp, Homo sapiens
ctgtagagactt

SEQ ID NO: 6160145 - DNA, 13 bp, Homo sapiens
ctgtagagacttc

SEQ ID NO: 6160146 - DNA, 16 bp, Homo sapiens
ctgtagagagagacct

SEQ ID NO: 6160147 - DNA, 20 bp, Homo sapiens
ctgtagagcatggttccagt

SEQ ID NO: 6160148 - DNA, 16 bp, Homo sapiens
ctgtagagccaattag

SEQ ID NO: 6160149 - DNA, 17 bp, Homo sapiens
ctgtagagccaattaga

SEQ ID NO: 6160150 - DNA, 16 bp, Homo sapiens
ctgtagaggaccagga

SEQ ID NO: 6160151 - DNA, 20 bp, Homo sapiens
ctgtagaggagcctggagtc

SEQ ID NO: 6160152 - DNA, 16 bp, Homo sapiens
ctgtagagggccctgg

SEQ ID NO: 6160153 - DNA, 13 bp, Homo sapiens
ctgtagagttgct

SEQ ID NO: 6160154 - DNA, 15 bp, Homo sapiens
ctgtagagttgctga

SEQ ID NO: 6160155 - DNA, 17 bp, Homo sapiens
ctgtagagttgctgaga

SEQ ID NO: 6160156 - DNA, 14 bp, Homo sapiens
ctgtagataaataa

SEQ ID NO: 6160157 - DNA, 16 bp, Homo sapiens
ctgtagataacagcaa

SEQ ID NO: 6160158 - DNA, 20 bp, Homo sapiens
ctgtagatatgtattctttt

SEQ ID NO: 6160159 - DNA, 12 bp, Homo sapiens
ctgtagatcagg

SEQ ID NO: 6160160 - DNA, 13 bp, Homo sapiens
ctgtagatgatgt

SEQ ID NO: 6160161 - DNA, 16 bp, Homo sapiens
ctgtagatgatgtatt

SEQ ID NO: 6160162 - DNA, 17 bp, Homo sapiens
ctgtagatgcagaaaaa

SEQ ID NO: 6160163 - DNA, 21 bp, Homo sapiens
ctgtagatggtgacctgggta

SEQ ID NO: 6160164 - DNA, 22 bp, Homo sapiens
ctgtagatggtgacctgggtat

SEQ ID NO: 6160165 - DNA, 14 bp, Homo sapiens
ctgtagatgttcta

SEQ ID NO: 6160166 - DNA, 17 bp, Homo sapiens
ctgtagattcatgcaag

SEQ ID NO: 6160167 - DNA, 18 bp, Homo sapiens
ctgtagattcatgcaagt

SEQ ID NO: 6160168 - DNA, 15 bp, Homo sapiens
ctgtagattctgtgg

SEQ ID NO: 6160169 - DNA, 19 bp, Homo sapiens
ctgtagattgcttctgtag

SEQ ID NO: 6160170 - DNA, 13 bp, Homo sapiens
ctgtagcaagctg

SEQ ID NO: 6160171 - DNA, 19 bp, Homo sapiens
ctgtagcaatggccagagc

SEQ ID NO: 6160172 - DNA, 23 bp, Homo sapiens
ctgtagcaatggccagagcctct

SEQ ID NO: 6160173 - DNA, 12 bp, Homo sapiens
ctgtagcacaaa

SEQ ID NO: 6160174 - DNA, 20 bp, Homo sapiens
ctgtagcatcttctggagtc

SEQ ID NO: 6160175 - DNA, 18 bp, Homo sapiens
ctgtagccacagctgctg

SEQ ID NO: 6160176 - DNA, 15 bp, Homo sapiens
ctgtagccacctcct

SEQ ID NO: 6160177 - DNA, 14 bp, Homo sapiens
ctgtagccatggct

SEQ ID NO: 6160178 - DNA, 16 bp, Homo sapiens
ctgtagccatggctca

SEQ ID NO: 6160179 - DNA, 24 bp, Homo sapiens
ctgtagccatggctcaggcaagcc

SEQ ID NO: 6160180 - DNA, 20 bp, Homo sapiens
ctgtagcccactctgctcgc

SEQ ID NO: 6160181 - DNA, 20 bp, Homo sapiens
ctgtagccccagtgacagct

SEQ ID NO: 6160182 - DNA, 23 bp, Homo sapiens
ctgtagcctaaaacgaatggtct

SEQ ID NO: 6160183 - DNA, 22 bp, Homo sapiens
ctgtagcctaaactccaaacat

SEQ ID NO: 6160184 - DNA, 21 bp, Homo sapiens
ctgtagcctatttttttagat

SEQ ID NO: 6160185 - DNA, 13 bp, Homo sapiens
ctgtagcctgaag

SEQ ID NO: 6160186 - DNA, 14 bp, Homo sapiens
ctgtagcctgaaga

SEQ ID NO: 6160187 - DNA, 20 bp, Homo sapiens
ctgtagcctgcgtcatggct

SEQ ID NO: 6160188 - DNA, 16 bp, Homo sapiens
ctgtagcctggtctgt

SEQ ID NO: 6160189 - DNA, 19 bp, Homo sapiens
ctgtagcctggtctgtgca

SEQ ID NO: 6160190 - DNA, 16 bp, Homo sapiens
ctgtagcgaccccaga

SEQ ID NO: 6160191 - DNA, 19 bp, Homo sapiens
ctgtagctacaagggaagc

SEQ ID NO: 6160192 - DNA, 18 bp, Homo sapiens
ctgtagctacattttcag

SEQ ID NO: 6160193 - DNA, 21 bp, Homo sapiens
ctgtagctataatgagcatgt

SEQ ID NO: 6160194 - DNA, 20 bp, Homo sapiens
ctgtagctattagcggctcc

SEQ ID NO: 6160195 - DNA, 21 bp, Homo sapiens
ctgtagctattagcggctcct

SEQ ID NO: 6160196 - DNA, 16 bp, Homo sapiens
ctgtagctattctttg

SEQ ID NO: 6160197 - DNA, 16 bp, Homo sapiens
ctgtagctcagtcatc

SEQ ID NO: 6160198 - DNA, 22 bp, Homo sapiens
ctgtagctcccctgctgaggca

SEQ ID NO: 6160199 - DNA, 17 bp, Homo sapiens
ctgtagctccctcctcc

SEQ ID NO: 6160200 - DNA, 18 bp, Homo sapiens
ctgtagctccctcctccc

SEQ ID NO: 6160201 - DNA, 23 bp, Homo sapiens
ctgtagctccctcctcccatctc

SEQ ID NO: 6160202 - DNA, 14 bp, Homo sapiens
ctgtagctctcctg

SEQ ID NO: 6160203 - DNA, 22 bp, Homo sapiens
ctgtagctgatgaaactcctga

SEQ ID NO: 6160204 - DNA, 21 bp, Homo sapiens
ctgtagcttctaatgttcccc

SEQ ID NO: 6160205 - DNA, 18 bp, Homo sapiens
ctgtagcttctcttgctc

SEQ ID NO: 6160206 - DNA, 13 bp, Homo sapiens
ctgtagctttaaa

SEQ ID NO: 6160207 - DNA, 12 bp, Homo sapiens
ctgtagctttct

SEQ ID NO: 6160208 - DNA, 20 bp, Homo sapiens
ctgtagctttgggcagattt

SEQ ID NO: 6160209 - DNA, 18 bp, Homo sapiens
ctgtaggaaacagaaaag

SEQ ID NO: 6160210 - DNA, 14 bp, Homo sapiens
ctgtaggaaaccca

SEQ ID NO: 6160211 - DNA, 14 bp, Homo sapiens
ctgtaggagagact

SEQ ID NO: 6160212 - DNA, 16 bp, Homo sapiens
ctgtaggagagactgg

SEQ ID NO: 6160213 - DNA, 20 bp, Homo sapiens
ctgtaggagagtcggtctgc

SEQ ID NO: 6160214 - DNA, 23 bp, Homo sapiens
ctgtaggagagtcggtctgcttt

SEQ ID NO: 6160215 - DNA, 22 bp, Homo sapiens
ctgtaggagcaggtgaataaag

SEQ ID NO: 6160216 - DNA, 19 bp, Homo sapiens
ctgtaggcacagagctgca

SEQ ID NO: 6160217 - DNA, 12 bp, Homo sapiens
ctgtaggcagca

SEQ ID NO: 6160218 - DNA, 12 bp, Homo sapiens
ctgtaggcctca

SEQ ID NO: 6160219 - DNA, 13 bp, Homo sapiens
ctgtaggcctcag

SEQ ID NO: 6160220 - DNA, 21 bp, Homo sapiens
ctgtaggcgcccctggggtgg

SEQ ID NO: 6160221 - DNA, 14 bp, Homo sapiens
ctgtagggaactct

SEQ ID NO: 6160222 - DNA, 18 bp, Homo sapiens
ctgtagggagaagcttta

SEQ ID NO: 6160223 - DNA, 21 bp, Homo sapiens
ctgtagggagggcggcagggg

SEQ ID NO: 6160224 - DNA, 16 bp, Homo sapiens
ctgtagggctggacct

SEQ ID NO: 6160225 - DNA, 24 bp, Homo sapiens
ctgtagggtaattagtaacatgtg

SEQ ID NO: 6160226 - DNA, 17 bp, Homo sapiens
ctgtagggtccaaccag

SEQ ID NO: 6160227 - DNA, 19 bp, Homo sapiens
ctgtagggtttggacagac

SEQ ID NO: 6160228 - DNA, 21 bp, Homo sapiens
ctgtagggtttggacagaccc

SEQ ID NO: 6160229 - DNA, 20 bp, Homo sapiens
ctgtaggtatgatctcttct

SEQ ID NO: 6160230 - DNA, 21 bp, Homo sapiens
ctgtaggtggaagaaatttag

SEQ ID NO: 6160231 - DNA, 15 bp, Homo sapiens
ctgtaggtgtctctg

SEQ ID NO: 6160232 - DNA, 17 bp, Homo sapiens
ctgtaggtgtctctggg

SEQ ID NO: 6160233 - DNA, 23 bp, Homo sapiens
ctgtaggtgtctctgggcctgtg

SEQ ID NO: 6160234 - DNA, 17 bp, Homo sapiens
ctgtaggtgttatgtat

SEQ ID NO: 6160235 - DNA, 20 bp, Homo sapiens
ctgtaggttgcacactttgg

SEQ ID NO: 6160236 - DNA, 22 bp, Homo sapiens
ctgtaggttgcacactttggta

SEQ ID NO: 6160237 - DNA, 14 bp, Homo sapiens
ctgtaggttgctta

SEQ ID NO: 6160238 - DNA, 21 bp, Homo sapiens
ctgtaggtttctctcttccct

SEQ ID NO: 6160239 - DNA, 16 bp, Homo sapiens
ctgtaggtttgtagta

SEQ ID NO: 6160240 - DNA, 22 bp, Homo sapiens
ctgtagtaaaatgttttcattt

SEQ ID NO: 6160241 - DNA, 18 bp, Homo sapiens
ctgtagtaaactatttat

SEQ ID NO: 6160242 - DNA, 20 bp, Homo sapiens
ctgtagtaaataatgctttg

SEQ ID NO: 6160243 - DNA, 21 bp, Homo sapiens
ctgtagtactccttaagaaca

SEQ ID NO: 6160244 - DNA, 23 bp, Homo sapiens
ctgtagtactccttaagaacaca

SEQ ID NO: 6160245 - DNA, 22 bp, Homo sapiens
ctgtagtcatttactaaacata

SEQ ID NO: 6160246 - DNA, 12 bp, Homo sapiens
ctgtagtcccag

SEQ ID NO: 6160247 - DNA, 19 bp, Homo sapiens
ctgtagtcccagcactttg

SEQ ID NO: 6160248 - DNA, 14 bp, Homo sapiens
ctgtagtcccagcc

SEQ ID NO: 6160249 - DNA, 23 bp, Homo sapiens
ctgtagtcccagctactcaggag

SEQ ID NO: 6160250 - DNA, 22 bp, Homo sapiens
ctgtagtcccagctactcggga

SEQ ID NO: 6160251 - DNA, 22 bp, Homo sapiens
ctgtagtcctagccactcagga

SEQ ID NO: 6160252 - DNA, 14 bp, Homo sapiens
ctgtagtcctttct

SEQ ID NO: 6160253 - DNA, 14 bp, Homo sapiens
ctgtagtctcagga

SEQ ID NO: 6160254 - DNA, 20 bp, Homo sapiens
ctgtagtctcaggacctagg

SEQ ID NO: 6160255 - DNA, 15 bp, Homo sapiens
ctgtagtctcagttc

SEQ ID NO: 6160256 - DNA, 20 bp, Homo sapiens
ctgtagtgagatagcattgt

SEQ ID NO: 6160257 - DNA, 20 bp, Homo sapiens
ctgtagtgatggagttcctt

SEQ ID NO: 6160258 - DNA, 23 bp, Homo sapiens
ctgtagtgccagctactcaggag

SEQ ID NO: 6160259 - DNA, 21 bp, Homo sapiens
ctgtagtgccccctctaaccc

SEQ ID NO: 6160260 - DNA, 15 bp, Homo sapiens
ctgtagtgcccctcc

SEQ ID NO: 6160261 - DNA, 21 bp, Homo sapiens
ctgtagtgcccctcccatggc

SEQ ID NO: 6160262 - DNA, 20 bp, Homo sapiens
ctgtagtgctacagggtcca

SEQ ID NO: 6160263 - DNA, 12 bp, Homo sapiens
ctgtagtgtagt

SEQ ID NO: 6160264 - DNA, 21 bp, Homo sapiens
ctgtagtgtattaatctctgt

SEQ ID NO: 6160265 - DNA, 20 bp, Homo sapiens
ctgtagtgtcactcaaggcg

SEQ ID NO: 6160266 - DNA, 15 bp, Homo sapiens
ctgtagttacattta

SEQ ID NO: 6160267 - DNA, 15 bp, Homo sapiens
ctgtagttaggaaat

SEQ ID NO: 6160268 - DNA, 17 bp, Homo sapiens
ctgtagttaggaaataa

SEQ ID NO: 6160269 - DNA, 22 bp, Homo sapiens
ctgtagttaggaaataaaacct

SEQ ID NO: 6160270 - DNA, 15 bp, Homo sapiens
ctgtagttaggcctg

SEQ ID NO: 6160271 - DNA, 20 bp, Homo sapiens
ctgtagttaggcctggctca

SEQ ID NO: 6160272 - DNA, 14 bp, Homo sapiens
ctgtagttctaaga

SEQ ID NO: 6160273 - DNA, 17 bp, Homo sapiens
ctgtagtttaatacttt

SEQ ID NO: 6160274 - DNA, 15 bp, Homo sapiens
ctgtagtttagttct

SEQ ID NO: 6160275 - DNA, 21 bp, Homo sapiens
ctgtagtttatggcagaaggg

SEQ ID NO: 6160276 - DNA, 24 bp, Homo sapiens
ctgtagtttccgctttgcttgctt

SEQ ID NO: 6160277 - DNA, 17 bp, Homo sapiens
ctgtagtttggagacaa

SEQ ID NO: 6160278 - DNA, 22 bp, Homo sapiens
ctgtagttttatcacatgtatg

SEQ ID NO: 6160279 - DNA, 24 bp, Homo sapiens
ctgtagttttattttatgtttaga

SEQ ID NO: 6160280 - DNA, 20 bp, Homo sapiens
ctgtagttttccctgcactg

SEQ ID NO: 6160281 - DNA, 22 bp, Homo sapiens
ctgtagttttccctgcactgtg

SEQ ID NO: 6160282 - DNA, 19 bp, Homo sapiens
ctgtagtttttgaaaatta

SEQ ID NO: 6160283 - DNA, 20 bp, Homo sapiens
ctgtagtttttgttcacctt

SEQ ID NO: 6160284 - DNA, 22 bp, Homo sapiens
ctgtagtttttgttcaccttct

SEQ ID NO: 6160285 - DNA, 15 bp, Homo sapiens
ctgtataaaaatgta

SEQ ID NO: 6160286 - DNA, 16 bp, Homo sapiens
ctgtataaaaatgtaa

SEQ ID NO: 6160287 - DNA, 20 bp, Homo sapiens
ctgtataaaggtgtgctgtg

SEQ ID NO: 6160288 - DNA, 15 bp, Homo sapiens
ctgtataaataggag

SEQ ID NO: 6160289 - DNA, 12 bp, Homo sapiens
ctgtataaatgt

SEQ ID NO: 6160290 - DNA, 15 bp, Homo sapiens
ctgtataaatgtcta

SEQ ID NO: 6160291 - DNA, 18 bp, Homo sapiens
ctgtataaatgtgaaatt

SEQ ID NO: 6160292 - DNA, 18 bp, Homo sapiens
ctgtataacattaagaaa

SEQ ID NO: 6160293 - DNA, 17 bp, Homo sapiens
ctgtataaccctgttac

SEQ ID NO: 6160294 - DNA, 14 bp, Homo sapiens
ctgtataactgttc

SEQ ID NO: 6160295 - DNA, 20 bp, Homo sapiens
ctgtataagacactttgcca

SEQ ID NO: 6160296 - DNA, 15 bp, Homo sapiens
ctgtataagcactga

SEQ ID NO: 6160297 - DNA, 21 bp, Homo sapiens
ctgtataagcactgaaaaaca

SEQ ID NO: 6160298 - DNA, 17 bp, Homo sapiens
ctgtataagctgtaata

SEQ ID NO: 6160299 - DNA, 15 bp, Homo sapiens
ctgtataagtaagaa

SEQ ID NO: 6160300 - DNA, 18 bp, Homo sapiens
ctgtataagtaagaaaat

SEQ ID NO: 6160301 - DNA, 22 bp, Homo sapiens
ctgtataagtggaggcacttta

SEQ ID NO: 6160302 - DNA, 15 bp, Homo sapiens
ctgtataagttattt

SEQ ID NO: 6160303 - DNA, 21 bp, Homo sapiens
ctgtataatactttgtataca

SEQ ID NO: 6160304 - DNA, 19 bp, Homo sapiens
ctgtataatagagataagt

SEQ ID NO: 6160305 - DNA, 18 bp, Homo sapiens
ctgtataatctatttaca

SEQ ID NO: 6160306 - DNA, 19 bp, Homo sapiens
ctgtataatctatttacat

SEQ ID NO: 6160307 - DNA, 20 bp, Homo sapiens
ctgtataatggagaattaaa

SEQ ID NO: 6160308 - DNA, 17 bp, Homo sapiens
ctgtataatttaacagt

SEQ ID NO: 6160309 - DNA, 20 bp, Homo sapiens
ctgtataatttaacagtgcc

SEQ ID NO: 6160310 - DNA, 14 bp, Homo sapiens
ctgtatacaaacag

SEQ ID NO: 6160311 - DNA, 19 bp, Homo sapiens
ctgtatacaaacaggtgct

SEQ ID NO: 6160312 - DNA, 20 bp, Homo sapiens
ctgtatacaaacaggtgcta

SEQ ID NO: 6160313 - DNA, 15 bp, Homo sapiens
ctgtatacaaggatc

SEQ ID NO: 6160314 - DNA, 18 bp, Homo sapiens
ctgtatacaaggatcaga

SEQ ID NO: 6160315 - DNA, 21 bp, Homo sapiens
ctgtatacaaggatcagattc

SEQ ID NO: 6160316 - DNA, 21 bp, Homo sapiens
ctgtatacagtgcagagcctt

SEQ ID NO: 6160317 - DNA, 17 bp, Homo sapiens
ctgtataccgatcagga

SEQ ID NO: 6160318 - DNA, 15 bp, Homo sapiens
ctgtatactcttgaa

SEQ ID NO: 6160319 - DNA, 14 bp, Homo sapiens
ctgtatactggtgt

SEQ ID NO: 6160320 - DNA, 16 bp, Homo sapiens
ctgtatactgtaaaag

SEQ ID NO: 6160321 - DNA, 17 bp, Homo sapiens
ctgtatactgtaaaagt

SEQ ID NO: 6160322 - DNA, 13 bp, Homo sapiens
ctgtatagaaatc

SEQ ID NO: 6160323 - DNA, 16 bp, Homo sapiens
ctgtatagacagtttg

SEQ ID NO: 6160324 - DNA, 21 bp, Homo sapiens
ctgtatagacagtttgtaaat

SEQ ID NO: 6160325 - DNA, 16 bp, Homo sapiens
ctgtatagattagaat

SEQ ID NO: 6160326 - DNA, 20 bp, Homo sapiens
ctgtatagattagaattctg

SEQ ID NO: 6160327 - DNA, 15 bp, Homo sapiens
ctgtatagattagag

SEQ ID NO: 6160328 - DNA, 14 bp, Homo sapiens
ctgtatagcaacct

SEQ ID NO: 6160329 - DNA, 24 bp, Homo sapiens
ctgtatagcaacctatttgactgc

SEQ ID NO: 6160330 - DNA, 14 bp, Homo sapiens
ctgtatagctcctt

SEQ ID NO: 6160331 - DNA, 20 bp, Homo sapiens
ctgtatagtaatcattgact

SEQ ID NO: 6160332 - DNA, 16 bp, Homo sapiens
ctgtatagttaggata

SEQ ID NO: 6160333 - DNA, 18 bp, Homo sapiens
ctgtatataaaatatttt

SEQ ID NO: 6160334 - DNA, 15 bp, Homo sapiens
ctgtatataaatata

SEQ ID NO: 6160335 - DNA, 15 bp, Homo sapiens
ctgtatataaatggg

SEQ ID NO: 6160336 - DNA, 16 bp, Homo sapiens
ctgtatataaatggga

SEQ ID NO: 6160337 - DNA, 18 bp, Homo sapiens
ctgtatataaatgggaac

SEQ ID NO: 6160338 - DNA, 19 bp, Homo sapiens
ctgtatataaatgggaaca

SEQ ID NO: 6160339 - DNA, 22 bp, Homo sapiens
ctgtatataaatgggaacattt

SEQ ID NO: 6160340 - DNA, 17 bp, Homo sapiens
ctgtatataacttattt

SEQ ID NO: 6160341 - DNA, 15 bp, Homo sapiens
ctgtatatacaataa

SEQ ID NO: 6160342 - DNA, 19 bp, Homo sapiens
ctgtatatacaataacata

SEQ ID NO: 6160343 - DNA, 19 bp, Homo sapiens
ctgtatatatatatgtgtg

SEQ ID NO: 6160344 - DNA, 20 bp, Homo sapiens
ctgtatatatatatgtgtgt

SEQ ID NO: 6160345 - DNA, 22 bp, Homo sapiens
ctgtatatatatatgtgtgtgt

SEQ ID NO: 6160346 - DNA, 19 bp, Homo sapiens
ctgtatatgattctctgtg

SEQ ID NO: 6160347 - DNA, 15 bp, Homo sapiens
ctgtatatgtaaatt

SEQ ID NO: 6160348 - DNA, 13 bp, Homo sapiens
ctgtatatgtatt

SEQ ID NO: 6160349 - DNA, 15 bp, Homo sapiens
ctgtatatgtattcc

SEQ ID NO: 6160350 - DNA, 16 bp, Homo sapiens
ctgtatatgtcaaaaa

SEQ ID NO: 6160351 - DNA, 19 bp, Homo sapiens
ctgtatatgttgtaataaa

SEQ ID NO: 6160352 - DNA, 19 bp, Homo sapiens
ctgtatattccatgtataa

SEQ ID NO: 6160353 - DNA, 19 bp, Homo sapiens
ctgtatattccctgtggaa

SEQ ID NO: 6160354 - DNA, 18 bp, Homo sapiens
ctgtatattgggctcaga

SEQ ID NO: 6160355 - DNA, 14 bp, Homo sapiens
ctgtatatttatga

SEQ ID NO: 6160356 - DNA, 21 bp, Homo sapiens
ctgtatatttatgaccagagc

SEQ ID NO: 6160357 - DNA, 13 bp, Homo sapiens
ctgtatatttctt

SEQ ID NO: 6160358 - DNA, 15 bp, Homo sapiens
ctgtatatttctttt

SEQ ID NO: 6160359 - DNA, 16 bp, Homo sapiens
ctgtatatttctttta

SEQ ID NO: 6160360 - DNA, 23 bp, Homo sapiens
ctgtatatttgaaactgctaatt

SEQ ID NO: 6160361 - DNA, 19 bp, Homo sapiens
ctgtatatttgtaaagcta

SEQ ID NO: 6160362 - DNA, 21 bp, Homo sapiens
ctgtatatttgtatgatattt

SEQ ID NO: 6160363 - DNA, 15 bp, Homo sapiens
ctgtatatttgtcat

SEQ ID NO: 6160364 - DNA, 16 bp, Homo sapiens
ctgtatatttgtcatg

SEQ ID NO: 6160365 - DNA, 23 bp, Homo sapiens
ctgtatattttgtagttaatata

SEQ ID NO: 6160366 - DNA, 16 bp, Homo sapiens
ctgtatcaataaaatt

SEQ ID NO: 6160367 - DNA, 21 bp, Homo sapiens
ctgtatcaataaaattctgta

SEQ ID NO: 6160368 - DNA, 18 bp, Homo sapiens
ctgtatcaatttctaatg

SEQ ID NO: 6160369 - DNA, 15 bp, Homo sapiens
ctgtatcagaaatga

SEQ ID NO: 6160370 - DNA, 16 bp, Homo sapiens
ctgtatcaggacccag

SEQ ID NO: 6160371 - DNA, 22 bp, Homo sapiens
ctgtatcaggacccagaggaag

SEQ ID NO: 6160372 - DNA, 23 bp, Homo sapiens
ctgtatcaggacccagaggaagg

SEQ ID NO: 6160373 - DNA, 23 bp, Homo sapiens
ctgtatcatcagtgcctctttga

SEQ ID NO: 6160374 - DNA, 16 bp, Homo sapiens
ctgtatcatttcatgc

SEQ ID NO: 6160375 - DNA, 19 bp, Homo sapiens
ctgtatccactttcagaat

SEQ ID NO: 6160376 - DNA, 23 bp, Homo sapiens
ctgtatccaggttccctcccaga

SEQ ID NO: 6160377 - DNA, 18 bp, Homo sapiens
ctgtatcccatgagcctc

SEQ ID NO: 6160378 - DNA, 17 bp, Homo sapiens
ctgtatccccagtgccc

SEQ ID NO: 6160379 - DNA, 19 bp, Homo sapiens
ctgtatccctacattacac

SEQ ID NO: 6160380 - DNA, 20 bp, Homo sapiens
ctgtatccgtgaattgcttt

SEQ ID NO: 6160381 - DNA, 20 bp, Homo sapiens
ctgtatcctccctggcagac

SEQ ID NO: 6160382 - DNA, 12 bp, Homo sapiens
ctgtatcctgaa

SEQ ID NO: 6160383 - DNA, 20 bp, Homo sapiens
ctgtatctacttagccagat

SEQ ID NO: 6160384 - DNA, 16 bp, Homo sapiens
ctgtatctaggcattt

SEQ ID NO: 6160385 - DNA, 16 bp, Homo sapiens
ctgtatctgacatatt

SEQ ID NO: 6160386 - DNA, 20 bp, Homo sapiens
ctgtatctgtaattaatatt

SEQ ID NO: 6160387 - DNA, 19 bp, Homo sapiens
ctgtatcttgatgtttaga

SEQ ID NO: 6160388 - DNA, 19 bp, Homo sapiens
ctgtatctttgacaattct

SEQ ID NO: 6160389 - DNA, 21 bp, Homo sapiens
ctgtatgaaaaattggggagg

SEQ ID NO: 6160390 - DNA, 17 bp, Homo sapiens
ctgtatgacccctggcc

SEQ ID NO: 6160391 - DNA, 21 bp, Homo sapiens
ctgtatgacccctggccacag

SEQ ID NO: 6160392 - DNA, 21 bp, Homo sapiens
ctgtatgagacaggaaaaacc

SEQ ID NO: 6160393 - DNA, 13 bp, Homo sapiens
ctgtatgatcaaa

SEQ ID NO: 6160394 - DNA, 14 bp, Homo sapiens
ctgtatgatcaaat

SEQ ID NO: 6160395 - DNA, 16 bp, Homo sapiens
ctgtatgatcaaatgt

SEQ ID NO: 6160396 - DNA, 18 bp, Homo sapiens
ctgtatgatcaaatgttt

SEQ ID NO: 6160397 - DNA, 19 bp, Homo sapiens
ctgtatgatcaaatgttta

SEQ ID NO: 6160398 - DNA, 21 bp, Homo sapiens
ctgtatgatcaaatgtttaat

SEQ ID NO: 6160399 - DNA, 23 bp, Homo sapiens
ctgtatgatcaaatgtttaatca

SEQ ID NO: 6160400 - DNA, 15 bp, Homo sapiens
ctgtatgattcccag

SEQ ID NO: 6160401 - DNA, 19 bp, Homo sapiens
ctgtatgatttaggcttct

SEQ ID NO: 6160402 - DNA, 18 bp, Homo sapiens
ctgtatgatttgttttga

SEQ ID NO: 6160403 - DNA, 17 bp, Homo sapiens
ctgtatgcagtactaaa

SEQ ID NO: 6160404 - DNA, 13 bp, Homo sapiens
ctgtatgcagttt

SEQ ID NO: 6160405 - DNA, 14 bp, Homo sapiens
ctgtatgccttctg

SEQ ID NO: 6160406 - DNA, 21 bp, Homo sapiens
ctgtatggaaacactgatttt

SEQ ID NO: 6160407 - DNA, 21 bp, Homo sapiens
ctgtatggaatacaatgtaat

SEQ ID NO: 6160408 - DNA, 12 bp, Homo sapiens
ctgtatggccca

SEQ ID NO: 6160409 - DNA, 20 bp, Homo sapiens
ctgtatggcccaggcagcct

SEQ ID NO: 6160410 - DNA, 18 bp, Homo sapiens
ctgtatgggagcttaact

SEQ ID NO: 6160411 - DNA, 23 bp, Homo sapiens
ctgtatgggggagattgaacttt

SEQ ID NO: 6160412 - DNA, 16 bp, Homo sapiens
ctgtatggtggaagct

SEQ ID NO: 6160413 - DNA, 22 bp, Homo sapiens
ctgtatggtggaagctgggtga

SEQ ID NO: 6160414 - DNA, 17 bp, Homo sapiens
ctgtatgtataaattat

SEQ ID NO: 6160415 - DNA, 16 bp, Homo sapiens
ctgtatgtattagtga

SEQ ID NO: 6160416 - DNA, 17 bp, Homo sapiens
ctgtatgtattagtgat

SEQ ID NO: 6160417 - DNA, 9 bp, Homo sapiens
ctgtatgtc

SEQ ID NO: 6160418 - DNA, 14 bp, Homo sapiens
ctgtatgtcatgga

SEQ ID NO: 6160419 - DNA, 15 bp, Homo sapiens
ctgtatgtcattaaa

SEQ ID NO: 6160420 - DNA, 16 bp, Homo sapiens
ctgtatgtctgcctaa

SEQ ID NO: 6160421 - DNA, 17 bp, Homo sapiens
ctgtatgtctgtcattg

SEQ ID NO: 6160422 - DNA, 19 bp, Homo sapiens
ctgtatgtgagctgtaaaa

SEQ ID NO: 6160423 - DNA, 19 bp, Homo sapiens
ctgtatgtgctgtaattta

SEQ ID NO: 6160424 - DNA, 16 bp, Homo sapiens
ctgtatgtggtgtggg

SEQ ID NO: 6160425 - DNA, 19 bp, Homo sapiens
ctgtatgttatagaacttc

SEQ ID NO: 6160426 - DNA, 13 bp, Homo sapiens
ctgtatgttgtac

SEQ ID NO: 6160427 - DNA, 15 bp, Homo sapiens
ctgtatgttgtacaa

SEQ ID NO: 6160428 - DNA, 18 bp, Homo sapiens
ctgtatgtttttactgaa

SEQ ID NO: 6160429 - DNA, 17 bp, Homo sapiens
ctgtattaaagaaaaat

SEQ ID NO: 6160430 - DNA, 23 bp, Homo sapiens
ctgtattaaatcttaaacaatgt

SEQ ID NO: 6160431 - DNA, 21 bp, Homo sapiens
ctgtattactgaataatatca

SEQ ID NO: 6160432 - DNA, 16 bp, Homo sapiens
ctgtattcagacagat

SEQ ID NO: 6160433 - DNA, 13 bp, Homo sapiens
ctgtattcagatc

SEQ ID NO: 6160434 - DNA, 17 bp, Homo sapiens
ctgtattcatatattgc

SEQ ID NO: 6160435 - DNA, 20 bp, Homo sapiens
ctgtattcatatattgcatt

SEQ ID NO: 6160436 - DNA, 22 bp, Homo sapiens
ctgtattcatgaatcttgagag

SEQ ID NO: 6160437 - DNA, 13 bp, Homo sapiens
ctgtattctagtg

SEQ ID NO: 6160438 - DNA, 17 bp, Homo sapiens
ctgtattctagtggctg

SEQ ID NO: 6160439 - DNA, 22 bp, Homo sapiens
ctgtattctagtggctgttcat

SEQ ID NO: 6160440 - DNA, 12 bp, Homo sapiens
ctgtattctgca

SEQ ID NO: 6160441 - DNA, 20 bp, Homo sapiens
ctgtattctgcaacagcctg

SEQ ID NO: 6160442 - DNA, 19 bp, Homo sapiens
ctgtattcttgtttgaatt

SEQ ID NO: 6160443 - DNA, 12 bp, Homo sapiens
ctgtattgaatc

SEQ ID NO: 6160444 - DNA, 15 bp, Homo sapiens
ctgtattgatgacag

SEQ ID NO: 6160445 - DNA, 15 bp, Homo sapiens
ctgtattgcccccat

SEQ ID NO: 6160446 - DNA, 22 bp, Homo sapiens
ctgtattgctcctcccacttct

SEQ ID NO: 6160447 - DNA, 22 bp, Homo sapiens
ctgtattggcagcacagctact

SEQ ID NO: 6160448 - DNA, 23 bp, Homo sapiens
ctgtattgtaagtggaaaatgca

SEQ ID NO: 6160449 - DNA, 23 bp, Homo sapiens
ctgtatttaaaaagaaacagaaa

SEQ ID NO: 6160450 - DNA, 18 bp, Homo sapiens
ctgtatttaaaaatagaa

SEQ ID NO: 6160451 - DNA, 19 bp, Homo sapiens
ctgtatttaaaaatagaaa

SEQ ID NO: 6160452 - DNA, 16 bp, Homo sapiens
ctgtatttaagcaaat

SEQ ID NO: 6160453 - DNA, 20 bp, Homo sapiens
ctgtatttaatggtttttat

SEQ ID NO: 6160454 - DNA, 14 bp, Homo sapiens
ctgtatttaatttt

SEQ ID NO: 6160455 - DNA, 21 bp, Homo sapiens
ctgtatttacttgttatgttg

SEQ ID NO: 6160456 - DNA, 19 bp, Homo sapiens
ctgtatttagtaaaaataa

SEQ ID NO: 6160457 - DNA, 23 bp, Homo sapiens
ctgtatttatgtgtgaggagctg

SEQ ID NO: 6160458 - DNA, 15 bp, Homo sapiens
ctgtatttcagtatt

SEQ ID NO: 6160459 - DNA, 16 bp, Homo sapiens
ctgtatttcagtattt

SEQ ID NO: 6160460 - DNA, 18 bp, Homo sapiens
ctgtatttcagtattttc

SEQ ID NO: 6160461 - DNA, 20 bp, Homo sapiens
ctgtatttcagtattttcca

SEQ ID NO: 6160462 - DNA, 14 bp, Homo sapiens
ctgtatttcctgct

SEQ ID NO: 6160463 - DNA, 13 bp, Homo sapiens
ctgtatttctaag

SEQ ID NO: 6160464 - DNA, 15 bp, Homo sapiens
ctgtatttctgtgga

SEQ ID NO: 6160465 - DNA, 15 bp, Homo sapiens
ctgtatttctttgta

SEQ ID NO: 6160466 - DNA, 17 bp, Homo sapiens
ctgtatttctttgtaga

SEQ ID NO: 6160467 - DNA, 19 bp, Homo sapiens
ctgtatttgaaagtgcctt

SEQ ID NO: 6160468 - DNA, 15 bp, Homo sapiens
ctgtatttgaggaaa

SEQ ID NO: 6160469 - DNA, 22 bp, Homo sapiens
ctgtatttgccggtgcctagga

SEQ ID NO: 6160470 - DNA, 13 bp, Homo sapiens
ctgtatttgctcc

SEQ ID NO: 6160471 - DNA, 16 bp, Homo sapiens
ctgtatttgctgttga

SEQ ID NO: 6160472 - DNA, 14 bp, Homo sapiens
ctgtatttgtatct

SEQ ID NO: 6160473 - DNA, 23 bp, Homo sapiens
ctgtatttgtatctctgaagcat

SEQ ID NO: 6160474 - DNA, 13 bp, Homo sapiens
ctgtatttgtgac

SEQ ID NO: 6160475 - DNA, 15 bp, Homo sapiens
ctgtatttgtgacta

SEQ ID NO: 6160476 - DNA, 21 bp, Homo sapiens
ctgtatttgtgactaattgta

SEQ ID NO: 6160477 - DNA, 23 bp, Homo sapiens
ctgtatttgtgactaattgtata

SEQ ID NO: 6160478 - DNA, 13 bp, Homo sapiens
ctgtatttgttaa

SEQ ID NO: 6160479 - DNA, 15 bp, Homo sapiens
ctgtatttgttaatt

SEQ ID NO: 6160480 - DNA, 21 bp, Homo sapiens
ctgtatttgttaatttcttgc

SEQ ID NO: 6160481 - DNA, 13 bp, Homo sapiens
ctgtattttaaaa

SEQ ID NO: 6160482 - DNA, 16 bp, Homo sapiens
ctgtattttaaaagaa

SEQ ID NO: 6160483 - DNA, 19 bp, Homo sapiens
ctgtattttaaaagaatga

SEQ ID NO: 6160484 - DNA, 21 bp, Homo sapiens
ctgtattttatttagacaaga

SEQ ID NO: 6160485 - DNA, 22 bp, Homo sapiens
ctgtattttatttagacaagag

SEQ ID NO: 6160486 - DNA, 16 bp, Homo sapiens
ctgtattttcaggaag

SEQ ID NO: 6160487 - DNA, 17 bp, Homo sapiens
ctgtattttcaggaagg

SEQ ID NO: 6160488 - DNA, 19 bp, Homo sapiens
ctgtattttcatttaacta

SEQ ID NO: 6160489 - DNA, 15 bp, Homo sapiens
ctgtattttctttca

SEQ ID NO: 6160490 - DNA, 20 bp, Homo sapiens
ctgtattttctttcacttta

SEQ ID NO: 6160491 - DNA, 15 bp, Homo sapiens
ctgtattttctttta

SEQ ID NO: 6160492 - DNA, 22 bp, Homo sapiens
ctgtattttcttttatatctgt

SEQ ID NO: 6160493 - DNA, 23 bp, Homo sapiens
ctgtattttcttttatatctgta

SEQ ID NO: 6160494 - DNA, 14 bp, Homo sapiens
ctgtattttgagtt

SEQ ID NO: 6160495 - DNA, 21 bp, Homo sapiens
ctgaagccacctctctgcctg

SEQ ID NO: 6160496 - DNA, 22 bp, Homo sapiens
ctgaagccattggagagctgtc

SEQ ID NO: 6160497 - DNA, 16 bp, Homo sapiens
ctgaagcccagacctc

SEQ ID NO: 6160498 - DNA, 14 bp, Homo sapiens
ctgaagccgtgcct

SEQ ID NO: 6160499 - DNA, 13 bp, Homo sapiens
ctgaagcctccgt

SEQ ID NO: 6160500 - DNA, 12 bp, Homo sapiens
ctgaagcctcta

SEQ ID NO: 6160501 - DNA, 23 bp, Homo sapiens
ctgaagcctctaacaaatgatct

SEQ ID NO: 6160502 - DNA, 17 bp, Homo sapiens
ctgaagcctctgccctg

SEQ ID NO: 6160503 - DNA, 20 bp, Homo sapiens
ctgaagcctctgccctgcct

SEQ ID NO: 6160504 - DNA, 15 bp, Homo sapiens
ctgaagcctgcagga

SEQ ID NO: 6160505 - DNA, 15 bp, Homo sapiens
ctgaagcctgcaggt

SEQ ID NO: 6160506 - DNA, 15 bp, Homo sapiens
ctgaagcctggacgc

SEQ ID NO: 6160507 - DNA, 21 bp, Homo sapiens
ctgaagcctggacgcagccac

SEQ ID NO: 6160508 - DNA, 17 bp, Homo sapiens
ctgaagccttcttctgc

SEQ ID NO: 6160509 - DNA, 18 bp, Homo sapiens
ctgaagcgaacatcttca

SEQ ID NO: 6160510 - DNA, 15 bp, Homo sapiens
ctgaagcgactctcc

SEQ ID NO: 6160511 - DNA, 16 bp, Homo sapiens
ctgaagcgactctcct

SEQ ID NO: 6160512 - DNA, 18 bp, Homo sapiens
ctgaagcgactctcctgt

SEQ ID NO: 6160513 - DNA, 17 bp, Homo sapiens
ctgaagcggtcagactg

SEQ ID NO: 6160514 - DNA, 18 bp, Homo sapiens
ctgaagcggtcagactgg

SEQ ID NO: 6160515 - DNA, 17 bp, Homo sapiens
ctgaagctagaaacaat

SEQ ID NO: 6160516 - DNA, 15 bp, Homo sapiens
ctgaagctagaggaa

SEQ ID NO: 6160517 - DNA, 14 bp, Homo sapiens
ctgaagctgcctgc

SEQ ID NO: 6160518 - DNA, 18 bp, Homo sapiens
ctgaagctgcctgctttt

SEQ ID NO: 6160519 - DNA, 19 bp, Homo sapiens
ctgaagctgctgcagctcc

SEQ ID NO: 6160520 - DNA, 14 bp, Homo sapiens
ctgaagctgctgtg

SEQ ID NO: 6160521 - DNA, 18 bp, Homo sapiens
ctgaagctgcttaacagt

SEQ ID NO: 6160522 - DNA, 14 bp, Homo sapiens
ctgaagctggagca

SEQ ID NO: 6160523 - DNA, 15 bp, Homo sapiens
ctgaagctggagcag

SEQ ID NO: 6160524 - DNA, 16 bp, Homo sapiens
ctgaagctggagcagc

SEQ ID NO: 6160525 - DNA, 17 bp, Homo sapiens
ctgaagctggagcagcg

SEQ ID NO: 6160526 - DNA, 18 bp, Homo sapiens
ctgaagctggagcagcgg

SEQ ID NO: 6160527 - DNA, 14 bp, Homo sapiens
ctgaagctggggct

SEQ ID NO: 6160528 - DNA, 18 bp, Homo sapiens
ctgaagcttatgtttctt

SEQ ID NO: 6160529 - DNA, 12 bp, Homo sapiens
ctgaagcttatt

SEQ ID NO: 6160530 - DNA, 16 bp, Homo sapiens
ctgaagcttattaatg

SEQ ID NO: 6160531 - DNA, 20 bp, Homo sapiens
ctgaagcttattaatgctaa

SEQ ID NO: 6160532 - DNA, 21 bp, Homo sapiens
ctgaagcttcactcactgtca

SEQ ID NO: 6160533 - DNA, 11 bp, Homo sapiens
ctgaaggaaaa

SEQ ID NO: 6160534 - DNA, 14 bp, Homo sapiens
ctgaaggaaaaaca

SEQ ID NO: 6160535 - DNA, 16 bp, Homo sapiens
ctgaaggaaaaacaca

SEQ ID NO: 6160536 - DNA, 17 bp, Homo sapiens
ctgaaggaaaaacacaa

SEQ ID NO: 6160537 - DNA, 22 bp, Homo sapiens
ctgaaggaaaaacacaagcaaa

SEQ ID NO: 6160538 - DNA, 15 bp, Homo sapiens
ctgaaggaagagaag

SEQ ID NO: 6160539 - DNA, 17 bp, Homo sapiens
ctgaaggaatagccaga

SEQ ID NO: 6160540 - DNA, 18 bp, Homo sapiens
ctgaaggaatagccagag

SEQ ID NO: 6160541 - DNA, 19 bp, Homo sapiens
ctgaaggaatagccagaga

SEQ ID NO: 6160542 - DNA, 22 bp, Homo sapiens
ctgaaggaataggcaaaatgtt

SEQ ID NO: 6160543 - DNA, 23 bp, Homo sapiens
ctgaaggaattctggagtgagtt

SEQ ID NO: 6160544 - DNA, 21 bp, Homo sapiens
ctgaaggacacttcctgccta

SEQ ID NO: 6160545 - DNA, 14 bp, Homo sapiens
ctgaaggaccccag

SEQ ID NO: 6160546 - DNA, 15 bp, Homo sapiens
ctgaaggaccccagg

SEQ ID NO: 6160547 - DNA, 20 bp, Homo sapiens
ctgaaggaccccaggtaaga

SEQ ID NO: 6160548 - DNA, 21 bp, Homo sapiens
ctgaaggactcaacattacat

SEQ ID NO: 6160549 - DNA, 12 bp, Homo sapiens
ctgaaggactgt

SEQ ID NO: 6160550 - DNA, 15 bp, Homo sapiens
ctgaaggactgtgac

SEQ ID NO: 6160551 - DNA, 22 bp, Homo sapiens
ctgaaggactgtgacaggcagc

SEQ ID NO: 6160552 - DNA, 23 bp, Homo sapiens
ctgaaggactgtgacaggcagca

SEQ ID NO: 6160553 - DNA, 21 bp, Homo sapiens
ctgaaggagagagtcttttaa

SEQ ID NO: 6160554 - DNA, 12 bp, Homo sapiens
ctgaaggagagg

SEQ ID NO: 6160555 - DNA, 20 bp, Homo sapiens
ctgaaggagattttccttcc

SEQ ID NO: 6160556 - DNA, 17 bp, Homo sapiens
ctgaaggaggccacctc

SEQ ID NO: 6160557 - DNA, 18 bp, Homo sapiens
ctgaaggaggccacctcc

SEQ ID NO: 6160558 - DNA, 19 bp, Homo sapiens
ctgaaggaggcggggctct

SEQ ID NO: 6160559 - DNA, 16 bp, Homo sapiens
ctgaaggatgggggct

SEQ ID NO: 6160560 - DNA, 23 bp, Homo sapiens
ctgaaggcaaatctcctttgtcc

SEQ ID NO: 6160561 - DNA, 13 bp, Homo sapiens
ctgaaggcacagc

SEQ ID NO: 6160562 - DNA, 16 bp, Homo sapiens
ctgaaggcacagctaa

SEQ ID NO: 6160563 - DNA, 16 bp, Homo sapiens
ctgaaggcagggctcc

SEQ ID NO: 6160564 - DNA, 17 bp, Homo sapiens
ctgaaggcagggctcct

SEQ ID NO: 6160565 - DNA, 18 bp, Homo sapiens
ctgaaggcagggctcctc

SEQ ID NO: 6160566 - DNA, 20 bp, Homo sapiens
ctgaaggcagtggcagggga

SEQ ID NO: 6160567 - DNA, 21 bp, Homo sapiens
ctgaaggccccgcccaggctt

SEQ ID NO: 6160568 - DNA, 13 bp, Homo sapiens
ctgaaggcctcca

SEQ ID NO: 6160569 - DNA, 14 bp, Homo sapiens
ctgaaggcctccat

SEQ ID NO: 6160570 - DNA, 15 bp, Homo sapiens
ctgaaggcctgaggt

SEQ ID NO: 6160571 - DNA, 18 bp, Homo sapiens
ctgaagggaaagggctct

SEQ ID NO: 6160572 - DNA, 19 bp, Homo sapiens
ctgaagggaacagcctgag

SEQ ID NO: 6160573 - DNA, 21 bp, Homo sapiens
ctgaagggaacagcctgagcc

SEQ ID NO: 6160574 - DNA, 21 bp, Homo sapiens
ctgaagggaaggcaaaggcag

SEQ ID NO: 6160575 - DNA, 23 bp, Homo sapiens
ctgaagggactagctatctctgt

SEQ ID NO: 6160576 - DNA, 14 bp, Homo sapiens
ctgaagggagggga

SEQ ID NO: 6160577 - DNA, 19 bp, Homo sapiens
ctgaagggaggggaagaga

SEQ ID NO: 6160578 - DNA, 23 bp, Homo sapiens
ctgaagggaggggaagagagagg

SEQ ID NO: 6160579 - DNA, 19 bp, Homo sapiens
ctgaagggatatgtgaaac

SEQ ID NO: 6160580 - DNA, 21 bp, Homo sapiens
ctgaagggcctcccagccccc

SEQ ID NO: 6160581 - DNA, 20 bp, Homo sapiens
ctgaaggggaaaacctcagt

SEQ ID NO: 6160582 - DNA, 22 bp, Homo sapiens
ctgaaggggaaggaaatagctt

SEQ ID NO: 6160583 - DNA, 23 bp, Homo sapiens
ctgaaggggccatgatggcaaca

SEQ ID NO: 6160584 - DNA, 17 bp, Homo sapiens
ctgaaggggttctcaca

SEQ ID NO: 6160585 - DNA, 19 bp, Homo sapiens
ctgaaggggttttcttgat

SEQ ID NO: 6160586 - DNA, 21 bp, Homo sapiens
ctgaagggtaatatggactca

SEQ ID NO: 6160587 - DNA, 16 bp, Homo sapiens
ctgaagggtgacatcc

SEQ ID NO: 6160588 - DNA, 17 bp, Homo sapiens
ctgaagggtgacatccc

SEQ ID NO: 6160589 - DNA, 21 bp, Homo sapiens
ctgaagggtgacatcccagga

SEQ ID NO: 6160590 - DNA, 22 bp, Homo sapiens
ctgaagggtggatgtgctggag

SEQ ID NO: 6160591 - DNA, 15 bp, Homo sapiens
ctgaaggtaaaattg

SEQ ID NO: 6160592 - DNA, 17 bp, Homo sapiens
ctgaaggtaaaattgaa

SEQ ID NO: 6160593 - DNA, 19 bp, Homo sapiens
ctgaaggtaaaattgaaag

SEQ ID NO: 6160594 - DNA, 17 bp, Homo sapiens
ctgaaggtattggcctg

SEQ ID NO: 6160595 - DNA, 18 bp, Homo sapiens
ctgaaggtcccctggcag

SEQ ID NO: 6160596 - DNA, 19 bp, Homo sapiens
ctgaaggtcccctggcagt

SEQ ID NO: 6160597 - DNA, 15 bp, Homo sapiens
ctgaaggtgcccagg

SEQ ID NO: 6160598 - DNA, 22 bp, Homo sapiens
ctgaaggtggccactttaagag

SEQ ID NO: 6160599 - DNA, 13 bp, Homo sapiens
ctgaaggttctgg

SEQ ID NO: 6160600 - DNA, 20 bp, Homo sapiens
ctgaaggttggaactgctgc

SEQ ID NO: 6160601 - DNA, 23 bp, Homo sapiens
ctgaaggttggaactgctgccat

SEQ ID NO: 6160602 - DNA, 17 bp, Homo sapiens
ctgaaggttgtggcctt

SEQ ID NO: 6160603 - DNA, 15 bp, Homo sapiens
ctgaagtaaacagct

SEQ ID NO: 6160604 - DNA, 17 bp, Homo sapiens
ctgaagtacaaacatga

SEQ ID NO: 6160605 - DNA, 18 bp, Homo sapiens
ctgaagtacaaacatgaa

SEQ ID NO: 6160606 - DNA, 17 bp, Homo sapiens
ctgaagtacagtcccag

SEQ ID NO: 6160607 - DNA, 16 bp, Homo sapiens
ctgaagtatgaagtct

SEQ ID NO: 6160608 - DNA, 15 bp, Homo sapiens
ctgaagtcaaaatat

SEQ ID NO: 6160609 - DNA, 17 bp, Homo sapiens
ctgaagtcacacagtga

SEQ ID NO: 6160610 - DNA, 18 bp, Homo sapiens
ctgaagtcacacagtgag

SEQ ID NO: 6160611 - DNA, 21 bp, Homo sapiens
ctgaagtcacacagtgagtcg

SEQ ID NO: 6160612 - DNA, 22 bp, Homo sapiens
ctgaagtcacatcacaggacac

SEQ ID NO: 6160613 - DNA, 16 bp, Homo sapiens
ctgaagtcactgcaca

SEQ ID NO: 6160614 - DNA, 22 bp, Homo sapiens
ctgaagtcactgcacagtgcat

SEQ ID NO: 6160615 - DNA, 16 bp, Homo sapiens
ctgaagtcagatctgc

SEQ ID NO: 6160616 - DNA, 21 bp, Homo sapiens
ctgaagtcagatctgcctaag

SEQ ID NO: 6160617 - DNA, 21 bp, Homo sapiens
ctgaagtcagcgggcccaggc

SEQ ID NO: 6160618 - DNA, 13 bp, Homo sapiens
ctgaagtcccttc

SEQ ID NO: 6160619 - DNA, 15 bp, Homo sapiens
ctgaagtcccttcct

SEQ ID NO: 6160620 - DNA, 17 bp, Homo sapiens
ctgaagtcccttcctgt

SEQ ID NO: 6160621 - DNA, 21 bp, Homo sapiens
ctgaagtcccttcctgtcctg

SEQ ID NO: 6160622 - DNA, 21 bp, Homo sapiens
ctgaagtctcaagaactgcca

SEQ ID NO: 6160623 - DNA, 13 bp, Homo sapiens
ctgaagtctcttt

SEQ ID NO: 6160624 - DNA, 16 bp, Homo sapiens
ctgaagtctctttttc

SEQ ID NO: 6160625 - DNA, 13 bp, Homo sapiens
ctgaagtctgaaa

SEQ ID NO: 6160626 - DNA, 16 bp, Homo sapiens
ctgaagtcttttctgt

SEQ ID NO: 6160627 - DNA, 18 bp, Homo sapiens
ctgaagtgaaggagaaag

SEQ ID NO: 6160628 - DNA, 17 bp, Homo sapiens
ctgaagtgaatacatgg

SEQ ID NO: 6160629 - DNA, 17 bp, Homo sapiens
ctgaagtgacctcactg

SEQ ID NO: 6160630 - DNA, 19 bp, Homo sapiens
ctgaagtgagcacagccta

SEQ ID NO: 6160631 - DNA, 14 bp, Homo sapiens
ctgaagtgcatcca

SEQ ID NO: 6160632 - DNA, 18 bp, Homo sapiens
ctgaagtgcatccaaagg

SEQ ID NO: 6160633 - DNA, 22 bp, Homo sapiens
ctgaagtgcatccaaaggtgct

SEQ ID NO: 6160634 - DNA, 20 bp, Homo sapiens
ctgaagtgcatgggtcaggg

SEQ ID NO: 6160635 - DNA, 22 bp, Homo sapiens
ctgaagtgccagatcaaaattg

SEQ ID NO: 6160636 - DNA, 13 bp, Homo sapiens
ctgaagtggctgg

SEQ ID NO: 6160637 - DNA, 22 bp, Homo sapiens
ctgaagtggttcagtctagaag

SEQ ID NO: 6160638 - DNA, 23 bp, Homo sapiens
ctgaagtggtttgcaggtcagcc

SEQ ID NO: 6160639 - DNA, 18 bp, Homo sapiens
ctgaagtgtcgagtccag

SEQ ID NO: 6160640 - DNA, 23 bp, Homo sapiens
ctgaagtgtcgagtccagtcctt

SEQ ID NO: 6160641 - DNA, 12 bp, Homo sapiens
ctgaagtgttct

SEQ ID NO: 6160642 - DNA, 18 bp, Homo sapiens
ctgaagtgttctctagaa

SEQ ID NO: 6160643 - DNA, 20 bp, Homo sapiens
ctgaagttatatttcctata

SEQ ID NO: 6160644 - DNA, 14 bp, Homo sapiens
ctgaagttatgtgt

SEQ ID NO: 6160645 - DNA, 14 bp, Homo sapiens
ctgaagttcaccat

SEQ ID NO: 6160646 - DNA, 17 bp, Homo sapiens
ctgaagttcagctgcat

SEQ ID NO: 6160647 - DNA, 14 bp, Homo sapiens
ctgaagttctgagc

SEQ ID NO: 6160648 - DNA, 20 bp, Homo sapiens
ctgaagttctgagccgggca

SEQ ID NO: 6160649 - DNA, 13 bp, Homo sapiens
ctgaagttcttgg

SEQ ID NO: 6160650 - DNA, 17 bp, Homo sapiens
ctgaagttgcagatgtt

SEQ ID NO: 6160651 - DNA, 22 bp, Homo sapiens
ctgaagttggagtgagtgtggc

SEQ ID NO: 6160652 - DNA, 16 bp, Homo sapiens
ctgaagttggcccccc

SEQ ID NO: 6160653 - DNA, 13 bp, Homo sapiens
ctgaagtttcaca

SEQ ID NO: 6160654 - DNA, 19 bp, Homo sapiens
ctgaagtttttgaaatacc

SEQ ID NO: 6160655 - DNA, 15 bp, Homo sapiens
ctgaataaaaaagat

SEQ ID NO: 6160656 - DNA, 16 bp, Homo sapiens
ctgaataaaaaataaa

SEQ ID NO: 6160657 - DNA, 16 bp, Homo sapiens
ctgaataaaccaagac

SEQ ID NO: 6160658 - DNA, 17 bp, Homo sapiens
ctgaataaaccaagaca

SEQ ID NO: 6160659 - DNA, 23 bp, Homo sapiens
ctgaataaaccaagacaagacct

SEQ ID NO: 6160660 - DNA, 14 bp, Homo sapiens
ctgaataaagcaat

SEQ ID NO: 6160661 - DNA, 21 bp, Homo sapiens
ctgaataaatacctcttagct

SEQ ID NO: 6160662 - DNA, 12 bp, Homo sapiens
ctgaataaatgg

SEQ ID NO: 6160663 - DNA, 14 bp, Homo sapiens
ctgaataaatggta

SEQ ID NO: 6160664 - DNA, 17 bp, Homo sapiens
ctgaataaatggtagta

SEQ ID NO: 6160665 - DNA, 13 bp, Homo sapiens
ctgaataaatgtc

SEQ ID NO: 6160666 - DNA, 15 bp, Homo sapiens
ctgaataaatgtctt

SEQ ID NO: 6160667 - DNA, 16 bp, Homo sapiens
ctgaataaattcagta

SEQ ID NO: 6160668 - DNA, 21 bp, Homo sapiens
ctgaataaattgtacagccgg

SEQ ID NO: 6160669 - DNA, 14 bp, Homo sapiens
ctgaataacctgca

SEQ ID NO: 6160670 - DNA, 14 bp, Homo sapiens
ctgaataacttgaa

SEQ ID NO: 6160671 - DNA, 14 bp, Homo sapiens
ctgaataatatcaa

SEQ ID NO: 6160672 - DNA, 15 bp, Homo sapiens
ctgaataatgaagat

SEQ ID NO: 6160673 - DNA, 15 bp, Homo sapiens
ctgtattttgagttt

SEQ ID NO: 6160674 - DNA, 13 bp, Homo sapiens
ctgtattttgata

SEQ ID NO: 6160675 - DNA, 22 bp, Homo sapiens
ctgtattttgatataattgtac

SEQ ID NO: 6160676 - DNA, 19 bp, Homo sapiens
ctgtattttggctttctcc

SEQ ID NO: 6160677 - DNA, 18 bp, Homo sapiens
ctgtattttgttttcctt

SEQ ID NO: 6160678 - DNA, 20 bp, Homo sapiens
ctgtattttgttttcctttt

SEQ ID NO: 6160679 - DNA, 18 bp, Homo sapiens
ctgtatttttaaagcatg

SEQ ID NO: 6160680 - DNA, 21 bp, Homo sapiens
ctgtatttttacagctacttt

SEQ ID NO: 6160681 - DNA, 21 bp, Homo sapiens
ctgtatttttatttttgcaca

SEQ ID NO: 6160682 - DNA, 13 bp, Homo sapiens
ctgtatttttcag

SEQ ID NO: 6160683 - DNA, 18 bp, Homo sapiens
ctgtattttttgtttgta

SEQ ID NO: 6160684 - DNA, 22 bp, Homo sapiens
ctgtattttttgtttgtattgt

SEQ ID NO: 6160685 - DNA, 16 bp, Homo sapiens
ctgtatttttttaact

SEQ ID NO: 6160686 - DNA, 21 bp, Homo sapiens
ctgtatttttttttctaagag

SEQ ID NO: 6160687 - DNA, 22 bp, Homo sapiens
ctgtatttttttttctaagaga

SEQ ID NO: 6160688 - DNA, 20 bp, Homo sapiens
ctgtcaaaaattttgaatgt

SEQ ID NO: 6160689 - DNA, 19 bp, Homo sapiens
ctgtcaaaacaagtttttc

SEQ ID NO: 6160690 - DNA, 15 bp, Homo sapiens
ctgtcaaaacactgt

SEQ ID NO: 6160691 - DNA, 17 bp, Homo sapiens
ctgtcaaaacactgtgg

SEQ ID NO: 6160692 - DNA, 14 bp, Homo sapiens
ctgtcaaaactact

SEQ ID NO: 6160693 - DNA, 17 bp, Homo sapiens
ctgtcaaaataatttta

SEQ ID NO: 6160694 - DNA, 14 bp, Homo sapiens
ctgtcaaacaaagc

SEQ ID NO: 6160695 - DNA, 19 bp, Homo sapiens
ctgtcaaacaaagccagaa

SEQ ID NO: 6160696 - DNA, 22 bp, Homo sapiens
ctgtcaaacaaagccagaagct

SEQ ID NO: 6160697 - DNA, 17 bp, Homo sapiens
ctgtcaaacaataaagg

SEQ ID NO: 6160698 - DNA, 12 bp, Homo sapiens
ctgtcaaacatt

SEQ ID NO: 6160699 - DNA, 15 bp, Homo sapiens
ctgtcaaatccatgt

SEQ ID NO: 6160700 - DNA, 17 bp, Homo sapiens
ctgtcaaatccatgtgt

SEQ ID NO: 6160701 - DNA, 20 bp, Homo sapiens
ctgtcaaatccatgtgtccc

SEQ ID NO: 6160702 - DNA, 21 bp, Homo sapiens
ctgtcaaatccatgtgtcccc

SEQ ID NO: 6160703 - DNA, 16 bp, Homo sapiens
ctgtcaaatgaacttt

SEQ ID NO: 6160704 - DNA, 14 bp, Homo sapiens
ctgtcaaatgatgt

SEQ ID NO: 6160705 - DNA, 18 bp, Homo sapiens
ctgtcaaatgatgtgcaa

SEQ ID NO: 6160706 - DNA, 13 bp, Homo sapiens
ctgtcaaatgttt

SEQ ID NO: 6160707 - DNA, 18 bp, Homo sapiens
ctgtcaacctgaattaaa

SEQ ID NO: 6160708 - DNA, 22 bp, Homo sapiens
ctgtcaacttcccatctggctc

SEQ ID NO: 6160709 - DNA, 12 bp, Homo sapiens
ctgtcaagaaga

SEQ ID NO: 6160710 - DNA, 18 bp, Homo sapiens
ctgtcaagaggcaaagga

SEQ ID NO: 6160711 - DNA, 15 bp, Homo sapiens
ctgtcaagagggagg

SEQ ID NO: 6160712 - DNA, 18 bp, Homo sapiens
ctgtcaagagggaggaag

SEQ ID NO: 6160713 - DNA, 19 bp, Homo sapiens
ctgtcaagattaagttata

SEQ ID NO: 6160714 - DNA, 13 bp, Homo sapiens
ctgtcaagcatat

SEQ ID NO: 6160715 - DNA, 20 bp, Homo sapiens
ctgtcaagcatattggaaag

SEQ ID NO: 6160716 - DNA, 19 bp, Homo sapiens
ctgtcaagccatttttaca

SEQ ID NO: 6160717 - DNA, 13 bp, Homo sapiens
ctgtcaagctggt

SEQ ID NO: 6160718 - DNA, 12 bp, Homo sapiens
ctgtcaaggccg

SEQ ID NO: 6160719 - DNA, 20 bp, Homo sapiens
ctgtcaaggccgagggccag

SEQ ID NO: 6160720 - DNA, 22 bp, Homo sapiens
ctgtcaaggccgagggccaggc

SEQ ID NO: 6160721 - DNA, 23 bp, Homo sapiens
ctgtcaaggccgagggccaggca

SEQ ID NO: 6160722 - DNA, 17 bp, Homo sapiens
ctgtcaaggctgcttag

SEQ ID NO: 6160723 - DNA, 20 bp, Homo sapiens
ctgtcaaggctgcttagaat

SEQ ID NO: 6160724 - DNA, 18 bp, Homo sapiens
ctgtcaagtcatgatgga

SEQ ID NO: 6160725 - DNA, 21 bp, Homo sapiens
ctgtcaagtgggatctgtcac

SEQ ID NO: 6160726 - DNA, 14 bp, Homo sapiens
ctgtcaagttaaca

SEQ ID NO: 6160727 - DNA, 19 bp, Homo sapiens
ctgtcaagttaacaaggaa

SEQ ID NO: 6160728 - DNA, 16 bp, Homo sapiens
ctgtcaagttgtacat

SEQ ID NO: 6160729 - DNA, 13 bp, Homo sapiens
ctgtcaataaaca

SEQ ID NO: 6160730 - DNA, 16 bp, Homo sapiens
ctgtcaataaatgaca

SEQ ID NO: 6160731 - DNA, 17 bp, Homo sapiens
ctgtcaataaatgacac

SEQ ID NO: 6160732 - DNA, 18 bp, Homo sapiens
ctgtcaataaatgttgaa

SEQ ID NO: 6160733 - DNA, 13 bp, Homo sapiens
ctgtcaatcacag

SEQ ID NO: 6160734 - DNA, 16 bp, Homo sapiens
ctgtcaatgagagcat

SEQ ID NO: 6160735 - DNA, 22 bp, Homo sapiens
ctgtcaatgagagcataattta

SEQ ID NO: 6160736 - DNA, 23 bp, Homo sapiens
ctgtcaatgaggttatgagaaaa

SEQ ID NO: 6160737 - DNA, 16 bp, Homo sapiens
ctgtcaatggactgca

SEQ ID NO: 6160738 - DNA, 15 bp, Homo sapiens
ctgtcaattacagga

SEQ ID NO: 6160739 - DNA, 17 bp, Homo sapiens
ctgtcaatttccctgac

SEQ ID NO: 6160740 - DNA, 15 bp, Homo sapiens
ctgtcacaaccaaga

SEQ ID NO: 6160741 - DNA, 20 bp, Homo sapiens
ctgtcacaataaagtttatt

SEQ ID NO: 6160742 - DNA, 13 bp, Homo sapiens
ctgtcacacactg

SEQ ID NO: 6160743 - DNA, 22 bp, Homo sapiens
ctgtcacacactggaccccact

SEQ ID NO: 6160744 - DNA, 16 bp, Homo sapiens
ctgtcacactggtgct

SEQ ID NO: 6160745 - DNA, 17 bp, Homo sapiens
ctgtcacactggtgctg

SEQ ID NO: 6160746 - DNA, 22 bp, Homo sapiens
ctgtcacactggtgctgagtga

SEQ ID NO: 6160747 - DNA, 13 bp, Homo sapiens
ctgtcacaggctg

SEQ ID NO: 6160748 - DNA, 21 bp, Homo sapiens
ctgtcacagtaaaaataaaat

SEQ ID NO: 6160749 - DNA, 22 bp, Homo sapiens
ctgtcacagtaaaaataaaata

SEQ ID NO: 6160750 - DNA, 15 bp, Homo sapiens
ctgtcacattgcatt

SEQ ID NO: 6160751 - DNA, 15 bp, Homo sapiens
ctgtcaccacatctt

SEQ ID NO: 6160752 - DNA, 17 bp, Homo sapiens
ctgtcaccacatcttgt

SEQ ID NO: 6160753 - DNA, 20 bp, Homo sapiens
ctgtcaccacatcttgtctt

SEQ ID NO: 6160754 - DNA, 19 bp, Homo sapiens
ctgtcaccagagcttctct

SEQ ID NO: 6160755 - DNA, 16 bp, Homo sapiens
ctgtcacccacagacc

SEQ ID NO: 6160756 - DNA, 16 bp, Homo sapiens
ctgtcacccagactgg

SEQ ID NO: 6160757 - DNA, 12 bp, Homo sapiens
ctgtcacccagc

SEQ ID NO: 6160758 - DNA, 16 bp, Homo sapiens
ctgtcacccagctcct

SEQ ID NO: 6160759 - DNA, 16 bp, Homo sapiens
ctgtcacccaggctgc

SEQ ID NO: 6160760 - DNA, 17 bp, Homo sapiens
ctgtcacccaggctgga

SEQ ID NO: 6160761 - DNA, 15 bp, Homo sapiens
ctgtcacccagtctg

SEQ ID NO: 6160762 - DNA, 17 bp, Homo sapiens
ctgtcacccccactccc

SEQ ID NO: 6160763 - DNA, 23 bp, Homo sapiens
ctgtcacccgtgtgaagatgaag

SEQ ID NO: 6160764 - DNA, 14 bp, Homo sapiens
ctgtcaccctccac

SEQ ID NO: 6160765 - DNA, 19 bp, Homo sapiens
ctgtcaccctccaccgagc

SEQ ID NO: 6160766 - DNA, 16 bp, Homo sapiens
ctgtcaccctccacct

SEQ ID NO: 6160767 - DNA, 18 bp, Homo sapiens
ctgtcaccctccacctct

SEQ ID NO: 6160768 - DNA, 18 bp, Homo sapiens
ctgtcaccctgcaggact

SEQ ID NO: 6160769 - DNA, 15 bp, Homo sapiens
ctgtcaccctggcca

SEQ ID NO: 6160770 - DNA, 20 bp, Homo sapiens
ctgtcaccctggccaccacc

SEQ ID NO: 6160771 - DNA, 15 bp, Homo sapiens
ctgtcaccgccatgc

SEQ ID NO: 6160772 - DNA, 18 bp, Homo sapiens
ctgtcacctagaacgtgc

SEQ ID NO: 6160773 - DNA, 19 bp, Homo sapiens
ctgtcacctagaacgtgca

SEQ ID NO: 6160774 - DNA, 18 bp, Homo sapiens
ctgtcacctctcagctgc

SEQ ID NO: 6160775 - DNA, 20 bp, Homo sapiens
ctgtcacctctcagctgctg

SEQ ID NO: 6160776 - DNA, 15 bp, Homo sapiens
ctgtcacctcttccg

SEQ ID NO: 6160777 - DNA, 19 bp, Homo sapiens
ctgtcacctgctcacaggg

SEQ ID NO: 6160778 - DNA, 14 bp, Homo sapiens
ctgtcacctggcct

SEQ ID NO: 6160779 - DNA, 17 bp, Homo sapiens
ctgtcacctggcctgcc

SEQ ID NO: 6160780 - DNA, 21 bp, Homo sapiens
ctgtcacgcggcagcttcagg

SEQ ID NO: 6160781 - DNA, 17 bp, Homo sapiens
ctgtcacgctcatgtcc

SEQ ID NO: 6160782 - DNA, 20 bp, Homo sapiens
ctgtcacgctcatgtcctgt

SEQ ID NO: 6160783 - DNA, 19 bp, Homo sapiens
ctgtcacgctctggtgcag

SEQ ID NO: 6160784 - DNA, 19 bp, Homo sapiens
ctgtcacggaacagatctt

SEQ ID NO: 6160785 - DNA, 12 bp, Homo sapiens
ctgtcactactg

SEQ ID NO: 6160786 - DNA, 13 bp, Homo sapiens
ctgtcactactgg

SEQ ID NO: 6160787 - DNA, 18 bp, Homo sapiens
ctgtcactcacaaaaggc

SEQ ID NO: 6160788 - DNA, 19 bp, Homo sapiens
ctgtcactcacaaaaggct

SEQ ID NO: 6160789 - DNA, 15 bp, Homo sapiens
ctgtcactcactgag

SEQ ID NO: 6160790 - DNA, 19 bp, Homo sapiens
ctgtcactcagctgagaag

SEQ ID NO: 6160791 - DNA, 17 bp, Homo sapiens
ctgtcactcaggctgga

SEQ ID NO: 6160792 - DNA, 19 bp, Homo sapiens
ctgtcactcaggctggagt

SEQ ID NO: 6160793 - DNA, 13 bp, Homo sapiens
ctgtcactccagg

SEQ ID NO: 6160794 - DNA, 16 bp, Homo sapiens
ctgtcactgatggaag

SEQ ID NO: 6160795 - DNA, 17 bp, Homo sapiens
ctgtcactgctctggac

SEQ ID NO: 6160796 - DNA, 15 bp, Homo sapiens
ctgtcactgctgctt

SEQ ID NO: 6160797 - DNA, 18 bp, Homo sapiens
ctgtcactggcagagcac

SEQ ID NO: 6160798 - DNA, 14 bp, Homo sapiens
ctgtcactggctgg

SEQ ID NO: 6160799 - DNA, 17 bp, Homo sapiens
ctgtcactgtccagagt

SEQ ID NO: 6160800 - DNA, 11 bp, Homo sapiens
ctgtcactgtt

SEQ ID NO: 6160801 - DNA, 20 bp, Homo sapiens
ctgtcacttgctgctttttc

SEQ ID NO: 6160802 - DNA, 12 bp, Homo sapiens
ctgtcactttgc

SEQ ID NO: 6160803 - DNA, 17 bp, Homo sapiens
ctgtcactttgctctgg

SEQ ID NO: 6160804 - DNA, 18 bp, Homo sapiens
ctgtcagaagacactaat

SEQ ID NO: 6160805 - DNA, 22 bp, Homo sapiens
ctgtcagaagggggttgtggca

SEQ ID NO: 6160806 - DNA, 13 bp, Homo sapiens
ctgtcagaataaa

SEQ ID NO: 6160807 - DNA, 20 bp, Homo sapiens
ctgtcagaataaagaacatt

SEQ ID NO: 6160808 - DNA, 14 bp, Homo sapiens
ctgtcagaatattc

SEQ ID NO: 6160809 - DNA, 24 bp, Homo sapiens
ctgtcagaatcatgctgttctctt

SEQ ID NO: 6160810 - DNA, 14 bp, Homo sapiens
ctgtcagagccgcc

SEQ ID NO: 6160811 - DNA, 24 bp, Homo sapiens
ctgtcagagctgttggcctcgcct

SEQ ID NO: 6160812 - DNA, 21 bp, Homo sapiens
ctgtcagataccctgtttctg

SEQ ID NO: 6160813 - DNA, 22 bp, Homo sapiens
ctgtcagatccaggagctccag

SEQ ID NO: 6160814 - DNA, 23 bp, Homo sapiens
ctgtcagatccaggagctccagt

SEQ ID NO: 6160815 - DNA, 21 bp, Homo sapiens
ctgtcagattaaattacagct

SEQ ID NO: 6160816 - DNA, 16 bp, Homo sapiens
ctgtcagcatctggct

SEQ ID NO: 6160817 - DNA, 12 bp, Homo sapiens
ctgtcagcatga

SEQ ID NO: 6160818 - DNA, 14 bp, Homo sapiens
ctgtcagcatgaat

SEQ ID NO: 6160819 - DNA, 16 bp, Homo sapiens
ctgtcagccagccgcc

SEQ ID NO: 6160820 - DNA, 19 bp, Homo sapiens
ctgtcagccagccgccctg

SEQ ID NO: 6160821 - DNA, 19 bp, Homo sapiens
ctgtcagccctcactgtca

SEQ ID NO: 6160822 - DNA, 16 bp, Homo sapiens
ctgtcagccgggccct

SEQ ID NO: 6160823 - DNA, 17 bp, Homo sapiens
ctgtcagccgggccctg

SEQ ID NO: 6160824 - DNA, 18 bp, Homo sapiens
ctgtcagccgggccctga

SEQ ID NO: 6160825 - DNA, 22 bp, Homo sapiens
ctgtcagctaaagaagtttgaa

SEQ ID NO: 6160826 - DNA, 23 bp, Homo sapiens
ctgtcagctcccctcggagaaga

SEQ ID NO: 6160827 - DNA, 15 bp, Homo sapiens
ctgtcagctccttga

SEQ ID NO: 6160828 - DNA, 13 bp, Homo sapiens
ctgtcagctgagc

SEQ ID NO: 6160829 - DNA, 18 bp, Homo sapiens
ctgtcagctgtgaaggct

SEQ ID NO: 6160830 - DNA, 15 bp, Homo sapiens
ctgtcagcttcccaa

SEQ ID NO: 6160831 - DNA, 19 bp, Homo sapiens
ctgtcagcttcccaacaat

SEQ ID NO: 6160832 - DNA, 12 bp, Homo sapiens
ctgtcaggaagt

SEQ ID NO: 6160833 - DNA, 16 bp, Homo sapiens
ctgtcaggaccatttt

SEQ ID NO: 6160834 - DNA, 18 bp, Homo sapiens
ctgtcaggaccattttag

SEQ ID NO: 6160835 - DNA, 20 bp, Homo sapiens
ctgtcaggagatggaagagt

SEQ ID NO: 6160836 - DNA, 17 bp, Homo sapiens
ctgtcaggattgcgaga

SEQ ID NO: 6160837 - DNA, 19 bp, Homo sapiens
ctgtcaggattgcgagaga

SEQ ID NO: 6160838 - DNA, 19 bp, Homo sapiens
ctgtcaggcagtagcagct

SEQ ID NO: 6160839 - DNA, 20 bp, Homo sapiens
ctgtcaggcagtagcagctg

SEQ ID NO: 6160840 - DNA, 18 bp, Homo sapiens
ctgtcaggcctctgagcc

SEQ ID NO: 6160841 - DNA, 19 bp, Homo sapiens
ctgtcaggctctggccctt

SEQ ID NO: 6160842 - DNA, 16 bp, Homo sapiens
ctgtcaggctgaaaac

SEQ ID NO: 6160843 - DNA, 16 bp, Homo sapiens
ctgtcaggctgggaca

SEQ ID NO: 6160844 - DNA, 21 bp, Homo sapiens
ctgtcaggctgggacaggctt

SEQ ID NO: 6160845 - DNA, 13 bp, Homo sapiens
ctgtcagggaggg

SEQ ID NO: 6160846 - DNA, 18 bp, Homo sapiens
ctgtcagggagggccagg

SEQ ID NO: 6160847 - DNA, 23 bp, Homo sapiens
ctgtcagggagggccagggaggc

SEQ ID NO: 6160848 - DNA, 18 bp, Homo sapiens
ctgtcagtgcagcccgtg

SEQ ID NO: 6160849 - DNA, 19 bp, Homo sapiens
ctgtcagtggggcagcctc

SEQ ID NO: 6160850 - DNA, 22 bp, Homo sapiens
ctgtcagtggggcagcctctcc

SEQ ID NO: 6160851 - DNA, 19 bp, Homo sapiens
ctgaataatgctaccagga

SEQ ID NO: 6160852 - DNA, 15 bp, Homo sapiens
ctgaataatttctta

SEQ ID NO: 6160853 - DNA, 16 bp, Homo sapiens
ctgaataatttcttac

SEQ ID NO: 6160854 - DNA, 16 bp, Homo sapiens
ctgaatacaaacattt

SEQ ID NO: 6160855 - DNA, 16 bp, Homo sapiens
ctgaatacaaagtgat

SEQ ID NO: 6160856 - DNA, 17 bp, Homo sapiens
ctgaatacaagcctatg

SEQ ID NO: 6160857 - DNA, 13 bp, Homo sapiens
ctgaatacacagt

SEQ ID NO: 6160858 - DNA, 17 bp, Homo sapiens
ctgaatacacagtattc

SEQ ID NO: 6160859 - DNA, 21 bp, Homo sapiens
ctgaatacacagtattcagag

SEQ ID NO: 6160860 - DNA, 16 bp, Homo sapiens
ctgaatacattctgct

SEQ ID NO: 6160861 - DNA, 15 bp, Homo sapiens
ctgaataccactctg

SEQ ID NO: 6160862 - DNA, 18 bp, Homo sapiens
ctgaataccactctgtaa

SEQ ID NO: 6160863 - DNA, 19 bp, Homo sapiens
ctgaataccactctgtaat

SEQ ID NO: 6160864 - DNA, 21 bp, Homo sapiens
ctgaataccactctgtaattg

SEQ ID NO: 6160865 - DNA, 13 bp, Homo sapiens
ctgaataccactt

SEQ ID NO: 6160866 - DNA, 18 bp, Homo sapiens
ctgaataccacttacctc

SEQ ID NO: 6160867 - DNA, 19 bp, Homo sapiens
ctgaataccacttacctca

SEQ ID NO: 6160868 - DNA, 23 bp, Homo sapiens
ctgaatacttaatatgtgggaaa

SEQ ID NO: 6160869 - DNA, 19 bp, Homo sapiens
ctgaatacttgaagtagga

SEQ ID NO: 6160870 - DNA, 15 bp, Homo sapiens
ctgaatagagggagt

SEQ ID NO: 6160871 - DNA, 21 bp, Homo sapiens
ctgaatagagggagtagaaag

SEQ ID NO: 6160872 - DNA, 15 bp, Homo sapiens
ctgaatagcagaagg

SEQ ID NO: 6160873 - DNA, 23 bp, Homo sapiens
ctgaataggcgatcacaacgtgc

SEQ ID NO: 6160874 - DNA, 17 bp, Homo sapiens
ctgaatataggaagcat

SEQ ID NO: 6160875 - DNA, 21 bp, Homo sapiens
ctgaatatctgttcacttttc

SEQ ID NO: 6160876 - DNA, 20 bp, Homo sapiens
ctgaatattagatgctctga

SEQ ID NO: 6160877 - DNA, 15 bp, Homo sapiens
ctgaatattctagaa

SEQ ID NO: 6160878 - DNA, 11 bp, Homo sapiens
ctgaatatttt

SEQ ID NO: 6160879 - DNA, 18 bp, Homo sapiens
ctgaatattttggaaact

SEQ ID NO: 6160880 - DNA, 14 bp, Homo sapiens
ctgaatattttgta

SEQ ID NO: 6160881 - DNA, 18 bp, Homo sapiens
ctgaatattttttgaggc

SEQ ID NO: 6160882 - DNA, 15 bp, Homo sapiens
ctgaatcaaaagctg

SEQ ID NO: 6160883 - DNA, 18 bp, Homo sapiens
ctgaatcaaagacatttc

SEQ ID NO: 6160884 - DNA, 21 bp, Homo sapiens
ctgaatcaaagacatttcatc

SEQ ID NO: 6160885 - DNA, 19 bp, Homo sapiens
ctgaatcaagcacactgta

SEQ ID NO: 6160886 - DNA, 19 bp, Homo sapiens
ctgaatcaccaattaaaaa

SEQ ID NO: 6160887 - DNA, 11 bp, Homo sapiens
ctgaatcactg

SEQ ID NO: 6160888 - DNA, 19 bp, Homo sapiens
ctgaatccaaaagaaaaac

SEQ ID NO: 6160889 - DNA, 19 bp, Homo sapiens
ctgaatccaaactaatcca

SEQ ID NO: 6160890 - DNA, 13 bp, Homo sapiens
ctgaatccacctc

SEQ ID NO: 6160891 - DNA, 14 bp, Homo sapiens
ctgaatccacctcg

SEQ ID NO: 6160892 - DNA, 17 bp, Homo sapiens
ctgaatccacctcggag

SEQ ID NO: 6160893 - DNA, 16 bp, Homo sapiens
ctgaatccatatttca

SEQ ID NO: 6160894 - DNA, 16 bp, Homo sapiens
ctgaatcccatcaggc

SEQ ID NO: 6160895 - DNA, 16 bp, Homo sapiens
ctgaatccctttcagt

SEQ ID NO: 6160896 - DNA, 13 bp, Homo sapiens
ctgaatccgtggt

SEQ ID NO: 6160897 - DNA, 13 bp, Homo sapiens
ctgaatcctgtta

SEQ ID NO: 6160898 - DNA, 20 bp, Homo sapiens
ctgaatcctgttaaattttc

SEQ ID NO: 6160899 - DNA, 21 bp, Homo sapiens
ctgaatccttccatttcttct

SEQ ID NO: 6160900 - DNA, 15 bp, Homo sapiens
ctgaatcgtttcatg

SEQ ID NO: 6160901 - DNA, 16 bp, Homo sapiens
ctgaatctaaaataaa

SEQ ID NO: 6160902 - DNA, 20 bp, Homo sapiens
ctgaatctaacagtgacttc

SEQ ID NO: 6160903 - DNA, 15 bp, Homo sapiens
ctgaatctcccaagg

SEQ ID NO: 6160904 - DNA, 16 bp, Homo sapiens
ctgaatctcccaagga

SEQ ID NO: 6160905 - DNA, 19 bp, Homo sapiens
ctgaatctctcaaaatgtg

SEQ ID NO: 6160906 - DNA, 19 bp, Homo sapiens
ctgaatctgaccacagaca

SEQ ID NO: 6160907 - DNA, 19 bp, Homo sapiens
ctgaatctgataggaaaag

SEQ ID NO: 6160908 - DNA, 12 bp, Homo sapiens
ctgaatctgtac

SEQ ID NO: 6160909 - DNA, 15 bp, Homo sapiens
ctgaatctgtgcaaa

SEQ ID NO: 6160910 - DNA, 18 bp, Homo sapiens
ctgaatctgtgcaaacag

SEQ ID NO: 6160911 - DNA, 15 bp, Homo sapiens
ctgaatctgtgcctg

SEQ ID NO: 6160912 - DNA, 14 bp, Homo sapiens
ctgaatctgtttct

SEQ ID NO: 6160913 - DNA, 23 bp, Homo sapiens
ctgaatcttcacgacaatgttga

SEQ ID NO: 6160914 - DNA, 21 bp, Homo sapiens
ctgaatcttttttttatataa

SEQ ID NO: 6160915 - DNA, 17 bp, Homo sapiens
ctgaatgaaaataactg

SEQ ID NO: 6160916 - DNA, 22 bp, Homo sapiens
ctgaatgaaaataactgaacca

SEQ ID NO: 6160917 - DNA, 21 bp, Homo sapiens
ctgaatgaaacccccacacac

SEQ ID NO: 6160918 - DNA, 23 bp, Homo sapiens
ctgaatgaaacccccacacacac

SEQ ID NO: 6160919 - DNA, 20 bp, Homo sapiens
ctgaatgaacaacctcggct

SEQ ID NO: 6160920 - DNA, 22 bp, Homo sapiens
ctgaatgaacaacctcggctcc

SEQ ID NO: 6160921 - DNA, 13 bp, Homo sapiens
ctgaatgaagcct

SEQ ID NO: 6160922 - DNA, 21 bp, Homo sapiens
ctgaatgaagccttctgacct

SEQ ID NO: 6160923 - DNA, 14 bp, Homo sapiens
ctgaatgaagctga

SEQ ID NO: 6160924 - DNA, 17 bp, Homo sapiens
ctgaatgacctgcagtc

SEQ ID NO: 6160925 - DNA, 17 bp, Homo sapiens
ctgaatgagaagtaaat

SEQ ID NO: 6160926 - DNA, 18 bp, Homo sapiens
ctgaatgagaagtaaatt

SEQ ID NO: 6160927 - DNA, 17 bp, Homo sapiens
ctgaatgaggcggagct

SEQ ID NO: 6160928 - DNA, 15 bp, Homo sapiens
ctgaatgatctattc

SEQ ID NO: 6160929 - DNA, 21 bp, Homo sapiens
ctgaatgatcttgtgtaaggt

SEQ ID NO: 6160930 - DNA, 16 bp, Homo sapiens
ctgaatgcagaacggt

SEQ ID NO: 6160931 - DNA, 13 bp, Homo sapiens
ctgaatgccccct

SEQ ID NO: 6160932 - DNA, 21 bp, Homo sapiens
ctgaatgccgcgatgggtcag

SEQ ID NO: 6160933 - DNA, 22 bp, Homo sapiens
ctgaatgcctcaatgtgaccag

SEQ ID NO: 6160934 - DNA, 23 bp, Homo sapiens
ctgaatgcctcaatgtgaccagg

SEQ ID NO: 6160935 - DNA, 18 bp, Homo sapiens
ctgaatgcctcctgtggg

SEQ ID NO: 6160936 - DNA, 18 bp, Homo sapiens
ctgaatgctatttgtgta

SEQ ID NO: 6160937 - DNA, 20 bp, Homo sapiens
ctgaatgctatttgtgtaac

SEQ ID NO: 6160938 - DNA, 23 bp, Homo sapiens
ctgaatgctatttgtgtaactga

SEQ ID NO: 6160939 - DNA, 22 bp, Homo sapiens
ctgaatgctgagctgaagaaat

SEQ ID NO: 6160940 - DNA, 13 bp, Homo sapiens
ctgaatgcttcta

SEQ ID NO: 6160941 - DNA, 14 bp, Homo sapiens
ctgaatgcttctaa

SEQ ID NO: 6160942 - DNA, 15 bp, Homo sapiens
ctgaatgcttctaag

SEQ ID NO: 6160943 - DNA, 19 bp, Homo sapiens
ctgaatggactaagatgaa

SEQ ID NO: 6160944 - DNA, 21 bp, Homo sapiens
ctgaatggctttgtcttgaaa

SEQ ID NO: 6160945 - DNA, 19 bp, Homo sapiens
ctgaatggttttcaaaata

SEQ ID NO: 6160946 - DNA, 17 bp, Homo sapiens
ctgaatgtaaaagaaaa

SEQ ID NO: 6160947 - DNA, 22 bp, Homo sapiens
ctgaatgtagccagcccacatc

SEQ ID NO: 6160948 - DNA, 16 bp, Homo sapiens
ctgaatgtatttatgt

SEQ ID NO: 6160949 - DNA, 20 bp, Homo sapiens
ctgaatgtatttatgtgtat

SEQ ID NO: 6160950 - DNA, 18 bp, Homo sapiens
ctgaatgtcaaacagtgc

SEQ ID NO: 6160951 - DNA, 20 bp, Homo sapiens
ctgaatgtcaaacagtgcca

SEQ ID NO: 6160952 - DNA, 23 bp, Homo sapiens
ctgaatgtcaaacagtgccaaat

SEQ ID NO: 6160953 - DNA, 18 bp, Homo sapiens
ctgaatgtcaagaaaagg

SEQ ID NO: 6160954 - DNA, 15 bp, Homo sapiens
ctgaatgtcattatt

SEQ ID NO: 6160955 - DNA, 14 bp, Homo sapiens
ctgaatgtcccaga

SEQ ID NO: 6160956 - DNA, 15 bp, Homo sapiens
ctgaatgtcccagag

SEQ ID NO: 6160957 - DNA, 23 bp, Homo sapiens
ctgaatgtcctttctccagtgta

SEQ ID NO: 6160958 - DNA, 20 bp, Homo sapiens
ctgaatgttctgacattaac

SEQ ID NO: 6160959 - DNA, 21 bp, Homo sapiens
ctgaatgttcttgaattatat

SEQ ID NO: 6160960 - DNA, 15 bp, Homo sapiens
ctgaatgttgggact

SEQ ID NO: 6160961 - DNA, 15 bp, Homo sapiens
ctgaatgtttgtgtc

SEQ ID NO: 6160962 - DNA, 19 bp, Homo sapiens
ctgaatgttttatttatca

SEQ ID NO: 6160963 - DNA, 16 bp, Homo sapiens
ctgaatgtttttctaa

SEQ ID NO: 6160964 - DNA, 15 bp, Homo sapiens
ctgaattaaaatggt

SEQ ID NO: 6160965 - DNA, 13 bp, Homo sapiens
ctgaattaaagtc

SEQ ID NO: 6160966 - DNA, 14 bp, Homo sapiens
ctgaattaaagtct

SEQ ID NO: 6160967 - DNA, 16 bp, Homo sapiens
ctgaattaaataaata

SEQ ID NO: 6160968 - DNA, 14 bp, Homo sapiens
ctgaattaagttat

SEQ ID NO: 6160969 - DNA, 21 bp, Homo sapiens
ctgaattaatgacagagccag

SEQ ID NO: 6160970 - DNA, 14 bp, Homo sapiens
ctgaattaattaat

SEQ ID NO: 6160971 - DNA, 14 bp, Homo sapiens
ctgaattacagtga

SEQ ID NO: 6160972 - DNA, 22 bp, Homo sapiens
ctgaattacagtgaaattttgg

SEQ ID NO: 6160973 - DNA, 18 bp, Homo sapiens
ctgaattagtccttgctt

SEQ ID NO: 6160974 - DNA, 19 bp, Homo sapiens
ctgaattagtccttgcttg

SEQ ID NO: 6160975 - DNA, 20 bp, Homo sapiens
ctgaattagtccttgcttgg

SEQ ID NO: 6160976 - DNA, 14 bp, Homo sapiens
ctgaattataagag

SEQ ID NO: 6160977 - DNA, 17 bp, Homo sapiens
ctgaattatctatttca

SEQ ID NO: 6160978 - DNA, 15 bp, Homo sapiens
ctgaattatgaaact

SEQ ID NO: 6160979 - DNA, 15 bp, Homo sapiens
ctgaattattaatga

SEQ ID NO: 6160980 - DNA, 12 bp, Homo sapiens
ctgaattatttt

SEQ ID NO: 6160981 - DNA, 17 bp, Homo sapiens
ctgaattcacctgtgga

SEQ ID NO: 6160982 - DNA, 12 bp, Homo sapiens
ctgaattcactc

SEQ ID NO: 6160983 - DNA, 15 bp, Homo sapiens
ctgaattcactccag

SEQ ID NO: 6160984 - DNA, 18 bp, Homo sapiens
ctgaattcactccagtca

SEQ ID NO: 6160985 - DNA, 23 bp, Homo sapiens
ctgaattcactccagtcaacaga

SEQ ID NO: 6160986 - DNA, 15 bp, Homo sapiens
ctgaattcagttgct

SEQ ID NO: 6160987 - DNA, 15 bp, Homo sapiens
ctgaattcattgtct

SEQ ID NO: 6160988 - DNA, 22 bp, Homo sapiens
ctgaattcattgtctcagtgaa

SEQ ID NO: 6160989 - DNA, 23 bp, Homo sapiens
ctgaattcctttacaactaaata

SEQ ID NO: 6160990 - DNA, 16 bp, Homo sapiens
ctgaattctatttgct

SEQ ID NO: 6160991 - DNA, 18 bp, Homo sapiens
ctgaattgacatgaccct

SEQ ID NO: 6160992 - DNA, 23 bp, Homo sapiens
ctgaattgacatgaccctctgtc

SEQ ID NO: 6160993 - DNA, 13 bp, Homo sapiens
ctgaattgagaaa

SEQ ID NO: 6160994 - DNA, 21 bp, Homo sapiens
ctgaattgagcctaaaaataa

SEQ ID NO: 6160995 - DNA, 22 bp, Homo sapiens
ctgaattgagcctaaaaataaa

SEQ ID NO: 6160996 - DNA, 23 bp, Homo sapiens
ctgaattgagcctaaaaataaag

SEQ ID NO: 6160997 - DNA, 18 bp, Homo sapiens
ctgaattgctatgtgaaa

SEQ ID NO: 6160998 - DNA, 13 bp, Homo sapiens
ctgaattgctttc

SEQ ID NO: 6160999 - DNA, 14 bp, Homo sapiens
ctgaattgctttct

SEQ ID NO: 6161000 - DNA, 22 bp, Homo sapiens
ctgaattgctttctgctcttta

SEQ ID NO: 6161001 - DNA, 14 bp, Homo sapiens
ctgaattggaaggg

SEQ ID NO: 6161002 - DNA, 19 bp, Homo sapiens
ctgaattggaagggaaaaa

SEQ ID NO: 6161003 - DNA, 21 bp, Homo sapiens
ctgaattggaatgcactcaga

SEQ ID NO: 6161004 - DNA, 19 bp, Homo sapiens
ctgaattggcttccagatt

SEQ ID NO: 6161005 - DNA, 20 bp, Homo sapiens
ctgaattggcttccagattt

SEQ ID NO: 6161006 - DNA, 19 bp, Homo sapiens
ctgaattgtatcaatttgt

SEQ ID NO: 6161007 - DNA, 21 bp, Homo sapiens
ctgaattgtcagatgtggagt

SEQ ID NO: 6161008 - DNA, 15 bp, Homo sapiens
ctgaattgttatgta

SEQ ID NO: 6161009 - DNA, 17 bp, Homo sapiens
ctgaattgtttataatg

SEQ ID NO: 6161010 - DNA, 18 bp, Homo sapiens
ctgaatttaaatagcttt

SEQ ID NO: 6161011 - DNA, 15 bp, Homo sapiens
ctgaatttaactact

SEQ ID NO: 6161012 - DNA, 16 bp, Homo sapiens
ctgaatttatctttga

SEQ ID NO: 6161013 - DNA, 15 bp, Homo sapiens
ctgaatttattgcct

SEQ ID NO: 6161014 - DNA, 20 bp, Homo sapiens
ctgaatttcaggcattttgt

SEQ ID NO: 6161015 - DNA, 19 bp, Homo sapiens
ctgaatttcattctcttga

SEQ ID NO: 6161016 - DNA, 13 bp, Homo sapiens
ctgaatttccctc

SEQ ID NO: 6161017 - DNA, 14 bp, Homo sapiens
ctgaatttcctttt

SEQ ID NO: 6161018 - DNA, 18 bp, Homo sapiens
ctgaatttgcaaagtact

SEQ ID NO: 6161019 - DNA, 21 bp, Homo sapiens
ctgaatttgcaaagtactgta

SEQ ID NO: 6161020 - DNA, 22 bp, Homo sapiens
ctgaatttgcaaagtactgtaa

SEQ ID NO: 6161021 - DNA, 12 bp, Homo sapiens
ctgaatttggag

SEQ ID NO: 6161022 - DNA, 21 bp, Homo sapiens
ctgaatttggcctgcactaat

SEQ ID NO: 6161023 - DNA, 14 bp, Homo sapiens
ctgaatttgggcct

SEQ ID NO: 6161024 - DNA, 20 bp, Homo sapiens
ctgaatttggggctacttat

SEQ ID NO: 6161025 - DNA, 22 bp, Homo sapiens
ctgaatttgtaagcaacttgct

SEQ ID NO: 6161026 - DNA, 17 bp, Homo sapiens
ctgaatttgtatatgac

SEQ ID NO: 6161027 - DNA, 20 bp, Homo sapiens
ctgaatttgtatatgactgc

SEQ ID NO: 6161028 - DNA, 18 bp, Homo sapiens
ctgaattttaaatgttca

SEQ ID NO: 6161029 - DNA, 13 bp, Homo sapiens
ctgtcagtgtcac

SEQ ID NO: 6161030 - DNA, 14 bp, Homo sapiens
ctgtcagtgtcctc

SEQ ID NO: 6161031 - DNA, 16 bp, Homo sapiens
ctgtcagtgtcctcag

SEQ ID NO: 6161032 - DNA, 11 bp, Homo sapiens
ctgtcagtgtg

SEQ ID NO: 6161033 - DNA, 14 bp, Homo sapiens
ctgtcagtgtgaaa

SEQ ID NO: 6161034 - DNA, 17 bp, Homo sapiens
ctgtcagtgttaaagat

SEQ ID NO: 6161035 - DNA, 18 bp, Homo sapiens
ctgtcagtgttaaagatt

SEQ ID NO: 6161036 - DNA, 19 bp, Homo sapiens
ctgtcagtgtttttgaaac

SEQ ID NO: 6161037 - DNA, 22 bp, Homo sapiens
ctgtcagttatgacatccacaa

SEQ ID NO: 6161038 - DNA, 15 bp, Homo sapiens
ctgtcagttcatcct

SEQ ID NO: 6161039 - DNA, 23 bp, Homo sapiens
ctgtcagtttcccctctcggcca

SEQ ID NO: 6161040 - DNA, 21 bp, Homo sapiens
ctgtcatagggattgtccctg

SEQ ID NO: 6161041 - DNA, 18 bp, Homo sapiens
ctgtcatatcttcacaat

SEQ ID NO: 6161042 - DNA, 22 bp, Homo sapiens
ctgtcatatgctctgatttatc

SEQ ID NO: 6161043 - DNA, 15 bp, Homo sapiens
ctgtcatcactccct

SEQ ID NO: 6161044 - DNA, 18 bp, Homo sapiens
ctgtcatcactccctgga

SEQ ID NO: 6161045 - DNA, 19 bp, Homo sapiens
ctgtcatcactccctggat

SEQ ID NO: 6161046 - DNA, 19 bp, Homo sapiens
ctgtcatcatcatggccag

SEQ ID NO: 6161047 - DNA, 14 bp, Homo sapiens
ctgtcatccagaaa

SEQ ID NO: 6161048 - DNA, 17 bp, Homo sapiens
ctgtcatccagctcact

SEQ ID NO: 6161049 - DNA, 19 bp, Homo sapiens
ctgtcatccatatttgcta

SEQ ID NO: 6161050 - DNA, 19 bp, Homo sapiens
ctgtcatcccgctcctgct

SEQ ID NO: 6161051 - DNA, 21 bp, Homo sapiens
ctgtcatcccgctcctgctga

SEQ ID NO: 6161052 - DNA, 21 bp, Homo sapiens
ctgtcatcctcaaagaaagtg

SEQ ID NO: 6161053 - DNA, 15 bp, Homo sapiens
ctgtcatcctctgga

SEQ ID NO: 6161054 - DNA, 14 bp, Homo sapiens
ctgtcatctaaagt

SEQ ID NO: 6161055 - DNA, 14 bp, Homo sapiens
ctgtcatctagccc

SEQ ID NO: 6161056 - DNA, 18 bp, Homo sapiens
ctgtcatctctctggggc

SEQ ID NO: 6161057 - DNA, 13 bp, Homo sapiens
ctgtcatctgctg

SEQ ID NO: 6161058 - DNA, 21 bp, Homo sapiens
ctgtcatgaaatcagcaagag

SEQ ID NO: 6161059 - DNA, 13 bp, Homo sapiens
ctgtcatgccccc

SEQ ID NO: 6161060 - DNA, 19 bp, Homo sapiens
ctgtcatggaaaagcccag

SEQ ID NO: 6161061 - DNA, 20 bp, Homo sapiens
ctgtcatggaaaagcccagt

SEQ ID NO: 6161062 - DNA, 22 bp, Homo sapiens
ctgtcatggctctgaactgcac

SEQ ID NO: 6161063 - DNA, 14 bp, Homo sapiens
ctgtcatggtcctt

SEQ ID NO: 6161064 - DNA, 13 bp, Homo sapiens
ctgtcatggtgca

SEQ ID NO: 6161065 - DNA, 18 bp, Homo sapiens
ctgtcatggtgcaatttg

SEQ ID NO: 6161066 - DNA, 20 bp, Homo sapiens
ctgtcattaaactcatattt

SEQ ID NO: 6161067 - DNA, 17 bp, Homo sapiens
ctgtcattagaattgaa

SEQ ID NO: 6161068 - DNA, 14 bp, Homo sapiens
ctgtcattatattc

SEQ ID NO: 6161069 - DNA, 16 bp, Homo sapiens
ctgtcattatattcta

SEQ ID NO: 6161070 - DNA, 23 bp, Homo sapiens
ctgtcattatattctaattaaaa

SEQ ID NO: 6161071 - DNA, 14 bp, Homo sapiens
ctgtcattcaaatg

SEQ ID NO: 6161072 - DNA, 17 bp, Homo sapiens
ctgtcattcaaatgggt

SEQ ID NO: 6161073 - DNA, 23 bp, Homo sapiens
ctgtcattcaggaccccaacccc

SEQ ID NO: 6161074 - DNA, 22 bp, Homo sapiens
ctgtcattcctaaaacaccctt

SEQ ID NO: 6161075 - DNA, 15 bp, Homo sapiens
ctgtcattgcccctc

SEQ ID NO: 6161076 - DNA, 19 bp, Homo sapiens
ctgtcattgcttcttctga

SEQ ID NO: 6161077 - DNA, 14 bp, Homo sapiens
ctgtcatttctctt

SEQ ID NO: 6161078 - DNA, 19 bp, Homo sapiens
ctgtcatttctctttcaaa

SEQ ID NO: 6161079 - DNA, 17 bp, Homo sapiens
ctgtcatttgaacctgg

SEQ ID NO: 6161080 - DNA, 14 bp, Homo sapiens
ctgtcatttgagca

SEQ ID NO: 6161081 - DNA, 16 bp, Homo sapiens
ctgtcatttgagcagg

SEQ ID NO: 6161082 - DNA, 20 bp, Homo sapiens
ctgtcatttgagcagggctc

SEQ ID NO: 6161083 - DNA, 16 bp, Homo sapiens
ctgtcattttatgcta

SEQ ID NO: 6161084 - DNA, 23 bp, Homo sapiens
ctgtcattttcacaatcttgggg

SEQ ID NO: 6161085 - DNA, 16 bp, Homo sapiens
ctgtcattttgcactg

SEQ ID NO: 6161086 - DNA, 17 bp, Homo sapiens
ctgtcatttttaacagc

SEQ ID NO: 6161087 - DNA, 16 bp, Homo sapiens
ctgtccaaacatttca

SEQ ID NO: 6161088 - DNA, 20 bp, Homo sapiens
ctgtccaaactgcctaagcc

SEQ ID NO: 6161089 - DNA, 21 bp, Homo sapiens
ctgtccaaaggaggctggcag

SEQ ID NO: 6161090 - DNA, 16 bp, Homo sapiens
ctgtccaacatggtga

SEQ ID NO: 6161091 - DNA, 16 bp, Homo sapiens
ctgtccaacccctccc

SEQ ID NO: 6161092 - DNA, 16 bp, Homo sapiens
ctgtccaacctaaccc

SEQ ID NO: 6161093 - DNA, 16 bp, Homo sapiens
ctgtccaagacagggc

SEQ ID NO: 6161094 - DNA, 18 bp, Homo sapiens
ctgtccaatcagagaata

SEQ ID NO: 6161095 - DNA, 15 bp, Homo sapiens
ctgtccaatctgcaa

SEQ ID NO: 6161096 - DNA, 20 bp, Homo sapiens
ctgtccaattccagagctgt

SEQ ID NO: 6161097 - DNA, 19 bp, Homo sapiens
ctgtccaatttctattaaa

SEQ ID NO: 6161098 - DNA, 22 bp, Homo sapiens
ctgtccaatttctattaaaggt

SEQ ID NO: 6161099 - DNA, 16 bp, Homo sapiens
ctgtccaatttctgct

SEQ ID NO: 6161100 - DNA, 19 bp, Homo sapiens
ctgtccacatccccagagc

SEQ ID NO: 6161101 - DNA, 17 bp, Homo sapiens
ctgtccacatgacctcc

SEQ ID NO: 6161102 - DNA, 19 bp, Homo sapiens
ctgtccacatgacctccat

SEQ ID NO: 6161103 - DNA, 20 bp, Homo sapiens
ctgtccacatgacctccatt

SEQ ID NO: 6161104 - DNA, 16 bp, Homo sapiens
ctgtccaccagtttat

SEQ ID NO: 6161105 - DNA, 19 bp, Homo sapiens
ctgtccaccagtttataca

SEQ ID NO: 6161106 - DNA, 22 bp, Homo sapiens
ctgtccaccagtttatacagaa

SEQ ID NO: 6161107 - DNA, 22 bp, Homo sapiens
ctgtccactctcggggcccttg

SEQ ID NO: 6161108 - DNA, 18 bp, Homo sapiens
ctgtccactctgctcagg

SEQ ID NO: 6161109 - DNA, 14 bp, Homo sapiens
ctgtccacttgtgg

SEQ ID NO: 6161110 - DNA, 19 bp, Homo sapiens
ctgtccacttgtgggtcct

SEQ ID NO: 6161111 - DNA, 15 bp, Homo sapiens
ctgtccagacagcct

SEQ ID NO: 6161112 - DNA, 16 bp, Homo sapiens
ctgtccagacagcctg

SEQ ID NO: 6161113 - DNA, 16 bp, Homo sapiens
ctgtccagagtctctt

SEQ ID NO: 6161114 - DNA, 19 bp, Homo sapiens
ctgtccagataagttattt

SEQ ID NO: 6161115 - DNA, 19 bp, Homo sapiens
ctgtccagattattggctg

SEQ ID NO: 6161116 - DNA, 22 bp, Homo sapiens
ctgtccagattattggctgctt

SEQ ID NO: 6161117 - DNA, 23 bp, Homo sapiens
ctgtccagattattggctgcttt

SEQ ID NO: 6161118 - DNA, 21 bp, Homo sapiens
ctgtccagccgtgtgtgcatg

SEQ ID NO: 6161119 - DNA, 23 bp, Homo sapiens
ctgtccagccgtgtgtgcatgtg

SEQ ID NO: 6161120 - DNA, 15 bp, Homo sapiens
ctgtccagcctgggc

SEQ ID NO: 6161121 - DNA, 13 bp, Homo sapiens
ctgtccagctcca

SEQ ID NO: 6161122 - DNA, 14 bp, Homo sapiens
ctgtccagctccaa

SEQ ID NO: 6161123 - DNA, 18 bp, Homo sapiens
ctgtccagctccaacctg

SEQ ID NO: 6161124 - DNA, 13 bp, Homo sapiens
ctgtccagctggg

SEQ ID NO: 6161125 - DNA, 20 bp, Homo sapiens
ctgtccagctggggccagag

SEQ ID NO: 6161126 - DNA, 23 bp, Homo sapiens
ctgtccagctggggccagaggct

SEQ ID NO: 6161127 - DNA, 17 bp, Homo sapiens
ctgtccaggatggaggg

SEQ ID NO: 6161128 - DNA, 21 bp, Homo sapiens
ctgtccaggatggagggtcca

SEQ ID NO: 6161129 - DNA, 17 bp, Homo sapiens
ctgtccaggcactgctg

SEQ ID NO: 6161130 - DNA, 21 bp, Homo sapiens
ctgtccaggcactgctgccca

SEQ ID NO: 6161131 - DNA, 12 bp, Homo sapiens
ctgtccaggcag

SEQ ID NO: 6161132 - DNA, 14 bp, Homo sapiens
ctgtccaggcagct

SEQ ID NO: 6161133 - DNA, 19 bp, Homo sapiens
ctgtccaggcagctccctc

SEQ ID NO: 6161134 - DNA, 21 bp, Homo sapiens
ctgtccaggcagctccctcct

SEQ ID NO: 6161135 - DNA, 12 bp, Homo sapiens
ctgtccaggcca

SEQ ID NO: 6161136 - DNA, 13 bp, Homo sapiens
ctgtccaggccac

SEQ ID NO: 6161137 - DNA, 16 bp, Homo sapiens
ctgtccaggccactgt

SEQ ID NO: 6161138 - DNA, 21 bp, Homo sapiens
ctgtccaggccactgtggcca

SEQ ID NO: 6161139 - DNA, 13 bp, Homo sapiens
ctgtccaggctcg

SEQ ID NO: 6161140 - DNA, 12 bp, Homo sapiens
ctgtccagggaa

SEQ ID NO: 6161141 - DNA, 19 bp, Homo sapiens
ctgtccagggaaacagcct

SEQ ID NO: 6161142 - DNA, 20 bp, Homo sapiens
ctgtccagggaaacagcctc

SEQ ID NO: 6161143 - DNA, 21 bp, Homo sapiens
ctgtccagggaaacagcctct

SEQ ID NO: 6161144 - DNA, 22 bp, Homo sapiens
ctgtccagggaaacagcctctc

SEQ ID NO: 6161145 - DNA, 11 bp, Homo sapiens
ctgtccagggc

SEQ ID NO: 6161146 - DNA, 22 bp, Homo sapiens
ctgtccagggcccatgtagctg

SEQ ID NO: 6161147 - DNA, 23 bp, Homo sapiens
ctgtccagggcccatgtagctgg

SEQ ID NO: 6161148 - DNA, 24 bp, Homo sapiens
ctgtccagggcccatgtagctggc

SEQ ID NO: 6161149 - DNA, 19 bp, Homo sapiens
ctgtccagggccctgagct

SEQ ID NO: 6161150 - DNA, 12 bp, Homo sapiens
ctgtccagggct

SEQ ID NO: 6161151 - DNA, 15 bp, Homo sapiens
ctgtccagggcttca

SEQ ID NO: 6161152 - DNA, 12 bp, Homo sapiens
ctgtccagtgcc

SEQ ID NO: 6161153 - DNA, 14 bp, Homo sapiens
ctgtccagtgccca

SEQ ID NO: 6161154 - DNA, 14 bp, Homo sapiens
ctgtccagttccca

SEQ ID NO: 6161155 - DNA, 15 bp, Homo sapiens
ctgtccagttcccag

SEQ ID NO: 6161156 - DNA, 18 bp, Homo sapiens
ctgtccagttcccagaag

SEQ ID NO: 6161157 - DNA, 20 bp, Homo sapiens
ctgtccagttcccagaaggc

SEQ ID NO: 6161158 - DNA, 21 bp, Homo sapiens
ctgtccagttcccagaaggca

SEQ ID NO: 6161159 - DNA, 20 bp, Homo sapiens
ctgtccagttcctttagaaa

SEQ ID NO: 6161160 - DNA, 14 bp, Homo sapiens
ctgtccagtttcca

SEQ ID NO: 6161161 - DNA, 22 bp, Homo sapiens
ctgtccatatttataggtaccc

SEQ ID NO: 6161162 - DNA, 16 bp, Homo sapiens
ctgtccatcagccagg

SEQ ID NO: 6161163 - DNA, 13 bp, Homo sapiens
ctgtccatcccca

SEQ ID NO: 6161164 - DNA, 14 bp, Homo sapiens
ctgtccatccccag

SEQ ID NO: 6161165 - DNA, 22 bp, Homo sapiens
ctgtccatctgcccgcctgccc

SEQ ID NO: 6161166 - DNA, 16 bp, Homo sapiens
ctgtccatgcttctca

SEQ ID NO: 6161167 - DNA, 16 bp, Homo sapiens
ctgtccatggcctttc

SEQ ID NO: 6161168 - DNA, 17 bp, Homo sapiens
ctgtccatggcctttct

SEQ ID NO: 6161169 - DNA, 20 bp, Homo sapiens
ctgtccattcggaaccaggc

SEQ ID NO: 6161170 - DNA, 21 bp, Homo sapiens
ctgtccattgccacggccatg

SEQ ID NO: 6161171 - DNA, 21 bp, Homo sapiens
ctgtccatttatccacaggaa

SEQ ID NO: 6161172 - DNA, 21 bp, Homo sapiens
ctgtccattttcttttaaagt

SEQ ID NO: 6161173 - DNA, 17 bp, Homo sapiens
ctgtccatttttattca

SEQ ID NO: 6161174 - DNA, 21 bp, Homo sapiens
ctgtccatttttattcagggg

SEQ ID NO: 6161175 - DNA, 14 bp, Homo sapiens
ctgtcccaagctcc

SEQ ID NO: 6161176 - DNA, 19 bp, Homo sapiens
ctgtcccaagctcccaaga

SEQ ID NO: 6161177 - DNA, 17 bp, Homo sapiens
ctgtcccaaggaggggg

SEQ ID NO: 6161178 - DNA, 11 bp, Homo sapiens
ctgtcccaagt

SEQ ID NO: 6161179 - DNA, 12 bp, Homo sapiens
ctgtcccaagtc

SEQ ID NO: 6161180 - DNA, 20 bp, Homo sapiens
ctgtcccaagtcctgctcct

SEQ ID NO: 6161181 - DNA, 14 bp, Homo sapiens
ctgtcccaagtctc

SEQ ID NO: 6161182 - DNA, 18 bp, Homo sapiens
ctgtcccaccaactctgc

SEQ ID NO: 6161183 - DNA, 21 bp, Homo sapiens
ctgtcccaccaactctgcact

SEQ ID NO: 6161184 - DNA, 15 bp, Homo sapiens
ctgtcccacccacac

SEQ ID NO: 6161185 - DNA, 14 bp, Homo sapiens
ctgtcccaccccca

SEQ ID NO: 6161186 - DNA, 19 bp, Homo sapiens
ctgtcccaccgggagcctc

SEQ ID NO: 6161187 - DNA, 13 bp, Homo sapiens
ctgtcccacctct

SEQ ID NO: 6161188 - DNA, 11 bp, Homo sapiens
ctgtcccactg

SEQ ID NO: 6161189 - DNA, 15 bp, Homo sapiens
ctgtcccactggctc

SEQ ID NO: 6161190 - DNA, 22 bp, Homo sapiens
ctgtcccactggctcctcccag

SEQ ID NO: 6161191 - DNA, 23 bp, Homo sapiens
ctgtcccactggctcctcccagc

SEQ ID NO: 6161192 - DNA, 14 bp, Homo sapiens
ctgtcccactggga

SEQ ID NO: 6161193 - DNA, 15 bp, Homo sapiens
ctgtcccactgggac

SEQ ID NO: 6161194 - DNA, 16 bp, Homo sapiens
ctgtcccactgggaca

SEQ ID NO: 6161195 - DNA, 15 bp, Homo sapiens
ctgtcccaggactca

SEQ ID NO: 6161196 - DNA, 22 bp, Homo sapiens
ctgtcccaggactcaccctcca

SEQ ID NO: 6161197 - DNA, 18 bp, Homo sapiens
ctgtcccaggcagcgcca

SEQ ID NO: 6161198 - DNA, 14 bp, Homo sapiens
ctgtcccaggcatg

SEQ ID NO: 6161199 - DNA, 20 bp, Homo sapiens
ctgtcccaggccggcccaga

SEQ ID NO: 6161200 - DNA, 22 bp, Homo sapiens
ctgtcccaggttatctgggcat

SEQ ID NO: 6161201 - DNA, 21 bp, Homo sapiens
ctgtcccatctggtcatttgg

SEQ ID NO: 6161202 - DNA, 19 bp, Homo sapiens
ctgtcccatggacactcca

SEQ ID NO: 6161203 - DNA, 20 bp, Homo sapiens
ctgtcccatgggctctggcc

SEQ ID NO: 6161204 - DNA, 22 bp, Homo sapiens
ctgtcccatgggctctggcccc

SEQ ID NO: 6161205 - DNA, 23 bp, Homo sapiens
ctgtcccatgggctctggcccca

SEQ ID NO: 6161206 - DNA, 13 bp, Homo sapiens
ctgtcccattccc

SEQ ID NO: 6161207 - DNA, 11 bp, Homo sapiens
ctgaattttag

SEQ ID NO: 6161208 - DNA, 16 bp, Homo sapiens
ctgaattttctggaaa

SEQ ID NO: 6161209 - DNA, 17 bp, Homo sapiens
ctgaattttgagtctat

SEQ ID NO: 6161210 - DNA, 16 bp, Homo sapiens
ctgaattttgcttcct

SEQ ID NO: 6161211 - DNA, 19 bp, Homo sapiens
ctgaattttgcttcctttg

SEQ ID NO: 6161212 - DNA, 16 bp, Homo sapiens
ctgaattttggaggca

SEQ ID NO: 6161213 - DNA, 16 bp, Homo sapiens
ctgaattttgggactt

SEQ ID NO: 6161214 - DNA, 14 bp, Homo sapiens
ctgaatttttaaaa

SEQ ID NO: 6161215 - DNA, 20 bp, Homo sapiens
ctgaatttttatgtgtgatt

SEQ ID NO: 6161216 - DNA, 16 bp, Homo sapiens
ctgaatttttcttgcg

SEQ ID NO: 6161217 - DNA, 14 bp, Homo sapiens
ctgaatttttttgt

SEQ ID NO: 6161218 - DNA, 19 bp, Homo sapiens
ctgaatttttttgtaataa

SEQ ID NO: 6161219 - DNA, 23 bp, Homo sapiens
ctgaatttttttgtaataagcaa

SEQ ID NO: 6161220 - DNA, 23 bp, Homo sapiens
ctgacaaaaaggtgctacggtag

SEQ ID NO: 6161221 - DNA, 19 bp, Homo sapiens
ctgacaaaaggctccagtt

SEQ ID NO: 6161222 - DNA, 20 bp, Homo sapiens
ctgacaaacgtccccagcgg

SEQ ID NO: 6161223 - DNA, 21 bp, Homo sapiens
ctgacaaacgtccccagcggt

SEQ ID NO: 6161224 - DNA, 14 bp, Homo sapiens
ctgacaaaggagcc

SEQ ID NO: 6161225 - DNA, 23 bp, Homo sapiens
ctgacaaaggtggtaaattcaga

SEQ ID NO: 6161226 - DNA, 16 bp, Homo sapiens
ctgacaaagtcatccc

SEQ ID NO: 6161227 - DNA, 18 bp, Homo sapiens
ctgacaaagtcatcccct

SEQ ID NO: 6161228 - DNA, 22 bp, Homo sapiens
ctgacaaagtcatgaagctcag

SEQ ID NO: 6161229 - DNA, 16 bp, Homo sapiens
ctgacaaatcaagttt

SEQ ID NO: 6161230 - DNA, 15 bp, Homo sapiens
ctgacaaatgtgtat

SEQ ID NO: 6161231 - DNA, 14 bp, Homo sapiens
ctgacaaattttaa

SEQ ID NO: 6161232 - DNA, 17 bp, Homo sapiens
ctgacaaattttaatta

SEQ ID NO: 6161233 - DNA, 17 bp, Homo sapiens
ctgacaacagcctgaga

SEQ ID NO: 6161234 - DNA, 19 bp, Homo sapiens
ctgacaacagcctgagaaa

SEQ ID NO: 6161235 - DNA, 22 bp, Homo sapiens
ctgacaacatttctatagccaa

SEQ ID NO: 6161236 - DNA, 21 bp, Homo sapiens
ctgacaaccaccgctccccag

SEQ ID NO: 6161237 - DNA, 22 bp, Homo sapiens
ctgacaaccaccgctccccagc

SEQ ID NO: 6161238 - DNA, 18 bp, Homo sapiens
ctgacaaccactggtctg

SEQ ID NO: 6161239 - DNA, 20 bp, Homo sapiens
ctgacaaccactggtctgta

SEQ ID NO: 6161240 - DNA, 17 bp, Homo sapiens
ctgacaacgtctcttca

SEQ ID NO: 6161241 - DNA, 17 bp, Homo sapiens
ctgacaactgtgaagcc

SEQ ID NO: 6161242 - DNA, 18 bp, Homo sapiens
ctgacaacttagctcagg

SEQ ID NO: 6161243 - DNA, 21 bp, Homo sapiens
ctgacaacttagctcaggtgc

SEQ ID NO: 6161244 - DNA, 23 bp, Homo sapiens
ctgacaacttagctcaggtgcct

SEQ ID NO: 6161245 - DNA, 20 bp, Homo sapiens
ctgacaagaagctcccagat

SEQ ID NO: 6161246 - DNA, 23 bp, Homo sapiens
ctgacaagattataatattttaa

SEQ ID NO: 6161247 - DNA, 13 bp, Homo sapiens
ctgacaagctcca

SEQ ID NO: 6161248 - DNA, 18 bp, Homo sapiens
ctgacaagctccatttaa

SEQ ID NO: 6161249 - DNA, 22 bp, Homo sapiens
ctgacaaggcacttcatgtaaa

SEQ ID NO: 6161250 - DNA, 23 bp, Homo sapiens
ctgacaaggccagcacccaaagg

SEQ ID NO: 6161251 - DNA, 20 bp, Homo sapiens
ctgacaagggctgacctgcc

SEQ ID NO: 6161252 - DNA, 22 bp, Homo sapiens
ctgacaagtgaagttgtaaaca

SEQ ID NO: 6161253 - DNA, 13 bp, Homo sapiens
ctgacaagttatt

SEQ ID NO: 6161254 - DNA, 12 bp, Homo sapiens
ctgacaataaag

SEQ ID NO: 6161255 - DNA, 21 bp, Homo sapiens
ctgacaatcagttaaacacac

SEQ ID NO: 6161256 - DNA, 15 bp, Homo sapiens
ctgacaatcctattt

SEQ ID NO: 6161257 - DNA, 16 bp, Homo sapiens
ctgacaatgaagggaa

SEQ ID NO: 6161258 - DNA, 19 bp, Homo sapiens
ctgacaatgcgtggcacat

SEQ ID NO: 6161259 - DNA, 15 bp, Homo sapiens
ctgacaatgctgcca

SEQ ID NO: 6161260 - DNA, 20 bp, Homo sapiens
ctgacaatgctgccatgccc

SEQ ID NO: 6161261 - DNA, 18 bp, Homo sapiens
ctgacaattaacatacat

SEQ ID NO: 6161262 - DNA, 15 bp, Homo sapiens
ctgacaattatgaaa

SEQ ID NO: 6161263 - DNA, 16 bp, Homo sapiens
ctgacacaaacctgcc

SEQ ID NO: 6161264 - DNA, 18 bp, Homo sapiens
ctgacacaaacctgcctg

SEQ ID NO: 6161265 - DNA, 19 bp, Homo sapiens
ctgacacaaacctgcctgg

SEQ ID NO: 6161266 - DNA, 14 bp, Homo sapiens
ctgacacaaaggaa

SEQ ID NO: 6161267 - DNA, 21 bp, Homo sapiens
ctgacacaatggtagctctga

SEQ ID NO: 6161268 - DNA, 16 bp, Homo sapiens
ctgacacacagctctg

SEQ ID NO: 6161269 - DNA, 20 bp, Homo sapiens
ctgacacacagctctgtcct

SEQ ID NO: 6161270 - DNA, 23 bp, Homo sapiens
ctgacacacagctctgtcctggg

SEQ ID NO: 6161271 - DNA, 19 bp, Homo sapiens
ctgacacaccaggcgctaa

SEQ ID NO: 6161272 - DNA, 21 bp, Homo sapiens
ctgacacacctgcagcctccc

SEQ ID NO: 6161273 - DNA, 16 bp, Homo sapiens
ctgacacactaaccaa

SEQ ID NO: 6161274 - DNA, 19 bp, Homo sapiens
ctgacacactaaccaagct

SEQ ID NO: 6161275 - DNA, 20 bp, Homo sapiens
ctgacacagaggctggcact

SEQ ID NO: 6161276 - DNA, 18 bp, Homo sapiens
ctgacacaggatgaaggc

SEQ ID NO: 6161277 - DNA, 16 bp, Homo sapiens
ctgacacaggccagcc

SEQ ID NO: 6161278 - DNA, 20 bp, Homo sapiens
ctgacacaggccagccccat

SEQ ID NO: 6161279 - DNA, 17 bp, Homo sapiens
ctgacacaggccagcct

SEQ ID NO: 6161280 - DNA, 21 bp, Homo sapiens
ctgacacaggccagccttggc

SEQ ID NO: 6161281 - DNA, 22 bp, Homo sapiens
ctgacacaggccagccttggca

SEQ ID NO: 6161282 - DNA, 14 bp, Homo sapiens
ctgacacaggggac

SEQ ID NO: 6161283 - DNA, 19 bp, Homo sapiens
ctgacacaggggacactga

SEQ ID NO: 6161284 - DNA, 19 bp, Homo sapiens
ctgacacataatttgaatg

SEQ ID NO: 6161285 - DNA, 21 bp, Homo sapiens
ctgacacatatcattctgtga

SEQ ID NO: 6161286 - DNA, 23 bp, Homo sapiens
ctgacacatcagcatgttttctg

SEQ ID NO: 6161287 - DNA, 21 bp, Homo sapiens
ctgacacatgctgaacatcac

SEQ ID NO: 6161288 - DNA, 19 bp, Homo sapiens
ctgacaccacgctggagct

SEQ ID NO: 6161289 - DNA, 11 bp, Homo sapiens
ctgacaccagg

SEQ ID NO: 6161290 - DNA, 12 bp, Homo sapiens
ctgacacccagg

SEQ ID NO: 6161291 - DNA, 14 bp, Homo sapiens
ctgacacccaggcc

SEQ ID NO: 6161292 - DNA, 19 bp, Homo sapiens
ctgacacccaggcccgagc

SEQ ID NO: 6161293 - DNA, 22 bp, Homo sapiens
ctgacacccagtgtccttccat

SEQ ID NO: 6161294 - DNA, 14 bp, Homo sapiens
ctgacaccccactt

SEQ ID NO: 6161295 - DNA, 15 bp, Homo sapiens
ctgacaccccctccc

SEQ ID NO: 6161296 - DNA, 20 bp, Homo sapiens
ctgacaccctggtcctgact

SEQ ID NO: 6161297 - DNA, 16 bp, Homo sapiens
ctgacacccttctccc

SEQ ID NO: 6161298 - DNA, 20 bp, Homo sapiens
ctgacaccgaccggagtact

SEQ ID NO: 6161299 - DNA, 19 bp, Homo sapiens
ctgacaccgtccctcagtg

SEQ ID NO: 6161300 - DNA, 20 bp, Homo sapiens
ctgacaccgtccctcagtga

SEQ ID NO: 6161301 - DNA, 18 bp, Homo sapiens
ctgacaccgtcgaccagg

SEQ ID NO: 6161302 - DNA, 20 bp, Homo sapiens
ctgacacctaccatgctgct

SEQ ID NO: 6161303 - DNA, 18 bp, Homo sapiens
ctgacacctcactgagga

SEQ ID NO: 6161304 - DNA, 14 bp, Homo sapiens
ctgacacctccaag

SEQ ID NO: 6161305 - DNA, 12 bp, Homo sapiens
ctgacacctgcc

SEQ ID NO: 6161306 - DNA, 15 bp, Homo sapiens
ctgacacctttaaaa

SEQ ID NO: 6161307 - DNA, 15 bp, Homo sapiens
ctgacaccttttcag

SEQ ID NO: 6161308 - DNA, 20 bp, Homo sapiens
ctgacacgaagccagcagag

SEQ ID NO: 6161309 - DNA, 23 bp, Homo sapiens
ctgacacggggatcatctctgtg

SEQ ID NO: 6161310 - DNA, 23 bp, Homo sapiens
ctgacacgtgatggaccaaagcc

SEQ ID NO: 6161311 - DNA, 19 bp, Homo sapiens
ctgacactaaccagagtca

SEQ ID NO: 6161312 - DNA, 20 bp, Homo sapiens
ctgacactaccttatcaggc

SEQ ID NO: 6161313 - DNA, 17 bp, Homo sapiens
ctgacactcagatgccc

SEQ ID NO: 6161314 - DNA, 14 bp, Homo sapiens
ctgacactcccacc

SEQ ID NO: 6161315 - DNA, 14 bp, Homo sapiens
ctgacactgagccc

SEQ ID NO: 6161316 - DNA, 22 bp, Homo sapiens
ctgacactgcgaactctcagga

SEQ ID NO: 6161317 - DNA, 14 bp, Homo sapiens
ctgacactgctgga

SEQ ID NO: 6161318 - DNA, 20 bp, Homo sapiens
ctgacactgtgaccctgggt

SEQ ID NO: 6161319 - DNA, 12 bp, Homo sapiens
ctgacactgtgt

SEQ ID NO: 6161320 - DNA, 15 bp, Homo sapiens
ctgacacttcctgtc

SEQ ID NO: 6161321 - DNA, 16 bp, Homo sapiens
ctgacacttcctgtcc

SEQ ID NO: 6161322 - DNA, 20 bp, Homo sapiens
ctgacacttcctgtccttgt

SEQ ID NO: 6161323 - DNA, 16 bp, Homo sapiens
ctgacagaaagcaagg

SEQ ID NO: 6161324 - DNA, 14 bp, Homo sapiens
ctgacagaaagcag

SEQ ID NO: 6161325 - DNA, 18 bp, Homo sapiens
ctgacagaatctctgaat

SEQ ID NO: 6161326 - DNA, 12 bp, Homo sapiens
ctgacagacaca

SEQ ID NO: 6161327 - DNA, 16 bp, Homo sapiens
ctgacagacacaggcc

SEQ ID NO: 6161328 - DNA, 19 bp, Homo sapiens
ctgacagacacaggcccgg

SEQ ID NO: 6161329 - DNA, 17 bp, Homo sapiens
ctgacagacagccctcc

SEQ ID NO: 6161330 - DNA, 16 bp, Homo sapiens
ctgacagagcaggtct

SEQ ID NO: 6161331 - DNA, 22 bp, Homo sapiens
ctgacagagcaggtctgcaggc

SEQ ID NO: 6161332 - DNA, 13 bp, Homo sapiens
ctgacagagccag

SEQ ID NO: 6161333 - DNA, 21 bp, Homo sapiens
ctgacagagccctatctatgt

SEQ ID NO: 6161334 - DNA, 13 bp, Homo sapiens
ctgacagaggggg

SEQ ID NO: 6161335 - DNA, 18 bp, Homo sapiens
ctgacagatataaaatag

SEQ ID NO: 6161336 - DNA, 15 bp, Homo sapiens
ctgacagatgcctgg

SEQ ID NO: 6161337 - DNA, 17 bp, Homo sapiens
ctgacagcaaacacagt

SEQ ID NO: 6161338 - DNA, 15 bp, Homo sapiens
ctgacagcagcctgt

SEQ ID NO: 6161339 - DNA, 15 bp, Homo sapiens
ctgacagcatgtgcc

SEQ ID NO: 6161340 - DNA, 18 bp, Homo sapiens
ctgacagcatgtgccctc

SEQ ID NO: 6161341 - DNA, 20 bp, Homo sapiens
ctgacagcatgtgccctcct

SEQ ID NO: 6161342 - DNA, 21 bp, Homo sapiens
ctgacagccacaccgtggcag

SEQ ID NO: 6161343 - DNA, 12 bp, Homo sapiens
ctgacagccaga

SEQ ID NO: 6161344 - DNA, 15 bp, Homo sapiens
ctgacagccagaact

SEQ ID NO: 6161345 - DNA, 13 bp, Homo sapiens
ctgacagcctcca

SEQ ID NO: 6161346 - DNA, 13 bp, Homo sapiens
ctgacagcctccc

SEQ ID NO: 6161347 - DNA, 14 bp, Homo sapiens
ctgacagcctccca

SEQ ID NO: 6161348 - DNA, 15 bp, Homo sapiens
ctgacagcctcctag

SEQ ID NO: 6161349 - DNA, 15 bp, Homo sapiens
ctgacagcctggggg

SEQ ID NO: 6161350 - DNA, 21 bp, Homo sapiens
ctgacagcgccatgtgtgtca

SEQ ID NO: 6161351 - DNA, 13 bp, Homo sapiens
ctgacagctgctc

SEQ ID NO: 6161352 - DNA, 15 bp, Homo sapiens
ctgacagctgctcct

SEQ ID NO: 6161353 - DNA, 17 bp, Homo sapiens
ctgacagctgctcctag

SEQ ID NO: 6161354 - DNA, 23 bp, Homo sapiens
ctgacagctgctcctagagggag

SEQ ID NO: 6161355 - DNA, 14 bp, Homo sapiens
ctgacagctgtcct

SEQ ID NO: 6161356 - DNA, 21 bp, Homo sapiens
ctgacaggatgtggcactgct

SEQ ID NO: 6161357 - DNA, 13 bp, Homo sapiens
ctgacaggctgtg

SEQ ID NO: 6161358 - DNA, 19 bp, Homo sapiens
ctgacaggctgtgactctt

SEQ ID NO: 6161359 - DNA, 21 bp, Homo sapiens
ctgacaggctgtgactcttct

SEQ ID NO: 6161360 - DNA, 22 bp, Homo sapiens
ctgacagggacatgccctgtgt

SEQ ID NO: 6161361 - DNA, 19 bp, Homo sapiens
ctgacaggtgatgctctgg

SEQ ID NO: 6161362 - DNA, 21 bp, Homo sapiens
ctgacaggtgatgctctggct

SEQ ID NO: 6161363 - DNA, 22 bp, Homo sapiens
ctgacaggtgatgctctggctt

SEQ ID NO: 6161364 - DNA, 17 bp, Homo sapiens
ctgacaggttcccagca

SEQ ID NO: 6161365 - DNA, 20 bp, Homo sapiens
ctgacagtagctcttagact

SEQ ID NO: 6161366 - DNA, 19 bp, Homo sapiens
ctgacagtcagctgtgggg

SEQ ID NO: 6161367 - DNA, 17 bp, Homo sapiens
ctgacagtcatgcagtc

SEQ ID NO: 6161368 - DNA, 17 bp, Homo sapiens
ctgacagtccacagggg

SEQ ID NO: 6161369 - DNA, 19 bp, Homo sapiens
ctgacagtccacaggggcc

SEQ ID NO: 6161370 - DNA, 15 bp, Homo sapiens
ctgacagtcttgtgc

SEQ ID NO: 6161371 - DNA, 21 bp, Homo sapiens
ctgacagtgtgggacaggctc

SEQ ID NO: 6161372 - DNA, 22 bp, Homo sapiens
ctgacagtgtgggacaggctct

SEQ ID NO: 6161373 - DNA, 24 bp, Homo sapiens
ctgacagtgtgggacaggctcttc

SEQ ID NO: 6161374 - DNA, 15 bp, Homo sapiens
ctgacagtttttctg

SEQ ID NO: 6161375 - DNA, 21 bp, Homo sapiens
ctgacataaacccatctgtaa

SEQ ID NO: 6161376 - DNA, 23 bp, Homo sapiens
ctgacataatggggattaattag

SEQ ID NO: 6161377 - DNA, 22 bp, Homo sapiens
ctgacataccttagactgaaaa

SEQ ID NO: 6161378 - DNA, 23 bp, Homo sapiens
ctgacataccttagactgaaaaa

SEQ ID NO: 6161379 - DNA, 20 bp, Homo sapiens
ctgacatagtggatggacag

SEQ ID NO: 6161380 - DNA, 23 bp, Homo sapiens
ctgacatagtggatggacagatg

SEQ ID NO: 6161381 - DNA, 20 bp, Homo sapiens
ctgacatattatgcctgaat

SEQ ID NO: 6161382 - DNA, 22 bp, Homo sapiens
ctgacatatttcataagcacat

SEQ ID NO: 6161383 - DNA, 15 bp, Homo sapiens
ctgtcccattccctg

SEQ ID NO: 6161384 - DNA, 17 bp, Homo sapiens
ctgtccccaaaatgtga

SEQ ID NO: 6161385 - DNA, 23 bp, Homo sapiens
ctgtccccaagacacttcccctt

SEQ ID NO: 6161386 - DNA, 12 bp, Homo sapiens
ctgtccccaccc

SEQ ID NO: 6161387 - DNA, 18 bp, Homo sapiens
ctgtccccaccctccact

SEQ ID NO: 6161388 - DNA, 12 bp, Homo sapiens
ctgtccccagac

SEQ ID NO: 6161389 - DNA, 13 bp, Homo sapiens
ctgtccccagacc

SEQ ID NO: 6161390 - DNA, 18 bp, Homo sapiens
ctgtccccagaccaaccc

SEQ ID NO: 6161391 - DNA, 22 bp, Homo sapiens
ctgtccccagaccaaccctggg

SEQ ID NO: 6161392 - DNA, 16 bp, Homo sapiens
ctgtccccaggcccag

SEQ ID NO: 6161393 - DNA, 14 bp, Homo sapiens
ctgtccccaggcct

SEQ ID NO: 6161394 - DNA, 22 bp, Homo sapiens
ctgtccccaggtcctgtctctg

SEQ ID NO: 6161395 - DNA, 23 bp, Homo sapiens
ctgtccccaggtcctgtctctgc

SEQ ID NO: 6161396 - DNA, 20 bp, Homo sapiens
ctgtccccagtccccagccc

SEQ ID NO: 6161397 - DNA, 22 bp, Homo sapiens
ctgtccccagtccccagccctg

SEQ ID NO: 6161398 - DNA, 13 bp, Homo sapiens
ctgtccccatagc

SEQ ID NO: 6161399 - DNA, 21 bp, Homo sapiens
ctgtccccatctaggtcctgg

SEQ ID NO: 6161400 - DNA, 22 bp, Homo sapiens
ctgtccccatctaggtcctggc

SEQ ID NO: 6161401 - DNA, 13 bp, Homo sapiens
ctgtcccccacac

SEQ ID NO: 6161402 - DNA, 17 bp, Homo sapiens
ctgtcccccacgtggac

SEQ ID NO: 6161403 - DNA, 13 bp, Homo sapiens
ctgtcccccactc

SEQ ID NO: 6161404 - DNA, 22 bp, Homo sapiens
ctgtcccccactctctcaccca

SEQ ID NO: 6161405 - DNA, 15 bp, Homo sapiens
ctgtcccccagcatc

SEQ ID NO: 6161406 - DNA, 16 bp, Homo sapiens
ctgtcccccagcatcg

SEQ ID NO: 6161407 - DNA, 14 bp, Homo sapiens
ctgtcccccagctc

SEQ ID NO: 6161408 - DNA, 16 bp, Homo sapiens
ctgtcccccaggctgg

SEQ ID NO: 6161409 - DNA, 16 bp, Homo sapiens
ctgtccccccagctaa

SEQ ID NO: 6161410 - DNA, 23 bp, Homo sapiens
ctgtccccctcctcccagggcct

SEQ ID NO: 6161411 - DNA, 15 bp, Homo sapiens
ctgtccccgcagccc

SEQ ID NO: 6161412 - DNA, 22 bp, Homo sapiens
ctgtccccggcggggtgcctgc

SEQ ID NO: 6161413 - DNA, 16 bp, Homo sapiens
ctgtcccctagggact

SEQ ID NO: 6161414 - DNA, 17 bp, Homo sapiens
ctgtcccctagggactg

SEQ ID NO: 6161415 - DNA, 14 bp, Homo sapiens
ctgtcccctcagcg

SEQ ID NO: 6161416 - DNA, 14 bp, Homo sapiens
ctgtcccctcagct

SEQ ID NO: 6161417 - DNA, 16 bp, Homo sapiens
ctgtcccctcagctcc

SEQ ID NO: 6161418 - DNA, 17 bp, Homo sapiens
ctgtcccctccatctgg

SEQ ID NO: 6161419 - DNA, 13 bp, Homo sapiens
ctgtcccctctcc

SEQ ID NO: 6161420 - DNA, 14 bp, Homo sapiens
ctgtcccctctccc

SEQ ID NO: 6161421 - DNA, 18 bp, Homo sapiens
ctgtcccctctgtcatca

SEQ ID NO: 6161422 - DNA, 18 bp, Homo sapiens
ctgtcccctcttgcccca

SEQ ID NO: 6161423 - DNA, 19 bp, Homo sapiens
ctgtcccctcttgccccaa

SEQ ID NO: 6161424 - DNA, 20 bp, Homo sapiens
ctgtcccctcttgccccaac

SEQ ID NO: 6161425 - DNA, 20 bp, Homo sapiens
ctgtcccctgaaaaactgat

SEQ ID NO: 6161426 - DNA, 21 bp, Homo sapiens
ctgtcccctggggctggtgga

SEQ ID NO: 6161427 - DNA, 16 bp, Homo sapiens
ctgtccccttccaggg

SEQ ID NO: 6161428 - DNA, 16 bp, Homo sapiens
ctgtccccttctctca

SEQ ID NO: 6161429 - DNA, 14 bp, Homo sapiens
ctgtcccgccttcc

SEQ ID NO: 6161430 - DNA, 21 bp, Homo sapiens
ctgtcccgccttcctcctcca

SEQ ID NO: 6161431 - DNA, 21 bp, Homo sapiens
ctgtcccggggtcctgtggca

SEQ ID NO: 6161432 - DNA, 18 bp, Homo sapiens
ctgtcccggttcaccttg

SEQ ID NO: 6161433 - DNA, 19 bp, Homo sapiens
ctgtcccggttcaccttgc

SEQ ID NO: 6161434 - DNA, 15 bp, Homo sapiens
ctgtccctacccact

SEQ ID NO: 6161435 - DNA, 19 bp, Homo sapiens
ctgtccctacccactcttt

SEQ ID NO: 6161436 - DNA, 18 bp, Homo sapiens
ctgtccctagctcacact

SEQ ID NO: 6161437 - DNA, 20 bp, Homo sapiens
ctgtccctagctcacactca

SEQ ID NO: 6161438 - DNA, 21 bp, Homo sapiens
ctgtccctagggctctccaag

SEQ ID NO: 6161439 - DNA, 17 bp, Homo sapiens
ctgtccctaggtcagct

SEQ ID NO: 6161440 - DNA, 18 bp, Homo sapiens
ctgtccctatacactaga

SEQ ID NO: 6161441 - DNA, 11 bp, Homo sapiens
ctgtccctcca

SEQ ID NO: 6161442 - DNA, 16 bp, Homo sapiens
ctgtccctccatccca

SEQ ID NO: 6161443 - DNA, 18 bp, Homo sapiens
ctgtccctccatcccaga

SEQ ID NO: 6161444 - DNA, 11 bp, Homo sapiens
ctgtccctccc

SEQ ID NO: 6161445 - DNA, 18 bp, Homo sapiens
ctgtccctcccctgggca

SEQ ID NO: 6161446 - DNA, 23 bp, Homo sapiens
ctgtccctcccttgctgaacaca

SEQ ID NO: 6161447 - DNA, 17 bp, Homo sapiens
ctgtccctccgggacct

SEQ ID NO: 6161448 - DNA, 21 bp, Homo sapiens
ctgtccctccgggacctggtg

SEQ ID NO: 6161449 - DNA, 19 bp, Homo sapiens
ctgtccctcctggtgtcac

SEQ ID NO: 6161450 - DNA, 17 bp, Homo sapiens
ctgtccctctagtgcct

SEQ ID NO: 6161451 - DNA, 11 bp, Homo sapiens
ctgtccctctc

SEQ ID NO: 6161452 - DNA, 15 bp, Homo sapiens
ctgtccctctcaggc

SEQ ID NO: 6161453 - DNA, 20 bp, Homo sapiens
ctgtccctctcagtgccttc

SEQ ID NO: 6161454 - DNA, 22 bp, Homo sapiens
ctgtccctctcctatgtggcag

SEQ ID NO: 6161455 - DNA, 17 bp, Homo sapiens
ctgtccctctccttgcc

SEQ ID NO: 6161456 - DNA, 15 bp, Homo sapiens
ctgtccctgaaacct

SEQ ID NO: 6161457 - DNA, 13 bp, Homo sapiens
ctgtccctgaggt

SEQ ID NO: 6161458 - DNA, 17 bp, Homo sapiens
ctgtccctgcactgtgc

SEQ ID NO: 6161459 - DNA, 18 bp, Homo sapiens
ctgtccctgccccgcccc

SEQ ID NO: 6161460 - DNA, 21 bp, Homo sapiens
ctgtccctgccccgcccccca

SEQ ID NO: 6161461 - DNA, 23 bp, Homo sapiens
ctgtccctgccccgccccccaga

SEQ ID NO: 6161462 - DNA, 15 bp, Homo sapiens
ctgtccctgcccttc

SEQ ID NO: 6161463 - DNA, 16 bp, Homo sapiens
ctgtccctgcccttct

SEQ ID NO: 6161464 - DNA, 11 bp, Homo sapiens
ctgtccctgcg

SEQ ID NO: 6161465 - DNA, 13 bp, Homo sapiens
ctgtccctgcgcc

SEQ ID NO: 6161466 - DNA, 13 bp, Homo sapiens
ctgtccctgcttt

SEQ ID NO: 6161467 - DNA, 12 bp, Homo sapiens
ctgtccctggga

SEQ ID NO: 6161468 - DNA, 18 bp, Homo sapiens
ctgtccctgtagctcagt

SEQ ID NO: 6161469 - DNA, 19 bp, Homo sapiens
ctgtccctgtagctcagtc

SEQ ID NO: 6161470 - DNA, 12 bp, Homo sapiens
ctgtccctgtca

SEQ ID NO: 6161471 - DNA, 12 bp, Homo sapiens
ctgtccctgtcc

SEQ ID NO: 6161472 - DNA, 13 bp, Homo sapiens
ctgtccctgtccc

SEQ ID NO: 6161473 - DNA, 18 bp, Homo sapiens
ctgtccctgtccccctcc

SEQ ID NO: 6161474 - DNA, 14 bp, Homo sapiens
ctgtccctgtccct

SEQ ID NO: 6161475 - DNA, 19 bp, Homo sapiens
ctgtccctgtgggctcaca

SEQ ID NO: 6161476 - DNA, 21 bp, Homo sapiens
ctgtccctgtgggctcacacc

SEQ ID NO: 6161477 - DNA, 16 bp, Homo sapiens
ctgtcccttccccttc

SEQ ID NO: 6161478 - DNA, 18 bp, Homo sapiens
ctgtcccttcctttctcc

SEQ ID NO: 6161479 - DNA, 16 bp, Homo sapiens
ctgtcccttctcttaa

SEQ ID NO: 6161480 - DNA, 21 bp, Homo sapiens
ctgtcccttctcttaatttaa

SEQ ID NO: 6161481 - DNA, 18 bp, Homo sapiens
ctgtcccttctgtccctc

SEQ ID NO: 6161482 - DNA, 19 bp, Homo sapiens
ctgtcccttctgtccctca

SEQ ID NO: 6161483 - DNA, 20 bp, Homo sapiens
ctgtcccttgcccccctggc

SEQ ID NO: 6161484 - DNA, 14 bp, Homo sapiens
ctgtcccttgcctc

SEQ ID NO: 6161485 - DNA, 20 bp, Homo sapiens
ctgtcccttgcctcaatgcc

SEQ ID NO: 6161486 - DNA, 21 bp, Homo sapiens
ctgtcccttgcctcaatgcca

SEQ ID NO: 6161487 - DNA, 15 bp, Homo sapiens
ctgtcccttgcctct

SEQ ID NO: 6161488 - DNA, 16 bp, Homo sapiens
ctgtcccttgcctctg

SEQ ID NO: 6161489 - DNA, 17 bp, Homo sapiens
ctgtcccttgcctctgc

SEQ ID NO: 6161490 - DNA, 18 bp, Homo sapiens
ctgtcccttgtttttgat

SEQ ID NO: 6161491 - DNA, 13 bp, Homo sapiens
ctgtccctttgct

SEQ ID NO: 6161492 - DNA, 14 bp, Homo sapiens
ctgtccgagctttg

SEQ ID NO: 6161493 - DNA, 18 bp, Homo sapiens
ctgtccgagtgtgccaca

SEQ ID NO: 6161494 - DNA, 17 bp, Homo sapiens
ctgtccgccctcttccc

SEQ ID NO: 6161495 - DNA, 21 bp, Homo sapiens
ctgtccgcctctgcccgcaga

SEQ ID NO: 6161496 - DNA, 20 bp, Homo sapiens
ctgtccgcgtcctttcctct

SEQ ID NO: 6161497 - DNA, 13 bp, Homo sapiens
ctgtccgctgtct

SEQ ID NO: 6161498 - DNA, 19 bp, Homo sapiens
ctgtccgctgtctccctcc

SEQ ID NO: 6161499 - DNA, 13 bp, Homo sapiens
ctgtccggagcga

SEQ ID NO: 6161500 - DNA, 15 bp, Homo sapiens
ctgtccggcccagtg

SEQ ID NO: 6161501 - DNA, 20 bp, Homo sapiens
ctgtccggcccagtgccact

SEQ ID NO: 6161502 - DNA, 22 bp, Homo sapiens
ctgtccggcccagtgccactgc

SEQ ID NO: 6161503 - DNA, 21 bp, Homo sapiens
ctgtccggcccagtgccagct

SEQ ID NO: 6161504 - DNA, 14 bp, Homo sapiens
ctgtccgggagcag

SEQ ID NO: 6161505 - DNA, 14 bp, Homo sapiens
ctgtccgtcctgct

SEQ ID NO: 6161506 - DNA, 19 bp, Homo sapiens
ctgtccgtctgtcctgcgc

SEQ ID NO: 6161507 - DNA, 15 bp, Homo sapiens
ctgtccgtgcccctt

SEQ ID NO: 6161508 - DNA, 21 bp, Homo sapiens
ctgtccgtgccccttccctgg

SEQ ID NO: 6161509 - DNA, 20 bp, Homo sapiens
ctgtccgtgcttgctggtgc

SEQ ID NO: 6161510 - DNA, 22 bp, Homo sapiens
ctgtccgtggaaaatttcagtc

SEQ ID NO: 6161511 - DNA, 23 bp, Homo sapiens
ctgtccgtgtgcctcctgtgtgt

SEQ ID NO: 6161512 - DNA, 18 bp, Homo sapiens
ctgtccgtttactccaag

SEQ ID NO: 6161513 - DNA, 13 bp, Homo sapiens
ctgtcctaagaac

SEQ ID NO: 6161514 - DNA, 19 bp, Homo sapiens
ctgtcctaccagttgccct

SEQ ID NO: 6161515 - DNA, 20 bp, Homo sapiens
ctgtcctaccatcagctctg

SEQ ID NO: 6161516 - DNA, 14 bp, Homo sapiens
ctgtcctacccacc

SEQ ID NO: 6161517 - DNA, 15 bp, Homo sapiens
ctgtcctacccgccc

SEQ ID NO: 6161518 - DNA, 22 bp, Homo sapiens
ctgtcctacccgcccgcgtcca

SEQ ID NO: 6161519 - DNA, 17 bp, Homo sapiens
ctgtcctactctgtgtc

SEQ ID NO: 6161520 - DNA, 23 bp, Homo sapiens
ctgtcctacttctgactttactt

SEQ ID NO: 6161521 - DNA, 20 bp, Homo sapiens
ctgtcctagcaggatctgcc

SEQ ID NO: 6161522 - DNA, 17 bp, Homo sapiens
ctgtcctagccaggtct

SEQ ID NO: 6161523 - DNA, 22 bp, Homo sapiens
ctgtcctagccaggtctcctgg

SEQ ID NO: 6161524 - DNA, 22 bp, Homo sapiens
ctgtcctaggtcatgaaggaca

SEQ ID NO: 6161525 - DNA, 15 bp, Homo sapiens
ctgtcctaggtgacc

SEQ ID NO: 6161526 - DNA, 16 bp, Homo sapiens
ctgtcctagtctcctt

SEQ ID NO: 6161527 - DNA, 19 bp, Homo sapiens
ctgtcctagtctcctttga

SEQ ID NO: 6161528 - DNA, 19 bp, Homo sapiens
ctgtcctcaaataagtctt

SEQ ID NO: 6161529 - DNA, 13 bp, Homo sapiens
ctgtcctcaccct

SEQ ID NO: 6161530 - DNA, 21 bp, Homo sapiens
ctgtcctcaccctgtgggacc

SEQ ID NO: 6161531 - DNA, 18 bp, Homo sapiens
ctgtcctcacgccccctg

SEQ ID NO: 6161532 - DNA, 16 bp, Homo sapiens
ctgtcctcactgctcc

SEQ ID NO: 6161533 - DNA, 19 bp, Homo sapiens
ctgtcctcactgctccctg

SEQ ID NO: 6161534 - DNA, 17 bp, Homo sapiens
ctgtcctcagagcaggg

SEQ ID NO: 6161535 - DNA, 22 bp, Homo sapiens
ctgtcctcagaggcgtgctggt

SEQ ID NO: 6161536 - DNA, 18 bp, Homo sapiens
ctgtcctcagccttgcca

SEQ ID NO: 6161537 - DNA, 18 bp, Homo sapiens
ctgtcctcaggtggccat

SEQ ID NO: 6161538 - DNA, 14 bp, Homo sapiens
ctgtcctcatgacc

SEQ ID NO: 6161539 - DNA, 22 bp, Homo sapiens
ctgtcctcattcttctctccca

SEQ ID NO: 6161540 - DNA, 17 bp, Homo sapiens
ctgtcctccaagccagc

SEQ ID NO: 6161541 - DNA, 11 bp, Homo sapiens
ctgtcctccag

SEQ ID NO: 6161542 - DNA, 19 bp, Homo sapiens
ctgtcctccagcttcccct

SEQ ID NO: 6161543 - DNA, 22 bp, Homo sapiens
ctgtcctcccacccctccccac

SEQ ID NO: 6161544 - DNA, 15 bp, Homo sapiens
ctgtcctcccatccc

SEQ ID NO: 6161545 - DNA, 19 bp, Homo sapiens
ctgtcctcccatcccctca

SEQ ID NO: 6161546 - DNA, 18 bp, Homo sapiens
ctgtcctcccatcccctg

SEQ ID NO: 6161547 - DNA, 21 bp, Homo sapiens
ctgtcctcccatcccctggac

SEQ ID NO: 6161548 - DNA, 14 bp, Homo sapiens
ctgtcctccccacc

SEQ ID NO: 6161549 - DNA, 21 bp, Homo sapiens
ctgtcctccgtgaaaatatgt

SEQ ID NO: 6161550 - DNA, 13 bp, Homo sapiens
ctgtcctcctgga

SEQ ID NO: 6161551 - DNA, 19 bp, Homo sapiens
ctgtcctcctggtgggtcc

SEQ ID NO: 6161552 - DNA, 21 bp, Homo sapiens
ctgtcctcctggtgggtccag

SEQ ID NO: 6161553 - DNA, 16 bp, Homo sapiens
ctgtcctccttcctgg

SEQ ID NO: 6161554 - DNA, 19 bp, Homo sapiens
ctgtcctccttcctgggac

SEQ ID NO: 6161555 - DNA, 21 bp, Homo sapiens
ctgtcctccttcctgggaccc

SEQ ID NO: 6161556 - DNA, 14 bp, Homo sapiens
ctgtcctccttggc

SEQ ID NO: 6161557 - DNA, 21 bp, Homo sapiens
ctgtcctcgaattttatctgt

SEQ ID NO: 6161558 - DNA, 12 bp, Homo sapiens
ctgtcctctccc

SEQ ID NO: 6161559 - DNA, 21 bp, Homo sapiens
ctgtcctctcccccttcagct

SEQ ID NO: 6161560 - DNA, 18 bp, Homo sapiens
ctgtcctctcccctccag

SEQ ID NO: 6161561 - DNA, 16 bp, Homo sapiens
ctgtcctctgctttgc

SEQ ID NO: 6161562 - DNA, 14 bp, Homo sapiens
ctgtcctctgtagt

SEQ ID NO: 6161563 - DNA, 20 bp, Homo sapiens
ctgtcctctttcagaaaaca

SEQ ID NO: 6161564 - DNA, 15 bp, Homo sapiens
ctgtcctctttcagc

SEQ ID NO: 6161565 - DNA, 16 bp, Homo sapiens
ctgtcctctttcagct

SEQ ID NO: 6161566 - DNA, 19 bp, Homo sapiens
ctgtcctctttcagctcct

SEQ ID NO: 6161567 - DNA, 22 bp, Homo sapiens
ctgtcctctttcagctcctgac

SEQ ID NO: 6161568 - DNA, 14 bp, Homo sapiens
ctgtcctgaaagcg

SEQ ID NO: 6161569 - DNA, 19 bp, Homo sapiens
ctgtcctgaaggcctgagg

SEQ ID NO: 6161570 - DNA, 18 bp, Homo sapiens
ctgtcctgacaccaggca

SEQ ID NO: 6161571 - DNA, 20 bp, Homo sapiens
ctgtcctgacaccaggcaag

SEQ ID NO: 6161572 - DNA, 20 bp, Homo sapiens
ctgtcctgacttcaggggct

SEQ ID NO: 6161573 - DNA, 12 bp, Homo sapiens
ctgtcctgagcc

SEQ ID NO: 6161574 - DNA, 14 bp, Homo sapiens
ctgtcctgagcccc

SEQ ID NO: 6161575 - DNA, 18 bp, Homo sapiens
ctgtcctgagccccctgc

SEQ ID NO: 6161576 - DNA, 18 bp, Homo sapiens
ctgtcctgaggagccctg

SEQ ID NO: 6161577 - DNA, 20 bp, Homo sapiens
ctgtcctgaggagccctgag

SEQ ID NO: 6161578 - DNA, 21 bp, Homo sapiens
ctgtcctgaggagccctgagg

SEQ ID NO: 6161579 - DNA, 24 bp, Homo sapiens
ctgtcctgaggagccctgaggacc

SEQ ID NO: 6161580 - DNA, 16 bp, Homo sapiens
ctgtcctgcagcaaac

SEQ ID NO: 6161581 - DNA, 21 bp, Homo sapiens
ctgtcctgcagtagaaggtgc

SEQ ID NO: 6161582 - DNA, 17 bp, Homo sapiens
ctgtcctgcagtcccac

SEQ ID NO: 6161583 - DNA, 17 bp, Homo sapiens
ctgtcctgccacccagc

SEQ ID NO: 6161584 - DNA, 23 bp, Homo sapiens
ctgtcctgccacccagccccagc

SEQ ID NO: 6161585 - DNA, 11 bp, Homo sapiens
ctgtcctgcct

SEQ ID NO: 6161586 - DNA, 13 bp, Homo sapiens
ctgtcctgcctcc

SEQ ID NO: 6161587 - DNA, 15 bp, Homo sapiens
ctgtcctgcctcctc

SEQ ID NO: 6161588 - DNA, 18 bp, Homo sapiens
ctgtcctgcctgtggcca

SEQ ID NO: 6161589 - DNA, 21 bp, Homo sapiens
ctgtcctgcgttcagcccctg

SEQ ID NO: 6161590 - DNA, 13 bp, Homo sapiens
ctgtcctgctcac

SEQ ID NO: 6161591 - DNA, 18 bp, Homo sapiens
ctgtcctgctcacgtctg

SEQ ID NO: 6161592 - DNA, 13 bp, Homo sapiens
ctgtcctgctcca

SEQ ID NO: 6161593 - DNA, 14 bp, Homo sapiens
ctgtcctgctccac

SEQ ID NO: 6161594 - DNA, 16 bp, Homo sapiens
ctgtcctgctccacag

SEQ ID NO: 6161595 - DNA, 12 bp, Homo sapiens
ctgtcctgctgc

SEQ ID NO: 6161596 - DNA, 16 bp, Homo sapiens
ctgtcctgctgccctc

SEQ ID NO: 6161597 - DNA, 13 bp, Homo sapiens
ctgtcctgctggt

SEQ ID NO: 6161598 - DNA, 13 bp, Homo sapiens
ctgtcctgctgtg

SEQ ID NO: 6161599 - DNA, 21 bp, Homo sapiens
ctgtcctggaacctgtctcca

SEQ ID NO: 6161600 - DNA, 13 bp, Homo sapiens
ctgtcctggcccg

SEQ ID NO: 6161601 - DNA, 17 bp, Homo sapiens
ctgtcctggctgtgcac

SEQ ID NO: 6161602 - DNA, 13 bp, Homo sapiens
ctgtcctgggagt

SEQ ID NO: 6161603 - DNA, 20 bp, Homo sapiens
ctgtcctgggagtgagctgg

SEQ ID NO: 6161604 - DNA, 12 bp, Homo sapiens
ctgtcctgggca

SEQ ID NO: 6161605 - DNA, 20 bp, Homo sapiens
ctgtcctgggcatgggtcca

SEQ ID NO: 6161606 - DNA, 13 bp, Homo sapiens
ctgtcctgggcgc

SEQ ID NO: 6161607 - DNA, 19 bp, Homo sapiens
ctgtcctgggcgccctgga

SEQ ID NO: 6161608 - DNA, 23 bp, Homo sapiens
ctgtcctgggcgccctggaagcc

SEQ ID NO: 6161609 - DNA, 19 bp, Homo sapiens
ctgtcctggtacagcaggg

SEQ ID NO: 6161610 - DNA, 18 bp, Homo sapiens
ctgtcctggtcctgatgc

SEQ ID NO: 6161611 - DNA, 16 bp, Homo sapiens
ctgtcctggtggctgg

SEQ ID NO: 6161612 - DNA, 17 bp, Homo sapiens
ctgtcctggtggctggg

SEQ ID NO: 6161613 - DNA, 19 bp, Homo sapiens
ctgtcctggtggctgggcc

SEQ ID NO: 6161614 - DNA, 17 bp, Homo sapiens
ctgtcctggtggtattt

SEQ ID NO: 6161615 - DNA, 20 bp, Homo sapiens
ctgtcctggtggtattttca

SEQ ID NO: 6161616 - DNA, 23 bp, Homo sapiens
ctgtcctggtggtattttcaata

SEQ ID NO: 6161617 - DNA, 14 bp, Homo sapiens
ctgtcctgtacatt

SEQ ID NO: 6161618 - DNA, 17 bp, Homo sapiens
ctgtcctgtgaatggaa

SEQ ID NO: 6161619 - DNA, 16 bp, Homo sapiens
ctgtcctgtgaggttt

SEQ ID NO: 6161620 - DNA, 21 bp, Homo sapiens
ctgtcctgttaggccaactgc

SEQ ID NO: 6161621 - DNA, 19 bp, Homo sapiens
ctgtccttaacccacctct

SEQ ID NO: 6161622 - DNA, 17 bp, Homo sapiens
ctgtccttacccatctg

SEQ ID NO: 6161623 - DNA, 20 bp, Homo sapiens
ctgtccttagactccttctc

SEQ ID NO: 6161624 - DNA, 15 bp, Homo sapiens
ctgtccttcagtctt

SEQ ID NO: 6161625 - DNA, 20 bp, Homo sapiens
ctgtccttcccacggccact

SEQ ID NO: 6161626 - DNA, 14 bp, Homo sapiens
ctgtccttcccctt

SEQ ID NO: 6161627 - DNA, 17 bp, Homo sapiens
ctgtccttccccttccc

SEQ ID NO: 6161628 - DNA, 22 bp, Homo sapiens
ctgtccttccccttccccgtcc

SEQ ID NO: 6161629 - DNA, 17 bp, Homo sapiens
ctgtccttccctgccac

SEQ ID NO: 6161630 - DNA, 14 bp, Homo sapiens
ctgtccttccctgt

SEQ ID NO: 6161631 - DNA, 22 bp, Homo sapiens
ctgtccttccctgttctccctt

SEQ ID NO: 6161632 - DNA, 16 bp, Homo sapiens
ctgtccttctcaggct

SEQ ID NO: 6161633 - DNA, 23 bp, Homo sapiens
ctgtccttctctcacctcctaaa

SEQ ID NO: 6161634 - DNA, 21 bp, Homo sapiens
ctgtccttctgaagtgtgtcc

SEQ ID NO: 6161635 - DNA, 19 bp, Homo sapiens
ctgtccttcttagaatgtt

SEQ ID NO: 6161636 - DNA, 18 bp, Homo sapiens
ctgtccttgaaaaacaaa

SEQ ID NO: 6161637 - DNA, 17 bp, Homo sapiens
ctgtccttgaaggacta

SEQ ID NO: 6161638 - DNA, 17 bp, Homo sapiens
ctgtccttggcaacttt

SEQ ID NO: 6161639 - DNA, 17 bp, Homo sapiens
ctgtcctttcagtctga

SEQ ID NO: 6161640 - DNA, 13 bp, Homo sapiens
ctgtcctttcctt

SEQ ID NO: 6161641 - DNA, 20 bp, Homo sapiens
ctgtcctttctagagcactg

SEQ ID NO: 6161642 - DNA, 15 bp, Homo sapiens
ctgtcctttctccag

SEQ ID NO: 6161643 - DNA, 22 bp, Homo sapiens
ctgtcctttgcaattgctcttc

SEQ ID NO: 6161644 - DNA, 17 bp, Homo sapiens
ctgtcctttttcctctc

SEQ ID NO: 6161645 - DNA, 17 bp, Homo sapiens
ctgtcgaaggggaggca

SEQ ID NO: 6161646 - DNA, 21 bp, Homo sapiens
ctgtcgaaggggaggcacact

SEQ ID NO: 6161647 - DNA, 22 bp, Homo sapiens
ctgtcgagttcggctctgggtg

SEQ ID NO: 6161648 - DNA, 23 bp, Homo sapiens
ctgtcgagttcggctctgggtgg

SEQ ID NO: 6161649 - DNA, 23 bp, Homo sapiens
ctgtcgattagactggacagctt

SEQ ID NO: 6161650 - DNA, 18 bp, Homo sapiens
ctgtcgcccacccagctg

SEQ ID NO: 6161651 - DNA, 13 bp, Homo sapiens
ctgtcgcccagtc

SEQ ID NO: 6161652 - DNA, 16 bp, Homo sapiens
ctgtcgcccagtctgg

SEQ ID NO: 6161653 - DNA, 13 bp, Homo sapiens
ctgtcgccccagg

SEQ ID NO: 6161654 - DNA, 16 bp, Homo sapiens
ctgtcgccccaggccc

SEQ ID NO: 6161655 - DNA, 15 bp, Homo sapiens
ctgtcgcccttctcc

SEQ ID NO: 6161656 - DNA, 19 bp, Homo sapiens
ctgtcgcctgcggactcca

SEQ ID NO: 6161657 - DNA, 17 bp, Homo sapiens
ctgtcgccttagcatgt

SEQ ID NO: 6161658 - DNA, 18 bp, Homo sapiens
ctgtcgccttagcatgtt

SEQ ID NO: 6161659 - DNA, 17 bp, Homo sapiens
ctgtcgctgcttcgtgg

SEQ ID NO: 6161660 - DNA, 15 bp, Homo sapiens
ctgtcggagggctgg

SEQ ID NO: 6161661 - DNA, 17 bp, Homo sapiens
ctgtcggagggctggac

SEQ ID NO: 6161662 - DNA, 14 bp, Homo sapiens
ctgtcggcaccatg

SEQ ID NO: 6161663 - DNA, 15 bp, Homo sapiens
ctgtcggcaccatgt

SEQ ID NO: 6161664 - DNA, 22 bp, Homo sapiens
ctgtcggccacaccccagactc

SEQ ID NO: 6161665 - DNA, 20 bp, Homo sapiens
ctgtcggcgctgccccatct

SEQ ID NO: 6161666 - DNA, 14 bp, Homo sapiens
ctgtcgggaccaca

SEQ ID NO: 6161667 - DNA, 22 bp, Homo sapiens
ctgtcgggaccacatctgtcct

SEQ ID NO: 6161668 - DNA, 15 bp, Homo sapiens
ctgtcggtggctgcc

SEQ ID NO: 6161669 - DNA, 16 bp, Homo sapiens
ctgtcggtggctgcct

SEQ ID NO: 6161670 - DNA, 20 bp, Homo sapiens
ctgtcggtgtgctgtcagcc

SEQ ID NO: 6161671 - DNA, 23 bp, Homo sapiens
ctgtcggtgtggacgctgtgctg

SEQ ID NO: 6161672 - DNA, 22 bp, Homo sapiens
ctgtcggtgtttggaggctgct

SEQ ID NO: 6161673 - DNA, 23 bp, Homo sapiens
ctgtcggtgtttggaggctgctg

SEQ ID NO: 6161674 - DNA, 12 bp, Homo sapiens
ctgtcgtcccca

SEQ ID NO: 6161675 - DNA, 12 bp, Homo sapiens
ctgtcgtctgac

SEQ ID NO: 6161676 - DNA, 16 bp, Homo sapiens
ctgtcgtctgactctg

SEQ ID NO: 6161677 - DNA, 16 bp, Homo sapiens
ctgtcgtgccagtcct

SEQ ID NO: 6161678 - DNA, 19 bp, Homo sapiens
ctgtcgtgccagtcctggg

SEQ ID NO: 6161679 - DNA, 16 bp, Homo sapiens
ctgtcgtggagccatt

SEQ ID NO: 6161680 - DNA, 14 bp, Homo sapiens
ctgtcgtgtccagc

SEQ ID NO: 6161681 - DNA, 14 bp, Homo sapiens
ctgtcgtgtttaca

SEQ ID NO: 6161682 - DNA, 18 bp, Homo sapiens
ctgtctaaaaaacaaaac

SEQ ID NO: 6161683 - DNA, 16 bp, Homo sapiens
ctgtctaaaaaccaga

SEQ ID NO: 6161684 - DNA, 13 bp, Homo sapiens
ctgtctaaccccc

SEQ ID NO: 6161685 - DNA, 15 bp, Homo sapiens
ctgtctaacccccag

SEQ ID NO: 6161686 - DNA, 18 bp, Homo sapiens
ctgtctaacccccagctg

SEQ ID NO: 6161687 - DNA, 20 bp, Homo sapiens
ctgtctaacccccagctggg

SEQ ID NO: 6161688 - DNA, 24 bp, Homo sapiens
ctgtctaacccccagctgggtcta

SEQ ID NO: 6161689 - DNA, 19 bp, Homo sapiens
ctgtctaacctacgacccc

SEQ ID NO: 6161690 - DNA, 23 bp, Homo sapiens
ctgtctaacctacgaccccagag

SEQ ID NO: 6161691 - DNA, 15 bp, Homo sapiens
ctgtctaacctgtga

SEQ ID NO: 6161692 - DNA, 13 bp, Homo sapiens
ctgtctaactgct

SEQ ID NO: 6161693 - DNA, 16 bp, Homo sapiens
ctgtctaacttgggga

SEQ ID NO: 6161694 - DNA, 13 bp, Homo sapiens
ctgtctaacttta

SEQ ID NO: 6161695 - DNA, 14 bp, Homo sapiens
ctgtctaagcagtt

SEQ ID NO: 6161696 - DNA, 22 bp, Homo sapiens
ctgtctaatgaaacctgtgtct

SEQ ID NO: 6161697 - DNA, 20 bp, Homo sapiens
ctgtctacactaagagagaa

SEQ ID NO: 6161698 - DNA, 11 bp, Homo sapiens
ctgtctacatt

SEQ ID NO: 6161699 - DNA, 13 bp, Homo sapiens
ctgtctacatttc

SEQ ID NO: 6161700 - DNA, 13 bp, Homo sapiens
ctgtctaccatct

SEQ ID NO: 6161701 - DNA, 17 bp, Homo sapiens
ctgtctaccatctccct

SEQ ID NO: 6161702 - DNA, 17 bp, Homo sapiens
ctgtctacctcacagaa

SEQ ID NO: 6161703 - DNA, 18 bp, Homo sapiens
ctgtctacttgctcaggt

SEQ ID NO: 6161704 - DNA, 16 bp, Homo sapiens
ctgtctactttctctt

SEQ ID NO: 6161705 - DNA, 18 bp, Homo sapiens
ctgtctagaatcctgctt

SEQ ID NO: 6161706 - DNA, 20 bp, Homo sapiens
ctgtctagaatcctgcttta

SEQ ID NO: 6161707 - DNA, 14 bp, Homo sapiens
ctgtctagaatgtg

SEQ ID NO: 6161708 - DNA, 15 bp, Homo sapiens
ctgtctagactggcc

SEQ ID NO: 6161709 - DNA, 16 bp, Homo sapiens
ctgtctagactggcct

SEQ ID NO: 6161710 - DNA, 17 bp, Homo sapiens
ctgtctagactggccta

SEQ ID NO: 6161711 - DNA, 16 bp, Homo sapiens
ctgtctagcacttcct

SEQ ID NO: 6161712 - DNA, 15 bp, Homo sapiens
ctgtctagcatgcca

SEQ ID NO: 6161713 - DNA, 19 bp, Homo sapiens
ctgtctagccttagtcaat

SEQ ID NO: 6161714 - DNA, 14 bp, Homo sapiens
ctgtctaggaaaat

SEQ ID NO: 6161715 - DNA, 20 bp, Homo sapiens
ctgtctaggttaaagctaaa

SEQ ID NO: 6161716 - DNA, 17 bp, Homo sapiens
ctgtctatgattgtact

SEQ ID NO: 6161717 - DNA, 17 bp, Homo sapiens
ctgtctatgcagcctgc

SEQ ID NO: 6161718 - DNA, 18 bp, Homo sapiens
ctgtctatgcagcctgct

SEQ ID NO: 6161719 - DNA, 13 bp, Homo sapiens
ctgtctattctag

SEQ ID NO: 6161720 - DNA, 14 bp, Homo sapiens
ctgtctatttaagt

SEQ ID NO: 6161721 - DNA, 14 bp, Homo sapiens
ctgtctatttctgc

SEQ ID NO: 6161722 - DNA, 19 bp, Homo sapiens
ctgtctatttctgctgaat

SEQ ID NO: 6161723 - DNA, 20 bp, Homo sapiens
ctgtctatttttgtttttta

SEQ ID NO: 6161724 - DNA, 22 bp, Homo sapiens
ctgtctcaaaaaaagaaaaaga

SEQ ID NO: 6161725 - DNA, 20 bp, Homo sapiens
ctgtctcaaagcataaaatg

SEQ ID NO: 6161726 - DNA, 21 bp, Homo sapiens
ctgtctcaagagggcactggt

SEQ ID NO: 6161727 - DNA, 18 bp, Homo sapiens
ctgtctcaagctcttcct

SEQ ID NO: 6161728 - DNA, 16 bp, Homo sapiens
ctgtctcaatagctcc

SEQ ID NO: 6161729 - DNA, 17 bp, Homo sapiens
ctgtctcaatagctcca

SEQ ID NO: 6161730 - DNA, 21 bp, Homo sapiens
ctgtctcaatagctccaagct

SEQ ID NO: 6161731 - DNA, 17 bp, Homo sapiens
ctgtctcactcttctgt

SEQ ID NO: 6161732 - DNA, 20 bp, Homo sapiens
ctgtctcagacgactagccc

SEQ ID NO: 6161733 - DNA, 23 bp, Homo sapiens
ctgtctcagacgactagcccagg

SEQ ID NO: 6161734 - DNA, 16 bp, Homo sapiens
ctgtctcagattggga

SEQ ID NO: 6161735 - DNA, 16 bp, Homo sapiens
ctgtctcagcctccca

SEQ ID NO: 6161736 - DNA, 19 bp, Homo sapiens
ctgtctcagtgattcgctt

SEQ ID NO: 6161737 - DNA, 16 bp, Homo sapiens
ctgtctcagtttcact

SEQ ID NO: 6161738 - DNA, 17 bp, Homo sapiens
ctgtctcagtttcactt

SEQ ID NO: 6161739 - DNA, 13 bp, Homo sapiens
ctgtctcataatt

SEQ ID NO: 6161740 - DNA, 22 bp, Homo sapiens
ctgacatcaccaagtgtggaat

SEQ ID NO: 6161741 - DNA, 14 bp, Homo sapiens
ctgacatcagattt

SEQ ID NO: 6161742 - DNA, 13 bp, Homo sapiens
ctgacatcagcac

SEQ ID NO: 6161743 - DNA, 21 bp, Homo sapiens
ctgacatcagcactttaccag

SEQ ID NO: 6161744 - DNA, 20 bp, Homo sapiens
ctgacatcatcattcttgtg

SEQ ID NO: 6161745 - DNA, 23 bp, Homo sapiens
ctgacatcatcattcttgtggga

SEQ ID NO: 6161746 - DNA, 16 bp, Homo sapiens
ctgacatcatttgtat

SEQ ID NO: 6161747 - DNA, 18 bp, Homo sapiens
ctgacatccacatgctct

SEQ ID NO: 6161748 - DNA, 16 bp, Homo sapiens
ctgacatccactgttt

SEQ ID NO: 6161749 - DNA, 14 bp, Homo sapiens
ctgacatccccact

SEQ ID NO: 6161750 - DNA, 13 bp, Homo sapiens
ctgacatcccttc

SEQ ID NO: 6161751 - DNA, 18 bp, Homo sapiens
ctgacatcccttcctgga

SEQ ID NO: 6161752 - DNA, 22 bp, Homo sapiens
ctgacatcccttcctggaaaca

SEQ ID NO: 6161753 - DNA, 15 bp, Homo sapiens
ctgacatctctgcaa

SEQ ID NO: 6161754 - DNA, 16 bp, Homo sapiens
ctgacatctctgcaat

SEQ ID NO: 6161755 - DNA, 17 bp, Homo sapiens
ctgacatctgtgtttca

SEQ ID NO: 6161756 - DNA, 21 bp, Homo sapiens
ctgacatcttagtatttgcat

SEQ ID NO: 6161757 - DNA, 23 bp, Homo sapiens
ctgacatgaagctgttgtgtgag

SEQ ID NO: 6161758 - DNA, 15 bp, Homo sapiens
ctgacatgattcctt

SEQ ID NO: 6161759 - DNA, 23 bp, Homo sapiens
ctgacatgcatattgattctgaa

SEQ ID NO: 6161760 - DNA, 13 bp, Homo sapiens
ctgacatgctaac

SEQ ID NO: 6161761 - DNA, 13 bp, Homo sapiens
ctgacatgctcac

SEQ ID NO: 6161762 - DNA, 19 bp, Homo sapiens
ctgacatggacccactacc

SEQ ID NO: 6161763 - DNA, 18 bp, Homo sapiens
ctgacatggagttcccgt

SEQ ID NO: 6161764 - DNA, 14 bp, Homo sapiens
ctgacatggctctg

SEQ ID NO: 6161765 - DNA, 14 bp, Homo sapiens
ctgacatggctttg

SEQ ID NO: 6161766 - DNA, 17 bp, Homo sapiens
ctgacatggtgctgtgt

SEQ ID NO: 6161767 - DNA, 19 bp, Homo sapiens
ctgacatgtaagaaaatgt

SEQ ID NO: 6161768 - DNA, 21 bp, Homo sapiens
ctgacatgtaccccctttccc

SEQ ID NO: 6161769 - DNA, 14 bp, Homo sapiens
ctgacatgtggggc

SEQ ID NO: 6161770 - DNA, 15 bp, Homo sapiens
ctgacatgtttcaca

SEQ ID NO: 6161771 - DNA, 18 bp, Homo sapiens
ctgacatgtttgtgctct

SEQ ID NO: 6161772 - DNA, 23 bp, Homo sapiens
ctgacattaacagttttccatga

SEQ ID NO: 6161773 - DNA, 23 bp, Homo sapiens
ctgacattcacctgccccaactc

SEQ ID NO: 6161774 - DNA, 16 bp, Homo sapiens
ctgacattcactgagt

SEQ ID NO: 6161775 - DNA, 23 bp, Homo sapiens
ctgacattcacttccagagagga

SEQ ID NO: 6161776 - DNA, 16 bp, Homo sapiens
ctgacattccttgctg

SEQ ID NO: 6161777 - DNA, 20 bp, Homo sapiens
ctgacattgccaaaaaggat

SEQ ID NO: 6161778 - DNA, 21 bp, Homo sapiens
ctgacattgccaaaaaggata

SEQ ID NO: 6161779 - DNA, 14 bp, Homo sapiens
ctgacattggagcc

SEQ ID NO: 6161780 - DNA, 15 bp, Homo sapiens
ctgacattggagcct

SEQ ID NO: 6161781 - DNA, 16 bp, Homo sapiens
ctgacattggagcctg

SEQ ID NO: 6161782 - DNA, 20 bp, Homo sapiens
ctgacatttatatttgtgta

SEQ ID NO: 6161783 - DNA, 17 bp, Homo sapiens
ctgacatttcacttcct

SEQ ID NO: 6161784 - DNA, 22 bp, Homo sapiens
ctgacatttctaacatatgtat

SEQ ID NO: 6161785 - DNA, 17 bp, Homo sapiens
ctgacatttgttgttaa

SEQ ID NO: 6161786 - DNA, 21 bp, Homo sapiens
ctgacatttgtttattttttg

SEQ ID NO: 6161787 - DNA, 19 bp, Homo sapiens
ctgaccaaaaccagagggc

SEQ ID NO: 6161788 - DNA, 17 bp, Homo sapiens
ctgaccaaagactgcag

SEQ ID NO: 6161789 - DNA, 19 bp, Homo sapiens
ctgaccaaagactgcagaa

SEQ ID NO: 6161790 - DNA, 22 bp, Homo sapiens
ctgaccaaatcacccaatccca

SEQ ID NO: 6161791 - DNA, 23 bp, Homo sapiens
ctgaccaaatcacccaatcccag

SEQ ID NO: 6161792 - DNA, 17 bp, Homo sapiens
ctgaccaaatggccagt

SEQ ID NO: 6161793 - DNA, 12 bp, Homo sapiens
ctgaccaacagg

SEQ ID NO: 6161794 - DNA, 18 bp, Homo sapiens
ctgaccaacaggctgttc

SEQ ID NO: 6161795 - DNA, 21 bp, Homo sapiens
ctgaccaacattcaaaagcac

SEQ ID NO: 6161796 - DNA, 22 bp, Homo sapiens
ctgaccaacattcaaaagcaca

SEQ ID NO: 6161797 - DNA, 17 bp, Homo sapiens
ctgaccaagagagaaag

SEQ ID NO: 6161798 - DNA, 19 bp, Homo sapiens
ctgaccaagtgctggccca

SEQ ID NO: 6161799 - DNA, 21 bp, Homo sapiens
ctgaccaagtgctggcccacc

SEQ ID NO: 6161800 - DNA, 20 bp, Homo sapiens
ctgaccaataaaaaaataag

SEQ ID NO: 6161801 - DNA, 16 bp, Homo sapiens
ctgaccaattgtgctg

SEQ ID NO: 6161802 - DNA, 17 bp, Homo sapiens
ctgaccaattgtgctgc

SEQ ID NO: 6161803 - DNA, 21 bp, Homo sapiens
ctgaccacaccaaccaggcct

SEQ ID NO: 6161804 - DNA, 12 bp, Homo sapiens
ctgaccacactt

SEQ ID NO: 6161805 - DNA, 13 bp, Homo sapiens
ctgaccacacttc

SEQ ID NO: 6161806 - DNA, 17 bp, Homo sapiens
ctgaccacacttcctgt

SEQ ID NO: 6161807 - DNA, 18 bp, Homo sapiens
ctgaccacacttcctgtc

SEQ ID NO: 6161808 - DNA, 19 bp, Homo sapiens
ctgaccacacttcctgtcc

SEQ ID NO: 6161809 - DNA, 20 bp, Homo sapiens
ctgaccacacttcctgtcca

SEQ ID NO: 6161810 - DNA, 21 bp, Homo sapiens
ctgaccacacttcctgtccag

SEQ ID NO: 6161811 - DNA, 14 bp, Homo sapiens
ctgaccacagacac

SEQ ID NO: 6161812 - DNA, 18 bp, Homo sapiens
ctgaccacagacactcct

SEQ ID NO: 6161813 - DNA, 20 bp, Homo sapiens
ctgaccacagacactcctgg

SEQ ID NO: 6161814 - DNA, 15 bp, Homo sapiens
ctgaccacagcacag

SEQ ID NO: 6161815 - DNA, 18 bp, Homo sapiens
ctgaccacagcacagcca

SEQ ID NO: 6161816 - DNA, 16 bp, Homo sapiens
ctgaccaccctcccct

SEQ ID NO: 6161817 - DNA, 17 bp, Homo sapiens
ctgaccaccctcccctc

SEQ ID NO: 6161818 - DNA, 15 bp, Homo sapiens
ctgaccaccctgcct

SEQ ID NO: 6161819 - DNA, 21 bp, Homo sapiens
ctgaccaccctgcctgtggag

SEQ ID NO: 6161820 - DNA, 22 bp, Homo sapiens
ctgaccacggacgtttccatca

SEQ ID NO: 6161821 - DNA, 15 bp, Homo sapiens
ctgaccactcagaga

SEQ ID NO: 6161822 - DNA, 17 bp, Homo sapiens
ctgaccactcagagaca

SEQ ID NO: 6161823 - DNA, 15 bp, Homo sapiens
ctgaccactggccta

SEQ ID NO: 6161824 - DNA, 13 bp, Homo sapiens
ctgaccagaacta

SEQ ID NO: 6161825 - DNA, 14 bp, Homo sapiens
ctgaccagaagaca

SEQ ID NO: 6161826 - DNA, 23 bp, Homo sapiens
ctgaccagaagacaaaggcccaa

SEQ ID NO: 6161827 - DNA, 17 bp, Homo sapiens
ctgaccagaagtggcag

SEQ ID NO: 6161828 - DNA, 21 bp, Homo sapiens
ctgaccagaagtggcaggagg

SEQ ID NO: 6161829 - DNA, 23 bp, Homo sapiens
ctgaccagaagtggcaggaggac

SEQ ID NO: 6161830 - DNA, 23 bp, Homo sapiens
ctgaccagccgtgagcatgtttg

SEQ ID NO: 6161831 - DNA, 17 bp, Homo sapiens
ctgaccagcctccatgc

SEQ ID NO: 6161832 - DNA, 13 bp, Homo sapiens
ctgaccagcggct

SEQ ID NO: 6161833 - DNA, 17 bp, Homo sapiens
ctgaccagcggctgctc

SEQ ID NO: 6161834 - DNA, 18 bp, Homo sapiens
ctgaccagcggctgctca

SEQ ID NO: 6161835 - DNA, 20 bp, Homo sapiens
ctgaccagcggctgctcaag

SEQ ID NO: 6161836 - DNA, 16 bp, Homo sapiens
ctgaccagctgctccg

SEQ ID NO: 6161837 - DNA, 19 bp, Homo sapiens
ctgaccagctgctccgagg

SEQ ID NO: 6161838 - DNA, 16 bp, Homo sapiens
ctgaccagctggagtg

SEQ ID NO: 6161839 - DNA, 15 bp, Homo sapiens
ctgaccaggccctgc

SEQ ID NO: 6161840 - DNA, 22 bp, Homo sapiens
ctgaccaggccctgctcatcac

SEQ ID NO: 6161841 - DNA, 15 bp, Homo sapiens
ctgaccaggggccct

SEQ ID NO: 6161842 - DNA, 20 bp, Homo sapiens
ctgaccaggggccctacctg

SEQ ID NO: 6161843 - DNA, 17 bp, Homo sapiens
ctgaccagtcagatggt

SEQ ID NO: 6161844 - DNA, 22 bp, Homo sapiens
ctgaccatattgtgcttcacag

SEQ ID NO: 6161845 - DNA, 19 bp, Homo sapiens
ctgaccatcatgccctctc

SEQ ID NO: 6161846 - DNA, 19 bp, Homo sapiens
ctgaccatccactctaccc

SEQ ID NO: 6161847 - DNA, 17 bp, Homo sapiens
ctgaccatctgtgacta

SEQ ID NO: 6161848 - DNA, 15 bp, Homo sapiens
ctgaccatgcatttt

SEQ ID NO: 6161849 - DNA, 15 bp, Homo sapiens
ctgaccatgcgtcag

SEQ ID NO: 6161850 - DNA, 23 bp, Homo sapiens
ctgaccatgcgtcaggggcctag

SEQ ID NO: 6161851 - DNA, 22 bp, Homo sapiens
ctgaccatgctcatctgctggt

SEQ ID NO: 6161852 - DNA, 18 bp, Homo sapiens
ctgaccatggttttggct

SEQ ID NO: 6161853 - DNA, 22 bp, Homo sapiens
ctgaccatggttttggctctcc

SEQ ID NO: 6161854 - DNA, 19 bp, Homo sapiens
ctgaccatgtgcggagcag

SEQ ID NO: 6161855 - DNA, 21 bp, Homo sapiens
ctgaccatgtgcggagcagcc

SEQ ID NO: 6161856 - DNA, 18 bp, Homo sapiens
ctgaccatttcaggggtc

SEQ ID NO: 6161857 - DNA, 14 bp, Homo sapiens
ctgacccaaagcaa

SEQ ID NO: 6161858 - DNA, 15 bp, Homo sapiens
ctgacccaaagcaaa

SEQ ID NO: 6161859 - DNA, 22 bp, Homo sapiens
ctgacccaactgatcctgctcc

SEQ ID NO: 6161860 - DNA, 21 bp, Homo sapiens
ctgacccaagtggggcctcct

SEQ ID NO: 6161861 - DNA, 15 bp, Homo sapiens
ctgacccacagcctc

SEQ ID NO: 6161862 - DNA, 21 bp, Homo sapiens
ctgacccacagcctccaagtc

SEQ ID NO: 6161863 - DNA, 19 bp, Homo sapiens
ctgacccaccaaggtctca

SEQ ID NO: 6161864 - DNA, 22 bp, Homo sapiens
ctgacccaccaaggtctcacac

SEQ ID NO: 6161865 - DNA, 21 bp, Homo sapiens
ctgacccacctgcgcttctgc

SEQ ID NO: 6161866 - DNA, 12 bp, Homo sapiens
ctgacccactgc

SEQ ID NO: 6161867 - DNA, 13 bp, Homo sapiens
ctgacccactgct

SEQ ID NO: 6161868 - DNA, 12 bp, Homo sapiens
ctgacccagagg

SEQ ID NO: 6161869 - DNA, 20 bp, Homo sapiens
ctgacccagagtggagtctg

SEQ ID NO: 6161870 - DNA, 16 bp, Homo sapiens
ctgacccagcatctcc

SEQ ID NO: 6161871 - DNA, 12 bp, Homo sapiens
ctgacccaggcc

SEQ ID NO: 6161872 - DNA, 16 bp, Homo sapiens
ctgacccaggccgcag

SEQ ID NO: 6161873 - DNA, 10 bp, Homo sapiens
ctgacccagt

SEQ ID NO: 6161874 - DNA, 11 bp, Homo sapiens
ctgacccagtc

SEQ ID NO: 6161875 - DNA, 12 bp, Homo sapiens
ctgacccagtcc

SEQ ID NO: 6161876 - DNA, 13 bp, Homo sapiens
ctgacccagtgag

SEQ ID NO: 6161877 - DNA, 18 bp, Homo sapiens
ctgacccagtgcccccac

SEQ ID NO: 6161878 - DNA, 21 bp, Homo sapiens
ctgacccagtgcccccactga

SEQ ID NO: 6161879 - DNA, 13 bp, Homo sapiens
ctgacccatccct

SEQ ID NO: 6161880 - DNA, 14 bp, Homo sapiens
ctgacccatccctt

SEQ ID NO: 6161881 - DNA, 16 bp, Homo sapiens
ctgacccatgctgccc

SEQ ID NO: 6161882 - DNA, 18 bp, Homo sapiens
ctgacccatgctgccctg

SEQ ID NO: 6161883 - DNA, 22 bp, Homo sapiens
ctgacccatgctgccctgtgag

SEQ ID NO: 6161884 - DNA, 16 bp, Homo sapiens
ctgacccattgctgtt

SEQ ID NO: 6161885 - DNA, 20 bp, Homo sapiens
ctgaccccaaacaccttcca

SEQ ID NO: 6161886 - DNA, 20 bp, Homo sapiens
ctgaccccaaagagcctgga

SEQ ID NO: 6161887 - DNA, 16 bp, Homo sapiens
ctgaccccacctagaa

SEQ ID NO: 6161888 - DNA, 22 bp, Homo sapiens
ctgaccccacttatgctgctgt

SEQ ID NO: 6161889 - DNA, 21 bp, Homo sapiens
ctgaccccagaaattctggcc

SEQ ID NO: 6161890 - DNA, 13 bp, Homo sapiens
ctgaccccagccc

SEQ ID NO: 6161891 - DNA, 21 bp, Homo sapiens
ctgaccccagcccagacagca

SEQ ID NO: 6161892 - DNA, 12 bp, Homo sapiens
ctgaccccagga

SEQ ID NO: 6161893 - DNA, 14 bp, Homo sapiens
ctgaccccaggaag

SEQ ID NO: 6161894 - DNA, 20 bp, Homo sapiens
ctgaccccagtggaaaacaa

SEQ ID NO: 6161895 - DNA, 21 bp, Homo sapiens
ctgaccccagtggtatcctgt

SEQ ID NO: 6161896 - DNA, 15 bp, Homo sapiens
ctgaccccatcacct

SEQ ID NO: 6161897 - DNA, 23 bp, Homo sapiens
ctgacccccatcgctctgagcat

SEQ ID NO: 6161898 - DNA, 18 bp, Homo sapiens
ctgacccccatgtaaata

SEQ ID NO: 6161899 - DNA, 19 bp, Homo sapiens
ctgaccccccccattagaa

SEQ ID NO: 6161900 - DNA, 20 bp, Homo sapiens
ctgaccccccccattagaat

SEQ ID NO: 6161901 - DNA, 23 bp, Homo sapiens
ctgaccccccccattagaatgtg

SEQ ID NO: 6161902 - DNA, 16 bp, Homo sapiens
ctgaccccgccatgca

SEQ ID NO: 6161903 - DNA, 20 bp, Homo sapiens
ctgaccccggtggcggcccc

SEQ ID NO: 6161904 - DNA, 17 bp, Homo sapiens
ctgacccctcatagccc

SEQ ID NO: 6161905 - DNA, 21 bp, Homo sapiens
ctgacccctcatagccctcac

SEQ ID NO: 6161906 - DNA, 12 bp, Homo sapiens
ctgacccctcct

SEQ ID NO: 6161907 - DNA, 15 bp, Homo sapiens
ctgacccctcctcac

SEQ ID NO: 6161908 - DNA, 13 bp, Homo sapiens
ctgacccctctgg

SEQ ID NO: 6161909 - DNA, 14 bp, Homo sapiens
ctgacccctctggt

SEQ ID NO: 6161910 - DNA, 23 bp, Homo sapiens
ctgacccctgcctgttggcaggc

SEQ ID NO: 6161911 - DNA, 14 bp, Homo sapiens
ctgacccctgctca

SEQ ID NO: 6161912 - DNA, 13 bp, Homo sapiens
ctgacccctgtgt

SEQ ID NO: 6161913 - DNA, 23 bp, Homo sapiens
ctgacccctgtgtgacatcacag

SEQ ID NO: 6161914 - DNA, 12 bp, Homo sapiens
ctgaccccttca

SEQ ID NO: 6161915 - DNA, 13 bp, Homo sapiens
ctgaccccttgct

SEQ ID NO: 6161916 - DNA, 14 bp, Homo sapiens
ctgaccccttgctc

SEQ ID NO: 6161917 - DNA, 19 bp, Homo sapiens
ctgacccggttgcagtcac

SEQ ID NO: 6161918 - DNA, 12 bp, Homo sapiens
ctgtctcatcca

SEQ ID NO: 6161919 - DNA, 22 bp, Homo sapiens
ctgtctcatccacataagcact

SEQ ID NO: 6161920 - DNA, 14 bp, Homo sapiens
ctgtctcatcccca

SEQ ID NO: 6161921 - DNA, 16 bp, Homo sapiens
ctgtctcatccccagg

SEQ ID NO: 6161922 - DNA, 17 bp, Homo sapiens
ctgtctcatccccaggg

SEQ ID NO: 6161923 - DNA, 21 bp, Homo sapiens
ctgtctcatccccaggggtcc

SEQ ID NO: 6161924 - DNA, 18 bp, Homo sapiens
ctgtctcatcctcctgga

SEQ ID NO: 6161925 - DNA, 22 bp, Homo sapiens
ctgtctcatcctcctggaacct

SEQ ID NO: 6161926 - DNA, 13 bp, Homo sapiens
ctgtctcatttat

SEQ ID NO: 6161927 - DNA, 15 bp, Homo sapiens
ctgtctcatttattt

SEQ ID NO: 6161928 - DNA, 20 bp, Homo sapiens
ctgtctccaagaatgttttg

SEQ ID NO: 6161929 - DNA, 19 bp, Homo sapiens
ctgtctccaagaccttggc

SEQ ID NO: 6161930 - DNA, 14 bp, Homo sapiens
ctgtctccactgtg

SEQ ID NO: 6161931 - DNA, 15 bp, Homo sapiens
ctgtctccagctgcc

SEQ ID NO: 6161932 - DNA, 16 bp, Homo sapiens
ctgtctccagctgcct

SEQ ID NO: 6161933 - DNA, 21 bp, Homo sapiens
ctgtctccagctgcctgggcc

SEQ ID NO: 6161934 - DNA, 20 bp, Homo sapiens
ctgtctccagggcccccacc

SEQ ID NO: 6161935 - DNA, 14 bp, Homo sapiens
ctgtctccatgctg

SEQ ID NO: 6161936 - DNA, 15 bp, Homo sapiens
ctgtctccatgctgg

SEQ ID NO: 6161937 - DNA, 17 bp, Homo sapiens
ctgtctccatgctggat

SEQ ID NO: 6161938 - DNA, 22 bp, Homo sapiens
ctgtctccatgctggatactgg

SEQ ID NO: 6161939 - DNA, 18 bp, Homo sapiens
ctgtctccatgtttgatg

SEQ ID NO: 6161940 - DNA, 14 bp, Homo sapiens
ctgtctcccaccct

SEQ ID NO: 6161941 - DNA, 18 bp, Homo sapiens
ctgtctcccaccctttct

SEQ ID NO: 6161942 - DNA, 22 bp, Homo sapiens
ctgtctcccaccctttctgcca

SEQ ID NO: 6161943 - DNA, 23 bp, Homo sapiens
ctgtctcccaccctttctgccag

SEQ ID NO: 6161944 - DNA, 21 bp, Homo sapiens
ctgtctcccacgtgtgtatta

SEQ ID NO: 6161945 - DNA, 23 bp, Homo sapiens
ctgtctcccacgtgtgtattatg

SEQ ID NO: 6161946 - DNA, 15 bp, Homo sapiens
ctgtctcccacttcc

SEQ ID NO: 6161947 - DNA, 14 bp, Homo sapiens
ctgtctcccaggct

SEQ ID NO: 6161948 - DNA, 15 bp, Homo sapiens
ctgtctcccctctgc

SEQ ID NO: 6161949 - DNA, 18 bp, Homo sapiens
ctgtctcccctctgctgg

SEQ ID NO: 6161950 - DNA, 19 bp, Homo sapiens
ctgtctcccggctcccctc

SEQ ID NO: 6161951 - DNA, 24 bp, Homo sapiens
ctgtctccctccccaaatggctgc

SEQ ID NO: 6161952 - DNA, 20 bp, Homo sapiens
ctgtctccctcccctctcag

SEQ ID NO: 6161953 - DNA, 21 bp, Homo sapiens
ctgtctccctcctctgcccgg

SEQ ID NO: 6161954 - DNA, 14 bp, Homo sapiens
ctgtctccctcctg

SEQ ID NO: 6161955 - DNA, 15 bp, Homo sapiens
ctgtctccctcctga

SEQ ID NO: 6161956 - DNA, 15 bp, Homo sapiens
ctgtctccctggggt

SEQ ID NO: 6161957 - DNA, 18 bp, Homo sapiens
ctgtctcccttctctctc

SEQ ID NO: 6161958 - DNA, 16 bp, Homo sapiens
ctgtctcctccctggg

SEQ ID NO: 6161959 - DNA, 17 bp, Homo sapiens
ctgtctcctccctgggc

SEQ ID NO: 6161960 - DNA, 17 bp, Homo sapiens
ctgtctcctctctctgt

SEQ ID NO: 6161961 - DNA, 20 bp, Homo sapiens
ctgtctcctctctctgtaat

SEQ ID NO: 6161962 - DNA, 12 bp, Homo sapiens
ctgtctcctctg

SEQ ID NO: 6161963 - DNA, 11 bp, Homo sapiens
ctgtctcctgt

SEQ ID NO: 6161964 - DNA, 12 bp, Homo sapiens
ctgtctcctgtc

SEQ ID NO: 6161965 - DNA, 15 bp, Homo sapiens
ctgtctcctgtcccc

SEQ ID NO: 6161966 - DNA, 12 bp, Homo sapiens
ctgtctccttcc

SEQ ID NO: 6161967 - DNA, 16 bp, Homo sapiens
ctgtctccttcccact

SEQ ID NO: 6161968 - DNA, 19 bp, Homo sapiens
ctgtctccttcccactgtc

SEQ ID NO: 6161969 - DNA, 22 bp, Homo sapiens
ctgtctccttcccactgtcctt

SEQ ID NO: 6161970 - DNA, 23 bp, Homo sapiens
ctgtctcctttcaccccagggcc

SEQ ID NO: 6161971 - DNA, 18 bp, Homo sapiens
ctgtctcgagcgccctgc

SEQ ID NO: 6161972 - DNA, 23 bp, Homo sapiens
ctgtctcggcagaggtggtctgg

SEQ ID NO: 6161973 - DNA, 21 bp, Homo sapiens
ctgtctcgggctgaccctttt

SEQ ID NO: 6161974 - DNA, 20 bp, Homo sapiens
ctgtctctagtttctttctg

SEQ ID NO: 6161975 - DNA, 20 bp, Homo sapiens
ctgtctctattagctgggtt

SEQ ID NO: 6161976 - DNA, 17 bp, Homo sapiens
ctgtctctcatgaacct

SEQ ID NO: 6161977 - DNA, 14 bp, Homo sapiens
ctgtctctccagtg

SEQ ID NO: 6161978 - DNA, 11 bp, Homo sapiens
ctgtctctccc

SEQ ID NO: 6161979 - DNA, 21 bp, Homo sapiens
ctgtctctccctaccctcttc

SEQ ID NO: 6161980 - DNA, 12 bp, Homo sapiens
ctgtctctctct

SEQ ID NO: 6161981 - DNA, 16 bp, Homo sapiens
ctgtctctctcttctc

SEQ ID NO: 6161982 - DNA, 13 bp, Homo sapiens
ctgtctctctggg

SEQ ID NO: 6161983 - DNA, 19 bp, Homo sapiens
ctgtctctcttgtcacatg

SEQ ID NO: 6161984 - DNA, 19 bp, Homo sapiens
ctgtctctgaagtactaac

SEQ ID NO: 6161985 - DNA, 14 bp, Homo sapiens
ctgtctctgcatct

SEQ ID NO: 6161986 - DNA, 13 bp, Homo sapiens
ctgtctctgcctc

SEQ ID NO: 6161987 - DNA, 16 bp, Homo sapiens
ctgtctctgcctccct

SEQ ID NO: 6161988 - DNA, 14 bp, Homo sapiens
ctgtctctgcctct

SEQ ID NO: 6161989 - DNA, 14 bp, Homo sapiens
ctgtctctgcctgc

SEQ ID NO: 6161990 - DNA, 13 bp, Homo sapiens
ctgtctctgctcg

SEQ ID NO: 6161991 - DNA, 17 bp, Homo sapiens
ctgtctctgctcgccct

SEQ ID NO: 6161992 - DNA, 14 bp, Homo sapiens
ctgtctctgctctt

SEQ ID NO: 6161993 - DNA, 16 bp, Homo sapiens
ctgtctctgctcttgc

SEQ ID NO: 6161994 - DNA, 19 bp, Homo sapiens
ctgtctctgctcttgcctg

SEQ ID NO: 6161995 - DNA, 16 bp, Homo sapiens
ctgtctctgcttggct

SEQ ID NO: 6161996 - DNA, 17 bp, Homo sapiens
ctgtctctgcttggctt

SEQ ID NO: 6161997 - DNA, 23 bp, Homo sapiens
ctgtctctgcttggcttcccctc

SEQ ID NO: 6161998 - DNA, 15 bp, Homo sapiens
ctgtctctggagtga

SEQ ID NO: 6161999 - DNA, 13 bp, Homo sapiens
ctgtctctggcta

SEQ ID NO: 6162000 - DNA, 19 bp, Homo sapiens
ctgtctctggctactccct

SEQ ID NO: 6162001 - DNA, 12 bp, Homo sapiens
ctgtctctgtgg

SEQ ID NO: 6162002 - DNA, 14 bp, Homo sapiens
ctgtctctgtggaa

SEQ ID NO: 6162003 - DNA, 12 bp, Homo sapiens
ctgtctcttcca

SEQ ID NO: 6162004 - DNA, 23 bp, Homo sapiens
ctgtctcttcttaaccctgaaca

SEQ ID NO: 6162005 - DNA, 18 bp, Homo sapiens
ctgtctcttgggaagcag

SEQ ID NO: 6162006 - DNA, 19 bp, Homo sapiens
ctgtctctttaagggcatg

SEQ ID NO: 6162007 - DNA, 23 bp, Homo sapiens
ctgtctctttaagggcatgcctt

SEQ ID NO: 6162008 - DNA, 14 bp, Homo sapiens
ctgtctctttccac

SEQ ID NO: 6162009 - DNA, 22 bp, Homo sapiens
ctgtctgaaaccagaagactgg

SEQ ID NO: 6162010 - DNA, 23 bp, Homo sapiens
ctgtctgaaaccagaagactgga

SEQ ID NO: 6162011 - DNA, 14 bp, Homo sapiens
ctgtctgaagccca

SEQ ID NO: 6162012 - DNA, 16 bp, Homo sapiens
ctgtctgaagcccaaa

SEQ ID NO: 6162013 - DNA, 20 bp, Homo sapiens
ctgtctgaaggacacttcct

SEQ ID NO: 6162014 - DNA, 18 bp, Homo sapiens
ctgtctgaatattctaga

SEQ ID NO: 6162015 - DNA, 16 bp, Homo sapiens
ctgtctgaccagagaa

SEQ ID NO: 6162016 - DNA, 13 bp, Homo sapiens
ctgtctgactaca

SEQ ID NO: 6162017 - DNA, 14 bp, Homo sapiens
ctgtctgagacagg

SEQ ID NO: 6162018 - DNA, 19 bp, Homo sapiens
ctgtctgagacaggtgcct

SEQ ID NO: 6162019 - DNA, 13 bp, Homo sapiens
ctgtctgagccct

SEQ ID NO: 6162020 - DNA, 14 bp, Homo sapiens
ctgtctgagccctg

SEQ ID NO: 6162021 - DNA, 16 bp, Homo sapiens
ctgtctgagccctgcc

SEQ ID NO: 6162022 - DNA, 19 bp, Homo sapiens
ctgtctgagccctgccctc

SEQ ID NO: 6162023 - DNA, 22 bp, Homo sapiens
ctgtctgagccctgccctcact

SEQ ID NO: 6162024 - DNA, 16 bp, Homo sapiens
ctgtctgaggagtaag

SEQ ID NO: 6162025 - DNA, 21 bp, Homo sapiens
ctgtctgagtagtggccactg

SEQ ID NO: 6162026 - DNA, 16 bp, Homo sapiens
ctgtctgatcagggtg

SEQ ID NO: 6162027 - DNA, 15 bp, Homo sapiens
ctgtctgattctatg

SEQ ID NO: 6162028 - DNA, 16 bp, Homo sapiens
ctgtctgattctatgc

SEQ ID NO: 6162029 - DNA, 13 bp, Homo sapiens
ctgtctgcagcct

SEQ ID NO: 6162030 - DNA, 11 bp, Homo sapiens
ctgtctgcagg

SEQ ID NO: 6162031 - DNA, 19 bp, Homo sapiens
ctgtctgcagtgcccggct

SEQ ID NO: 6162032 - DNA, 17 bp, Homo sapiens
ctgtctgccaacctaaa

SEQ ID NO: 6162033 - DNA, 15 bp, Homo sapiens
ctgtctgccagccag

SEQ ID NO: 6162034 - DNA, 15 bp, Homo sapiens
ctgtctgccccagcc

SEQ ID NO: 6162035 - DNA, 18 bp, Homo sapiens
ctgtctgccccagcccag

SEQ ID NO: 6162036 - DNA, 19 bp, Homo sapiens
ctgtctgccccgccctcat

SEQ ID NO: 6162037 - DNA, 16 bp, Homo sapiens
ctgtctgcgccgctgt

SEQ ID NO: 6162038 - DNA, 18 bp, Homo sapiens
ctgtctgcgccgctgtgc

SEQ ID NO: 6162039 - DNA, 15 bp, Homo sapiens
ctgtctgcggagcca

SEQ ID NO: 6162040 - DNA, 16 bp, Homo sapiens
ctgtctgctctgcata

SEQ ID NO: 6162041 - DNA, 22 bp, Homo sapiens
ctgtctgctcttatttttgtac

SEQ ID NO: 6162042 - DNA, 14 bp, Homo sapiens
ctgtctgctgccag

SEQ ID NO: 6162043 - DNA, 17 bp, Homo sapiens
ctgtctgctgccagcac

SEQ ID NO: 6162044 - DNA, 13 bp, Homo sapiens
ctgtctgctgggc

SEQ ID NO: 6162045 - DNA, 19 bp, Homo sapiens
ctgtctgctggtcacttct

SEQ ID NO: 6162046 - DNA, 16 bp, Homo sapiens
ctgtctgcttctctct

SEQ ID NO: 6162047 - DNA, 12 bp, Homo sapiens
ctgtctggaaga

SEQ ID NO: 6162048 - DNA, 19 bp, Homo sapiens
ctgtctggatccttcccaa

SEQ ID NO: 6162049 - DNA, 19 bp, Homo sapiens
ctgtctggcaatgccacag

SEQ ID NO: 6162050 - DNA, 13 bp, Homo sapiens
ctgtctggcacag

SEQ ID NO: 6162051 - DNA, 15 bp, Homo sapiens
ctgtctggcacagcc

SEQ ID NO: 6162052 - DNA, 16 bp, Homo sapiens
ctgtctggccagggag

SEQ ID NO: 6162053 - DNA, 17 bp, Homo sapiens
ctgtctggccagggagg

SEQ ID NO: 6162054 - DNA, 14 bp, Homo sapiens
ctgtctggccctgg

SEQ ID NO: 6162055 - DNA, 23 bp, Homo sapiens
ctgtctggctcggacccacccca

SEQ ID NO: 6162056 - DNA, 12 bp, Homo sapiens
ctgtctgggctc

SEQ ID NO: 6162057 - DNA, 16 bp, Homo sapiens
ctgtctgggctcagac

SEQ ID NO: 6162058 - DNA, 12 bp, Homo sapiens
ctgtctggggcc

SEQ ID NO: 6162059 - DNA, 20 bp, Homo sapiens
ctgtctggtgaggtggccca

SEQ ID NO: 6162060 - DNA, 21 bp, Homo sapiens
ctgtctggtgaggtggcccag

SEQ ID NO: 6162061 - DNA, 22 bp, Homo sapiens
ctgtctggtgaggtggcccagg

SEQ ID NO: 6162062 - DNA, 16 bp, Homo sapiens
ctgtctggtgccccta

SEQ ID NO: 6162063 - DNA, 19 bp, Homo sapiens
ctgtctggtgcccctactg

SEQ ID NO: 6162064 - DNA, 23 bp, Homo sapiens
ctgtctggtggccccgtttctgg

SEQ ID NO: 6162065 - DNA, 23 bp, Homo sapiens
ctgtctggtgtagctcctctgct

SEQ ID NO: 6162066 - DNA, 23 bp, Homo sapiens
ctgtctggtttcaccgaggacat

SEQ ID NO: 6162067 - DNA, 22 bp, Homo sapiens
ctgtctgtaatgggatctattt

SEQ ID NO: 6162068 - DNA, 19 bp, Homo sapiens
ctgtctgtatagtgtctgt

SEQ ID NO: 6162069 - DNA, 20 bp, Homo sapiens
ctgtctgtatataacttatt

SEQ ID NO: 6162070 - DNA, 13 bp, Homo sapiens
ctgtctgtcacca

SEQ ID NO: 6162071 - DNA, 14 bp, Homo sapiens
ctgtctgtcatctg

SEQ ID NO: 6162072 - DNA, 19 bp, Homo sapiens
ctgtctgtccaacccctcc

SEQ ID NO: 6162073 - DNA, 23 bp, Homo sapiens
ctgtctgtccaacccctccccca

SEQ ID NO: 6162074 - DNA, 13 bp, Homo sapiens
ctgtctgtcctac

SEQ ID NO: 6162075 - DNA, 20 bp, Homo sapiens
ctgtctgtcctacccgcccg

SEQ ID NO: 6162076 - DNA, 17 bp, Homo sapiens
ctgtctgtcctggaggt

SEQ ID NO: 6162077 - DNA, 15 bp, Homo sapiens
ctgtctgtccttcct

SEQ ID NO: 6162078 - DNA, 16 bp, Homo sapiens
ctgtctgtccttctga

SEQ ID NO: 6162079 - DNA, 13 bp, Homo sapiens
ctgtctgtctcca

SEQ ID NO: 6162080 - DNA, 13 bp, Homo sapiens
ctgtctgtctcta

SEQ ID NO: 6162081 - DNA, 15 bp, Homo sapiens
ctgtctgtctctaat

SEQ ID NO: 6162082 - DNA, 14 bp, Homo sapiens
ctgtctgtctctcc

SEQ ID NO: 6162083 - DNA, 17 bp, Homo sapiens
ctgtctgtctgtgggct

SEQ ID NO: 6162084 - DNA, 11 bp, Homo sapiens
ctgtctgtgca

SEQ ID NO: 6162085 - DNA, 22 bp, Homo sapiens
ctgtctgtgcacatgcctctgt

SEQ ID NO: 6162086 - DNA, 23 bp, Homo sapiens
ctgtctgtgcacatgcctctgta

SEQ ID NO: 6162087 - DNA, 15 bp, Homo sapiens
ctgtctgtgggcttc

SEQ ID NO: 6162088 - DNA, 22 bp, Homo sapiens
ctgtctgtgggcttcagcactt

SEQ ID NO: 6162089 - DNA, 14 bp, Homo sapiens
ctgtctgtgtccca

SEQ ID NO: 6162090 - DNA, 17 bp, Homo sapiens
ctgtctgtgtcccagcc

SEQ ID NO: 6162091 - DNA, 18 bp, Homo sapiens
ctgtctgtgtcccagcca

SEQ ID NO: 6162092 - DNA, 23 bp, Homo sapiens
ctgtctgtgtcccagccacgcag

SEQ ID NO: 6162093 - DNA, 18 bp, Homo sapiens
ctgtctgtgtgcatcatg

SEQ ID NO: 6162094 - DNA, 16 bp, Homo sapiens
ctgtctgttatgattt

SEQ ID NO: 6162095 - DNA, 13 bp, Homo sapiens
ctgtctgttccca

SEQ ID NO: 6162096 - DNA, 14 bp, Homo sapiens
ctgtctgttcccag

SEQ ID NO: 6162097 - DNA, 17 bp, Homo sapiens
ctgtctgttcccagccc

SEQ ID NO: 6162098 - DNA, 20 bp, Homo sapiens
ctgtctgttcccagcccctg

SEQ ID NO: 6162099 - DNA, 22 bp, Homo sapiens
ctgtctgttcccagcccctgca

SEQ ID NO: 6162100 - DNA, 21 bp, Homo sapiens
ctgtctgttctgcacaataaa

SEQ ID NO: 6162101 - DNA, 14 bp, Homo sapiens
ctgtctgttctttt

SEQ ID NO: 6162102 - DNA, 19 bp, Homo sapiens
ctgtcttaaactaaatgtg

SEQ ID NO: 6162103 - DNA, 21 bp, Homo sapiens
ctgtcttaaactaaatgtgca

SEQ ID NO: 6162104 - DNA, 15 bp, Homo sapiens
ctgtcttactaatag

SEQ ID NO: 6162105 - DNA, 19 bp, Homo sapiens
ctgtcttactattatagca

SEQ ID NO: 6162106 - DNA, 18 bp, Homo sapiens
ctgtcttatggtccagaa

SEQ ID NO: 6162107 - DNA, 17 bp, Homo sapiens
ctgtcttcaacagctcc

SEQ ID NO: 6162108 - DNA, 18 bp, Homo sapiens
ctgtcttcaaccctgccc

SEQ ID NO: 6162109 - DNA, 22 bp, Homo sapiens
ctgtcttcaaccctgccctgca

SEQ ID NO: 6162110 - DNA, 18 bp, Homo sapiens
ctgtcttcacaacagatt

SEQ ID NO: 6162111 - DNA, 14 bp, Homo sapiens
ctgtcttcacaacc

SEQ ID NO: 6162112 - DNA, 15 bp, Homo sapiens
ctgtcttcacaacct

SEQ ID NO: 6162113 - DNA, 23 bp, Homo sapiens
ctgtcttcacagctctgtgttgc

SEQ ID NO: 6162114 - DNA, 17 bp, Homo sapiens
ctgtcttcacatgtatg

SEQ ID NO: 6162115 - DNA, 18 bp, Homo sapiens
ctgtcttcacctgattca

SEQ ID NO: 6162116 - DNA, 14 bp, Homo sapiens
ctgtcttcacctgc

SEQ ID NO: 6162117 - DNA, 14 bp, Homo sapiens
ctgtcttcagagca

SEQ ID NO: 6162118 - DNA, 22 bp, Homo sapiens
ctgtcttcagcacattccacgg

SEQ ID NO: 6162119 - DNA, 18 bp, Homo sapiens
ctgtcttcaggctctgcc

SEQ ID NO: 6162120 - DNA, 14 bp, Homo sapiens
ctgtcttcagtctc

SEQ ID NO: 6162121 - DNA, 22 bp, Homo sapiens
ctgtcttcatagcagattttaa

SEQ ID NO: 6162122 - DNA, 20 bp, Homo sapiens
ctgtcttcatcccctcagaa

SEQ ID NO: 6162123 - DNA, 17 bp, Homo sapiens
ctgtcttcatccttagc

SEQ ID NO: 6162124 - DNA, 18 bp, Homo sapiens
ctgtcttccacagccgcc

SEQ ID NO: 6162125 - DNA, 16 bp, Homo sapiens
ctgtcttccactgtac

SEQ ID NO: 6162126 - DNA, 12 bp, Homo sapiens
ctgtcttcccag

SEQ ID NO: 6162127 - DNA, 12 bp, Homo sapiens
ctgtcttccttt

SEQ ID NO: 6162128 - DNA, 17 bp, Homo sapiens
ctgtcttcggccgagct

SEQ ID NO: 6162129 - DNA, 15 bp, Homo sapiens
ctgtcttctcccaga

SEQ ID NO: 6162130 - DNA, 23 bp, Homo sapiens
ctgtcttctccctgcacaagcca

SEQ ID NO: 6162131 - DNA, 20 bp, Homo sapiens
ctgtcttctctccacttctg

SEQ ID NO: 6162132 - DNA, 21 bp, Homo sapiens
ctgtcttctctccacttctgg

SEQ ID NO: 6162133 - DNA, 13 bp, Homo sapiens
ctgtcttctgctt

SEQ ID NO: 6162134 - DNA, 14 bp, Homo sapiens
ctgtcttctggact

SEQ ID NO: 6162135 - DNA, 20 bp, Homo sapiens
ctgtcttctggacttggtct

SEQ ID NO: 6162136 - DNA, 13 bp, Homo sapiens
ctgtcttctgggc

SEQ ID NO: 6162137 - DNA, 14 bp, Homo sapiens
ctgtcttctgggca

SEQ ID NO: 6162138 - DNA, 17 bp, Homo sapiens
ctgtcttctggtctgtg

SEQ ID NO: 6162139 - DNA, 19 bp, Homo sapiens
ctgtcttctggtctgtgtg

SEQ ID NO: 6162140 - DNA, 20 bp, Homo sapiens
ctgtcttctggtctgtgtgt

SEQ ID NO: 6162141 - DNA, 13 bp, Homo sapiens
ctgtcttctttct

SEQ ID NO: 6162142 - DNA, 16 bp, Homo sapiens
ctgtcttctttctcct

SEQ ID NO: 6162143 - DNA, 19 bp, Homo sapiens
ctgtcttgaataagagtga

SEQ ID NO: 6162144 - DNA, 12 bp, Homo sapiens
ctgtcttgaatt

SEQ ID NO: 6162145 - DNA, 19 bp, Homo sapiens
ctgtcttgaattagtattt

SEQ ID NO: 6162146 - DNA, 21 bp, Homo sapiens
ctgtcttgaattagtatttca

SEQ ID NO: 6162147 - DNA, 14 bp, Homo sapiens
ctgtcttgactgtc

SEQ ID NO: 6162148 - DNA, 13 bp, Homo sapiens
ctgtcttgagaga

SEQ ID NO: 6162149 - DNA, 21 bp, Homo sapiens
ctgtcttgagagaaaagaaaa

SEQ ID NO: 6162150 - DNA, 13 bp, Homo sapiens
ctgtcttgccagc

SEQ ID NO: 6162151 - DNA, 15 bp, Homo sapiens
ctgtcttgccagcca

SEQ ID NO: 6162152 - DNA, 16 bp, Homo sapiens
ctgtcttgccagccag

SEQ ID NO: 6162153 - DNA, 22 bp, Homo sapiens
ctgtcttgccccagtttggggt

SEQ ID NO: 6162154 - DNA, 20 bp, Homo sapiens
ctgtcttgcctgccagggcc

SEQ ID NO: 6162155 - DNA, 14 bp, Homo sapiens
ctgtcttgctcctg

SEQ ID NO: 6162156 - DNA, 15 bp, Homo sapiens
ctgtcttgctcctgg

SEQ ID NO: 6162157 - DNA, 17 bp, Homo sapiens
ctgtcttgctcctgggg

SEQ ID NO: 6162158 - DNA, 16 bp, Homo sapiens
ctgtcttggaagtctg

SEQ ID NO: 6162159 - DNA, 14 bp, Homo sapiens
ctgtcttggcatta

SEQ ID NO: 6162160 - DNA, 22 bp, Homo sapiens
ctgtcttggcattaaaccacat

SEQ ID NO: 6162161 - DNA, 14 bp, Homo sapiens
ctgtcttggctgtg

SEQ ID NO: 6162162 - DNA, 17 bp, Homo sapiens
ctgtcttgtcatctttt

SEQ ID NO: 6162163 - DNA, 16 bp, Homo sapiens
ctgtcttgtccccacc

SEQ ID NO: 6162164 - DNA, 18 bp, Homo sapiens
ctgtcttgttaatgcttt

SEQ ID NO: 6162165 - DNA, 17 bp, Homo sapiens
ctgtcttgttcattttg

SEQ ID NO: 6162166 - DNA, 22 bp, Homo sapiens
ctgtcttgttgcggatggatgg

SEQ ID NO: 6162167 - DNA, 18 bp, Homo sapiens
ctgtctttaaaagagaga

SEQ ID NO: 6162168 - DNA, 18 bp, Homo sapiens
ctgtctttaaaagtcatt

SEQ ID NO: 6162169 - DNA, 13 bp, Homo sapiens
ctgtctttaagaa

SEQ ID NO: 6162170 - DNA, 16 bp, Homo sapiens
ctgtctttaattctgt

SEQ ID NO: 6162171 - DNA, 20 bp, Homo sapiens
ctgtctttatgtaagaagaa

SEQ ID NO: 6162172 - DNA, 19 bp, Homo sapiens
ctgtctttcactggaatga

SEQ ID NO: 6162173 - DNA, 11 bp, Homo sapiens
ctgtctttcca

SEQ ID NO: 6162174 - DNA, 17 bp, Homo sapiens
ctgtctttccactctgg

SEQ ID NO: 6162175 - DNA, 12 bp, Homo sapiens
ctgtctttccta

SEQ ID NO: 6162176 - DNA, 14 bp, Homo sapiens
ctgtctttcctaga

SEQ ID NO: 6162177 - DNA, 13 bp, Homo sapiens
ctgtctttctgct

SEQ ID NO: 6162178 - DNA, 23 bp, Homo sapiens
ctgtctttcttgctccctgactg

SEQ ID NO: 6162179 - DNA, 17 bp, Homo sapiens
ctgtctttgcagggcac

SEQ ID NO: 6162180 - DNA, 20 bp, Homo sapiens
ctgtctttgcatacatgaat

SEQ ID NO: 6162181 - DNA, 17 bp, Homo sapiens
ctgtctttgcggggcct

SEQ ID NO: 6162182 - DNA, 21 bp, Homo sapiens
ctgtctttgcggggcctgtct

SEQ ID NO: 6162183 - DNA, 22 bp, Homo sapiens
ctgtctttgcggggcctgtctc

SEQ ID NO: 6162184 - DNA, 23 bp, Homo sapiens
ctgtctttgctgtttatatatat

SEQ ID NO: 6162185 - DNA, 14 bp, Homo sapiens
ctgtctttggaaaa

SEQ ID NO: 6162186 - DNA, 22 bp, Homo sapiens
ctgtctttggataataggaatt

SEQ ID NO: 6162187 - DNA, 15 bp, Homo sapiens
ctgtctttgtggact

SEQ ID NO: 6162188 - DNA, 18 bp, Homo sapiens
ctgtctttgttgtctccc

SEQ ID NO: 6162189 - DNA, 21 bp, Homo sapiens
ctgtctttgttgtctccctct

SEQ ID NO: 6162190 - DNA, 14 bp, Homo sapiens
ctgtcttttaaact

SEQ ID NO: 6162191 - DNA, 19 bp, Homo sapiens
ctgtcttttctgggatgtg

SEQ ID NO: 6162192 - DNA, 16 bp, Homo sapiens
ctgtcttttgaagaag

SEQ ID NO: 6162193 - DNA, 15 bp, Homo sapiens
ctgtcttttgattct

SEQ ID NO: 6162194 - DNA, 13 bp, Homo sapiens
ctgtctttttcct

SEQ ID NO: 6162195 - DNA, 15 bp, Homo sapiens
ctgtctttttccttc

SEQ ID NO: 6162196 - DNA, 18 bp, Homo sapiens
ctgtctttttccttcctg

SEQ ID NO: 6162197 - DNA, 19 bp, Homo sapiens
ctgtctttttccttcctga

SEQ ID NO: 6162198 - DNA, 20 bp, Homo sapiens
ctgtctttttccttcctgag

SEQ ID NO: 6162199 - DNA, 17 bp, Homo sapiens
ctgtgaaaaaaaatttg

SEQ ID NO: 6162200 - DNA, 12 bp, Homo sapiens
ctgtgaaaaatc

SEQ ID NO: 6162201 - DNA, 17 bp, Homo sapiens
ctgtgaaaactctggta

SEQ ID NO: 6162202 - DNA, 23 bp, Homo sapiens
ctgtgaaaatagtgtaagaactg

SEQ ID NO: 6162203 - DNA, 19 bp, Homo sapiens
ctgtgaaacctgtgaagct

SEQ ID NO: 6162204 - DNA, 17 bp, Homo sapiens
ctgtgaaacgtcccaca

SEQ ID NO: 6162205 - DNA, 15 bp, Homo sapiens
ctgtgaaactatcct

SEQ ID NO: 6162206 - DNA, 23 bp, Homo sapiens
ctgtgaaactggcactgaattaa

SEQ ID NO: 6162207 - DNA, 14 bp, Homo sapiens
ctgtgaaagaagta

SEQ ID NO: 6162208 - DNA, 18 bp, Homo sapiens
ctgtgaaagtctcctgta

SEQ ID NO: 6162209 - DNA, 13 bp, Homo sapiens
ctgtgaaatacca

SEQ ID NO: 6162210 - DNA, 24 bp, Homo sapiens
ctgtgaaataccacaagcctgaga

SEQ ID NO: 6162211 - DNA, 15 bp, Homo sapiens
ctgtgaaatattctt

SEQ ID NO: 6162212 - DNA, 20 bp, Homo sapiens
ctgtgaaatcagaagtgcaa

SEQ ID NO: 6162213 - DNA, 19 bp, Homo sapiens
ctgtgaaatgagttggcca

SEQ ID NO: 6162214 - DNA, 14 bp, Homo sapiens
ctgtgaaattccca

SEQ ID NO: 6162215 - DNA, 22 bp, Homo sapiens
ctgtgaaattcccaacaaacat

SEQ ID NO: 6162216 - DNA, 12 bp, Homo sapiens
ctgtgaaattct

SEQ ID NO: 6162217 - DNA, 23 bp, Homo sapiens
ctgtgaaattctcagagtgttta

SEQ ID NO: 6162218 - DNA, 13 bp, Homo sapiens
ctgtgaaatttca

SEQ ID NO: 6162219 - DNA, 19 bp, Homo sapiens
ctgtgaacaccaggacttt

SEQ ID NO: 6162220 - DNA, 21 bp, Homo sapiens
ctgtgaacagcttgctgtcac

SEQ ID NO: 6162221 - DNA, 15 bp, Homo sapiens
ctgtgaacaggctgg

SEQ ID NO: 6162222 - DNA, 21 bp, Homo sapiens
ctgtgaacaggctgggctgct

SEQ ID NO: 6162223 - DNA, 20 bp, Homo sapiens
ctgtgaacagtacagtattt

SEQ ID NO: 6162224 - DNA, 14 bp, Homo sapiens
ctgtgaacatgcct

SEQ ID NO: 6162225 - DNA, 19 bp, Homo sapiens
ctgtgaacatgcctcctcc

SEQ ID NO: 6162226 - DNA, 20 bp, Homo sapiens
ctgtgaacatgcctcctcct

SEQ ID NO: 6162227 - DNA, 19 bp, Homo sapiens
ctgtgaaccaacccccatc

SEQ ID NO: 6162228 - DNA, 16 bp, Homo sapiens
ctgtgaacccaggaca

SEQ ID NO: 6162229 - DNA, 19 bp, Homo sapiens
ctgtgaacccaggacaagc

SEQ ID NO: 6162230 - DNA, 22 bp, Homo sapiens
ctgtgaacccaggacaagcatg

SEQ ID NO: 6162231 - DNA, 19 bp, Homo sapiens
ctgtgaaccctggggcctg

SEQ ID NO: 6162232 - DNA, 19 bp, Homo sapiens
ctgtgaacctgggcactcc

SEQ ID NO: 6162233 - DNA, 18 bp, Homo sapiens
ctgtgaactattttgaag

SEQ ID NO: 6162234 - DNA, 20 bp, Homo sapiens
ctgtgaactcaatctccagg

SEQ ID NO: 6162235 - DNA, 15 bp, Homo sapiens
ctgtgaactgaaatt

SEQ ID NO: 6162236 - DNA, 22 bp, Homo sapiens
ctgtgaactgaaattaaaacta

SEQ ID NO: 6162237 - DNA, 13 bp, Homo sapiens
ctgtgaactgaac

SEQ ID NO: 6162238 - DNA, 15 bp, Homo sapiens
ctgtgaactgaactc

SEQ ID NO: 6162239 - DNA, 16 bp, Homo sapiens
ctgtgaactgaactct

SEQ ID NO: 6162240 - DNA, 15 bp, Homo sapiens
ctgtgaactgccagg

SEQ ID NO: 6162241 - DNA, 23 bp, Homo sapiens
ctgtgaactgccaggcagctgca

SEQ ID NO: 6162242 - DNA, 20 bp, Homo sapiens
ctgtgaactgggcatttcac

SEQ ID NO: 6162243 - DNA, 20 bp, Homo sapiens
ctgtgaactgtgtgtgaatc

SEQ ID NO: 6162244 - DNA, 15 bp, Homo sapiens
ctgtgaacttgaaat

SEQ ID NO: 6162245 - DNA, 17 bp, Homo sapiens
ctgtgaacttgaaattt

SEQ ID NO: 6162246 - DNA, 18 bp, Homo sapiens
ctgtgaacttgatgttcc

SEQ ID NO: 6162247 - DNA, 15 bp, Homo sapiens
ctgtgaacttgggga

SEQ ID NO: 6162248 - DNA, 22 bp, Homo sapiens
ctgtgaagaaccctgcagggcc

SEQ ID NO: 6162249 - DNA, 16 bp, Homo sapiens
ctgtgaagaagccctg

SEQ ID NO: 6162250 - DNA, 21 bp, Homo sapiens
ctgtgaagaagccctgttctc

SEQ ID NO: 6162251 - DNA, 18 bp, Homo sapiens
ctgtgaagacccagcagg

SEQ ID NO: 6162252 - DNA, 21 bp, Homo sapiens
ctgtgaagacccagcaggaag

SEQ ID NO: 6162253 - DNA, 19 bp, Homo sapiens
ctgtgaagcagtcagccct

SEQ ID NO: 6162254 - DNA, 13 bp, Homo sapiens
ctgtgaagccacc

SEQ ID NO: 6162255 - DNA, 18 bp, Homo sapiens
ctgtgaagccctttgcct

SEQ ID NO: 6162256 - DNA, 20 bp, Homo sapiens
ctgtgaagtaacccctcctg

SEQ ID NO: 6162257 - DNA, 18 bp, Homo sapiens
ctgtgaagtccttcacct

SEQ ID NO: 6162258 - DNA, 18 bp, Homo sapiens
ctgtgaagttacatgcat

SEQ ID NO: 6162259 - DNA, 16 bp, Homo sapiens
ctgtgaataaaaagaa

SEQ ID NO: 6162260 - DNA, 21 bp, Homo sapiens
ctgtgaataaaaagaaagatt

SEQ ID NO: 6162261 - DNA, 12 bp, Homo sapiens
ctgtgaatacaa

SEQ ID NO: 6162262 - DNA, 14 bp, Homo sapiens
ctgtgaatacaatt

SEQ ID NO: 6162263 - DNA, 15 bp, Homo sapiens
ctgtgaatacaatta

SEQ ID NO: 6162264 - DNA, 16 bp, Homo sapiens
ctgtgaatacaattaa

SEQ ID NO: 6162265 - DNA, 17 bp, Homo sapiens
ctgtgaatacaattaaa

SEQ ID NO: 6162266 - DNA, 21 bp, Homo sapiens
ctgtgaatacaattaaaggtc

SEQ ID NO: 6162267 - DNA, 21 bp, Homo sapiens
ctgtgaatagcagtggcaaaa

SEQ ID NO: 6162268 - DNA, 18 bp, Homo sapiens
ctgtgaatatgagaaata

SEQ ID NO: 6162269 - DNA, 12 bp, Homo sapiens
ctgtgaatatgt

SEQ ID NO: 6162270 - DNA, 14 bp, Homo sapiens
ctgtgaatatgtgt

SEQ ID NO: 6162271 - DNA, 18 bp, Homo sapiens
ctgtgaatcaaaacaaat

SEQ ID NO: 6162272 - DNA, 15 bp, Homo sapiens
ctgtgaatcaatcct

SEQ ID NO: 6162273 - DNA, 18 bp, Homo sapiens
ctgtgaatccatgggtct

SEQ ID NO: 6162274 - DNA, 15 bp, Homo sapiens
ctgtgaatcctggca

SEQ ID NO: 6162275 - DNA, 17 bp, Homo sapiens
ctgtgaatcctggcaag

SEQ ID NO: 6162276 - DNA, 20 bp, Homo sapiens
ctgtgaatctgctttaatta

SEQ ID NO: 6162277 - DNA, 20 bp, Homo sapiens
ctgacccggttgcagtcact

SEQ ID NO: 6162278 - DNA, 23 bp, Homo sapiens
ctgacccggttgcagtcactgtg

SEQ ID NO: 6162279 - DNA, 20 bp, Homo sapiens
ctgaccctactcccttgccc

SEQ ID NO: 6162280 - DNA, 24 bp, Homo sapiens
ctgaccctcacttttctcatctgt

SEQ ID NO: 6162281 - DNA, 12 bp, Homo sapiens
ctgaccctcagg

SEQ ID NO: 6162282 - DNA, 13 bp, Homo sapiens
ctgaccctcaggc

SEQ ID NO: 6162283 - DNA, 14 bp, Homo sapiens
ctgaccctcaggca

SEQ ID NO: 6162284 - DNA, 19 bp, Homo sapiens
ctgaccctcaggcacacct

SEQ ID NO: 6162285 - DNA, 18 bp, Homo sapiens
ctgaccctccaccgcaga

SEQ ID NO: 6162286 - DNA, 15 bp, Homo sapiens
ctgaccctcccactc

SEQ ID NO: 6162287 - DNA, 22 bp, Homo sapiens
ctgaccctcctccactccacct

SEQ ID NO: 6162288 - DNA, 13 bp, Homo sapiens
ctgaccctccttc

SEQ ID NO: 6162289 - DNA, 18 bp, Homo sapiens
ctgaccctctccacccca

SEQ ID NO: 6162290 - DNA, 21 bp, Homo sapiens
ctgaccctctgcggccactgc

SEQ ID NO: 6162291 - DNA, 16 bp, Homo sapiens
ctgaccctgaggaggc

SEQ ID NO: 6162292 - DNA, 17 bp, Homo sapiens
ctgaccctgaggaggcc

SEQ ID NO: 6162293 - DNA, 19 bp, Homo sapiens
ctgaccctgatgcttaata

SEQ ID NO: 6162294 - DNA, 17 bp, Homo sapiens
ctgaccctgcagagatg

SEQ ID NO: 6162295 - DNA, 17 bp, Homo sapiens
ctgaccctgctcctagc

SEQ ID NO: 6162296 - DNA, 18 bp, Homo sapiens
ctgaccctgctcctagca

SEQ ID NO: 6162297 - DNA, 19 bp, Homo sapiens
ctgaccctgggcctggagg

SEQ ID NO: 6162298 - DNA, 14 bp, Homo sapiens
ctgaccctggggct

SEQ ID NO: 6162299 - DNA, 15 bp, Homo sapiens
ctgaccctgtatata

SEQ ID NO: 6162300 - DNA, 18 bp, Homo sapiens
ctgaccctgtatatagcc

SEQ ID NO: 6162301 - DNA, 22 bp, Homo sapiens
ctgaccctgtatatagcccagc

SEQ ID NO: 6162302 - DNA, 21 bp, Homo sapiens
ctgaccctgtgatgcctgaca

SEQ ID NO: 6162303 - DNA, 14 bp, Homo sapiens
ctgacccttccaga

SEQ ID NO: 6162304 - DNA, 16 bp, Homo sapiens
ctgacccttccagaca

SEQ ID NO: 6162305 - DNA, 18 bp, Homo sapiens
ctgacccttccagacata

SEQ ID NO: 6162306 - DNA, 18 bp, Homo sapiens
ctgaccgaaacagcgctg

SEQ ID NO: 6162307 - DNA, 20 bp, Homo sapiens
ctgaccgacgatccctcgac

SEQ ID NO: 6162308 - DNA, 20 bp, Homo sapiens
ctgaccgatgtgtctcccag

SEQ ID NO: 6162309 - DNA, 14 bp, Homo sapiens
ctgaccggcacctg

SEQ ID NO: 6162310 - DNA, 16 bp, Homo sapiens
ctgaccggcacctgcg

SEQ ID NO: 6162311 - DNA, 18 bp, Homo sapiens
ctgaccgggctcacttgc

SEQ ID NO: 6162312 - DNA, 21 bp, Homo sapiens
ctgaccgggtctgcttctgca

SEQ ID NO: 6162313 - DNA, 17 bp, Homo sapiens
ctgaccggtgcttttat

SEQ ID NO: 6162314 - DNA, 16 bp, Homo sapiens
ctgaccgtatgatgag

SEQ ID NO: 6162315 - DNA, 18 bp, Homo sapiens
ctgaccgtcgaccttggg

SEQ ID NO: 6162316 - DNA, 17 bp, Homo sapiens
ctgacctaccccagcca

SEQ ID NO: 6162317 - DNA, 24 bp, Homo sapiens
ctgacctaccccagccaggctcct

SEQ ID NO: 6162318 - DNA, 14 bp, Homo sapiens
ctgacctacttcct

SEQ ID NO: 6162319 - DNA, 20 bp, Homo sapiens
ctgacctagaccagtttgca

SEQ ID NO: 6162320 - DNA, 20 bp, Homo sapiens
ctgacctcaagcaaccatga

SEQ ID NO: 6162321 - DNA, 14 bp, Homo sapiens
ctgacctcaccggc

SEQ ID NO: 6162322 - DNA, 14 bp, Homo sapiens
ctgacctcacctgg

SEQ ID NO: 6162323 - DNA, 12 bp, Homo sapiens
ctgacctcagca

SEQ ID NO: 6162324 - DNA, 16 bp, Homo sapiens
ctgacctcaggtgatc

SEQ ID NO: 6162325 - DNA, 21 bp, Homo sapiens
ctgacctcaggtgatccaccc

SEQ ID NO: 6162326 - DNA, 16 bp, Homo sapiens
ctgacctccacagctt

SEQ ID NO: 6162327 - DNA, 20 bp, Homo sapiens
ctgacctccagtcctgctgg

SEQ ID NO: 6162328 - DNA, 11 bp, Homo sapiens
ctgacctccca

SEQ ID NO: 6162329 - DNA, 13 bp, Homo sapiens
ctgacctcccact

SEQ ID NO: 6162330 - DNA, 17 bp, Homo sapiens
ctgacctcccactttgg

SEQ ID NO: 6162331 - DNA, 21 bp, Homo sapiens
ctgacctccccctccttccca

SEQ ID NO: 6162332 - DNA, 19 bp, Homo sapiens
ctgacctcctcctgccctc

SEQ ID NO: 6162333 - DNA, 16 bp, Homo sapiens
ctgacctcctctgggc

SEQ ID NO: 6162334 - DNA, 15 bp, Homo sapiens
ctgacctctgcaaga

SEQ ID NO: 6162335 - DNA, 14 bp, Homo sapiens
ctgacctctgctga

SEQ ID NO: 6162336 - DNA, 17 bp, Homo sapiens
ctgacctctgctgagtg

SEQ ID NO: 6162337 - DNA, 23 bp, Homo sapiens
ctgacctctgctgagtgctgggc

SEQ ID NO: 6162338 - DNA, 17 bp, Homo sapiens
ctgacctcttgctgcca

SEQ ID NO: 6162339 - DNA, 15 bp, Homo sapiens
ctgacctcttgctgt

SEQ ID NO: 6162340 - DNA, 18 bp, Homo sapiens
ctgacctcttgctgtctc

SEQ ID NO: 6162341 - DNA, 19 bp, Homo sapiens
ctgacctgaccccattcct

SEQ ID NO: 6162342 - DNA, 12 bp, Homo sapiens
ctgacctgagcg

SEQ ID NO: 6162343 - DNA, 13 bp, Homo sapiens
ctgacctgaggct

SEQ ID NO: 6162344 - DNA, 22 bp, Homo sapiens
ctgacctgatcacctctggctt

SEQ ID NO: 6162345 - DNA, 12 bp, Homo sapiens
ctgacctgcagg

SEQ ID NO: 6162346 - DNA, 12 bp, Homo sapiens
ctgacctgccca

SEQ ID NO: 6162347 - DNA, 13 bp, Homo sapiens
ctgacctgcccat

SEQ ID NO: 6162348 - DNA, 23 bp, Homo sapiens
ctgacctgcccccgctctgccat

SEQ ID NO: 6162349 - DNA, 14 bp, Homo sapiens
ctgacctgcctctc

SEQ ID NO: 6162350 - DNA, 22 bp, Homo sapiens
ctgacctgcctctcacacacat

SEQ ID NO: 6162351 - DNA, 16 bp, Homo sapiens
ctgacctgctgaattg

SEQ ID NO: 6162352 - DNA, 19 bp, Homo sapiens
ctgacctgctgacctgtgc

SEQ ID NO: 6162353 - DNA, 15 bp, Homo sapiens
ctgacctgctgtgca

SEQ ID NO: 6162354 - DNA, 18 bp, Homo sapiens
ctgacctggaagagctgg

SEQ ID NO: 6162355 - DNA, 21 bp, Homo sapiens
ctgacctggaagagctgggta

SEQ ID NO: 6162356 - DNA, 10 bp, Homo sapiens
ctgacctggc

SEQ ID NO: 6162357 - DNA, 12 bp, Homo sapiens
ctgacctggccc

SEQ ID NO: 6162358 - DNA, 20 bp, Homo sapiens
ctgacctgggcccacagagc

SEQ ID NO: 6162359 - DNA, 16 bp, Homo sapiens
ctgacctggtccacag

SEQ ID NO: 6162360 - DNA, 20 bp, Homo sapiens
ctgacctggtccacagggca

SEQ ID NO: 6162361 - DNA, 23 bp, Homo sapiens
ctgacctggtgggagcacctgcc

SEQ ID NO: 6162362 - DNA, 16 bp, Homo sapiens
ctgacctggttgtcca

SEQ ID NO: 6162363 - DNA, 20 bp, Homo sapiens
ctgacctggttgtccaggtc

SEQ ID NO: 6162364 - DNA, 19 bp, Homo sapiens
ctgacctgtaggtcaggac

SEQ ID NO: 6162365 - DNA, 19 bp, Homo sapiens
ctgacctgtcatgcccccc

SEQ ID NO: 6162366 - DNA, 12 bp, Homo sapiens
ctgacctgtcca

SEQ ID NO: 6162367 - DNA, 16 bp, Homo sapiens
ctgaccttagcgttct

SEQ ID NO: 6162368 - DNA, 15 bp, Homo sapiens
ctgaccttcacaggg

SEQ ID NO: 6162369 - DNA, 16 bp, Homo sapiens
ctgaccttcacaggga

SEQ ID NO: 6162370 - DNA, 22 bp, Homo sapiens
ctgaccttcacccagagctgcc

SEQ ID NO: 6162371 - DNA, 23 bp, Homo sapiens
ctgaccttcacccagagctgcct

SEQ ID NO: 6162372 - DNA, 14 bp, Homo sapiens
ctgaccttcagctc

SEQ ID NO: 6162373 - DNA, 22 bp, Homo sapiens
ctgaccttcagctcacgcttca

SEQ ID NO: 6162374 - DNA, 20 bp, Homo sapiens
ctgaccttccagagcccaag

SEQ ID NO: 6162375 - DNA, 20 bp, Homo sapiens
ctgaccttcctcgcagagag

SEQ ID NO: 6162376 - DNA, 13 bp, Homo sapiens
ctgaccttccttc

SEQ ID NO: 6162377 - DNA, 16 bp, Homo sapiens
ctgaccttccttcctg

SEQ ID NO: 6162378 - DNA, 21 bp, Homo sapiens
ctgaccttcggcagtggctgg

SEQ ID NO: 6162379 - DNA, 16 bp, Homo sapiens
ctgaccttctccaggg

SEQ ID NO: 6162380 - DNA, 17 bp, Homo sapiens
ctgaccttctccaggga

SEQ ID NO: 6162381 - DNA, 20 bp, Homo sapiens
ctgaccttctccagggacag

SEQ ID NO: 6162382 - DNA, 13 bp, Homo sapiens
ctgaccttctgcg

SEQ ID NO: 6162383 - DNA, 22 bp, Homo sapiens
ctgaccttgaactcctgggctc

SEQ ID NO: 6162384 - DNA, 15 bp, Homo sapiens
ctgaccttgctgcca

SEQ ID NO: 6162385 - DNA, 16 bp, Homo sapiens
ctgaccttgctgccac

SEQ ID NO: 6162386 - DNA, 19 bp, Homo sapiens
ctgaccttggagagacaca

SEQ ID NO: 6162387 - DNA, 16 bp, Homo sapiens
ctgaccttggaggaat

SEQ ID NO: 6162388 - DNA, 21 bp, Homo sapiens
ctgaccttggaggaatgacaa

SEQ ID NO: 6162389 - DNA, 19 bp, Homo sapiens
ctgaccttgtaaaagacag

SEQ ID NO: 6162390 - DNA, 20 bp, Homo sapiens
ctgacctttaactgagggct

SEQ ID NO: 6162391 - DNA, 22 bp, Homo sapiens
ctgacctttaactgagggctga

SEQ ID NO: 6162392 - DNA, 21 bp, Homo sapiens
ctgacctttgtcatctttctt

SEQ ID NO: 6162393 - DNA, 23 bp, Homo sapiens
ctgacctttgtcatctttcttct

SEQ ID NO: 6162394 - DNA, 16 bp, Homo sapiens
ctgacgaaatggaaac

SEQ ID NO: 6162395 - DNA, 22 bp, Homo sapiens
ctgacgaaatggaaacacacac

SEQ ID NO: 6162396 - DNA, 21 bp, Homo sapiens
ctgacgaacttccatggccct

SEQ ID NO: 6162397 - DNA, 13 bp, Homo sapiens
ctgacgaaggtcc

SEQ ID NO: 6162398 - DNA, 16 bp, Homo sapiens
ctgacgaggctgggcc

SEQ ID NO: 6162399 - DNA, 19 bp, Homo sapiens
ctgacgaggctgggccaag

SEQ ID NO: 6162400 - DNA, 20 bp, Homo sapiens
ctgacgaggctgggccaagc

SEQ ID NO: 6162401 - DNA, 16 bp, Homo sapiens
ctgacgatcttccccc

SEQ ID NO: 6162402 - DNA, 17 bp, Homo sapiens
ctgacgatcttccccct

SEQ ID NO: 6162403 - DNA, 23 bp, Homo sapiens
ctgacgatggggggctgatggct

SEQ ID NO: 6162404 - DNA, 12 bp, Homo sapiens
ctgacgattctt

SEQ ID NO: 6162405 - DNA, 21 bp, Homo sapiens
ctgacgcaaaaccactttcct

SEQ ID NO: 6162406 - DNA, 16 bp, Homo sapiens
ctgacgcaccactgcc

SEQ ID NO: 6162407 - DNA, 15 bp, Homo sapiens
ctgacgcagcctgag

SEQ ID NO: 6162408 - DNA, 16 bp, Homo sapiens
ctgacgcagcctgaga

SEQ ID NO: 6162409 - DNA, 20 bp, Homo sapiens
ctgacgccgcgcactcagcc

SEQ ID NO: 6162410 - DNA, 13 bp, Homo sapiens
ctgacgctcagcc

SEQ ID NO: 6162411 - DNA, 17 bp, Homo sapiens
ctgacgctggagatgca

SEQ ID NO: 6162412 - DNA, 18 bp, Homo sapiens
ctgacgctggagatgcaa

SEQ ID NO: 6162413 - DNA, 23 bp, Homo sapiens
ctgacggaagccaacttggcttt

SEQ ID NO: 6162414 - DNA, 23 bp, Homo sapiens
ctgacggcagtaaatccacagtg

SEQ ID NO: 6162415 - DNA, 21 bp, Homo sapiens
ctgacggccagggagaagctc

SEQ ID NO: 6162416 - DNA, 13 bp, Homo sapiens
ctgacggccctgc

SEQ ID NO: 6162417 - DNA, 15 bp, Homo sapiens
ctgacggctggggac

SEQ ID NO: 6162418 - DNA, 14 bp, Homo sapiens
ctgacgggaggccc

SEQ ID NO: 6162419 - DNA, 15 bp, Homo sapiens
ctgacgggaggcccc

SEQ ID NO: 6162420 - DNA, 18 bp, Homo sapiens
ctgacgggaggccccagc

SEQ ID NO: 6162421 - DNA, 19 bp, Homo sapiens
ctgacggtttctccccgga

SEQ ID NO: 6162422 - DNA, 22 bp, Homo sapiens
ctgacgtagctgcaaaggacag

SEQ ID NO: 6162423 - DNA, 23 bp, Homo sapiens
ctgacgtcaacccaagctctggg

SEQ ID NO: 6162424 - DNA, 14 bp, Homo sapiens
ctgacgtcaagtga

SEQ ID NO: 6162425 - DNA, 19 bp, Homo sapiens
ctgacgtcagcgcaccaaa

SEQ ID NO: 6162426 - DNA, 23 bp, Homo sapiens
ctgacgtctgaagcttgactccc

SEQ ID NO: 6162427 - DNA, 14 bp, Homo sapiens
ctgacgtctgccac

SEQ ID NO: 6162428 - DNA, 16 bp, Homo sapiens
ctgacgtctgccacca

SEQ ID NO: 6162429 - DNA, 18 bp, Homo sapiens
ctgacgtgccttttgcac

SEQ ID NO: 6162430 - DNA, 23 bp, Homo sapiens
ctgacgtttgacaccagggccag

SEQ ID NO: 6162431 - DNA, 21 bp, Homo sapiens
ctgactaaactaccacctcag

SEQ ID NO: 6162432 - DNA, 14 bp, Homo sapiens
ctgactaaactttt

SEQ ID NO: 6162433 - DNA, 13 bp, Homo sapiens
ctgactaagaaga

SEQ ID NO: 6162434 - DNA, 21 bp, Homo sapiens
ctgactaagccccgtctgacc

SEQ ID NO: 6162435 - DNA, 22 bp, Homo sapiens
ctgactaagccccgtctgaccc

SEQ ID NO: 6162436 - DNA, 15 bp, Homo sapiens
ctgactacagggccg

SEQ ID NO: 6162437 - DNA, 16 bp, Homo sapiens
ctgactacattttttc

SEQ ID NO: 6162438 - DNA, 17 bp, Homo sapiens
ctgactactactctgcc

SEQ ID NO: 6162439 - DNA, 14 bp, Homo sapiens
ctgactactgccca

SEQ ID NO: 6162440 - DNA, 16 bp, Homo sapiens
ctgactactgggcaaa

SEQ ID NO: 6162441 - DNA, 11 bp, Homo sapiens
ctgactagaac

SEQ ID NO: 6162442 - DNA, 13 bp, Homo sapiens
ctgactagaactc

SEQ ID NO: 6162443 - DNA, 20 bp, Homo sapiens
ctgactagaactcctgtctt

SEQ ID NO: 6162444 - DNA, 22 bp, Homo sapiens
ctgactagaagggccagtcctg

SEQ ID NO: 6162445 - DNA, 21 bp, Homo sapiens
ctgactagagtgatgactgct

SEQ ID NO: 6162446 - DNA, 17 bp, Homo sapiens
ctgactagatctctgga

SEQ ID NO: 6162447 - DNA, 16 bp, Homo sapiens
ctgactaggaaaagtt

SEQ ID NO: 6162448 - DNA, 22 bp, Homo sapiens
ctgactattcttgatgtaaaat

SEQ ID NO: 6162449 - DNA, 18 bp, Homo sapiens
ctgactcaacatgttact

SEQ ID NO: 6162450 - DNA, 15 bp, Homo sapiens
ctgactcacaagaag

SEQ ID NO: 6162451 - DNA, 17 bp, Homo sapiens
ctgactcacaagaagac

SEQ ID NO: 6162452 - DNA, 21 bp, Homo sapiens
ctgactcacaagaagaccaga

SEQ ID NO: 6162453 - DNA, 22 bp, Homo sapiens
ctgactcacacctgaactgaac

SEQ ID NO: 6162454 - DNA, 15 bp, Homo sapiens
ctgactcaggcatca

SEQ ID NO: 6162455 - DNA, 21 bp, Homo sapiens
ctgtgaatgccactgccttcg

SEQ ID NO: 6162456 - DNA, 15 bp, Homo sapiens
ctgtgaatggaagca

SEQ ID NO: 6162457 - DNA, 21 bp, Homo sapiens
ctgtgaatggaagcaaagtgc

SEQ ID NO: 6162458 - DNA, 16 bp, Homo sapiens
ctgtgaatggaggcag

SEQ ID NO: 6162459 - DNA, 21 bp, Homo sapiens
ctgtgaatggaggcagagacc

SEQ ID NO: 6162460 - DNA, 15 bp, Homo sapiens
ctgtgaatggctgtg

SEQ ID NO: 6162461 - DNA, 21 bp, Homo sapiens
ctgtgaatggctgtgccccac

SEQ ID NO: 6162462 - DNA, 21 bp, Homo sapiens
ctgtgaattgagctgcagaaa

SEQ ID NO: 6162463 - DNA, 15 bp, Homo sapiens
ctgtgaatttcaaaa

SEQ ID NO: 6162464 - DNA, 19 bp, Homo sapiens
ctgtgaatttgtgtaagga

SEQ ID NO: 6162465 - DNA, 15 bp, Homo sapiens
ctgtgacaaagaaga

SEQ ID NO: 6162466 - DNA, 13 bp, Homo sapiens
ctgtgacaacact

SEQ ID NO: 6162467 - DNA, 17 bp, Homo sapiens
ctgtgacaaccctggcc

SEQ ID NO: 6162468 - DNA, 23 bp, Homo sapiens
ctgtgacaaccctggcctcactt

SEQ ID NO: 6162469 - DNA, 16 bp, Homo sapiens
ctgtgacaataagttt

SEQ ID NO: 6162470 - DNA, 12 bp, Homo sapiens
ctgtgacaatga

SEQ ID NO: 6162471 - DNA, 16 bp, Homo sapiens
ctgtgacaatgactaa

SEQ ID NO: 6162472 - DNA, 23 bp, Homo sapiens
ctgtgacaatgactaagccaagc

SEQ ID NO: 6162473 - DNA, 16 bp, Homo sapiens
ctgtgacacagctgag

SEQ ID NO: 6162474 - DNA, 15 bp, Homo sapiens
ctgtgacacatcgtt

SEQ ID NO: 6162475 - DNA, 20 bp, Homo sapiens
ctgtgacaccccccttctga

SEQ ID NO: 6162476 - DNA, 14 bp, Homo sapiens
ctgtgacacctggt

SEQ ID NO: 6162477 - DNA, 22 bp, Homo sapiens
ctgtgacacctggtgcgggcct

SEQ ID NO: 6162478 - DNA, 17 bp, Homo sapiens
ctgtgacagcagctctg

SEQ ID NO: 6162479 - DNA, 19 bp, Homo sapiens
ctgtgacatggtgcctgag

SEQ ID NO: 6162480 - DNA, 22 bp, Homo sapiens
ctgtgacatggtgcctgagagg

SEQ ID NO: 6162481 - DNA, 12 bp, Homo sapiens
ctgtgaccaaag

SEQ ID NO: 6162482 - DNA, 17 bp, Homo sapiens
ctgtgaccaactgttgg

SEQ ID NO: 6162483 - DNA, 15 bp, Homo sapiens
ctgtgaccaatgtct

SEQ ID NO: 6162484 - DNA, 18 bp, Homo sapiens
ctgtgaccaggaaggaag

SEQ ID NO: 6162485 - DNA, 23 bp, Homo sapiens
ctgtgaccagtctgacccttaca

SEQ ID NO: 6162486 - DNA, 22 bp, Homo sapiens
ctgtgacccacttctcatcaca

SEQ ID NO: 6162487 - DNA, 23 bp, Homo sapiens
ctgtgacccacttctcatcacac

SEQ ID NO: 6162488 - DNA, 13 bp, Homo sapiens
ctgtgacccatct

SEQ ID NO: 6162489 - DNA, 15 bp, Homo sapiens
ctgtgacccatctgt

SEQ ID NO: 6162490 - DNA, 14 bp, Homo sapiens
ctgtgaccggggtc

SEQ ID NO: 6162491 - DNA, 15 bp, Homo sapiens
ctgtgaccggggtcc

SEQ ID NO: 6162492 - DNA, 23 bp, Homo sapiens
ctgtgacctgatttcagaagaga

SEQ ID NO: 6162493 - DNA, 15 bp, Homo sapiens
ctgtgacctgcatct

SEQ ID NO: 6162494 - DNA, 16 bp, Homo sapiens
ctgtgacctgctcctg

SEQ ID NO: 6162495 - DNA, 17 bp, Homo sapiens
ctgtgacctgctcctgc

SEQ ID NO: 6162496 - DNA, 19 bp, Homo sapiens
ctgtgacctgctcctgccc

SEQ ID NO: 6162497 - DNA, 21 bp, Homo sapiens
ctgtgacctgctcctgcccac

SEQ ID NO: 6162498 - DNA, 16 bp, Homo sapiens
ctgtgacctgctgagc

SEQ ID NO: 6162499 - DNA, 16 bp, Homo sapiens
ctgtgacctggtctgg

SEQ ID NO: 6162500 - DNA, 19 bp, Homo sapiens
ctgtgacctgtcagaataa

SEQ ID NO: 6162501 - DNA, 13 bp, Homo sapiens
ctgtgacctgtgg

SEQ ID NO: 6162502 - DNA, 14 bp, Homo sapiens
ctgtgaccttggga

SEQ ID NO: 6162503 - DNA, 20 bp, Homo sapiens
ctgtgaccttgggaccaaag

SEQ ID NO: 6162504 - DNA, 21 bp, Homo sapiens
ctgtgacgcagacagagggga

SEQ ID NO: 6162505 - DNA, 20 bp, Homo sapiens
ctgtgacgtcggccgaccag

SEQ ID NO: 6162506 - DNA, 17 bp, Homo sapiens
ctgtgactagatacaga

SEQ ID NO: 6162507 - DNA, 19 bp, Homo sapiens
ctgtgactataaagctgtt

SEQ ID NO: 6162508 - DNA, 15 bp, Homo sapiens
ctgtgactcctgttg

SEQ ID NO: 6162509 - DNA, 20 bp, Homo sapiens
ctgtgactcgcttagctgaa

SEQ ID NO: 6162510 - DNA, 12 bp, Homo sapiens
ctgtgactctgg

SEQ ID NO: 6162511 - DNA, 17 bp, Homo sapiens
ctgtgactctgggcagg

SEQ ID NO: 6162512 - DNA, 18 bp, Homo sapiens
ctgtgactcttctctcaa

SEQ ID NO: 6162513 - DNA, 23 bp, Homo sapiens
ctgtgactgaagaagatgagcct

SEQ ID NO: 6162514 - DNA, 14 bp, Homo sapiens
ctgtgactgatgtt

SEQ ID NO: 6162515 - DNA, 21 bp, Homo sapiens
ctgtgactgatgttaggctgg

SEQ ID NO: 6162516 - DNA, 18 bp, Homo sapiens
ctgtgactgccaaggtgt

SEQ ID NO: 6162517 - DNA, 23 bp, Homo sapiens
ctgtgactgccaaggtgtggcct

SEQ ID NO: 6162518 - DNA, 16 bp, Homo sapiens
ctgtgactggatcttc

SEQ ID NO: 6162519 - DNA, 15 bp, Homo sapiens
ctgtgactgtttttg

SEQ ID NO: 6162520 - DNA, 21 bp, Homo sapiens
ctgtgacttctccaggtctca

SEQ ID NO: 6162521 - DNA, 16 bp, Homo sapiens
ctgtgagaactgtgaa

SEQ ID NO: 6162522 - DNA, 17 bp, Homo sapiens
ctgtgagaactgtgaat

SEQ ID NO: 6162523 - DNA, 20 bp, Homo sapiens
ctgtgagaaggtttattgtt

SEQ ID NO: 6162524 - DNA, 12 bp, Homo sapiens
ctgtgagaccaa

SEQ ID NO: 6162525 - DNA, 17 bp, Homo sapiens
ctgtgagacccccacac

SEQ ID NO: 6162526 - DNA, 21 bp, Homo sapiens
ctgtgagagaataatttctgt

SEQ ID NO: 6162527 - DNA, 22 bp, Homo sapiens
ctgtgagagccacgctggcctt

SEQ ID NO: 6162528 - DNA, 15 bp, Homo sapiens
ctgtgagataaatat

SEQ ID NO: 6162529 - DNA, 22 bp, Homo sapiens
ctgtgagataaatatcattata

SEQ ID NO: 6162530 - DNA, 17 bp, Homo sapiens
ctgtgagcaagagccag

SEQ ID NO: 6162531 - DNA, 18 bp, Homo sapiens
ctgtgagcaagagccagg

SEQ ID NO: 6162532 - DNA, 12 bp, Homo sapiens
ctgtgagcacaa

SEQ ID NO: 6162533 - DNA, 18 bp, Homo sapiens
ctgtgagcacaaagaaga

SEQ ID NO: 6162534 - DNA, 15 bp, Homo sapiens
ctgtgagcagcctcc

SEQ ID NO: 6162535 - DNA, 19 bp, Homo sapiens
ctgtgagcatcacagtttt

SEQ ID NO: 6162536 - DNA, 16 bp, Homo sapiens
ctgtgagcatcctggc

SEQ ID NO: 6162537 - DNA, 21 bp, Homo sapiens
ctgtgagcatggggccaggaa

SEQ ID NO: 6162538 - DNA, 19 bp, Homo sapiens
ctgtgagccatgcctccct

SEQ ID NO: 6162539 - DNA, 15 bp, Homo sapiens
ctgtgagcccagctg

SEQ ID NO: 6162540 - DNA, 22 bp, Homo sapiens
ctgtgagccccacagccctgct

SEQ ID NO: 6162541 - DNA, 14 bp, Homo sapiens
ctgtgagcccctgg

SEQ ID NO: 6162542 - DNA, 15 bp, Homo sapiens
ctgtgagcccctggt

SEQ ID NO: 6162543 - DNA, 21 bp, Homo sapiens
ctgtgagcccctggtcctgag

SEQ ID NO: 6162544 - DNA, 13 bp, Homo sapiens
ctgtgagccttgc

SEQ ID NO: 6162545 - DNA, 20 bp, Homo sapiens
ctgtgagcgagcctggcagg

SEQ ID NO: 6162546 - DNA, 22 bp, Homo sapiens
ctgtgagcgctggctccctggg

SEQ ID NO: 6162547 - DNA, 23 bp, Homo sapiens
ctgtgagcgctggctccctgggc

SEQ ID NO: 6162548 - DNA, 13 bp, Homo sapiens
ctgtgagctgcac

SEQ ID NO: 6162549 - DNA, 20 bp, Homo sapiens
ctgtgaggaatgctctgtgc

SEQ ID NO: 6162550 - DNA, 15 bp, Homo sapiens
ctgtgaggacagaca

SEQ ID NO: 6162551 - DNA, 19 bp, Homo sapiens
ctgtgaggacagggccccc

SEQ ID NO: 6162552 - DNA, 17 bp, Homo sapiens
ctgtgaggagccccatc

SEQ ID NO: 6162553 - DNA, 18 bp, Homo sapiens
ctgtgaggagccccatct

SEQ ID NO: 6162554 - DNA, 15 bp, Homo sapiens
ctgtgaggagtctgg

SEQ ID NO: 6162555 - DNA, 23 bp, Homo sapiens
ctgtgaggatagagacttgcagt

SEQ ID NO: 6162556 - DNA, 14 bp, Homo sapiens
ctgtgaggcagggg

SEQ ID NO: 6162557 - DNA, 18 bp, Homo sapiens
ctgtgaggcaggggcgga

SEQ ID NO: 6162558 - DNA, 22 bp, Homo sapiens
ctgtgaggccatacttgtgaaa

SEQ ID NO: 6162559 - DNA, 18 bp, Homo sapiens
ctgtgaggcggcagctgg

SEQ ID NO: 6162560 - DNA, 12 bp, Homo sapiens
ctgtgaggctgt

SEQ ID NO: 6162561 - DNA, 18 bp, Homo sapiens
ctgtgaggcttgcccagg

SEQ ID NO: 6162562 - DNA, 21 bp, Homo sapiens
ctgtgaggcttgcccaggagc

SEQ ID NO: 6162563 - DNA, 22 bp, Homo sapiens
ctgtgagggaggggaaaagcat

SEQ ID NO: 6162564 - DNA, 16 bp, Homo sapiens
ctgtgaggggaaggcc

SEQ ID NO: 6162565 - DNA, 17 bp, Homo sapiens
ctgtgaggggaaggcct

SEQ ID NO: 6162566 - DNA, 13 bp, Homo sapiens
ctgtgaggggccc

SEQ ID NO: 6162567 - DNA, 17 bp, Homo sapiens
ctgtgaggggcccctgg

SEQ ID NO: 6162568 - DNA, 23 bp, Homo sapiens
ctgtgaggggcccctggcccagg

SEQ ID NO: 6162569 - DNA, 19 bp, Homo sapiens
ctgtgaggggctctctcat

SEQ ID NO: 6162570 - DNA, 17 bp, Homo sapiens
ctgtgaggggtgtttgg

SEQ ID NO: 6162571 - DNA, 22 bp, Homo sapiens
ctgtgaggtaactgggatcgca

SEQ ID NO: 6162572 - DNA, 22 bp, Homo sapiens
ctgtgaggtgcagagtgcccag

SEQ ID NO: 6162573 - DNA, 15 bp, Homo sapiens
ctgtgaggtgctgat

SEQ ID NO: 6162574 - DNA, 16 bp, Homo sapiens
ctgtgaggtgctgatg

SEQ ID NO: 6162575 - DNA, 19 bp, Homo sapiens
ctgtgaggtgctgatgagt

SEQ ID NO: 6162576 - DNA, 21 bp, Homo sapiens
ctgtgagtactacagtcctcc

SEQ ID NO: 6162577 - DNA, 13 bp, Homo sapiens
ctgtgagtcctga

SEQ ID NO: 6162578 - DNA, 15 bp, Homo sapiens
ctgtgagtctgtcct

SEQ ID NO: 6162579 - DNA, 21 bp, Homo sapiens
ctgtgagtctttggttctaag

SEQ ID NO: 6162580 - DNA, 22 bp, Homo sapiens
ctgtgagtctttggttctaagg

SEQ ID NO: 6162581 - DNA, 23 bp, Homo sapiens
ctgtgagtctttggttctaagga

SEQ ID NO: 6162582 - DNA, 16 bp, Homo sapiens
ctgtgagtgcgcctca

SEQ ID NO: 6162583 - DNA, 17 bp, Homo sapiens
ctgtgagtgcgcctcac

SEQ ID NO: 6162584 - DNA, 18 bp, Homo sapiens
ctgtgagtgcgtctgagg

SEQ ID NO: 6162585 - DNA, 19 bp, Homo sapiens
ctgtgagtgcgtctgaggg

SEQ ID NO: 6162586 - DNA, 20 bp, Homo sapiens
ctgtgagtgcgtctgagggg

SEQ ID NO: 6162587 - DNA, 22 bp, Homo sapiens
ctgtgagtggttcaagcacact

SEQ ID NO: 6162588 - DNA, 14 bp, Homo sapiens
ctgtgagtgtaagt

SEQ ID NO: 6162589 - DNA, 21 bp, Homo sapiens
ctgtgagtgtaagtgtgagta

SEQ ID NO: 6162590 - DNA, 16 bp, Homo sapiens
ctgtgagttctccctg

SEQ ID NO: 6162591 - DNA, 22 bp, Homo sapiens
ctgtgagttctccctgtacagt

SEQ ID NO: 6162592 - DNA, 17 bp, Homo sapiens
ctgtgagttctgatgtc

SEQ ID NO: 6162593 - DNA, 20 bp, Homo sapiens
ctgtgagttctgttgtgttt

SEQ ID NO: 6162594 - DNA, 14 bp, Homo sapiens
ctgtgataacagag

SEQ ID NO: 6162595 - DNA, 17 bp, Homo sapiens
ctgtgataacagagtga

SEQ ID NO: 6162596 - DNA, 20 bp, Homo sapiens
ctgtgatatgtctgctgagt

SEQ ID NO: 6162597 - DNA, 19 bp, Homo sapiens
ctgtgatcagtgattttca

SEQ ID NO: 6162598 - DNA, 13 bp, Homo sapiens
ctgtgatcattta

SEQ ID NO: 6162599 - DNA, 16 bp, Homo sapiens
ctgtgatccaggaaag

SEQ ID NO: 6162600 - DNA, 19 bp, Homo sapiens
ctgtgatccttggtgctgt

SEQ ID NO: 6162601 - DNA, 20 bp, Homo sapiens
ctgtgatcgtgtgttgccat

SEQ ID NO: 6162602 - DNA, 17 bp, Homo sapiens
ctgtgatctaagcagtt

SEQ ID NO: 6162603 - DNA, 15 bp, Homo sapiens
ctgtgatctctgctg

SEQ ID NO: 6162604 - DNA, 17 bp, Homo sapiens
ctgtgatctgtgtacaa

SEQ ID NO: 6162605 - DNA, 14 bp, Homo sapiens
ctgtgatcttaaaa

SEQ ID NO: 6162606 - DNA, 14 bp, Homo sapiens
ctgtgatcttattt

SEQ ID NO: 6162607 - DNA, 16 bp, Homo sapiens
ctgtgatgaaatatga

SEQ ID NO: 6162608 - DNA, 15 bp, Homo sapiens
ctgtgatgagctgat

SEQ ID NO: 6162609 - DNA, 16 bp, Homo sapiens
ctgtgatgagctgatc

SEQ ID NO: 6162610 - DNA, 22 bp, Homo sapiens
ctgtgatgaggggaggggggca

SEQ ID NO: 6162611 - DNA, 16 bp, Homo sapiens
ctgtgatgcatgagct

SEQ ID NO: 6162612 - DNA, 17 bp, Homo sapiens
ctgtgatgccgtcctgc

SEQ ID NO: 6162613 - DNA, 19 bp, Homo sapiens
ctgtgatgccgtcctgctg

SEQ ID NO: 6162614 - DNA, 19 bp, Homo sapiens
ctgtgatgctcccaagcaa

SEQ ID NO: 6162615 - DNA, 21 bp, Homo sapiens
ctgtgatgctcccaagcaaag

SEQ ID NO: 6162616 - DNA, 15 bp, Homo sapiens
ctgtgatgctgtgtg

SEQ ID NO: 6162617 - DNA, 16 bp, Homo sapiens
ctgtgatgctgtgtgc

SEQ ID NO: 6162618 - DNA, 21 bp, Homo sapiens
ctgtgatgctgtgtgcccaag

SEQ ID NO: 6162619 - DNA, 18 bp, Homo sapiens
ctgtgatgctttgaagta

SEQ ID NO: 6162620 - DNA, 19 bp, Homo sapiens
ctgtgatggcgggcactgg

SEQ ID NO: 6162621 - DNA, 19 bp, Homo sapiens
ctgtgatggggccctgcct

SEQ ID NO: 6162622 - DNA, 21 bp, Homo sapiens
ctgtgatggggccctgcctcc

SEQ ID NO: 6162623 - DNA, 16 bp, Homo sapiens
ctgtgatggggtgggc

SEQ ID NO: 6162624 - DNA, 20 bp, Homo sapiens
ctgtgatggggtgggcaggg

SEQ ID NO: 6162625 - DNA, 21 bp, Homo sapiens
ctgtgatggggtgggcagggc

SEQ ID NO: 6162626 - DNA, 16 bp, Homo sapiens
ctgtgatgtcacagtt

SEQ ID NO: 6162627 - DNA, 21 bp, Homo sapiens
ctgtgatgtcacagtttgttc

SEQ ID NO: 6162628 - DNA, 12 bp, Homo sapiens
ctgtgatgtcag

SEQ ID NO: 6162629 - DNA, 16 bp, Homo sapiens
ctgtgatgtcagcggt

SEQ ID NO: 6162630 - DNA, 15 bp, Homo sapiens
ctgtgatgtcccagt

SEQ ID NO: 6162631 - DNA, 13 bp, Homo sapiens
ctgtgatgtttgt

SEQ ID NO: 6162632 - DNA, 21 bp, Homo sapiens
ctgactcagtgaccagtgcct

SEQ ID NO: 6162633 - DNA, 23 bp, Homo sapiens
ctgactcagtgcagggacagcct

SEQ ID NO: 6162634 - DNA, 16 bp, Homo sapiens
ctgactcatcatttgt

SEQ ID NO: 6162635 - DNA, 16 bp, Homo sapiens
ctgactcatccgcctg

SEQ ID NO: 6162636 - DNA, 19 bp, Homo sapiens
ctgactcatccgcctggcc

SEQ ID NO: 6162637 - DNA, 22 bp, Homo sapiens
ctgactcatccgcctggcccgg

SEQ ID NO: 6162638 - DNA, 20 bp, Homo sapiens
ctgactccacgatcctgcca

SEQ ID NO: 6162639 - DNA, 21 bp, Homo sapiens
ctgactccagtgagctggaat

SEQ ID NO: 6162640 - DNA, 20 bp, Homo sapiens
ctgactccatatggaggcct

SEQ ID NO: 6162641 - DNA, 16 bp, Homo sapiens
ctgactcccatgcaag

SEQ ID NO: 6162642 - DNA, 12 bp, Homo sapiens
ctgactccctcc

SEQ ID NO: 6162643 - DNA, 16 bp, Homo sapiens
ctgactccctccccac

SEQ ID NO: 6162644 - DNA, 15 bp, Homo sapiens
ctgactccctgtggg

SEQ ID NO: 6162645 - DNA, 17 bp, Homo sapiens
ctgactccctgtggggg

SEQ ID NO: 6162646 - DNA, 18 bp, Homo sapiens
ctgactccgtcaagctgg

SEQ ID NO: 6162647 - DNA, 22 bp, Homo sapiens
ctgactcctcagtccctcttct

SEQ ID NO: 6162648 - DNA, 17 bp, Homo sapiens
ctgactcctctaagcca

SEQ ID NO: 6162649 - DNA, 19 bp, Homo sapiens
ctgactcctctaagccact

SEQ ID NO: 6162650 - DNA, 14 bp, Homo sapiens
ctgactcctctggc

SEQ ID NO: 6162651 - DNA, 20 bp, Homo sapiens
ctgactcctctggctttccc

SEQ ID NO: 6162652 - DNA, 22 bp, Homo sapiens
ctgactcctctggctttcccag

SEQ ID NO: 6162653 - DNA, 14 bp, Homo sapiens
ctgactcctggact

SEQ ID NO: 6162654 - DNA, 14 bp, Homo sapiens
ctgactcctgggtg

SEQ ID NO: 6162655 - DNA, 21 bp, Homo sapiens
ctgactcggtcaaaatatttt

SEQ ID NO: 6162656 - DNA, 11 bp, Homo sapiens
ctgactctaaa

SEQ ID NO: 6162657 - DNA, 22 bp, Homo sapiens
ctgactctcttttgaggtccct

SEQ ID NO: 6162658 - DNA, 15 bp, Homo sapiens
ctgactctgaaatct

SEQ ID NO: 6162659 - DNA, 20 bp, Homo sapiens
ctgactctgaaatctgaaga

SEQ ID NO: 6162660 - DNA, 20 bp, Homo sapiens
ctgactctgagtccactgct

SEQ ID NO: 6162661 - DNA, 14 bp, Homo sapiens
ctgactctgccccc

SEQ ID NO: 6162662 - DNA, 19 bp, Homo sapiens
ctgactctgccccctgctg

SEQ ID NO: 6162663 - DNA, 16 bp, Homo sapiens
ctgactctggaccatg

SEQ ID NO: 6162664 - DNA, 19 bp, Homo sapiens
ctgactctggaccatgctg

SEQ ID NO: 6162665 - DNA, 18 bp, Homo sapiens
ctgactctgtgctgagca

SEQ ID NO: 6162666 - DNA, 14 bp, Homo sapiens
ctgactctgttatt

SEQ ID NO: 6162667 - DNA, 17 bp, Homo sapiens
ctgactcttaagaagac

SEQ ID NO: 6162668 - DNA, 15 bp, Homo sapiens
ctgactcttattttt

SEQ ID NO: 6162669 - DNA, 20 bp, Homo sapiens
ctgactcttattttttaaaa

SEQ ID NO: 6162670 - DNA, 14 bp, Homo sapiens
ctgactcttgcctt

SEQ ID NO: 6162671 - DNA, 16 bp, Homo sapiens
ctgactcttgcctttc

SEQ ID NO: 6162672 - DNA, 16 bp, Homo sapiens
ctgactgaactagagc

SEQ ID NO: 6162673 - DNA, 15 bp, Homo sapiens
ctgactgaaggaaaa

SEQ ID NO: 6162674 - DNA, 18 bp, Homo sapiens
ctgactgacacaggccag

SEQ ID NO: 6162675 - DNA, 19 bp, Homo sapiens
ctgactgacacaggccagc

SEQ ID NO: 6162676 - DNA, 22 bp, Homo sapiens
ctgactgacacaggccagcccc

SEQ ID NO: 6162677 - DNA, 23 bp, Homo sapiens
ctgactgacacaggccagcccca

SEQ ID NO: 6162678 - DNA, 13 bp, Homo sapiens
ctgactgacatga

SEQ ID NO: 6162679 - DNA, 22 bp, Homo sapiens
ctgactgagacacgatgccgag

SEQ ID NO: 6162680 - DNA, 12 bp, Homo sapiens
ctgactgaggcc

SEQ ID NO: 6162681 - DNA, 13 bp, Homo sapiens
ctgactgaggcct

SEQ ID NO: 6162682 - DNA, 14 bp, Homo sapiens
ctgactgaggcctg

SEQ ID NO: 6162683 - DNA, 18 bp, Homo sapiens
ctgactgaggcctgcttc

SEQ ID NO: 6162684 - DNA, 19 bp, Homo sapiens
ctgactgaggcctgcttcc

SEQ ID NO: 6162685 - DNA, 13 bp, Homo sapiens
ctgactgatcctg

SEQ ID NO: 6162686 - DNA, 22 bp, Homo sapiens
ctgactgatcctgaacaagaaa

SEQ ID NO: 6162687 - DNA, 23 bp, Homo sapiens
ctgactgatggtttggaaaataa

SEQ ID NO: 6162688 - DNA, 21 bp, Homo sapiens
ctgactgattccttctctgga

SEQ ID NO: 6162689 - DNA, 21 bp, Homo sapiens
ctgactgcaacttctgtccct

SEQ ID NO: 6162690 - DNA, 15 bp, Homo sapiens
ctgactgcacacagc

SEQ ID NO: 6162691 - DNA, 23 bp, Homo sapiens
ctgactgcactgttgctgactac

SEQ ID NO: 6162692 - DNA, 15 bp, Homo sapiens
ctgactgccaagcca

SEQ ID NO: 6162693 - DNA, 15 bp, Homo sapiens
ctgactgccaggacc

SEQ ID NO: 6162694 - DNA, 15 bp, Homo sapiens
ctgactgcccagcat

SEQ ID NO: 6162695 - DNA, 16 bp, Homo sapiens
ctgactgccctccgaa

SEQ ID NO: 6162696 - DNA, 14 bp, Homo sapiens
ctgactgctcagaa

SEQ ID NO: 6162697 - DNA, 21 bp, Homo sapiens
ctgactgctcagaacttgctg

SEQ ID NO: 6162698 - DNA, 18 bp, Homo sapiens
ctgactggaggaggcctg

SEQ ID NO: 6162699 - DNA, 20 bp, Homo sapiens
ctgactggatggtccagtgt

SEQ ID NO: 6162700 - DNA, 15 bp, Homo sapiens
ctgactggccagttg

SEQ ID NO: 6162701 - DNA, 21 bp, Homo sapiens
ctgactggccagttgcccaga

SEQ ID NO: 6162702 - DNA, 23 bp, Homo sapiens
ctgactggccagttgcccagagc

SEQ ID NO: 6162703 - DNA, 22 bp, Homo sapiens
ctgactggccccagggactctt

SEQ ID NO: 6162704 - DNA, 18 bp, Homo sapiens
ctgactgggaccaggcac

SEQ ID NO: 6162705 - DNA, 19 bp, Homo sapiens
ctgactgggactcccagct

SEQ ID NO: 6162706 - DNA, 23 bp, Homo sapiens
ctgactgggctgggtttgctgtc

SEQ ID NO: 6162707 - DNA, 16 bp, Homo sapiens
ctgactggggctgggg

SEQ ID NO: 6162708 - DNA, 18 bp, Homo sapiens
ctgactggggctggggtg

SEQ ID NO: 6162709 - DNA, 15 bp, Homo sapiens
ctgactgggggcaga

SEQ ID NO: 6162710 - DNA, 17 bp, Homo sapiens
ctgactgggggcagaca

SEQ ID NO: 6162711 - DNA, 21 bp, Homo sapiens
ctgactgggggcctctgcctc

SEQ ID NO: 6162712 - DNA, 22 bp, Homo sapiens
ctgactggtgctataggctgga

SEQ ID NO: 6162713 - DNA, 14 bp, Homo sapiens
ctgactggttgtca

SEQ ID NO: 6162714 - DNA, 17 bp, Homo sapiens
ctgactggttgtcagaa

SEQ ID NO: 6162715 - DNA, 19 bp, Homo sapiens
ctgactggttgtcagaatg

SEQ ID NO: 6162716 - DNA, 21 bp, Homo sapiens
ctgactggtttctcctggtag

SEQ ID NO: 6162717 - DNA, 15 bp, Homo sapiens
ctgactgtaacgatt

SEQ ID NO: 6162718 - DNA, 18 bp, Homo sapiens
ctgactgtagctttggaa

SEQ ID NO: 6162719 - DNA, 17 bp, Homo sapiens
ctgactgtccaggagct

SEQ ID NO: 6162720 - DNA, 16 bp, Homo sapiens
ctgactgtccctgcca

SEQ ID NO: 6162721 - DNA, 17 bp, Homo sapiens
ctgactgtccctgccaa

SEQ ID NO: 6162722 - DNA, 16 bp, Homo sapiens
ctgactgtcctctccc

SEQ ID NO: 6162723 - DNA, 22 bp, Homo sapiens
ctgactgtcctctcccctccag

SEQ ID NO: 6162724 - DNA, 21 bp, Homo sapiens
ctgactgtcgggctttaaaaa

SEQ ID NO: 6162725 - DNA, 18 bp, Homo sapiens
ctgactgtgttcagtgcc

SEQ ID NO: 6162726 - DNA, 22 bp, Homo sapiens
ctgactgtgttgggcaagacct

SEQ ID NO: 6162727 - DNA, 23 bp, Homo sapiens
ctgactgtgttgggcaagacctc

SEQ ID NO: 6162728 - DNA, 16 bp, Homo sapiens
ctgactgttctcttac

SEQ ID NO: 6162729 - DNA, 17 bp, Homo sapiens
ctgactgttctcttact

SEQ ID NO: 6162730 - DNA, 15 bp, Homo sapiens
ctgactgttggctct

SEQ ID NO: 6162731 - DNA, 21 bp, Homo sapiens
ctgactgtttacacctttccg

SEQ ID NO: 6162732 - DNA, 18 bp, Homo sapiens
ctgactgtttcattcact

SEQ ID NO: 6162733 - DNA, 22 bp, Homo sapiens
ctgactgtttcattcactgtgc

SEQ ID NO: 6162734 - DNA, 18 bp, Homo sapiens
ctgactgttttctcttga

SEQ ID NO: 6162735 - DNA, 19 bp, Homo sapiens
ctgactgttttttttgcag

SEQ ID NO: 6162736 - DNA, 22 bp, Homo sapiens
ctgacttaactttaacttttga

SEQ ID NO: 6162737 - DNA, 19 bp, Homo sapiens
ctgacttaagcaaaagaaa

SEQ ID NO: 6162738 - DNA, 12 bp, Homo sapiens
ctgacttagaat

SEQ ID NO: 6162739 - DNA, 12 bp, Homo sapiens
ctgacttagcct

SEQ ID NO: 6162740 - DNA, 13 bp, Homo sapiens
ctgacttagccta

SEQ ID NO: 6162741 - DNA, 23 bp, Homo sapiens
ctgacttatggcatgactcttca

SEQ ID NO: 6162742 - DNA, 13 bp, Homo sapiens
ctgacttcactag

SEQ ID NO: 6162743 - DNA, 21 bp, Homo sapiens
ctgacttcaggggctgcccgc

SEQ ID NO: 6162744 - DNA, 22 bp, Homo sapiens
ctgacttcagtgaatatttttg

SEQ ID NO: 6162745 - DNA, 16 bp, Homo sapiens
ctgacttcagtgggac

SEQ ID NO: 6162746 - DNA, 17 bp, Homo sapiens
ctgacttcatctcccac

SEQ ID NO: 6162747 - DNA, 13 bp, Homo sapiens
ctgacttcatctg

SEQ ID NO: 6162748 - DNA, 20 bp, Homo sapiens
ctgacttcatggaatggaca

SEQ ID NO: 6162749 - DNA, 22 bp, Homo sapiens
ctgacttcatggaatggacatc

SEQ ID NO: 6162750 - DNA, 16 bp, Homo sapiens
ctgacttcatttgtgc

SEQ ID NO: 6162751 - DNA, 13 bp, Homo sapiens
ctgacttcccagc

SEQ ID NO: 6162752 - DNA, 16 bp, Homo sapiens
ctgacttcccagctgg

SEQ ID NO: 6162753 - DNA, 18 bp, Homo sapiens
ctgacttcccagctggca

SEQ ID NO: 6162754 - DNA, 22 bp, Homo sapiens
ctgacttccccaaacccagaaa

SEQ ID NO: 6162755 - DNA, 16 bp, Homo sapiens
ctgacttcctctgatt

SEQ ID NO: 6162756 - DNA, 18 bp, Homo sapiens
ctgacttctagctgtctg

SEQ ID NO: 6162757 - DNA, 19 bp, Homo sapiens
ctgacttctagctgtctgt

SEQ ID NO: 6162758 - DNA, 20 bp, Homo sapiens
ctgacttctagctgtctgtg

SEQ ID NO: 6162759 - DNA, 13 bp, Homo sapiens
ctgacttctcact

SEQ ID NO: 6162760 - DNA, 14 bp, Homo sapiens
ctgacttctccagg

SEQ ID NO: 6162761 - DNA, 15 bp, Homo sapiens
ctgacttctccagga

SEQ ID NO: 6162762 - DNA, 16 bp, Homo sapiens
ctgacttctccaggac

SEQ ID NO: 6162763 - DNA, 15 bp, Homo sapiens
ctgacttctcccccg

SEQ ID NO: 6162764 - DNA, 16 bp, Homo sapiens
ctgacttctcccccgc

SEQ ID NO: 6162765 - DNA, 14 bp, Homo sapiens
ctgacttctctgaa

SEQ ID NO: 6162766 - DNA, 14 bp, Homo sapiens
ctgacttctgcctg

SEQ ID NO: 6162767 - DNA, 15 bp, Homo sapiens
ctgacttctgcctgg

SEQ ID NO: 6162768 - DNA, 14 bp, Homo sapiens
ctgacttgagccac

SEQ ID NO: 6162769 - DNA, 17 bp, Homo sapiens
ctgacttgagccactcc

SEQ ID NO: 6162770 - DNA, 19 bp, Homo sapiens
ctgacttgagccactcctt

SEQ ID NO: 6162771 - DNA, 13 bp, Homo sapiens
ctgacttgagtgt

SEQ ID NO: 6162772 - DNA, 14 bp, Homo sapiens
ctgacttgagtgtt

SEQ ID NO: 6162773 - DNA, 21 bp, Homo sapiens
ctgacttgagtgttccttttt

SEQ ID NO: 6162774 - DNA, 16 bp, Homo sapiens
ctgacttgctgtgtga

SEQ ID NO: 6162775 - DNA, 12 bp, Homo sapiens
ctgacttgcttt

SEQ ID NO: 6162776 - DNA, 13 bp, Homo sapiens
ctgacttgcttta

SEQ ID NO: 6162777 - DNA, 20 bp, Homo sapiens
ctgacttggatcccaaagca

SEQ ID NO: 6162778 - DNA, 16 bp, Homo sapiens
ctgacttggcacttaa

SEQ ID NO: 6162779 - DNA, 15 bp, Homo sapiens
ctgacttggctggtg

SEQ ID NO: 6162780 - DNA, 16 bp, Homo sapiens
ctgacttggctggtgt

SEQ ID NO: 6162781 - DNA, 20 bp, Homo sapiens
ctgacttggctggtgtggta

SEQ ID NO: 6162782 - DNA, 19 bp, Homo sapiens
ctgacttggggaccttttg

SEQ ID NO: 6162783 - DNA, 20 bp, Homo sapiens
ctgacttggggagatggagt

SEQ ID NO: 6162784 - DNA, 13 bp, Homo sapiens
ctgacttggggga

SEQ ID NO: 6162785 - DNA, 15 bp, Homo sapiens
ctgacttgtttgtct

SEQ ID NO: 6162786 - DNA, 20 bp, Homo sapiens
ctgacttgtttgtcttccat

SEQ ID NO: 6162787 - DNA, 22 bp, Homo sapiens
ctgactttcatttcttgaggta

SEQ ID NO: 6162788 - DNA, 13 bp, Homo sapiens
ctgactttctccc

SEQ ID NO: 6162789 - DNA, 16 bp, Homo sapiens
ctgactttctcttcta

SEQ ID NO: 6162790 - DNA, 16 bp, Homo sapiens
ctgactttgaatttat

SEQ ID NO: 6162791 - DNA, 22 bp, Homo sapiens
ctgactttgaatttatataaag

SEQ ID NO: 6162792 - DNA, 22 bp, Homo sapiens
ctgactttgcccccttgcccat

SEQ ID NO: 6162793 - DNA, 14 bp, Homo sapiens
ctgactttgctctt

SEQ ID NO: 6162794 - DNA, 15 bp, Homo sapiens
ctgactttgctcttt

SEQ ID NO: 6162795 - DNA, 16 bp, Homo sapiens
ctgactttgctctttc

SEQ ID NO: 6162796 - DNA, 15 bp, Homo sapiens
ctgactttgcttgct

SEQ ID NO: 6162797 - DNA, 16 bp, Homo sapiens
ctgactttgcttgctt

SEQ ID NO: 6162798 - DNA, 19 bp, Homo sapiens
ctgactttgcttgctttga

SEQ ID NO: 6162799 - DNA, 21 bp, Homo sapiens
ctgactttggagacgatgctt

SEQ ID NO: 6162800 - DNA, 18 bp, Homo sapiens
ctgactttggtttttcca

SEQ ID NO: 6162801 - DNA, 22 bp, Homo sapiens
ctgactttgttgccttatcttg

SEQ ID NO: 6162802 - DNA, 21 bp, Homo sapiens
ctgacttttaatgtcatttgt

SEQ ID NO: 6162803 - DNA, 15 bp, Homo sapiens
ctgacttttacagct

SEQ ID NO: 6162804 - DNA, 17 bp, Homo sapiens
ctgacttttctttttaa

SEQ ID NO: 6162805 - DNA, 13 bp, Homo sapiens
ctgactttttcca

SEQ ID NO: 6162806 - DNA, 16 bp, Homo sapiens
ctgactttttcccccc

SEQ ID NO: 6162807 - DNA, 17 bp, Homo sapiens
ctgactttttcccccca

SEQ ID NO: 6162808 - DNA, 17 bp, Homo sapiens
ctgactttttgtttctt

SEQ ID NO: 6162809 - DNA, 22 bp, Homo sapiens
ctgagaaaacgaaactgctcta

SEQ ID NO: 6162810 - DNA, 17 bp, Homo sapiens
ctgtgattaacttgctt

SEQ ID NO: 6162811 - DNA, 18 bp, Homo sapiens
ctgtgattaacttgctta

SEQ ID NO: 6162812 - DNA, 12 bp, Homo sapiens
ctgtgattaatt

SEQ ID NO: 6162813 - DNA, 12 bp, Homo sapiens
ctgtgattacat

SEQ ID NO: 6162814 - DNA, 15 bp, Homo sapiens
ctgtgattacctctc

SEQ ID NO: 6162815 - DNA, 23 bp, Homo sapiens
ctgtgattactgcaatcactgtg

SEQ ID NO: 6162816 - DNA, 16 bp, Homo sapiens
ctgtgattagatcaca

SEQ ID NO: 6162817 - DNA, 14 bp, Homo sapiens
ctgtgattcatatg

SEQ ID NO: 6162818 - DNA, 22 bp, Homo sapiens
ctgtgatttatttggagtggag

SEQ ID NO: 6162819 - DNA, 19 bp, Homo sapiens
ctgtgatttcttctccctc

SEQ ID NO: 6162820 - DNA, 15 bp, Homo sapiens
ctgtgattttaaaat

SEQ ID NO: 6162821 - DNA, 18 bp, Homo sapiens
ctgtgattttaagacaag

SEQ ID NO: 6162822 - DNA, 17 bp, Homo sapiens
ctgtgattttgccctcc

SEQ ID NO: 6162823 - DNA, 23 bp, Homo sapiens
ctgtgattttgccctcctgccca

SEQ ID NO: 6162824 - DNA, 16 bp, Homo sapiens
ctgtgatttttatcac

SEQ ID NO: 6162825 - DNA, 16 bp, Homo sapiens
ctgtgcaaacagtaac

SEQ ID NO: 6162826 - DNA, 15 bp, Homo sapiens
ctgtgcaaacagtgt

SEQ ID NO: 6162827 - DNA, 16 bp, Homo sapiens
ctgtgcaaacagtgta

SEQ ID NO: 6162828 - DNA, 19 bp, Homo sapiens
ctgtgcaacggtctcctga

SEQ ID NO: 6162829 - DNA, 11 bp, Homo sapiens
ctgtgcaataa

SEQ ID NO: 6162830 - DNA, 13 bp, Homo sapiens
ctgtgcaataaaa

SEQ ID NO: 6162831 - DNA, 19 bp, Homo sapiens
ctgtgcaattcagtctgct

SEQ ID NO: 6162832 - DNA, 19 bp, Homo sapiens
ctgtgcaatttctgtacat

SEQ ID NO: 6162833 - DNA, 20 bp, Homo sapiens
ctgtgcacaaaacccagacc

SEQ ID NO: 6162834 - DNA, 22 bp, Homo sapiens
ctgtgcacaaaacccagacctg

SEQ ID NO: 6162835 - DNA, 17 bp, Homo sapiens
ctgtgcacacccacctt

SEQ ID NO: 6162836 - DNA, 12 bp, Homo sapiens
ctgtgcacagcc

SEQ ID NO: 6162837 - DNA, 16 bp, Homo sapiens
ctgtgcacagtggctt

SEQ ID NO: 6162838 - DNA, 14 bp, Homo sapiens
ctgtgcacatgcct

SEQ ID NO: 6162839 - DNA, 16 bp, Homo sapiens
ctgtgcacatgcctct

SEQ ID NO: 6162840 - DNA, 17 bp, Homo sapiens
ctgtgcacatgcctctg

SEQ ID NO: 6162841 - DNA, 22 bp, Homo sapiens
ctgtgcacatgcctctgtagag

SEQ ID NO: 6162842 - DNA, 18 bp, Homo sapiens
ctgtgcacattctccctt

SEQ ID NO: 6162843 - DNA, 20 bp, Homo sapiens
ctgtgcaccacttgacagac

SEQ ID NO: 6162844 - DNA, 15 bp, Homo sapiens
ctgtgcaccaggcac

SEQ ID NO: 6162845 - DNA, 19 bp, Homo sapiens
ctgtgcacccagaagaaga

SEQ ID NO: 6162846 - DNA, 17 bp, Homo sapiens
ctgtgcacccgtgccac

SEQ ID NO: 6162847 - DNA, 17 bp, Homo sapiens
ctgtgcacctattctgt

SEQ ID NO: 6162848 - DNA, 18 bp, Homo sapiens
ctgtgcacctattctgta

SEQ ID NO: 6162849 - DNA, 21 bp, Homo sapiens
ctgtgcacggccagctgcatc

SEQ ID NO: 6162850 - DNA, 16 bp, Homo sapiens
ctgtgcactagcctgt

SEQ ID NO: 6162851 - DNA, 21 bp, Homo sapiens
ctgtgcactagcctgtgatta

SEQ ID NO: 6162852 - DNA, 16 bp, Homo sapiens
ctgtgcactgggcagg

SEQ ID NO: 6162853 - DNA, 17 bp, Homo sapiens
ctgtgcactgggcaggt

SEQ ID NO: 6162854 - DNA, 21 bp, Homo sapiens
ctgtgcactgggcaggttcct

SEQ ID NO: 6162855 - DNA, 15 bp, Homo sapiens
ctgtgcacttagcca

SEQ ID NO: 6162856 - DNA, 19 bp, Homo sapiens
ctgtgcagaaggtctggtc

SEQ ID NO: 6162857 - DNA, 13 bp, Homo sapiens
ctgtgcagaataa

SEQ ID NO: 6162858 - DNA, 14 bp, Homo sapiens
ctgtgcagaataat

SEQ ID NO: 6162859 - DNA, 13 bp, Homo sapiens
ctgtgcagaccca

SEQ ID NO: 6162860 - DNA, 12 bp, Homo sapiens
ctgtgcagagac

SEQ ID NO: 6162861 - DNA, 13 bp, Homo sapiens
ctgtgcagagact

SEQ ID NO: 6162862 - DNA, 15 bp, Homo sapiens
ctgtgcagagacttt

SEQ ID NO: 6162863 - DNA, 20 bp, Homo sapiens
ctgtgcagagatgactgtcc

SEQ ID NO: 6162864 - DNA, 23 bp, Homo sapiens
ctgtgcagaggaaacttaagcat

SEQ ID NO: 6162865 - DNA, 13 bp, Homo sapiens
ctgtgcagatgct

SEQ ID NO: 6162866 - DNA, 16 bp, Homo sapiens
ctgtgcagcacgtctc

SEQ ID NO: 6162867 - DNA, 14 bp, Homo sapiens
ctgtgcagccgggg

SEQ ID NO: 6162868 - DNA, 23 bp, Homo sapiens
ctgtgcagccggggagctgaggg

SEQ ID NO: 6162869 - DNA, 14 bp, Homo sapiens
ctgtgcaggcccag

SEQ ID NO: 6162870 - DNA, 16 bp, Homo sapiens
ctgtgcaggcccaggc

SEQ ID NO: 6162871 - DNA, 21 bp, Homo sapiens
ctgtgcaggcccaggcaggcc

SEQ ID NO: 6162872 - DNA, 13 bp, Homo sapiens
ctgtgcaggcctg

SEQ ID NO: 6162873 - DNA, 19 bp, Homo sapiens
ctgtgcaggcctgtccctg

SEQ ID NO: 6162874 - DNA, 20 bp, Homo sapiens
ctgtgcaggcctgtccctgg

SEQ ID NO: 6162875 - DNA, 21 bp, Homo sapiens
ctgtgcaggcctgtccctggg

SEQ ID NO: 6162876 - DNA, 23 bp, Homo sapiens
ctgtgcaggcctgtccctgggag

SEQ ID NO: 6162877 - DNA, 23 bp, Homo sapiens
ctgtgcaggctgcagtggctccc

SEQ ID NO: 6162878 - DNA, 15 bp, Homo sapiens
ctgtgcagggaggag

SEQ ID NO: 6162879 - DNA, 15 bp, Homo sapiens
ctgtgcagggcacag

SEQ ID NO: 6162880 - DNA, 16 bp, Homo sapiens
ctgtgcagggcacaga

SEQ ID NO: 6162881 - DNA, 17 bp, Homo sapiens
ctgtgcagggccctctg

SEQ ID NO: 6162882 - DNA, 22 bp, Homo sapiens
ctgtgcagggccctctggggct

SEQ ID NO: 6162883 - DNA, 17 bp, Homo sapiens
ctgtgcagggctggttt

SEQ ID NO: 6162884 - DNA, 18 bp, Homo sapiens
ctgtgcagggctggtttg

SEQ ID NO: 6162885 - DNA, 13 bp, Homo sapiens
ctgtgcaggtgct

SEQ ID NO: 6162886 - DNA, 15 bp, Homo sapiens
ctgtgcaggtgctgc

SEQ ID NO: 6162887 - DNA, 17 bp, Homo sapiens
ctgtgcaggtgctgcct

SEQ ID NO: 6162888 - DNA, 17 bp, Homo sapiens
ctgtgcaggttcccact

SEQ ID NO: 6162889 - DNA, 16 bp, Homo sapiens
ctgtgcagtcactgga

SEQ ID NO: 6162890 - DNA, 19 bp, Homo sapiens
ctgtgcagtcccgtggagg

SEQ ID NO: 6162891 - DNA, 21 bp, Homo sapiens
ctgtgcagtcccgtggagggt

SEQ ID NO: 6162892 - DNA, 16 bp, Homo sapiens
ctgtgcagtcctgggt

SEQ ID NO: 6162893 - DNA, 11 bp, Homo sapiens
ctgtgcagtga

SEQ ID NO: 6162894 - DNA, 22 bp, Homo sapiens
ctgtgcagtttggtatgaaaca

SEQ ID NO: 6162895 - DNA, 19 bp, Homo sapiens
ctgtgcatcaaccaggaag

SEQ ID NO: 6162896 - DNA, 20 bp, Homo sapiens
ctgtgcatcaaccaggaaga

SEQ ID NO: 6162897 - DNA, 15 bp, Homo sapiens
ctgtgcatgtatgtc

SEQ ID NO: 6162898 - DNA, 15 bp, Homo sapiens
ctgtgcatgtgcagg

SEQ ID NO: 6162899 - DNA, 15 bp, Homo sapiens
ctgtgcattacaaag

SEQ ID NO: 6162900 - DNA, 17 bp, Homo sapiens
ctgtgcattacaaagtt

SEQ ID NO: 6162901 - DNA, 15 bp, Homo sapiens
ctgtgcattagatat

SEQ ID NO: 6162902 - DNA, 19 bp, Homo sapiens
ctgtgcattcatgcaagag

SEQ ID NO: 6162903 - DNA, 15 bp, Homo sapiens
ctgtgcattctcctg

SEQ ID NO: 6162904 - DNA, 20 bp, Homo sapiens
ctgtgcattctcctggatgc

SEQ ID NO: 6162905 - DNA, 21 bp, Homo sapiens
ctgtgccaagatttaaaatta

SEQ ID NO: 6162906 - DNA, 14 bp, Homo sapiens
ctgtgccaagggca

SEQ ID NO: 6162907 - DNA, 16 bp, Homo sapiens
ctgtgccaagggcagg

SEQ ID NO: 6162908 - DNA, 16 bp, Homo sapiens
ctgtgccaccccttcc

SEQ ID NO: 6162909 - DNA, 13 bp, Homo sapiens
ctgtgccaccctg

SEQ ID NO: 6162910 - DNA, 16 bp, Homo sapiens
ctgtgccaccctgggc

SEQ ID NO: 6162911 - DNA, 22 bp, Homo sapiens
ctgtgccaccctgggctctgtg

SEQ ID NO: 6162912 - DNA, 21 bp, Homo sapiens
ctgtgccacctgcaagtgccc

SEQ ID NO: 6162913 - DNA, 21 bp, Homo sapiens
ctgtgccactcaccgaagcca

SEQ ID NO: 6162914 - DNA, 20 bp, Homo sapiens
ctgtgccactgacttgctgt

SEQ ID NO: 6162915 - DNA, 20 bp, Homo sapiens
ctgtgccactttgactcaga

SEQ ID NO: 6162916 - DNA, 22 bp, Homo sapiens
ctgtgccactttgactcagagg

SEQ ID NO: 6162917 - DNA, 18 bp, Homo sapiens
ctgtgccagagcctgggg

SEQ ID NO: 6162918 - DNA, 13 bp, Homo sapiens
ctgtgccagaggc

SEQ ID NO: 6162919 - DNA, 11 bp, Homo sapiens
ctgtgccagca

SEQ ID NO: 6162920 - DNA, 16 bp, Homo sapiens
ctgtgccagcaccaca

SEQ ID NO: 6162921 - DNA, 20 bp, Homo sapiens
ctgtgccagcaccacagccg

SEQ ID NO: 6162922 - DNA, 12 bp, Homo sapiens
ctgtgccagctc

SEQ ID NO: 6162923 - DNA, 13 bp, Homo sapiens
ctgtgccagctca

SEQ ID NO: 6162924 - DNA, 16 bp, Homo sapiens
ctgtgccagctgcttc

SEQ ID NO: 6162925 - DNA, 17 bp, Homo sapiens
ctgtgccagctgcttct

SEQ ID NO: 6162926 - DNA, 18 bp, Homo sapiens
ctgtgccagctgcttctg

SEQ ID NO: 6162927 - DNA, 19 bp, Homo sapiens
ctgtgccagctgcttctgc

SEQ ID NO: 6162928 - DNA, 23 bp, Homo sapiens
ctgtgccagctgcttctgcccac

SEQ ID NO: 6162929 - DNA, 18 bp, Homo sapiens
ctgtgccaggactgtgac

SEQ ID NO: 6162930 - DNA, 21 bp, Homo sapiens
ctgtgccaggactgtgactca

SEQ ID NO: 6162931 - DNA, 23 bp, Homo sapiens
ctgtgccaggactgtgactcatt

SEQ ID NO: 6162932 - DNA, 23 bp, Homo sapiens
ctgtgccaggcgaggcccttggc

SEQ ID NO: 6162933 - DNA, 13 bp, Homo sapiens
ctgtgccaggctg

SEQ ID NO: 6162934 - DNA, 14 bp, Homo sapiens
ctgtgccaggctgg

SEQ ID NO: 6162935 - DNA, 15 bp, Homo sapiens
ctgtgccaggctggg

SEQ ID NO: 6162936 - DNA, 18 bp, Homo sapiens
ctgtgccaggctgggagg

SEQ ID NO: 6162937 - DNA, 17 bp, Homo sapiens
ctgtgccagggcagcat

SEQ ID NO: 6162938 - DNA, 14 bp, Homo sapiens
ctgtgccaggtgaa

SEQ ID NO: 6162939 - DNA, 22 bp, Homo sapiens
ctgtgccatacttgttctgtat

SEQ ID NO: 6162940 - DNA, 12 bp, Homo sapiens
ctgtgccatgcc

SEQ ID NO: 6162941 - DNA, 14 bp, Homo sapiens
ctgtgccatgccca

SEQ ID NO: 6162942 - DNA, 14 bp, Homo sapiens
ctgtgccatgctgg

SEQ ID NO: 6162943 - DNA, 16 bp, Homo sapiens
ctgtgccatgctgggc

SEQ ID NO: 6162944 - DNA, 22 bp, Homo sapiens
ctgtgccatggatgattctttt

SEQ ID NO: 6162945 - DNA, 23 bp, Homo sapiens
ctgtgccatggccccccactccc

SEQ ID NO: 6162946 - DNA, 15 bp, Homo sapiens
ctgtgccatgtgcca

SEQ ID NO: 6162947 - DNA, 16 bp, Homo sapiens
ctgtgccatgtgccag

SEQ ID NO: 6162948 - DNA, 18 bp, Homo sapiens
ctgtgccatttctcaggg

SEQ ID NO: 6162949 - DNA, 18 bp, Homo sapiens
ctgtgccattttctgtaa

SEQ ID NO: 6162950 - DNA, 19 bp, Homo sapiens
ctgtgccattttctgtaaa

SEQ ID NO: 6162951 - DNA, 23 bp, Homo sapiens
ctgtgcccaagtgggtccaagtg

SEQ ID NO: 6162952 - DNA, 19 bp, Homo sapiens
ctgtgcccacatcccaggc

SEQ ID NO: 6162953 - DNA, 18 bp, Homo sapiens
ctgtgcccacccagggcc

SEQ ID NO: 6162954 - DNA, 20 bp, Homo sapiens
ctgtgcccacggtctgagct

SEQ ID NO: 6162955 - DNA, 19 bp, Homo sapiens
ctgtgcccagaatactgat

SEQ ID NO: 6162956 - DNA, 17 bp, Homo sapiens
ctgtgcccagcaggccc

SEQ ID NO: 6162957 - DNA, 21 bp, Homo sapiens
ctgtgcccagcagtttcccag

SEQ ID NO: 6162958 - DNA, 15 bp, Homo sapiens
ctgtgcccagctcag

SEQ ID NO: 6162959 - DNA, 16 bp, Homo sapiens
ctgtgcccagctcagt

SEQ ID NO: 6162960 - DNA, 13 bp, Homo sapiens
ctgtgcccatggg

SEQ ID NO: 6162961 - DNA, 20 bp, Homo sapiens
ctgtgcccatgggcactgct

SEQ ID NO: 6162962 - DNA, 14 bp, Homo sapiens
ctgtgccccagctg

SEQ ID NO: 6162963 - DNA, 18 bp, Homo sapiens
ctgtgccccatcagcagc

SEQ ID NO: 6162964 - DNA, 20 bp, Homo sapiens
ctgtgccccatcagcagctt

SEQ ID NO: 6162965 - DNA, 18 bp, Homo sapiens
ctgtgcccccagcctcag

SEQ ID NO: 6162966 - DNA, 21 bp, Homo sapiens
ctgtgcccccagcctcagccc

SEQ ID NO: 6162967 - DNA, 14 bp, Homo sapiens
ctgtgcccccaggg

SEQ ID NO: 6162968 - DNA, 18 bp, Homo sapiens
ctgtgccccgaccccacc

SEQ ID NO: 6162969 - DNA, 19 bp, Homo sapiens
ctgtgccccgaccccacct

SEQ ID NO: 6162970 - DNA, 15 bp, Homo sapiens
ctgtgccccgcctcc

SEQ ID NO: 6162971 - DNA, 20 bp, Homo sapiens
ctgtgccccgcctcccgggg

SEQ ID NO: 6162972 - DNA, 21 bp, Homo sapiens
ctgtgcccctgatgcagcctg

SEQ ID NO: 6162973 - DNA, 15 bp, Homo sapiens
ctgtgcccctggcct

SEQ ID NO: 6162974 - DNA, 18 bp, Homo sapiens
ctgtgcccctggccttgg

SEQ ID NO: 6162975 - DNA, 16 bp, Homo sapiens
ctgtgcccctgtaaat

SEQ ID NO: 6162976 - DNA, 19 bp, Homo sapiens
ctgtgcccctgtaaatagt

SEQ ID NO: 6162977 - DNA, 18 bp, Homo sapiens
ctgtgccccttccgccac

SEQ ID NO: 6162978 - DNA, 20 bp, Homo sapiens
ctgtgccccttccgccactg

SEQ ID NO: 6162979 - DNA, 20 bp, Homo sapiens
ctgtgccccttgacaactgg

SEQ ID NO: 6162980 - DNA, 21 bp, Homo sapiens
ctgtgcccgaggttcctgtca

SEQ ID NO: 6162981 - DNA, 17 bp, Homo sapiens
ctgtgcccgccctgggc

SEQ ID NO: 6162982 - DNA, 21 bp, Homo sapiens
ctgtgcccgccctgggctggg

SEQ ID NO: 6162983 - DNA, 16 bp, Homo sapiens
ctgtgcccgctgcgct

SEQ ID NO: 6162984 - DNA, 22 bp, Homo sapiens
ctgtgcccgctgcgctgccctg

SEQ ID NO: 6162985 - DNA, 23 bp, Homo sapiens
ctgtgcccgctgcgctgccctgc

SEQ ID NO: 6162986 - DNA, 21 bp, Homo sapiens
ctgtgcccggtgccatcttcc

SEQ ID NO: 6162987 - DNA, 13 bp, Homo sapiens
ctgtgccctcacc

SEQ ID NO: 6162988 - DNA, 13 bp, Homo sapiens
ctgagaaaagaac

SEQ ID NO: 6162989 - DNA, 18 bp, Homo sapiens
ctgagaaacccaccagcc

SEQ ID NO: 6162990 - DNA, 23 bp, Homo sapiens
ctgagaaacccaccagcctaaga

SEQ ID NO: 6162991 - DNA, 12 bp, Homo sapiens
ctgagaaagact

SEQ ID NO: 6162992 - DNA, 17 bp, Homo sapiens
ctgagaaagaggcaggg

SEQ ID NO: 6162993 - DNA, 16 bp, Homo sapiens
ctgagaaagctcaaag

SEQ ID NO: 6162994 - DNA, 19 bp, Homo sapiens
ctgagaaagtatgccccac

SEQ ID NO: 6162995 - DNA, 19 bp, Homo sapiens
ctgagaaataggtatcaaa

SEQ ID NO: 6162996 - DNA, 14 bp, Homo sapiens
ctgagaaattatta

SEQ ID NO: 6162997 - DNA, 15 bp, Homo sapiens
ctgagaaattgaatg

SEQ ID NO: 6162998 - DNA, 18 bp, Homo sapiens
ctgagaacacgttgccag

SEQ ID NO: 6162999 - DNA, 20 bp, Homo sapiens
ctgagaaccaaaagatgcct

SEQ ID NO: 6163000 - DNA, 15 bp, Homo sapiens
ctgagaaccacggtg

SEQ ID NO: 6163001 - DNA, 20 bp, Homo sapiens
ctgagaaccataggactgtg

SEQ ID NO: 6163002 - DNA, 23 bp, Homo sapiens
ctgagaaccataggactgtggca

SEQ ID NO: 6163003 - DNA, 14 bp, Homo sapiens
ctgagaacctggcc

SEQ ID NO: 6163004 - DNA, 16 bp, Homo sapiens
ctgagaacctggcctt

SEQ ID NO: 6163005 - DNA, 13 bp, Homo sapiens
ctgagaactcctg

SEQ ID NO: 6163006 - DNA, 14 bp, Homo sapiens
ctgagaactcctga

SEQ ID NO: 6163007 - DNA, 11 bp, Homo sapiens
ctgagaagaag

SEQ ID NO: 6163008 - DNA, 20 bp, Homo sapiens
ctgagaagaatgaaaatgca

SEQ ID NO: 6163009 - DNA, 18 bp, Homo sapiens
ctgagaagaggagccctc

SEQ ID NO: 6163010 - DNA, 14 bp, Homo sapiens
ctgagaagaggagg

SEQ ID NO: 6163011 - DNA, 19 bp, Homo sapiens
ctgagaagatctaccccag

SEQ ID NO: 6163012 - DNA, 22 bp, Homo sapiens
ctgagaagatggcactgtccag

SEQ ID NO: 6163013 - DNA, 22 bp, Homo sapiens
ctgagaagcctcatgggagtca

SEQ ID NO: 6163014 - DNA, 13 bp, Homo sapiens
ctgagaagcgctg

SEQ ID NO: 6163015 - DNA, 17 bp, Homo sapiens
ctgagaagctgctccag

SEQ ID NO: 6163016 - DNA, 18 bp, Homo sapiens
ctgagaagctgctccagg

SEQ ID NO: 6163017 - DNA, 21 bp, Homo sapiens
ctgagaaggaacagggaacat

SEQ ID NO: 6163018 - DNA, 15 bp, Homo sapiens
ctgagaaggccccag

SEQ ID NO: 6163019 - DNA, 17 bp, Homo sapiens
ctgagaaggccccaggg

SEQ ID NO: 6163020 - DNA, 18 bp, Homo sapiens
ctgagaaggcgaggagag

SEQ ID NO: 6163021 - DNA, 18 bp, Homo sapiens
ctgagaaggggaggacct

SEQ ID NO: 6163022 - DNA, 17 bp, Homo sapiens
ctgagaaggtccttaat

SEQ ID NO: 6163023 - DNA, 18 bp, Homo sapiens
ctgagaagtcaaacattt

SEQ ID NO: 6163024 - DNA, 15 bp, Homo sapiens
ctgagaataagaaag

SEQ ID NO: 6163025 - DNA, 15 bp, Homo sapiens
ctgagaatagaagga

SEQ ID NO: 6163026 - DNA, 17 bp, Homo sapiens
ctgagaatagaaggaaa

SEQ ID NO: 6163027 - DNA, 18 bp, Homo sapiens
ctgagaatagaaggaaac

SEQ ID NO: 6163028 - DNA, 22 bp, Homo sapiens
ctgagaatccccgtgctcacag

SEQ ID NO: 6163029 - DNA, 15 bp, Homo sapiens
ctgagaatctggggg

SEQ ID NO: 6163030 - DNA, 14 bp, Homo sapiens
ctgagaatctttat

SEQ ID NO: 6163031 - DNA, 22 bp, Homo sapiens
ctgagaatctttattgagaaag

SEQ ID NO: 6163032 - DNA, 18 bp, Homo sapiens
ctgagaatgaacaaagac

SEQ ID NO: 6163033 - DNA, 21 bp, Homo sapiens
ctgagaatgcctaggccagct

SEQ ID NO: 6163034 - DNA, 22 bp, Homo sapiens
ctgagaatgcctaggccagctc

SEQ ID NO: 6163035 - DNA, 15 bp, Homo sapiens
ctgagaattccaagg

SEQ ID NO: 6163036 - DNA, 17 bp, Homo sapiens
ctgagaattgaggggag

SEQ ID NO: 6163037 - DNA, 18 bp, Homo sapiens
ctgagaattgaggggagg

SEQ ID NO: 6163038 - DNA, 12 bp, Homo sapiens
ctgagaattgtg

SEQ ID NO: 6163039 - DNA, 17 bp, Homo sapiens
ctgagacacagcccaga

SEQ ID NO: 6163040 - DNA, 21 bp, Homo sapiens
ctgagacacagcccagagact

SEQ ID NO: 6163041 - DNA, 19 bp, Homo sapiens
ctgagacacatgggtgcta

SEQ ID NO: 6163042 - DNA, 17 bp, Homo sapiens
ctgagacagaattaatg

SEQ ID NO: 6163043 - DNA, 14 bp, Homo sapiens
ctgagacagacaca

SEQ ID NO: 6163044 - DNA, 20 bp, Homo sapiens
ctgagacagacacacagcct

SEQ ID NO: 6163045 - DNA, 14 bp, Homo sapiens
ctgagacagcccgg

SEQ ID NO: 6163046 - DNA, 16 bp, Homo sapiens
ctgagacagcccgggc

SEQ ID NO: 6163047 - DNA, 20 bp, Homo sapiens
ctgagacagcccgggctctg

SEQ ID NO: 6163048 - DNA, 21 bp, Homo sapiens
ctgagacagcccgggctctgc

SEQ ID NO: 6163049 - DNA, 22 bp, Homo sapiens
ctgagacagcccgggctctgcc

SEQ ID NO: 6163050 - DNA, 14 bp, Homo sapiens
ctgagacagggtgc

SEQ ID NO: 6163051 - DNA, 22 bp, Homo sapiens
ctgagacaggtgcctaacctgg

SEQ ID NO: 6163052 - DNA, 16 bp, Homo sapiens
ctgagacagtgaattt

SEQ ID NO: 6163053 - DNA, 14 bp, Homo sapiens
ctgagacatccctc

SEQ ID NO: 6163054 - DNA, 23 bp, Homo sapiens
ctgagacatcttgcctacttttc

SEQ ID NO: 6163055 - DNA, 23 bp, Homo sapiens
ctgagaccacccccaaacacaaa

SEQ ID NO: 6163056 - DNA, 17 bp, Homo sapiens
ctgagaccactgagtac

SEQ ID NO: 6163057 - DNA, 14 bp, Homo sapiens
ctgagaccagcctg

SEQ ID NO: 6163058 - DNA, 16 bp, Homo sapiens
ctgagaccagggtggc

SEQ ID NO: 6163059 - DNA, 20 bp, Homo sapiens
ctgagaccagggtggccaca

SEQ ID NO: 6163060 - DNA, 21 bp, Homo sapiens
ctgagaccagggtggccacac

SEQ ID NO: 6163061 - DNA, 24 bp, Homo sapiens
ctgagaccagtgtatcaggtcagg

SEQ ID NO: 6163062 - DNA, 23 bp, Homo sapiens
ctgagaccagttgggagcactgg

SEQ ID NO: 6163063 - DNA, 22 bp, Homo sapiens
ctgagaccatttaacatgcaac

SEQ ID NO: 6163064 - DNA, 14 bp, Homo sapiens
ctgagacccaggac

SEQ ID NO: 6163065 - DNA, 13 bp, Homo sapiens
ctgagacccctgg

SEQ ID NO: 6163066 - DNA, 15 bp, Homo sapiens
ctgagacccctggcc

SEQ ID NO: 6163067 - DNA, 16 bp, Homo sapiens
ctgagacccctggcct

SEQ ID NO: 6163068 - DNA, 19 bp, Homo sapiens
ctgagacccctggcctccg

SEQ ID NO: 6163069 - DNA, 20 bp, Homo sapiens
ctgagaccctgggagagaag

SEQ ID NO: 6163070 - DNA, 18 bp, Homo sapiens
ctgagacccttatttaaa

SEQ ID NO: 6163071 - DNA, 21 bp, Homo sapiens
ctgagacccttttctcaggac

SEQ ID NO: 6163072 - DNA, 14 bp, Homo sapiens
ctgagacctgggat

SEQ ID NO: 6163073 - DNA, 19 bp, Homo sapiens
ctgagacggatggaaggag

SEQ ID NO: 6163074 - DNA, 15 bp, Homo sapiens
ctgagacggcagaga

SEQ ID NO: 6163075 - DNA, 15 bp, Homo sapiens
ctgagactacaggtg

SEQ ID NO: 6163076 - DNA, 20 bp, Homo sapiens
ctgagactacaggtgagtgc

SEQ ID NO: 6163077 - DNA, 20 bp, Homo sapiens
ctgagactataactgtcatc

SEQ ID NO: 6163078 - DNA, 12 bp, Homo sapiens
ctgagactcaca

SEQ ID NO: 6163079 - DNA, 19 bp, Homo sapiens
ctgagactcacactctctg

SEQ ID NO: 6163080 - DNA, 17 bp, Homo sapiens
ctgagactcagacagga

SEQ ID NO: 6163081 - DNA, 21 bp, Homo sapiens
ctgagactcagacaggaaagg

SEQ ID NO: 6163082 - DNA, 21 bp, Homo sapiens
ctgagactccagaatctgctg

SEQ ID NO: 6163083 - DNA, 17 bp, Homo sapiens
ctgagactctcttagga

SEQ ID NO: 6163084 - DNA, 21 bp, Homo sapiens
ctgagactctcttaggagcag

SEQ ID NO: 6163085 - DNA, 18 bp, Homo sapiens
ctgagactctttagagca

SEQ ID NO: 6163086 - DNA, 15 bp, Homo sapiens
ctgagactgcagagg

SEQ ID NO: 6163087 - DNA, 17 bp, Homo sapiens
ctgagactgcagaggag

SEQ ID NO: 6163088 - DNA, 19 bp, Homo sapiens
ctgagactgcagaggagcc

SEQ ID NO: 6163089 - DNA, 16 bp, Homo sapiens
ctgagactgctaagta

SEQ ID NO: 6163090 - DNA, 20 bp, Homo sapiens
ctgagactgggtaatttata

SEQ ID NO: 6163091 - DNA, 22 bp, Homo sapiens
ctgagactgggtaatttataaa

SEQ ID NO: 6163092 - DNA, 20 bp, Homo sapiens
ctgagacttcgaagacccag

SEQ ID NO: 6163093 - DNA, 17 bp, Homo sapiens
ctgagactttcccctct

SEQ ID NO: 6163094 - DNA, 16 bp, Homo sapiens
ctgagagaaggtgaaa

SEQ ID NO: 6163095 - DNA, 14 bp, Homo sapiens
ctgagagaccatct

SEQ ID NO: 6163096 - DNA, 19 bp, Homo sapiens
ctgagagacccaaggagga

SEQ ID NO: 6163097 - DNA, 14 bp, Homo sapiens
ctgagagaccctgg

SEQ ID NO: 6163098 - DNA, 20 bp, Homo sapiens
ctgagagaccctggcctcaa

SEQ ID NO: 6163099 - DNA, 19 bp, Homo sapiens
ctgagagacctgccctctc

SEQ ID NO: 6163100 - DNA, 19 bp, Homo sapiens
ctgagagacctgtgtgaac

SEQ ID NO: 6163101 - DNA, 13 bp, Homo sapiens
ctgagagactttt

SEQ ID NO: 6163102 - DNA, 16 bp, Homo sapiens
ctgagagacttttaat

SEQ ID NO: 6163103 - DNA, 14 bp, Homo sapiens
ctgagagaggccat

SEQ ID NO: 6163104 - DNA, 16 bp, Homo sapiens
ctgagagagtataaat

SEQ ID NO: 6163105 - DNA, 17 bp, Homo sapiens
ctgagagagtataaata

SEQ ID NO: 6163106 - DNA, 14 bp, Homo sapiens
ctgagagagtggca

SEQ ID NO: 6163107 - DNA, 17 bp, Homo sapiens
ctgagagcaaagtgacc

SEQ ID NO: 6163108 - DNA, 17 bp, Homo sapiens
ctgagagcatctcagga

SEQ ID NO: 6163109 - DNA, 20 bp, Homo sapiens
ctgagagcatgtgggggaag

SEQ ID NO: 6163110 - DNA, 23 bp, Homo sapiens
ctgagagcatgtgggggaaggcc

SEQ ID NO: 6163111 - DNA, 14 bp, Homo sapiens
ctgagagccccagc

SEQ ID NO: 6163112 - DNA, 13 bp, Homo sapiens
ctgagagccccca

SEQ ID NO: 6163113 - DNA, 21 bp, Homo sapiens
ctgagagccctgctgtgggag

SEQ ID NO: 6163114 - DNA, 12 bp, Homo sapiens
ctgagagcctgt

SEQ ID NO: 6163115 - DNA, 13 bp, Homo sapiens
ctgagagcctgtg

SEQ ID NO: 6163116 - DNA, 17 bp, Homo sapiens
ctgagagcgagatggga

SEQ ID NO: 6163117 - DNA, 23 bp, Homo sapiens
ctgagagctagtacctatatgct

SEQ ID NO: 6163118 - DNA, 14 bp, Homo sapiens
ctgagagctcacag

SEQ ID NO: 6163119 - DNA, 23 bp, Homo sapiens
ctgagagctctctcttctctgtt

SEQ ID NO: 6163120 - DNA, 13 bp, Homo sapiens
ctgagagctgcct

SEQ ID NO: 6163121 - DNA, 14 bp, Homo sapiens
ctgagagctgctcc

SEQ ID NO: 6163122 - DNA, 14 bp, Homo sapiens
ctgagagctgggct

SEQ ID NO: 6163123 - DNA, 17 bp, Homo sapiens
ctgagagctgtttttga

SEQ ID NO: 6163124 - DNA, 23 bp, Homo sapiens
ctgagagctgtttttgacagcct

SEQ ID NO: 6163125 - DNA, 15 bp, Homo sapiens
ctgagaggaagatga

SEQ ID NO: 6163126 - DNA, 20 bp, Homo sapiens
ctgagaggacagagagaaat

SEQ ID NO: 6163127 - DNA, 21 bp, Homo sapiens
ctgagaggacagagagaaata

SEQ ID NO: 6163128 - DNA, 22 bp, Homo sapiens
ctgagaggacttttctttgtgg

SEQ ID NO: 6163129 - DNA, 19 bp, Homo sapiens
ctgagaggagcgtgtccta

SEQ ID NO: 6163130 - DNA, 15 bp, Homo sapiens
ctgagaggcaccagt

SEQ ID NO: 6163131 - DNA, 17 bp, Homo sapiens
ctgagaggcaggcatag

SEQ ID NO: 6163132 - DNA, 14 bp, Homo sapiens
ctgagaggccctgg

SEQ ID NO: 6163133 - DNA, 15 bp, Homo sapiens
ctgagaggccctgga

SEQ ID NO: 6163134 - DNA, 16 bp, Homo sapiens
ctgagaggccctggat

SEQ ID NO: 6163135 - DNA, 14 bp, Homo sapiens
ctgagaggcctgga

SEQ ID NO: 6163136 - DNA, 17 bp, Homo sapiens
ctgagaggctgcctccg

SEQ ID NO: 6163137 - DNA, 18 bp, Homo sapiens
ctgagagggagagactgc

SEQ ID NO: 6163138 - DNA, 18 bp, Homo sapiens
ctgagagggcaaggaagt

SEQ ID NO: 6163139 - DNA, 16 bp, Homo sapiens
ctgagagggctgtggc

SEQ ID NO: 6163140 - DNA, 21 bp, Homo sapiens
ctgagagggctgtggctgggt

SEQ ID NO: 6163141 - DNA, 20 bp, Homo sapiens
ctgagaggtgtctgccactt

SEQ ID NO: 6163142 - DNA, 17 bp, Homo sapiens
ctgagagtagagtcact

SEQ ID NO: 6163143 - DNA, 14 bp, Homo sapiens
ctgagagtcagctc

SEQ ID NO: 6163144 - DNA, 13 bp, Homo sapiens
ctgagagtcagga

SEQ ID NO: 6163145 - DNA, 15 bp, Homo sapiens
ctgagagtcaggagt

SEQ ID NO: 6163146 - DNA, 15 bp, Homo sapiens
ctgagagtctagagg

SEQ ID NO: 6163147 - DNA, 20 bp, Homo sapiens
ctgagagtctgaaagacaga

SEQ ID NO: 6163148 - DNA, 22 bp, Homo sapiens
ctgagagtctgaaagacagaat

SEQ ID NO: 6163149 - DNA, 17 bp, Homo sapiens
ctgagagtgcaaattgt

SEQ ID NO: 6163150 - DNA, 14 bp, Homo sapiens
ctgagagtggggct

SEQ ID NO: 6163151 - DNA, 22 bp, Homo sapiens
ctgagagtggtgccctggaaca

SEQ ID NO: 6163152 - DNA, 21 bp, Homo sapiens
ctgagagtttcctcagaaccc

SEQ ID NO: 6163153 - DNA, 22 bp, Homo sapiens
ctgagagtttcctcagaaccca

SEQ ID NO: 6163154 - DNA, 19 bp, Homo sapiens
ctgagataagaaaagcctg

SEQ ID NO: 6163155 - DNA, 20 bp, Homo sapiens
ctgagataagaaaagcctga

SEQ ID NO: 6163156 - DNA, 21 bp, Homo sapiens
ctgagataagtaggctggttt

SEQ ID NO: 6163157 - DNA, 17 bp, Homo sapiens
ctgagatacaaggccca

SEQ ID NO: 6163158 - DNA, 20 bp, Homo sapiens
ctgagatacaaggcccagaa

SEQ ID NO: 6163159 - DNA, 22 bp, Homo sapiens
ctgagatacaaggcccagaagc

SEQ ID NO: 6163160 - DNA, 17 bp, Homo sapiens
ctgagatacatacagaa

SEQ ID NO: 6163161 - DNA, 18 bp, Homo sapiens
ctgagataccagcgagga

SEQ ID NO: 6163162 - DNA, 15 bp, Homo sapiens
ctgagatacttccca

SEQ ID NO: 6163163 - DNA, 17 bp, Homo sapiens
ctgagatacttcccaaa

SEQ ID NO: 6163164 - DNA, 18 bp, Homo sapiens
ctgagatagcttagtgtc

SEQ ID NO: 6163165 - DNA, 16 bp, Homo sapiens
ctgagatatgaacata

SEQ ID NO: 6163166 - DNA, 14 bp, Homo sapiens
ctgtgccctcacca

SEQ ID NO: 6163167 - DNA, 17 bp, Homo sapiens
ctgtgccctcaccacca

SEQ ID NO: 6163168 - DNA, 11 bp, Homo sapiens
ctgtgccctct

SEQ ID NO: 6163169 - DNA, 18 bp, Homo sapiens
ctgtgccctctcactgac

SEQ ID NO: 6163170 - DNA, 16 bp, Homo sapiens
ctgtgccctggtggag

SEQ ID NO: 6163171 - DNA, 14 bp, Homo sapiens
ctgtgcccttgctg

SEQ ID NO: 6163172 - DNA, 22 bp, Homo sapiens
ctgtgcccttgctgggtccagg

SEQ ID NO: 6163173 - DNA, 15 bp, Homo sapiens
ctgtgccgaggcttg

SEQ ID NO: 6163174 - DNA, 13 bp, Homo sapiens
ctgtgccgcactc

SEQ ID NO: 6163175 - DNA, 23 bp, Homo sapiens
ctgtgccgcactctggcggtggc

SEQ ID NO: 6163176 - DNA, 19 bp, Homo sapiens
ctgtgccgggaggcagcca

SEQ ID NO: 6163177 - DNA, 13 bp, Homo sapiens
ctgtgcctaataa

SEQ ID NO: 6163178 - DNA, 20 bp, Homo sapiens
ctgtgcctaataaagtctct

SEQ ID NO: 6163179 - DNA, 16 bp, Homo sapiens
ctgtgcctcagagacc

SEQ ID NO: 6163180 - DNA, 19 bp, Homo sapiens
ctgtgcctcagagaccagg

SEQ ID NO: 6163181 - DNA, 14 bp, Homo sapiens
ctgtgcctcaggcc

SEQ ID NO: 6163182 - DNA, 11 bp, Homo sapiens
ctgtgcctccc

SEQ ID NO: 6163183 - DNA, 20 bp, Homo sapiens
ctgtgcctcccaagctcaga

SEQ ID NO: 6163184 - DNA, 16 bp, Homo sapiens
ctgtgcctcccagctt

SEQ ID NO: 6163185 - DNA, 13 bp, Homo sapiens
ctgtgcctccccc

SEQ ID NO: 6163186 - DNA, 15 bp, Homo sapiens
ctgtgcctcccccca

SEQ ID NO: 6163187 - DNA, 19 bp, Homo sapiens
ctgtgcctccccccagacc

SEQ ID NO: 6163188 - DNA, 21 bp, Homo sapiens
ctgtgcctccccccagacccc

SEQ ID NO: 6163189 - DNA, 23 bp, Homo sapiens
ctgtgcctccctccccagtgcaa

SEQ ID NO: 6163190 - DNA, 13 bp, Homo sapiens
ctgtgcctcctca

SEQ ID NO: 6163191 - DNA, 16 bp, Homo sapiens
ctgtgcctcctcaccc

SEQ ID NO: 6163192 - DNA, 14 bp, Homo sapiens
ctgtgcctcctccc

SEQ ID NO: 6163193 - DNA, 16 bp, Homo sapiens
ctgtgcctcctccctc

SEQ ID NO: 6163194 - DNA, 18 bp, Homo sapiens
ctgtgcctcctccctccc

SEQ ID NO: 6163195 - DNA, 11 bp, Homo sapiens
ctgtgcctctg

SEQ ID NO: 6163196 - DNA, 12 bp, Homo sapiens
ctgtgcctctgc

SEQ ID NO: 6163197 - DNA, 14 bp, Homo sapiens
ctgtgcctctgcct

SEQ ID NO: 6163198 - DNA, 15 bp, Homo sapiens
ctgtgcctctgcctg

SEQ ID NO: 6163199 - DNA, 17 bp, Homo sapiens
ctgtgcctctgggactg

SEQ ID NO: 6163200 - DNA, 20 bp, Homo sapiens
ctgtgcctctgtcctagact

SEQ ID NO: 6163201 - DNA, 20 bp, Homo sapiens
ctgtgcctgactctgtgctg

SEQ ID NO: 6163202 - DNA, 15 bp, Homo sapiens
ctgtgcctgcactga

SEQ ID NO: 6163203 - DNA, 13 bp, Homo sapiens
ctgtgcctgccat

SEQ ID NO: 6163204 - DNA, 17 bp, Homo sapiens
ctgtgcctgccatgggc

SEQ ID NO: 6163205 - DNA, 18 bp, Homo sapiens
ctgtgcctgccatgggcc

SEQ ID NO: 6163206 - DNA, 21 bp, Homo sapiens
ctgtgcctgccatgggccagc

SEQ ID NO: 6163207 - DNA, 18 bp, Homo sapiens
ctgtgcctgcctttgtgt

SEQ ID NO: 6163208 - DNA, 11 bp, Homo sapiens
ctgtgcctgct

SEQ ID NO: 6163209 - DNA, 12 bp, Homo sapiens
ctgtgcctgcta

SEQ ID NO: 6163210 - DNA, 21 bp, Homo sapiens
ctgtgcctgctagagcaaccc

SEQ ID NO: 6163211 - DNA, 23 bp, Homo sapiens
ctgtgcctgctcagcagccagtc

SEQ ID NO: 6163212 - DNA, 18 bp, Homo sapiens
ctgtgcctgctgggcact

SEQ ID NO: 6163213 - DNA, 20 bp, Homo sapiens
ctgtgcctgctgggcactgg

SEQ ID NO: 6163214 - DNA, 13 bp, Homo sapiens
ctgtgcctgcttc

SEQ ID NO: 6163215 - DNA, 15 bp, Homo sapiens
ctgtgcctgcttctg

SEQ ID NO: 6163216 - DNA, 17 bp, Homo sapiens
ctgtgcctggagctcct

SEQ ID NO: 6163217 - DNA, 18 bp, Homo sapiens
ctgtgcctggagctcctg

SEQ ID NO: 6163218 - DNA, 20 bp, Homo sapiens
ctgtgcctggagctcctggg

SEQ ID NO: 6163219 - DNA, 20 bp, Homo sapiens
ctgtgcctggccccagcctg

SEQ ID NO: 6163220 - DNA, 15 bp, Homo sapiens
ctgtgcctggctccc

SEQ ID NO: 6163221 - DNA, 17 bp, Homo sapiens
ctgtgcctggctccctg

SEQ ID NO: 6163222 - DNA, 15 bp, Homo sapiens
ctgtgcctgggccct

SEQ ID NO: 6163223 - DNA, 20 bp, Homo sapiens
ctgtgcctgggccctgggct

SEQ ID NO: 6163224 - DNA, 20 bp, Homo sapiens
ctgtgcctgtcaggctctgg

SEQ ID NO: 6163225 - DNA, 22 bp, Homo sapiens
ctgtgcctgtcaggctctggcc

SEQ ID NO: 6163226 - DNA, 17 bp, Homo sapiens
ctgtgcctgtgtttcat

SEQ ID NO: 6163227 - DNA, 15 bp, Homo sapiens
ctgtgccttcagctg

SEQ ID NO: 6163228 - DNA, 23 bp, Homo sapiens
ctgtgccttgccacattaaattg

SEQ ID NO: 6163229 - DNA, 16 bp, Homo sapiens
ctgtgcctttcctatc

SEQ ID NO: 6163230 - DNA, 19 bp, Homo sapiens
ctgtgcctttgcaaatcag

SEQ ID NO: 6163231 - DNA, 18 bp, Homo sapiens
ctgtgcctttgggaggca

SEQ ID NO: 6163232 - DNA, 16 bp, Homo sapiens
ctgtgccttttgccat

SEQ ID NO: 6163233 - DNA, 20 bp, Homo sapiens
ctgtgcgagaacacaagcca

SEQ ID NO: 6163234 - DNA, 21 bp, Homo sapiens
ctgtgcgcataggcctgcttt

SEQ ID NO: 6163235 - DNA, 17 bp, Homo sapiens
ctgtgcgccttaaacaa

SEQ ID NO: 6163236 - DNA, 20 bp, Homo sapiens
ctgtgcgcgtggcgtggccc

SEQ ID NO: 6163237 - DNA, 16 bp, Homo sapiens
ctgtgcggcctcacca

SEQ ID NO: 6163238 - DNA, 17 bp, Homo sapiens
ctgtgcgggcgcccgga

SEQ ID NO: 6163239 - DNA, 19 bp, Homo sapiens
ctgtgcgtcttggtgtaat

SEQ ID NO: 6163240 - DNA, 18 bp, Homo sapiens
ctgtgcgtggaaaaagac

SEQ ID NO: 6163241 - DNA, 15 bp, Homo sapiens
ctgtgcgtggggctc

SEQ ID NO: 6163242 - DNA, 21 bp, Homo sapiens
ctgtgcgtgtggcgtggcccg

SEQ ID NO: 6163243 - DNA, 18 bp, Homo sapiens
ctgtgcgttcccttcagt

SEQ ID NO: 6163244 - DNA, 17 bp, Homo sapiens
ctgtgctaagttgtctt

SEQ ID NO: 6163245 - DNA, 18 bp, Homo sapiens
ctgtgctaagttgtctta

SEQ ID NO: 6163246 - DNA, 19 bp, Homo sapiens
ctgtgctacagagaaaatc

SEQ ID NO: 6163247 - DNA, 22 bp, Homo sapiens
ctgtgctacctctaacaccaca

SEQ ID NO: 6163248 - DNA, 14 bp, Homo sapiens
ctgtgctacgtgtg

SEQ ID NO: 6163249 - DNA, 16 bp, Homo sapiens
ctgtgctacgtgtgaa

SEQ ID NO: 6163250 - DNA, 18 bp, Homo sapiens
ctgtgctacgtgtgaaat

SEQ ID NO: 6163251 - DNA, 21 bp, Homo sapiens
ctgtgctacgtgtgaaatctg

SEQ ID NO: 6163252 - DNA, 15 bp, Homo sapiens
ctgtgctagctttcc

SEQ ID NO: 6163253 - DNA, 19 bp, Homo sapiens
ctgtgctaggtctgaccaa

SEQ ID NO: 6163254 - DNA, 20 bp, Homo sapiens
ctgtgctagttttacagatt

SEQ ID NO: 6163255 - DNA, 16 bp, Homo sapiens
ctgtgctatgaatttt

SEQ ID NO: 6163256 - DNA, 19 bp, Homo sapiens
ctgtgctatttgtacaaat

SEQ ID NO: 6163257 - DNA, 20 bp, Homo sapiens
ctgtgctatttgtacaaata

SEQ ID NO: 6163258 - DNA, 18 bp, Homo sapiens
ctgtgctcaccctctctt

SEQ ID NO: 6163259 - DNA, 17 bp, Homo sapiens
ctgtgctcagaagggct

SEQ ID NO: 6163260 - DNA, 13 bp, Homo sapiens
ctgtgctcagaga

SEQ ID NO: 6163261 - DNA, 15 bp, Homo sapiens
ctgtgctcagccctg

SEQ ID NO: 6163262 - DNA, 15 bp, Homo sapiens
ctgtgctcaggactc

SEQ ID NO: 6163263 - DNA, 17 bp, Homo sapiens
ctgtgctcatcggagac

SEQ ID NO: 6163264 - DNA, 15 bp, Homo sapiens
ctgtgctccaacctg

SEQ ID NO: 6163265 - DNA, 18 bp, Homo sapiens
ctgtgctccacactcaga

SEQ ID NO: 6163266 - DNA, 14 bp, Homo sapiens
ctgtgctccagcag

SEQ ID NO: 6163267 - DNA, 22 bp, Homo sapiens
ctgtgctccagcagtgctgggc

SEQ ID NO: 6163268 - DNA, 22 bp, Homo sapiens
ctgtgctccctggttctgatga

SEQ ID NO: 6163269 - DNA, 17 bp, Homo sapiens
ctgtgctccgtgcctcc

SEQ ID NO: 6163270 - DNA, 20 bp, Homo sapiens
ctgtgctccgtgcctccacc

SEQ ID NO: 6163271 - DNA, 23 bp, Homo sapiens
ctgtgctcctaaaggcagcaacc

SEQ ID NO: 6163272 - DNA, 17 bp, Homo sapiens
ctgtgctcctgcccagg

SEQ ID NO: 6163273 - DNA, 17 bp, Homo sapiens
ctgtgctcctgtccctc

SEQ ID NO: 6163274 - DNA, 21 bp, Homo sapiens
ctgtgctcgggtgctgccagc

SEQ ID NO: 6163275 - DNA, 12 bp, Homo sapiens
ctgtgctctcct

SEQ ID NO: 6163276 - DNA, 19 bp, Homo sapiens
ctgtgctctcctagagctc

SEQ ID NO: 6163277 - DNA, 15 bp, Homo sapiens
ctgtgctctctgtgg

SEQ ID NO: 6163278 - DNA, 12 bp, Homo sapiens
ctgtgctctgaa

SEQ ID NO: 6163279 - DNA, 15 bp, Homo sapiens
ctgtgctctggggat

SEQ ID NO: 6163280 - DNA, 20 bp, Homo sapiens
ctgtgctctggggatttctg

SEQ ID NO: 6163281 - DNA, 20 bp, Homo sapiens
ctgtgctctgtccttgtgta

SEQ ID NO: 6163282 - DNA, 15 bp, Homo sapiens
ctgtgctcttcctct

SEQ ID NO: 6163283 - DNA, 11 bp, Homo sapiens
ctgtgctgaac

SEQ ID NO: 6163284 - DNA, 22 bp, Homo sapiens
ctgtgctgaacataacttctca

SEQ ID NO: 6163285 - DNA, 14 bp, Homo sapiens
ctgtgctgaatgct

SEQ ID NO: 6163286 - DNA, 13 bp, Homo sapiens
ctgtgctgaccct

SEQ ID NO: 6163287 - DNA, 18 bp, Homo sapiens
ctgtgctgaccctcctgt

SEQ ID NO: 6163288 - DNA, 16 bp, Homo sapiens
ctgtgctgagaagcag

SEQ ID NO: 6163289 - DNA, 20 bp, Homo sapiens
ctgtgctgagtctgaaggct

SEQ ID NO: 6163290 - DNA, 23 bp, Homo sapiens
ctgtgctgatcctgctgacctca

SEQ ID NO: 6163291 - DNA, 14 bp, Homo sapiens
ctgtgctgcatgcg

SEQ ID NO: 6163292 - DNA, 17 bp, Homo sapiens
ctgtgctgccctgaaga

SEQ ID NO: 6163293 - DNA, 15 bp, Homo sapiens
ctgtgctgccctgcc

SEQ ID NO: 6163294 - DNA, 19 bp, Homo sapiens
ctgtgctgccctgcccacc

SEQ ID NO: 6163295 - DNA, 22 bp, Homo sapiens
ctgtgctgccctgcccacctgg

SEQ ID NO: 6163296 - DNA, 12 bp, Homo sapiens
ctgtgctgctca

SEQ ID NO: 6163297 - DNA, 17 bp, Homo sapiens
ctgtgctgcttttgagc

SEQ ID NO: 6163298 - DNA, 20 bp, Homo sapiens
ctgtgctgcttttgagcctc

SEQ ID NO: 6163299 - DNA, 22 bp, Homo sapiens
ctgtgctgcttttgagcctcag

SEQ ID NO: 6163300 - DNA, 18 bp, Homo sapiens
ctgtgctggaattccaca

SEQ ID NO: 6163301 - DNA, 21 bp, Homo sapiens
ctgtgctggaattccacaggg

SEQ ID NO: 6163302 - DNA, 21 bp, Homo sapiens
ctgtgctggagccactaacta

SEQ ID NO: 6163303 - DNA, 12 bp, Homo sapiens
ctgtgctggcca

SEQ ID NO: 6163304 - DNA, 13 bp, Homo sapiens
ctgtgctggccag

SEQ ID NO: 6163305 - DNA, 11 bp, Homo sapiens
ctgtgctggga

SEQ ID NO: 6163306 - DNA, 19 bp, Homo sapiens
ctgtgctgggaagcccgga

SEQ ID NO: 6163307 - DNA, 23 bp, Homo sapiens
ctgtgctgggaggtcccagggcc

SEQ ID NO: 6163308 - DNA, 22 bp, Homo sapiens
ctgtgctgggccagtggctggg

SEQ ID NO: 6163309 - DNA, 17 bp, Homo sapiens
ctgtgctggggcacggc

SEQ ID NO: 6163310 - DNA, 18 bp, Homo sapiens
ctgtgctggtctctaggc

SEQ ID NO: 6163311 - DNA, 21 bp, Homo sapiens
ctgtgctggtctctaggcctg

SEQ ID NO: 6163312 - DNA, 22 bp, Homo sapiens
ctgtgctggtctttagccccac

SEQ ID NO: 6163313 - DNA, 22 bp, Homo sapiens
ctgtgctggtgggggcctcttt

SEQ ID NO: 6163314 - DNA, 19 bp, Homo sapiens
ctgtgctggttgccacatc

SEQ ID NO: 6163315 - DNA, 12 bp, Homo sapiens
ctgtgctgtact

SEQ ID NO: 6163316 - DNA, 14 bp, Homo sapiens
ctgtgctgtactga

SEQ ID NO: 6163317 - DNA, 12 bp, Homo sapiens
ctgtgctgtgcc

SEQ ID NO: 6163318 - DNA, 18 bp, Homo sapiens
ctgtgctgtgcccaagtt

SEQ ID NO: 6163319 - DNA, 21 bp, Homo sapiens
ctgtgctgtgcctgctagagc

SEQ ID NO: 6163320 - DNA, 15 bp, Homo sapiens
ctgtgctgtggaagc

SEQ ID NO: 6163321 - DNA, 21 bp, Homo sapiens
ctgtgctgtggaagcaacagg

SEQ ID NO: 6163322 - DNA, 15 bp, Homo sapiens
ctgtgctgtggcata

SEQ ID NO: 6163323 - DNA, 18 bp, Homo sapiens
ctgtgctgtggcatagac

SEQ ID NO: 6163324 - DNA, 11 bp, Homo sapiens
ctgtgctgtgt

SEQ ID NO: 6163325 - DNA, 13 bp, Homo sapiens
ctgtgctgtgtgt

SEQ ID NO: 6163326 - DNA, 13 bp, Homo sapiens
ctgtgctgttgtc

SEQ ID NO: 6163327 - DNA, 17 bp, Homo sapiens
ctgtgctgttgttatga

SEQ ID NO: 6163328 - DNA, 19 bp, Homo sapiens
ctgtgctgttgttatgatg

SEQ ID NO: 6163329 - DNA, 14 bp, Homo sapiens
ctgtgctgtttcaa

SEQ ID NO: 6163330 - DNA, 17 bp, Homo sapiens
ctgtgcttacagtgact

SEQ ID NO: 6163331 - DNA, 19 bp, Homo sapiens
ctgtgcttacagtgactgt

SEQ ID NO: 6163332 - DNA, 20 bp, Homo sapiens
ctgtgcttccttggttcatg

SEQ ID NO: 6163333 - DNA, 22 bp, Homo sapiens
ctgtgcttccttggttcatgct

SEQ ID NO: 6163334 - DNA, 20 bp, Homo sapiens
ctgtgcttcgggcccttccc

SEQ ID NO: 6163335 - DNA, 21 bp, Homo sapiens
ctgtgcttcggtaggcgacca

SEQ ID NO: 6163336 - DNA, 13 bp, Homo sapiens
ctgtgcttctaat

SEQ ID NO: 6163337 - DNA, 22 bp, Homo sapiens
ctgtgcttgaaggccctgctga

SEQ ID NO: 6163338 - DNA, 19 bp, Homo sapiens
ctgtgcttgctcctaagca

SEQ ID NO: 6163339 - DNA, 20 bp, Homo sapiens
ctgtgcttgctcctaagcaa

SEQ ID NO: 6163340 - DNA, 23 bp, Homo sapiens
ctgtgcttgttgaatgtcaatca

SEQ ID NO: 6163341 - DNA, 20 bp, Homo sapiens
ctgtgctttccagctcaccc

SEQ ID NO: 6163342 - DNA, 22 bp, Homo sapiens
ctgtgctttccagctcaccccc

SEQ ID NO: 6163343 - DNA, 22 bp, Homo sapiens
ctgtgctttcccagaggacacc

SEQ ID NO: 6163344 - DNA, 19 bp, Homo sapiens
ctgtgctttccctgaactg

SEQ ID NO: 6163345 - DNA, 19 bp, Homo sapiens
ctgtgctttgactcacctg

SEQ ID NO: 6163346 - DNA, 14 bp, Homo sapiens
ctgtgctttgagat

SEQ ID NO: 6163347 - DNA, 11 bp, Homo sapiens
ctgtgctttgg

SEQ ID NO: 6163348 - DNA, 20 bp, Homo sapiens
ctgtgctttttgcaaaaggg

SEQ ID NO: 6163349 - DNA, 12 bp, Homo sapiens
ctgtggaaagct

SEQ ID NO: 6163350 - DNA, 21 bp, Homo sapiens
ctgtggaaagtgtaaagcatt

SEQ ID NO: 6163351 - DNA, 15 bp, Homo sapiens
ctgtggaaatgccaa

SEQ ID NO: 6163352 - DNA, 15 bp, Homo sapiens
ctgtggaacactaaa

SEQ ID NO: 6163353 - DNA, 16 bp, Homo sapiens
ctgtggaacccagcag

SEQ ID NO: 6163354 - DNA, 17 bp, Homo sapiens
ctgtggaactgccacct

SEQ ID NO: 6163355 - DNA, 23 bp, Homo sapiens
ctgtggaagcaaggctggggtct

SEQ ID NO: 6163356 - DNA, 16 bp, Homo sapiens
ctgtggaagcatggct

SEQ ID NO: 6163357 - DNA, 20 bp, Homo sapiens
ctgtggaagcatggctgtct

SEQ ID NO: 6163358 - DNA, 23 bp, Homo sapiens
ctgtggaagcatggctgtctgca

SEQ ID NO: 6163359 - DNA, 18 bp, Homo sapiens
ctgtggaaggcagagaaa

SEQ ID NO: 6163360 - DNA, 22 bp, Homo sapiens
ctgtggaatataaatagctgaa

SEQ ID NO: 6163361 - DNA, 23 bp, Homo sapiens
ctgtggaatataaatagctgaaa

SEQ ID NO: 6163362 - DNA, 18 bp, Homo sapiens
ctgtggaatctggagtga

SEQ ID NO: 6163363 - DNA, 20 bp, Homo sapiens
ctgtggaatgaagcttttta

SEQ ID NO: 6163364 - DNA, 21 bp, Homo sapiens
ctgtggaatgagtgtgcatgg

SEQ ID NO: 6163365 - DNA, 15 bp, Homo sapiens
ctgtggacaccactg

SEQ ID NO: 6163366 - DNA, 15 bp, Homo sapiens
ctgtggacactgtgg

SEQ ID NO: 6163367 - DNA, 16 bp, Homo sapiens
ctgtggacatgtgggt

SEQ ID NO: 6163368 - DNA, 21 bp, Homo sapiens
ctgtggaccctcgctctctgt

SEQ ID NO: 6163369 - DNA, 17 bp, Homo sapiens
ctgtggaccgtggacag

SEQ ID NO: 6163370 - DNA, 15 bp, Homo sapiens
ctgtggacggggagg

SEQ ID NO: 6163371 - DNA, 13 bp, Homo sapiens
ctgtggagaaata

SEQ ID NO: 6163372 - DNA, 17 bp, Homo sapiens
ctgtggagaatgtacac

SEQ ID NO: 6163373 - DNA, 22 bp, Homo sapiens
ctgtggagacagccctgcctat

SEQ ID NO: 6163374 - DNA, 22 bp, Homo sapiens
ctgtggagactgctcctgagcc

SEQ ID NO: 6163375 - DNA, 15 bp, Homo sapiens
ctgtggagactttct

SEQ ID NO: 6163376 - DNA, 18 bp, Homo sapiens
ctgtggagactttctgtt

SEQ ID NO: 6163377 - DNA, 22 bp, Homo sapiens
ctgtggagagaagtgagcaagg

SEQ ID NO: 6163378 - DNA, 17 bp, Homo sapiens
ctgtggagatggactca

SEQ ID NO: 6163379 - DNA, 19 bp, Homo sapiens
ctgtggagcaaaaggcagc

SEQ ID NO: 6163380 - DNA, 20 bp, Homo sapiens
ctgtggagcaaaaggcagct

SEQ ID NO: 6163381 - DNA, 22 bp, Homo sapiens
ctgtggagcccgcacccccacc

SEQ ID NO: 6163382 - DNA, 23 bp, Homo sapiens
ctgtggagcccgcacccccaccc

SEQ ID NO: 6163383 - DNA, 18 bp, Homo sapiens
ctgtggagcgtccttgtc

SEQ ID NO: 6163384 - DNA, 22 bp, Homo sapiens
ctgtggagcgtccttgtccccg

SEQ ID NO: 6163385 - DNA, 21 bp, Homo sapiens
ctgtggagctccactgccatg

SEQ ID NO: 6163386 - DNA, 18 bp, Homo sapiens
ctgtggagctgccacaga

SEQ ID NO: 6163387 - DNA, 22 bp, Homo sapiens
ctgtggagctgccacagagaag

SEQ ID NO: 6163388 - DNA, 15 bp, Homo sapiens
ctgtggaggaaggat

SEQ ID NO: 6163389 - DNA, 16 bp, Homo sapiens
ctgtggaggaaggatt

SEQ ID NO: 6163390 - DNA, 17 bp, Homo sapiens
ctgtggaggaaggattg

SEQ ID NO: 6163391 - DNA, 19 bp, Homo sapiens
ctgtggaggaaggattgta

SEQ ID NO: 6163392 - DNA, 22 bp, Homo sapiens
ctgtggaggccgagtctgtcct

SEQ ID NO: 6163393 - DNA, 18 bp, Homo sapiens
ctgtggaggcctgatgct

SEQ ID NO: 6163394 - DNA, 19 bp, Homo sapiens
ctgtggagggagggcagct

SEQ ID NO: 6163395 - DNA, 22 bp, Homo sapiens
ctgtggagggagtgttcaaaat

SEQ ID NO: 6163396 - DNA, 20 bp, Homo sapiens
ctgtggaggggagctgctgg

SEQ ID NO: 6163397 - DNA, 14 bp, Homo sapiens
ctgtggaggtggct

SEQ ID NO: 6163398 - DNA, 17 bp, Homo sapiens
ctgtggagtccagctct

SEQ ID NO: 6163399 - DNA, 20 bp, Homo sapiens
ctgtggagtccagctctact

SEQ ID NO: 6163400 - DNA, 15 bp, Homo sapiens
ctgtggagtgaggtg

SEQ ID NO: 6163401 - DNA, 15 bp, Homo sapiens
ctgtggagttcctgc

SEQ ID NO: 6163402 - DNA, 16 bp, Homo sapiens
ctgtggagttcctgct

SEQ ID NO: 6163403 - DNA, 21 bp, Homo sapiens
ctgtggataaaacattagaag

SEQ ID NO: 6163404 - DNA, 16 bp, Homo sapiens
ctgtggatacagtgcc

SEQ ID NO: 6163405 - DNA, 20 bp, Homo sapiens
ctgtggatacccttaccctt

SEQ ID NO: 6163406 - DNA, 22 bp, Homo sapiens
ctgtggatacgggggttccctt

SEQ ID NO: 6163407 - DNA, 14 bp, Homo sapiens
ctgtggatcaaatc

SEQ ID NO: 6163408 - DNA, 16 bp, Homo sapiens
ctgtggatgctgctgc

SEQ ID NO: 6163409 - DNA, 19 bp, Homo sapiens
ctgtggatgctgctgcccc

SEQ ID NO: 6163410 - DNA, 21 bp, Homo sapiens
ctgtggatgggatcctctcca

SEQ ID NO: 6163411 - DNA, 21 bp, Homo sapiens
ctgtggattcagcttctgttg

SEQ ID NO: 6163412 - DNA, 12 bp, Homo sapiens
ctgtggattcta

SEQ ID NO: 6163413 - DNA, 14 bp, Homo sapiens
ctgtggattctata

SEQ ID NO: 6163414 - DNA, 19 bp, Homo sapiens
ctgtggattttgtccattc

SEQ ID NO: 6163415 - DNA, 13 bp, Homo sapiens
ctgtggcacagcc

SEQ ID NO: 6163416 - DNA, 15 bp, Homo sapiens
ctgtggcacagccct

SEQ ID NO: 6163417 - DNA, 16 bp, Homo sapiens
ctgtggcacagccctg

SEQ ID NO: 6163418 - DNA, 20 bp, Homo sapiens
ctgtggcacagccctgagtg

SEQ ID NO: 6163419 - DNA, 15 bp, Homo sapiens
ctgtggcactgccac

SEQ ID NO: 6163420 - DNA, 16 bp, Homo sapiens
ctgtggcactgccacc

SEQ ID NO: 6163421 - DNA, 15 bp, Homo sapiens
ctgtggcactggcca

SEQ ID NO: 6163422 - DNA, 17 bp, Homo sapiens
ctgtggcactggccacc

SEQ ID NO: 6163423 - DNA, 17 bp, Homo sapiens
ctgtggcacttgcctgg

SEQ ID NO: 6163424 - DNA, 23 bp, Homo sapiens
ctgtggcagagttacagttctgt

SEQ ID NO: 6163425 - DNA, 23 bp, Homo sapiens
ctgtggcagccgtcccaggccac

SEQ ID NO: 6163426 - DNA, 22 bp, Homo sapiens
ctgtggcagctgcccctggcac

SEQ ID NO: 6163427 - DNA, 23 bp, Homo sapiens
ctgtggcagctgcccctggcacc

SEQ ID NO: 6163428 - DNA, 13 bp, Homo sapiens
ctgtggcaggcag

SEQ ID NO: 6163429 - DNA, 14 bp, Homo sapiens
ctgtggcaggcagc

SEQ ID NO: 6163430 - DNA, 14 bp, Homo sapiens
ctgtggcaggccta

SEQ ID NO: 6163431 - DNA, 23 bp, Homo sapiens
ctgtggcagtaaagagaaacttt

SEQ ID NO: 6163432 - DNA, 14 bp, Homo sapiens
ctgtggcataaatt

SEQ ID NO: 6163433 - DNA, 18 bp, Homo sapiens
ctgtggcatagacatgga

SEQ ID NO: 6163434 - DNA, 17 bp, Homo sapiens
ctgtggcatctttgcct

SEQ ID NO: 6163435 - DNA, 18 bp, Homo sapiens
ctgtggcatgggtgaaga

SEQ ID NO: 6163436 - DNA, 17 bp, Homo sapiens
ctgtggccacagccccc

SEQ ID NO: 6163437 - DNA, 22 bp, Homo sapiens
ctgtggccacattttcagccaa

SEQ ID NO: 6163438 - DNA, 13 bp, Homo sapiens
ctgtggccaccta

SEQ ID NO: 6163439 - DNA, 14 bp, Homo sapiens
ctgtggccacctag

SEQ ID NO: 6163440 - DNA, 23 bp, Homo sapiens
ctgtggccacctagaaaggggcc

SEQ ID NO: 6163441 - DNA, 21 bp, Homo sapiens
ctgtggccagagcacctcagg

SEQ ID NO: 6163442 - DNA, 22 bp, Homo sapiens
ctgtggccagagcacctcagga

SEQ ID NO: 6163443 - DNA, 17 bp, Homo sapiens
ctgtggccagagctgga

SEQ ID NO: 6163444 - DNA, 18 bp, Homo sapiens
ctgtggccagagctggaa

SEQ ID NO: 6163445 - DNA, 19 bp, Homo sapiens
ctgtggccagagctggaag

SEQ ID NO: 6163446 - DNA, 15 bp, Homo sapiens
ctgtggccagcctgg

SEQ ID NO: 6163447 - DNA, 21 bp, Homo sapiens
ctgtggccagcctggcatcag

SEQ ID NO: 6163448 - DNA, 22 bp, Homo sapiens
ctgtggccagcctggcatcagt

SEQ ID NO: 6163449 - DNA, 22 bp, Homo sapiens
ctgtggccagcttgttatttat

SEQ ID NO: 6163450 - DNA, 11 bp, Homo sapiens
ctgtggccagg

SEQ ID NO: 6163451 - DNA, 19 bp, Homo sapiens
ctgtggccaggagccctgg

SEQ ID NO: 6163452 - DNA, 14 bp, Homo sapiens
ctgtggccaggagg

SEQ ID NO: 6163453 - DNA, 19 bp, Homo sapiens
ctgtggccaggcctgcaga

SEQ ID NO: 6163454 - DNA, 15 bp, Homo sapiens
ctgtggccaggcctt

SEQ ID NO: 6163455 - DNA, 17 bp, Homo sapiens
ctgtggccatatatgct

SEQ ID NO: 6163456 - DNA, 23 bp, Homo sapiens
ctgtggccatatatgctgtattt

SEQ ID NO: 6163457 - DNA, 22 bp, Homo sapiens
ctgtggccatgaccctgcctct

SEQ ID NO: 6163458 - DNA, 22 bp, Homo sapiens
ctgtggccatggtccccaagac

SEQ ID NO: 6163459 - DNA, 23 bp, Homo sapiens
ctgtggcccacgggccggccagc

SEQ ID NO: 6163460 - DNA, 21 bp, Homo sapiens
ctgtggccccaccctgggccc

SEQ ID NO: 6163461 - DNA, 16 bp, Homo sapiens
ctgtggccccctgtcc

SEQ ID NO: 6163462 - DNA, 21 bp, Homo sapiens
ctgtggccccctgtccccaag

SEQ ID NO: 6163463 - DNA, 20 bp, Homo sapiens
ctgtggcccctcccctgcag

SEQ ID NO: 6163464 - DNA, 21 bp, Homo sapiens
ctgtggcccctccttctcccc

SEQ ID NO: 6163465 - DNA, 10 bp, Homo sapiens
ctgtggccct

SEQ ID NO: 6163466 - DNA, 11 bp, Homo sapiens
ctgtggccctg

SEQ ID NO: 6163467 - DNA, 13 bp, Homo sapiens
ctgtggccctgcc

SEQ ID NO: 6163468 - DNA, 23 bp, Homo sapiens
ctgtggccctgcccttggcacca

SEQ ID NO: 6163469 - DNA, 13 bp, Homo sapiens
ctgtggccctggc

SEQ ID NO: 6163470 - DNA, 22 bp, Homo sapiens
ctgtggccctggccactaaagc

SEQ ID NO: 6163471 - DNA, 16 bp, Homo sapiens
ctgtggccgccatctg

SEQ ID NO: 6163472 - DNA, 17 bp, Homo sapiens
ctgtggccggtgccagc

SEQ ID NO: 6163473 - DNA, 19 bp, Homo sapiens
ctgtggccggtgccagctg

SEQ ID NO: 6163474 - DNA, 15 bp, Homo sapiens
ctgtggccgtctcct

SEQ ID NO: 6163475 - DNA, 18 bp, Homo sapiens
ctgtggcctaacctgccg

SEQ ID NO: 6163476 - DNA, 22 bp, Homo sapiens
ctgtggcctcacttccctggga

SEQ ID NO: 6163477 - DNA, 12 bp, Homo sapiens
ctgtggcctcag

SEQ ID NO: 6163478 - DNA, 13 bp, Homo sapiens
ctgtggcctcagc

SEQ ID NO: 6163479 - DNA, 14 bp, Homo sapiens
ctgtggcctcagca

SEQ ID NO: 6163480 - DNA, 15 bp, Homo sapiens
ctgtggcctcaggag

SEQ ID NO: 6163481 - DNA, 15 bp, Homo sapiens
ctgtggcctctcagt

SEQ ID NO: 6163482 - DNA, 15 bp, Homo sapiens
ctgtggcctgcagga

SEQ ID NO: 6163483 - DNA, 17 bp, Homo sapiens
ctgtggcctgcaggagg

SEQ ID NO: 6163484 - DNA, 18 bp, Homo sapiens
ctgtggcctgcaggaggg

SEQ ID NO: 6163485 - DNA, 15 bp, Homo sapiens
ctgtggcctgtctct

SEQ ID NO: 6163486 - DNA, 14 bp, Homo sapiens
ctgtggcctgtgtc

SEQ ID NO: 6163487 - DNA, 15 bp, Homo sapiens
ctgtggcctgtgtcc

SEQ ID NO: 6163488 - DNA, 17 bp, Homo sapiens
ctgtggcctgtgtccag

SEQ ID NO: 6163489 - DNA, 19 bp, Homo sapiens
ctgtggcctgtgtccagca

SEQ ID NO: 6163490 - DNA, 19 bp, Homo sapiens
ctgtggccttctcagccta

SEQ ID NO: 6163491 - DNA, 14 bp, Homo sapiens
ctgtggccttggcc

SEQ ID NO: 6163492 - DNA, 18 bp, Homo sapiens
ctgtggccttggccctga

SEQ ID NO: 6163493 - DNA, 15 bp, Homo sapiens
ctgtggccttggtct

SEQ ID NO: 6163494 - DNA, 21 bp, Homo sapiens
ctgtggcgccgcgtggacagc

SEQ ID NO: 6163495 - DNA, 22 bp, Homo sapiens
ctgtggcgccgcgtggacagcc

SEQ ID NO: 6163496 - DNA, 19 bp, Homo sapiens
ctgtggcgctgcagcaggg

SEQ ID NO: 6163497 - DNA, 23 bp, Homo sapiens
ctgtggcgttctgctgcccctgc

SEQ ID NO: 6163498 - DNA, 14 bp, Homo sapiens
ctgtggctcagggg

SEQ ID NO: 6163499 - DNA, 11 bp, Homo sapiens
ctgtggctcca

SEQ ID NO: 6163500 - DNA, 15 bp, Homo sapiens
ctgtggctccaggcc

SEQ ID NO: 6163501 - DNA, 16 bp, Homo sapiens
ctgtggctccaggcca

SEQ ID NO: 6163502 - DNA, 18 bp, Homo sapiens
ctgtggctccaggccaaa

SEQ ID NO: 6163503 - DNA, 19 bp, Homo sapiens
ctgtggctccctcctcctg

SEQ ID NO: 6163504 - DNA, 23 bp, Homo sapiens
ctgtggctccctcctcctgtcct

SEQ ID NO: 6163505 - DNA, 19 bp, Homo sapiens
ctgtggctccctctctcct

SEQ ID NO: 6163506 - DNA, 21 bp, Homo sapiens
ctgtggctccctctctcctgg

SEQ ID NO: 6163507 - DNA, 22 bp, Homo sapiens
ctgtggctccctctctcctgga

SEQ ID NO: 6163508 - DNA, 17 bp, Homo sapiens
ctgtggctcctgccttg

SEQ ID NO: 6163509 - DNA, 17 bp, Homo sapiens
ctgtggctctgggtggg

SEQ ID NO: 6163510 - DNA, 15 bp, Homo sapiens
ctgtggctcttgcct

SEQ ID NO: 6163511 - DNA, 12 bp, Homo sapiens
ctgtggctgatt

SEQ ID NO: 6163512 - DNA, 21 bp, Homo sapiens
ctgtggctgatttactaacag

SEQ ID NO: 6163513 - DNA, 23 bp, Homo sapiens
ctgtggctgatttactaacagta

SEQ ID NO: 6163514 - DNA, 14 bp, Homo sapiens
ctgtggctgccatc

SEQ ID NO: 6163515 - DNA, 14 bp, Homo sapiens
ctgtggctgcgctt

SEQ ID NO: 6163516 - DNA, 18 bp, Homo sapiens
ctgtggctggaggagctg

SEQ ID NO: 6163517 - DNA, 19 bp, Homo sapiens
ctgtggctggaggagctgg

SEQ ID NO: 6163518 - DNA, 23 bp, Homo sapiens
ctgtggctggaggagctggcctg

SEQ ID NO: 6163519 - DNA, 13 bp, Homo sapiens
ctgtggctggctc

SEQ ID NO: 6163520 - DNA, 14 bp, Homo sapiens
ctgtggctgggggg

SEQ ID NO: 6163521 - DNA, 14 bp, Homo sapiens
ctgtggctgggtgg

SEQ ID NO: 6163522 - DNA, 21 bp, Homo sapiens
ctgagatatgaacatattgtt

SEQ ID NO: 6163523 - DNA, 20 bp, Homo sapiens
ctgagatatggcattgcact

SEQ ID NO: 6163524 - DNA, 15 bp, Homo sapiens
ctgagatattatttt

SEQ ID NO: 6163525 - DNA, 22 bp, Homo sapiens
ctgagatattattttaaatttc

SEQ ID NO: 6163526 - DNA, 17 bp, Homo sapiens
ctgagatcacaccactg

SEQ ID NO: 6163527 - DNA, 19 bp, Homo sapiens
ctgagatccagagaggctg

SEQ ID NO: 6163528 - DNA, 15 bp, Homo sapiens
ctgagatccagcaca

SEQ ID NO: 6163529 - DNA, 15 bp, Homo sapiens
ctgagatcctggact

SEQ ID NO: 6163530 - DNA, 15 bp, Homo sapiens
ctgagatcctggagt

SEQ ID NO: 6163531 - DNA, 14 bp, Homo sapiens
ctgagatcgtgcca

SEQ ID NO: 6163532 - DNA, 19 bp, Homo sapiens
ctgagatcgtgccattaca

SEQ ID NO: 6163533 - DNA, 14 bp, Homo sapiens
ctgagatctgctgt

SEQ ID NO: 6163534 - DNA, 16 bp, Homo sapiens
ctgagatctgtgtttt

SEQ ID NO: 6163535 - DNA, 23 bp, Homo sapiens
ctgagatcttctctgttattcct

SEQ ID NO: 6163536 - DNA, 18 bp, Homo sapiens
ctgagatgagaggtagcc

SEQ ID NO: 6163537 - DNA, 16 bp, Homo sapiens
ctgagatgagccccac

SEQ ID NO: 6163538 - DNA, 22 bp, Homo sapiens
ctgagatgcaccaagtacagcc

SEQ ID NO: 6163539 - DNA, 16 bp, Homo sapiens
ctgagatgccccgagc

SEQ ID NO: 6163540 - DNA, 20 bp, Homo sapiens
ctgagatgcctggtgagcat

SEQ ID NO: 6163541 - DNA, 21 bp, Homo sapiens
ctgagatgcgcaaagagtgtg

SEQ ID NO: 6163542 - DNA, 19 bp, Homo sapiens
ctgagatgctaatttattt

SEQ ID NO: 6163543 - DNA, 14 bp, Homo sapiens
ctgagatgctcact

SEQ ID NO: 6163544 - DNA, 22 bp, Homo sapiens
ctgagatgctcactttattatc

SEQ ID NO: 6163545 - DNA, 19 bp, Homo sapiens
ctgagatgctgggagggct

SEQ ID NO: 6163546 - DNA, 20 bp, Homo sapiens
ctgagatgctgggagggctg

SEQ ID NO: 6163547 - DNA, 17 bp, Homo sapiens
ctgagatgctgggctgt

SEQ ID NO: 6163548 - DNA, 23 bp, Homo sapiens
ctgagatggaacccttttggccc

SEQ ID NO: 6163549 - DNA, 18 bp, Homo sapiens
ctgagatggatggacaga

SEQ ID NO: 6163550 - DNA, 22 bp, Homo sapiens
ctgagatggatggacagacaga

SEQ ID NO: 6163551 - DNA, 18 bp, Homo sapiens
ctgagatggctcccaggg

SEQ ID NO: 6163552 - DNA, 17 bp, Homo sapiens
ctgagatgggaggatca

SEQ ID NO: 6163553 - DNA, 20 bp, Homo sapiens
ctgagatgggccggccccct

SEQ ID NO: 6163554 - DNA, 18 bp, Homo sapiens
ctgagatgtaggctccac

SEQ ID NO: 6163555 - DNA, 21 bp, Homo sapiens
ctgagatgtaggctccacctt

SEQ ID NO: 6163556 - DNA, 23 bp, Homo sapiens
ctgagatgtcagatctcaagatc

SEQ ID NO: 6163557 - DNA, 13 bp, Homo sapiens
ctgagatgtgtga

SEQ ID NO: 6163558 - DNA, 21 bp, Homo sapiens
ctgagattattccttcttcta

SEQ ID NO: 6163559 - DNA, 14 bp, Homo sapiens
ctgagattctaaga

SEQ ID NO: 6163560 - DNA, 12 bp, Homo sapiens
ctgagattctgg

SEQ ID NO: 6163561 - DNA, 14 bp, Homo sapiens
ctgagattctggga

SEQ ID NO: 6163562 - DNA, 16 bp, Homo sapiens
ctgagattctgggaaa

SEQ ID NO: 6163563 - DNA, 20 bp, Homo sapiens
ctgagattctgggaaaggtg

SEQ ID NO: 6163564 - DNA, 17 bp, Homo sapiens
ctgagattctttaagga

SEQ ID NO: 6163565 - DNA, 20 bp, Homo sapiens
ctgagattctttaaggagat

SEQ ID NO: 6163566 - DNA, 22 bp, Homo sapiens
ctgagattctttaaggagatag

SEQ ID NO: 6163567 - DNA, 19 bp, Homo sapiens
ctgagatttaacccctcca

SEQ ID NO: 6163568 - DNA, 20 bp, Homo sapiens
ctgagatttaacccctccac

SEQ ID NO: 6163569 - DNA, 22 bp, Homo sapiens
ctgagatttaacccctccactg

SEQ ID NO: 6163570 - DNA, 19 bp, Homo sapiens
ctgagatttattaaagaaa

SEQ ID NO: 6163571 - DNA, 15 bp, Homo sapiens
ctgagatttcatctg

SEQ ID NO: 6163572 - DNA, 18 bp, Homo sapiens
ctgagatttcatctgctc

SEQ ID NO: 6163573 - DNA, 19 bp, Homo sapiens
ctgagatttcatctgctct

SEQ ID NO: 6163574 - DNA, 15 bp, Homo sapiens
ctgagatttcttaaa

SEQ ID NO: 6163575 - DNA, 15 bp, Homo sapiens
ctgagatttgtaaat

SEQ ID NO: 6163576 - DNA, 19 bp, Homo sapiens
ctgagatttttgatatctc

SEQ ID NO: 6163577 - DNA, 20 bp, Homo sapiens
ctgagatttttttgtgtatg

SEQ ID NO: 6163578 - DNA, 22 bp, Homo sapiens
ctgagatttttttgtgtatgtt

SEQ ID NO: 6163579 - DNA, 15 bp, Homo sapiens
ctgagcaaaggccct

SEQ ID NO: 6163580 - DNA, 17 bp, Homo sapiens
ctgagcaaaggccctgg

SEQ ID NO: 6163581 - DNA, 21 bp, Homo sapiens
ctgagcaaaggccctgggtaa

SEQ ID NO: 6163582 - DNA, 11 bp, Homo sapiens
ctgagcaaata

SEQ ID NO: 6163583 - DNA, 20 bp, Homo sapiens
ctgagcaaatgtggctcctg

SEQ ID NO: 6163584 - DNA, 16 bp, Homo sapiens
ctgagcaacagagtga

SEQ ID NO: 6163585 - DNA, 24 bp, Homo sapiens
ctgagcaacagagtgagaccctgt

SEQ ID NO: 6163586 - DNA, 19 bp, Homo sapiens
ctgagcaacgctattccag

SEQ ID NO: 6163587 - DNA, 20 bp, Homo sapiens
ctgagcaagactctttcaaa

SEQ ID NO: 6163588 - DNA, 16 bp, Homo sapiens
ctgagcaagagctggc

SEQ ID NO: 6163589 - DNA, 20 bp, Homo sapiens
ctgagcaagatcttgtctcc

SEQ ID NO: 6163590 - DNA, 23 bp, Homo sapiens
ctgagcaataacttctatgttgg

SEQ ID NO: 6163591 - DNA, 17 bp, Homo sapiens
ctgagcaatctgaccct

SEQ ID NO: 6163592 - DNA, 17 bp, Homo sapiens
ctgagcaatgtctgtgc

SEQ ID NO: 6163593 - DNA, 18 bp, Homo sapiens
ctgagcacaggtgacaga

SEQ ID NO: 6163594 - DNA, 19 bp, Homo sapiens
ctgagcacatagtgtcctg

SEQ ID NO: 6163595 - DNA, 21 bp, Homo sapiens
ctgagcacatagtgtcctgcc

SEQ ID NO: 6163596 - DNA, 17 bp, Homo sapiens
ctgagcacatttgactc

SEQ ID NO: 6163597 - DNA, 13 bp, Homo sapiens
ctgagcaccaggg

SEQ ID NO: 6163598 - DNA, 20 bp, Homo sapiens
ctgagcacccagctctgtct

SEQ ID NO: 6163599 - DNA, 16 bp, Homo sapiens
ctgagcaccccctcat

SEQ ID NO: 6163600 - DNA, 18 bp, Homo sapiens
ctgagcaccccctcattc

SEQ ID NO: 6163601 - DNA, 15 bp, Homo sapiens
ctgagcaccctctcc

SEQ ID NO: 6163602 - DNA, 16 bp, Homo sapiens
ctgagcaccctctccg

SEQ ID NO: 6163603 - DNA, 14 bp, Homo sapiens
ctgagcaccctctg

SEQ ID NO: 6163604 - DNA, 16 bp, Homo sapiens
ctgagcaccctctgga

SEQ ID NO: 6163605 - DNA, 23 bp, Homo sapiens
ctgagcaccgtgtcaagctgctc

SEQ ID NO: 6163606 - DNA, 16 bp, Homo sapiens
ctgagcacctcccagc

SEQ ID NO: 6163607 - DNA, 12 bp, Homo sapiens
ctgagcacctct

SEQ ID NO: 6163608 - DNA, 13 bp, Homo sapiens
ctgagcacctgct

SEQ ID NO: 6163609 - DNA, 16 bp, Homo sapiens
ctgagcacctgcttca

SEQ ID NO: 6163610 - DNA, 23 bp, Homo sapiens
ctgagcacctgcttcatgctcag

SEQ ID NO: 6163611 - DNA, 18 bp, Homo sapiens
ctgagcactcctggtgca

SEQ ID NO: 6163612 - DNA, 14 bp, Homo sapiens
ctgagcactgtttt

SEQ ID NO: 6163613 - DNA, 15 bp, Homo sapiens
ctgagcactgttttc

SEQ ID NO: 6163614 - DNA, 23 bp, Homo sapiens
ctgagcactgttttctagtgtat

SEQ ID NO: 6163615 - DNA, 14 bp, Homo sapiens
ctgagcagacaggg

SEQ ID NO: 6163616 - DNA, 16 bp, Homo sapiens
ctgagcagactggtga

SEQ ID NO: 6163617 - DNA, 21 bp, Homo sapiens
ctgagcagactggtgagcaga

SEQ ID NO: 6163618 - DNA, 13 bp, Homo sapiens
ctgagcagccgcc

SEQ ID NO: 6163619 - DNA, 15 bp, Homo sapiens
ctgagcagccgccag

SEQ ID NO: 6163620 - DNA, 13 bp, Homo sapiens
ctgagcagcctct

SEQ ID NO: 6163621 - DNA, 14 bp, Homo sapiens
ctgagcagcctctg

SEQ ID NO: 6163622 - DNA, 18 bp, Homo sapiens
ctgagcagcctctgccag

SEQ ID NO: 6163623 - DNA, 16 bp, Homo sapiens
ctgagcagctggatct

SEQ ID NO: 6163624 - DNA, 23 bp, Homo sapiens
ctgagcaggaagcgagcagaggc

SEQ ID NO: 6163625 - DNA, 19 bp, Homo sapiens
ctgagcaggacagccagca

SEQ ID NO: 6163626 - DNA, 20 bp, Homo sapiens
ctgagcaggacagccagcag

SEQ ID NO: 6163627 - DNA, 23 bp, Homo sapiens
ctgagcaggacagccagcagcag

SEQ ID NO: 6163628 - DNA, 21 bp, Homo sapiens
ctgagcaggacgttaggcccg

SEQ ID NO: 6163629 - DNA, 21 bp, Homo sapiens
ctgagcaggcaggggcttggc

SEQ ID NO: 6163630 - DNA, 13 bp, Homo sapiens
ctgagcaggccac

SEQ ID NO: 6163631 - DNA, 19 bp, Homo sapiens
ctgagcaggcccgacagag

SEQ ID NO: 6163632 - DNA, 22 bp, Homo sapiens
ctgagcaggcccgacagagaga

SEQ ID NO: 6163633 - DNA, 13 bp, Homo sapiens
ctgagcagggatc

SEQ ID NO: 6163634 - DNA, 21 bp, Homo sapiens
ctgagcagggatctgccccct

SEQ ID NO: 6163635 - DNA, 21 bp, Homo sapiens
ctgagcaggggaacaaaataa

SEQ ID NO: 6163636 - DNA, 23 bp, Homo sapiens
ctgagcaggggaacaaaataagg

SEQ ID NO: 6163637 - DNA, 12 bp, Homo sapiens
ctgagcaggggc

SEQ ID NO: 6163638 - DNA, 14 bp, Homo sapiens
ctgagcaggggcag

SEQ ID NO: 6163639 - DNA, 15 bp, Homo sapiens
ctgagcaggggcagg

SEQ ID NO: 6163640 - DNA, 19 bp, Homo sapiens
ctgagcagggtccacagct

SEQ ID NO: 6163641 - DNA, 22 bp, Homo sapiens
ctgagcaggtacatttctgatt

SEQ ID NO: 6163642 - DNA, 12 bp, Homo sapiens
ctgagcaggtgt

SEQ ID NO: 6163643 - DNA, 18 bp, Homo sapiens
ctgagcagtccctgctta

SEQ ID NO: 6163644 - DNA, 18 bp, Homo sapiens
ctgagcagtccttggcct

SEQ ID NO: 6163645 - DNA, 22 bp, Homo sapiens
ctgagcagtccttggcctgcta

SEQ ID NO: 6163646 - DNA, 15 bp, Homo sapiens
ctgagcagtctactt

SEQ ID NO: 6163647 - DNA, 20 bp, Homo sapiens
ctgagcagtctacttctgtg

SEQ ID NO: 6163648 - DNA, 20 bp, Homo sapiens
ctgagcagtgaatgattcag

SEQ ID NO: 6163649 - DNA, 22 bp, Homo sapiens
ctgagcagtgatattctttgtt

SEQ ID NO: 6163650 - DNA, 15 bp, Homo sapiens
ctgagcagtgcctct

SEQ ID NO: 6163651 - DNA, 18 bp, Homo sapiens
ctgagcagtgcctcttgt

SEQ ID NO: 6163652 - DNA, 16 bp, Homo sapiens
ctgagcagtggggagc

SEQ ID NO: 6163653 - DNA, 23 bp, Homo sapiens
ctgagcagtgtacactgttccca

SEQ ID NO: 6163654 - DNA, 17 bp, Homo sapiens
ctgagcagttcccctgg

SEQ ID NO: 6163655 - DNA, 21 bp, Homo sapiens
ctgagcagttgttatattcat

SEQ ID NO: 6163656 - DNA, 21 bp, Homo sapiens
ctgagcatatgttccatgcct

SEQ ID NO: 6163657 - DNA, 17 bp, Homo sapiens
ctgagcatcacaataaa

SEQ ID NO: 6163658 - DNA, 16 bp, Homo sapiens
ctgagcatccagacct

SEQ ID NO: 6163659 - DNA, 12 bp, Homo sapiens
ctgagcatctcc

SEQ ID NO: 6163660 - DNA, 17 bp, Homo sapiens
ctgagcatggagacagc

SEQ ID NO: 6163661 - DNA, 15 bp, Homo sapiens
ctgagcattcaggca

SEQ ID NO: 6163662 - DNA, 14 bp, Homo sapiens
ctgagcatttgcac

SEQ ID NO: 6163663 - DNA, 21 bp, Homo sapiens
ctgagccaaaaacaataaacg

SEQ ID NO: 6163664 - DNA, 17 bp, Homo sapiens
ctgagccaaagccagag

SEQ ID NO: 6163665 - DNA, 21 bp, Homo sapiens
ctgagccaaagccagagtggc

SEQ ID NO: 6163666 - DNA, 16 bp, Homo sapiens
ctgagccaaatttctt

SEQ ID NO: 6163667 - DNA, 15 bp, Homo sapiens
ctgagccaaggaggc

SEQ ID NO: 6163668 - DNA, 16 bp, Homo sapiens
ctgagccaaggaggcc

SEQ ID NO: 6163669 - DNA, 19 bp, Homo sapiens
ctgagccaaggaggcctgg

SEQ ID NO: 6163670 - DNA, 16 bp, Homo sapiens
ctgagccaagggaggg

SEQ ID NO: 6163671 - DNA, 21 bp, Homo sapiens
ctgagccaagggagggaaggg

SEQ ID NO: 6163672 - DNA, 14 bp, Homo sapiens
ctgagccacagcag

SEQ ID NO: 6163673 - DNA, 18 bp, Homo sapiens
ctgagccacagcagcatt

SEQ ID NO: 6163674 - DNA, 16 bp, Homo sapiens
ctgagccacagtgggg

SEQ ID NO: 6163675 - DNA, 17 bp, Homo sapiens
ctgagccactggaggaa

SEQ ID NO: 6163676 - DNA, 16 bp, Homo sapiens
ctgagccagattacag

SEQ ID NO: 6163677 - DNA, 15 bp, Homo sapiens
ctgagccagattggc

SEQ ID NO: 6163678 - DNA, 22 bp, Homo sapiens
ctgagccagattggccaattaa

SEQ ID NO: 6163679 - DNA, 14 bp, Homo sapiens
ctgagccagatttc

SEQ ID NO: 6163680 - DNA, 18 bp, Homo sapiens
ctgagccagatttcactc

SEQ ID NO: 6163681 - DNA, 19 bp, Homo sapiens
ctgagccagatttcactct

SEQ ID NO: 6163682 - DNA, 16 bp, Homo sapiens
ctgagccagcaccgcc

SEQ ID NO: 6163683 - DNA, 12 bp, Homo sapiens
ctgagccagctg

SEQ ID NO: 6163684 - DNA, 22 bp, Homo sapiens
ctgagccaggagcctcctgacc

SEQ ID NO: 6163685 - DNA, 11 bp, Homo sapiens
ctgagccaggc

SEQ ID NO: 6163686 - DNA, 12 bp, Homo sapiens
ctgagccaggct

SEQ ID NO: 6163687 - DNA, 14 bp, Homo sapiens
ctgagccaggctag

SEQ ID NO: 6163688 - DNA, 14 bp, Homo sapiens
ctgagccagggaac

SEQ ID NO: 6163689 - DNA, 22 bp, Homo sapiens
ctgagccagggaacagccccag

SEQ ID NO: 6163690 - DNA, 23 bp, Homo sapiens
ctgagccagggaacagccccagg

SEQ ID NO: 6163691 - DNA, 22 bp, Homo sapiens
ctgagccagttcagtacctgga

SEQ ID NO: 6163692 - DNA, 17 bp, Homo sapiens
ctgagccataccgacca

SEQ ID NO: 6163693 - DNA, 13 bp, Homo sapiens
ctgagccatggcg

SEQ ID NO: 6163694 - DNA, 20 bp, Homo sapiens
ctgagcccaaccaggccctg

SEQ ID NO: 6163695 - DNA, 20 bp, Homo sapiens
ctgagcccactctactgccc

SEQ ID NO: 6163696 - DNA, 23 bp, Homo sapiens
ctgagcccactctactgccccag

SEQ ID NO: 6163697 - DNA, 13 bp, Homo sapiens
ctgagcccactgt

SEQ ID NO: 6163698 - DNA, 20 bp, Homo sapiens
ctgagcccagaaaaaaggac

SEQ ID NO: 6163699 - DNA, 21 bp, Homo sapiens
ctgtggctggtactttctgta

SEQ ID NO: 6163700 - DNA, 12 bp, Homo sapiens
ctgtggctggtg

SEQ ID NO: 6163701 - DNA, 15 bp, Homo sapiens
ctgtggctggtgagc

SEQ ID NO: 6163702 - DNA, 22 bp, Homo sapiens
ctgtggctgtgtgtctgcttgt

SEQ ID NO: 6163703 - DNA, 20 bp, Homo sapiens
ctgtggcttcccatgtcttt

SEQ ID NO: 6163704 - DNA, 15 bp, Homo sapiens
ctgtggcttctccgt

SEQ ID NO: 6163705 - DNA, 16 bp, Homo sapiens
ctgtggcttggagtgg

SEQ ID NO: 6163706 - DNA, 20 bp, Homo sapiens
ctgtggcttggagtggccaa

SEQ ID NO: 6163707 - DNA, 18 bp, Homo sapiens
ctgtggctttcagcctct

SEQ ID NO: 6163708 - DNA, 14 bp, Homo sapiens
ctgtgggaaatggt

SEQ ID NO: 6163709 - DNA, 24 bp, Homo sapiens
ctgtgggaaatggtactgtacagc

SEQ ID NO: 6163710 - DNA, 20 bp, Homo sapiens
ctgtgggaacgagaggggaa

SEQ ID NO: 6163711 - DNA, 23 bp, Homo sapiens
ctgtgggaacgagaggggaagag

SEQ ID NO: 6163712 - DNA, 20 bp, Homo sapiens
ctgtgggaaggccagctgcc

SEQ ID NO: 6163713 - DNA, 19 bp, Homo sapiens
ctgtgggactggcccaccc

SEQ ID NO: 6163714 - DNA, 16 bp, Homo sapiens
ctgtgggagctcagct

SEQ ID NO: 6163715 - DNA, 20 bp, Homo sapiens
ctgtgggagggactttgctg

SEQ ID NO: 6163716 - DNA, 15 bp, Homo sapiens
ctgtgggagtccact

SEQ ID NO: 6163717 - DNA, 21 bp, Homo sapiens
ctgtgggagtccactttcctc

SEQ ID NO: 6163718 - DNA, 19 bp, Homo sapiens
ctgtgggcaaagtcctcct

SEQ ID NO: 6163719 - DNA, 15 bp, Homo sapiens
ctgtgggcaatttag

SEQ ID NO: 6163720 - DNA, 21 bp, Homo sapiens
ctgtgggcacaggtcaggcta

SEQ ID NO: 6163721 - DNA, 17 bp, Homo sapiens
ctgtgggcactggtggg

SEQ ID NO: 6163722 - DNA, 23 bp, Homo sapiens
ctgtgggcagcaccctcccccgc

SEQ ID NO: 6163723 - DNA, 16 bp, Homo sapiens
ctgtgggcagcatgcc

SEQ ID NO: 6163724 - DNA, 15 bp, Homo sapiens
ctgtgggcagctggc

SEQ ID NO: 6163725 - DNA, 16 bp, Homo sapiens
ctgtgggcagctggct

SEQ ID NO: 6163726 - DNA, 20 bp, Homo sapiens
ctgtgggccaggagctcagc

SEQ ID NO: 6163727 - DNA, 18 bp, Homo sapiens
ctgtgggcccctcaacag

SEQ ID NO: 6163728 - DNA, 18 bp, Homo sapiens
ctgtgggccctaccctcc

SEQ ID NO: 6163729 - DNA, 20 bp, Homo sapiens
ctgtgggcctcaaggacttg

SEQ ID NO: 6163730 - DNA, 16 bp, Homo sapiens
ctgtgggcctcacctg

SEQ ID NO: 6163731 - DNA, 17 bp, Homo sapiens
ctgtgggcctcacctgc

SEQ ID NO: 6163732 - DNA, 16 bp, Homo sapiens
ctgtgggcggctcctg

SEQ ID NO: 6163733 - DNA, 19 bp, Homo sapiens
ctgtgggcgggcccagcac

SEQ ID NO: 6163734 - DNA, 21 bp, Homo sapiens
ctgtgggcgtgagacctgccc

SEQ ID NO: 6163735 - DNA, 22 bp, Homo sapiens
ctgtgggcgtgagacctgcccc

SEQ ID NO: 6163736 - DNA, 14 bp, Homo sapiens
ctgtgggctcacac

SEQ ID NO: 6163737 - DNA, 15 bp, Homo sapiens
ctgtgggctgactgc

SEQ ID NO: 6163738 - DNA, 14 bp, Homo sapiens
ctgtgggctgcact

SEQ ID NO: 6163739 - DNA, 18 bp, Homo sapiens
ctgtgggctgcactctgt

SEQ ID NO: 6163740 - DNA, 21 bp, Homo sapiens
ctgtgggcttatgtctctgcc

SEQ ID NO: 6163741 - DNA, 22 bp, Homo sapiens
ctgtgggcttatgtctctgcct

SEQ ID NO: 6163742 - DNA, 15 bp, Homo sapiens
ctgtgggcttcccca

SEQ ID NO: 6163743 - DNA, 18 bp, Homo sapiens
ctgtgggcttggccttgt

SEQ ID NO: 6163744 - DNA, 21 bp, Homo sapiens
ctgtgggcttggccttgtgtc

SEQ ID NO: 6163745 - DNA, 17 bp, Homo sapiens
ctgtggggaacatggct

SEQ ID NO: 6163746 - DNA, 15 bp, Homo sapiens
ctgtggggactgaac

SEQ ID NO: 6163747 - DNA, 14 bp, Homo sapiens
ctgtggggagccga

SEQ ID NO: 6163748 - DNA, 18 bp, Homo sapiens
ctgtggggagccgagggc

SEQ ID NO: 6163749 - DNA, 14 bp, Homo sapiens
ctgtggggagctgg

SEQ ID NO: 6163750 - DNA, 17 bp, Homo sapiens
ctgtggggatctcaggg

SEQ ID NO: 6163751 - DNA, 21 bp, Homo sapiens
ctgtggggatctcaggggctg

SEQ ID NO: 6163752 - DNA, 18 bp, Homo sapiens
ctgtggggatttctccca

SEQ ID NO: 6163753 - DNA, 21 bp, Homo sapiens
ctgtggggatttctcccagct

SEQ ID NO: 6163754 - DNA, 20 bp, Homo sapiens
ctgtggggcaagcctgagtg

SEQ ID NO: 6163755 - DNA, 20 bp, Homo sapiens
ctgtggggcagctgagcagc

SEQ ID NO: 6163756 - DNA, 12 bp, Homo sapiens
ctgtggggcagg

SEQ ID NO: 6163757 - DNA, 15 bp, Homo sapiens
ctgtggggcaggagt

SEQ ID NO: 6163758 - DNA, 20 bp, Homo sapiens
ctgtggggcaggagtgccag

SEQ ID NO: 6163759 - DNA, 16 bp, Homo sapiens
ctgtggggcccccaca

SEQ ID NO: 6163760 - DNA, 23 bp, Homo sapiens
ctgtggggcccttgggccacgct

SEQ ID NO: 6163761 - DNA, 20 bp, Homo sapiens
ctgtggggcctggggagccc

SEQ ID NO: 6163762 - DNA, 21 bp, Homo sapiens
ctgtggggcctggggagccca

SEQ ID NO: 6163763 - DNA, 15 bp, Homo sapiens
ctgtggggctgggca

SEQ ID NO: 6163764 - DNA, 14 bp, Homo sapiens
ctgtggggctggta

SEQ ID NO: 6163765 - DNA, 17 bp, Homo sapiens
ctgtggggctggtagct

SEQ ID NO: 6163766 - DNA, 20 bp, Homo sapiens
ctgtggggcttacagaaatg

SEQ ID NO: 6163767 - DNA, 22 bp, Homo sapiens
ctgtgggggtcatcagggaggg

SEQ ID NO: 6163768 - DNA, 14 bp, Homo sapiens
ctgtgggggtggcc

SEQ ID NO: 6163769 - DNA, 17 bp, Homo sapiens
ctgtgggggtggccatc

SEQ ID NO: 6163770 - DNA, 23 bp, Homo sapiens
ctgtgggggtggccatccctggg

SEQ ID NO: 6163771 - DNA, 20 bp, Homo sapiens
ctgtgggggtgtgccccctt

SEQ ID NO: 6163772 - DNA, 16 bp, Homo sapiens
ctgtggggtcgggctc

SEQ ID NO: 6163773 - DNA, 18 bp, Homo sapiens
ctgtggggtcgggctcac

SEQ ID NO: 6163774 - DNA, 16 bp, Homo sapiens
ctgtggggtggacctg

SEQ ID NO: 6163775 - DNA, 19 bp, Homo sapiens
ctgtggggtggacctggga

SEQ ID NO: 6163776 - DNA, 16 bp, Homo sapiens
ctgtggggtggagcac

SEQ ID NO: 6163777 - DNA, 18 bp, Homo sapiens
ctgtggggtggagcactg

SEQ ID NO: 6163778 - DNA, 22 bp, Homo sapiens
ctgtggggtttttaatctcttg

SEQ ID NO: 6163779 - DNA, 15 bp, Homo sapiens
ctgtgggtagtatga

SEQ ID NO: 6163780 - DNA, 14 bp, Homo sapiens
ctgtgggtattgtt

SEQ ID NO: 6163781 - DNA, 23 bp, Homo sapiens
ctgtgggtccctgcgtctcctgc

SEQ ID NO: 6163782 - DNA, 13 bp, Homo sapiens
ctgtgggtctctg

SEQ ID NO: 6163783 - DNA, 17 bp, Homo sapiens
ctgtgggtctctgaagg

SEQ ID NO: 6163784 - DNA, 11 bp, Homo sapiens
ctgtgggtggg

SEQ ID NO: 6163785 - DNA, 22 bp, Homo sapiens
ctgtgggtggggaggccctgcc

SEQ ID NO: 6163786 - DNA, 16 bp, Homo sapiens
ctgtgggtggggcttc

SEQ ID NO: 6163787 - DNA, 22 bp, Homo sapiens
ctgtgggtggggcttctctggg

SEQ ID NO: 6163788 - DNA, 16 bp, Homo sapiens
ctgtgggtgtctccct

SEQ ID NO: 6163789 - DNA, 17 bp, Homo sapiens
ctgtgggtgtctccctc

SEQ ID NO: 6163790 - DNA, 18 bp, Homo sapiens
ctgtgggtgtctccctcg

SEQ ID NO: 6163791 - DNA, 21 bp, Homo sapiens
ctgtgggtgtctccctcgggg

SEQ ID NO: 6163792 - DNA, 23 bp, Homo sapiens
ctgtgggtgtctccctcgggggc

SEQ ID NO: 6163793 - DNA, 18 bp, Homo sapiens
ctgtgggtgttctttcct

SEQ ID NO: 6163794 - DNA, 21 bp, Homo sapiens
ctgtgggtttctaaagctgcc

SEQ ID NO: 6163795 - DNA, 21 bp, Homo sapiens
ctgtgggtttgggtgcctcct

SEQ ID NO: 6163796 - DNA, 22 bp, Homo sapiens
ctgtgggtttgggtgcctcctg

SEQ ID NO: 6163797 - DNA, 23 bp, Homo sapiens
ctgtgggtttgggtgcctcctgc

SEQ ID NO: 6163798 - DNA, 24 bp, Homo sapiens
ctgtgggtttgggtgcctcctgca

SEQ ID NO: 6163799 - DNA, 23 bp, Homo sapiens
ctgtggtaaatgccacacacctt

SEQ ID NO: 6163800 - DNA, 23 bp, Homo sapiens
ctgtggtaactttgcaggcggcc

SEQ ID NO: 6163801 - DNA, 14 bp, Homo sapiens
ctgtggtaccctgg

SEQ ID NO: 6163802 - DNA, 18 bp, Homo sapiens
ctgtggtaccctggcaga

SEQ ID NO: 6163803 - DNA, 22 bp, Homo sapiens
ctgtggtaccctggcagagaag

SEQ ID NO: 6163804 - DNA, 16 bp, Homo sapiens
ctgtggtaggggcagg

SEQ ID NO: 6163805 - DNA, 17 bp, Homo sapiens
ctgtggtaggggcaggg

SEQ ID NO: 6163806 - DNA, 18 bp, Homo sapiens
ctgtggtaggggcaggga

SEQ ID NO: 6163807 - DNA, 21 bp, Homo sapiens
ctgtggtaggggcagggaggc

SEQ ID NO: 6163808 - DNA, 23 bp, Homo sapiens
ctgtggtagtcctcccaagctgt

SEQ ID NO: 6163809 - DNA, 21 bp, Homo sapiens
ctgtggtagttggaaacaaat

SEQ ID NO: 6163810 - DNA, 20 bp, Homo sapiens
ctgtggtatctttaattgta

SEQ ID NO: 6163811 - DNA, 20 bp, Homo sapiens
ctgtggtcaaggctacagat

SEQ ID NO: 6163812 - DNA, 16 bp, Homo sapiens
ctgtggtcacagcgga

SEQ ID NO: 6163813 - DNA, 22 bp, Homo sapiens
ctgtggtcagcagatgccagtg

SEQ ID NO: 6163814 - DNA, 15 bp, Homo sapiens
ctgtggtcaggccca

SEQ ID NO: 6163815 - DNA, 16 bp, Homo sapiens
ctgtggtcaggcccag

SEQ ID NO: 6163816 - DNA, 22 bp, Homo sapiens
ctgtggtcaggcccagcctctc

SEQ ID NO: 6163817 - DNA, 20 bp, Homo sapiens
ctgtggtccagagtcaactg

SEQ ID NO: 6163818 - DNA, 17 bp, Homo sapiens
ctgtggtcccacccagg

SEQ ID NO: 6163819 - DNA, 19 bp, Homo sapiens
ctgtggtcccacccaggaa

SEQ ID NO: 6163820 - DNA, 19 bp, Homo sapiens
ctgtggtgaagtgtggctg

SEQ ID NO: 6163821 - DNA, 22 bp, Homo sapiens
ctgtggtgaagtgtggctggtg

SEQ ID NO: 6163822 - DNA, 22 bp, Homo sapiens
ctgtggtgactgaacgagggat

SEQ ID NO: 6163823 - DNA, 12 bp, Homo sapiens
ctgtggtgactt

SEQ ID NO: 6163824 - DNA, 17 bp, Homo sapiens
ctgtggtgaggtcctgt

SEQ ID NO: 6163825 - DNA, 13 bp, Homo sapiens
ctgtggtgcagtg

SEQ ID NO: 6163826 - DNA, 13 bp, Homo sapiens
ctgtggtggcctg

SEQ ID NO: 6163827 - DNA, 22 bp, Homo sapiens
ctgtggtggctccccctctgct

SEQ ID NO: 6163828 - DNA, 23 bp, Homo sapiens
ctgtggtggctccccctctgctt

SEQ ID NO: 6163829 - DNA, 18 bp, Homo sapiens
ctgtggtggctgtctctg

SEQ ID NO: 6163830 - DNA, 19 bp, Homo sapiens
ctgtggtggctgtctctgt

SEQ ID NO: 6163831 - DNA, 20 bp, Homo sapiens
ctgtggtggttcattccaca

SEQ ID NO: 6163832 - DNA, 21 bp, Homo sapiens
ctgtggtggttcattccacag

SEQ ID NO: 6163833 - DNA, 18 bp, Homo sapiens
ctgtggtgtctcgtggcc

SEQ ID NO: 6163834 - DNA, 22 bp, Homo sapiens
ctgtggtgtgtccccctctgtc

SEQ ID NO: 6163835 - DNA, 14 bp, Homo sapiens
ctgtggttccagta

SEQ ID NO: 6163836 - DNA, 16 bp, Homo sapiens
ctgtggttccagtaag

SEQ ID NO: 6163837 - DNA, 20 bp, Homo sapiens
ctgtggttcctaagcctgtt

SEQ ID NO: 6163838 - DNA, 15 bp, Homo sapiens
ctgtggttcctctgc

SEQ ID NO: 6163839 - DNA, 21 bp, Homo sapiens
ctgtggttcctggggtgccct

SEQ ID NO: 6163840 - DNA, 17 bp, Homo sapiens
ctgtggttctataataa

SEQ ID NO: 6163841 - DNA, 20 bp, Homo sapiens
ctgtggttctgagatggctc

SEQ ID NO: 6163842 - DNA, 23 bp, Homo sapiens
ctgtggttgcagtctttccccca

SEQ ID NO: 6163843 - DNA, 15 bp, Homo sapiens
ctgtggttgcatttg

SEQ ID NO: 6163844 - DNA, 14 bp, Homo sapiens
ctgtggttgtggat

SEQ ID NO: 6163845 - DNA, 21 bp, Homo sapiens
ctgtggttgtggatgggaggc

SEQ ID NO: 6163846 - DNA, 22 bp, Homo sapiens
ctgtggttgtggatgggaggct

SEQ ID NO: 6163847 - DNA, 18 bp, Homo sapiens
ctgtggtttcatgttagt

SEQ ID NO: 6163848 - DNA, 20 bp, Homo sapiens
ctgtggtttgggggagaaga

SEQ ID NO: 6163849 - DNA, 23 bp, Homo sapiens
ctgtggtttggttggggcttcac

SEQ ID NO: 6163850 - DNA, 19 bp, Homo sapiens
ctgtggttttcccctccct

SEQ ID NO: 6163851 - DNA, 20 bp, Homo sapiens
ctgtggttttcccctccctg

SEQ ID NO: 6163852 - DNA, 16 bp, Homo sapiens
ctgtgtaaaaagagag

SEQ ID NO: 6163853 - DNA, 15 bp, Homo sapiens
ctgtgtaaaatgtaa

SEQ ID NO: 6163854 - DNA, 19 bp, Homo sapiens
ctgtgtaaaatgtaatgca

SEQ ID NO: 6163855 - DNA, 21 bp, Homo sapiens
ctgtgtaaactcatctgaaat

SEQ ID NO: 6163856 - DNA, 13 bp, Homo sapiens
ctgtgtaaagtta

SEQ ID NO: 6163857 - DNA, 14 bp, Homo sapiens
ctgtgtaaagttag

SEQ ID NO: 6163858 - DNA, 15 bp, Homo sapiens
ctgtgtaaagttagt

SEQ ID NO: 6163859 - DNA, 21 bp, Homo sapiens
ctgtgtaaatatttttccctc

SEQ ID NO: 6163860 - DNA, 23 bp, Homo sapiens
ctgtgtaaatatttttccctccg

SEQ ID NO: 6163861 - DNA, 17 bp, Homo sapiens
ctgtgtaaatgctccag

SEQ ID NO: 6163862 - DNA, 21 bp, Homo sapiens
ctgtgtaaatgctccagcact

SEQ ID NO: 6163863 - DNA, 18 bp, Homo sapiens
ctgtgtaacagctccttg

SEQ ID NO: 6163864 - DNA, 22 bp, Homo sapiens
ctgtgtaacagctccttgggag

SEQ ID NO: 6163865 - DNA, 19 bp, Homo sapiens
ctgtgtaacatccaagcca

SEQ ID NO: 6163866 - DNA, 22 bp, Homo sapiens
ctgtgtaacatccaagccagag

SEQ ID NO: 6163867 - DNA, 23 bp, Homo sapiens
ctgtgtaacatccaagccagagt

SEQ ID NO: 6163868 - DNA, 13 bp, Homo sapiens
ctgtgtaacatct

SEQ ID NO: 6163869 - DNA, 15 bp, Homo sapiens
ctgtgtaacatctgc

SEQ ID NO: 6163870 - DNA, 18 bp, Homo sapiens
ctgtgtaacatctgccat

SEQ ID NO: 6163871 - DNA, 22 bp, Homo sapiens
ctgtgtaaccattttataaagt

SEQ ID NO: 6163872 - DNA, 15 bp, Homo sapiens
ctgtgtaaccttggg

SEQ ID NO: 6163873 - DNA, 22 bp, Homo sapiens
ctgagcccagaaaaaaggactg

SEQ ID NO: 6163874 - DNA, 17 bp, Homo sapiens
ctgagcccagccacctc

SEQ ID NO: 6163875 - DNA, 19 bp, Homo sapiens
ctgagcccagccacctccc

SEQ ID NO: 6163876 - DNA, 21 bp, Homo sapiens
ctgagcccagccacctcccaa

SEQ ID NO: 6163877 - DNA, 19 bp, Homo sapiens
ctgagcccagctgcctgga

SEQ ID NO: 6163878 - DNA, 21 bp, Homo sapiens
ctgagcccagctgcctggaga

SEQ ID NO: 6163879 - DNA, 13 bp, Homo sapiens
ctgagcccaggag

SEQ ID NO: 6163880 - DNA, 15 bp, Homo sapiens
ctgagcccaggagct

SEQ ID NO: 6163881 - DNA, 13 bp, Homo sapiens
ctgagcccaggcc

SEQ ID NO: 6163882 - DNA, 16 bp, Homo sapiens
ctgagcccaggccgtt

SEQ ID NO: 6163883 - DNA, 17 bp, Homo sapiens
ctgagcccagggaggcc

SEQ ID NO: 6163884 - DNA, 22 bp, Homo sapiens
ctgagcccagggaggccgaagc

SEQ ID NO: 6163885 - DNA, 11 bp, Homo sapiens
ctgagcccata

SEQ ID NO: 6163886 - DNA, 19 bp, Homo sapiens
ctgagcccatgttctgccc

SEQ ID NO: 6163887 - DNA, 23 bp, Homo sapiens
ctgagcccatgttctgcccccag

SEQ ID NO: 6163888 - DNA, 17 bp, Homo sapiens
ctgagcccatttctggg

SEQ ID NO: 6163889 - DNA, 18 bp, Homo sapiens
ctgagcccatttctgggg

SEQ ID NO: 6163890 - DNA, 16 bp, Homo sapiens
ctgagccccagcccca

SEQ ID NO: 6163891 - DNA, 18 bp, Homo sapiens
ctgagccccagggagagg

SEQ ID NO: 6163892 - DNA, 19 bp, Homo sapiens
ctgagcccccaccggaact

SEQ ID NO: 6163893 - DNA, 20 bp, Homo sapiens
ctgagcccccacctgcctga

SEQ ID NO: 6163894 - DNA, 14 bp, Homo sapiens
ctgagcccccagct

SEQ ID NO: 6163895 - DNA, 18 bp, Homo sapiens
ctgagcccccagcttcca

SEQ ID NO: 6163896 - DNA, 13 bp, Homo sapiens
ctgagccccccat

SEQ ID NO: 6163897 - DNA, 15 bp, Homo sapiens
ctgagccccccatgc

SEQ ID NO: 6163898 - DNA, 21 bp, Homo sapiens
ctgagccccccatgcccctcc

SEQ ID NO: 6163899 - DNA, 21 bp, Homo sapiens
ctgagcccccccaacactgtg

SEQ ID NO: 6163900 - DNA, 16 bp, Homo sapiens
ctgagcccccggctag

SEQ ID NO: 6163901 - DNA, 15 bp, Homo sapiens
ctgagccccctctcc

SEQ ID NO: 6163902 - DNA, 19 bp, Homo sapiens
ctgagccccctctcctgaa

SEQ ID NO: 6163903 - DNA, 13 bp, Homo sapiens
ctgagccccctgt

SEQ ID NO: 6163904 - DNA, 18 bp, Homo sapiens
ctgagcccccttcctgtc

SEQ ID NO: 6163905 - DNA, 22 bp, Homo sapiens
ctgagccccgcagacctcccca

SEQ ID NO: 6163906 - DNA, 19 bp, Homo sapiens
ctgagccccgccctcttcc

SEQ ID NO: 6163907 - DNA, 11 bp, Homo sapiens
ctgagcccctc

SEQ ID NO: 6163908 - DNA, 14 bp, Homo sapiens
ctgagcccctcaga

SEQ ID NO: 6163909 - DNA, 15 bp, Homo sapiens
ctgagcccctcagac

SEQ ID NO: 6163910 - DNA, 23 bp, Homo sapiens
ctgagcccctcagacagccccct

SEQ ID NO: 6163911 - DNA, 15 bp, Homo sapiens
ctgagcccctcctct

SEQ ID NO: 6163912 - DNA, 19 bp, Homo sapiens
ctgagcccctgggactgct

SEQ ID NO: 6163913 - DNA, 22 bp, Homo sapiens
ctgagcccctgggactgctgct

SEQ ID NO: 6163914 - DNA, 16 bp, Homo sapiens
ctgagcccctggggaa

SEQ ID NO: 6163915 - DNA, 16 bp, Homo sapiens
ctgagcccctggtctt

SEQ ID NO: 6163916 - DNA, 21 bp, Homo sapiens
ctgagcccctggtcttctcta

SEQ ID NO: 6163917 - DNA, 20 bp, Homo sapiens
ctgagccccttccttgctct

SEQ ID NO: 6163918 - DNA, 10 bp, Homo sapiens
ctgagcccga

SEQ ID NO: 6163919 - DNA, 14 bp, Homo sapiens
ctgagcccgggctg

SEQ ID NO: 6163920 - DNA, 16 bp, Homo sapiens
ctgagcccgggctgcc

SEQ ID NO: 6163921 - DNA, 20 bp, Homo sapiens
ctgagcccgggctgcctggg

SEQ ID NO: 6163922 - DNA, 22 bp, Homo sapiens
ctgagcccgggctgcctgggct

SEQ ID NO: 6163923 - DNA, 18 bp, Homo sapiens
ctgagccctactccctgc

SEQ ID NO: 6163924 - DNA, 20 bp, Homo sapiens
ctgagccctactccctgcag

SEQ ID NO: 6163925 - DNA, 16 bp, Homo sapiens
ctgagccctcaaagtg

SEQ ID NO: 6163926 - DNA, 17 bp, Homo sapiens
ctgagccctcaaagtga

SEQ ID NO: 6163927 - DNA, 23 bp, Homo sapiens
ctgagccctccctcttcccagca

SEQ ID NO: 6163928 - DNA, 21 bp, Homo sapiens
ctgagccctccttcttgccct

SEQ ID NO: 6163929 - DNA, 23 bp, Homo sapiens
ctgagccctccttcttgccctga

SEQ ID NO: 6163930 - DNA, 18 bp, Homo sapiens
ctgagccctctcactcca

SEQ ID NO: 6163931 - DNA, 23 bp, Homo sapiens
ctgagccctctcactccagccaa

SEQ ID NO: 6163932 - DNA, 13 bp, Homo sapiens
ctgagccctgggg

SEQ ID NO: 6163933 - DNA, 14 bp, Homo sapiens
ctgagccctgggga

SEQ ID NO: 6163934 - DNA, 18 bp, Homo sapiens
ctgagccctggggactgt

SEQ ID NO: 6163935 - DNA, 18 bp, Homo sapiens
ctgagccctggtgtgttt

SEQ ID NO: 6163936 - DNA, 15 bp, Homo sapiens
ctgagcccttgcaca

SEQ ID NO: 6163937 - DNA, 22 bp, Homo sapiens
ctgagcccttgcacaggccact

SEQ ID NO: 6163938 - DNA, 15 bp, Homo sapiens
ctgagccgatctggt

SEQ ID NO: 6163939 - DNA, 14 bp, Homo sapiens
ctgagccgcagaga

SEQ ID NO: 6163940 - DNA, 23 bp, Homo sapiens
ctgagccgcgctttcccctcctc

SEQ ID NO: 6163941 - DNA, 18 bp, Homo sapiens
ctgagccggccccaggct

SEQ ID NO: 6163942 - DNA, 23 bp, Homo sapiens
ctgagccggccccaggctcgtgg

SEQ ID NO: 6163943 - DNA, 13 bp, Homo sapiens
ctgagcctactgt

SEQ ID NO: 6163944 - DNA, 21 bp, Homo sapiens
ctgagcctactgtctccttcc

SEQ ID NO: 6163945 - DNA, 20 bp, Homo sapiens
ctgagcctcaaccttctggg

SEQ ID NO: 6163946 - DNA, 22 bp, Homo sapiens
ctgagcctcaaccttctggggg

SEQ ID NO: 6163947 - DNA, 17 bp, Homo sapiens
ctgagcctcacagcagt

SEQ ID NO: 6163948 - DNA, 16 bp, Homo sapiens
ctgagcctcagtctcc

SEQ ID NO: 6163949 - DNA, 22 bp, Homo sapiens
ctgagcctcagtctccctccct

SEQ ID NO: 6163950 - DNA, 14 bp, Homo sapiens
ctgagcctctgctc

SEQ ID NO: 6163951 - DNA, 17 bp, Homo sapiens
ctgagcctgaggccttc

SEQ ID NO: 6163952 - DNA, 20 bp, Homo sapiens
ctgagcctgaggccttccag

SEQ ID NO: 6163953 - DNA, 13 bp, Homo sapiens
ctgagcctgcatt

SEQ ID NO: 6163954 - DNA, 16 bp, Homo sapiens
ctgagcctgcattctg

SEQ ID NO: 6163955 - DNA, 17 bp, Homo sapiens
ctgagcctgcattctgc

SEQ ID NO: 6163956 - DNA, 20 bp, Homo sapiens
ctgagcctgccaaagtgcct

SEQ ID NO: 6163957 - DNA, 12 bp, Homo sapiens
ctgagcctgccg

SEQ ID NO: 6163958 - DNA, 14 bp, Homo sapiens
ctgagcctgccgag

SEQ ID NO: 6163959 - DNA, 16 bp, Homo sapiens
ctgagcctgccgagca

SEQ ID NO: 6163960 - DNA, 20 bp, Homo sapiens
ctgagcctggccatgtcctc

SEQ ID NO: 6163961 - DNA, 16 bp, Homo sapiens
ctgagcctggctggca

SEQ ID NO: 6163962 - DNA, 22 bp, Homo sapiens
ctgagcctgtgggtccccactc

SEQ ID NO: 6163963 - DNA, 15 bp, Homo sapiens
ctgagcctgtgtcct

SEQ ID NO: 6163964 - DNA, 13 bp, Homo sapiens
ctgagcctgttca

SEQ ID NO: 6163965 - DNA, 22 bp, Homo sapiens
ctgagccttagtttcagctgac

SEQ ID NO: 6163966 - DNA, 23 bp, Homo sapiens
ctgagccttagtttcagctgacc

SEQ ID NO: 6163967 - DNA, 14 bp, Homo sapiens
ctgagccttctgag

SEQ ID NO: 6163968 - DNA, 16 bp, Homo sapiens
ctgagccttgtaattc

SEQ ID NO: 6163969 - DNA, 21 bp, Homo sapiens
ctgagccttgtaattctaaat

SEQ ID NO: 6163970 - DNA, 20 bp, Homo sapiens
ctgagcgacagtgagactct

SEQ ID NO: 6163971 - DNA, 14 bp, Homo sapiens
ctgagcgagctggg

SEQ ID NO: 6163972 - DNA, 19 bp, Homo sapiens
ctgagcgaggaaaaacaac

SEQ ID NO: 6163973 - DNA, 22 bp, Homo sapiens
ctgagcgaggaaaaacaacaaa

SEQ ID NO: 6163974 - DNA, 17 bp, Homo sapiens
ctgagcgagtgctctca

SEQ ID NO: 6163975 - DNA, 14 bp, Homo sapiens
ctgagcgcaagcca

SEQ ID NO: 6163976 - DNA, 20 bp, Homo sapiens
ctgagcgcccccgagccctg

SEQ ID NO: 6163977 - DNA, 15 bp, Homo sapiens
ctgagcgcctccatc

SEQ ID NO: 6163978 - DNA, 19 bp, Homo sapiens
ctgagcgcctggatttctg

SEQ ID NO: 6163979 - DNA, 15 bp, Homo sapiens
ctgagcgcctgggtc

SEQ ID NO: 6163980 - DNA, 14 bp, Homo sapiens
ctgagcgctcctgc

SEQ ID NO: 6163981 - DNA, 15 bp, Homo sapiens
ctgagcgctgtggac

SEQ ID NO: 6163982 - DNA, 20 bp, Homo sapiens
ctgagcgctgtggactgtcc

SEQ ID NO: 6163983 - DNA, 21 bp, Homo sapiens
ctgagcggcaccctggtctgt

SEQ ID NO: 6163984 - DNA, 20 bp, Homo sapiens
ctgagcggccgcctgtcctt

SEQ ID NO: 6163985 - DNA, 13 bp, Homo sapiens
ctgagcgggaggc

SEQ ID NO: 6163986 - DNA, 15 bp, Homo sapiens
ctgagcgggaggcag

SEQ ID NO: 6163987 - DNA, 23 bp, Homo sapiens
ctgagcgggagtcagggacctgc

SEQ ID NO: 6163988 - DNA, 18 bp, Homo sapiens
ctgagcgtccagaaatgg

SEQ ID NO: 6163989 - DNA, 23 bp, Homo sapiens
ctgagcgtgctttccaaaaccca

SEQ ID NO: 6163990 - DNA, 19 bp, Homo sapiens
ctgagcgtggaagggggag

SEQ ID NO: 6163991 - DNA, 21 bp, Homo sapiens
ctgagcgtggaagggggagga

SEQ ID NO: 6163992 - DNA, 22 bp, Homo sapiens
ctgagcgtggaagggggaggag

SEQ ID NO: 6163993 - DNA, 21 bp, Homo sapiens
ctgagcgtttaaagtactgag

SEQ ID NO: 6163994 - DNA, 21 bp, Homo sapiens
ctgagctagcctccagctttg

SEQ ID NO: 6163995 - DNA, 17 bp, Homo sapiens
ctgagctataacatttg

SEQ ID NO: 6163996 - DNA, 19 bp, Homo sapiens
ctgagctataacatttgct

SEQ ID NO: 6163997 - DNA, 13 bp, Homo sapiens
ctgagctatttca

SEQ ID NO: 6163998 - DNA, 21 bp, Homo sapiens
ctgagctatttcatctatttt

SEQ ID NO: 6163999 - DNA, 18 bp, Homo sapiens
ctgagctattttcctctg

SEQ ID NO: 6164000 - DNA, 13 bp, Homo sapiens
ctgagctcaagtg

SEQ ID NO: 6164001 - DNA, 17 bp, Homo sapiens
ctgagctcacaaggcag

SEQ ID NO: 6164002 - DNA, 22 bp, Homo sapiens
ctgagctcacaaggcagcaagg

SEQ ID NO: 6164003 - DNA, 23 bp, Homo sapiens
ctgagctcacaaggcagcaaggc

SEQ ID NO: 6164004 - DNA, 13 bp, Homo sapiens
ctgagctcactcg

SEQ ID NO: 6164005 - DNA, 17 bp, Homo sapiens
ctgagctcagcgtggag

SEQ ID NO: 6164006 - DNA, 12 bp, Homo sapiens
ctgagctcaggc

SEQ ID NO: 6164007 - DNA, 16 bp, Homo sapiens
ctgagctcaggctgag

SEQ ID NO: 6164008 - DNA, 18 bp, Homo sapiens
ctgagctcaggctgagcc

SEQ ID NO: 6164009 - DNA, 19 bp, Homo sapiens
ctgagctcatttggggacc

SEQ ID NO: 6164010 - DNA, 15 bp, Homo sapiens
ctgagctccacctct

SEQ ID NO: 6164011 - DNA, 12 bp, Homo sapiens
ctgagctccagc

SEQ ID NO: 6164012 - DNA, 13 bp, Homo sapiens
ctgagctccagcc

SEQ ID NO: 6164013 - DNA, 15 bp, Homo sapiens
ctgagctccagccac

SEQ ID NO: 6164014 - DNA, 20 bp, Homo sapiens
ctgagctcccacctcccttc

SEQ ID NO: 6164015 - DNA, 23 bp, Homo sapiens
ctgagctccccagatctcccact

SEQ ID NO: 6164016 - DNA, 14 bp, Homo sapiens
ctgagctccccatc

SEQ ID NO: 6164017 - DNA, 16 bp, Homo sapiens
ctgagctccccatcac

SEQ ID NO: 6164018 - DNA, 18 bp, Homo sapiens
ctgagctcctctgggcag

SEQ ID NO: 6164019 - DNA, 13 bp, Homo sapiens
ctgagctcctgct

SEQ ID NO: 6164020 - DNA, 12 bp, Homo sapiens
ctgagctcctgt

SEQ ID NO: 6164021 - DNA, 20 bp, Homo sapiens
ctgagctcggggggctctgc

SEQ ID NO: 6164022 - DNA, 22 bp, Homo sapiens
ctgagctcggggggctctgcct

SEQ ID NO: 6164023 - DNA, 23 bp, Homo sapiens
ctgagctcggggggctctgcctt

SEQ ID NO: 6164024 - DNA, 15 bp, Homo sapiens
ctgagctctccaggc

SEQ ID NO: 6164025 - DNA, 16 bp, Homo sapiens
ctgagctctccaggcc

SEQ ID NO: 6164026 - DNA, 14 bp, Homo sapiens
ctgagctctgacct

SEQ ID NO: 6164027 - DNA, 12 bp, Homo sapiens
ctgagctctgag

SEQ ID NO: 6164028 - DNA, 14 bp, Homo sapiens
ctgagctctgagag

SEQ ID NO: 6164029 - DNA, 17 bp, Homo sapiens
ctgagctctgagaggcc

SEQ ID NO: 6164030 - DNA, 20 bp, Homo sapiens
ctgagctctgagaggccctg

SEQ ID NO: 6164031 - DNA, 23 bp, Homo sapiens
ctgagctctgagaggccctggat

SEQ ID NO: 6164032 - DNA, 13 bp, Homo sapiens
ctgagctctgcct

SEQ ID NO: 6164033 - DNA, 17 bp, Homo sapiens
ctgagctctgcctcaac

SEQ ID NO: 6164034 - DNA, 16 bp, Homo sapiens
ctgagctcttgctatc

SEQ ID NO: 6164035 - DNA, 16 bp, Homo sapiens
ctgagctgaagaaatt

SEQ ID NO: 6164036 - DNA, 17 bp, Homo sapiens
ctgagctgaatgtttgt

SEQ ID NO: 6164037 - DNA, 15 bp, Homo sapiens
ctgagctgaccagcc

SEQ ID NO: 6164038 - DNA, 20 bp, Homo sapiens
ctgagctgagaccactgagt

SEQ ID NO: 6164039 - DNA, 17 bp, Homo sapiens
ctgagctgagccaggct

SEQ ID NO: 6164040 - DNA, 13 bp, Homo sapiens
ctgagctgagtgg

SEQ ID NO: 6164041 - DNA, 19 bp, Homo sapiens
ctgagctgcagcctggctg

SEQ ID NO: 6164042 - DNA, 13 bp, Homo sapiens
ctgagctgccagt

SEQ ID NO: 6164043 - DNA, 21 bp, Homo sapiens
ctgagctgcccacagcaggcc

SEQ ID NO: 6164044 - DNA, 19 bp, Homo sapiens
ctgagctgcccctgctgct

SEQ ID NO: 6164045 - DNA, 20 bp, Homo sapiens
ctgagctgcccctgctgctt

SEQ ID NO: 6164046 - DNA, 14 bp, Homo sapiens
ctgagctgctaaaa

SEQ ID NO: 6164047 - DNA, 13 bp, Homo sapiens
ctgagctgctcac

SEQ ID NO: 6164048 - DNA, 22 bp, Homo sapiens
ctgagctgcttcactagggaat

SEQ ID NO: 6164049 - DNA, 14 bp, Homo sapiens
ctgagctggaaggg

SEQ ID NO: 6164050 - DNA, 17 bp, Homo sapiens
ctgagctggaaggggcc

SEQ ID NO: 6164051 - DNA, 15 bp, Homo sapiens
ctgtgtaactgccca

SEQ ID NO: 6164052 - DNA, 15 bp, Homo sapiens
ctgtgtaagaagctg

SEQ ID NO: 6164053 - DNA, 20 bp, Homo sapiens
ctgtgtaagaagctgtgaat

SEQ ID NO: 6164054 - DNA, 13 bp, Homo sapiens
ctgtgtaagattt

SEQ ID NO: 6164055 - DNA, 17 bp, Homo sapiens
ctgtgtaagctcacatc

SEQ ID NO: 6164056 - DNA, 14 bp, Homo sapiens
ctgtgtaagctgtg

SEQ ID NO: 6164057 - DNA, 15 bp, Homo sapiens
ctgtgtaatagaata

SEQ ID NO: 6164058 - DNA, 15 bp, Homo sapiens
ctgtgtacaaagaaa

SEQ ID NO: 6164059 - DNA, 19 bp, Homo sapiens
ctgtgtacaacaatgcttt

SEQ ID NO: 6164060 - DNA, 20 bp, Homo sapiens
ctgtgtacaactttttaaat

SEQ ID NO: 6164061 - DNA, 16 bp, Homo sapiens
ctgtgtacaatgtgag

SEQ ID NO: 6164062 - DNA, 17 bp, Homo sapiens
ctgtgtacaattttagt

SEQ ID NO: 6164063 - DNA, 23 bp, Homo sapiens
ctgtgtacacatctattctcaaa

SEQ ID NO: 6164064 - DNA, 23 bp, Homo sapiens
ctgtgtacataaagtcatcaaag

SEQ ID NO: 6164065 - DNA, 17 bp, Homo sapiens
ctgtgtacataactgaa

SEQ ID NO: 6164066 - DNA, 14 bp, Homo sapiens
ctgtgtacatttta

SEQ ID NO: 6164067 - DNA, 14 bp, Homo sapiens
ctgtgtacccactc

SEQ ID NO: 6164068 - DNA, 17 bp, Homo sapiens
ctgtgtacctcactgtc

SEQ ID NO: 6164069 - DNA, 18 bp, Homo sapiens
ctgtgtacctcactgtcc

SEQ ID NO: 6164070 - DNA, 16 bp, Homo sapiens
ctgtgtacctctagaa

SEQ ID NO: 6164071 - DNA, 22 bp, Homo sapiens
ctgtgtactggagcctgcatta

SEQ ID NO: 6164072 - DNA, 13 bp, Homo sapiens
ctgtgtactgtgt

SEQ ID NO: 6164073 - DNA, 12 bp, Homo sapiens
ctgtgtacttta

SEQ ID NO: 6164074 - DNA, 15 bp, Homo sapiens
ctgtgtactttactg

SEQ ID NO: 6164075 - DNA, 20 bp, Homo sapiens
ctgtgtagaaactggaagct

SEQ ID NO: 6164076 - DNA, 19 bp, Homo sapiens
ctgtgtagagcctgcatct

SEQ ID NO: 6164077 - DNA, 13 bp, Homo sapiens
ctgtgtagccagt

SEQ ID NO: 6164078 - DNA, 17 bp, Homo sapiens
ctgtgtagctctgtcca

SEQ ID NO: 6164079 - DNA, 19 bp, Homo sapiens
ctgtgtagctctgtccact

SEQ ID NO: 6164080 - DNA, 13 bp, Homo sapiens
ctgtgtagctggg

SEQ ID NO: 6164081 - DNA, 15 bp, Homo sapiens
ctgtgtagctgtgac

SEQ ID NO: 6164082 - DNA, 18 bp, Homo sapiens
ctgtgtagctgtgacctg

SEQ ID NO: 6164083 - DNA, 19 bp, Homo sapiens
ctgtgtagctgtgacctgc

SEQ ID NO: 6164084 - DNA, 20 bp, Homo sapiens
ctgtgtagctgtgacctgct

SEQ ID NO: 6164085 - DNA, 17 bp, Homo sapiens
ctgtgtagtcaataaaa

SEQ ID NO: 6164086 - DNA, 14 bp, Homo sapiens
ctgtgtagttccct

SEQ ID NO: 6164087 - DNA, 17 bp, Homo sapiens
ctgtgtagttccctctg

SEQ ID NO: 6164088 - DNA, 18 bp, Homo sapiens
ctgtgtagttccctctgc

SEQ ID NO: 6164089 - DNA, 23 bp, Homo sapiens
ctgtgtagttccctctgcctggg

SEQ ID NO: 6164090 - DNA, 12 bp, Homo sapiens
ctgtgtatacat

SEQ ID NO: 6164091 - DNA, 22 bp, Homo sapiens
ctgtgtatacatatgtatgtgt

SEQ ID NO: 6164092 - DNA, 23 bp, Homo sapiens
ctgtgtatacatatgtatgtgtg

SEQ ID NO: 6164093 - DNA, 19 bp, Homo sapiens
ctgtgtataggaatttgta

SEQ ID NO: 6164094 - DNA, 22 bp, Homo sapiens
ctgtgtataggaatttgtattt

SEQ ID NO: 6164095 - DNA, 13 bp, Homo sapiens
ctgtgtatattat

SEQ ID NO: 6164096 - DNA, 17 bp, Homo sapiens
ctgtgtatattatttgg

SEQ ID NO: 6164097 - DNA, 16 bp, Homo sapiens
ctgtgtatatttgatt

SEQ ID NO: 6164098 - DNA, 18 bp, Homo sapiens
ctgtgtatatttgattta

SEQ ID NO: 6164099 - DNA, 16 bp, Homo sapiens
ctgtgtatcattaaaa

SEQ ID NO: 6164100 - DNA, 23 bp, Homo sapiens
ctgtgtatcattaaaatatatgt

SEQ ID NO: 6164101 - DNA, 18 bp, Homo sapiens
ctgtgtatgtacatatat

SEQ ID NO: 6164102 - DNA, 23 bp, Homo sapiens
ctgtgtatgtgtgtgtctgtgcg

SEQ ID NO: 6164103 - DNA, 13 bp, Homo sapiens
ctgtgtatgtttt

SEQ ID NO: 6164104 - DNA, 14 bp, Homo sapiens
ctgtgtatgtttta

SEQ ID NO: 6164105 - DNA, 15 bp, Homo sapiens
ctgtgtatgttttat

SEQ ID NO: 6164106 - DNA, 16 bp, Homo sapiens
ctgtgtattaaacctt

SEQ ID NO: 6164107 - DNA, 17 bp, Homo sapiens
ctgtgtattaaaccttt

SEQ ID NO: 6164108 - DNA, 15 bp, Homo sapiens
ctgtgtattccaaga

SEQ ID NO: 6164109 - DNA, 19 bp, Homo sapiens
ctgtgtattccaagacatg

SEQ ID NO: 6164110 - DNA, 17 bp, Homo sapiens
ctgtgtatttaattgta

SEQ ID NO: 6164111 - DNA, 17 bp, Homo sapiens
ctgtgtatttatttaaa

SEQ ID NO: 6164112 - DNA, 12 bp, Homo sapiens
ctgtgtatttct

SEQ ID NO: 6164113 - DNA, 19 bp, Homo sapiens
ctgtgtatttctgtagaat

SEQ ID NO: 6164114 - DNA, 21 bp, Homo sapiens
ctgtgtatttctgtagaatgc

SEQ ID NO: 6164115 - DNA, 14 bp, Homo sapiens
ctgtgtatttgctt

SEQ ID NO: 6164116 - DNA, 16 bp, Homo sapiens
ctgtgtatttgctttt

SEQ ID NO: 6164117 - DNA, 16 bp, Homo sapiens
ctgtgtattttcagtc

SEQ ID NO: 6164118 - DNA, 15 bp, Homo sapiens
ctgtgtattttgaga

SEQ ID NO: 6164119 - DNA, 17 bp, Homo sapiens
ctgtgtcaatccagatg

SEQ ID NO: 6164120 - DNA, 19 bp, Homo sapiens
ctgtgtcaatccagatggt

SEQ ID NO: 6164121 - DNA, 20 bp, Homo sapiens
ctgtgtcaatccagatggtg

SEQ ID NO: 6164122 - DNA, 13 bp, Homo sapiens
ctgtgtcacgtga

SEQ ID NO: 6164123 - DNA, 20 bp, Homo sapiens
ctgtgtcacgtgaccctgtg

SEQ ID NO: 6164124 - DNA, 23 bp, Homo sapiens
ctgtgtcacgtgaccctgtgccc

SEQ ID NO: 6164125 - DNA, 14 bp, Homo sapiens
ctgtgtcactacgt

SEQ ID NO: 6164126 - DNA, 19 bp, Homo sapiens
ctgtgtcactggctgcctc

SEQ ID NO: 6164127 - DNA, 13 bp, Homo sapiens
ctgtgtcagaaac

SEQ ID NO: 6164128 - DNA, 23 bp, Homo sapiens
ctgtgtcagaaaccctggtctcc

SEQ ID NO: 6164129 - DNA, 13 bp, Homo sapiens
ctgtgtcagagcc

SEQ ID NO: 6164130 - DNA, 21 bp, Homo sapiens
ctgtgtcagcatctttgccct

SEQ ID NO: 6164131 - DNA, 16 bp, Homo sapiens
ctgtgtcagcctgtcc

SEQ ID NO: 6164132 - DNA, 16 bp, Homo sapiens
ctgtgtcagtttatgt

SEQ ID NO: 6164133 - DNA, 19 bp, Homo sapiens
ctgtgtcagtttatgtttt

SEQ ID NO: 6164134 - DNA, 23 bp, Homo sapiens
ctgtgtcataaacagatgaataa

SEQ ID NO: 6164135 - DNA, 19 bp, Homo sapiens
ctgtgtcatggtgatgcaa

SEQ ID NO: 6164136 - DNA, 20 bp, Homo sapiens
ctgtgtcattaaccatcttt

SEQ ID NO: 6164137 - DNA, 19 bp, Homo sapiens
ctgtgtcattagtcctttg

SEQ ID NO: 6164138 - DNA, 21 bp, Homo sapiens
ctgtgtccaaaaccgccagct

SEQ ID NO: 6164139 - DNA, 14 bp, Homo sapiens
ctgtgtccagagac

SEQ ID NO: 6164140 - DNA, 23 bp, Homo sapiens
ctgtgtccagagacatgggcctc

SEQ ID NO: 6164141 - DNA, 16 bp, Homo sapiens
ctgtgtccagcagctg

SEQ ID NO: 6164142 - DNA, 23 bp, Homo sapiens
ctgtgtccagttttggaggctga

SEQ ID NO: 6164143 - DNA, 13 bp, Homo sapiens
ctgtgtccatgcg

SEQ ID NO: 6164144 - DNA, 21 bp, Homo sapiens
ctgtgtcccagcacctggcac

SEQ ID NO: 6164145 - DNA, 23 bp, Homo sapiens
ctgtgtcccagccacgcagggcc

SEQ ID NO: 6164146 - DNA, 20 bp, Homo sapiens
ctgtgtcccagtgtctggcc

SEQ ID NO: 6164147 - DNA, 20 bp, Homo sapiens
ctgtgtcccatgacccaccc

SEQ ID NO: 6164148 - DNA, 16 bp, Homo sapiens
ctgtgtcccatgtccc

SEQ ID NO: 6164149 - DNA, 13 bp, Homo sapiens
ctgtgtcccctga

SEQ ID NO: 6164150 - DNA, 17 bp, Homo sapiens
ctgtgtcccctgacctg

SEQ ID NO: 6164151 - DNA, 18 bp, Homo sapiens
ctgtgtccctgctggggt

SEQ ID NO: 6164152 - DNA, 15 bp, Homo sapiens
ctgtgtccggcccag

SEQ ID NO: 6164153 - DNA, 19 bp, Homo sapiens
ctgtgtccgtctgtgtatg

SEQ ID NO: 6164154 - DNA, 20 bp, Homo sapiens
ctgtgtccgtctgtgtatgt

SEQ ID NO: 6164155 - DNA, 21 bp, Homo sapiens
ctgtgtccgtctgtgtatgtg

SEQ ID NO: 6164156 - DNA, 16 bp, Homo sapiens
ctgtgtcctaaggccc

SEQ ID NO: 6164157 - DNA, 18 bp, Homo sapiens
ctgtgtcctaaggcccat

SEQ ID NO: 6164158 - DNA, 16 bp, Homo sapiens
ctgtgtcctccctccc

SEQ ID NO: 6164159 - DNA, 17 bp, Homo sapiens
ctgtgtcctcgcactgc

SEQ ID NO: 6164160 - DNA, 18 bp, Homo sapiens
ctgtgtcctcgcactgcc

SEQ ID NO: 6164161 - DNA, 13 bp, Homo sapiens
ctgtgtcctctcc

SEQ ID NO: 6164162 - DNA, 15 bp, Homo sapiens
ctgtgtcctctccag

SEQ ID NO: 6164163 - DNA, 14 bp, Homo sapiens
ctgtgtcctctccc

SEQ ID NO: 6164164 - DNA, 17 bp, Homo sapiens
ctgtgtcctctgcctgg

SEQ ID NO: 6164165 - DNA, 23 bp, Homo sapiens
ctgtgtcctctgcctgggctctg

SEQ ID NO: 6164166 - DNA, 15 bp, Homo sapiens
ctgtgtcctggtgct

SEQ ID NO: 6164167 - DNA, 20 bp, Homo sapiens
ctgtgtcctggtgctctctg

SEQ ID NO: 6164168 - DNA, 15 bp, Homo sapiens
ctgtgtccttccctg

SEQ ID NO: 6164169 - DNA, 16 bp, Homo sapiens
ctgtgtccttccctgc

SEQ ID NO: 6164170 - DNA, 22 bp, Homo sapiens
ctgtgtccttgcacctgcatcc

SEQ ID NO: 6164171 - DNA, 12 bp, Homo sapiens
ctgtgtctaaga

SEQ ID NO: 6164172 - DNA, 19 bp, Homo sapiens
ctgtgtctaggcaggcaag

SEQ ID NO: 6164173 - DNA, 17 bp, Homo sapiens
ctgtgtctctatgtgaa

SEQ ID NO: 6164174 - DNA, 19 bp, Homo sapiens
ctgtgtctctatgtgaata

SEQ ID NO: 6164175 - DNA, 17 bp, Homo sapiens
ctgtgtctctgcatcca

SEQ ID NO: 6164176 - DNA, 16 bp, Homo sapiens
ctgtgtctctgtttcc

SEQ ID NO: 6164177 - DNA, 20 bp, Homo sapiens
ctgtgtctctgtttcctgaa

SEQ ID NO: 6164178 - DNA, 19 bp, Homo sapiens
ctgtgtctgaatcatgtct

SEQ ID NO: 6164179 - DNA, 20 bp, Homo sapiens
ctgtgtctgaatcatgtctg

SEQ ID NO: 6164180 - DNA, 12 bp, Homo sapiens
ctgtgtctgagc

SEQ ID NO: 6164181 - DNA, 15 bp, Homo sapiens
ctgtgtctgagtggc

SEQ ID NO: 6164182 - DNA, 14 bp, Homo sapiens
ctgtgtctggcagg

SEQ ID NO: 6164183 - DNA, 21 bp, Homo sapiens
ctgtgtctggcgttctcaaga

SEQ ID NO: 6164184 - DNA, 19 bp, Homo sapiens
ctgtgtctggtccacacac

SEQ ID NO: 6164185 - DNA, 21 bp, Homo sapiens
ctgtgtctggtccacacacca

SEQ ID NO: 6164186 - DNA, 13 bp, Homo sapiens
ctgtgtctgtcac

SEQ ID NO: 6164187 - DNA, 13 bp, Homo sapiens
ctgtgtctgtccc

SEQ ID NO: 6164188 - DNA, 15 bp, Homo sapiens
ctgtgtctgtgtctg

SEQ ID NO: 6164189 - DNA, 21 bp, Homo sapiens
ctgtgtcttgcaatggcagcc

SEQ ID NO: 6164190 - DNA, 22 bp, Homo sapiens
ctgtgtcttgcaatggcagcct

SEQ ID NO: 6164191 - DNA, 10 bp, Homo sapiens
ctgtgtcttt

SEQ ID NO: 6164192 - DNA, 11 bp, Homo sapiens
ctgtgtcttta

SEQ ID NO: 6164193 - DNA, 22 bp, Homo sapiens
ctgtgtctttagggagacccaa

SEQ ID NO: 6164194 - DNA, 23 bp, Homo sapiens
ctgtgtctttctctctctctctt

SEQ ID NO: 6164195 - DNA, 20 bp, Homo sapiens
ctgtgtctttggtttgtgct

SEQ ID NO: 6164196 - DNA, 21 bp, Homo sapiens
ctgtgtgaactattgagaaga

SEQ ID NO: 6164197 - DNA, 14 bp, Homo sapiens
ctgtgtgaagaaat

SEQ ID NO: 6164198 - DNA, 16 bp, Homo sapiens
ctgtgtgaagaaatgg

SEQ ID NO: 6164199 - DNA, 18 bp, Homo sapiens
ctgtgtgaatacctgctc

SEQ ID NO: 6164200 - DNA, 14 bp, Homo sapiens
ctgtgtgaatccag

SEQ ID NO: 6164201 - DNA, 16 bp, Homo sapiens
ctgtgtgaatccagga

SEQ ID NO: 6164202 - DNA, 13 bp, Homo sapiens
ctgtgtgaatgtg

SEQ ID NO: 6164203 - DNA, 17 bp, Homo sapiens
ctgtgtgaattcccagg

SEQ ID NO: 6164204 - DNA, 15 bp, Homo sapiens
ctgtgtgaatttttc

SEQ ID NO: 6164205 - DNA, 18 bp, Homo sapiens
ctgtgtgaccctgggcag

SEQ ID NO: 6164206 - DNA, 13 bp, Homo sapiens
ctgtgtgagagag

SEQ ID NO: 6164207 - DNA, 17 bp, Homo sapiens
ctgtgtgagagagaggg

SEQ ID NO: 6164208 - DNA, 22 bp, Homo sapiens
ctgtgtgagaggggcgcctttt

SEQ ID NO: 6164209 - DNA, 20 bp, Homo sapiens
ctgtgtgagcatctctgtgt

SEQ ID NO: 6164210 - DNA, 19 bp, Homo sapiens
ctgtgtgaggctgtgtctc

SEQ ID NO: 6164211 - DNA, 19 bp, Homo sapiens
ctgtgtgatgaactttctc

SEQ ID NO: 6164212 - DNA, 14 bp, Homo sapiens
ctgtgtgattaaaa

SEQ ID NO: 6164213 - DNA, 21 bp, Homo sapiens
ctgtgtgattttcatacaggt

SEQ ID NO: 6164214 - DNA, 9 bp, Homo sapiens
ctgtgtgca

SEQ ID NO: 6164215 - DNA, 13 bp, Homo sapiens
ctgtgtgcaggtt

SEQ ID NO: 6164216 - DNA, 15 bp, Homo sapiens
ctgtgtgcagtgaag

SEQ ID NO: 6164217 - DNA, 15 bp, Homo sapiens
ctgtgtgccccactc

SEQ ID NO: 6164218 - DNA, 20 bp, Homo sapiens
ctgtgtgccctagggctcag

SEQ ID NO: 6164219 - DNA, 23 bp, Homo sapiens
ctgtgtgccctagggctcagagg

SEQ ID NO: 6164220 - DNA, 19 bp, Homo sapiens
ctgtgtgccctgaaaatgt

SEQ ID NO: 6164221 - DNA, 15 bp, Homo sapiens
ctgtgtgcgctctgt

SEQ ID NO: 6164222 - DNA, 19 bp, Homo sapiens
ctgtgtgcgtggcgtggcc

SEQ ID NO: 6164223 - DNA, 20 bp, Homo sapiens
ctgtgtgcgtggcgtggccc

SEQ ID NO: 6164224 - DNA, 21 bp, Homo sapiens
ctgtgtgcgtggtgtggcccg

SEQ ID NO: 6164225 - DNA, 14 bp, Homo sapiens
ctgtgtgctactaa

SEQ ID NO: 6164226 - DNA, 17 bp, Homo sapiens
ctgtgtgctactaacag

SEQ ID NO: 6164227 - DNA, 18 bp, Homo sapiens
ctgtgtgctactaacaga

SEQ ID NO: 6164228 - DNA, 14 bp, Homo sapiens
ctgtgtgctcagga

SEQ ID NO: 6164229 - DNA, 19 bp, Homo sapiens
ctgtgtgctcaggagccct

SEQ ID NO: 6164230 - DNA, 16 bp, Homo sapiens
ctgagctggccaggcc

SEQ ID NO: 6164231 - DNA, 19 bp, Homo sapiens
ctgagctggccctttccag

SEQ ID NO: 6164232 - DNA, 13 bp, Homo sapiens
ctgagctggcctc

SEQ ID NO: 6164233 - DNA, 17 bp, Homo sapiens
ctgagctggcctctcac

SEQ ID NO: 6164234 - DNA, 13 bp, Homo sapiens
ctgagctggctga

SEQ ID NO: 6164235 - DNA, 20 bp, Homo sapiens
ctgagctggctgactaagcc

SEQ ID NO: 6164236 - DNA, 16 bp, Homo sapiens
ctgagctggcttcgga

SEQ ID NO: 6164237 - DNA, 10 bp, Homo sapiens
ctgagctggg

SEQ ID NO: 6164238 - DNA, 12 bp, Homo sapiens
ctgagctgggat

SEQ ID NO: 6164239 - DNA, 13 bp, Homo sapiens
ctgagctgggccc

SEQ ID NO: 6164240 - DNA, 15 bp, Homo sapiens
ctgagctgggcccag

SEQ ID NO: 6164241 - DNA, 16 bp, Homo sapiens
ctgagctgggcccagc

SEQ ID NO: 6164242 - DNA, 17 bp, Homo sapiens
ctgagctgggcccagcc

SEQ ID NO: 6164243 - DNA, 19 bp, Homo sapiens
ctgagctgggcccagcccc

SEQ ID NO: 6164244 - DNA, 20 bp, Homo sapiens
ctgagctgggcccagcccct

SEQ ID NO: 6164245 - DNA, 11 bp, Homo sapiens
ctgagctgggg

SEQ ID NO: 6164246 - DNA, 12 bp, Homo sapiens
ctgagctgggga

SEQ ID NO: 6164247 - DNA, 16 bp, Homo sapiens
ctgagctggggccaca

SEQ ID NO: 6164248 - DNA, 18 bp, Homo sapiens
ctgagctggggcctggag

SEQ ID NO: 6164249 - DNA, 21 bp, Homo sapiens
ctgagctggggcctggagagg

SEQ ID NO: 6164250 - DNA, 23 bp, Homo sapiens
ctgagctggggcctggagagggg

SEQ ID NO: 6164251 - DNA, 17 bp, Homo sapiens
ctgagctgggggaagaa

SEQ ID NO: 6164252 - DNA, 12 bp, Homo sapiens
ctgagctgtaat

SEQ ID NO: 6164253 - DNA, 19 bp, Homo sapiens
ctgagctgtatcttgatgt

SEQ ID NO: 6164254 - DNA, 18 bp, Homo sapiens
ctgagctgtcccaagtcc

SEQ ID NO: 6164255 - DNA, 18 bp, Homo sapiens
ctgagctgtcgctgcctc

SEQ ID NO: 6164256 - DNA, 21 bp, Homo sapiens
ctgagctgtcgctgcctccat

SEQ ID NO: 6164257 - DNA, 18 bp, Homo sapiens
ctgagctgtgacccagag

SEQ ID NO: 6164258 - DNA, 15 bp, Homo sapiens
ctgagctgtgcaggt

SEQ ID NO: 6164259 - DNA, 16 bp, Homo sapiens
ctgagctgtgccagct

SEQ ID NO: 6164260 - DNA, 21 bp, Homo sapiens
ctgagctgtgttttgtctgag

SEQ ID NO: 6164261 - DNA, 22 bp, Homo sapiens
ctgagctgtgttttgtctgagc

SEQ ID NO: 6164262 - DNA, 14 bp, Homo sapiens
ctgagctgttatct

SEQ ID NO: 6164263 - DNA, 18 bp, Homo sapiens
ctgagcttagccttgtgc

SEQ ID NO: 6164264 - DNA, 19 bp, Homo sapiens
ctgagcttagccttgtgcc

SEQ ID NO: 6164265 - DNA, 24 bp, Homo sapiens
ctgagcttagccttgtgccctgcc

SEQ ID NO: 6164266 - DNA, 22 bp, Homo sapiens
ctgagcttagctctgccctgga

SEQ ID NO: 6164267 - DNA, 22 bp, Homo sapiens
ctgagcttcagtataaaagaca

SEQ ID NO: 6164268 - DNA, 16 bp, Homo sapiens
ctgagcttctgagaca

SEQ ID NO: 6164269 - DNA, 16 bp, Homo sapiens
ctgagcttgagctccc

SEQ ID NO: 6164270 - DNA, 17 bp, Homo sapiens
ctgagcttgagctcccc

SEQ ID NO: 6164271 - DNA, 23 bp, Homo sapiens
ctgagcttgagctcccctggagc

SEQ ID NO: 6164272 - DNA, 22 bp, Homo sapiens
ctgagcttgattctaaagggga

SEQ ID NO: 6164273 - DNA, 18 bp, Homo sapiens
ctgagcttggccagaagg

SEQ ID NO: 6164274 - DNA, 21 bp, Homo sapiens
ctgagcttgtcttttctgctg

SEQ ID NO: 6164275 - DNA, 21 bp, Homo sapiens
ctgagctttaaatcattagag

SEQ ID NO: 6164276 - DNA, 23 bp, Homo sapiens
ctgagctttccgcgtcagcaagt

SEQ ID NO: 6164277 - DNA, 19 bp, Homo sapiens
ctgagctttccggggagga

SEQ ID NO: 6164278 - DNA, 12 bp, Homo sapiens
ctgagctttgca

SEQ ID NO: 6164279 - DNA, 16 bp, Homo sapiens
ctgagctttggggaca

SEQ ID NO: 6164280 - DNA, 12 bp, Homo sapiens
ctgagctttgtt

SEQ ID NO: 6164281 - DNA, 21 bp, Homo sapiens
ctgagcttttgagtgttccca

SEQ ID NO: 6164282 - DNA, 17 bp, Homo sapiens
ctgaggaaaatggaaga

SEQ ID NO: 6164283 - DNA, 19 bp, Homo sapiens
ctgaggaaaatggaagacc

SEQ ID NO: 6164284 - DNA, 16 bp, Homo sapiens
ctgaggaaacaaaaag

SEQ ID NO: 6164285 - DNA, 22 bp, Homo sapiens
ctgaggaaaggccagctggcag

SEQ ID NO: 6164286 - DNA, 19 bp, Homo sapiens
ctgaggaaagggaggagag

SEQ ID NO: 6164287 - DNA, 16 bp, Homo sapiens
ctgaggaactgtctcg

SEQ ID NO: 6164288 - DNA, 18 bp, Homo sapiens
ctgaggaagatgggggca

SEQ ID NO: 6164289 - DNA, 21 bp, Homo sapiens
ctgaggaagcagttggggccc

SEQ ID NO: 6164290 - DNA, 23 bp, Homo sapiens
ctgaggaagcagttggggccctc

SEQ ID NO: 6164291 - DNA, 17 bp, Homo sapiens
ctgaggaataaagcttc

SEQ ID NO: 6164292 - DNA, 24 bp, Homo sapiens
ctgaggaataaagcttctctctga

SEQ ID NO: 6164293 - DNA, 19 bp, Homo sapiens
ctgaggaatcaacagggca

SEQ ID NO: 6164294 - DNA, 14 bp, Homo sapiens
ctgaggaatccaga

SEQ ID NO: 6164295 - DNA, 16 bp, Homo sapiens
ctgaggaattctgtat

SEQ ID NO: 6164296 - DNA, 22 bp, Homo sapiens
ctgaggacaatgtctggctgaa

SEQ ID NO: 6164297 - DNA, 23 bp, Homo sapiens
ctgaggacaccagtgaaagaagc

SEQ ID NO: 6164298 - DNA, 15 bp, Homo sapiens
ctgaggacagaaaga

SEQ ID NO: 6164299 - DNA, 19 bp, Homo sapiens
ctgaggacagaaagaccct

SEQ ID NO: 6164300 - DNA, 13 bp, Homo sapiens
ctgaggacagagc

SEQ ID NO: 6164301 - DNA, 15 bp, Homo sapiens
ctgaggacagatgcc

SEQ ID NO: 6164302 - DNA, 18 bp, Homo sapiens
ctgaggacagatgcctcc

SEQ ID NO: 6164303 - DNA, 14 bp, Homo sapiens
ctgaggacaggccc

SEQ ID NO: 6164304 - DNA, 16 bp, Homo sapiens
ctgaggacaggccccc

SEQ ID NO: 6164305 - DNA, 21 bp, Homo sapiens
ctgaggacatggagagagact

SEQ ID NO: 6164306 - DNA, 17 bp, Homo sapiens
ctgaggacattccaaga

SEQ ID NO: 6164307 - DNA, 19 bp, Homo sapiens
ctgaggacccggcgctgag

SEQ ID NO: 6164308 - DNA, 14 bp, Homo sapiens
ctgaggaccctcag

SEQ ID NO: 6164309 - DNA, 16 bp, Homo sapiens
ctgaggaccctcagcc

SEQ ID NO: 6164310 - DNA, 14 bp, Homo sapiens
ctgaggacctctca

SEQ ID NO: 6164311 - DNA, 15 bp, Homo sapiens
ctgaggacctctcag

SEQ ID NO: 6164312 - DNA, 23 bp, Homo sapiens
ctgaggacctctcagcatagcct

SEQ ID NO: 6164313 - DNA, 22 bp, Homo sapiens
ctgaggacgagacccccatcca

SEQ ID NO: 6164314 - DNA, 17 bp, Homo sapiens
ctgaggacggggcagag

SEQ ID NO: 6164315 - DNA, 18 bp, Homo sapiens
ctgaggacggggcagagc

SEQ ID NO: 6164316 - DNA, 15 bp, Homo sapiens
ctgaggactccctcc

SEQ ID NO: 6164317 - DNA, 16 bp, Homo sapiens
ctgaggactccctcca

SEQ ID NO: 6164318 - DNA, 20 bp, Homo sapiens
ctgaggactccctccatgtg

SEQ ID NO: 6164319 - DNA, 12 bp, Homo sapiens
ctgaggactctg

SEQ ID NO: 6164320 - DNA, 15 bp, Homo sapiens
ctgaggactctggac

SEQ ID NO: 6164321 - DNA, 20 bp, Homo sapiens
ctgaggactctggaccccag

SEQ ID NO: 6164322 - DNA, 15 bp, Homo sapiens
ctgaggactgcacca

SEQ ID NO: 6164323 - DNA, 23 bp, Homo sapiens
ctgaggactgcaccattgctgct

SEQ ID NO: 6164324 - DNA, 14 bp, Homo sapiens
ctgaggactggaga

SEQ ID NO: 6164325 - DNA, 15 bp, Homo sapiens
ctgaggactggagac

SEQ ID NO: 6164326 - DNA, 19 bp, Homo sapiens
ctgaggactttgcccagga

SEQ ID NO: 6164327 - DNA, 18 bp, Homo sapiens
ctgaggagacagaaagcc

SEQ ID NO: 6164328 - DNA, 20 bp, Homo sapiens
ctgaggagacagaaagcctc

SEQ ID NO: 6164329 - DNA, 23 bp, Homo sapiens
ctgaggagcagcaggagggggga

SEQ ID NO: 6164330 - DNA, 13 bp, Homo sapiens
ctgaggagcagcc

SEQ ID NO: 6164331 - DNA, 15 bp, Homo sapiens
ctgaggagcagccag

SEQ ID NO: 6164332 - DNA, 11 bp, Homo sapiens
ctgaggagccc

SEQ ID NO: 6164333 - DNA, 23 bp, Homo sapiens
ctgaggagcccacggggcaaagc

SEQ ID NO: 6164334 - DNA, 14 bp, Homo sapiens
ctgaggagccctga

SEQ ID NO: 6164335 - DNA, 15 bp, Homo sapiens
ctgaggagccctgag

SEQ ID NO: 6164336 - DNA, 20 bp, Homo sapiens
ctgaggagccctgaggacct

SEQ ID NO: 6164337 - DNA, 23 bp, Homo sapiens
ctgaggagccctgaggacctctc

SEQ ID NO: 6164338 - DNA, 17 bp, Homo sapiens
ctgaggagctcagggct

SEQ ID NO: 6164339 - DNA, 18 bp, Homo sapiens
ctgaggagctcagggctg

SEQ ID NO: 6164340 - DNA, 21 bp, Homo sapiens
ctgaggagctgttggcctggg

SEQ ID NO: 6164341 - DNA, 11 bp, Homo sapiens
ctgaggaggag

SEQ ID NO: 6164342 - DNA, 13 bp, Homo sapiens
ctgaggaggcagt

SEQ ID NO: 6164343 - DNA, 13 bp, Homo sapiens
ctgaggaggccgc

SEQ ID NO: 6164344 - DNA, 12 bp, Homo sapiens
ctgaggagggcc

SEQ ID NO: 6164345 - DNA, 19 bp, Homo sapiens
ctgaggagggccctgagga

SEQ ID NO: 6164346 - DNA, 22 bp, Homo sapiens
ctgaggagggccctgaggaata

SEQ ID NO: 6164347 - DNA, 13 bp, Homo sapiens
ctgaggaggggag

SEQ ID NO: 6164348 - DNA, 14 bp, Homo sapiens
ctgaggaggtgctg

SEQ ID NO: 6164349 - DNA, 15 bp, Homo sapiens
ctgaggaggtgctgc

SEQ ID NO: 6164350 - DNA, 16 bp, Homo sapiens
ctgaggagtaaaaaga

SEQ ID NO: 6164351 - DNA, 19 bp, Homo sapiens
ctgaggagtaagtgtacaa

SEQ ID NO: 6164352 - DNA, 20 bp, Homo sapiens
ctgaggagtaagtgtacaat

SEQ ID NO: 6164353 - DNA, 20 bp, Homo sapiens
ctgaggagtagctgagagga

SEQ ID NO: 6164354 - DNA, 22 bp, Homo sapiens
ctgaggagtattaagaatgcag

SEQ ID NO: 6164355 - DNA, 13 bp, Homo sapiens
ctgaggagtccaa

SEQ ID NO: 6164356 - DNA, 17 bp, Homo sapiens
ctgaggagtctgaggac

SEQ ID NO: 6164357 - DNA, 20 bp, Homo sapiens
ctgaggagtctgaggactgt

SEQ ID NO: 6164358 - DNA, 19 bp, Homo sapiens
ctgaggagtggcaggaaag

SEQ ID NO: 6164359 - DNA, 15 bp, Homo sapiens
ctgaggataccccaa

SEQ ID NO: 6164360 - DNA, 20 bp, Homo sapiens
ctgaggataccttccatctc

SEQ ID NO: 6164361 - DNA, 17 bp, Homo sapiens
ctgaggatcagaaagta

SEQ ID NO: 6164362 - DNA, 17 bp, Homo sapiens
ctgaggatcccctgtcc

SEQ ID NO: 6164363 - DNA, 20 bp, Homo sapiens
ctgaggatcccctgtcccct

SEQ ID NO: 6164364 - DNA, 21 bp, Homo sapiens
ctgaggatcctcacaggagca

SEQ ID NO: 6164365 - DNA, 15 bp, Homo sapiens
ctgaggatgagacag

SEQ ID NO: 6164366 - DNA, 13 bp, Homo sapiens
ctgaggatgagct

SEQ ID NO: 6164367 - DNA, 15 bp, Homo sapiens
ctgaggatgagctgg

SEQ ID NO: 6164368 - DNA, 17 bp, Homo sapiens
ctgaggatgagctggaa

SEQ ID NO: 6164369 - DNA, 20 bp, Homo sapiens
ctgaggatgggtcagagcta

SEQ ID NO: 6164370 - DNA, 22 bp, Homo sapiens
ctgaggatgtagagagaacagg

SEQ ID NO: 6164371 - DNA, 18 bp, Homo sapiens
ctgaggatttcaagcctg

SEQ ID NO: 6164372 - DNA, 14 bp, Homo sapiens
ctgaggatttcctg

SEQ ID NO: 6164373 - DNA, 19 bp, Homo sapiens
ctgaggatttcctggagtg

SEQ ID NO: 6164374 - DNA, 23 bp, Homo sapiens
ctgaggatttcctggagtgccct

SEQ ID NO: 6164375 - DNA, 14 bp, Homo sapiens
ctgaggatttcttt

SEQ ID NO: 6164376 - DNA, 22 bp, Homo sapiens
ctgaggcaaccccctcggagcc

SEQ ID NO: 6164377 - DNA, 16 bp, Homo sapiens
ctgaggcaagagaatt

SEQ ID NO: 6164378 - DNA, 22 bp, Homo sapiens
ctgaggcaccgtccaggcccca

SEQ ID NO: 6164379 - DNA, 15 bp, Homo sapiens
ctgaggcagaagaat

SEQ ID NO: 6164380 - DNA, 15 bp, Homo sapiens
ctgaggcagacagca

SEQ ID NO: 6164381 - DNA, 23 bp, Homo sapiens
ctgaggcagcagtgtgaggccag

SEQ ID NO: 6164382 - DNA, 24 bp, Homo sapiens
ctgaggcagcagtgtgaggccagg

SEQ ID NO: 6164383 - DNA, 11 bp, Homo sapiens
ctgaggcagga

SEQ ID NO: 6164384 - DNA, 20 bp, Homo sapiens
ctgaggcaggagaatcactt

SEQ ID NO: 6164385 - DNA, 18 bp, Homo sapiens
ctgaggcaggagactggc

SEQ ID NO: 6164386 - DNA, 20 bp, Homo sapiens
ctgaggcaggaggatcactt

SEQ ID NO: 6164387 - DNA, 14 bp, Homo sapiens
ctgaggcaggaggg

SEQ ID NO: 6164388 - DNA, 17 bp, Homo sapiens
ctgaggcaggagggcat

SEQ ID NO: 6164389 - DNA, 19 bp, Homo sapiens
ctgaggcaggcaatcactt

SEQ ID NO: 6164390 - DNA, 14 bp, Homo sapiens
ctgaggcagggaag

SEQ ID NO: 6164391 - DNA, 21 bp, Homo sapiens
ctgaggcagggaagtccccag

SEQ ID NO: 6164392 - DNA, 19 bp, Homo sapiens
ctgaggcaggggagtagtg

SEQ ID NO: 6164393 - DNA, 14 bp, Homo sapiens
ctgaggcaggtgag

SEQ ID NO: 6164394 - DNA, 17 bp, Homo sapiens
ctgaggcagtttgagga

SEQ ID NO: 6164395 - DNA, 15 bp, Homo sapiens
ctgaggcatccagca

SEQ ID NO: 6164396 - DNA, 22 bp, Homo sapiens
ctgaggcatccgtgaggcaggg

SEQ ID NO: 6164397 - DNA, 23 bp, Homo sapiens
ctgaggcatccgtgaggcaggga

SEQ ID NO: 6164398 - DNA, 17 bp, Homo sapiens
ctgaggcatcctctgac

SEQ ID NO: 6164399 - DNA, 18 bp, Homo sapiens
ctgaggccaaatattgat

SEQ ID NO: 6164400 - DNA, 14 bp, Homo sapiens
ctgaggccacactc

SEQ ID NO: 6164401 - DNA, 20 bp, Homo sapiens
ctgaggccacactcagcaca

SEQ ID NO: 6164402 - DNA, 17 bp, Homo sapiens
ctgaggccacccactga

SEQ ID NO: 6164403 - DNA, 20 bp, Homo sapiens
ctgaggccacccactgaccc

SEQ ID NO: 6164404 - DNA, 17 bp, Homo sapiens
ctgaggccacccagagg

SEQ ID NO: 6164405 - DNA, 13 bp, Homo sapiens
ctgaggccagaaa

SEQ ID NO: 6164406 - DNA, 16 bp, Homo sapiens
ctgaggccagaaaggt

SEQ ID NO: 6164407 - DNA, 23 bp, Homo sapiens
ctgaggccagaaaggtgtgagga

SEQ ID NO: 6164408 - DNA, 18 bp, Homo sapiens
ctgtgtgctcctccttgg

SEQ ID NO: 6164409 - DNA, 23 bp, Homo sapiens
ctgtgtgctcctccttggtgcct

SEQ ID NO: 6164410 - DNA, 19 bp, Homo sapiens
ctgtgtgctgactgaacat

SEQ ID NO: 6164411 - DNA, 21 bp, Homo sapiens
ctgtgtgctgtggttcctggg

SEQ ID NO: 6164412 - DNA, 18 bp, Homo sapiens
ctgtgtgctgtttgaaaa

SEQ ID NO: 6164413 - DNA, 13 bp, Homo sapiens
ctgtgtgcttttt

SEQ ID NO: 6164414 - DNA, 12 bp, Homo sapiens
ctgtgtggaact

SEQ ID NO: 6164415 - DNA, 18 bp, Homo sapiens
ctgtgtggactgtgatgc

SEQ ID NO: 6164416 - DNA, 12 bp, Homo sapiens
ctgtgtggagag

SEQ ID NO: 6164417 - DNA, 23 bp, Homo sapiens
ctgtgtggagagggaatgtgaaa

SEQ ID NO: 6164418 - DNA, 17 bp, Homo sapiens
ctgtgtggcaaacattt

SEQ ID NO: 6164419 - DNA, 18 bp, Homo sapiens
ctgtgtggcaaacattta

SEQ ID NO: 6164420 - DNA, 22 bp, Homo sapiens
ctgtgtggcaaacatttaaaaa

SEQ ID NO: 6164421 - DNA, 21 bp, Homo sapiens
ctgtgtggcaccttgattgga

SEQ ID NO: 6164422 - DNA, 17 bp, Homo sapiens
ctgtgtggcagttaatt

SEQ ID NO: 6164423 - DNA, 11 bp, Homo sapiens
ctgtgtggcca

SEQ ID NO: 6164424 - DNA, 21 bp, Homo sapiens
ctgtgtggccacttctgtcca

SEQ ID NO: 6164425 - DNA, 17 bp, Homo sapiens
ctgtgtggccagcagcc

SEQ ID NO: 6164426 - DNA, 12 bp, Homo sapiens
ctgtgtggctcc

SEQ ID NO: 6164427 - DNA, 19 bp, Homo sapiens
ctgtgtggctcctgggccg

SEQ ID NO: 6164428 - DNA, 24 bp, Homo sapiens
ctgtgtgggatacttagtggtatg

SEQ ID NO: 6164429 - DNA, 18 bp, Homo sapiens
ctgtgtgggctgcagatt

SEQ ID NO: 6164430 - DNA, 13 bp, Homo sapiens
ctgtgtggggagg

SEQ ID NO: 6164431 - DNA, 20 bp, Homo sapiens
ctgtgtggggaggcagctcc

SEQ ID NO: 6164432 - DNA, 21 bp, Homo sapiens
ctgtgtggggaggcagctcca

SEQ ID NO: 6164433 - DNA, 23 bp, Homo sapiens
ctgtgtgggtaaatgcttttaaa

SEQ ID NO: 6164434 - DNA, 17 bp, Homo sapiens
ctgtgtgggtctgggga

SEQ ID NO: 6164435 - DNA, 18 bp, Homo sapiens
ctgtgtgggtctggggag

SEQ ID NO: 6164436 - DNA, 15 bp, Homo sapiens
ctgtgtggtatattt

SEQ ID NO: 6164437 - DNA, 15 bp, Homo sapiens
ctgtgtggtgcattc

SEQ ID NO: 6164438 - DNA, 20 bp, Homo sapiens
ctgtgtggtggagccagggc

SEQ ID NO: 6164439 - DNA, 22 bp, Homo sapiens
ctgtgtggtggagccagggcct

SEQ ID NO: 6164440 - DNA, 22 bp, Homo sapiens
ctgtgtggtgtcgcgccttctc

SEQ ID NO: 6164441 - DNA, 11 bp, Homo sapiens
ctgtgtggttg

SEQ ID NO: 6164442 - DNA, 13 bp, Homo sapiens
ctgtgtgtagcca

SEQ ID NO: 6164443 - DNA, 17 bp, Homo sapiens
ctgtgtgtagccaggaa

SEQ ID NO: 6164444 - DNA, 15 bp, Homo sapiens
ctgtgtgtaggctgg

SEQ ID NO: 6164445 - DNA, 20 bp, Homo sapiens
ctgtgtgtcccaggcaggga

SEQ ID NO: 6164446 - DNA, 22 bp, Homo sapiens
ctgtgtgtcccaggcagggaga

SEQ ID NO: 6164447 - DNA, 20 bp, Homo sapiens
ctgtgtgtctccataaaagt

SEQ ID NO: 6164448 - DNA, 14 bp, Homo sapiens
ctgtgtgtctgcag

SEQ ID NO: 6164449 - DNA, 20 bp, Homo sapiens
ctgtgtgtctggtgggtgga

SEQ ID NO: 6164450 - DNA, 17 bp, Homo sapiens
ctgtgtgtcttctgccc

SEQ ID NO: 6164451 - DNA, 20 bp, Homo sapiens
ctgtgtgtgacaccaccact

SEQ ID NO: 6164452 - DNA, 21 bp, Homo sapiens
ctgtgtgtgacaccaccactg

SEQ ID NO: 6164453 - DNA, 16 bp, Homo sapiens
ctgtgtgtgacccctc

SEQ ID NO: 6164454 - DNA, 18 bp, Homo sapiens
ctgtgtgtgacccctcct

SEQ ID NO: 6164455 - DNA, 21 bp, Homo sapiens
ctgtgtgtgacccctcctggg

SEQ ID NO: 6164456 - DNA, 18 bp, Homo sapiens
ctgtgtgtgagtgtgaat

SEQ ID NO: 6164457 - DNA, 11 bp, Homo sapiens
ctgtgtgtgcc

SEQ ID NO: 6164458 - DNA, 13 bp, Homo sapiens
ctgtgtgtgccct

SEQ ID NO: 6164459 - DNA, 15 bp, Homo sapiens
ctgtgtgtgcctgtg

SEQ ID NO: 6164460 - DNA, 18 bp, Homo sapiens
ctgtgtgtgcctgtgtgc

SEQ ID NO: 6164461 - DNA, 18 bp, Homo sapiens
ctgtgtgtgcgcctacag

SEQ ID NO: 6164462 - DNA, 21 bp, Homo sapiens
ctgtgtgtggaaggcacccgc

SEQ ID NO: 6164463 - DNA, 19 bp, Homo sapiens
ctgtgtgtgtatgagagag

SEQ ID NO: 6164464 - DNA, 17 bp, Homo sapiens
ctgtgtgtgtcccctca

SEQ ID NO: 6164465 - DNA, 16 bp, Homo sapiens
ctgtgtgtgtgaatga

SEQ ID NO: 6164466 - DNA, 21 bp, Homo sapiens
ctgtgtgtgtgaatgaacact

SEQ ID NO: 6164467 - DNA, 17 bp, Homo sapiens
ctgtgtgtgtgtgtgca

SEQ ID NO: 6164468 - DNA, 14 bp, Homo sapiens
ctgtgtgtgttctt

SEQ ID NO: 6164469 - DNA, 15 bp, Homo sapiens
ctgtgtgtgttgccc

SEQ ID NO: 6164470 - DNA, 12 bp, Homo sapiens
ctgtgtgttaaa

SEQ ID NO: 6164471 - DNA, 18 bp, Homo sapiens
ctgtgtgttaagctctgc

SEQ ID NO: 6164472 - DNA, 20 bp, Homo sapiens
ctgtgtgttaagctctgcta

SEQ ID NO: 6164473 - DNA, 19 bp, Homo sapiens
ctgtgtgttagttcccaac

SEQ ID NO: 6164474 - DNA, 21 bp, Homo sapiens
ctgtgtgttagttcccaacat

SEQ ID NO: 6164475 - DNA, 14 bp, Homo sapiens
ctgtgtgttctttt

SEQ ID NO: 6164476 - DNA, 21 bp, Homo sapiens
ctgtgtgttcttttgatacat

SEQ ID NO: 6164477 - DNA, 22 bp, Homo sapiens
ctgtgtgttcttttgatacatt

SEQ ID NO: 6164478 - DNA, 16 bp, Homo sapiens
ctgtgtgttgcctggg

SEQ ID NO: 6164479 - DNA, 16 bp, Homo sapiens
ctgtgtgtttatgtgt

SEQ ID NO: 6164480 - DNA, 17 bp, Homo sapiens
ctgtgtgtttatgtgtg

SEQ ID NO: 6164481 - DNA, 16 bp, Homo sapiens
ctgtgtgttttcataa

SEQ ID NO: 6164482 - DNA, 18 bp, Homo sapiens
ctgtgtgttttcataata

SEQ ID NO: 6164483 - DNA, 22 bp, Homo sapiens
ctgtgttaaacactacacattt

SEQ ID NO: 6164484 - DNA, 16 bp, Homo sapiens
ctgtgttaactgttca

SEQ ID NO: 6164485 - DNA, 16 bp, Homo sapiens
ctgtgttaatttaagt

SEQ ID NO: 6164486 - DNA, 15 bp, Homo sapiens
ctgtgttacaatcgt

SEQ ID NO: 6164487 - DNA, 22 bp, Homo sapiens
ctgtgttactaaaaaaaagatg

SEQ ID NO: 6164488 - DNA, 16 bp, Homo sapiens
ctgtgttactgctttg

SEQ ID NO: 6164489 - DNA, 20 bp, Homo sapiens
ctgtgttaggatgcggcttt

SEQ ID NO: 6164490 - DNA, 21 bp, Homo sapiens
ctgtgttaggatgcggctttc

SEQ ID NO: 6164491 - DNA, 23 bp, Homo sapiens
ctgtgttaggatgcggctttctc

SEQ ID NO: 6164492 - DNA, 17 bp, Homo sapiens
ctgtgttagtgtctgtc

SEQ ID NO: 6164493 - DNA, 15 bp, Homo sapiens
ctgtgttatgaaaat

SEQ ID NO: 6164494 - DNA, 17 bp, Homo sapiens
ctgtgttcaaaaatata

SEQ ID NO: 6164495 - DNA, 23 bp, Homo sapiens
ctgtgttcaagcgattctcctgt

SEQ ID NO: 6164496 - DNA, 21 bp, Homo sapiens
ctgtgttcaatatttagaaaa

SEQ ID NO: 6164497 - DNA, 22 bp, Homo sapiens
ctgtgttcaatatttagaaaat

SEQ ID NO: 6164498 - DNA, 14 bp, Homo sapiens
ctgtgttcacactg

SEQ ID NO: 6164499 - DNA, 18 bp, Homo sapiens
ctgtgttcacactgtaaa

SEQ ID NO: 6164500 - DNA, 18 bp, Homo sapiens
ctgtgttcacagacctca

SEQ ID NO: 6164501 - DNA, 16 bp, Homo sapiens
ctgtgttcatggtcta

SEQ ID NO: 6164502 - DNA, 11 bp, Homo sapiens
ctgtgttcatt

SEQ ID NO: 6164503 - DNA, 13 bp, Homo sapiens
ctgtgttcccaga

SEQ ID NO: 6164504 - DNA, 18 bp, Homo sapiens
ctgtgttcccagaggcag

SEQ ID NO: 6164505 - DNA, 21 bp, Homo sapiens
ctgtgttcccagaggcaggcg

SEQ ID NO: 6164506 - DNA, 16 bp, Homo sapiens
ctgtgttccctttgag

SEQ ID NO: 6164507 - DNA, 12 bp, Homo sapiens
ctgtgttcctgg

SEQ ID NO: 6164508 - DNA, 13 bp, Homo sapiens
ctgtgttccttcc

SEQ ID NO: 6164509 - DNA, 20 bp, Homo sapiens
ctgtgttcgactcagcctca

SEQ ID NO: 6164510 - DNA, 21 bp, Homo sapiens
ctgtgttcgactcagcctcag

SEQ ID NO: 6164511 - DNA, 20 bp, Homo sapiens
ctgtgttcgggggagcagag

SEQ ID NO: 6164512 - DNA, 13 bp, Homo sapiens
ctgtgttctcaac

SEQ ID NO: 6164513 - DNA, 17 bp, Homo sapiens
ctgtgttctcttaagca

SEQ ID NO: 6164514 - DNA, 12 bp, Homo sapiens
ctgtgttctggg

SEQ ID NO: 6164515 - DNA, 15 bp, Homo sapiens
ctgtgttctgggctg

SEQ ID NO: 6164516 - DNA, 20 bp, Homo sapiens
ctgtgttctggtgaggcctt

SEQ ID NO: 6164517 - DNA, 20 bp, Homo sapiens
ctgtgttcttgctgagcacc

SEQ ID NO: 6164518 - DNA, 22 bp, Homo sapiens
ctgtgttctttccccaggggca

SEQ ID NO: 6164519 - DNA, 14 bp, Homo sapiens
ctgtgttgaacaca

SEQ ID NO: 6164520 - DNA, 14 bp, Homo sapiens
ctgtgttgactgct

SEQ ID NO: 6164521 - DNA, 18 bp, Homo sapiens
ctgtgttgactgctgctc

SEQ ID NO: 6164522 - DNA, 16 bp, Homo sapiens
ctgtgttgagcgtgcg

SEQ ID NO: 6164523 - DNA, 21 bp, Homo sapiens
ctgtgttgagcgtgcgtctgt

SEQ ID NO: 6164524 - DNA, 16 bp, Homo sapiens
ctgtgttgccaagctc

SEQ ID NO: 6164525 - DNA, 22 bp, Homo sapiens
ctgtgttgccacagtagaactg

SEQ ID NO: 6164526 - DNA, 16 bp, Homo sapiens
ctgtgttgcccaggct

SEQ ID NO: 6164527 - DNA, 18 bp, Homo sapiens
ctgtgttgcccaggctgg

SEQ ID NO: 6164528 - DNA, 21 bp, Homo sapiens
ctgtgttgcccaggctggtct

SEQ ID NO: 6164529 - DNA, 23 bp, Homo sapiens
ctgtgttgcccaggctggtcttg

SEQ ID NO: 6164530 - DNA, 18 bp, Homo sapiens
ctgtgttgcgtgtcgtgg

SEQ ID NO: 6164531 - DNA, 20 bp, Homo sapiens
ctgtgttgcgtgtcgtgggt

SEQ ID NO: 6164532 - DNA, 13 bp, Homo sapiens
ctgtgttgctgtt

SEQ ID NO: 6164533 - DNA, 17 bp, Homo sapiens
ctgtgttggccaggctg

SEQ ID NO: 6164534 - DNA, 15 bp, Homo sapiens
ctgtgttgtacagct

SEQ ID NO: 6164535 - DNA, 14 bp, Homo sapiens
ctgtgttgtctcta

SEQ ID NO: 6164536 - DNA, 22 bp, Homo sapiens
ctgtgttgtctctagagcaggg

SEQ ID NO: 6164537 - DNA, 18 bp, Homo sapiens
ctgtgttgtgtcctgaca

SEQ ID NO: 6164538 - DNA, 21 bp, Homo sapiens
ctgtgtttaactgctgcaggg

SEQ ID NO: 6164539 - DNA, 15 bp, Homo sapiens
ctgtgtttacagaca

SEQ ID NO: 6164540 - DNA, 16 bp, Homo sapiens
ctgtgtttagctattt

SEQ ID NO: 6164541 - DNA, 16 bp, Homo sapiens
ctgtgtttataaaata

SEQ ID NO: 6164542 - DNA, 19 bp, Homo sapiens
ctgtgtttataaaatataa

SEQ ID NO: 6164543 - DNA, 21 bp, Homo sapiens
ctgtgtttattcaaactgaaa

SEQ ID NO: 6164544 - DNA, 17 bp, Homo sapiens
ctgtgtttcaaacctgc

SEQ ID NO: 6164545 - DNA, 18 bp, Homo sapiens
ctgtgtttcatgttctgt

SEQ ID NO: 6164546 - DNA, 23 bp, Homo sapiens
ctgtgtttcatgttctgtgtcac

SEQ ID NO: 6164547 - DNA, 22 bp, Homo sapiens
ctgtgtttcattacttgaatgt

SEQ ID NO: 6164548 - DNA, 19 bp, Homo sapiens
ctgtgtttccaaaggttcc

SEQ ID NO: 6164549 - DNA, 23 bp, Homo sapiens
ctgtgtttccatctcaaagaagg

SEQ ID NO: 6164550 - DNA, 21 bp, Homo sapiens
ctgtgtttcgcattaagcaca

SEQ ID NO: 6164551 - DNA, 23 bp, Homo sapiens
ctgtgtttcgtgaactgcagtga

SEQ ID NO: 6164552 - DNA, 16 bp, Homo sapiens
ctgtgtttctggagtg

SEQ ID NO: 6164553 - DNA, 14 bp, Homo sapiens
ctgtgtttctgtgc

SEQ ID NO: 6164554 - DNA, 16 bp, Homo sapiens
ctgtgtttctgtgctc

SEQ ID NO: 6164555 - DNA, 17 bp, Homo sapiens
ctgtgtttcttgcctca

SEQ ID NO: 6164556 - DNA, 14 bp, Homo sapiens
ctgtgtttgcattg

SEQ ID NO: 6164557 - DNA, 17 bp, Homo sapiens
ctgtgtttgcattgtct

SEQ ID NO: 6164558 - DNA, 19 bp, Homo sapiens
ctgtgtttgctccccttcc

SEQ ID NO: 6164559 - DNA, 22 bp, Homo sapiens
ctgtgtttgctccccttcccct

SEQ ID NO: 6164560 - DNA, 17 bp, Homo sapiens
ctgtgtttggctttcag

SEQ ID NO: 6164561 - DNA, 22 bp, Homo sapiens
ctgtgtttggctttcagggagg

SEQ ID NO: 6164562 - DNA, 14 bp, Homo sapiens
ctgtgtttgtcctg

SEQ ID NO: 6164563 - DNA, 14 bp, Homo sapiens
ctgtgtttgttcct

SEQ ID NO: 6164564 - DNA, 18 bp, Homo sapiens
ctgtgttttataaaatag

SEQ ID NO: 6164565 - DNA, 14 bp, Homo sapiens
ctgtgttttcgatg

SEQ ID NO: 6164566 - DNA, 18 bp, Homo sapiens
ctgtgttttcgatgatga

SEQ ID NO: 6164567 - DNA, 17 bp, Homo sapiens
ctgtgttttgaaagaat

SEQ ID NO: 6164568 - DNA, 22 bp, Homo sapiens
ctgtgttttgaaagaatagaac

SEQ ID NO: 6164569 - DNA, 19 bp, Homo sapiens
ctgtgttttgtctgagcct

SEQ ID NO: 6164570 - DNA, 21 bp, Homo sapiens
ctgtgtttttaaattttgtat

SEQ ID NO: 6164571 - DNA, 23 bp, Homo sapiens
ctgttaaaaaagaaatctgtttc

SEQ ID NO: 6164572 - DNA, 15 bp, Homo sapiens
ctgttaaaactgtac

SEQ ID NO: 6164573 - DNA, 16 bp, Homo sapiens
ctgttaaaagatgaaa

SEQ ID NO: 6164574 - DNA, 19 bp, Homo sapiens
ctgttaaaagatgaaaata

SEQ ID NO: 6164575 - DNA, 21 bp, Homo sapiens
ctgttaaaagatgaaaatatt

SEQ ID NO: 6164576 - DNA, 23 bp, Homo sapiens
ctgttaaaagatgaaaatatttg

SEQ ID NO: 6164577 - DNA, 14 bp, Homo sapiens
ctgttaaaataaag

SEQ ID NO: 6164578 - DNA, 12 bp, Homo sapiens
ctgttaaaatct

SEQ ID NO: 6164579 - DNA, 23 bp, Homo sapiens
ctgttaaaatgcatgattgcaga

SEQ ID NO: 6164580 - DNA, 23 bp, Homo sapiens
ctgttaaacagtagttgtattct

SEQ ID NO: 6164581 - DNA, 13 bp, Homo sapiens
ctgttaaactgtt

SEQ ID NO: 6164582 - DNA, 15 bp, Homo sapiens
ctgttaaactgttag

SEQ ID NO: 6164583 - DNA, 19 bp, Homo sapiens
ctgttaaactgttagcact

SEQ ID NO: 6164584 - DNA, 21 bp, Homo sapiens
ctgttaaactgttagcactgt

SEQ ID NO: 6164585 - DNA, 18 bp, Homo sapiens
ctgaggccagagtcacct

SEQ ID NO: 6164586 - DNA, 12 bp, Homo sapiens
ctgaggccagcc

SEQ ID NO: 6164587 - DNA, 15 bp, Homo sapiens
ctgaggccagcctgg

SEQ ID NO: 6164588 - DNA, 16 bp, Homo sapiens
ctgaggccagcctggc

SEQ ID NO: 6164589 - DNA, 17 bp, Homo sapiens
ctgaggccagcctggcc

SEQ ID NO: 6164590 - DNA, 14 bp, Homo sapiens
ctgaggccagtggc

SEQ ID NO: 6164591 - DNA, 16 bp, Homo sapiens
ctgaggccagtggccc

SEQ ID NO: 6164592 - DNA, 17 bp, Homo sapiens
ctgaggccatcagggcc

SEQ ID NO: 6164593 - DNA, 18 bp, Homo sapiens
ctgaggccatcagggccc

SEQ ID NO: 6164594 - DNA, 18 bp, Homo sapiens
ctgaggcccagagaggga

SEQ ID NO: 6164595 - DNA, 14 bp, Homo sapiens
ctgaggcccagagg

SEQ ID NO: 6164596 - DNA, 16 bp, Homo sapiens
ctgaggcccagagggc

SEQ ID NO: 6164597 - DNA, 17 bp, Homo sapiens
ctgaggcccagagggcc

SEQ ID NO: 6164598 - DNA, 19 bp, Homo sapiens
ctgaggcccagagggcctg

SEQ ID NO: 6164599 - DNA, 21 bp, Homo sapiens
ctgaggcccagagggcctgca

SEQ ID NO: 6164600 - DNA, 23 bp, Homo sapiens
ctgaggcccagagggcctgcaag

SEQ ID NO: 6164601 - DNA, 12 bp, Homo sapiens
ctgaggcccagc

SEQ ID NO: 6164602 - DNA, 18 bp, Homo sapiens
ctgaggcccagcagagcc

SEQ ID NO: 6164603 - DNA, 14 bp, Homo sapiens
ctgaggcccagtgc

SEQ ID NO: 6164604 - DNA, 13 bp, Homo sapiens
ctgaggccccagg

SEQ ID NO: 6164605 - DNA, 18 bp, Homo sapiens
ctgaggccccaggcccta

SEQ ID NO: 6164606 - DNA, 22 bp, Homo sapiens
ctgaggccccagggctgtgggt

SEQ ID NO: 6164607 - DNA, 16 bp, Homo sapiens
ctgaggcccctaggtg

SEQ ID NO: 6164608 - DNA, 16 bp, Homo sapiens
ctgaggcccctgcctc

SEQ ID NO: 6164609 - DNA, 17 bp, Homo sapiens
ctgaggccctcactgag

SEQ ID NO: 6164610 - DNA, 20 bp, Homo sapiens
ctgaggccctcactgagcct

SEQ ID NO: 6164611 - DNA, 21 bp, Homo sapiens
ctgaggccctcactgagcctc

SEQ ID NO: 6164612 - DNA, 15 bp, Homo sapiens
ctgaggcccttctct

SEQ ID NO: 6164613 - DNA, 18 bp, Homo sapiens
ctgaggcccttctctcca

SEQ ID NO: 6164614 - DNA, 24 bp, Homo sapiens
ctgaggcccttctctccagcccct

SEQ ID NO: 6164615 - DNA, 20 bp, Homo sapiens
ctgaggccgttgctgactta

SEQ ID NO: 6164616 - DNA, 21 bp, Homo sapiens
ctgaggcctaaaagtaaacat

SEQ ID NO: 6164617 - DNA, 15 bp, Homo sapiens
ctgaggcctagactc

SEQ ID NO: 6164618 - DNA, 17 bp, Homo sapiens
ctgaggcctagactctg

SEQ ID NO: 6164619 - DNA, 19 bp, Homo sapiens
ctgaggcctagactctgtc

SEQ ID NO: 6164620 - DNA, 11 bp, Homo sapiens
ctgaggcctca

SEQ ID NO: 6164621 - DNA, 12 bp, Homo sapiens
ctgaggcctcac

SEQ ID NO: 6164622 - DNA, 15 bp, Homo sapiens
ctgaggcctcatccc

SEQ ID NO: 6164623 - DNA, 22 bp, Homo sapiens
ctgaggcctcattttgggggtc

SEQ ID NO: 6164624 - DNA, 15 bp, Homo sapiens
ctgaggcctccagct

SEQ ID NO: 6164625 - DNA, 14 bp, Homo sapiens
ctgaggcctccctt

SEQ ID NO: 6164626 - DNA, 15 bp, Homo sapiens
ctgaggcctcgaggg

SEQ ID NO: 6164627 - DNA, 19 bp, Homo sapiens
ctgaggcctcgaggggcct

SEQ ID NO: 6164628 - DNA, 21 bp, Homo sapiens
ctgaggcctgagacccaggac

SEQ ID NO: 6164629 - DNA, 18 bp, Homo sapiens
ctgaggcctgagcgctcc

SEQ ID NO: 6164630 - DNA, 16 bp, Homo sapiens
ctgaggcctgcagcac

SEQ ID NO: 6164631 - DNA, 21 bp, Homo sapiens
ctgaggcctgccccctgggct

SEQ ID NO: 6164632 - DNA, 20 bp, Homo sapiens
ctgaggcctgcttccccctc

SEQ ID NO: 6164633 - DNA, 22 bp, Homo sapiens
ctgaggcctggactttcctgca

SEQ ID NO: 6164634 - DNA, 15 bp, Homo sapiens
ctgaggcctgggccg

SEQ ID NO: 6164635 - DNA, 19 bp, Homo sapiens
ctgaggcctgggccgctgc

SEQ ID NO: 6164636 - DNA, 22 bp, Homo sapiens
ctgaggcctgggccgctgccac

SEQ ID NO: 6164637 - DNA, 23 bp, Homo sapiens
ctgaggcctgggccgctgccacg

SEQ ID NO: 6164638 - DNA, 14 bp, Homo sapiens
ctgaggcctgtgcc

SEQ ID NO: 6164639 - DNA, 16 bp, Homo sapiens
ctgaggcctgtgcctg

SEQ ID NO: 6164640 - DNA, 13 bp, Homo sapiens
ctgaggccttctc

SEQ ID NO: 6164641 - DNA, 16 bp, Homo sapiens
ctgaggcgctcgctcc

SEQ ID NO: 6164642 - DNA, 22 bp, Homo sapiens
ctgaggcgctcgctcccatgca

SEQ ID NO: 6164643 - DNA, 19 bp, Homo sapiens
ctgaggcggaggctgtgct

SEQ ID NO: 6164644 - DNA, 23 bp, Homo sapiens
ctgaggcggaggctgtgctccgc

SEQ ID NO: 6164645 - DNA, 17 bp, Homo sapiens
ctgaggctcaagaggcc

SEQ ID NO: 6164646 - DNA, 23 bp, Homo sapiens
ctgaggctcaagaggcccaggga

SEQ ID NO: 6164647 - DNA, 15 bp, Homo sapiens
ctgaggctcagccct

SEQ ID NO: 6164648 - DNA, 16 bp, Homo sapiens
ctgaggctcagcccta

SEQ ID NO: 6164649 - DNA, 20 bp, Homo sapiens
ctgaggctcctgtgctactt

SEQ ID NO: 6164650 - DNA, 11 bp, Homo sapiens
ctgaggctctc

SEQ ID NO: 6164651 - DNA, 19 bp, Homo sapiens
ctgaggctctctaagaaaa

SEQ ID NO: 6164652 - DNA, 23 bp, Homo sapiens
ctgaggctctctaagaaaagaga

SEQ ID NO: 6164653 - DNA, 22 bp, Homo sapiens
ctgaggctctgacccagtgaga

SEQ ID NO: 6164654 - DNA, 16 bp, Homo sapiens
ctgaggctctttctgg

SEQ ID NO: 6164655 - DNA, 17 bp, Homo sapiens
ctgaggctgctgccagg

SEQ ID NO: 6164656 - DNA, 24 bp, Homo sapiens
ctgaggctggactccagatctgca

SEQ ID NO: 6164657 - DNA, 18 bp, Homo sapiens
ctgaggctggcacaggac

SEQ ID NO: 6164658 - DNA, 19 bp, Homo sapiens
ctgaggctggcacaggaca

SEQ ID NO: 6164659 - DNA, 18 bp, Homo sapiens
ctgaggctggcatcctgg

SEQ ID NO: 6164660 - DNA, 17 bp, Homo sapiens
ctgaggctggctggggg

SEQ ID NO: 6164661 - DNA, 16 bp, Homo sapiens
ctgaggctgggctccc

SEQ ID NO: 6164662 - DNA, 14 bp, Homo sapiens
ctgaggctggggct

SEQ ID NO: 6164663 - DNA, 20 bp, Homo sapiens
ctgaggctgtttttggctgt

SEQ ID NO: 6164664 - DNA, 19 bp, Homo sapiens
ctgaggcttaggcctctct

SEQ ID NO: 6164665 - DNA, 18 bp, Homo sapiens
ctgaggcttccagagagt

SEQ ID NO: 6164666 - DNA, 21 bp, Homo sapiens
ctgaggcttgggcccagtagc

SEQ ID NO: 6164667 - DNA, 23 bp, Homo sapiens
ctgaggcttgggcccagtagccc

SEQ ID NO: 6164668 - DNA, 21 bp, Homo sapiens
ctgaggctttggatttgacat

SEQ ID NO: 6164669 - DNA, 23 bp, Homo sapiens
ctgagggaaagcccagaaaagga

SEQ ID NO: 6164670 - DNA, 17 bp, Homo sapiens
ctgagggaaaggccagc

SEQ ID NO: 6164671 - DNA, 18 bp, Homo sapiens
ctgagggaaaggccagca

SEQ ID NO: 6164672 - DNA, 18 bp, Homo sapiens
ctgagggaagcccacccg

SEQ ID NO: 6164673 - DNA, 19 bp, Homo sapiens
ctgagggaagcccacccgc

SEQ ID NO: 6164674 - DNA, 22 bp, Homo sapiens
ctgagggaagcccacccgcccc

SEQ ID NO: 6164675 - DNA, 13 bp, Homo sapiens
ctgagggaccagc

SEQ ID NO: 6164676 - DNA, 19 bp, Homo sapiens
ctgagggaccgagcccagc

SEQ ID NO: 6164677 - DNA, 20 bp, Homo sapiens
ctgagggaccgagcccagca

SEQ ID NO: 6164678 - DNA, 18 bp, Homo sapiens
ctgagggacgagcagagc

SEQ ID NO: 6164679 - DNA, 23 bp, Homo sapiens
ctgagggactctgaagcctctgg

SEQ ID NO: 6164680 - DNA, 11 bp, Homo sapiens
ctgagggagag

SEQ ID NO: 6164681 - DNA, 15 bp, Homo sapiens
ctgagggaggacctg

SEQ ID NO: 6164682 - DNA, 17 bp, Homo sapiens
ctgagggaggacctggg

SEQ ID NO: 6164683 - DNA, 23 bp, Homo sapiens
ctgagggaggaggccacctctcc

SEQ ID NO: 6164684 - DNA, 22 bp, Homo sapiens
ctgagggaggcagaaagggaaa

SEQ ID NO: 6164685 - DNA, 21 bp, Homo sapiens
ctgagggatggactgatgctt

SEQ ID NO: 6164686 - DNA, 23 bp, Homo sapiens
ctgagggattgaggggccctggc

SEQ ID NO: 6164687 - DNA, 13 bp, Homo sapiens
ctgagggcaaatc

SEQ ID NO: 6164688 - DNA, 22 bp, Homo sapiens
ctgagggcactctctgccagct

SEQ ID NO: 6164689 - DNA, 23 bp, Homo sapiens
ctgagggcactctctgccagctc

SEQ ID NO: 6164690 - DNA, 13 bp, Homo sapiens
ctgagggcagaga

SEQ ID NO: 6164691 - DNA, 19 bp, Homo sapiens
ctgagggcagggttctaga

SEQ ID NO: 6164692 - DNA, 16 bp, Homo sapiens
ctgagggcagtcgata

SEQ ID NO: 6164693 - DNA, 14 bp, Homo sapiens
ctgagggcagtgcc

SEQ ID NO: 6164694 - DNA, 15 bp, Homo sapiens
ctgagggcagtgccc

SEQ ID NO: 6164695 - DNA, 16 bp, Homo sapiens
ctgagggcagtgccct

SEQ ID NO: 6164696 - DNA, 17 bp, Homo sapiens
ctgagggcagtgccctt

SEQ ID NO: 6164697 - DNA, 22 bp, Homo sapiens
ctgagggcagttcgcagccacc

SEQ ID NO: 6164698 - DNA, 12 bp, Homo sapiens
ctgagggcatct

SEQ ID NO: 6164699 - DNA, 13 bp, Homo sapiens
ctgagggcatctc

SEQ ID NO: 6164700 - DNA, 16 bp, Homo sapiens
ctgagggcatctctga

SEQ ID NO: 6164701 - DNA, 14 bp, Homo sapiens
ctgagggccaggga

SEQ ID NO: 6164702 - DNA, 19 bp, Homo sapiens
ctgagggcccctctgccca

SEQ ID NO: 6164703 - DNA, 20 bp, Homo sapiens
ctgagggcccctctgcccag

SEQ ID NO: 6164704 - DNA, 22 bp, Homo sapiens
ctgagggcccctctgcccagct

SEQ ID NO: 6164705 - DNA, 16 bp, Homo sapiens
ctgagggcccttccca

SEQ ID NO: 6164706 - DNA, 14 bp, Homo sapiens
ctgagggcctggtc

SEQ ID NO: 6164707 - DNA, 16 bp, Homo sapiens
ctgagggctccatgct

SEQ ID NO: 6164708 - DNA, 20 bp, Homo sapiens
ctgagggctccatgctgaag

SEQ ID NO: 6164709 - DNA, 14 bp, Homo sapiens
ctgagggctcctcc

SEQ ID NO: 6164710 - DNA, 14 bp, Homo sapiens
ctgagggctctgtt

SEQ ID NO: 6164711 - DNA, 15 bp, Homo sapiens
ctgagggctctgttt

SEQ ID NO: 6164712 - DNA, 16 bp, Homo sapiens
ctgagggctctgtttg

SEQ ID NO: 6164713 - DNA, 22 bp, Homo sapiens
ctgagggctctgtttgtgggac

SEQ ID NO: 6164714 - DNA, 14 bp, Homo sapiens
ctgagggctgccag

SEQ ID NO: 6164715 - DNA, 15 bp, Homo sapiens
ctgagggctgccagc

SEQ ID NO: 6164716 - DNA, 20 bp, Homo sapiens
ctgagggcttgtagttcttt

SEQ ID NO: 6164717 - DNA, 17 bp, Homo sapiens
ctgaggggacgggcaag

SEQ ID NO: 6164718 - DNA, 18 bp, Homo sapiens
ctgaggggagacagagca

SEQ ID NO: 6164719 - DNA, 14 bp, Homo sapiens
ctgaggggaggcac

SEQ ID NO: 6164720 - DNA, 16 bp, Homo sapiens
ctgaggggaggcacct

SEQ ID NO: 6164721 - DNA, 19 bp, Homo sapiens
ctgaggggaggcacctcca

SEQ ID NO: 6164722 - DNA, 12 bp, Homo sapiens
ctgaggggaggg

SEQ ID NO: 6164723 - DNA, 16 bp, Homo sapiens
ctgaggggattctcta

SEQ ID NO: 6164724 - DNA, 19 bp, Homo sapiens
ctgaggggcaacgaagaaa

SEQ ID NO: 6164725 - DNA, 21 bp, Homo sapiens
ctgaggggcaacgaagaaaaa

SEQ ID NO: 6164726 - DNA, 17 bp, Homo sapiens
ctgaggggcagcctgcc

SEQ ID NO: 6164727 - DNA, 23 bp, Homo sapiens
ctgaggggcagcctgccttgccc

SEQ ID NO: 6164728 - DNA, 24 bp, Homo sapiens
ctgaggggcagggagagcgcctct

SEQ ID NO: 6164729 - DNA, 15 bp, Homo sapiens
ctgaggggcagggcc

SEQ ID NO: 6164730 - DNA, 14 bp, Homo sapiens
ctgaggggcctgcc

SEQ ID NO: 6164731 - DNA, 16 bp, Homo sapiens
ctgaggggcctgcgcc

SEQ ID NO: 6164732 - DNA, 20 bp, Homo sapiens
ctgaggggctaccaggaaag

SEQ ID NO: 6164733 - DNA, 15 bp, Homo sapiens
ctgaggggctgggct

SEQ ID NO: 6164734 - DNA, 16 bp, Homo sapiens
ctgaggggctgggctg

SEQ ID NO: 6164735 - DNA, 17 bp, Homo sapiens
ctgaggggctgggctgg

SEQ ID NO: 6164736 - DNA, 17 bp, Homo sapiens
ctgaggggctggggagg

SEQ ID NO: 6164737 - DNA, 20 bp, Homo sapiens
ctgaggggctggggaggggg

SEQ ID NO: 6164738 - DNA, 16 bp, Homo sapiens
ctgaggggcttgggaa

SEQ ID NO: 6164739 - DNA, 13 bp, Homo sapiens
ctgagggggagcc

SEQ ID NO: 6164740 - DNA, 18 bp, Homo sapiens
ctgagggggcctggatgc

SEQ ID NO: 6164741 - DNA, 23 bp, Homo sapiens
ctgaggggggccgtgcccagggg

SEQ ID NO: 6164742 - DNA, 15 bp, Homo sapiens
ctgagggtccccacc

SEQ ID NO: 6164743 - DNA, 19 bp, Homo sapiens
ctgagggtccccacctggg

SEQ ID NO: 6164744 - DNA, 20 bp, Homo sapiens
ctgagggtccccacctggga

SEQ ID NO: 6164745 - DNA, 15 bp, Homo sapiens
ctgagggtcgtggga

SEQ ID NO: 6164746 - DNA, 12 bp, Homo sapiens
ctgagggtctgt

SEQ ID NO: 6164747 - DNA, 22 bp, Homo sapiens
ctgaggtaagtgtatgatctta

SEQ ID NO: 6164748 - DNA, 17 bp, Homo sapiens
ctgaggtataaagacaa

SEQ ID NO: 6164749 - DNA, 18 bp, Homo sapiens
ctgaggtatctgtgttac

SEQ ID NO: 6164750 - DNA, 15 bp, Homo sapiens
ctgaggtatggccat

SEQ ID NO: 6164751 - DNA, 15 bp, Homo sapiens
ctgaggtcaataaag

SEQ ID NO: 6164752 - DNA, 16 bp, Homo sapiens
ctgaggtcaataaagc

SEQ ID NO: 6164753 - DNA, 20 bp, Homo sapiens
ctgaggtcaataaagcagag

SEQ ID NO: 6164754 - DNA, 21 bp, Homo sapiens
ctgaggtcaataaagcagagc

SEQ ID NO: 6164755 - DNA, 14 bp, Homo sapiens
ctgaggtcacctgg

SEQ ID NO: 6164756 - DNA, 16 bp, Homo sapiens
ctgaggtcactgctag

SEQ ID NO: 6164757 - DNA, 17 bp, Homo sapiens
ctgaggtcaggagttcg

SEQ ID NO: 6164758 - DNA, 17 bp, Homo sapiens
ctgaggtcagggagtgc

SEQ ID NO: 6164759 - DNA, 19 bp, Homo sapiens
ctgaggtcagggagtgctg

SEQ ID NO: 6164760 - DNA, 19 bp, Homo sapiens
ctgaggtcccttcaaggcc

SEQ ID NO: 6164761 - DNA, 21 bp, Homo sapiens
ctgaggtccgatggcccgaga

SEQ ID NO: 6164762 - DNA, 24 bp, Homo sapiens
ctgaggtcctgagcactgccagga

SEQ ID NO: 6164763 - DNA, 23 bp, Homo sapiens
ctgttaaactgttagcactgttg

SEQ ID NO: 6164764 - DNA, 15 bp, Homo sapiens
ctgttaaatacagga

SEQ ID NO: 6164765 - DNA, 16 bp, Homo sapiens
ctgttaaatatacact

SEQ ID NO: 6164766 - DNA, 20 bp, Homo sapiens
ctgttaacactgtaatatct

SEQ ID NO: 6164767 - DNA, 21 bp, Homo sapiens
ctgttaacactgtaatatctt

SEQ ID NO: 6164768 - DNA, 22 bp, Homo sapiens
ctgttaacatctagcctaaagt

SEQ ID NO: 6164769 - DNA, 12 bp, Homo sapiens
ctgttaaccaaa

SEQ ID NO: 6164770 - DNA, 13 bp, Homo sapiens
ctgttaaccaaat

SEQ ID NO: 6164771 - DNA, 20 bp, Homo sapiens
ctgttaaccaaataaaacat

SEQ ID NO: 6164772 - DNA, 12 bp, Homo sapiens
ctgttaactgaa

SEQ ID NO: 6164773 - DNA, 14 bp, Homo sapiens
ctgttaactgaata

SEQ ID NO: 6164774 - DNA, 21 bp, Homo sapiens
ctgttaactgtcttgagagaa

SEQ ID NO: 6164775 - DNA, 22 bp, Homo sapiens
ctgttaactgtgcgttaaataa

SEQ ID NO: 6164776 - DNA, 13 bp, Homo sapiens
ctgttaactgtta

SEQ ID NO: 6164777 - DNA, 20 bp, Homo sapiens
ctgttaactttcatgctaca

SEQ ID NO: 6164778 - DNA, 14 bp, Homo sapiens
ctgttaagaaagga

SEQ ID NO: 6164779 - DNA, 19 bp, Homo sapiens
ctgttaagaaatctgtttt

SEQ ID NO: 6164780 - DNA, 21 bp, Homo sapiens
ctgttaaggtggaaaatggac

SEQ ID NO: 6164781 - DNA, 20 bp, Homo sapiens
ctgttaaggttgaactttgc

SEQ ID NO: 6164782 - DNA, 23 bp, Homo sapiens
ctgttaaggttgaactttgccaa

SEQ ID NO: 6164783 - DNA, 16 bp, Homo sapiens
ctgttaagtggtttca

SEQ ID NO: 6164784 - DNA, 23 bp, Homo sapiens
ctgttaataaagaaatccagatc

SEQ ID NO: 6164785 - DNA, 21 bp, Homo sapiens
ctgttaatacacagtacttta

SEQ ID NO: 6164786 - DNA, 19 bp, Homo sapiens
ctgttaatagatcttaggg

SEQ ID NO: 6164787 - DNA, 21 bp, Homo sapiens
ctgttaatagtactattaaca

SEQ ID NO: 6164788 - DNA, 17 bp, Homo sapiens
ctgttaatatttctaaa

SEQ ID NO: 6164789 - DNA, 18 bp, Homo sapiens
ctgttaatatttctaaaa

SEQ ID NO: 6164790 - DNA, 19 bp, Homo sapiens
ctgttaatctgatgtataa

SEQ ID NO: 6164791 - DNA, 14 bp, Homo sapiens
ctgttaatgtattt

SEQ ID NO: 6164792 - DNA, 13 bp, Homo sapiens
ctgttaatgtgga

SEQ ID NO: 6164793 - DNA, 21 bp, Homo sapiens
ctgttaatgtggactggaaca

SEQ ID NO: 6164794 - DNA, 24 bp, Homo sapiens
ctgttaattctagatcagagagca

SEQ ID NO: 6164795 - DNA, 21 bp, Homo sapiens
ctgttaatttataatgtattt

SEQ ID NO: 6164796 - DNA, 22 bp, Homo sapiens
ctgttaatttataatgtatttg

SEQ ID NO: 6164797 - DNA, 15 bp, Homo sapiens
ctgttaatttatagg

SEQ ID NO: 6164798 - DNA, 16 bp, Homo sapiens
ctgttaatttttctta

SEQ ID NO: 6164799 - DNA, 11 bp, Homo sapiens
ctgttacaaaa

SEQ ID NO: 6164800 - DNA, 18 bp, Homo sapiens
ctgttacaaaatgtaact

SEQ ID NO: 6164801 - DNA, 19 bp, Homo sapiens
ctgttacaaaatgtaactg

SEQ ID NO: 6164802 - DNA, 22 bp, Homo sapiens
ctgttacaaaatgtaactgtta

SEQ ID NO: 6164803 - DNA, 16 bp, Homo sapiens
ctgttacacaatatgt

SEQ ID NO: 6164804 - DNA, 22 bp, Homo sapiens
ctgttacacactaacatcaatg

SEQ ID NO: 6164805 - DNA, 12 bp, Homo sapiens
ctgttacactgg

SEQ ID NO: 6164806 - DNA, 18 bp, Homo sapiens
ctgttacactttttggaa

SEQ ID NO: 6164807 - DNA, 19 bp, Homo sapiens
ctgttacactttttggaag

SEQ ID NO: 6164808 - DNA, 17 bp, Homo sapiens
ctgttaccattggaaat

SEQ ID NO: 6164809 - DNA, 22 bp, Homo sapiens
ctgttacccagggctctgcagc

SEQ ID NO: 6164810 - DNA, 20 bp, Homo sapiens
ctgttaccccatcctccctc

SEQ ID NO: 6164811 - DNA, 22 bp, Homo sapiens
ctgttaccccatcctccctccc

SEQ ID NO: 6164812 - DNA, 18 bp, Homo sapiens
ctgttacctaggttaaca

SEQ ID NO: 6164813 - DNA, 19 bp, Homo sapiens
ctgttacctaggttaacaa

SEQ ID NO: 6164814 - DNA, 22 bp, Homo sapiens
ctgttacctcaacaagaagaat

SEQ ID NO: 6164815 - DNA, 23 bp, Homo sapiens
ctgttacctctgacatcaagtgt

SEQ ID NO: 6164816 - DNA, 21 bp, Homo sapiens
ctgttacctgatcaatgacag

SEQ ID NO: 6164817 - DNA, 21 bp, Homo sapiens
ctgttactccaaaaagaaata

SEQ ID NO: 6164818 - DNA, 15 bp, Homo sapiens
ctgttactccacagc

SEQ ID NO: 6164819 - DNA, 14 bp, Homo sapiens
ctgttactctgtcc

SEQ ID NO: 6164820 - DNA, 15 bp, Homo sapiens
ctgttactctgtccc

SEQ ID NO: 6164821 - DNA, 13 bp, Homo sapiens
ctgttactgcttc

SEQ ID NO: 6164822 - DNA, 23 bp, Homo sapiens
ctgttactgcttctctttgtgca

SEQ ID NO: 6164823 - DNA, 14 bp, Homo sapiens
ctgttactgggccc

SEQ ID NO: 6164824 - DNA, 16 bp, Homo sapiens
ctgttactgggccctg

SEQ ID NO: 6164825 - DNA, 13 bp, Homo sapiens
ctgttactgtctt

SEQ ID NO: 6164826 - DNA, 17 bp, Homo sapiens
ctgttactgtcttcagt

SEQ ID NO: 6164827 - DNA, 18 bp, Homo sapiens
ctgttactgttaaccatt

SEQ ID NO: 6164828 - DNA, 20 bp, Homo sapiens
ctgttacttatgtagaaact

SEQ ID NO: 6164829 - DNA, 18 bp, Homo sapiens
ctgttacttgcttcagtg

SEQ ID NO: 6164830 - DNA, 18 bp, Homo sapiens
ctgttacttgcttctgct

SEQ ID NO: 6164831 - DNA, 15 bp, Homo sapiens
ctgttactttctttc

SEQ ID NO: 6164832 - DNA, 15 bp, Homo sapiens
ctgttactttggcaa

SEQ ID NO: 6164833 - DNA, 23 bp, Homo sapiens
ctgttactttggcaatttcctgg

SEQ ID NO: 6164834 - DNA, 14 bp, Homo sapiens
ctgttactttttag

SEQ ID NO: 6164835 - DNA, 14 bp, Homo sapiens
ctgttagaacacta

SEQ ID NO: 6164836 - DNA, 17 bp, Homo sapiens
ctgttagaattctttta

SEQ ID NO: 6164837 - DNA, 18 bp, Homo sapiens
ctgttagaattcttttat

SEQ ID NO: 6164838 - DNA, 15 bp, Homo sapiens
ctgttagatgctgaa

SEQ ID NO: 6164839 - DNA, 16 bp, Homo sapiens
ctgttagcactgttga

SEQ ID NO: 6164840 - DNA, 18 bp, Homo sapiens
ctgttagcactgttgatg

SEQ ID NO: 6164841 - DNA, 15 bp, Homo sapiens
ctgttagcagacagg

SEQ ID NO: 6164842 - DNA, 13 bp, Homo sapiens
ctgttagcagagt

SEQ ID NO: 6164843 - DNA, 12 bp, Homo sapiens
ctgttagcatta

SEQ ID NO: 6164844 - DNA, 17 bp, Homo sapiens
ctgttagcattattgcc

SEQ ID NO: 6164845 - DNA, 19 bp, Homo sapiens
ctgttagcattattgccaa

SEQ ID NO: 6164846 - DNA, 22 bp, Homo sapiens
ctgttagctaaaagaggcctgt

SEQ ID NO: 6164847 - DNA, 15 bp, Homo sapiens
ctgttagctgctcac

SEQ ID NO: 6164848 - DNA, 18 bp, Homo sapiens
ctgttaggaacagcagtg

SEQ ID NO: 6164849 - DNA, 23 bp, Homo sapiens
ctgttaggaacagcagtgttctc

SEQ ID NO: 6164850 - DNA, 22 bp, Homo sapiens
ctgttaggacagcaaagcagca

SEQ ID NO: 6164851 - DNA, 22 bp, Homo sapiens
ctgttagggacatttccaagct

SEQ ID NO: 6164852 - DNA, 20 bp, Homo sapiens
ctgttaggggccaataaaat

SEQ ID NO: 6164853 - DNA, 21 bp, Homo sapiens
ctgttaggggccaataaaatg

SEQ ID NO: 6164854 - DNA, 18 bp, Homo sapiens
ctgttaggtccattttct

SEQ ID NO: 6164855 - DNA, 19 bp, Homo sapiens
ctgttagtattgattcaaa

SEQ ID NO: 6164856 - DNA, 13 bp, Homo sapiens
ctgttagtgacag

SEQ ID NO: 6164857 - DNA, 12 bp, Homo sapiens
ctgttagttttg

SEQ ID NO: 6164858 - DNA, 16 bp, Homo sapiens
ctgttagttttgtaaa

SEQ ID NO: 6164859 - DNA, 22 bp, Homo sapiens
ctgttagttttgtaaaaactga

SEQ ID NO: 6164860 - DNA, 19 bp, Homo sapiens
ctgttataaattttgtaca

SEQ ID NO: 6164861 - DNA, 20 bp, Homo sapiens
ctgttataaattttgtacat

SEQ ID NO: 6164862 - DNA, 14 bp, Homo sapiens
ctgttataactctg

SEQ ID NO: 6164863 - DNA, 17 bp, Homo sapiens
ctgttataataaatgta

SEQ ID NO: 6164864 - DNA, 20 bp, Homo sapiens
ctgttataataaatgtacct

SEQ ID NO: 6164865 - DNA, 13 bp, Homo sapiens
ctgttataatctt

SEQ ID NO: 6164866 - DNA, 19 bp, Homo sapiens
ctgttataatctttcacag

SEQ ID NO: 6164867 - DNA, 18 bp, Homo sapiens
ctgttataggtcctttag

SEQ ID NO: 6164868 - DNA, 14 bp, Homo sapiens
ctgttatatttcat

SEQ ID NO: 6164869 - DNA, 13 bp, Homo sapiens
ctgttatcaagct

SEQ ID NO: 6164870 - DNA, 20 bp, Homo sapiens
ctgttatcattttttcctgt

SEQ ID NO: 6164871 - DNA, 16 bp, Homo sapiens
ctgttatgctgtttcc

SEQ ID NO: 6164872 - DNA, 13 bp, Homo sapiens
ctgttatgggctt

SEQ ID NO: 6164873 - DNA, 12 bp, Homo sapiens
ctgttatgtctg

SEQ ID NO: 6164874 - DNA, 17 bp, Homo sapiens
ctgttatgtctgtttaa

SEQ ID NO: 6164875 - DNA, 21 bp, Homo sapiens
ctgttatgtctgtttaagaaa

SEQ ID NO: 6164876 - DNA, 16 bp, Homo sapiens
ctgttatgtgagaaca

SEQ ID NO: 6164877 - DNA, 14 bp, Homo sapiens
ctgttatgtttaac

SEQ ID NO: 6164878 - DNA, 20 bp, Homo sapiens
ctgttattatatttgacatg

SEQ ID NO: 6164879 - DNA, 13 bp, Homo sapiens
ctgttattcttgt

SEQ ID NO: 6164880 - DNA, 17 bp, Homo sapiens
ctgttattcttgttata

SEQ ID NO: 6164881 - DNA, 23 bp, Homo sapiens
ctgttattgcactatgaaaatca

SEQ ID NO: 6164882 - DNA, 22 bp, Homo sapiens
ctgttattgttttgttaacaat

SEQ ID NO: 6164883 - DNA, 14 bp, Homo sapiens
ctgttatttagact

SEQ ID NO: 6164884 - DNA, 12 bp, Homo sapiens
ctgttatttcta

SEQ ID NO: 6164885 - DNA, 19 bp, Homo sapiens
ctgttatttctatgaaaat

SEQ ID NO: 6164886 - DNA, 17 bp, Homo sapiens
ctgttatttctattttt

SEQ ID NO: 6164887 - DNA, 13 bp, Homo sapiens
ctgttatttcttc

SEQ ID NO: 6164888 - DNA, 14 bp, Homo sapiens
ctgttatttcttcc

SEQ ID NO: 6164889 - DNA, 21 bp, Homo sapiens
ctgttatttcttccctgcttt

SEQ ID NO: 6164890 - DNA, 20 bp, Homo sapiens
ctgttattttcaagtagctg

SEQ ID NO: 6164891 - DNA, 23 bp, Homo sapiens
ctgttattttgcatatatgttct

SEQ ID NO: 6164892 - DNA, 18 bp, Homo sapiens
ctgttatttttctgccct

SEQ ID NO: 6164893 - DNA, 17 bp, Homo sapiens
ctgttcaaaatgttaat

SEQ ID NO: 6164894 - DNA, 13 bp, Homo sapiens
ctgttcaaagtac

SEQ ID NO: 6164895 - DNA, 16 bp, Homo sapiens
ctgttcaacatcactg

SEQ ID NO: 6164896 - DNA, 19 bp, Homo sapiens
ctgttcaacatcactgaaa

SEQ ID NO: 6164897 - DNA, 13 bp, Homo sapiens
ctgttcaagcaaa

SEQ ID NO: 6164898 - DNA, 15 bp, Homo sapiens
ctgttcaagtgtccc

SEQ ID NO: 6164899 - DNA, 12 bp, Homo sapiens
ctgttcaatact

SEQ ID NO: 6164900 - DNA, 21 bp, Homo sapiens
ctgttcacaaactacctctgg

SEQ ID NO: 6164901 - DNA, 16 bp, Homo sapiens
ctgttcacagaaaaag

SEQ ID NO: 6164902 - DNA, 15 bp, Homo sapiens
ctgttcacagctttt

SEQ ID NO: 6164903 - DNA, 17 bp, Homo sapiens
ctgttcacagtctctgg

SEQ ID NO: 6164904 - DNA, 17 bp, Homo sapiens
ctgttcaccttatgtat

SEQ ID NO: 6164905 - DNA, 22 bp, Homo sapiens
ctgttcacgctcacccagtcac

SEQ ID NO: 6164906 - DNA, 20 bp, Homo sapiens
ctgttcacggggatgcttgg

SEQ ID NO: 6164907 - DNA, 16 bp, Homo sapiens
ctgttcacggtgacac

SEQ ID NO: 6164908 - DNA, 13 bp, Homo sapiens
ctgttcactctac

SEQ ID NO: 6164909 - DNA, 15 bp, Homo sapiens
ctgttcactgcattc

SEQ ID NO: 6164910 - DNA, 15 bp, Homo sapiens
ctgttcagatgtgca

SEQ ID NO: 6164911 - DNA, 17 bp, Homo sapiens
ctgttcagatgtgcatt

SEQ ID NO: 6164912 - DNA, 14 bp, Homo sapiens
ctgttcagcattct

SEQ ID NO: 6164913 - DNA, 17 bp, Homo sapiens
ctgttcagcattcttag

SEQ ID NO: 6164914 - DNA, 18 bp, Homo sapiens
ctgttcagcggagctgac

SEQ ID NO: 6164915 - DNA, 22 bp, Homo sapiens
ctgttcagcggagctgactggt

SEQ ID NO: 6164916 - DNA, 19 bp, Homo sapiens
ctgttcagctggttgaggt

SEQ ID NO: 6164917 - DNA, 20 bp, Homo sapiens
ctgttcagcttttattcctg

SEQ ID NO: 6164918 - DNA, 15 bp, Homo sapiens
ctgttcaggagctga

SEQ ID NO: 6164919 - DNA, 20 bp, Homo sapiens
ctgttcagggcatcggcagc

SEQ ID NO: 6164920 - DNA, 16 bp, Homo sapiens
ctgttcagtaacaggg

SEQ ID NO: 6164921 - DNA, 14 bp, Homo sapiens
ctgttcagtactct

SEQ ID NO: 6164922 - DNA, 14 bp, Homo sapiens
ctgttcagtgagat

SEQ ID NO: 6164923 - DNA, 14 bp, Homo sapiens
ctgttcagtgcttt

SEQ ID NO: 6164924 - DNA, 13 bp, Homo sapiens
ctgttcagttaca

SEQ ID NO: 6164925 - DNA, 14 bp, Homo sapiens
ctgttcagttacag

SEQ ID NO: 6164926 - DNA, 21 bp, Homo sapiens
ctgttcagttacagaaagtgg

SEQ ID NO: 6164927 - DNA, 23 bp, Homo sapiens
ctgttcagttagagtgagtgctg

SEQ ID NO: 6164928 - DNA, 16 bp, Homo sapiens
ctgttcagtttcccca

SEQ ID NO: 6164929 - DNA, 21 bp, Homo sapiens
ctgttcatagatattggaaga

SEQ ID NO: 6164930 - DNA, 21 bp, Homo sapiens
ctgttcatctctttgtcctga

SEQ ID NO: 6164931 - DNA, 15 bp, Homo sapiens
ctgttcatctgtgca

SEQ ID NO: 6164932 - DNA, 23 bp, Homo sapiens
ctgttcatggcagatgtaggagg

SEQ ID NO: 6164933 - DNA, 15 bp, Homo sapiens
ctgttcattcctcca

SEQ ID NO: 6164934 - DNA, 14 bp, Homo sapiens
ctgttcattctgat

SEQ ID NO: 6164935 - DNA, 13 bp, Homo sapiens
ctgttcattgtaa

SEQ ID NO: 6164936 - DNA, 14 bp, Homo sapiens
ctgttcattgtaag

SEQ ID NO: 6164937 - DNA, 17 bp, Homo sapiens
ctgttcatttcctcaaa

SEQ ID NO: 6164938 - DNA, 18 bp, Homo sapiens
ctgttcatttctaaattt

SEQ ID NO: 6164939 - DNA, 20 bp, Homo sapiens
ctgttcatttctaaatttat

SEQ ID NO: 6164940 - DNA, 14 bp, Homo sapiens
ctgttcatttgtta

SEQ ID NO: 6164941 - DNA, 21 bp, Homo sapiens
ctgaggtcctgcatttctcag

SEQ ID NO: 6164942 - DNA, 17 bp, Homo sapiens
ctgaggtctagaaatag

SEQ ID NO: 6164943 - DNA, 15 bp, Homo sapiens
ctgaggtctcattca

SEQ ID NO: 6164944 - DNA, 16 bp, Homo sapiens
ctgaggtctgtttctc

SEQ ID NO: 6164945 - DNA, 16 bp, Homo sapiens
ctgaggtgcccactcc

SEQ ID NO: 6164946 - DNA, 22 bp, Homo sapiens
ctgaggtgcccactccgccagc

SEQ ID NO: 6164947 - DNA, 13 bp, Homo sapiens
ctgaggtgcctcc

SEQ ID NO: 6164948 - DNA, 14 bp, Homo sapiens
ctgaggtgcctgct

SEQ ID NO: 6164949 - DNA, 19 bp, Homo sapiens
ctgaggtgctatgaagcca

SEQ ID NO: 6164950 - DNA, 17 bp, Homo sapiens
ctgaggtggatttactg

SEQ ID NO: 6164951 - DNA, 20 bp, Homo sapiens
ctgaggtggatttactgaga

SEQ ID NO: 6164952 - DNA, 23 bp, Homo sapiens
ctgaggtggatttactgagagaa

SEQ ID NO: 6164953 - DNA, 12 bp, Homo sapiens
ctgaggtgggag

SEQ ID NO: 6164954 - DNA, 21 bp, Homo sapiens
ctgaggtgggagatgtggaaa

SEQ ID NO: 6164955 - DNA, 13 bp, Homo sapiens
ctgaggtgggagg

SEQ ID NO: 6164956 - DNA, 14 bp, Homo sapiens
ctgaggtgggcaga

SEQ ID NO: 6164957 - DNA, 17 bp, Homo sapiens
ctgaggtgggcccagga

SEQ ID NO: 6164958 - DNA, 19 bp, Homo sapiens
ctgaggtgggccttccatg

SEQ ID NO: 6164959 - DNA, 22 bp, Homo sapiens
ctgaggtgggctggggctgctc

SEQ ID NO: 6164960 - DNA, 12 bp, Homo sapiens
ctgaggtgggga

SEQ ID NO: 6164961 - DNA, 14 bp, Homo sapiens
ctgaggtggggaag

SEQ ID NO: 6164962 - DNA, 15 bp, Homo sapiens
ctgaggtggggaagg

SEQ ID NO: 6164963 - DNA, 17 bp, Homo sapiens
ctgaggtggtggacatc

SEQ ID NO: 6164964 - DNA, 18 bp, Homo sapiens
ctgaggtgtctggcctga

SEQ ID NO: 6164965 - DNA, 21 bp, Homo sapiens
ctgaggtgtctggcctgaggt

SEQ ID NO: 6164966 - DNA, 20 bp, Homo sapiens
ctgaggtgtgggggctgcag

SEQ ID NO: 6164967 - DNA, 17 bp, Homo sapiens
ctgaggtgttattttca

SEQ ID NO: 6164968 - DNA, 21 bp, Homo sapiens
ctgaggttaaacggtgcccat

SEQ ID NO: 6164969 - DNA, 22 bp, Homo sapiens
ctgaggttaaacggtgcccatc

SEQ ID NO: 6164970 - DNA, 17 bp, Homo sapiens
ctgaggttactggaaat

SEQ ID NO: 6164971 - DNA, 19 bp, Homo sapiens
ctgaggttactggaaatta

SEQ ID NO: 6164972 - DNA, 15 bp, Homo sapiens
ctgaggttcctctgc

SEQ ID NO: 6164973 - DNA, 16 bp, Homo sapiens
ctgaggttcctctgcc

SEQ ID NO: 6164974 - DNA, 23 bp, Homo sapiens
ctgaggttgggaaggcacctgct

SEQ ID NO: 6164975 - DNA, 21 bp, Homo sapiens
ctgaggttgggagaggtgcac

SEQ ID NO: 6164976 - DNA, 14 bp, Homo sapiens
ctgaggttgggagt

SEQ ID NO: 6164977 - DNA, 15 bp, Homo sapiens
ctgaggttttgaata

SEQ ID NO: 6164978 - DNA, 20 bp, Homo sapiens
ctgagtaaacataaaaactg

SEQ ID NO: 6164979 - DNA, 14 bp, Homo sapiens
ctgagtaaagtgtt

SEQ ID NO: 6164980 - DNA, 20 bp, Homo sapiens
ctgagtaaattggaaacatt

SEQ ID NO: 6164981 - DNA, 22 bp, Homo sapiens
ctgagtaactggttgctgtgtc

SEQ ID NO: 6164982 - DNA, 14 bp, Homo sapiens
ctgagtaagtgtgt

SEQ ID NO: 6164983 - DNA, 15 bp, Homo sapiens
ctgagtacaaatgtg

SEQ ID NO: 6164984 - DNA, 20 bp, Homo sapiens
ctgagtacgttgtgcatttg

SEQ ID NO: 6164985 - DNA, 16 bp, Homo sapiens
ctgagtactctttctc

SEQ ID NO: 6164986 - DNA, 13 bp, Homo sapiens
ctgagtactggaa

SEQ ID NO: 6164987 - DNA, 17 bp, Homo sapiens
ctgagtactggaataaa

SEQ ID NO: 6164988 - DNA, 12 bp, Homo sapiens
ctgagtagaaag

SEQ ID NO: 6164989 - DNA, 20 bp, Homo sapiens
ctgagtagctggaattacag

SEQ ID NO: 6164990 - DNA, 22 bp, Homo sapiens
ctgagtagctgggactagaggc

SEQ ID NO: 6164991 - DNA, 15 bp, Homo sapiens
ctgagtagctgggat

SEQ ID NO: 6164992 - DNA, 20 bp, Homo sapiens
ctgagtagctgggattacag

SEQ ID NO: 6164993 - DNA, 15 bp, Homo sapiens
ctgagtagctgggcc

SEQ ID NO: 6164994 - DNA, 16 bp, Homo sapiens
ctgagtagctgggcct

SEQ ID NO: 6164995 - DNA, 18 bp, Homo sapiens
ctgagtagctttacactg

SEQ ID NO: 6164996 - DNA, 20 bp, Homo sapiens
ctgagtaggtctgggatgga

SEQ ID NO: 6164997 - DNA, 22 bp, Homo sapiens
ctgagtatctcctcgcaagctg

SEQ ID NO: 6164998 - DNA, 20 bp, Homo sapiens
ctgagtatgtaacttgcaat

SEQ ID NO: 6164999 - DNA, 13 bp, Homo sapiens
ctgagtatgtgga

SEQ ID NO: 6165000 - DNA, 20 bp, Homo sapiens
ctgagtatgttaagctcttt

SEQ ID NO: 6165001 - DNA, 13 bp, Homo sapiens
ctgagtatttttt

SEQ ID NO: 6165002 - DNA, 17 bp, Homo sapiens
ctgagtattttttataa

SEQ ID NO: 6165003 - DNA, 16 bp, Homo sapiens
ctgagtcaaatccagt

SEQ ID NO: 6165004 - DNA, 22 bp, Homo sapiens
ctgagtcaaatccagtggtggg

SEQ ID NO: 6165005 - DNA, 23 bp, Homo sapiens
ctgagtcaaatccagtggtgggt

SEQ ID NO: 6165006 - DNA, 16 bp, Homo sapiens
ctgagtcaactggagc

SEQ ID NO: 6165007 - DNA, 17 bp, Homo sapiens
ctgagtcaactggagca

SEQ ID NO: 6165008 - DNA, 16 bp, Homo sapiens
ctgagtcaagttgttc

SEQ ID NO: 6165009 - DNA, 22 bp, Homo sapiens
ctgagtcacacaagggaagtgg

SEQ ID NO: 6165010 - DNA, 20 bp, Homo sapiens
ctgagtcacccatgaagaca

SEQ ID NO: 6165011 - DNA, 22 bp, Homo sapiens
ctgagtcaccctacctgtgcct

SEQ ID NO: 6165012 - DNA, 14 bp, Homo sapiens
ctgagtcacctcct

SEQ ID NO: 6165013 - DNA, 15 bp, Homo sapiens
ctgagtcacctcctc

SEQ ID NO: 6165014 - DNA, 18 bp, Homo sapiens
ctgagtcacctcctccac

SEQ ID NO: 6165015 - DNA, 23 bp, Homo sapiens
ctgagtcacctcctccactcact

SEQ ID NO: 6165016 - DNA, 15 bp, Homo sapiens
ctgagtcacgctggg

SEQ ID NO: 6165017 - DNA, 20 bp, Homo sapiens
ctgagtcacgctggggctct

SEQ ID NO: 6165018 - DNA, 14 bp, Homo sapiens
ctgagtcagagcca

SEQ ID NO: 6165019 - DNA, 18 bp, Homo sapiens
ctgagtcagagccatgtc

SEQ ID NO: 6165020 - DNA, 19 bp, Homo sapiens
ctgagtcagagccatgtct

SEQ ID NO: 6165021 - DNA, 13 bp, Homo sapiens
ctgagtcagtgct

SEQ ID NO: 6165022 - DNA, 12 bp, Homo sapiens
ctgagtcatcaa

SEQ ID NO: 6165023 - DNA, 17 bp, Homo sapiens
ctgagtcatcaaaaaga

SEQ ID NO: 6165024 - DNA, 22 bp, Homo sapiens
ctgagtcatcaaaaagagtctt

SEQ ID NO: 6165025 - DNA, 21 bp, Homo sapiens
ctgagtcatcttgtgagtgga

SEQ ID NO: 6165026 - DNA, 18 bp, Homo sapiens
ctgagtcatgatctccct

SEQ ID NO: 6165027 - DNA, 22 bp, Homo sapiens
ctgagtcatgatctccctgccg

SEQ ID NO: 6165028 - DNA, 18 bp, Homo sapiens
ctgagtcatggccgggtg

SEQ ID NO: 6165029 - DNA, 21 bp, Homo sapiens
ctgagtccaagagggtccttt

SEQ ID NO: 6165030 - DNA, 15 bp, Homo sapiens
ctgagtccagagctt

SEQ ID NO: 6165031 - DNA, 20 bp, Homo sapiens
ctgagtccagagcttgtgct

SEQ ID NO: 6165032 - DNA, 16 bp, Homo sapiens
ctgagtcccaggagct

SEQ ID NO: 6165033 - DNA, 20 bp, Homo sapiens
ctgagtcccaggctgagcct

SEQ ID NO: 6165034 - DNA, 20 bp, Homo sapiens
ctgagtcccgtggggccccg

SEQ ID NO: 6165035 - DNA, 20 bp, Homo sapiens
ctgagtccctggcaagactg

SEQ ID NO: 6165036 - DNA, 15 bp, Homo sapiens
ctgagtcctgagact

SEQ ID NO: 6165037 - DNA, 14 bp, Homo sapiens
ctgagtcctggccc

SEQ ID NO: 6165038 - DNA, 15 bp, Homo sapiens
ctgagtcctggccca

SEQ ID NO: 6165039 - DNA, 12 bp, Homo sapiens
ctgagtcctggg

SEQ ID NO: 6165040 - DNA, 20 bp, Homo sapiens
ctgagtcctggtccctctga

SEQ ID NO: 6165041 - DNA, 21 bp, Homo sapiens
ctgagtcctggtccctctgag

SEQ ID NO: 6165042 - DNA, 23 bp, Homo sapiens
ctgagtcctggtccctctgaggc

SEQ ID NO: 6165043 - DNA, 22 bp, Homo sapiens
ctgagtcctggtttcctggcag

SEQ ID NO: 6165044 - DNA, 21 bp, Homo sapiens
ctgagtccttaaacagggcat

SEQ ID NO: 6165045 - DNA, 24 bp, Homo sapiens
ctgagtcgattaacctgcatgcag

SEQ ID NO: 6165046 - DNA, 20 bp, Homo sapiens
ctgagtcggccccacatggg

SEQ ID NO: 6165047 - DNA, 21 bp, Homo sapiens
ctgagtcggccccacatggga

SEQ ID NO: 6165048 - DNA, 16 bp, Homo sapiens
ctgagtcggctgggca

SEQ ID NO: 6165049 - DNA, 19 bp, Homo sapiens
ctgagtcggctgggcaggg

SEQ ID NO: 6165050 - DNA, 21 bp, Homo sapiens
ctgagtcggctgggcagggcc

SEQ ID NO: 6165051 - DNA, 19 bp, Homo sapiens
ctgagtcgtacagaaagct

SEQ ID NO: 6165052 - DNA, 21 bp, Homo sapiens
ctgagtcgtacagaaagctgc

SEQ ID NO: 6165053 - DNA, 23 bp, Homo sapiens
ctgagtcgtacagaaagctgcct

SEQ ID NO: 6165054 - DNA, 17 bp, Homo sapiens
ctgagtcgtgacctgct

SEQ ID NO: 6165055 - DNA, 13 bp, Homo sapiens
ctgagtctatgtt

SEQ ID NO: 6165056 - DNA, 18 bp, Homo sapiens
ctgagtctatgttcaaag

SEQ ID NO: 6165057 - DNA, 20 bp, Homo sapiens
ctgagtctatgttcaaagac

SEQ ID NO: 6165058 - DNA, 22 bp, Homo sapiens
ctgagtctccagggccccccaa

SEQ ID NO: 6165059 - DNA, 15 bp, Homo sapiens
ctgagtctcccaagg

SEQ ID NO: 6165060 - DNA, 16 bp, Homo sapiens
ctgagtctcccaaggc

SEQ ID NO: 6165061 - DNA, 17 bp, Homo sapiens
ctgagtctcccaaggct

SEQ ID NO: 6165062 - DNA, 13 bp, Homo sapiens
ctgagtctcggca

SEQ ID NO: 6165063 - DNA, 21 bp, Homo sapiens
ctgagtctcggcatagtcccc

SEQ ID NO: 6165064 - DNA, 14 bp, Homo sapiens
ctgagtctgaaggc

SEQ ID NO: 6165065 - DNA, 16 bp, Homo sapiens
ctgagtctgagtcctg

SEQ ID NO: 6165066 - DNA, 19 bp, Homo sapiens
ctgagtctgagtcctgtct

SEQ ID NO: 6165067 - DNA, 21 bp, Homo sapiens
ctgagtctgctatattttcat

SEQ ID NO: 6165068 - DNA, 15 bp, Homo sapiens
ctgagtctggacctc

SEQ ID NO: 6165069 - DNA, 18 bp, Homo sapiens
ctgagtctggacctccat

SEQ ID NO: 6165070 - DNA, 22 bp, Homo sapiens
ctgagtctggacctccatccct

SEQ ID NO: 6165071 - DNA, 15 bp, Homo sapiens
ctgagtctggacttt

SEQ ID NO: 6165072 - DNA, 16 bp, Homo sapiens
ctgagtctggactttg

SEQ ID NO: 6165073 - DNA, 14 bp, Homo sapiens
ctgagtctggcaaa

SEQ ID NO: 6165074 - DNA, 21 bp, Homo sapiens
ctgagtctggcaaacatgtgc

SEQ ID NO: 6165075 - DNA, 13 bp, Homo sapiens
ctgagtctggcta

SEQ ID NO: 6165076 - DNA, 20 bp, Homo sapiens
ctgagtctggctaggggccg

SEQ ID NO: 6165077 - DNA, 23 bp, Homo sapiens
ctgagtctgtggacactgtggaa

SEQ ID NO: 6165078 - DNA, 13 bp, Homo sapiens
ctgagtgaaaaat

SEQ ID NO: 6165079 - DNA, 21 bp, Homo sapiens
ctgagtgaaaaatctgtggaa

SEQ ID NO: 6165080 - DNA, 18 bp, Homo sapiens
ctgagtgaagtccagtga

SEQ ID NO: 6165081 - DNA, 20 bp, Homo sapiens
ctgagtgaagtccagtgacc

SEQ ID NO: 6165082 - DNA, 16 bp, Homo sapiens
ctgagtgaatactttg

SEQ ID NO: 6165083 - DNA, 14 bp, Homo sapiens
ctgagtgacacaag

SEQ ID NO: 6165084 - DNA, 21 bp, Homo sapiens
ctgagtgaccgggggctgctg

SEQ ID NO: 6165085 - DNA, 17 bp, Homo sapiens
ctgagtgacctccttct

SEQ ID NO: 6165086 - DNA, 21 bp, Homo sapiens
ctgagtgacctccttctgcaa

SEQ ID NO: 6165087 - DNA, 16 bp, Homo sapiens
ctgagtgagaggggag

SEQ ID NO: 6165088 - DNA, 21 bp, Homo sapiens
ctgagtgaggagtggacgctg

SEQ ID NO: 6165089 - DNA, 14 bp, Homo sapiens
ctgagtgagtggga

SEQ ID NO: 6165090 - DNA, 14 bp, Homo sapiens
ctgagtgagtgtgt

SEQ ID NO: 6165091 - DNA, 19 bp, Homo sapiens
ctgagtgagtgtgtgtgct

SEQ ID NO: 6165092 - DNA, 20 bp, Homo sapiens
ctgagtgagttattgggagt

SEQ ID NO: 6165093 - DNA, 22 bp, Homo sapiens
ctgagtgcagaggctgagcagg

SEQ ID NO: 6165094 - DNA, 13 bp, Homo sapiens
ctgagtgcagcca

SEQ ID NO: 6165095 - DNA, 19 bp, Homo sapiens
ctgagtgcagccgtttgag

SEQ ID NO: 6165096 - DNA, 14 bp, Homo sapiens
ctgagtgccccact

SEQ ID NO: 6165097 - DNA, 13 bp, Homo sapiens
ctgagtgcctgca

SEQ ID NO: 6165098 - DNA, 16 bp, Homo sapiens
ctgagtgcctgcagca

SEQ ID NO: 6165099 - DNA, 14 bp, Homo sapiens
ctgagtgcctggcc

SEQ ID NO: 6165100 - DNA, 16 bp, Homo sapiens
ctgagtgcctggccaa

SEQ ID NO: 6165101 - DNA, 19 bp, Homo sapiens
ctgagtgcctggccaaagg

SEQ ID NO: 6165102 - DNA, 21 bp, Homo sapiens
ctgagtgccttctgtggggac

SEQ ID NO: 6165103 - DNA, 15 bp, Homo sapiens
ctgagtgcgaccacc

SEQ ID NO: 6165104 - DNA, 20 bp, Homo sapiens
ctgagtgcgggctgaggcca

SEQ ID NO: 6165105 - DNA, 14 bp, Homo sapiens
ctgagtgctgggca

SEQ ID NO: 6165106 - DNA, 22 bp, Homo sapiens
ctgagtgctgggcactgctcca

SEQ ID NO: 6165107 - DNA, 17 bp, Homo sapiens
ctgagtgcttgcttttc

SEQ ID NO: 6165108 - DNA, 17 bp, Homo sapiens
ctgagtggaatgcaggg

SEQ ID NO: 6165109 - DNA, 23 bp, Homo sapiens
ctgagtggaatgcagggaagagg

SEQ ID NO: 6165110 - DNA, 22 bp, Homo sapiens
ctgagtggactggagtggagca

SEQ ID NO: 6165111 - DNA, 18 bp, Homo sapiens
ctgagtggatctccaagg

SEQ ID NO: 6165112 - DNA, 18 bp, Homo sapiens
ctgagtggcaggggacag

SEQ ID NO: 6165113 - DNA, 13 bp, Homo sapiens
ctgagtggccagc

SEQ ID NO: 6165114 - DNA, 21 bp, Homo sapiens
ctgagtggccagccagtgcca

SEQ ID NO: 6165115 - DNA, 17 bp, Homo sapiens
ctgagtggcggggcccc

SEQ ID NO: 6165116 - DNA, 18 bp, Homo sapiens
ctgagtggcggggcccct

SEQ ID NO: 6165117 - DNA, 13 bp, Homo sapiens
ctgagtggctcgt

SEQ ID NO: 6165118 - DNA, 19 bp, Homo sapiens
ctgttcatttgttattctt

SEQ ID NO: 6165119 - DNA, 18 bp, Homo sapiens
ctgttccaaattcagttt

SEQ ID NO: 6165120 - DNA, 20 bp, Homo sapiens
ctgttccaaattcagtttca

SEQ ID NO: 6165121 - DNA, 22 bp, Homo sapiens
ctgttccaacctcctgctctgg

SEQ ID NO: 6165122 - DNA, 15 bp, Homo sapiens
ctgttccaagtgtgt

SEQ ID NO: 6165123 - DNA, 20 bp, Homo sapiens
ctgttccacacccaatgctg

SEQ ID NO: 6165124 - DNA, 23 bp, Homo sapiens
ctgttccacagtgactgggccct

SEQ ID NO: 6165125 - DNA, 16 bp, Homo sapiens
ctgttccacttctcta

SEQ ID NO: 6165126 - DNA, 15 bp, Homo sapiens
ctgttccagactcag

SEQ ID NO: 6165127 - DNA, 15 bp, Homo sapiens
ctgttccagattcct

SEQ ID NO: 6165128 - DNA, 14 bp, Homo sapiens
ctgttccagcctgc

SEQ ID NO: 6165129 - DNA, 14 bp, Homo sapiens
ctgttccaggccct

SEQ ID NO: 6165130 - DNA, 16 bp, Homo sapiens
ctgttccaggccctcc

SEQ ID NO: 6165131 - DNA, 22 bp, Homo sapiens
ctgttccaggtttttctggcat

SEQ ID NO: 6165132 - DNA, 19 bp, Homo sapiens
ctgttccataggaaggctg

SEQ ID NO: 6165133 - DNA, 16 bp, Homo sapiens
ctgttccatgcaactg

SEQ ID NO: 6165134 - DNA, 13 bp, Homo sapiens
ctgttccattaca

SEQ ID NO: 6165135 - DNA, 15 bp, Homo sapiens
ctgttcccaactcag

SEQ ID NO: 6165136 - DNA, 16 bp, Homo sapiens
ctgttcccaaggaagc

SEQ ID NO: 6165137 - DNA, 23 bp, Homo sapiens
ctgttcccaaggaagctccttcc

SEQ ID NO: 6165138 - DNA, 16 bp, Homo sapiens
ctgttcccagcccctc

SEQ ID NO: 6165139 - DNA, 21 bp, Homo sapiens
ctgttcccagcccctcctccc

SEQ ID NO: 6165140 - DNA, 17 bp, Homo sapiens
ctgttcccagcccctgc

SEQ ID NO: 6165141 - DNA, 21 bp, Homo sapiens
ctgttcccataacccctagtc

SEQ ID NO: 6165142 - DNA, 13 bp, Homo sapiens
ctgttccccacag

SEQ ID NO: 6165143 - DNA, 18 bp, Homo sapiens
ctgttccccacaggtcct

SEQ ID NO: 6165144 - DNA, 22 bp, Homo sapiens
ctgttccccacaggtcctccat

SEQ ID NO: 6165145 - DNA, 15 bp, Homo sapiens
ctgttccccagagaa

SEQ ID NO: 6165146 - DNA, 15 bp, Homo sapiens
ctgttccccagcaac

SEQ ID NO: 6165147 - DNA, 14 bp, Homo sapiens
ctgttcccccaccc

SEQ ID NO: 6165148 - DNA, 15 bp, Homo sapiens
ctgttcccccaccct

SEQ ID NO: 6165149 - DNA, 19 bp, Homo sapiens
ctgttccccctgccgcagg

SEQ ID NO: 6165150 - DNA, 16 bp, Homo sapiens
ctgttcccccttcaca

SEQ ID NO: 6165151 - DNA, 17 bp, Homo sapiens
ctgttcccccttcacaa

SEQ ID NO: 6165152 - DNA, 15 bp, Homo sapiens
ctgttcccctcactg

SEQ ID NO: 6165153 - DNA, 15 bp, Homo sapiens
ctgttcccctccccc

SEQ ID NO: 6165154 - DNA, 15 bp, Homo sapiens
ctgttcccctctccc

SEQ ID NO: 6165155 - DNA, 16 bp, Homo sapiens
ctgttcccctctccct

SEQ ID NO: 6165156 - DNA, 17 bp, Homo sapiens
ctgttcccctctccctt

SEQ ID NO: 6165157 - DNA, 20 bp, Homo sapiens
ctgttcccctctcccttccc

SEQ ID NO: 6165158 - DNA, 21 bp, Homo sapiens
ctgttcccctctcccttccct

SEQ ID NO: 6165159 - DNA, 15 bp, Homo sapiens
ctgttccccttggta

SEQ ID NO: 6165160 - DNA, 11 bp, Homo sapiens
ctgttccctag

SEQ ID NO: 6165161 - DNA, 15 bp, Homo sapiens
ctgttccctagagag

SEQ ID NO: 6165162 - DNA, 21 bp, Homo sapiens
ctgttccctagagagaataaa

SEQ ID NO: 6165163 - DNA, 11 bp, Homo sapiens
ctgttccctat

SEQ ID NO: 6165164 - DNA, 19 bp, Homo sapiens
ctgttccctatggagaggc

SEQ ID NO: 6165165 - DNA, 14 bp, Homo sapiens
ctgttccctccaag

SEQ ID NO: 6165166 - DNA, 16 bp, Homo sapiens
ctgttccctccaaggt

SEQ ID NO: 6165167 - DNA, 14 bp, Homo sapiens
ctgttccctcctgg

SEQ ID NO: 6165168 - DNA, 20 bp, Homo sapiens
ctgttccctcctggtcctgg

SEQ ID NO: 6165169 - DNA, 20 bp, Homo sapiens
ctgttccctctgctcctgga

SEQ ID NO: 6165170 - DNA, 11 bp, Homo sapiens
ctgttccctgg

SEQ ID NO: 6165171 - DNA, 19 bp, Homo sapiens
ctgttccctggagtcaggg

SEQ ID NO: 6165172 - DNA, 22 bp, Homo sapiens
ctgttcccttatctgttttcta

SEQ ID NO: 6165173 - DNA, 21 bp, Homo sapiens
ctgttcccttcctctgtgcca

SEQ ID NO: 6165174 - DNA, 15 bp, Homo sapiens
ctgttccgcctcact

SEQ ID NO: 6165175 - DNA, 16 bp, Homo sapiens
ctgttccgcctcactg

SEQ ID NO: 6165176 - DNA, 20 bp, Homo sapiens
ctgttcctcccccataaaat

SEQ ID NO: 6165177 - DNA, 19 bp, Homo sapiens
ctgttcctcccctgtaggg

SEQ ID NO: 6165178 - DNA, 18 bp, Homo sapiens
ctgttcctccctcccaca

SEQ ID NO: 6165179 - DNA, 18 bp, Homo sapiens
ctgttcctgactgttctc

SEQ ID NO: 6165180 - DNA, 12 bp, Homo sapiens
ctgttcctgcct

SEQ ID NO: 6165181 - DNA, 18 bp, Homo sapiens
ctgttcctgtccagcagg

SEQ ID NO: 6165182 - DNA, 16 bp, Homo sapiens
ctgttcctgtgttctt

SEQ ID NO: 6165183 - DNA, 20 bp, Homo sapiens
ctgttccttatgatattctc

SEQ ID NO: 6165184 - DNA, 12 bp, Homo sapiens
ctgttccttcct

SEQ ID NO: 6165185 - DNA, 16 bp, Homo sapiens
ctgttccttcctgcag

SEQ ID NO: 6165186 - DNA, 18 bp, Homo sapiens
ctgttccttcctgcagac

SEQ ID NO: 6165187 - DNA, 20 bp, Homo sapiens
ctgttccttcctgcagacct

SEQ ID NO: 6165188 - DNA, 16 bp, Homo sapiens
ctgttccttcgagggt

SEQ ID NO: 6165189 - DNA, 20 bp, Homo sapiens
ctgttccttgaatctgaaag

SEQ ID NO: 6165190 - DNA, 19 bp, Homo sapiens
ctgttccttgtactcttag

SEQ ID NO: 6165191 - DNA, 14 bp, Homo sapiens
ctgttccttttata

SEQ ID NO: 6165192 - DNA, 21 bp, Homo sapiens
ctgttccttttctctcctgtg

SEQ ID NO: 6165193 - DNA, 20 bp, Homo sapiens
ctgttcctttttaggtacag

SEQ ID NO: 6165194 - DNA, 22 bp, Homo sapiens
ctgttcgctcctcccagatggc

SEQ ID NO: 6165195 - DNA, 13 bp, Homo sapiens
ctgttcggaaggg

SEQ ID NO: 6165196 - DNA, 22 bp, Homo sapiens
ctgttcgttcaaaagtggagtt

SEQ ID NO: 6165197 - DNA, 19 bp, Homo sapiens
ctgttctaactagtaatct

SEQ ID NO: 6165198 - DNA, 22 bp, Homo sapiens
ctgttctaagggggaggggaag

SEQ ID NO: 6165199 - DNA, 19 bp, Homo sapiens
ctgttctacatagatgctt

SEQ ID NO: 6165200 - DNA, 20 bp, Homo sapiens
ctgttctacatagatgctta

SEQ ID NO: 6165201 - DNA, 19 bp, Homo sapiens
ctgttctacccgttccaaa

SEQ ID NO: 6165202 - DNA, 20 bp, Homo sapiens
ctgttctacccgttccaaaa

SEQ ID NO: 6165203 - DNA, 18 bp, Homo sapiens
ctgttctagagtgacagg

SEQ ID NO: 6165204 - DNA, 22 bp, Homo sapiens
ctgttctagcacttcatctggc

SEQ ID NO: 6165205 - DNA, 19 bp, Homo sapiens
ctgttctagttttttactt

SEQ ID NO: 6165206 - DNA, 20 bp, Homo sapiens
ctgttctatggaccaaatgt

SEQ ID NO: 6165207 - DNA, 21 bp, Homo sapiens
ctgttctatggaccaaatgta

SEQ ID NO: 6165208 - DNA, 22 bp, Homo sapiens
ctgttctatggaccaaatgtaa

SEQ ID NO: 6165209 - DNA, 15 bp, Homo sapiens
ctgttctcaaatgct

SEQ ID NO: 6165210 - DNA, 22 bp, Homo sapiens
ctgttctcaccttaactcagcc

SEQ ID NO: 6165211 - DNA, 16 bp, Homo sapiens
ctgttctcagcgtttt

SEQ ID NO: 6165212 - DNA, 15 bp, Homo sapiens
ctgttctcagctccg

SEQ ID NO: 6165213 - DNA, 15 bp, Homo sapiens
ctgttctcattcctg

SEQ ID NO: 6165214 - DNA, 16 bp, Homo sapiens
ctgttctcattcctgt

SEQ ID NO: 6165215 - DNA, 12 bp, Homo sapiens
ctgttctccaga

SEQ ID NO: 6165216 - DNA, 12 bp, Homo sapiens
ctgttctcctgt

SEQ ID NO: 6165217 - DNA, 15 bp, Homo sapiens
ctgttctcgttgccc

SEQ ID NO: 6165218 - DNA, 18 bp, Homo sapiens
ctgttctcgttgccctaa

SEQ ID NO: 6165219 - DNA, 23 bp, Homo sapiens
ctgttctcgttgccctaattcat

SEQ ID NO: 6165220 - DNA, 12 bp, Homo sapiens
ctgttctctccc

SEQ ID NO: 6165221 - DNA, 15 bp, Homo sapiens
ctgttctctcccctc

SEQ ID NO: 6165222 - DNA, 17 bp, Homo sapiens
ctgttctctcccctcac

SEQ ID NO: 6165223 - DNA, 11 bp, Homo sapiens
ctgttctctgc

SEQ ID NO: 6165224 - DNA, 15 bp, Homo sapiens
ctgttctctgctttt

SEQ ID NO: 6165225 - DNA, 13 bp, Homo sapiens
ctgttctcttgct

SEQ ID NO: 6165226 - DNA, 14 bp, Homo sapiens
ctgttctcttgctt

SEQ ID NO: 6165227 - DNA, 14 bp, Homo sapiens
ctgttctctttgct

SEQ ID NO: 6165228 - DNA, 15 bp, Homo sapiens
ctgttctctttgctg

SEQ ID NO: 6165229 - DNA, 12 bp, Homo sapiens
ctgttctgaaat

SEQ ID NO: 6165230 - DNA, 14 bp, Homo sapiens
ctgttctgaaatta

SEQ ID NO: 6165231 - DNA, 15 bp, Homo sapiens
ctgttctgagaaggt

SEQ ID NO: 6165232 - DNA, 22 bp, Homo sapiens
ctgttctgatcggccagttttc

SEQ ID NO: 6165233 - DNA, 17 bp, Homo sapiens
ctgttctgcactgaaaa

SEQ ID NO: 6165234 - DNA, 18 bp, Homo sapiens
ctgttctgcactgaaaag

SEQ ID NO: 6165235 - DNA, 14 bp, Homo sapiens
ctgttctgcagtgg

SEQ ID NO: 6165236 - DNA, 21 bp, Homo sapiens
ctgttctgcgctgtgtacaat

SEQ ID NO: 6165237 - DNA, 14 bp, Homo sapiens
ctgttctgctccca

SEQ ID NO: 6165238 - DNA, 19 bp, Homo sapiens
ctgttctggagctgctgtt

SEQ ID NO: 6165239 - DNA, 16 bp, Homo sapiens
ctgttctggcctcaga

SEQ ID NO: 6165240 - DNA, 18 bp, Homo sapiens
ctgttctgggactccagg

SEQ ID NO: 6165241 - DNA, 13 bp, Homo sapiens
ctgttctggggga

SEQ ID NO: 6165242 - DNA, 24 bp, Homo sapiens
ctgttctggtatttcccctgtcag

SEQ ID NO: 6165243 - DNA, 16 bp, Homo sapiens
ctgttctggtggcccc

SEQ ID NO: 6165244 - DNA, 22 bp, Homo sapiens
ctgttctggtttttaaccattg

SEQ ID NO: 6165245 - DNA, 22 bp, Homo sapiens
ctgttctgtagcttatctgccc

SEQ ID NO: 6165246 - DNA, 23 bp, Homo sapiens
ctgttctgtagcttatctgcccc

SEQ ID NO: 6165247 - DNA, 20 bp, Homo sapiens
ctgttctgtggaaagtgtaa

SEQ ID NO: 6165248 - DNA, 22 bp, Homo sapiens
ctgttctgtggaaagtgtaaag

SEQ ID NO: 6165249 - DNA, 20 bp, Homo sapiens
ctgttctgtggttcctctgc

SEQ ID NO: 6165250 - DNA, 11 bp, Homo sapiens
ctgttctgtgt

SEQ ID NO: 6165251 - DNA, 15 bp, Homo sapiens
ctgttctgtgtacat

SEQ ID NO: 6165252 - DNA, 12 bp, Homo sapiens
ctgttctgtgtc

SEQ ID NO: 6165253 - DNA, 14 bp, Homo sapiens
ctgttctgtgtggg

SEQ ID NO: 6165254 - DNA, 22 bp, Homo sapiens
ctgttctgtgtgggtctgggga

SEQ ID NO: 6165255 - DNA, 23 bp, Homo sapiens
ctgttctgtgtgggtctggggag

SEQ ID NO: 6165256 - DNA, 15 bp, Homo sapiens
ctgttctgtgttgca

SEQ ID NO: 6165257 - DNA, 16 bp, Homo sapiens
ctgttctgtttcctgt

SEQ ID NO: 6165258 - DNA, 23 bp, Homo sapiens
ctgttctgtttggcacttgtatt

SEQ ID NO: 6165259 - DNA, 14 bp, Homo sapiens
ctgttcttacaaat

SEQ ID NO: 6165260 - DNA, 15 bp, Homo sapiens
ctgttcttacaaatg

SEQ ID NO: 6165261 - DNA, 17 bp, Homo sapiens
ctgttcttagctcaatg

SEQ ID NO: 6165262 - DNA, 20 bp, Homo sapiens
ctgttcttcaactcctgggc

SEQ ID NO: 6165263 - DNA, 14 bp, Homo sapiens
ctgttcttcacttc

SEQ ID NO: 6165264 - DNA, 16 bp, Homo sapiens
ctgttcttcatttcta

SEQ ID NO: 6165265 - DNA, 12 bp, Homo sapiens
ctgttcttcctc

SEQ ID NO: 6165266 - DNA, 16 bp, Homo sapiens
ctgttcttcctcagcc

SEQ ID NO: 6165267 - DNA, 23 bp, Homo sapiens
ctgttcttcctcagccagcctcg

SEQ ID NO: 6165268 - DNA, 13 bp, Homo sapiens
ctgttcttcctcc

SEQ ID NO: 6165269 - DNA, 22 bp, Homo sapiens
ctgttcttcctccagctgcacc

SEQ ID NO: 6165270 - DNA, 23 bp, Homo sapiens
ctgttcttcctccagctgcacca

SEQ ID NO: 6165271 - DNA, 13 bp, Homo sapiens
ctgttcttcctgg

SEQ ID NO: 6165272 - DNA, 14 bp, Homo sapiens
ctgttcttccttcc

SEQ ID NO: 6165273 - DNA, 15 bp, Homo sapiens
ctgttcttccttcct

SEQ ID NO: 6165274 - DNA, 18 bp, Homo sapiens
ctgttcttccttcctaga

SEQ ID NO: 6165275 - DNA, 15 bp, Homo sapiens
ctgttcttgacaatc

SEQ ID NO: 6165276 - DNA, 16 bp, Homo sapiens
ctgttcttgacaatca

SEQ ID NO: 6165277 - DNA, 19 bp, Homo sapiens
ctgttcttgaggtctcttt

SEQ ID NO: 6165278 - DNA, 19 bp, Homo sapiens
ctgttcttgctgctagaac

SEQ ID NO: 6165279 - DNA, 13 bp, Homo sapiens
ctgttctttaatt

SEQ ID NO: 6165280 - DNA, 15 bp, Homo sapiens
ctgttctttccaaag

SEQ ID NO: 6165281 - DNA, 14 bp, Homo sapiens
ctgttctttctggc

SEQ ID NO: 6165282 - DNA, 21 bp, Homo sapiens
ctgttctttctggctatgcat

SEQ ID NO: 6165283 - DNA, 23 bp, Homo sapiens
ctgttctttctggctatgcattt

SEQ ID NO: 6165284 - DNA, 16 bp, Homo sapiens
ctgttctttgcagtga

SEQ ID NO: 6165285 - DNA, 18 bp, Homo sapiens
ctgttctttgcagtgaag

SEQ ID NO: 6165286 - DNA, 13 bp, Homo sapiens
ctgttctttttga

SEQ ID NO: 6165287 - DNA, 15 bp, Homo sapiens
ctgttcttttttgta

SEQ ID NO: 6165288 - DNA, 20 bp, Homo sapiens
ctgttgaaaagcacacacaa

SEQ ID NO: 6165289 - DNA, 21 bp, Homo sapiens
ctgttgaaacttacactgttt

SEQ ID NO: 6165290 - DNA, 14 bp, Homo sapiens
ctgttgaaagcaaa

SEQ ID NO: 6165291 - DNA, 17 bp, Homo sapiens
ctgttgaaagcaaaaat

SEQ ID NO: 6165292 - DNA, 15 bp, Homo sapiens
ctgttgaagattaac

SEQ ID NO: 6165293 - DNA, 22 bp, Homo sapiens
ctgttgaagatttgaggacttg

SEQ ID NO: 6165294 - DNA, 23 bp, Homo sapiens
ctgttgaaggtgccattttaaat

SEQ ID NO: 6165295 - DNA, 16 bp, Homo sapiens
ctgttgaagtgcatgt

SEQ ID NO: 6165296 - DNA, 19 bp, Homo sapiens
ctgttgaagtgcatgttaa

SEQ ID NO: 6165297 - DNA, 20 bp, Homo sapiens
ctgagtggctcgtgtttcac

SEQ ID NO: 6165298 - DNA, 15 bp, Homo sapiens
ctgagtggcttcact

SEQ ID NO: 6165299 - DNA, 21 bp, Homo sapiens
ctgagtggcttcactcctgct

SEQ ID NO: 6165300 - DNA, 23 bp, Homo sapiens
ctgagtggcttcactcctgctgt

SEQ ID NO: 6165301 - DNA, 17 bp, Homo sapiens
ctgagtggggcttcctg

SEQ ID NO: 6165302 - DNA, 21 bp, Homo sapiens
ctgagtggggcttcctgggca

SEQ ID NO: 6165303 - DNA, 13 bp, Homo sapiens
ctgagtggtcact

SEQ ID NO: 6165304 - DNA, 20 bp, Homo sapiens
ctgagtggtcactggtcagg

SEQ ID NO: 6165305 - DNA, 23 bp, Homo sapiens
ctgagtggtcactggtcagggca

SEQ ID NO: 6165306 - DNA, 22 bp, Homo sapiens
ctgagtggtgaggggccactgg

SEQ ID NO: 6165307 - DNA, 14 bp, Homo sapiens
ctgagtggtggttc

SEQ ID NO: 6165308 - DNA, 16 bp, Homo sapiens
ctgagtggtggttcct

SEQ ID NO: 6165309 - DNA, 19 bp, Homo sapiens
ctgagtggtggttcctttg

SEQ ID NO: 6165310 - DNA, 14 bp, Homo sapiens
ctgagtggtgtttt

SEQ ID NO: 6165311 - DNA, 15 bp, Homo sapiens
ctgagtggtgttttt

SEQ ID NO: 6165312 - DNA, 14 bp, Homo sapiens
ctgagtgtatttta

SEQ ID NO: 6165313 - DNA, 16 bp, Homo sapiens
ctgagtgtattttact

SEQ ID NO: 6165314 - DNA, 16 bp, Homo sapiens
ctgagtgtcccaagcc

SEQ ID NO: 6165315 - DNA, 18 bp, Homo sapiens
ctgagtgtctctgcctgg

SEQ ID NO: 6165316 - DNA, 18 bp, Homo sapiens
ctgagtgtgggcttctga

SEQ ID NO: 6165317 - DNA, 16 bp, Homo sapiens
ctgagtgttctgggat

SEQ ID NO: 6165318 - DNA, 18 bp, Homo sapiens
ctgagttacttgtctgag

SEQ ID NO: 6165319 - DNA, 15 bp, Homo sapiens
ctgagttagctgttt

SEQ ID NO: 6165320 - DNA, 23 bp, Homo sapiens
ctgagttagctgtttactgacat

SEQ ID NO: 6165321 - DNA, 17 bp, Homo sapiens
ctgagttatcaggtgca

SEQ ID NO: 6165322 - DNA, 18 bp, Homo sapiens
ctgagttatcaggtgcag

SEQ ID NO: 6165323 - DNA, 13 bp, Homo sapiens
ctgagttatgatg

SEQ ID NO: 6165324 - DNA, 19 bp, Homo sapiens
ctgagttcccaaagggagg

SEQ ID NO: 6165325 - DNA, 20 bp, Homo sapiens
ctgagttcccaaagggaggg

SEQ ID NO: 6165326 - DNA, 23 bp, Homo sapiens
ctgagttcccgggagctgggccc

SEQ ID NO: 6165327 - DNA, 17 bp, Homo sapiens
ctgagttcctagccacc

SEQ ID NO: 6165328 - DNA, 18 bp, Homo sapiens
ctgagttcctagccaccg

SEQ ID NO: 6165329 - DNA, 13 bp, Homo sapiens
ctgagttcctgag

SEQ ID NO: 6165330 - DNA, 20 bp, Homo sapiens
ctgagttcctggaatggcac

SEQ ID NO: 6165331 - DNA, 15 bp, Homo sapiens
ctgagttctcatcca

SEQ ID NO: 6165332 - DNA, 23 bp, Homo sapiens
ctgagttctgggtttctagaggt

SEQ ID NO: 6165333 - DNA, 14 bp, Homo sapiens
ctgagttctggttc

SEQ ID NO: 6165334 - DNA, 21 bp, Homo sapiens
ctgagttcttgtgtcctggta

SEQ ID NO: 6165335 - DNA, 17 bp, Homo sapiens
ctgagttgaagagggga

SEQ ID NO: 6165336 - DNA, 14 bp, Homo sapiens
ctgagttgcacata

SEQ ID NO: 6165337 - DNA, 22 bp, Homo sapiens
ctgagttgcaccattctttctt

SEQ ID NO: 6165338 - DNA, 11 bp, Homo sapiens
ctgagttgcca

SEQ ID NO: 6165339 - DNA, 23 bp, Homo sapiens
ctgagttgcttcttcttgtggag

SEQ ID NO: 6165340 - DNA, 15 bp, Homo sapiens
ctgagttggagctca

SEQ ID NO: 6165341 - DNA, 22 bp, Homo sapiens
ctgagttggcagaccgggcccc

SEQ ID NO: 6165342 - DNA, 19 bp, Homo sapiens
ctgagttggcatcacctgc

SEQ ID NO: 6165343 - DNA, 18 bp, Homo sapiens
ctgagttggcctggccat

SEQ ID NO: 6165344 - DNA, 23 bp, Homo sapiens
ctgagttggcctggccatttcca

SEQ ID NO: 6165345 - DNA, 21 bp, Homo sapiens
ctgagttggcgttgtgggcag

SEQ ID NO: 6165346 - DNA, 23 bp, Homo sapiens
ctgagttggcgttgtgggcaggc

SEQ ID NO: 6165347 - DNA, 22 bp, Homo sapiens
ctgagttgggcaaaacccagga

SEQ ID NO: 6165348 - DNA, 18 bp, Homo sapiens
ctgagttgggcagccagg

SEQ ID NO: 6165349 - DNA, 19 bp, Homo sapiens
ctgagttgggcagccagga

SEQ ID NO: 6165350 - DNA, 13 bp, Homo sapiens
ctgagttgtataa

SEQ ID NO: 6165351 - DNA, 17 bp, Homo sapiens
ctgagttgtataaaagt

SEQ ID NO: 6165352 - DNA, 16 bp, Homo sapiens
ctgagttgttacccca

SEQ ID NO: 6165353 - DNA, 17 bp, Homo sapiens
ctgagttgttaccccaa

SEQ ID NO: 6165354 - DNA, 13 bp, Homo sapiens
ctgagttgttcta

SEQ ID NO: 6165355 - DNA, 15 bp, Homo sapiens
ctgagttgttctaac

SEQ ID NO: 6165356 - DNA, 19 bp, Homo sapiens
ctgagtttaccatttgtaa

SEQ ID NO: 6165357 - DNA, 18 bp, Homo sapiens
ctgagtttatattctgaa

SEQ ID NO: 6165358 - DNA, 20 bp, Homo sapiens
ctgagtttatattctgaaag

SEQ ID NO: 6165359 - DNA, 22 bp, Homo sapiens
ctgagtttatattctgaaagga

SEQ ID NO: 6165360 - DNA, 17 bp, Homo sapiens
ctgagtttcattctcct

SEQ ID NO: 6165361 - DNA, 19 bp, Homo sapiens
ctgagtttcattctcctgc

SEQ ID NO: 6165362 - DNA, 16 bp, Homo sapiens
ctgagtttccagcctg

SEQ ID NO: 6165363 - DNA, 22 bp, Homo sapiens
ctgagtttgaacacagatcatt

SEQ ID NO: 6165364 - DNA, 18 bp, Homo sapiens
ctgagtttgtgctggtgt

SEQ ID NO: 6165365 - DNA, 23 bp, Homo sapiens
ctgagttttacaccatactgtta

SEQ ID NO: 6165366 - DNA, 13 bp, Homo sapiens
ctgagttttacca

SEQ ID NO: 6165367 - DNA, 19 bp, Homo sapiens
ctgagttttagttggtctt

SEQ ID NO: 6165368 - DNA, 23 bp, Homo sapiens
ctgagttttagttggtctttcca

SEQ ID NO: 6165369 - DNA, 16 bp, Homo sapiens
ctgagttttccatggc

SEQ ID NO: 6165370 - DNA, 20 bp, Homo sapiens
ctgagttttccatggcagga

SEQ ID NO: 6165371 - DNA, 17 bp, Homo sapiens
ctgagttttgtgtttgt

SEQ ID NO: 6165372 - DNA, 19 bp, Homo sapiens
ctgagttttgtttcacttt

SEQ ID NO: 6165373 - DNA, 12 bp, Homo sapiens
ctgataaaatac

SEQ ID NO: 6165374 - DNA, 21 bp, Homo sapiens
ctgataaacctaatattcaat

SEQ ID NO: 6165375 - DNA, 15 bp, Homo sapiens
ctgataaagaaacct

SEQ ID NO: 6165376 - DNA, 17 bp, Homo sapiens
ctgataaagaaaccttt

SEQ ID NO: 6165377 - DNA, 16 bp, Homo sapiens
ctgataaagcacagct

SEQ ID NO: 6165378 - DNA, 17 bp, Homo sapiens
ctgataaagttccttaa

SEQ ID NO: 6165379 - DNA, 22 bp, Homo sapiens
ctgataaattaacctctcacag

SEQ ID NO: 6165380 - DNA, 18 bp, Homo sapiens
ctgataactagatggtgc

SEQ ID NO: 6165381 - DNA, 21 bp, Homo sapiens
ctgataactagatggtgctga

SEQ ID NO: 6165382 - DNA, 23 bp, Homo sapiens
ctgataactagatggtgctgaga

SEQ ID NO: 6165383 - DNA, 24 bp, Homo sapiens
ctgataactagatggtgctgagaa

SEQ ID NO: 6165384 - DNA, 18 bp, Homo sapiens
ctgataacttggggaggc

SEQ ID NO: 6165385 - DNA, 21 bp, Homo sapiens
ctgataagactgtttttaagt

SEQ ID NO: 6165386 - DNA, 14 bp, Homo sapiens
ctgataagcttcaa

SEQ ID NO: 6165387 - DNA, 21 bp, Homo sapiens
ctgataagcttcctagaaagt

SEQ ID NO: 6165388 - DNA, 15 bp, Homo sapiens
ctgataagggagagg

SEQ ID NO: 6165389 - DNA, 17 bp, Homo sapiens
ctgataataaaggaact

SEQ ID NO: 6165390 - DNA, 14 bp, Homo sapiens
ctgataataaatgt

SEQ ID NO: 6165391 - DNA, 14 bp, Homo sapiens
ctgataatgtattg

SEQ ID NO: 6165392 - DNA, 15 bp, Homo sapiens
ctgataattccagtg

SEQ ID NO: 6165393 - DNA, 19 bp, Homo sapiens
ctgataatttattgtcttt

SEQ ID NO: 6165394 - DNA, 13 bp, Homo sapiens
ctgataattttac

SEQ ID NO: 6165395 - DNA, 14 bp, Homo sapiens
ctgataattttaca

SEQ ID NO: 6165396 - DNA, 12 bp, Homo sapiens
ctgatacacagt

SEQ ID NO: 6165397 - DNA, 19 bp, Homo sapiens
ctgatacacagtaattgtg

SEQ ID NO: 6165398 - DNA, 14 bp, Homo sapiens
ctgatacagcctta

SEQ ID NO: 6165399 - DNA, 21 bp, Homo sapiens
ctgatacagccttacaataca

SEQ ID NO: 6165400 - DNA, 18 bp, Homo sapiens
ctgatacataactaaatt

SEQ ID NO: 6165401 - DNA, 15 bp, Homo sapiens
ctgatacatttacat

SEQ ID NO: 6165402 - DNA, 18 bp, Homo sapiens
ctgataccatatgaatga

SEQ ID NO: 6165403 - DNA, 23 bp, Homo sapiens
ctgataccattctattctccaga

SEQ ID NO: 6165404 - DNA, 18 bp, Homo sapiens
ctgatactattcaatgca

SEQ ID NO: 6165405 - DNA, 16 bp, Homo sapiens
ctgatactgggtctgc

SEQ ID NO: 6165406 - DNA, 16 bp, Homo sapiens
ctgatagactttgtga

SEQ ID NO: 6165407 - DNA, 16 bp, Homo sapiens
ctgatagagtgatttt

SEQ ID NO: 6165408 - DNA, 17 bp, Homo sapiens
ctgatagagtgattttg

SEQ ID NO: 6165409 - DNA, 23 bp, Homo sapiens
ctgatagagtttaacagatattt

SEQ ID NO: 6165410 - DNA, 17 bp, Homo sapiens
ctgatagcccctctccc

SEQ ID NO: 6165411 - DNA, 21 bp, Homo sapiens
ctgatagctacccacagagca

SEQ ID NO: 6165412 - DNA, 22 bp, Homo sapiens
ctgatagctgtttcaaatgtgc

SEQ ID NO: 6165413 - DNA, 21 bp, Homo sapiens
ctgatagcttacactgaggac

SEQ ID NO: 6165414 - DNA, 17 bp, Homo sapiens
ctgataggccaagtttg

SEQ ID NO: 6165415 - DNA, 19 bp, Homo sapiens
ctgatagggatacatgctc

SEQ ID NO: 6165416 - DNA, 20 bp, Homo sapiens
ctgatagtagtaaaattaga

SEQ ID NO: 6165417 - DNA, 22 bp, Homo sapiens
ctgatagtagtaaaattagaaa

SEQ ID NO: 6165418 - DNA, 20 bp, Homo sapiens
ctgatagtagtctttaaaag

SEQ ID NO: 6165419 - DNA, 17 bp, Homo sapiens
ctgatagtcacctgctg

SEQ ID NO: 6165420 - DNA, 21 bp, Homo sapiens
ctgatagtcacctgctggttg

SEQ ID NO: 6165421 - DNA, 23 bp, Homo sapiens
ctgatagtcctttttccaatgtt

SEQ ID NO: 6165422 - DNA, 13 bp, Homo sapiens
ctgatagtgtttc

SEQ ID NO: 6165423 - DNA, 21 bp, Homo sapiens
ctgatagtgtttcgttaagca

SEQ ID NO: 6165424 - DNA, 23 bp, Homo sapiens
ctgatagtgtttcgttaagcagt

SEQ ID NO: 6165425 - DNA, 16 bp, Homo sapiens
ctgatagttactgttg

SEQ ID NO: 6165426 - DNA, 17 bp, Homo sapiens
ctgatataaattctgtg

SEQ ID NO: 6165427 - DNA, 21 bp, Homo sapiens
ctgatatacttgagtgtgcaa

SEQ ID NO: 6165428 - DNA, 12 bp, Homo sapiens
ctgatatagaat

SEQ ID NO: 6165429 - DNA, 15 bp, Homo sapiens
ctgatatagaattgc

SEQ ID NO: 6165430 - DNA, 18 bp, Homo sapiens
ctgatatattttacaatt

SEQ ID NO: 6165431 - DNA, 18 bp, Homo sapiens
ctgatatcaacagcttcc

SEQ ID NO: 6165432 - DNA, 20 bp, Homo sapiens
ctgatatcacgggcccgctc

SEQ ID NO: 6165433 - DNA, 14 bp, Homo sapiens
ctgatatcagcact

SEQ ID NO: 6165434 - DNA, 20 bp, Homo sapiens
ctgatatctgtttgcttcta

SEQ ID NO: 6165435 - DNA, 18 bp, Homo sapiens
ctgatatgatttaaaaca

SEQ ID NO: 6165436 - DNA, 18 bp, Homo sapiens
ctgatattaaagatttct

SEQ ID NO: 6165437 - DNA, 12 bp, Homo sapiens
ctgatattaatc

SEQ ID NO: 6165438 - DNA, 15 bp, Homo sapiens
ctgatattaatcaaa

SEQ ID NO: 6165439 - DNA, 19 bp, Homo sapiens
ctgatattatggcaagtga

SEQ ID NO: 6165440 - DNA, 20 bp, Homo sapiens
ctgatattatttcttctctt

SEQ ID NO: 6165441 - DNA, 21 bp, Homo sapiens
ctgatattatttcttctctta

SEQ ID NO: 6165442 - DNA, 20 bp, Homo sapiens
ctgatattcagaattatgat

SEQ ID NO: 6165443 - DNA, 19 bp, Homo sapiens
ctgatattccatgaatgta

SEQ ID NO: 6165444 - DNA, 22 bp, Homo sapiens
ctgatattgccgcactagggga

SEQ ID NO: 6165445 - DNA, 20 bp, Homo sapiens
ctgatattggtgtgaatgct

SEQ ID NO: 6165446 - DNA, 21 bp, Homo sapiens
ctgatatttgctggagtgctg

SEQ ID NO: 6165447 - DNA, 23 bp, Homo sapiens
ctgatattttacctcttattgca

SEQ ID NO: 6165448 - DNA, 15 bp, Homo sapiens
ctgatattttctcta

SEQ ID NO: 6165449 - DNA, 18 bp, Homo sapiens
ctgatattttctctagga

SEQ ID NO: 6165450 - DNA, 14 bp, Homo sapiens
ctgatcaaaaataa

SEQ ID NO: 6165451 - DNA, 17 bp, Homo sapiens
ctgatcaaaaataaact

SEQ ID NO: 6165452 - DNA, 23 bp, Homo sapiens
ctgatcaaaaataaactagtttc

SEQ ID NO: 6165453 - DNA, 18 bp, Homo sapiens
ctgatcaaagcaccttga

SEQ ID NO: 6165454 - DNA, 22 bp, Homo sapiens
ctgatcaaattggctacaatct

SEQ ID NO: 6165455 - DNA, 22 bp, Homo sapiens
ctgatcaagagtccggatttct

SEQ ID NO: 6165456 - DNA, 17 bp, Homo sapiens
ctgatcaagcttcagac

SEQ ID NO: 6165457 - DNA, 14 bp, Homo sapiens
ctgatcaaggtgct

SEQ ID NO: 6165458 - DNA, 16 bp, Homo sapiens
ctgatcaaggtgctct

SEQ ID NO: 6165459 - DNA, 22 bp, Homo sapiens
ctgatcaaggtgctcttctcat

SEQ ID NO: 6165460 - DNA, 15 bp, Homo sapiens
ctgatcaatgacaga

SEQ ID NO: 6165461 - DNA, 17 bp, Homo sapiens
ctgatcaatgacagagc

SEQ ID NO: 6165462 - DNA, 15 bp, Homo sapiens
ctgatcacccaatgc

SEQ ID NO: 6165463 - DNA, 21 bp, Homo sapiens
ctgatcacccaatgcatcacg

SEQ ID NO: 6165464 - DNA, 18 bp, Homo sapiens
ctgatcacccccctgctt

SEQ ID NO: 6165465 - DNA, 17 bp, Homo sapiens
ctgatcactcccagcac

SEQ ID NO: 6165466 - DNA, 18 bp, Homo sapiens
ctgatcactcccagcact

SEQ ID NO: 6165467 - DNA, 20 bp, Homo sapiens
ctgatcactcccagcactcc

SEQ ID NO: 6165468 - DNA, 15 bp, Homo sapiens
ctgatcactgaaata

SEQ ID NO: 6165469 - DNA, 19 bp, Homo sapiens
ctgatcagaaaccaaccat

SEQ ID NO: 6165470 - DNA, 16 bp, Homo sapiens
ctgatcagaacaaatg

SEQ ID NO: 6165471 - DNA, 20 bp, Homo sapiens
ctgatcagagccgtggtcct

SEQ ID NO: 6165472 - DNA, 13 bp, Homo sapiens
ctgatcagaggca

SEQ ID NO: 6165473 - DNA, 18 bp, Homo sapiens
ctgttgaatcaaagtgat

SEQ ID NO: 6165474 - DNA, 19 bp, Homo sapiens
ctgttgaatcaaagtgatt

SEQ ID NO: 6165475 - DNA, 16 bp, Homo sapiens
ctgttgaatcacagta

SEQ ID NO: 6165476 - DNA, 21 bp, Homo sapiens
ctgttgaattatgttttgaca

SEQ ID NO: 6165477 - DNA, 20 bp, Homo sapiens
ctgttgaattggtgaataaa

SEQ ID NO: 6165478 - DNA, 21 bp, Homo sapiens
ctgttgaattggtgaataaaa

SEQ ID NO: 6165479 - DNA, 23 bp, Homo sapiens
ctgttgacaatttgccatagcag

SEQ ID NO: 6165480 - DNA, 22 bp, Homo sapiens
ctgttgacacaggtctttccta

SEQ ID NO: 6165481 - DNA, 16 bp, Homo sapiens
ctgttgacatatttaa

SEQ ID NO: 6165482 - DNA, 20 bp, Homo sapiens
ctgttgacatccaagcttcc

SEQ ID NO: 6165483 - DNA, 16 bp, Homo sapiens
ctgttgaccaggctgg

SEQ ID NO: 6165484 - DNA, 20 bp, Homo sapiens
ctgttgaccaggctggagtg

SEQ ID NO: 6165485 - DNA, 19 bp, Homo sapiens
ctgttgacctaccctggac

SEQ ID NO: 6165486 - DNA, 13 bp, Homo sapiens
ctgttgacctgcc

SEQ ID NO: 6165487 - DNA, 14 bp, Homo sapiens
ctgttgacctgccc

SEQ ID NO: 6165488 - DNA, 16 bp, Homo sapiens
ctgttgacctgcccga

SEQ ID NO: 6165489 - DNA, 14 bp, Homo sapiens
ctgttgacctgtgc

SEQ ID NO: 6165490 - DNA, 22 bp, Homo sapiens
ctgttgacgttgatctcctggt

SEQ ID NO: 6165491 - DNA, 22 bp, Homo sapiens
ctgttgactctagtactgtgaa

SEQ ID NO: 6165492 - DNA, 18 bp, Homo sapiens
ctgttgactcttccattc

SEQ ID NO: 6165493 - DNA, 15 bp, Homo sapiens
ctgttgactggctgt

SEQ ID NO: 6165494 - DNA, 11 bp, Homo sapiens
ctgttgagaaa

SEQ ID NO: 6165495 - DNA, 20 bp, Homo sapiens
ctgttgagaaaaaagaccct

SEQ ID NO: 6165496 - DNA, 15 bp, Homo sapiens
ctgttgagaaaacga

SEQ ID NO: 6165497 - DNA, 13 bp, Homo sapiens
ctgttgagatgcc

SEQ ID NO: 6165498 - DNA, 15 bp, Homo sapiens
ctgttgagatgtgct

SEQ ID NO: 6165499 - DNA, 21 bp, Homo sapiens
ctgttgagatgtgctttgctg

SEQ ID NO: 6165500 - DNA, 15 bp, Homo sapiens
ctgttgagccccagt

SEQ ID NO: 6165501 - DNA, 18 bp, Homo sapiens
ctgttgagccccagtgct

SEQ ID NO: 6165502 - DNA, 15 bp, Homo sapiens
ctgttgagctgtttt

SEQ ID NO: 6165503 - DNA, 11 bp, Homo sapiens
ctgttgaggca

SEQ ID NO: 6165504 - DNA, 19 bp, Homo sapiens
ctgttgagggccacttttt

SEQ ID NO: 6165505 - DNA, 22 bp, Homo sapiens
ctgttgaggggtcccctctgga

SEQ ID NO: 6165506 - DNA, 14 bp, Homo sapiens
ctgttgataaaaac

SEQ ID NO: 6165507 - DNA, 15 bp, Homo sapiens
ctgttgataaaaact

SEQ ID NO: 6165508 - DNA, 18 bp, Homo sapiens
ctgttgataattcttatt

SEQ ID NO: 6165509 - DNA, 13 bp, Homo sapiens
ctgttgatacaaa

SEQ ID NO: 6165510 - DNA, 21 bp, Homo sapiens
ctgttgatcccacttcactgt

SEQ ID NO: 6165511 - DNA, 22 bp, Homo sapiens
ctgttgatcccacttcactgtg

SEQ ID NO: 6165512 - DNA, 15 bp, Homo sapiens
ctgttgatcccctct

SEQ ID NO: 6165513 - DNA, 18 bp, Homo sapiens
ctgttgatcccctctctg

SEQ ID NO: 6165514 - DNA, 22 bp, Homo sapiens
ctgttgatcccctctctgtggc

SEQ ID NO: 6165515 - DNA, 18 bp, Homo sapiens
ctgttgatctatgggaaa

SEQ ID NO: 6165516 - DNA, 14 bp, Homo sapiens
ctgttgatctttca

SEQ ID NO: 6165517 - DNA, 17 bp, Homo sapiens
ctgttgatctttcacta

SEQ ID NO: 6165518 - DNA, 19 bp, Homo sapiens
ctgttgatgaagtatactt

SEQ ID NO: 6165519 - DNA, 20 bp, Homo sapiens
ctgttgatgaagtatacttt

SEQ ID NO: 6165520 - DNA, 15 bp, Homo sapiens
ctgttgatgggaaaa

SEQ ID NO: 6165521 - DNA, 15 bp, Homo sapiens
ctgttgattccactg

SEQ ID NO: 6165522 - DNA, 15 bp, Homo sapiens
ctgttgattgctaaa

SEQ ID NO: 6165523 - DNA, 22 bp, Homo sapiens
ctgttgattgctaaatgtaaca

SEQ ID NO: 6165524 - DNA, 23 bp, Homo sapiens
ctgttgattgctaaatgtaacag

SEQ ID NO: 6165525 - DNA, 19 bp, Homo sapiens
ctgttgcaaactcagcctc

SEQ ID NO: 6165526 - DNA, 14 bp, Homo sapiens
ctgttgcacagcca

SEQ ID NO: 6165527 - DNA, 13 bp, Homo sapiens
ctgttgcacccag

SEQ ID NO: 6165528 - DNA, 12 bp, Homo sapiens
ctgttgcacttt

SEQ ID NO: 6165529 - DNA, 14 bp, Homo sapiens
ctgttgcaggcaaa

SEQ ID NO: 6165530 - DNA, 15 bp, Homo sapiens
ctgttgcagtggcct

SEQ ID NO: 6165531 - DNA, 21 bp, Homo sapiens
ctgttgcagtggcctggccgt

SEQ ID NO: 6165532 - DNA, 15 bp, Homo sapiens
ctgttgcatttactt

SEQ ID NO: 6165533 - DNA, 17 bp, Homo sapiens
ctgttgcatttactttt

SEQ ID NO: 6165534 - DNA, 19 bp, Homo sapiens
ctgttgcatttacttttaa

SEQ ID NO: 6165535 - DNA, 20 bp, Homo sapiens
ctgttgccaccatgtattca

SEQ ID NO: 6165536 - DNA, 14 bp, Homo sapiens
ctgttgccagactg

SEQ ID NO: 6165537 - DNA, 18 bp, Homo sapiens
ctgttgccagtcagcaac

SEQ ID NO: 6165538 - DNA, 18 bp, Homo sapiens
ctgttgccatagccccat

SEQ ID NO: 6165539 - DNA, 14 bp, Homo sapiens
ctgttgccatggat

SEQ ID NO: 6165540 - DNA, 15 bp, Homo sapiens
ctgttgcccacgttt

SEQ ID NO: 6165541 - DNA, 14 bp, Homo sapiens
ctgttgcccaggct

SEQ ID NO: 6165542 - DNA, 15 bp, Homo sapiens
ctgttgcccaggctg

SEQ ID NO: 6165543 - DNA, 15 bp, Homo sapiens
ctgttgccccccagg

SEQ ID NO: 6165544 - DNA, 23 bp, Homo sapiens
ctgttgcccgccctccacccact

SEQ ID NO: 6165545 - DNA, 13 bp, Homo sapiens
ctgttgcccttct

SEQ ID NO: 6165546 - DNA, 14 bp, Homo sapiens
ctgttgcccttctg

SEQ ID NO: 6165547 - DNA, 18 bp, Homo sapiens
ctgttgcccttctgtcca

SEQ ID NO: 6165548 - DNA, 20 bp, Homo sapiens
ctgttgccctttctgtacca

SEQ ID NO: 6165549 - DNA, 17 bp, Homo sapiens
ctgttgccgagcccagc

SEQ ID NO: 6165550 - DNA, 12 bp, Homo sapiens
ctgttgcctcat

SEQ ID NO: 6165551 - DNA, 19 bp, Homo sapiens
ctgttgcctcctctctccc

SEQ ID NO: 6165552 - DNA, 22 bp, Homo sapiens
ctgttgcctcctctctccctgc

SEQ ID NO: 6165553 - DNA, 18 bp, Homo sapiens
ctgttgccttatttctca

SEQ ID NO: 6165554 - DNA, 15 bp, Homo sapiens
ctgttgccttttaaa

SEQ ID NO: 6165555 - DNA, 22 bp, Homo sapiens
ctgttgcctttttcattttcca

SEQ ID NO: 6165556 - DNA, 18 bp, Homo sapiens
ctgttgcgtaactggctg

SEQ ID NO: 6165557 - DNA, 17 bp, Homo sapiens
ctgttgctaacacacag

SEQ ID NO: 6165558 - DNA, 12 bp, Homo sapiens
ctgttgctacat

SEQ ID NO: 6165559 - DNA, 19 bp, Homo sapiens
ctgttgctacatcagagtg

SEQ ID NO: 6165560 - DNA, 19 bp, Homo sapiens
ctgttgctagggagaggga

SEQ ID NO: 6165561 - DNA, 23 bp, Homo sapiens
ctgttgctatttgtatttctctt

SEQ ID NO: 6165562 - DNA, 21 bp, Homo sapiens
ctgttgctcaaatctattcag

SEQ ID NO: 6165563 - DNA, 23 bp, Homo sapiens
ctgttgctccaggatgcattctg

SEQ ID NO: 6165564 - DNA, 16 bp, Homo sapiens
ctgttgctgaagtcat

SEQ ID NO: 6165565 - DNA, 15 bp, Homo sapiens
ctgttgctgaatagg

SEQ ID NO: 6165566 - DNA, 16 bp, Homo sapiens
ctgttgctgattttat

SEQ ID NO: 6165567 - DNA, 22 bp, Homo sapiens
ctgttgctgattttattcttga

SEQ ID NO: 6165568 - DNA, 16 bp, Homo sapiens
ctgttgctgcctcatg

SEQ ID NO: 6165569 - DNA, 17 bp, Homo sapiens
ctgttgctgcctcatgc

SEQ ID NO: 6165570 - DNA, 15 bp, Homo sapiens
ctgttgctggactga

SEQ ID NO: 6165571 - DNA, 16 bp, Homo sapiens
ctgttgctggaggggc

SEQ ID NO: 6165572 - DNA, 16 bp, Homo sapiens
ctgttgctgtcctcca

SEQ ID NO: 6165573 - DNA, 14 bp, Homo sapiens
ctgttgctgttgct

SEQ ID NO: 6165574 - DNA, 14 bp, Homo sapiens
ctgttgctttacag

SEQ ID NO: 6165575 - DNA, 18 bp, Homo sapiens
ctgttggaatgttgttaa

SEQ ID NO: 6165576 - DNA, 20 bp, Homo sapiens
ctgttggaatgttgttaaat

SEQ ID NO: 6165577 - DNA, 16 bp, Homo sapiens
ctgttggacagctgct

SEQ ID NO: 6165578 - DNA, 18 bp, Homo sapiens
ctgttggacccgctctgg

SEQ ID NO: 6165579 - DNA, 22 bp, Homo sapiens
ctgttggacccgctctggacca

SEQ ID NO: 6165580 - DNA, 16 bp, Homo sapiens
ctgttggagaaagaaa

SEQ ID NO: 6165581 - DNA, 14 bp, Homo sapiens
ctgttggagcaaac

SEQ ID NO: 6165582 - DNA, 22 bp, Homo sapiens
ctgttggaggtgagtggcctgt

SEQ ID NO: 6165583 - DNA, 19 bp, Homo sapiens
ctgttggattccatgctaa

SEQ ID NO: 6165584 - DNA, 19 bp, Homo sapiens
ctgttggatttgtttaaaa

SEQ ID NO: 6165585 - DNA, 21 bp, Homo sapiens
ctgttggcactcacagacctg

SEQ ID NO: 6165586 - DNA, 16 bp, Homo sapiens
ctgttggcaggctggc

SEQ ID NO: 6165587 - DNA, 18 bp, Homo sapiens
ctgttggcaggctggcca

SEQ ID NO: 6165588 - DNA, 19 bp, Homo sapiens
ctgttggcccctctgctgt

SEQ ID NO: 6165589 - DNA, 23 bp, Homo sapiens
ctgttggcccctctgctgtcctg

SEQ ID NO: 6165590 - DNA, 21 bp, Homo sapiens
ctgttggcctaagtgcctctt

SEQ ID NO: 6165591 - DNA, 23 bp, Homo sapiens
ctgttggcctaagtgcctcttct

SEQ ID NO: 6165592 - DNA, 19 bp, Homo sapiens
ctgttggcctcaagcaagg

SEQ ID NO: 6165593 - DNA, 12 bp, Homo sapiens
ctgttggcctcg

SEQ ID NO: 6165594 - DNA, 14 bp, Homo sapiens
ctgttggcctcgcc

SEQ ID NO: 6165595 - DNA, 17 bp, Homo sapiens
ctgttggcctcgcctgg

SEQ ID NO: 6165596 - DNA, 14 bp, Homo sapiens
ctgttggcctgtgg

SEQ ID NO: 6165597 - DNA, 20 bp, Homo sapiens
ctgttggcgtgtcccagcac

SEQ ID NO: 6165598 - DNA, 16 bp, Homo sapiens
ctgttggctctctgac

SEQ ID NO: 6165599 - DNA, 13 bp, Homo sapiens
ctgttggctgatt

SEQ ID NO: 6165600 - DNA, 20 bp, Homo sapiens
ctgttggctgattggaaaat

SEQ ID NO: 6165601 - DNA, 15 bp, Homo sapiens
ctgttggctgctgcc

SEQ ID NO: 6165602 - DNA, 18 bp, Homo sapiens
ctgttgggaacagcatgg

SEQ ID NO: 6165603 - DNA, 22 bp, Homo sapiens
ctgttgggacagccattttcca

SEQ ID NO: 6165604 - DNA, 17 bp, Homo sapiens
ctgttgggccaggagcc

SEQ ID NO: 6165605 - DNA, 14 bp, Homo sapiens
ctgttggggagggg

SEQ ID NO: 6165606 - DNA, 14 bp, Homo sapiens
ctgttgggggcttc

SEQ ID NO: 6165607 - DNA, 16 bp, Homo sapiens
ctgttggtaaagcaca

SEQ ID NO: 6165608 - DNA, 18 bp, Homo sapiens
ctgttggtccactgtgtt

SEQ ID NO: 6165609 - DNA, 22 bp, Homo sapiens
ctgttggtccactgtgtttagt

SEQ ID NO: 6165610 - DNA, 13 bp, Homo sapiens
ctgttggtctgcc

SEQ ID NO: 6165611 - DNA, 21 bp, Homo sapiens
ctgttggtctgccttctgctg

SEQ ID NO: 6165612 - DNA, 22 bp, Homo sapiens
ctgttggtctgccttctgctga

SEQ ID NO: 6165613 - DNA, 18 bp, Homo sapiens
ctgttggtcttaactaat

SEQ ID NO: 6165614 - DNA, 21 bp, Homo sapiens
ctgttggtgttctaagactct

SEQ ID NO: 6165615 - DNA, 19 bp, Homo sapiens
ctgttggttagctggacat

SEQ ID NO: 6165616 - DNA, 22 bp, Homo sapiens
ctgttggttcatccagaagtgt

SEQ ID NO: 6165617 - DNA, 19 bp, Homo sapiens
ctgttgtaaatgaccaaga

SEQ ID NO: 6165618 - DNA, 15 bp, Homo sapiens
ctgttgtaacttatg

SEQ ID NO: 6165619 - DNA, 17 bp, Homo sapiens
ctgttgtaacttatgta

SEQ ID NO: 6165620 - DNA, 18 bp, Homo sapiens
ctgttgtaacttatgtag

SEQ ID NO: 6165621 - DNA, 17 bp, Homo sapiens
ctgttgtaagaattctg

SEQ ID NO: 6165622 - DNA, 20 bp, Homo sapiens
ctgttgtaagtaataatttg

SEQ ID NO: 6165623 - DNA, 21 bp, Homo sapiens
ctgttgtaagtaataatttgt

SEQ ID NO: 6165624 - DNA, 12 bp, Homo sapiens
ctgttgtaatag

SEQ ID NO: 6165625 - DNA, 17 bp, Homo sapiens
ctgttgtaatagtccat

SEQ ID NO: 6165626 - DNA, 12 bp, Homo sapiens
ctgttgtaattt

SEQ ID NO: 6165627 - DNA, 14 bp, Homo sapiens
ctgttgtacaagct

SEQ ID NO: 6165628 - DNA, 16 bp, Homo sapiens
ctgttgtacaatcatg

SEQ ID NO: 6165629 - DNA, 16 bp, Homo sapiens
ctgttgtacacttggg

SEQ ID NO: 6165630 - DNA, 19 bp, Homo sapiens
ctgttgtacatttatgatt

SEQ ID NO: 6165631 - DNA, 21 bp, Homo sapiens
ctgttgtacgtaaagcttaaa

SEQ ID NO: 6165632 - DNA, 21 bp, Homo sapiens
ctgttgtagaataataataaa

SEQ ID NO: 6165633 - DNA, 19 bp, Homo sapiens
ctgttgtagcattttcctg

SEQ ID NO: 6165634 - DNA, 18 bp, Homo sapiens
ctgttgtatttatggatt

SEQ ID NO: 6165635 - DNA, 17 bp, Homo sapiens
ctgttgtcaccttcacc

SEQ ID NO: 6165636 - DNA, 18 bp, Homo sapiens
ctgttgtcaccttcacct

SEQ ID NO: 6165637 - DNA, 21 bp, Homo sapiens
ctgttgtcaccttcacctcct

SEQ ID NO: 6165638 - DNA, 17 bp, Homo sapiens
ctgttgtcattgctgtt

SEQ ID NO: 6165639 - DNA, 15 bp, Homo sapiens
ctgttgtcctcccct

SEQ ID NO: 6165640 - DNA, 14 bp, Homo sapiens
ctgttgtctagagc

SEQ ID NO: 6165641 - DNA, 14 bp, Homo sapiens
ctgttgtctcttct

SEQ ID NO: 6165642 - DNA, 20 bp, Homo sapiens
ctgttgtctgccgtgagagc

SEQ ID NO: 6165643 - DNA, 22 bp, Homo sapiens
ctgttgtctgccgtgagagccc

SEQ ID NO: 6165644 - DNA, 23 bp, Homo sapiens
ctgttgtctgccgtgagagccca

SEQ ID NO: 6165645 - DNA, 15 bp, Homo sapiens
ctgttgtctgcgcct

SEQ ID NO: 6165646 - DNA, 19 bp, Homo sapiens
ctgttgtctgcgcctgaaa

SEQ ID NO: 6165647 - DNA, 21 bp, Homo sapiens
ctgttgtctgcgcctgaaaag

SEQ ID NO: 6165648 - DNA, 22 bp, Homo sapiens
ctgttgtctgcgcctgaaaagg

SEQ ID NO: 6165649 - DNA, 16 bp, Homo sapiens
ctgttgtgaagctaat

SEQ ID NO: 6165650 - DNA, 19 bp, Homo sapiens
ctgttgtgacctgaagttc

SEQ ID NO: 6165651 - DNA, 14 bp, Homo sapiens
ctgatcagaggcat

SEQ ID NO: 6165652 - DNA, 12 bp, Homo sapiens
ctgatcagtgta

SEQ ID NO: 6165653 - DNA, 16 bp, Homo sapiens
ctgatcatgcattgtt

SEQ ID NO: 6165654 - DNA, 18 bp, Homo sapiens
ctgatcatggtcagctca

SEQ ID NO: 6165655 - DNA, 20 bp, Homo sapiens
ctgatcattacatggctgtg

SEQ ID NO: 6165656 - DNA, 23 bp, Homo sapiens
ctgatcattgcagtatcagaggg

SEQ ID NO: 6165657 - DNA, 18 bp, Homo sapiens
ctgatccagacaagtggg

SEQ ID NO: 6165658 - DNA, 21 bp, Homo sapiens
ctgatccagagcacagatctg

SEQ ID NO: 6165659 - DNA, 20 bp, Homo sapiens
ctgatccagccctgagttcc

SEQ ID NO: 6165660 - DNA, 18 bp, Homo sapiens
ctgatccagcctctcccc

SEQ ID NO: 6165661 - DNA, 14 bp, Homo sapiens
ctgatcccaccccc

SEQ ID NO: 6165662 - DNA, 23 bp, Homo sapiens
ctgatcccaccccctcctccccc

SEQ ID NO: 6165663 - DNA, 17 bp, Homo sapiens
ctgatcccactcctagg

SEQ ID NO: 6165664 - DNA, 13 bp, Homo sapiens
ctgatcccagacc

SEQ ID NO: 6165665 - DNA, 15 bp, Homo sapiens
ctgatcccagacctg

SEQ ID NO: 6165666 - DNA, 21 bp, Homo sapiens
ctgatcccagagagcccgagg

SEQ ID NO: 6165667 - DNA, 12 bp, Homo sapiens
ctgatcccatgg

SEQ ID NO: 6165668 - DNA, 16 bp, Homo sapiens
ctgatcccatggccag

SEQ ID NO: 6165669 - DNA, 12 bp, Homo sapiens
ctgatccccaac

SEQ ID NO: 6165670 - DNA, 17 bp, Homo sapiens
ctgatcccccagatgca

SEQ ID NO: 6165671 - DNA, 22 bp, Homo sapiens
ctgatcccggccggccctggct

SEQ ID NO: 6165672 - DNA, 13 bp, Homo sapiens
ctgatccctccac

SEQ ID NO: 6165673 - DNA, 15 bp, Homo sapiens
ctgatccctccaccc

SEQ ID NO: 6165674 - DNA, 16 bp, Homo sapiens
ctgatccctccacccc

SEQ ID NO: 6165675 - DNA, 19 bp, Homo sapiens
ctgatccctccacccccat

SEQ ID NO: 6165676 - DNA, 13 bp, Homo sapiens
ctgatccctctgg

SEQ ID NO: 6165677 - DNA, 14 bp, Homo sapiens
ctgatccctctggg

SEQ ID NO: 6165678 - DNA, 20 bp, Homo sapiens
ctgatccctctgggggctct

SEQ ID NO: 6165679 - DNA, 21 bp, Homo sapiens
ctgatccctctgggggctctg

SEQ ID NO: 6165680 - DNA, 20 bp, Homo sapiens
ctgatccctgaacccctggc

SEQ ID NO: 6165681 - DNA, 21 bp, Homo sapiens
ctgatccctgaacccctggcc

SEQ ID NO: 6165682 - DNA, 22 bp, Homo sapiens
ctgatccctgaacccctggcca

SEQ ID NO: 6165683 - DNA, 23 bp, Homo sapiens
ctgatccctgaacccctggccag

SEQ ID NO: 6165684 - DNA, 18 bp, Homo sapiens
ctgatccctgctctctga

SEQ ID NO: 6165685 - DNA, 19 bp, Homo sapiens
ctgatccctgctctctgag

SEQ ID NO: 6165686 - DNA, 20 bp, Homo sapiens
ctgatccctgctctctgagt

SEQ ID NO: 6165687 - DNA, 14 bp, Homo sapiens
ctgatccctggcca

SEQ ID NO: 6165688 - DNA, 18 bp, Homo sapiens
ctgatccctggccactga

SEQ ID NO: 6165689 - DNA, 18 bp, Homo sapiens
ctgatcccttccacctgc

SEQ ID NO: 6165690 - DNA, 16 bp, Homo sapiens
ctgatccgcatccaag

SEQ ID NO: 6165691 - DNA, 20 bp, Homo sapiens
ctgatccggctgctcctcca

SEQ ID NO: 6165692 - DNA, 20 bp, Homo sapiens
ctgatcctaaccctgggctc

SEQ ID NO: 6165693 - DNA, 21 bp, Homo sapiens
ctgatcctaactgaagagaca

SEQ ID NO: 6165694 - DNA, 16 bp, Homo sapiens
ctgatcctgctccagc

SEQ ID NO: 6165695 - DNA, 22 bp, Homo sapiens
ctgatcctgctccagcagcaca

SEQ ID NO: 6165696 - DNA, 12 bp, Homo sapiens
ctgatcctgctg

SEQ ID NO: 6165697 - DNA, 17 bp, Homo sapiens
ctgatcctggaggccca

SEQ ID NO: 6165698 - DNA, 19 bp, Homo sapiens
ctgatcctggaggcccagt

SEQ ID NO: 6165699 - DNA, 20 bp, Homo sapiens
ctgatcctgtgaagtaagga

SEQ ID NO: 6165700 - DNA, 16 bp, Homo sapiens
ctgatccttcaactct

SEQ ID NO: 6165701 - DNA, 20 bp, Homo sapiens
ctgatccttcaactctgtga

SEQ ID NO: 6165702 - DNA, 16 bp, Homo sapiens
ctgatccttttcaata

SEQ ID NO: 6165703 - DNA, 18 bp, Homo sapiens
ctgatcgatttctttcct

SEQ ID NO: 6165704 - DNA, 20 bp, Homo sapiens
ctgatcgccaacctttcccc

SEQ ID NO: 6165705 - DNA, 21 bp, Homo sapiens
ctgatcgggataacaaaatca

SEQ ID NO: 6165706 - DNA, 24 bp, Homo sapiens
ctgatcgggataacaaaatcacaa

SEQ ID NO: 6165707 - DNA, 16 bp, Homo sapiens
ctgatcgtagaaaatt

SEQ ID NO: 6165708 - DNA, 17 bp, Homo sapiens
ctgatcgtagaaaattt

SEQ ID NO: 6165709 - DNA, 22 bp, Homo sapiens
ctgatcgtagaaaatttgcttt

SEQ ID NO: 6165710 - DNA, 15 bp, Homo sapiens
ctgatcgtctcggcc

SEQ ID NO: 6165711 - DNA, 14 bp, Homo sapiens
ctgatcgtgacgct

SEQ ID NO: 6165712 - DNA, 20 bp, Homo sapiens
ctgatctcagggaagcccag

SEQ ID NO: 6165713 - DNA, 13 bp, Homo sapiens
ctgatctccatgg

SEQ ID NO: 6165714 - DNA, 14 bp, Homo sapiens
ctgatctccatggc

SEQ ID NO: 6165715 - DNA, 21 bp, Homo sapiens
ctgatctctactaccacaagg

SEQ ID NO: 6165716 - DNA, 17 bp, Homo sapiens
ctgatctctcagcccca

SEQ ID NO: 6165717 - DNA, 14 bp, Homo sapiens
ctgatctctgacct

SEQ ID NO: 6165718 - DNA, 15 bp, Homo sapiens
ctgatctctgacctc

SEQ ID NO: 6165719 - DNA, 17 bp, Homo sapiens
ctgatctctgacctctg

SEQ ID NO: 6165720 - DNA, 18 bp, Homo sapiens
ctgatctctgacctctgc

SEQ ID NO: 6165721 - DNA, 20 bp, Homo sapiens
ctgatctctgacctctgctg

SEQ ID NO: 6165722 - DNA, 21 bp, Homo sapiens
ctgatctcttcctgttttgta

SEQ ID NO: 6165723 - DNA, 21 bp, Homo sapiens
ctgatctgaggctaagacaca

SEQ ID NO: 6165724 - DNA, 14 bp, Homo sapiens
ctgatctgattttt

SEQ ID NO: 6165725 - DNA, 13 bp, Homo sapiens
ctgatctgcccat

SEQ ID NO: 6165726 - DNA, 19 bp, Homo sapiens
ctgatctgcggatctcagc

SEQ ID NO: 6165727 - DNA, 23 bp, Homo sapiens
ctgatctggcccaagctgggctc

SEQ ID NO: 6165728 - DNA, 22 bp, Homo sapiens
ctgatctgggttttgcctctgc

SEQ ID NO: 6165729 - DNA, 17 bp, Homo sapiens
ctgatctgtactttgtg

SEQ ID NO: 6165730 - DNA, 18 bp, Homo sapiens
ctgatcttaagaggctga

SEQ ID NO: 6165731 - DNA, 19 bp, Homo sapiens
ctgatcttacctttatgag

SEQ ID NO: 6165732 - DNA, 23 bp, Homo sapiens
ctgatcttactctactgctgctg

SEQ ID NO: 6165733 - DNA, 14 bp, Homo sapiens
ctgatctttctaga

SEQ ID NO: 6165734 - DNA, 20 bp, Homo sapiens
ctgatctttgggcatcagaa

SEQ ID NO: 6165735 - DNA, 22 bp, Homo sapiens
ctgatgaaaaattgctgactgt

SEQ ID NO: 6165736 - DNA, 12 bp, Homo sapiens
ctgatgaaaaca

SEQ ID NO: 6165737 - DNA, 12 bp, Homo sapiens
ctgatgaaaata

SEQ ID NO: 6165738 - DNA, 16 bp, Homo sapiens
ctgatgaaaataaaga

SEQ ID NO: 6165739 - DNA, 18 bp, Homo sapiens
ctgatgaaaataaagaat

SEQ ID NO: 6165740 - DNA, 21 bp, Homo sapiens
ctgatgaaactcacaaatgat

SEQ ID NO: 6165741 - DNA, 14 bp, Homo sapiens
ctgatgaatcactg

SEQ ID NO: 6165742 - DNA, 16 bp, Homo sapiens
ctgatgacaataaagc

SEQ ID NO: 6165743 - DNA, 21 bp, Homo sapiens
ctgatgacacccaccctgtgc

SEQ ID NO: 6165744 - DNA, 23 bp, Homo sapiens
ctgatgacacccaccctgtgcca

SEQ ID NO: 6165745 - DNA, 16 bp, Homo sapiens
ctgatgacagagcgag

SEQ ID NO: 6165746 - DNA, 17 bp, Homo sapiens
ctgatgacagagcgaga

SEQ ID NO: 6165747 - DNA, 23 bp, Homo sapiens
ctgatgacagtgttatcccaaga

SEQ ID NO: 6165748 - DNA, 12 bp, Homo sapiens
ctgatgacccag

SEQ ID NO: 6165749 - DNA, 19 bp, Homo sapiens
ctgatgacccaggctgcct

SEQ ID NO: 6165750 - DNA, 19 bp, Homo sapiens
ctgatgacctaacctaagc

SEQ ID NO: 6165751 - DNA, 14 bp, Homo sapiens
ctgatgacttgctt

SEQ ID NO: 6165752 - DNA, 13 bp, Homo sapiens
ctgatgagacaac

SEQ ID NO: 6165753 - DNA, 19 bp, Homo sapiens
ctgatgagacaacacacac

SEQ ID NO: 6165754 - DNA, 15 bp, Homo sapiens
ctgatgagactccac

SEQ ID NO: 6165755 - DNA, 20 bp, Homo sapiens
ctgatgagagaatgtggaaa

SEQ ID NO: 6165756 - DNA, 18 bp, Homo sapiens
ctgatgagatacatttga

SEQ ID NO: 6165757 - DNA, 22 bp, Homo sapiens
ctgatgagatacatttgatctt

SEQ ID NO: 6165758 - DNA, 12 bp, Homo sapiens
ctgatgagcaca

SEQ ID NO: 6165759 - DNA, 14 bp, Homo sapiens
ctgatgagcacatc

SEQ ID NO: 6165760 - DNA, 21 bp, Homo sapiens
ctgatgagcacatctctctgc

SEQ ID NO: 6165761 - DNA, 16 bp, Homo sapiens
ctgatgaggcatttta

SEQ ID NO: 6165762 - DNA, 21 bp, Homo sapiens
ctgatgaggcattttactatg

SEQ ID NO: 6165763 - DNA, 18 bp, Homo sapiens
ctgatgagggggaattcc

SEQ ID NO: 6165764 - DNA, 23 bp, Homo sapiens
ctgatgagggggaattcctggaa

SEQ ID NO: 6165765 - DNA, 21 bp, Homo sapiens
ctgatgagtaaactgaggccc

SEQ ID NO: 6165766 - DNA, 18 bp, Homo sapiens
ctgatgagtttcactgta

SEQ ID NO: 6165767 - DNA, 23 bp, Homo sapiens
ctgatgagtttcactgtactgca

SEQ ID NO: 6165768 - DNA, 16 bp, Homo sapiens
ctgatgatataaacaa

SEQ ID NO: 6165769 - DNA, 14 bp, Homo sapiens
ctgatgatatattc

SEQ ID NO: 6165770 - DNA, 14 bp, Homo sapiens
ctgatgatccagaa

SEQ ID NO: 6165771 - DNA, 17 bp, Homo sapiens
ctgatgatccagaacag

SEQ ID NO: 6165772 - DNA, 14 bp, Homo sapiens
ctgatgatgctggc

SEQ ID NO: 6165773 - DNA, 11 bp, Homo sapiens
ctgatgatgtc

SEQ ID NO: 6165774 - DNA, 20 bp, Homo sapiens
ctgatgatgtcggtcttgca

SEQ ID NO: 6165775 - DNA, 15 bp, Homo sapiens
ctgatgatgttctga

SEQ ID NO: 6165776 - DNA, 21 bp, Homo sapiens
ctgatgatttagagtgctgtc

SEQ ID NO: 6165777 - DNA, 20 bp, Homo sapiens
ctgatgatttcttgaaaagg

SEQ ID NO: 6165778 - DNA, 12 bp, Homo sapiens
ctgatgcagaaa

SEQ ID NO: 6165779 - DNA, 14 bp, Homo sapiens
ctgatgcagaactt

SEQ ID NO: 6165780 - DNA, 13 bp, Homo sapiens
ctgatgcagacac

SEQ ID NO: 6165781 - DNA, 14 bp, Homo sapiens
ctgatgcagcctgt

SEQ ID NO: 6165782 - DNA, 16 bp, Homo sapiens
ctgatgcagcctgtgg

SEQ ID NO: 6165783 - DNA, 17 bp, Homo sapiens
ctgatgcagcctgtggc

SEQ ID NO: 6165784 - DNA, 18 bp, Homo sapiens
ctgatgcagcctgtggct

SEQ ID NO: 6165785 - DNA, 14 bp, Homo sapiens
ctgatgcaggtcag

SEQ ID NO: 6165786 - DNA, 22 bp, Homo sapiens
ctgatgcaggtcagcccatgga

SEQ ID NO: 6165787 - DNA, 23 bp, Homo sapiens
ctgatgcagtcacgtggaggagc

SEQ ID NO: 6165788 - DNA, 17 bp, Homo sapiens
ctgatgcatcagaaagg

SEQ ID NO: 6165789 - DNA, 23 bp, Homo sapiens
ctgatgcatcagaaagggagggc

SEQ ID NO: 6165790 - DNA, 21 bp, Homo sapiens
ctgatgccaaagctgctttct

SEQ ID NO: 6165791 - DNA, 19 bp, Homo sapiens
ctgatgccaagttgtttga

SEQ ID NO: 6165792 - DNA, 19 bp, Homo sapiens
ctgatgccaatactagtca

SEQ ID NO: 6165793 - DNA, 18 bp, Homo sapiens
ctgatgcccaccgaggag

SEQ ID NO: 6165794 - DNA, 21 bp, Homo sapiens
ctgatgcccaccgaggagccc

SEQ ID NO: 6165795 - DNA, 15 bp, Homo sapiens
ctgatgccccttctc

SEQ ID NO: 6165796 - DNA, 14 bp, Homo sapiens
ctgatgcccgttgt

SEQ ID NO: 6165797 - DNA, 15 bp, Homo sapiens
ctgatgccctcttct

SEQ ID NO: 6165798 - DNA, 16 bp, Homo sapiens
ctgatgccctcttctc

SEQ ID NO: 6165799 - DNA, 17 bp, Homo sapiens
ctgatgcgaaaacttga

SEQ ID NO: 6165800 - DNA, 18 bp, Homo sapiens
ctgatgcgaaaacttgaa

SEQ ID NO: 6165801 - DNA, 15 bp, Homo sapiens
ctgatgctccctccc

SEQ ID NO: 6165802 - DNA, 19 bp, Homo sapiens
ctgatgctccctcccctgc

SEQ ID NO: 6165803 - DNA, 15 bp, Homo sapiens
ctgatgctcctccgg

SEQ ID NO: 6165804 - DNA, 17 bp, Homo sapiens
ctgatgctcctccgggt

SEQ ID NO: 6165805 - DNA, 23 bp, Homo sapiens
ctgatgctgaaataaactagggt

SEQ ID NO: 6165806 - DNA, 12 bp, Homo sapiens
ctgatgctgaca

SEQ ID NO: 6165807 - DNA, 23 bp, Homo sapiens
ctgatgctgagattcttcaggct

SEQ ID NO: 6165808 - DNA, 13 bp, Homo sapiens
ctgatgctgcccc

SEQ ID NO: 6165809 - DNA, 14 bp, Homo sapiens
ctgatgctgcccct

SEQ ID NO: 6165810 - DNA, 14 bp, Homo sapiens
ctgatgctgggacc

SEQ ID NO: 6165811 - DNA, 15 bp, Homo sapiens
ctgatgctgggcaat

SEQ ID NO: 6165812 - DNA, 13 bp, Homo sapiens
ctgatgctgggct

SEQ ID NO: 6165813 - DNA, 18 bp, Homo sapiens
ctgatgctgggctgggtg

SEQ ID NO: 6165814 - DNA, 14 bp, Homo sapiens
ctgatgctgtacta

SEQ ID NO: 6165815 - DNA, 17 bp, Homo sapiens
ctgatgcttaataaacg

SEQ ID NO: 6165816 - DNA, 16 bp, Homo sapiens
ctgatgcttacatctg

SEQ ID NO: 6165817 - DNA, 20 bp, Homo sapiens
ctgatgcttcttcagagact

SEQ ID NO: 6165818 - DNA, 20 bp, Homo sapiens
ctgatggaaacaaagtggaa

SEQ ID NO: 6165819 - DNA, 20 bp, Homo sapiens
ctgatggaactgtgtattta

SEQ ID NO: 6165820 - DNA, 15 bp, Homo sapiens
ctgatggaagatggt

SEQ ID NO: 6165821 - DNA, 18 bp, Homo sapiens
ctgatggaagcacacaag

SEQ ID NO: 6165822 - DNA, 20 bp, Homo sapiens
ctgatggaagtaaagcctca

SEQ ID NO: 6165823 - DNA, 19 bp, Homo sapiens
ctgatggaatgtgccacct

SEQ ID NO: 6165824 - DNA, 15 bp, Homo sapiens
ctgatggaattgtta

SEQ ID NO: 6165825 - DNA, 18 bp, Homo sapiens
ctgatggaatttttttgt

SEQ ID NO: 6165826 - DNA, 14 bp, Homo sapiens
ctgatggagaagga

SEQ ID NO: 6165827 - DNA, 15 bp, Homo sapiens
ctgatggagaaggaa

SEQ ID NO: 6165828 - DNA, 16 bp, Homo sapiens
ctgatggagaaggaag

SEQ ID NO: 6165829 - DNA, 20 bp, Homo sapiens
ctgttgtgacctgaagttca

SEQ ID NO: 6165830 - DNA, 18 bp, Homo sapiens
ctgttgtgatcttgcatt

SEQ ID NO: 6165831 - DNA, 22 bp, Homo sapiens
ctgttgtgatcttgcattcatt

SEQ ID NO: 6165832 - DNA, 21 bp, Homo sapiens
ctgttgtgcatgctcaaatga

SEQ ID NO: 6165833 - DNA, 16 bp, Homo sapiens
ctgttgtgccacagag

SEQ ID NO: 6165834 - DNA, 23 bp, Homo sapiens
ctgttgtgccacagagtgtagcc

SEQ ID NO: 6165835 - DNA, 21 bp, Homo sapiens
ctgttgtgtatagatgcaaga

SEQ ID NO: 6165836 - DNA, 21 bp, Homo sapiens
ctgttgtgtctggagcctgca

SEQ ID NO: 6165837 - DNA, 14 bp, Homo sapiens
ctgttgtgtgcctg

SEQ ID NO: 6165838 - DNA, 17 bp, Homo sapiens
ctgttgtgttcaccaga

SEQ ID NO: 6165839 - DNA, 15 bp, Homo sapiens
ctgttgtgttcgttc

SEQ ID NO: 6165840 - DNA, 17 bp, Homo sapiens
ctgttgtgtttgtcaaa

SEQ ID NO: 6165841 - DNA, 21 bp, Homo sapiens
ctgttgttatgatgtgcttaa

SEQ ID NO: 6165842 - DNA, 12 bp, Homo sapiens
ctgttgttattc

SEQ ID NO: 6165843 - DNA, 17 bp, Homo sapiens
ctgttgttcccatctgc

SEQ ID NO: 6165844 - DNA, 12 bp, Homo sapiens
ctgttgttcccg

SEQ ID NO: 6165845 - DNA, 21 bp, Homo sapiens
ctgttgttccttcacatttaa

SEQ ID NO: 6165846 - DNA, 22 bp, Homo sapiens
ctgttgttccttcacatttaag

SEQ ID NO: 6165847 - DNA, 23 bp, Homo sapiens
ctgttgttctgtggtcacagtga

SEQ ID NO: 6165848 - DNA, 22 bp, Homo sapiens
ctgttgttcttataagaagaag

SEQ ID NO: 6165849 - DNA, 23 bp, Homo sapiens
ctgttgttgaggtggtggtagtg

SEQ ID NO: 6165850 - DNA, 15 bp, Homo sapiens
ctgttgttgcaggga

SEQ ID NO: 6165851 - DNA, 17 bp, Homo sapiens
ctgttgttgttaatgaa

SEQ ID NO: 6165852 - DNA, 23 bp, Homo sapiens
ctgttgttgttacttccctccaa

SEQ ID NO: 6165853 - DNA, 9 bp, Homo sapiens
ctgttgttt

SEQ ID NO: 6165854 - DNA, 16 bp, Homo sapiens
ctgttgtttaaaataa

SEQ ID NO: 6165855 - DNA, 19 bp, Homo sapiens
ctgttgtttacctaccgta

SEQ ID NO: 6165856 - DNA, 12 bp, Homo sapiens
ctgttgtttcta

SEQ ID NO: 6165857 - DNA, 17 bp, Homo sapiens
ctgttgtttctaaacaa

SEQ ID NO: 6165858 - DNA, 20 bp, Homo sapiens
ctgttgtttctataaatgac

SEQ ID NO: 6165859 - DNA, 15 bp, Homo sapiens
ctgttgttttgtatg

SEQ ID NO: 6165860 - DNA, 20 bp, Homo sapiens
ctgttgttttgttttaaata

SEQ ID NO: 6165861 - DNA, 18 bp, Homo sapiens
ctgtttaaaaaaccacat

SEQ ID NO: 6165862 - DNA, 23 bp, Homo sapiens
ctgtttaaaatttgtgctgggtt

SEQ ID NO: 6165863 - DNA, 18 bp, Homo sapiens
ctgtttaaagctttgaat

SEQ ID NO: 6165864 - DNA, 21 bp, Homo sapiens
ctgtttaaagtcacatccctg

SEQ ID NO: 6165865 - DNA, 23 bp, Homo sapiens
ctgtttaactccctagttaccca

SEQ ID NO: 6165866 - DNA, 12 bp, Homo sapiens
ctgtttaagaaa

SEQ ID NO: 6165867 - DNA, 18 bp, Homo sapiens
ctgtttaagacacttccg

SEQ ID NO: 6165868 - DNA, 20 bp, Homo sapiens
ctgtttaatatttaaacagc

SEQ ID NO: 6165869 - DNA, 14 bp, Homo sapiens
ctgtttaatttaca

SEQ ID NO: 6165870 - DNA, 13 bp, Homo sapiens
ctgtttacaacat

SEQ ID NO: 6165871 - DNA, 18 bp, Homo sapiens
ctgtttacaacatcacca

SEQ ID NO: 6165872 - DNA, 14 bp, Homo sapiens
ctgtttacaagaaa

SEQ ID NO: 6165873 - DNA, 13 bp, Homo sapiens
ctgtttacagtgt

SEQ ID NO: 6165874 - DNA, 15 bp, Homo sapiens
ctgtttacagtgttc

SEQ ID NO: 6165875 - DNA, 19 bp, Homo sapiens
ctgtttacatccagagttc

SEQ ID NO: 6165876 - DNA, 22 bp, Homo sapiens
ctgtttacatccagagttctgt

SEQ ID NO: 6165877 - DNA, 18 bp, Homo sapiens
ctgtttacctggcagtgg

SEQ ID NO: 6165878 - DNA, 18 bp, Homo sapiens
ctgtttactgacatggtg

SEQ ID NO: 6165879 - DNA, 18 bp, Homo sapiens
ctgtttactgattagagt

SEQ ID NO: 6165880 - DNA, 19 bp, Homo sapiens
ctgtttacttgaatagtat

SEQ ID NO: 6165881 - DNA, 17 bp, Homo sapiens
ctgtttagatttattag

SEQ ID NO: 6165882 - DNA, 22 bp, Homo sapiens
ctgtttagatttgccatagagt

SEQ ID NO: 6165883 - DNA, 20 bp, Homo sapiens
ctgtttagcagcagccttta

SEQ ID NO: 6165884 - DNA, 21 bp, Homo sapiens
ctgtttagcttcctccagagg

SEQ ID NO: 6165885 - DNA, 18 bp, Homo sapiens
ctgtttaggaagaagtgg

SEQ ID NO: 6165886 - DNA, 18 bp, Homo sapiens
ctgtttagtaaatacatc

SEQ ID NO: 6165887 - DNA, 17 bp, Homo sapiens
ctgtttagtagcagtga

SEQ ID NO: 6165888 - DNA, 15 bp, Homo sapiens
ctgtttagttttaca

SEQ ID NO: 6165889 - DNA, 16 bp, Homo sapiens
ctgtttataaaaacaa

SEQ ID NO: 6165890 - DNA, 15 bp, Homo sapiens
ctgtttataaatgtt

SEQ ID NO: 6165891 - DNA, 15 bp, Homo sapiens
ctgtttataatctga

SEQ ID NO: 6165892 - DNA, 20 bp, Homo sapiens
ctgtttataatctgaagata

SEQ ID NO: 6165893 - DNA, 12 bp, Homo sapiens
ctgtttatactt

SEQ ID NO: 6165894 - DNA, 12 bp, Homo sapiens
ctgtttatataa

SEQ ID NO: 6165895 - DNA, 16 bp, Homo sapiens
ctgtttatatgtgttg

SEQ ID NO: 6165896 - DNA, 19 bp, Homo sapiens
ctgtttatcccttaagaat

SEQ ID NO: 6165897 - DNA, 19 bp, Homo sapiens
ctgtttatgatctatttgt

SEQ ID NO: 6165898 - DNA, 20 bp, Homo sapiens
ctgtttatgatctatttgta

SEQ ID NO: 6165899 - DNA, 15 bp, Homo sapiens
ctgtttatgcttttg

SEQ ID NO: 6165900 - DNA, 23 bp, Homo sapiens
ctgtttatggaaataccaggacc

SEQ ID NO: 6165901 - DNA, 21 bp, Homo sapiens
ctgtttatggccacatttaat

SEQ ID NO: 6165902 - DNA, 14 bp, Homo sapiens
ctgtttatggcctc

SEQ ID NO: 6165903 - DNA, 21 bp, Homo sapiens
ctgtttatggcctcagctgcc

SEQ ID NO: 6165904 - DNA, 16 bp, Homo sapiens
ctgtttatggtatttt

SEQ ID NO: 6165905 - DNA, 15 bp, Homo sapiens
ctgtttattaaaaat

SEQ ID NO: 6165906 - DNA, 16 bp, Homo sapiens
ctgtttattaatctta

SEQ ID NO: 6165907 - DNA, 14 bp, Homo sapiens
ctgtttattacttc

SEQ ID NO: 6165908 - DNA, 16 bp, Homo sapiens
ctgtttattcatatgc

SEQ ID NO: 6165909 - DNA, 15 bp, Homo sapiens
ctgtttattcccatc

SEQ ID NO: 6165910 - DNA, 23 bp, Homo sapiens
ctgtttattgaaagaattatcct

SEQ ID NO: 6165911 - DNA, 17 bp, Homo sapiens
ctgtttatttaaggatg

SEQ ID NO: 6165912 - DNA, 20 bp, Homo sapiens
ctgtttatttaaggatggat

SEQ ID NO: 6165913 - DNA, 22 bp, Homo sapiens
ctgtttatttaaggatggatgg

SEQ ID NO: 6165914 - DNA, 17 bp, Homo sapiens
ctgtttatttttaaatt

SEQ ID NO: 6165915 - DNA, 22 bp, Homo sapiens
ctgtttcaaactgaatttgttc

SEQ ID NO: 6165916 - DNA, 17 bp, Homo sapiens
ctgtttcaaactttact

SEQ ID NO: 6165917 - DNA, 15 bp, Homo sapiens
ctgtttcaagccctc

SEQ ID NO: 6165918 - DNA, 11 bp, Homo sapiens
ctgtttcaagg

SEQ ID NO: 6165919 - DNA, 20 bp, Homo sapiens
ctgtttcactgaaatgtttg

SEQ ID NO: 6165920 - DNA, 16 bp, Homo sapiens
ctgtttcagaaaacat

SEQ ID NO: 6165921 - DNA, 18 bp, Homo sapiens
ctgtttcagaccccccca

SEQ ID NO: 6165922 - DNA, 16 bp, Homo sapiens
ctgtttcagaggctca

SEQ ID NO: 6165923 - DNA, 14 bp, Homo sapiens
ctgtttcagtgtga

SEQ ID NO: 6165924 - DNA, 22 bp, Homo sapiens
ctgtttcataagctttgtaatt

SEQ ID NO: 6165925 - DNA, 23 bp, Homo sapiens
ctgtttcataagctttgtaattc

SEQ ID NO: 6165926 - DNA, 18 bp, Homo sapiens
ctgtttcataatgcagaa

SEQ ID NO: 6165927 - DNA, 16 bp, Homo sapiens
ctgtttcatagttttc

SEQ ID NO: 6165928 - DNA, 17 bp, Homo sapiens
ctgtttcatagttttct

SEQ ID NO: 6165929 - DNA, 18 bp, Homo sapiens
ctgtttcattcactgtgc

SEQ ID NO: 6165930 - DNA, 15 bp, Homo sapiens
ctgtttccaaatccc

SEQ ID NO: 6165931 - DNA, 15 bp, Homo sapiens
ctgtttcccagcagt

SEQ ID NO: 6165932 - DNA, 21 bp, Homo sapiens
ctgtttcccagcagtggactc

SEQ ID NO: 6165933 - DNA, 16 bp, Homo sapiens
ctgtttcccaggccca

SEQ ID NO: 6165934 - DNA, 20 bp, Homo sapiens
ctgtttcccgtaaggctgta

SEQ ID NO: 6165935 - DNA, 20 bp, Homo sapiens
ctgtttccctgctgaatgcc

SEQ ID NO: 6165936 - DNA, 14 bp, Homo sapiens
ctgtttcctgaaat

SEQ ID NO: 6165937 - DNA, 16 bp, Homo sapiens
ctgtttcctgaaatat

SEQ ID NO: 6165938 - DNA, 12 bp, Homo sapiens
ctgtttcctgat

SEQ ID NO: 6165939 - DNA, 17 bp, Homo sapiens
ctgtttcctgctgcttt

SEQ ID NO: 6165940 - DNA, 18 bp, Homo sapiens
ctgtttcctggcctcaga

SEQ ID NO: 6165941 - DNA, 13 bp, Homo sapiens
ctgtttcctgtgt

SEQ ID NO: 6165942 - DNA, 14 bp, Homo sapiens
ctgtttccttgcct

SEQ ID NO: 6165943 - DNA, 16 bp, Homo sapiens
ctgtttcgcatccacc

SEQ ID NO: 6165944 - DNA, 12 bp, Homo sapiens
ctgtttctaaga

SEQ ID NO: 6165945 - DNA, 18 bp, Homo sapiens
ctgtttctaagaaaatgt

SEQ ID NO: 6165946 - DNA, 16 bp, Homo sapiens
ctgtttctatcctgtt

SEQ ID NO: 6165947 - DNA, 15 bp, Homo sapiens
ctgtttctcaagtgt

SEQ ID NO: 6165948 - DNA, 12 bp, Homo sapiens
ctgtttctcatg

SEQ ID NO: 6165949 - DNA, 17 bp, Homo sapiens
ctgtttctcatgaagct

SEQ ID NO: 6165950 - DNA, 22 bp, Homo sapiens
ctgtttctccccacaccctgga

SEQ ID NO: 6165951 - DNA, 15 bp, Homo sapiens
ctgtttctcctccat

SEQ ID NO: 6165952 - DNA, 21 bp, Homo sapiens
ctgtttctctgccgctacctc

SEQ ID NO: 6165953 - DNA, 13 bp, Homo sapiens
ctgtttctctgct

SEQ ID NO: 6165954 - DNA, 16 bp, Homo sapiens
ctgtttctcttgagct

SEQ ID NO: 6165955 - DNA, 17 bp, Homo sapiens
ctgtttctcttgagctg

SEQ ID NO: 6165956 - DNA, 22 bp, Homo sapiens
ctgtttctcttgagctggcctc

SEQ ID NO: 6165957 - DNA, 16 bp, Homo sapiens
ctgtttctctttgtct

SEQ ID NO: 6165958 - DNA, 20 bp, Homo sapiens
ctgtttctctttgtctgcct

SEQ ID NO: 6165959 - DNA, 18 bp, Homo sapiens
ctgtttctgaaaagaaat

SEQ ID NO: 6165960 - DNA, 15 bp, Homo sapiens
ctgtttctgcagccc

SEQ ID NO: 6165961 - DNA, 15 bp, Homo sapiens
ctgtttctgcttatt

SEQ ID NO: 6165962 - DNA, 20 bp, Homo sapiens
ctgtttctgcttccttacac

SEQ ID NO: 6165963 - DNA, 23 bp, Homo sapiens
ctgtttctggaagactgctcccg

SEQ ID NO: 6165964 - DNA, 14 bp, Homo sapiens
ctgtttctgtagaa

SEQ ID NO: 6165965 - DNA, 21 bp, Homo sapiens
ctgtttctgtcaagctggtgc

SEQ ID NO: 6165966 - DNA, 16 bp, Homo sapiens
ctgtttcttctctaca

SEQ ID NO: 6165967 - DNA, 15 bp, Homo sapiens
ctgtttcttcttgtg

SEQ ID NO: 6165968 - DNA, 17 bp, Homo sapiens
ctgtttcttgatgctca

SEQ ID NO: 6165969 - DNA, 13 bp, Homo sapiens
ctgtttcttgctc

SEQ ID NO: 6165970 - DNA, 19 bp, Homo sapiens
ctgtttcttgcttgtacct

SEQ ID NO: 6165971 - DNA, 23 bp, Homo sapiens
ctgtttctttttttatgactgta

SEQ ID NO: 6165972 - DNA, 13 bp, Homo sapiens
ctgtttgaaaaac

SEQ ID NO: 6165973 - DNA, 18 bp, Homo sapiens
ctgtttgaaacttttcaa

SEQ ID NO: 6165974 - DNA, 15 bp, Homo sapiens
ctgtttgaacccagg

SEQ ID NO: 6165975 - DNA, 17 bp, Homo sapiens
ctgtttgaacccaggag

SEQ ID NO: 6165976 - DNA, 18 bp, Homo sapiens
ctgtttgaacccaggaga

SEQ ID NO: 6165977 - DNA, 19 bp, Homo sapiens
ctgtttgaacccaggagag

SEQ ID NO: 6165978 - DNA, 16 bp, Homo sapiens
ctgtttgaattttcaa

SEQ ID NO: 6165979 - DNA, 19 bp, Homo sapiens
ctgtttgacacctcttttt

SEQ ID NO: 6165980 - DNA, 19 bp, Homo sapiens
ctgtttgagatgtgatgct

SEQ ID NO: 6165981 - DNA, 22 bp, Homo sapiens
ctgtttgagatgtgatgctggt

SEQ ID NO: 6165982 - DNA, 16 bp, Homo sapiens
ctgtttgatgtatgtg

SEQ ID NO: 6165983 - DNA, 13 bp, Homo sapiens
ctgtttgattctt

SEQ ID NO: 6165984 - DNA, 15 bp, Homo sapiens
ctgtttgcatgagaa

SEQ ID NO: 6165985 - DNA, 22 bp, Homo sapiens
ctgtttgcatttgatacatttt

SEQ ID NO: 6165986 - DNA, 14 bp, Homo sapiens
ctgtttgccacacc

SEQ ID NO: 6165987 - DNA, 13 bp, Homo sapiens
ctgtttgccactt

SEQ ID NO: 6165988 - DNA, 20 bp, Homo sapiens
ctgtttgctcaaaattgctt

SEQ ID NO: 6165989 - DNA, 12 bp, Homo sapiens
ctgtttgctcac

SEQ ID NO: 6165990 - DNA, 22 bp, Homo sapiens
ctgtttgctgttgctgatttta

SEQ ID NO: 6165991 - DNA, 13 bp, Homo sapiens
ctgtttgcttcta

SEQ ID NO: 6165992 - DNA, 19 bp, Homo sapiens
ctgtttgcttgtagttgaa

SEQ ID NO: 6165993 - DNA, 17 bp, Homo sapiens
ctgtttggaaaagacag

SEQ ID NO: 6165994 - DNA, 23 bp, Homo sapiens
ctgtttggaaatggggagctggc

SEQ ID NO: 6165995 - DNA, 20 bp, Homo sapiens
ctgtttggcacttgtattta

SEQ ID NO: 6165996 - DNA, 22 bp, Homo sapiens
ctgtttgggaagagcttagaaa

SEQ ID NO: 6165997 - DNA, 19 bp, Homo sapiens
ctgtttgggaggctggagt

SEQ ID NO: 6165998 - DNA, 16 bp, Homo sapiens
ctgtttgggcaggagt

SEQ ID NO: 6165999 - DNA, 16 bp, Homo sapiens
ctgtttgggcccctct

SEQ ID NO: 6166000 - DNA, 20 bp, Homo sapiens
ctgtttgggcccctctccca

SEQ ID NO: 6166001 - DNA, 14 bp, Homo sapiens
ctgtttggggaggg

SEQ ID NO: 6166002 - DNA, 20 bp, Homo sapiens
ctgtttggtcgagtctttgt

SEQ ID NO: 6166003 - DNA, 17 bp, Homo sapiens
ctgtttggtgaggacct

SEQ ID NO: 6166004 - DNA, 23 bp, Homo sapiens
ctgtttggtggggtggcacctgt

SEQ ID NO: 6166005 - DNA, 20 bp, Homo sapiens
ctgtttggtttgtttataat

SEQ ID NO: 6166006 - DNA, 13 bp, Homo sapiens
ctgtttgtaaatt

SEQ ID NO: 6166007 - DNA, 13 bp, Homo sapiens
ctgatggagagga

SEQ ID NO: 6166008 - DNA, 14 bp, Homo sapiens
ctgatggagaggag

SEQ ID NO: 6166009 - DNA, 17 bp, Homo sapiens
ctgatggagccccacct

SEQ ID NO: 6166010 - DNA, 18 bp, Homo sapiens
ctgatggagccccacctt

SEQ ID NO: 6166011 - DNA, 15 bp, Homo sapiens
ctgatggaggaaaaa

SEQ ID NO: 6166012 - DNA, 16 bp, Homo sapiens
ctgatggaggaaaaag

SEQ ID NO: 6166013 - DNA, 23 bp, Homo sapiens
ctgatggagggagggggaagtcg

SEQ ID NO: 6166014 - DNA, 20 bp, Homo sapiens
ctgatggagtgtgcagacag

SEQ ID NO: 6166015 - DNA, 23 bp, Homo sapiens
ctgatggattccaaaccaggaca

SEQ ID NO: 6166016 - DNA, 19 bp, Homo sapiens
ctgatggattccaaccttc

SEQ ID NO: 6166017 - DNA, 19 bp, Homo sapiens
ctgatggcagaactcccac

SEQ ID NO: 6166018 - DNA, 16 bp, Homo sapiens
ctgatggcaggatggc

SEQ ID NO: 6166019 - DNA, 13 bp, Homo sapiens
ctgatggccaaga

SEQ ID NO: 6166020 - DNA, 18 bp, Homo sapiens
ctgatggccaagggggtg

SEQ ID NO: 6166021 - DNA, 17 bp, Homo sapiens
ctgatggcccctccagc

SEQ ID NO: 6166022 - DNA, 18 bp, Homo sapiens
ctgatggcccctccagca

SEQ ID NO: 6166023 - DNA, 14 bp, Homo sapiens
ctgatggccctcat

SEQ ID NO: 6166024 - DNA, 11 bp, Homo sapiens
ctgatggcctg

SEQ ID NO: 6166025 - DNA, 14 bp, Homo sapiens
ctgatggcctggct

SEQ ID NO: 6166026 - DNA, 14 bp, Homo sapiens
ctgatggccttaat

SEQ ID NO: 6166027 - DNA, 19 bp, Homo sapiens
ctgatggccttaatttcct

SEQ ID NO: 6166028 - DNA, 21 bp, Homo sapiens
ctgatggccttaatttccttt

SEQ ID NO: 6166029 - DNA, 15 bp, Homo sapiens
ctgatggcctttgga

SEQ ID NO: 6166030 - DNA, 16 bp, Homo sapiens
ctgatggcctttggac

SEQ ID NO: 6166031 - DNA, 18 bp, Homo sapiens
ctgatggcctttggaccc

SEQ ID NO: 6166032 - DNA, 20 bp, Homo sapiens
ctgatggcctttggacccag

SEQ ID NO: 6166033 - DNA, 19 bp, Homo sapiens
ctgatggctgctagatttt

SEQ ID NO: 6166034 - DNA, 15 bp, Homo sapiens
ctgatggctgctgga

SEQ ID NO: 6166035 - DNA, 18 bp, Homo sapiens
ctgatggcttgacatgtg

SEQ ID NO: 6166036 - DNA, 20 bp, Homo sapiens
ctgatggcttgacatgtgca

SEQ ID NO: 6166037 - DNA, 22 bp, Homo sapiens
ctgatggcttgacatgtgcaat

SEQ ID NO: 6166038 - DNA, 23 bp, Homo sapiens
ctgatggcttgacatgtgcaatt

SEQ ID NO: 6166039 - DNA, 14 bp, Homo sapiens
ctgatgggaaggag

SEQ ID NO: 6166040 - DNA, 18 bp, Homo sapiens
ctgatgggaaggagggga

SEQ ID NO: 6166041 - DNA, 16 bp, Homo sapiens
ctgatgggacatcaaa

SEQ ID NO: 6166042 - DNA, 18 bp, Homo sapiens
ctgatgggcaacccccag

SEQ ID NO: 6166043 - DNA, 21 bp, Homo sapiens
ctgatgggctggggcaggggc

SEQ ID NO: 6166044 - DNA, 22 bp, Homo sapiens
ctgatggggaagggacttttat

SEQ ID NO: 6166045 - DNA, 17 bp, Homo sapiens
ctgatggggtcgctctt

SEQ ID NO: 6166046 - DNA, 18 bp, Homo sapiens
ctgatgggtatcatgctt

SEQ ID NO: 6166047 - DNA, 16 bp, Homo sapiens
ctgatgggtcctgctg

SEQ ID NO: 6166048 - DNA, 16 bp, Homo sapiens
ctgatgggtgcccttt

SEQ ID NO: 6166049 - DNA, 15 bp, Homo sapiens
ctgatgggttcttag

SEQ ID NO: 6166050 - DNA, 24 bp, Homo sapiens
ctgatggtataaacaggagacagg

SEQ ID NO: 6166051 - DNA, 14 bp, Homo sapiens
ctgatggtcagctc

SEQ ID NO: 6166052 - DNA, 15 bp, Homo sapiens
ctgatggtcagctcc

SEQ ID NO: 6166053 - DNA, 19 bp, Homo sapiens
ctgatggtcagctcccttc

SEQ ID NO: 6166054 - DNA, 16 bp, Homo sapiens
ctgatggtgagcagta

SEQ ID NO: 6166055 - DNA, 21 bp, Homo sapiens
ctgatggtgagcagtaactgt

SEQ ID NO: 6166056 - DNA, 15 bp, Homo sapiens
ctgatggtgagctgg

SEQ ID NO: 6166057 - DNA, 16 bp, Homo sapiens
ctgatggtgagctggg

SEQ ID NO: 6166058 - DNA, 14 bp, Homo sapiens
ctgatggtgcaatg

SEQ ID NO: 6166059 - DNA, 23 bp, Homo sapiens
ctgatggtgctcacgactcttcc

SEQ ID NO: 6166060 - DNA, 15 bp, Homo sapiens
ctgatggtggggcca

SEQ ID NO: 6166061 - DNA, 21 bp, Homo sapiens
ctgatggtgtggcctgtggct

SEQ ID NO: 6166062 - DNA, 14 bp, Homo sapiens
ctgatggttgcttt

SEQ ID NO: 6166063 - DNA, 15 bp, Homo sapiens
ctgatggttgctttg

SEQ ID NO: 6166064 - DNA, 21 bp, Homo sapiens
ctgatggtttctttttttccc

SEQ ID NO: 6166065 - DNA, 15 bp, Homo sapiens
ctgatggtttggaaa

SEQ ID NO: 6166066 - DNA, 19 bp, Homo sapiens
ctgatggtttggaaaataa

SEQ ID NO: 6166067 - DNA, 16 bp, Homo sapiens
ctgatgtaacaaggtg

SEQ ID NO: 6166068 - DNA, 16 bp, Homo sapiens
ctgatgtactctaaat

SEQ ID NO: 6166069 - DNA, 16 bp, Homo sapiens
ctgatgtagcttgaga

SEQ ID NO: 6166070 - DNA, 15 bp, Homo sapiens
ctgatgtaggagctg

SEQ ID NO: 6166071 - DNA, 17 bp, Homo sapiens
ctgatgtaggagctgga

SEQ ID NO: 6166072 - DNA, 21 bp, Homo sapiens
ctgatgtattacatgactgtt

SEQ ID NO: 6166073 - DNA, 22 bp, Homo sapiens
ctgatgtcaatttctgtgttgc

SEQ ID NO: 6166074 - DNA, 11 bp, Homo sapiens
ctgatgtcatc

SEQ ID NO: 6166075 - DNA, 13 bp, Homo sapiens
ctgatgtcatctt

SEQ ID NO: 6166076 - DNA, 22 bp, Homo sapiens
ctgatgtccatttgtcccaata

SEQ ID NO: 6166077 - DNA, 18 bp, Homo sapiens
ctgatgtctcctaagcac

SEQ ID NO: 6166078 - DNA, 18 bp, Homo sapiens
ctgatgtctctaaagcac

SEQ ID NO: 6166079 - DNA, 19 bp, Homo sapiens
ctgatgtcttagtgactta

SEQ ID NO: 6166080 - DNA, 12 bp, Homo sapiens
ctgatgtgaaac

SEQ ID NO: 6166081 - DNA, 22 bp, Homo sapiens
ctgatgtgacattccatgacga

SEQ ID NO: 6166082 - DNA, 23 bp, Homo sapiens
ctgatgtgacttttatatgcttt

SEQ ID NO: 6166083 - DNA, 13 bp, Homo sapiens
ctgatgtggactg

SEQ ID NO: 6166084 - DNA, 13 bp, Homo sapiens
ctgatgtgtacat

SEQ ID NO: 6166085 - DNA, 13 bp, Homo sapiens
ctgatgtgtccct

SEQ ID NO: 6166086 - DNA, 19 bp, Homo sapiens
ctgatgtgtgttgtcagcc

SEQ ID NO: 6166087 - DNA, 20 bp, Homo sapiens
ctgatgtgtgttgtcagcct

SEQ ID NO: 6166088 - DNA, 21 bp, Homo sapiens
ctgatgtgtgttgtcagcctg

SEQ ID NO: 6166089 - DNA, 17 bp, Homo sapiens
ctgatgttactagcctc

SEQ ID NO: 6166090 - DNA, 16 bp, Homo sapiens
ctgatgttactgagat

SEQ ID NO: 6166091 - DNA, 20 bp, Homo sapiens
ctgatgttactgagatgttt

SEQ ID NO: 6166092 - DNA, 15 bp, Homo sapiens
ctgatgttaggctgg

SEQ ID NO: 6166093 - DNA, 18 bp, Homo sapiens
ctgatgttaggctgggcc

SEQ ID NO: 6166094 - DNA, 19 bp, Homo sapiens
ctgatgttaggctgggccc

SEQ ID NO: 6166095 - DNA, 22 bp, Homo sapiens
ctgatgttaggctgggcccaga

SEQ ID NO: 6166096 - DNA, 22 bp, Homo sapiens
ctgatgttgagggaacagacag

SEQ ID NO: 6166097 - DNA, 19 bp, Homo sapiens
ctgatgtttacaatgatgc

SEQ ID NO: 6166098 - DNA, 14 bp, Homo sapiens
ctgatgtttataaa

SEQ ID NO: 6166099 - DNA, 18 bp, Homo sapiens
ctgatgtttataaactga

SEQ ID NO: 6166100 - DNA, 20 bp, Homo sapiens
ctgatgtttataaactgaga

SEQ ID NO: 6166101 - DNA, 21 bp, Homo sapiens
ctgatgtttataaactgagag

SEQ ID NO: 6166102 - DNA, 14 bp, Homo sapiens
ctgatgtttatgta

SEQ ID NO: 6166103 - DNA, 22 bp, Homo sapiens
ctgatgtttatgtactgtaaac

SEQ ID NO: 6166104 - DNA, 22 bp, Homo sapiens
ctgatgtttgggggttaccaaa

SEQ ID NO: 6166105 - DNA, 13 bp, Homo sapiens
ctgatgttttagc

SEQ ID NO: 6166106 - DNA, 17 bp, Homo sapiens
ctgatgttttagcattt

SEQ ID NO: 6166107 - DNA, 18 bp, Homo sapiens
ctgatgttttgtattttg

SEQ ID NO: 6166108 - DNA, 16 bp, Homo sapiens
ctgatgtttttctgtg

SEQ ID NO: 6166109 - DNA, 17 bp, Homo sapiens
ctgattaaagtgccttc

SEQ ID NO: 6166110 - DNA, 18 bp, Homo sapiens
ctgattaaagtgccttca

SEQ ID NO: 6166111 - DNA, 18 bp, Homo sapiens
ctgattaaatatttgaag

SEQ ID NO: 6166112 - DNA, 21 bp, Homo sapiens
ctgattaaatttaatatactg

SEQ ID NO: 6166113 - DNA, 16 bp, Homo sapiens
ctgattaatatattta

SEQ ID NO: 6166114 - DNA, 17 bp, Homo sapiens
ctgattactgtcaataa

SEQ ID NO: 6166115 - DNA, 22 bp, Homo sapiens
ctgattacttgtaattatgaaa

SEQ ID NO: 6166116 - DNA, 20 bp, Homo sapiens
ctgattagagtgcaaaagtg

SEQ ID NO: 6166117 - DNA, 20 bp, Homo sapiens
ctgattagagtggttattca

SEQ ID NO: 6166118 - DNA, 12 bp, Homo sapiens
ctgattagcttt

SEQ ID NO: 6166119 - DNA, 13 bp, Homo sapiens
ctgattagtgtct

SEQ ID NO: 6166120 - DNA, 17 bp, Homo sapiens
ctgattagttgacagta

SEQ ID NO: 6166121 - DNA, 15 bp, Homo sapiens
ctgattataagacaa

SEQ ID NO: 6166122 - DNA, 17 bp, Homo sapiens
ctgattataagacaatg

SEQ ID NO: 6166123 - DNA, 16 bp, Homo sapiens
ctgattataggatttt

SEQ ID NO: 6166124 - DNA, 21 bp, Homo sapiens
ctgattatcctataggcagac

SEQ ID NO: 6166125 - DNA, 14 bp, Homo sapiens
ctgattatgtcttt

SEQ ID NO: 6166126 - DNA, 22 bp, Homo sapiens
ctgattattacaacaagcaaac

SEQ ID NO: 6166127 - DNA, 12 bp, Homo sapiens
ctgattattact

SEQ ID NO: 6166128 - DNA, 18 bp, Homo sapiens
ctgattattgaatgttat

SEQ ID NO: 6166129 - DNA, 11 bp, Homo sapiens
ctgattattta

SEQ ID NO: 6166130 - DNA, 17 bp, Homo sapiens
ctgattatttagagcca

SEQ ID NO: 6166131 - DNA, 18 bp, Homo sapiens
ctgattatttatgacctg

SEQ ID NO: 6166132 - DNA, 14 bp, Homo sapiens
ctgattattttagc

SEQ ID NO: 6166133 - DNA, 18 bp, Homo sapiens
ctgattattttagctaaa

SEQ ID NO: 6166134 - DNA, 12 bp, Homo sapiens
ctgattcaaacc

SEQ ID NO: 6166135 - DNA, 21 bp, Homo sapiens
ctgattcaaaccaaagctgcc

SEQ ID NO: 6166136 - DNA, 22 bp, Homo sapiens
ctgattcaaaccaaagctgcct

SEQ ID NO: 6166137 - DNA, 17 bp, Homo sapiens
ctgattcaactaaaaaa

SEQ ID NO: 6166138 - DNA, 17 bp, Homo sapiens
ctgattcaagaaacaga

SEQ ID NO: 6166139 - DNA, 16 bp, Homo sapiens
ctgattcaagaacaag

SEQ ID NO: 6166140 - DNA, 19 bp, Homo sapiens
ctgattcaagaacaagcaa

SEQ ID NO: 6166141 - DNA, 21 bp, Homo sapiens
ctgattcaataaaatgcactg

SEQ ID NO: 6166142 - DNA, 17 bp, Homo sapiens
ctgattcaatttgatgt

SEQ ID NO: 6166143 - DNA, 13 bp, Homo sapiens
ctgattcactgca

SEQ ID NO: 6166144 - DNA, 17 bp, Homo sapiens
ctgattcagcagtgcct

SEQ ID NO: 6166145 - DNA, 20 bp, Homo sapiens
ctgattcagcatcactaaac

SEQ ID NO: 6166146 - DNA, 13 bp, Homo sapiens
ctgattcagcatt

SEQ ID NO: 6166147 - DNA, 17 bp, Homo sapiens
ctgattccatcctgtgt

SEQ ID NO: 6166148 - DNA, 12 bp, Homo sapiens
ctgattcccaga

SEQ ID NO: 6166149 - DNA, 23 bp, Homo sapiens
ctgattcccgcatggtttttata

SEQ ID NO: 6166150 - DNA, 20 bp, Homo sapiens
ctgattccctctcccaccca

SEQ ID NO: 6166151 - DNA, 16 bp, Homo sapiens
ctgattccctgattta

SEQ ID NO: 6166152 - DNA, 19 bp, Homo sapiens
ctgattcctaaggcccagc

SEQ ID NO: 6166153 - DNA, 19 bp, Homo sapiens
ctgattcctctcatttcca

SEQ ID NO: 6166154 - DNA, 17 bp, Homo sapiens
ctgattcggctgtctca

SEQ ID NO: 6166155 - DNA, 23 bp, Homo sapiens
ctgattcggctgtctcagactct

SEQ ID NO: 6166156 - DNA, 18 bp, Homo sapiens
ctgattcggggctgacct

SEQ ID NO: 6166157 - DNA, 23 bp, Homo sapiens
ctgattctatgcctgtatttcca

SEQ ID NO: 6166158 - DNA, 19 bp, Homo sapiens
ctgattctatgtaacttgt

SEQ ID NO: 6166159 - DNA, 15 bp, Homo sapiens
ctgattctcagggtc

SEQ ID NO: 6166160 - DNA, 21 bp, Homo sapiens
ctgattctcagggtctctgct

SEQ ID NO: 6166161 - DNA, 14 bp, Homo sapiens
ctgattctccctgg

SEQ ID NO: 6166162 - DNA, 21 bp, Homo sapiens
ctgattctctttaactgtgtg

SEQ ID NO: 6166163 - DNA, 16 bp, Homo sapiens
ctgattctgattgcta

SEQ ID NO: 6166164 - DNA, 22 bp, Homo sapiens
ctgattctgattgctatcagca

SEQ ID NO: 6166165 - DNA, 14 bp, Homo sapiens
ctgattctgggatg

SEQ ID NO: 6166166 - DNA, 16 bp, Homo sapiens
ctgattctgggatgct

SEQ ID NO: 6166167 - DNA, 15 bp, Homo sapiens
ctgattcttcagcaa

SEQ ID NO: 6166168 - DNA, 13 bp, Homo sapiens
ctgattcttgtaa

SEQ ID NO: 6166169 - DNA, 20 bp, Homo sapiens
ctgattcttgtaaatctttt

SEQ ID NO: 6166170 - DNA, 13 bp, Homo sapiens
ctgattgaaacat

SEQ ID NO: 6166171 - DNA, 13 bp, Homo sapiens
ctgattgatcaca

SEQ ID NO: 6166172 - DNA, 19 bp, Homo sapiens
ctgattgatcacacagtgt

SEQ ID NO: 6166173 - DNA, 19 bp, Homo sapiens
ctgattgcagaaaggagag

SEQ ID NO: 6166174 - DNA, 18 bp, Homo sapiens
ctgattgctatcagcaat

SEQ ID NO: 6166175 - DNA, 12 bp, Homo sapiens
ctgattgctctg

SEQ ID NO: 6166176 - DNA, 21 bp, Homo sapiens
ctgattggaaaataataaaag

SEQ ID NO: 6166177 - DNA, 22 bp, Homo sapiens
ctgattggaaaataataaaaga

SEQ ID NO: 6166178 - DNA, 15 bp, Homo sapiens
ctgattggaatttct

SEQ ID NO: 6166179 - DNA, 18 bp, Homo sapiens
ctgattggaatttctggc

SEQ ID NO: 6166180 - DNA, 15 bp, Homo sapiens
ctgattggacatttt

SEQ ID NO: 6166181 - DNA, 21 bp, Homo sapiens
ctgattggacctggcccagtg

SEQ ID NO: 6166182 - DNA, 23 bp, Homo sapiens
ctgattggacctggcccagtgca

SEQ ID NO: 6166183 - DNA, 15 bp, Homo sapiens
ctgattggcagatga

SEQ ID NO: 6166184 - DNA, 15 bp, Homo sapiens
ctgattggccactgg

SEQ ID NO: 6166185 - DNA, 23 bp, Homo sapiens
ctgtttgtaatcattatctcact

SEQ ID NO: 6166186 - DNA, 15 bp, Homo sapiens
ctgtttgtatgaaat

SEQ ID NO: 6166187 - DNA, 11 bp, Homo sapiens
ctgtttgtcat

SEQ ID NO: 6166188 - DNA, 17 bp, Homo sapiens
ctgtttgtctgaacaaa

SEQ ID NO: 6166189 - DNA, 18 bp, Homo sapiens
ctgtttgtctgaacaaag

SEQ ID NO: 6166190 - DNA, 13 bp, Homo sapiens
ctgtttgtctttt

SEQ ID NO: 6166191 - DNA, 12 bp, Homo sapiens
ctgtttgttatg

SEQ ID NO: 6166192 - DNA, 17 bp, Homo sapiens
ctgtttgttccaggctc

SEQ ID NO: 6166193 - DNA, 19 bp, Homo sapiens
ctgtttgtttaagctgagc

SEQ ID NO: 6166194 - DNA, 20 bp, Homo sapiens
ctgtttgtttcaagaacctg

SEQ ID NO: 6166195 - DNA, 24 bp, Homo sapiens
ctgttttaaaaaatacagtattat

SEQ ID NO: 6166196 - DNA, 16 bp, Homo sapiens
ctgttttaaaaacctg

SEQ ID NO: 6166197 - DNA, 23 bp, Homo sapiens
ctgttttaaaactttaagaaagg

SEQ ID NO: 6166198 - DNA, 14 bp, Homo sapiens
ctgttttaataatt

SEQ ID NO: 6166199 - DNA, 18 bp, Homo sapiens
ctgttttacagctgcctt

SEQ ID NO: 6166200 - DNA, 15 bp, Homo sapiens
ctgttttacaggaaa

SEQ ID NO: 6166201 - DNA, 17 bp, Homo sapiens
ctgttttactgctttta

SEQ ID NO: 6166202 - DNA, 17 bp, Homo sapiens
ctgttttagaaattggt

SEQ ID NO: 6166203 - DNA, 16 bp, Homo sapiens
ctgttttagctgaggg

SEQ ID NO: 6166204 - DNA, 21 bp, Homo sapiens
ctgttttagtgtttatgttta

SEQ ID NO: 6166205 - DNA, 14 bp, Homo sapiens
ctgttttatatatt

SEQ ID NO: 6166206 - DNA, 22 bp, Homo sapiens
ctgttttatatattatgtgaag

SEQ ID NO: 6166207 - DNA, 14 bp, Homo sapiens
ctgttttatctctg

SEQ ID NO: 6166208 - DNA, 17 bp, Homo sapiens
ctgttttatctctgtga

SEQ ID NO: 6166209 - DNA, 16 bp, Homo sapiens
ctgttttatgacttca

SEQ ID NO: 6166210 - DNA, 13 bp, Homo sapiens
ctgttttatgtca

SEQ ID NO: 6166211 - DNA, 15 bp, Homo sapiens
ctgttttatgttgat

SEQ ID NO: 6166212 - DNA, 21 bp, Homo sapiens
ctgttttatgttgatctgcat

SEQ ID NO: 6166213 - DNA, 18 bp, Homo sapiens
ctgttttattactgtttc

SEQ ID NO: 6166214 - DNA, 22 bp, Homo sapiens
ctgttttattactgtttctaaa

SEQ ID NO: 6166215 - DNA, 19 bp, Homo sapiens
ctgttttattgagttctga

SEQ ID NO: 6166216 - DNA, 21 bp, Homo sapiens
ctgttttcatggacagctgag

SEQ ID NO: 6166217 - DNA, 10 bp, Homo sapiens
ctgttttcca

SEQ ID NO: 6166218 - DNA, 19 bp, Homo sapiens
ctgttttccaaagataatg

SEQ ID NO: 6166219 - DNA, 22 bp, Homo sapiens
ctgttttcccaacctcctgtgg

SEQ ID NO: 6166220 - DNA, 12 bp, Homo sapiens
ctgttttccctc

SEQ ID NO: 6166221 - DNA, 12 bp, Homo sapiens
ctgttttcctcc

SEQ ID NO: 6166222 - DNA, 14 bp, Homo sapiens
ctgttttcctccct

SEQ ID NO: 6166223 - DNA, 15 bp, Homo sapiens
ctgttttcctccctt

SEQ ID NO: 6166224 - DNA, 23 bp, Homo sapiens
ctgttttcctcccttctgctact

SEQ ID NO: 6166225 - DNA, 16 bp, Homo sapiens
ctgttttccttcttcc

SEQ ID NO: 6166226 - DNA, 20 bp, Homo sapiens
ctgttttctaaaggagcaga

SEQ ID NO: 6166227 - DNA, 13 bp, Homo sapiens
ctgttttctaatc

SEQ ID NO: 6166228 - DNA, 20 bp, Homo sapiens
ctgttttctacccttggaaa

SEQ ID NO: 6166229 - DNA, 18 bp, Homo sapiens
ctgttttctagtgtatca

SEQ ID NO: 6166230 - DNA, 13 bp, Homo sapiens
ctgttttctccct

SEQ ID NO: 6166231 - DNA, 14 bp, Homo sapiens
ctgttttctcttga

SEQ ID NO: 6166232 - DNA, 14 bp, Homo sapiens
ctgttttctgctgt

SEQ ID NO: 6166233 - DNA, 15 bp, Homo sapiens
ctgttttctgctgtt

SEQ ID NO: 6166234 - DNA, 15 bp, Homo sapiens
ctgttttctgtaaat

SEQ ID NO: 6166235 - DNA, 18 bp, Homo sapiens
ctgttttcttctcagtct

SEQ ID NO: 6166236 - DNA, 14 bp, Homo sapiens
ctgttttcttcttg

SEQ ID NO: 6166237 - DNA, 21 bp, Homo sapiens
ctgttttctttatgtcttttg

SEQ ID NO: 6166238 - DNA, 15 bp, Homo sapiens
ctgttttgaataaca

SEQ ID NO: 6166239 - DNA, 19 bp, Homo sapiens
ctgttttgaataacatagg

SEQ ID NO: 6166240 - DNA, 18 bp, Homo sapiens
ctgttttgaatctcataa

SEQ ID NO: 6166241 - DNA, 18 bp, Homo sapiens
ctgttttgagttttgtag

SEQ ID NO: 6166242 - DNA, 20 bp, Homo sapiens
ctgttttgagttttgtagca

SEQ ID NO: 6166243 - DNA, 15 bp, Homo sapiens
ctgttttgccaagaa

SEQ ID NO: 6166244 - DNA, 22 bp, Homo sapiens
ctgttttgccaagaatatagtt

SEQ ID NO: 6166245 - DNA, 14 bp, Homo sapiens
ctgttttgcctccc

SEQ ID NO: 6166246 - DNA, 16 bp, Homo sapiens
ctgttttgcctcccca

SEQ ID NO: 6166247 - DNA, 20 bp, Homo sapiens
ctgttttgcttttgtaactt

SEQ ID NO: 6166248 - DNA, 14 bp, Homo sapiens
ctgttttggaatgt

SEQ ID NO: 6166249 - DNA, 16 bp, Homo sapiens
ctgttttggatgttgc

SEQ ID NO: 6166250 - DNA, 21 bp, Homo sapiens
ctgttttggtcccctccctcg

SEQ ID NO: 6166251 - DNA, 23 bp, Homo sapiens
ctgttttggtcccctccctcgtg

SEQ ID NO: 6166252 - DNA, 14 bp, Homo sapiens
ctgttttgtaaagt

SEQ ID NO: 6166253 - DNA, 18 bp, Homo sapiens
ctgttttgtaaatgtaag

SEQ ID NO: 6166254 - DNA, 15 bp, Homo sapiens
ctgttttgtatatga

SEQ ID NO: 6166255 - DNA, 19 bp, Homo sapiens
ctgttttgtatatgctgca

SEQ ID NO: 6166256 - DNA, 22 bp, Homo sapiens
ctgttttgtcctttgagaaaga

SEQ ID NO: 6166257 - DNA, 18 bp, Homo sapiens
ctgttttgtggtttggaa

SEQ ID NO: 6166258 - DNA, 19 bp, Homo sapiens
ctgttttgtggtttggaat

SEQ ID NO: 6166259 - DNA, 14 bp, Homo sapiens
ctgttttgtgtata

SEQ ID NO: 6166260 - DNA, 18 bp, Homo sapiens
ctgttttgttaatgctct

SEQ ID NO: 6166261 - DNA, 18 bp, Homo sapiens
ctgttttgttatataatt

SEQ ID NO: 6166262 - DNA, 20 bp, Homo sapiens
ctgttttgttgacattctga

SEQ ID NO: 6166263 - DNA, 21 bp, Homo sapiens
ctgttttgttgacattctgaa

SEQ ID NO: 6166264 - DNA, 16 bp, Homo sapiens
ctgttttgtttcgctc

SEQ ID NO: 6166265 - DNA, 14 bp, Homo sapiens
ctgttttgtttctt

SEQ ID NO: 6166266 - DNA, 19 bp, Homo sapiens
ctgtttttaagctgtttcc

SEQ ID NO: 6166267 - DNA, 13 bp, Homo sapiens
ctgtttttaccca

SEQ ID NO: 6166268 - DNA, 15 bp, Homo sapiens
ctgtttttagacacc

SEQ ID NO: 6166269 - DNA, 18 bp, Homo sapiens
ctgtttttagacaccttc

SEQ ID NO: 6166270 - DNA, 18 bp, Homo sapiens
ctgtttttattattaaca

SEQ ID NO: 6166271 - DNA, 13 bp, Homo sapiens
ctgtttttcacat

SEQ ID NO: 6166272 - DNA, 15 bp, Homo sapiens
ctgtttttcggacag

SEQ ID NO: 6166273 - DNA, 20 bp, Homo sapiens
ctgtttttcggacagtttat

SEQ ID NO: 6166274 - DNA, 17 bp, Homo sapiens
ctgtttttctaactggg

SEQ ID NO: 6166275 - DNA, 16 bp, Homo sapiens
ctgtttttctcaaata

SEQ ID NO: 6166276 - DNA, 17 bp, Homo sapiens
ctgtttttctcaaataa

SEQ ID NO: 6166277 - DNA, 21 bp, Homo sapiens
ctgtttttcttctgaaataca

SEQ ID NO: 6166278 - DNA, 22 bp, Homo sapiens
ctgtttttgaagaagggaaatt

SEQ ID NO: 6166279 - DNA, 22 bp, Homo sapiens
ctgtttttgataaagtaataat

SEQ ID NO: 6166280 - DNA, 20 bp, Homo sapiens
ctgtttttggctgttttccc

SEQ ID NO: 6166281 - DNA, 15 bp, Homo sapiens
ctgtttttgtatctt

SEQ ID NO: 6166282 - DNA, 16 bp, Homo sapiens
ctgtttttgtatcttt

SEQ ID NO: 6166283 - DNA, 22 bp, Homo sapiens
ctgtttttgtatctttatgctg

SEQ ID NO: 6166284 - DNA, 14 bp, Homo sapiens
ctgtttttgttgtg

SEQ ID NO: 6166285 - DNA, 14 bp, Homo sapiens
ctgtttttttgtta

SEQ ID NO: 6166286 - DNA, 22 bp, Homo sapiens
ctgttttttttttttgtatttc

SEQ ID NO: 6166287 - DNA, 23 bp, Homo sapiens
ctgtttttttttttttaaataat

SEQ ID NO: 6166288 - DNA, 21 bp, Homo sapiens
cttaaaaaaaaaaaaaagctt

SEQ ID NO: 6166289 - DNA, 15 bp, Homo sapiens
cttaaaaaaaactca

SEQ ID NO: 6166290 - DNA, 15 bp, Homo sapiens
cttaaaaaaaggaaa

SEQ ID NO: 6166291 - DNA, 16 bp, Homo sapiens
cttaaaaaaaggaaaa

SEQ ID NO: 6166292 - DNA, 13 bp, Homo sapiens
cttaaaaaaataa

SEQ ID NO: 6166293 - DNA, 14 bp, Homo sapiens
cttaaaaaaataaa

SEQ ID NO: 6166294 - DNA, 15 bp, Homo sapiens
cttaaaaaaatgaca

SEQ ID NO: 6166295 - DNA, 18 bp, Homo sapiens
cttaaaaaacttgtaaat

SEQ ID NO: 6166296 - DNA, 21 bp, Homo sapiens
cttaaaaaagaaagattttat

SEQ ID NO: 6166297 - DNA, 14 bp, Homo sapiens
cttaaaaaatgtcc

SEQ ID NO: 6166298 - DNA, 18 bp, Homo sapiens
cttaaaaaatttatactt

SEQ ID NO: 6166299 - DNA, 22 bp, Homo sapiens
cttaaaaaatttatacttaaaa

SEQ ID NO: 6166300 - DNA, 12 bp, Homo sapiens
cttaaaaactca

SEQ ID NO: 6166301 - DNA, 11 bp, Homo sapiens
cttaaaaactg

SEQ ID NO: 6166302 - DNA, 16 bp, Homo sapiens
cttaaaaactgtgtat

SEQ ID NO: 6166303 - DNA, 18 bp, Homo sapiens
cttaaaaaggactatatt

SEQ ID NO: 6166304 - DNA, 11 bp, Homo sapiens
cttaaaaagta

SEQ ID NO: 6166305 - DNA, 19 bp, Homo sapiens
cttaaaaagtaattgtaga

SEQ ID NO: 6166306 - DNA, 18 bp, Homo sapiens
cttaaaaagtctgcatta

SEQ ID NO: 6166307 - DNA, 22 bp, Homo sapiens
cttaaaaagtctgcattacatt

SEQ ID NO: 6166308 - DNA, 22 bp, Homo sapiens
cttaaaaagtggcgttgttcat

SEQ ID NO: 6166309 - DNA, 14 bp, Homo sapiens
cttaaaaagttata

SEQ ID NO: 6166310 - DNA, 15 bp, Homo sapiens
cttaaaaatacttct

SEQ ID NO: 6166311 - DNA, 17 bp, Homo sapiens
cttaaaaatacttctat

SEQ ID NO: 6166312 - DNA, 22 bp, Homo sapiens
cttaaaaatattttttctgtac

SEQ ID NO: 6166313 - DNA, 22 bp, Homo sapiens
cttaaaaatcacactgtaaata

SEQ ID NO: 6166314 - DNA, 15 bp, Homo sapiens
cttaaaaatcttggt

SEQ ID NO: 6166315 - DNA, 23 bp, Homo sapiens
cttaaaaatcttggtttggtaca

SEQ ID NO: 6166316 - DNA, 12 bp, Homo sapiens
cttaaaaatggt

SEQ ID NO: 6166317 - DNA, 17 bp, Homo sapiens
cttaaaaatgtaaatat

SEQ ID NO: 6166318 - DNA, 15 bp, Homo sapiens
cttaaaacaaaagga

SEQ ID NO: 6166319 - DNA, 14 bp, Homo sapiens
cttaaaacaacact

SEQ ID NO: 6166320 - DNA, 12 bp, Homo sapiens
cttaaaacactt

SEQ ID NO: 6166321 - DNA, 11 bp, Homo sapiens
cttaaaacagc

SEQ ID NO: 6166322 - DNA, 13 bp, Homo sapiens
cttaaaacagctg

SEQ ID NO: 6166323 - DNA, 19 bp, Homo sapiens
cttaaaacatcattccttt

SEQ ID NO: 6166324 - DNA, 20 bp, Homo sapiens
cttaaaacatcattcctttt

SEQ ID NO: 6166325 - DNA, 19 bp, Homo sapiens
cttaaaacatggtgcctat

SEQ ID NO: 6166326 - DNA, 15 bp, Homo sapiens
cttaaaaccaaagag

SEQ ID NO: 6166327 - DNA, 23 bp, Homo sapiens
cttaaaacctgcttttcaatgtg

SEQ ID NO: 6166328 - DNA, 13 bp, Homo sapiens
cttaaaactataa

SEQ ID NO: 6166329 - DNA, 15 bp, Homo sapiens
cttaaaactttgtag

SEQ ID NO: 6166330 - DNA, 15 bp, Homo sapiens
cttaaaacttttcaa

SEQ ID NO: 6166331 - DNA, 12 bp, Homo sapiens
cttaaaagacag

SEQ ID NO: 6166332 - DNA, 14 bp, Homo sapiens
cttaaaagagtaga

SEQ ID NO: 6166333 - DNA, 16 bp, Homo sapiens
cttaaaagagtagaat

SEQ ID NO: 6166334 - DNA, 11 bp, Homo sapiens
cttaaaagatg

SEQ ID NO: 6166335 - DNA, 18 bp, Homo sapiens
cttaaaagcatcataata

SEQ ID NO: 6166336 - DNA, 21 bp, Homo sapiens
cttaaaaggagagaagaaagt

SEQ ID NO: 6166337 - DNA, 15 bp, Homo sapiens
cttaaaaggggccca

SEQ ID NO: 6166338 - DNA, 18 bp, Homo sapiens
cttaaaaggggcccaagc

SEQ ID NO: 6166339 - DNA, 17 bp, Homo sapiens
cttaaaagtaataaaga

SEQ ID NO: 6166340 - DNA, 18 bp, Homo sapiens
cttaaaagtaataaagag

SEQ ID NO: 6166341 - DNA, 17 bp, Homo sapiens
cttaaaagtactttaaa

SEQ ID NO: 6166342 - DNA, 12 bp, Homo sapiens
cttaaaagtatt

SEQ ID NO: 6166343 - DNA, 20 bp, Homo sapiens
cttaaaataaaattatatac

SEQ ID NO: 6166344 - DNA, 20 bp, Homo sapiens
cttaaaataaacagttgtga

SEQ ID NO: 6166345 - DNA, 12 bp, Homo sapiens
cttaaaataagc

SEQ ID NO: 6166346 - DNA, 22 bp, Homo sapiens
cttaaaataagtgaatctaata

SEQ ID NO: 6166347 - DNA, 22 bp, Homo sapiens
cttaaaataatgaatacatttc

SEQ ID NO: 6166348 - DNA, 17 bp, Homo sapiens
cttaaaataatgattta

SEQ ID NO: 6166349 - DNA, 12 bp, Homo sapiens
cttaaaatacaa

SEQ ID NO: 6166350 - DNA, 13 bp, Homo sapiens
cttaaaatacaag

SEQ ID NO: 6166351 - DNA, 19 bp, Homo sapiens
cttaaaatatgtgaagttt

SEQ ID NO: 6166352 - DNA, 20 bp, Homo sapiens
cttaaaatcaaatgtaaatc

SEQ ID NO: 6166353 - DNA, 22 bp, Homo sapiens
cttaaaatcactcagcactcca

SEQ ID NO: 6166354 - DNA, 19 bp, Homo sapiens
cttaaaatgcaatatttgt

SEQ ID NO: 6166355 - DNA, 20 bp, Homo sapiens
cttaaaattacttggctttt

SEQ ID NO: 6166356 - DNA, 21 bp, Homo sapiens
cttaaaattcaagaaaataaa

SEQ ID NO: 6166357 - DNA, 19 bp, Homo sapiens
cttaaaattgatattatat

SEQ ID NO: 6166358 - DNA, 23 bp, Homo sapiens
cttaaaattggtaattgaatgga

SEQ ID NO: 6166359 - DNA, 21 bp, Homo sapiens
cttaaaattggttaatgaaaa

SEQ ID NO: 6166360 - DNA, 22 bp, Homo sapiens
cttaaaattggttaatgaaaaa

SEQ ID NO: 6166361 - DNA, 11 bp, Homo sapiens
cttaaacaaaa

SEQ ID NO: 6166362 - DNA, 13 bp, Homo sapiens
cttaaacaaaaaa

SEQ ID NO: 6166363 - DNA, 14 bp, Homo sapiens
cttaaacaaaaact

SEQ ID NO: 6166364 - DNA, 22 bp, Homo sapiens
cttaaacaaaaactttccatga

SEQ ID NO: 6166365 - DNA, 12 bp, Homo sapiens
ctgattggctgc

SEQ ID NO: 6166366 - DNA, 16 bp, Homo sapiens
ctgattggctgcttaa

SEQ ID NO: 6166367 - DNA, 18 bp, Homo sapiens
ctgattggcttgtagaat

SEQ ID NO: 6166368 - DNA, 22 bp, Homo sapiens
ctgattggcttgtagaattgtt

SEQ ID NO: 6166369 - DNA, 16 bp, Homo sapiens
ctgattgggtcagctg

SEQ ID NO: 6166370 - DNA, 20 bp, Homo sapiens
ctgattgggtcagctggctt

SEQ ID NO: 6166371 - DNA, 18 bp, Homo sapiens
ctgattggtccaacagtt

SEQ ID NO: 6166372 - DNA, 14 bp, Homo sapiens
ctgattgtaacgtt

SEQ ID NO: 6166373 - DNA, 18 bp, Homo sapiens
ctgattgtaacgttgctg

SEQ ID NO: 6166374 - DNA, 21 bp, Homo sapiens
ctgattgtgtctcttggtcct

SEQ ID NO: 6166375 - DNA, 17 bp, Homo sapiens
ctgattgtgttgaagaa

SEQ ID NO: 6166376 - DNA, 18 bp, Homo sapiens
ctgattgtgttgaagaag

SEQ ID NO: 6166377 - DNA, 17 bp, Homo sapiens
ctgattgtttcattgcg

SEQ ID NO: 6166378 - DNA, 15 bp, Homo sapiens
ctgatttaacacttt

SEQ ID NO: 6166379 - DNA, 17 bp, Homo sapiens
ctgatttaatgttttct

SEQ ID NO: 6166380 - DNA, 18 bp, Homo sapiens
ctgatttaatgttttctg

SEQ ID NO: 6166381 - DNA, 12 bp, Homo sapiens
ctgatttacagt

SEQ ID NO: 6166382 - DNA, 19 bp, Homo sapiens
ctgatttacctcttacctg

SEQ ID NO: 6166383 - DNA, 15 bp, Homo sapiens
ctgatttagaagcaa

SEQ ID NO: 6166384 - DNA, 21 bp, Homo sapiens
ctgatttagaagcaaagattt

SEQ ID NO: 6166385 - DNA, 19 bp, Homo sapiens
ctgatttagaccaaaagat

SEQ ID NO: 6166386 - DNA, 23 bp, Homo sapiens
ctgatttagcaatgctgtgaata

SEQ ID NO: 6166387 - DNA, 20 bp, Homo sapiens
ctgatttaggagaagccagg

SEQ ID NO: 6166388 - DNA, 17 bp, Homo sapiens
ctgatttattgaaattt

SEQ ID NO: 6166389 - DNA, 22 bp, Homo sapiens
ctgatttatttctactatatac

SEQ ID NO: 6166390 - DNA, 23 bp, Homo sapiens
ctgatttattttgtatgaaatat

SEQ ID NO: 6166391 - DNA, 13 bp, Homo sapiens
ctgatttcaaggc

SEQ ID NO: 6166392 - DNA, 20 bp, Homo sapiens
ctgatttcaaggtccgagct

SEQ ID NO: 6166393 - DNA, 12 bp, Homo sapiens
ctgatttcagga

SEQ ID NO: 6166394 - DNA, 14 bp, Homo sapiens
ctgatttcagggaa

SEQ ID NO: 6166395 - DNA, 16 bp, Homo sapiens
ctgatttcagtttttc

SEQ ID NO: 6166396 - DNA, 18 bp, Homo sapiens
ctgatttcagtttttcat

SEQ ID NO: 6166397 - DNA, 15 bp, Homo sapiens
ctgatttcattcctc

SEQ ID NO: 6166398 - DNA, 13 bp, Homo sapiens
ctgatttccaggc

SEQ ID NO: 6166399 - DNA, 14 bp, Homo sapiens
ctgatttccaggcc

SEQ ID NO: 6166400 - DNA, 15 bp, Homo sapiens
ctgatttccaggccc

SEQ ID NO: 6166401 - DNA, 18 bp, Homo sapiens
ctgatttccccttttgca

SEQ ID NO: 6166402 - DNA, 19 bp, Homo sapiens
ctgatttccccttttgcat

SEQ ID NO: 6166403 - DNA, 20 bp, Homo sapiens
ctgatttctacaactggagt

SEQ ID NO: 6166404 - DNA, 16 bp, Homo sapiens
ctgatttctatggctt

SEQ ID NO: 6166405 - DNA, 19 bp, Homo sapiens
ctgatttctatggctttca

SEQ ID NO: 6166406 - DNA, 21 bp, Homo sapiens
ctgatttctatggctttcaaa

SEQ ID NO: 6166407 - DNA, 14 bp, Homo sapiens
ctgatttctctgaa

SEQ ID NO: 6166408 - DNA, 23 bp, Homo sapiens
ctgatttctctgaacagaaaaca

SEQ ID NO: 6166409 - DNA, 12 bp, Homo sapiens
ctgatttctgaa

SEQ ID NO: 6166410 - DNA, 22 bp, Homo sapiens
ctgatttgacatagtctggctg

SEQ ID NO: 6166411 - DNA, 16 bp, Homo sapiens
ctgatttgcaaatgca

SEQ ID NO: 6166412 - DNA, 17 bp, Homo sapiens
ctgatttgcaaatgcac

SEQ ID NO: 6166413 - DNA, 11 bp, Homo sapiens
ctgatttgcag

SEQ ID NO: 6166414 - DNA, 16 bp, Homo sapiens
ctgatttgcaggattt

SEQ ID NO: 6166415 - DNA, 19 bp, Homo sapiens
ctgatttgcaggattttta

SEQ ID NO: 6166416 - DNA, 22 bp, Homo sapiens
ctgatttgccactgatattcag

SEQ ID NO: 6166417 - DNA, 11 bp, Homo sapiens
ctgatttgctg

SEQ ID NO: 6166418 - DNA, 17 bp, Homo sapiens
ctgatttgctgctcttc

SEQ ID NO: 6166419 - DNA, 19 bp, Homo sapiens
ctgatttggagtgagccag

SEQ ID NO: 6166420 - DNA, 23 bp, Homo sapiens
ctgatttgggctgaatgtatgta

SEQ ID NO: 6166421 - DNA, 23 bp, Homo sapiens
ctgatttggtacttttgagtgtg

SEQ ID NO: 6166422 - DNA, 20 bp, Homo sapiens
ctgatttggtcaccttcctc

SEQ ID NO: 6166423 - DNA, 19 bp, Homo sapiens
ctgatttgtaacccactga

SEQ ID NO: 6166424 - DNA, 14 bp, Homo sapiens
ctgatttgtattaa

SEQ ID NO: 6166425 - DNA, 14 bp, Homo sapiens
ctgatttgtcctgc

SEQ ID NO: 6166426 - DNA, 23 bp, Homo sapiens
ctgatttgttttcattatagaca

SEQ ID NO: 6166427 - DNA, 23 bp, Homo sapiens
ctgattttaaaaggttgactcaa

SEQ ID NO: 6166428 - DNA, 19 bp, Homo sapiens
ctgattttaaaggcagaga

SEQ ID NO: 6166429 - DNA, 15 bp, Homo sapiens
ctgattttaaatgca

SEQ ID NO: 6166430 - DNA, 12 bp, Homo sapiens
ctgattttaaca

SEQ ID NO: 6166431 - DNA, 17 bp, Homo sapiens
ctgattttaacaataac

SEQ ID NO: 6166432 - DNA, 22 bp, Homo sapiens
ctgattttaatggattgttaat

SEQ ID NO: 6166433 - DNA, 20 bp, Homo sapiens
ctgattttacaaattaatat

SEQ ID NO: 6166434 - DNA, 21 bp, Homo sapiens
ctgattttaggagctaaggct

SEQ ID NO: 6166435 - DNA, 23 bp, Homo sapiens
ctgattttaggagctaaggctct

SEQ ID NO: 6166436 - DNA, 12 bp, Homo sapiens
ctgattttattc

SEQ ID NO: 6166437 - DNA, 17 bp, Homo sapiens
ctgattttattcttgat

SEQ ID NO: 6166438 - DNA, 14 bp, Homo sapiens
ctgattttcaaaaa

SEQ ID NO: 6166439 - DNA, 18 bp, Homo sapiens
ctgattttcaaagctttt

SEQ ID NO: 6166440 - DNA, 14 bp, Homo sapiens
ctgattttctcact

SEQ ID NO: 6166441 - DNA, 20 bp, Homo sapiens
ctgattttctcactgaactc

SEQ ID NO: 6166442 - DNA, 23 bp, Homo sapiens
ctgattttctccacaacactgtg

SEQ ID NO: 6166443 - DNA, 16 bp, Homo sapiens
ctgattttcttctttc

SEQ ID NO: 6166444 - DNA, 19 bp, Homo sapiens
ctgattttgaccttgtatt

SEQ ID NO: 6166445 - DNA, 13 bp, Homo sapiens
ctgattttgtatg

SEQ ID NO: 6166446 - DNA, 14 bp, Homo sapiens
ctgattttgtatgt

SEQ ID NO: 6166447 - DNA, 19 bp, Homo sapiens
ctgattttgtatgtaaata

SEQ ID NO: 6166448 - DNA, 14 bp, Homo sapiens
ctgatttttccttt

SEQ ID NO: 6166449 - DNA, 14 bp, Homo sapiens
ctgatttttctctt

SEQ ID NO: 6166450 - DNA, 15 bp, Homo sapiens
ctgatttttctcttt

SEQ ID NO: 6166451 - DNA, 21 bp, Homo sapiens
ctgatttttctcttttttaaa

SEQ ID NO: 6166452 - DNA, 23 bp, Homo sapiens
ctgattttttactggctgtgtga

SEQ ID NO: 6166453 - DNA, 17 bp, Homo sapiens
ctgattttttttttaac

SEQ ID NO: 6166454 - DNA, 16 bp, Homo sapiens
ctgcaaaaagtacata

SEQ ID NO: 6166455 - DNA, 15 bp, Homo sapiens
ctgcaaaaatattta

SEQ ID NO: 6166456 - DNA, 13 bp, Homo sapiens
ctgcaaaaatgag

SEQ ID NO: 6166457 - DNA, 16 bp, Homo sapiens
ctgcaaaaatgagttg

SEQ ID NO: 6166458 - DNA, 21 bp, Homo sapiens
ctgcaaaaatggatattatta

SEQ ID NO: 6166459 - DNA, 14 bp, Homo sapiens
ctgcaaaaccaggt

SEQ ID NO: 6166460 - DNA, 16 bp, Homo sapiens
ctgcaaaaccaggttt

SEQ ID NO: 6166461 - DNA, 19 bp, Homo sapiens
ctgcaaaaggcctcttgta

SEQ ID NO: 6166462 - DNA, 21 bp, Homo sapiens
ctgcaaaaggcctgtgatcca

SEQ ID NO: 6166463 - DNA, 22 bp, Homo sapiens
ctgcaaaaggcctgtgatccag

SEQ ID NO: 6166464 - DNA, 22 bp, Homo sapiens
ctgcaaaatacattattcttct

SEQ ID NO: 6166465 - DNA, 12 bp, Homo sapiens
ctgcaaaataga

SEQ ID NO: 6166466 - DNA, 16 bp, Homo sapiens
ctgcaaaatgaagaca

SEQ ID NO: 6166467 - DNA, 14 bp, Homo sapiens
ctgcaaaatgagac

SEQ ID NO: 6166468 - DNA, 16 bp, Homo sapiens
ctgcaaaatgtagaaa

SEQ ID NO: 6166469 - DNA, 17 bp, Homo sapiens
ctgcaaaatgtagaaat

SEQ ID NO: 6166470 - DNA, 23 bp, Homo sapiens
ctgcaaaatttgatgccaggaca

SEQ ID NO: 6166471 - DNA, 18 bp, Homo sapiens
ctgcaaacaaacaccttc

SEQ ID NO: 6166472 - DNA, 14 bp, Homo sapiens
ctgcaaacacacct

SEQ ID NO: 6166473 - DNA, 14 bp, Homo sapiens
ctgcaaacagaaca

SEQ ID NO: 6166474 - DNA, 20 bp, Homo sapiens
ctgcaaacattgtacatcca

SEQ ID NO: 6166475 - DNA, 15 bp, Homo sapiens
ctgcaaaccctgctg

SEQ ID NO: 6166476 - DNA, 18 bp, Homo sapiens
ctgcaaacctgctggtgg

SEQ ID NO: 6166477 - DNA, 15 bp, Homo sapiens
ctgcaaaccttcctg

SEQ ID NO: 6166478 - DNA, 13 bp, Homo sapiens
ctgcaaactggga

SEQ ID NO: 6166479 - DNA, 21 bp, Homo sapiens
ctgcaaactgggaaccccttt

SEQ ID NO: 6166480 - DNA, 23 bp, Homo sapiens
ctgcaaactgggaacccctttcc

SEQ ID NO: 6166481 - DNA, 12 bp, Homo sapiens
ctgcaaagacag

SEQ ID NO: 6166482 - DNA, 16 bp, Homo sapiens
ctgcaaagacagtatt

SEQ ID NO: 6166483 - DNA, 15 bp, Homo sapiens
ctgcaaagagaaacc

SEQ ID NO: 6166484 - DNA, 13 bp, Homo sapiens
ctgcaaagcccag

SEQ ID NO: 6166485 - DNA, 15 bp, Homo sapiens
ctgcaaagcccagct

SEQ ID NO: 6166486 - DNA, 18 bp, Homo sapiens
ctgcaaagcccagcttga

SEQ ID NO: 6166487 - DNA, 16 bp, Homo sapiens
ctgcaaagctttggct

SEQ ID NO: 6166488 - DNA, 22 bp, Homo sapiens
ctgcaaagctttggctgagacc

SEQ ID NO: 6166489 - DNA, 16 bp, Homo sapiens
ctgcaaaggacagatc

SEQ ID NO: 6166490 - DNA, 19 bp, Homo sapiens
ctgcaaaggacagtgggca

SEQ ID NO: 6166491 - DNA, 13 bp, Homo sapiens
ctgcaaaggaggg

SEQ ID NO: 6166492 - DNA, 19 bp, Homo sapiens
ctgcaaaggagggcctcag

SEQ ID NO: 6166493 - DNA, 15 bp, Homo sapiens
ctgcaaaggcccttg

SEQ ID NO: 6166494 - DNA, 19 bp, Homo sapiens
ctgcaaagggaactgaaga

SEQ ID NO: 6166495 - DNA, 20 bp, Homo sapiens
ctgcaaaggtggcaatgctt

SEQ ID NO: 6166496 - DNA, 16 bp, Homo sapiens
ctgcaaagtcgccagt

SEQ ID NO: 6166497 - DNA, 20 bp, Homo sapiens
ctgcaaagtgattcactgtg

SEQ ID NO: 6166498 - DNA, 16 bp, Homo sapiens
ctgcaaagtgcaaata

SEQ ID NO: 6166499 - DNA, 18 bp, Homo sapiens
ctgcaaagtggcagggac

SEQ ID NO: 6166500 - DNA, 20 bp, Homo sapiens
ctgcaaagtggcagggaccg

SEQ ID NO: 6166501 - DNA, 19 bp, Homo sapiens
ctgcaaagtgtatgcagta

SEQ ID NO: 6166502 - DNA, 20 bp, Homo sapiens
ctgcaaataaggacagcagc

SEQ ID NO: 6166503 - DNA, 21 bp, Homo sapiens
ctgcaaatcagccatgtgctg

SEQ ID NO: 6166504 - DNA, 18 bp, Homo sapiens
ctgcaaatcaggcttttg

SEQ ID NO: 6166505 - DNA, 16 bp, Homo sapiens
ctgcaaatccttgtgg

SEQ ID NO: 6166506 - DNA, 19 bp, Homo sapiens
ctgcaaatccttgtgggaa

SEQ ID NO: 6166507 - DNA, 20 bp, Homo sapiens
ctgcaaatctgatggcctta

SEQ ID NO: 6166508 - DNA, 19 bp, Homo sapiens
ctgcaaattgtagcccagt

SEQ ID NO: 6166509 - DNA, 14 bp, Homo sapiens
ctgcaaatttagtt

SEQ ID NO: 6166510 - DNA, 20 bp, Homo sapiens
ctgcaaatttagtttgttaa

SEQ ID NO: 6166511 - DNA, 22 bp, Homo sapiens
ctgcaaatttagtttgttaaag

SEQ ID NO: 6166512 - DNA, 15 bp, Homo sapiens
ctgcaacaacctttc

SEQ ID NO: 6166513 - DNA, 21 bp, Homo sapiens
ctgcaacaacgcctggtgccc

SEQ ID NO: 6166514 - DNA, 21 bp, Homo sapiens
ctgcaacaagctcatccctgg

SEQ ID NO: 6166515 - DNA, 16 bp, Homo sapiens
ctgcaacacaacattt

SEQ ID NO: 6166516 - DNA, 18 bp, Homo sapiens
ctgcaacagagagaaaaa

SEQ ID NO: 6166517 - DNA, 20 bp, Homo sapiens
ctgcaacaggaactgtgaga

SEQ ID NO: 6166518 - DNA, 12 bp, Homo sapiens
ctgcaacaggct

SEQ ID NO: 6166519 - DNA, 14 bp, Homo sapiens
ctgcaaccactctg

SEQ ID NO: 6166520 - DNA, 22 bp, Homo sapiens
ctgcaacccatgagcgtccagg

SEQ ID NO: 6166521 - DNA, 13 bp, Homo sapiens
ctgcaacctccac

SEQ ID NO: 6166522 - DNA, 16 bp, Homo sapiens
ctgcaacctccacctc

SEQ ID NO: 6166523 - DNA, 19 bp, Homo sapiens
ctgcaacctccacctcctg

SEQ ID NO: 6166524 - DNA, 13 bp, Homo sapiens
ctgcaacctccgc

SEQ ID NO: 6166525 - DNA, 22 bp, Homo sapiens
ctgcaacctccgcctctcaggt

SEQ ID NO: 6166526 - DNA, 20 bp, Homo sapiens
ctgcaacctccgcctcttgg

SEQ ID NO: 6166527 - DNA, 14 bp, Homo sapiens
ctgcaacctctgcc

SEQ ID NO: 6166528 - DNA, 19 bp, Homo sapiens
ctgcaacctctgcctcctg

SEQ ID NO: 6166529 - DNA, 19 bp, Homo sapiens
ctgcaacctcttcctcctg

SEQ ID NO: 6166530 - DNA, 22 bp, Homo sapiens
ctgcaaccttcgccacctgggt

SEQ ID NO: 6166531 - DNA, 23 bp, Homo sapiens
ctgcaacgctgattcctaaggcc

SEQ ID NO: 6166532 - DNA, 13 bp, Homo sapiens
ctgcaactagcca

SEQ ID NO: 6166533 - DNA, 15 bp, Homo sapiens
ctgcaactagccaag

SEQ ID NO: 6166534 - DNA, 18 bp, Homo sapiens
ctgcaactagccaaggct

SEQ ID NO: 6166535 - DNA, 23 bp, Homo sapiens
ctgcaactcaaggactttgcagc

SEQ ID NO: 6166536 - DNA, 23 bp, Homo sapiens
ctgcaactccatcctcctgtgtc

SEQ ID NO: 6166537 - DNA, 18 bp, Homo sapiens
ctgcaacttccgctgagg

SEQ ID NO: 6166538 - DNA, 13 bp, Homo sapiens
ctgcaacttctat

SEQ ID NO: 6166539 - DNA, 21 bp, Homo sapiens
ctgcaacttctatcctttctt

SEQ ID NO: 6166540 - DNA, 14 bp, Homo sapiens
ctgcaacttctgtc

SEQ ID NO: 6166541 - DNA, 16 bp, Homo sapiens
ctgcaacttctgtccc

SEQ ID NO: 6166542 - DNA, 15 bp, Homo sapiens
ctgcaacttgtgaac

SEQ ID NO: 6166543 - DNA, 23 bp, Homo sapiens
cttaaacaaaaactttccatgac

SEQ ID NO: 6166544 - DNA, 16 bp, Homo sapiens
cttaaacaaagtgact

SEQ ID NO: 6166545 - DNA, 21 bp, Homo sapiens
cttaaacaacacctcctcctg

SEQ ID NO: 6166546 - DNA, 21 bp, Homo sapiens
cttaaacaattcttgtaactt

SEQ ID NO: 6166547 - DNA, 17 bp, Homo sapiens
cttaaacacaggctgtc

SEQ ID NO: 6166548 - DNA, 21 bp, Homo sapiens
cttaaacacaggctgtcctta

SEQ ID NO: 6166549 - DNA, 23 bp, Homo sapiens
cttaaacattttttgtttcttgg

SEQ ID NO: 6166550 - DNA, 22 bp, Homo sapiens
cttaaaccacacacacaaggtg

SEQ ID NO: 6166551 - DNA, 18 bp, Homo sapiens
cttaaacccacataaaca

SEQ ID NO: 6166552 - DNA, 16 bp, Homo sapiens
cttaaacccatacaat

SEQ ID NO: 6166553 - DNA, 19 bp, Homo sapiens
cttaaacccatacaatgta

SEQ ID NO: 6166554 - DNA, 20 bp, Homo sapiens
cttaaacccatacaatgtat

SEQ ID NO: 6166555 - DNA, 22 bp, Homo sapiens
cttaaacctcctgctgtgcctc

SEQ ID NO: 6166556 - DNA, 19 bp, Homo sapiens
cttaaacctgaagatgtct

SEQ ID NO: 6166557 - DNA, 22 bp, Homo sapiens
cttaaacctgtgctttcatgtt

SEQ ID NO: 6166558 - DNA, 15 bp, Homo sapiens
cttaaaccttcagtt

SEQ ID NO: 6166559 - DNA, 16 bp, Homo sapiens
cttaaactaaataatg

SEQ ID NO: 6166560 - DNA, 16 bp, Homo sapiens
cttaaactctggacac

SEQ ID NO: 6166561 - DNA, 15 bp, Homo sapiens
cttaaactcttgaat

SEQ ID NO: 6166562 - DNA, 19 bp, Homo sapiens
cttaaactgaaagctttaa

SEQ ID NO: 6166563 - DNA, 16 bp, Homo sapiens
cttaaactgttcttca

SEQ ID NO: 6166564 - DNA, 14 bp, Homo sapiens
cttaaacttgtgaa

SEQ ID NO: 6166565 - DNA, 15 bp, Homo sapiens
cttaaacttgtgaat

SEQ ID NO: 6166566 - DNA, 20 bp, Homo sapiens
cttaaactttgtcacttctg

SEQ ID NO: 6166567 - DNA, 21 bp, Homo sapiens
cttaaactttgtcacttctgc

SEQ ID NO: 6166568 - DNA, 23 bp, Homo sapiens
cttaaagaaacagctttcaagtg

SEQ ID NO: 6166569 - DNA, 21 bp, Homo sapiens
cttaaagaaagtcgaattaat

SEQ ID NO: 6166570 - DNA, 22 bp, Homo sapiens
cttaaagaaagtcgaattaata

SEQ ID NO: 6166571 - DNA, 17 bp, Homo sapiens
cttaaagaattcaaatt

SEQ ID NO: 6166572 - DNA, 16 bp, Homo sapiens
cttaaagaatttgaaa

SEQ ID NO: 6166573 - DNA, 15 bp, Homo sapiens
cttaaagagggacag

SEQ ID NO: 6166574 - DNA, 12 bp, Homo sapiens
cttaaagcaaaa

SEQ ID NO: 6166575 - DNA, 15 bp, Homo sapiens
cttaaagcaaaatag

SEQ ID NO: 6166576 - DNA, 19 bp, Homo sapiens
cttaaagcaaaatagtatt

SEQ ID NO: 6166577 - DNA, 20 bp, Homo sapiens
cttaaagcaaaatagtattg

SEQ ID NO: 6166578 - DNA, 18 bp, Homo sapiens
cttaaagcaaagtcactt

SEQ ID NO: 6166579 - DNA, 15 bp, Homo sapiens
cttaaagcaataagt

SEQ ID NO: 6166580 - DNA, 23 bp, Homo sapiens
cttaaagcaataagttcattaaa

SEQ ID NO: 6166581 - DNA, 13 bp, Homo sapiens
cttaaagcagaag

SEQ ID NO: 6166582 - DNA, 13 bp, Homo sapiens
cttaaagccccct

SEQ ID NO: 6166583 - DNA, 22 bp, Homo sapiens
cttaaagcccccttctccatgg

SEQ ID NO: 6166584 - DNA, 19 bp, Homo sapiens
cttaaagctactgtagaaa

SEQ ID NO: 6166585 - DNA, 18 bp, Homo sapiens
cttaaagctgcctgtagt

SEQ ID NO: 6166586 - DNA, 14 bp, Homo sapiens
cttaaagcttccct

SEQ ID NO: 6166587 - DNA, 21 bp, Homo sapiens
cttaaagcttgatttgatctt

SEQ ID NO: 6166588 - DNA, 13 bp, Homo sapiens
cttaaagcttgtt

SEQ ID NO: 6166589 - DNA, 23 bp, Homo sapiens
cttaaaggaaaagtcaacatctt

SEQ ID NO: 6166590 - DNA, 12 bp, Homo sapiens
cttaaaggacat

SEQ ID NO: 6166591 - DNA, 15 bp, Homo sapiens
cttaaaggacataaa

SEQ ID NO: 6166592 - DNA, 20 bp, Homo sapiens
cttaaaggccgtcatttcat

SEQ ID NO: 6166593 - DNA, 16 bp, Homo sapiens
cttaaaggcctggaac

SEQ ID NO: 6166594 - DNA, 16 bp, Homo sapiens
cttaaagtgaaggaaa

SEQ ID NO: 6166595 - DNA, 13 bp, Homo sapiens
cttaaagttgaat

SEQ ID NO: 6166596 - DNA, 15 bp, Homo sapiens
cttaaagttgaattt

SEQ ID NO: 6166597 - DNA, 18 bp, Homo sapiens
cttaaagttgacatttaa

SEQ ID NO: 6166598 - DNA, 22 bp, Homo sapiens
cttaaagttgattttgaacttt

SEQ ID NO: 6166599 - DNA, 10 bp, Homo sapiens
cttaaataaa

SEQ ID NO: 6166600 - DNA, 18 bp, Homo sapiens
cttaaataaaaataatag

SEQ ID NO: 6166601 - DNA, 12 bp, Homo sapiens
cttaaataaatc

SEQ ID NO: 6166602 - DNA, 20 bp, Homo sapiens
cttaaataatgcttcagata

SEQ ID NO: 6166603 - DNA, 14 bp, Homo sapiens
cttaaataatgtga

SEQ ID NO: 6166604 - DNA, 12 bp, Homo sapiens
cttaaataattt

SEQ ID NO: 6166605 - DNA, 20 bp, Homo sapiens
cttaaatacactgaattgaa

SEQ ID NO: 6166606 - DNA, 18 bp, Homo sapiens
cttaaatacgttgttaaa

SEQ ID NO: 6166607 - DNA, 20 bp, Homo sapiens
cttaaatagctttgagattt

SEQ ID NO: 6166608 - DNA, 15 bp, Homo sapiens
cttaaatatagcagt

SEQ ID NO: 6166609 - DNA, 14 bp, Homo sapiens
cttaaatatgaatt

SEQ ID NO: 6166610 - DNA, 16 bp, Homo sapiens
cttaaatattgtaata

SEQ ID NO: 6166611 - DNA, 23 bp, Homo sapiens
cttaaatattgtaatatgacaga

SEQ ID NO: 6166612 - DNA, 13 bp, Homo sapiens
cttaaatatttcc

SEQ ID NO: 6166613 - DNA, 14 bp, Homo sapiens
cttaaatatttgaa

SEQ ID NO: 6166614 - DNA, 13 bp, Homo sapiens
cttaaatatttgt

SEQ ID NO: 6166615 - DNA, 13 bp, Homo sapiens
cttaaatcactga

SEQ ID NO: 6166616 - DNA, 16 bp, Homo sapiens
cttaaatcagaataaa

SEQ ID NO: 6166617 - DNA, 19 bp, Homo sapiens
cttaaatcagaataaatta

SEQ ID NO: 6166618 - DNA, 13 bp, Homo sapiens
cttaaatcagttt

SEQ ID NO: 6166619 - DNA, 23 bp, Homo sapiens
cttaaatcagtttattaaatctg

SEQ ID NO: 6166620 - DNA, 23 bp, Homo sapiens
cttaaatcgaggcagaaagatac

SEQ ID NO: 6166621 - DNA, 19 bp, Homo sapiens
cttaaatctcttaaactct

SEQ ID NO: 6166622 - DNA, 13 bp, Homo sapiens
cttaaatctttct

SEQ ID NO: 6166623 - DNA, 11 bp, Homo sapiens
cttaaatgaac

SEQ ID NO: 6166624 - DNA, 16 bp, Homo sapiens
cttaaatgagaaggaa

SEQ ID NO: 6166625 - DNA, 13 bp, Homo sapiens
cttaaatgcaata

SEQ ID NO: 6166626 - DNA, 20 bp, Homo sapiens
cttaaatgctcattttctgg

SEQ ID NO: 6166627 - DNA, 12 bp, Homo sapiens
cttaaatgtgaa

SEQ ID NO: 6166628 - DNA, 16 bp, Homo sapiens
cttaaatgtgaattac

SEQ ID NO: 6166629 - DNA, 14 bp, Homo sapiens
cttaaatgtttata

SEQ ID NO: 6166630 - DNA, 16 bp, Homo sapiens
cttaaatgtttatact

SEQ ID NO: 6166631 - DNA, 21 bp, Homo sapiens
cttaaattaaacaatttattt

SEQ ID NO: 6166632 - DNA, 18 bp, Homo sapiens
cttaaattatatatttat

SEQ ID NO: 6166633 - DNA, 17 bp, Homo sapiens
cttaaattatgttttaa

SEQ ID NO: 6166634 - DNA, 19 bp, Homo sapiens
cttaaattcatttctagac

SEQ ID NO: 6166635 - DNA, 20 bp, Homo sapiens
cttaaattcatttctagact

SEQ ID NO: 6166636 - DNA, 14 bp, Homo sapiens
cttaaattcctcaa

SEQ ID NO: 6166637 - DNA, 22 bp, Homo sapiens
cttaaattcctcaacagtgttt

SEQ ID NO: 6166638 - DNA, 23 bp, Homo sapiens
cttaaattgggttcatgatgcag

SEQ ID NO: 6166639 - DNA, 12 bp, Homo sapiens
cttaaatttaat

SEQ ID NO: 6166640 - DNA, 16 bp, Homo sapiens
cttaaatttcagaatt

SEQ ID NO: 6166641 - DNA, 13 bp, Homo sapiens
cttaaatttctaa

SEQ ID NO: 6166642 - DNA, 20 bp, Homo sapiens
cttaaatttctaaaaacagt

SEQ ID NO: 6166643 - DNA, 13 bp, Homo sapiens
cttaaatttctta

SEQ ID NO: 6166644 - DNA, 20 bp, Homo sapiens
cttaaatttcttatgtgaca

SEQ ID NO: 6166645 - DNA, 23 bp, Homo sapiens
cttaaatttgggttgcaaagcta

SEQ ID NO: 6166646 - DNA, 16 bp, Homo sapiens
cttaaatttgttcttt

SEQ ID NO: 6166647 - DNA, 18 bp, Homo sapiens
cttaaattttaaagcctg

SEQ ID NO: 6166648 - DNA, 23 bp, Homo sapiens
cttaaattttaactaaattttaa

SEQ ID NO: 6166649 - DNA, 17 bp, Homo sapiens
cttaaattttaatttat

SEQ ID NO: 6166650 - DNA, 23 bp, Homo sapiens
cttaaattttatatcattttaaa

SEQ ID NO: 6166651 - DNA, 16 bp, Homo sapiens
cttaaattttcttcct

SEQ ID NO: 6166652 - DNA, 20 bp, Homo sapiens
cttaaattttcttcctttga

SEQ ID NO: 6166653 - DNA, 16 bp, Homo sapiens
cttaaatttttgtcat

SEQ ID NO: 6166654 - DNA, 15 bp, Homo sapiens
cttaacaaaccaaca

SEQ ID NO: 6166655 - DNA, 19 bp, Homo sapiens
cttaacaaaccaacatctt

SEQ ID NO: 6166656 - DNA, 19 bp, Homo sapiens
cttaacaaaccctcgtttc

SEQ ID NO: 6166657 - DNA, 12 bp, Homo sapiens
cttaacaaatac

SEQ ID NO: 6166658 - DNA, 22 bp, Homo sapiens
cttaacaactgactaaccattg

SEQ ID NO: 6166659 - DNA, 15 bp, Homo sapiens
cttaacacactggcc

SEQ ID NO: 6166660 - DNA, 20 bp, Homo sapiens
cttaacactaccaatttccc

SEQ ID NO: 6166661 - DNA, 14 bp, Homo sapiens
cttaacagctgtat

SEQ ID NO: 6166662 - DNA, 20 bp, Homo sapiens
cttaacatagccaaaatgtg

SEQ ID NO: 6166663 - DNA, 18 bp, Homo sapiens
cttaacatggaagatatt

SEQ ID NO: 6166664 - DNA, 13 bp, Homo sapiens
cttaacatgggct

SEQ ID NO: 6166665 - DNA, 23 bp, Homo sapiens
cttaacattaagtattccttggc

SEQ ID NO: 6166666 - DNA, 17 bp, Homo sapiens
cttaacattctgtaaaa

SEQ ID NO: 6166667 - DNA, 15 bp, Homo sapiens
cttaacatttcatgt

SEQ ID NO: 6166668 - DNA, 15 bp, Homo sapiens
cttaacatttctctc

SEQ ID NO: 6166669 - DNA, 14 bp, Homo sapiens
cttaaccaataatg

SEQ ID NO: 6166670 - DNA, 21 bp, Homo sapiens
cttaaccaccccataccagtc

SEQ ID NO: 6166671 - DNA, 20 bp, Homo sapiens
cttaaccaccgcatatgcat

SEQ ID NO: 6166672 - DNA, 12 bp, Homo sapiens
cttaaccagcac

SEQ ID NO: 6166673 - DNA, 16 bp, Homo sapiens
cttaacccaaggagca

SEQ ID NO: 6166674 - DNA, 20 bp, Homo sapiens
cttaacccccatttttgtaa

SEQ ID NO: 6166675 - DNA, 22 bp, Homo sapiens
cttaacccccatttttgtaata

SEQ ID NO: 6166676 - DNA, 14 bp, Homo sapiens
cttaacccctaaga

SEQ ID NO: 6166677 - DNA, 19 bp, Homo sapiens
cttaacccctaagactgcc

SEQ ID NO: 6166678 - DNA, 22 bp, Homo sapiens
cttaacccctaagactgccttc

SEQ ID NO: 6166679 - DNA, 23 bp, Homo sapiens
cttaaccctgaacaagagtgtct

SEQ ID NO: 6166680 - DNA, 23 bp, Homo sapiens
cttaaccgaagaactaataaatg

SEQ ID NO: 6166681 - DNA, 16 bp, Homo sapiens
cttaaccgcatcagaa

SEQ ID NO: 6166682 - DNA, 21 bp, Homo sapiens
cttaacctactaatagtttgt

SEQ ID NO: 6166683 - DNA, 12 bp, Homo sapiens
cttaacctcagg

SEQ ID NO: 6166684 - DNA, 19 bp, Homo sapiens
cttaaccttcaaatacatt

SEQ ID NO: 6166685 - DNA, 18 bp, Homo sapiens
cttaacctttaagtctta

SEQ ID NO: 6166686 - DNA, 18 bp, Homo sapiens
cttaacctttattaaaac

SEQ ID NO: 6166687 - DNA, 13 bp, Homo sapiens
cttaacctttgct

SEQ ID NO: 6166688 - DNA, 16 bp, Homo sapiens
cttaacggctccagga

SEQ ID NO: 6166689 - DNA, 21 bp, Homo sapiens
cttaacgttctataaatgaat

SEQ ID NO: 6166690 - DNA, 15 bp, Homo sapiens
cttaacgttttctta

SEQ ID NO: 6166691 - DNA, 14 bp, Homo sapiens
cttaactaagactc

SEQ ID NO: 6166692 - DNA, 20 bp, Homo sapiens
cttaactaagactcccgccc

SEQ ID NO: 6166693 - DNA, 16 bp, Homo sapiens
cttaactaatgtaaat

SEQ ID NO: 6166694 - DNA, 15 bp, Homo sapiens
cttaactaatttgaa

SEQ ID NO: 6166695 - DNA, 12 bp, Homo sapiens
cttaactacttt

SEQ ID NO: 6166696 - DNA, 19 bp, Homo sapiens
cttaactataaggtgcctc

SEQ ID NO: 6166697 - DNA, 16 bp, Homo sapiens
cttaactatctgttcc

SEQ ID NO: 6166698 - DNA, 11 bp, Homo sapiens
cttaactattc

SEQ ID NO: 6166699 - DNA, 16 bp, Homo sapiens
cttaactatttcacat

SEQ ID NO: 6166700 - DNA, 17 bp, Homo sapiens
cttaactccttccagtg

SEQ ID NO: 6166701 - DNA, 16 bp, Homo sapiens
cttaactctcaagcta

SEQ ID NO: 6166702 - DNA, 21 bp, Homo sapiens
cttaactctttgcctttgcca

SEQ ID NO: 6166703 - DNA, 12 bp, Homo sapiens
cttaactgaaat

SEQ ID NO: 6166704 - DNA, 21 bp, Homo sapiens
cttaactggactgaattcaaa

SEQ ID NO: 6166705 - DNA, 17 bp, Homo sapiens
cttaactggcccagaag

SEQ ID NO: 6166706 - DNA, 14 bp, Homo sapiens
cttaactggccctc

SEQ ID NO: 6166707 - DNA, 13 bp, Homo sapiens
cttaactggctgt

SEQ ID NO: 6166708 - DNA, 17 bp, Homo sapiens
cttaactgtgtgaagaa

SEQ ID NO: 6166709 - DNA, 16 bp, Homo sapiens
cttaactgttgttgac

SEQ ID NO: 6166710 - DNA, 15 bp, Homo sapiens
cttaacttcacatat

SEQ ID NO: 6166711 - DNA, 22 bp, Homo sapiens
cttaacttcacatattgatttc

SEQ ID NO: 6166712 - DNA, 20 bp, Homo sapiens
cttaacttccatgttctggg

SEQ ID NO: 6166713 - DNA, 21 bp, Homo sapiens
cttaacttccatgttctgggt

SEQ ID NO: 6166714 - DNA, 23 bp, Homo sapiens
cttaacttccatgttctgggtga

SEQ ID NO: 6166715 - DNA, 18 bp, Homo sapiens
cttaacttcttgcttctt

SEQ ID NO: 6166716 - DNA, 13 bp, Homo sapiens
cttaactttaact

SEQ ID NO: 6166717 - DNA, 13 bp, Homo sapiens
cttaactttataa

SEQ ID NO: 6166718 - DNA, 20 bp, Homo sapiens
cttaactttcccatggtcaa

SEQ ID NO: 6166719 - DNA, 13 bp, Homo sapiens
cttaacttttcct

SEQ ID NO: 6166720 - DNA, 19 bp, Homo sapiens
cttaagaaagctatatatg

SEQ ID NO: 6166721 - DNA, 22 bp, Homo sapiens
cttaagaaagctatatatgaat

SEQ ID NO: 6166722 - DNA, 21 bp, Homo sapiens
ctgcaactttaagcagctctt

SEQ ID NO: 6166723 - DNA, 15 bp, Homo sapiens
ctgcaagaactgttt

SEQ ID NO: 6166724 - DNA, 13 bp, Homo sapiens
ctgcaagaagtct

SEQ ID NO: 6166725 - DNA, 16 bp, Homo sapiens
ctgcaagaattaaaac

SEQ ID NO: 6166726 - DNA, 17 bp, Homo sapiens
ctgcaagaattaaaact

SEQ ID NO: 6166727 - DNA, 19 bp, Homo sapiens
ctgcaagaattaaaactga

SEQ ID NO: 6166728 - DNA, 22 bp, Homo sapiens
ctgcaagaattaaaactgagtc

SEQ ID NO: 6166729 - DNA, 15 bp, Homo sapiens
ctgcaagacacaggc

SEQ ID NO: 6166730 - DNA, 18 bp, Homo sapiens
ctgcaagacacaggctca

SEQ ID NO: 6166731 - DNA, 22 bp, Homo sapiens
ctgcaagagatggaaaaaaagt

SEQ ID NO: 6166732 - DNA, 21 bp, Homo sapiens
ctgcaagagccaagttccaaa

SEQ ID NO: 6166733 - DNA, 15 bp, Homo sapiens
ctgcaagagccttgg

SEQ ID NO: 6166734 - DNA, 23 bp, Homo sapiens
ctgcaagagccttggtgtccacc

SEQ ID NO: 6166735 - DNA, 16 bp, Homo sapiens
ctgcaagaggctcctg

SEQ ID NO: 6166736 - DNA, 16 bp, Homo sapiens
ctgcaagagggggggc

SEQ ID NO: 6166737 - DNA, 22 bp, Homo sapiens
ctgcaagagtgggctttccagg

SEQ ID NO: 6166738 - DNA, 19 bp, Homo sapiens
ctgcaagattctgaaacat

SEQ ID NO: 6166739 - DNA, 15 bp, Homo sapiens
ctgcaagatttcaca

SEQ ID NO: 6166740 - DNA, 14 bp, Homo sapiens
ctgcaagcacagcc

SEQ ID NO: 6166741 - DNA, 20 bp, Homo sapiens
ctgcaagcacatctgcattt

SEQ ID NO: 6166742 - DNA, 14 bp, Homo sapiens
ctgcaagcagggct

SEQ ID NO: 6166743 - DNA, 17 bp, Homo sapiens
ctgcaagcatttttcca

SEQ ID NO: 6166744 - DNA, 20 bp, Homo sapiens
ctgcaagcatttttccatct

SEQ ID NO: 6166745 - DNA, 15 bp, Homo sapiens
ctgcaagccagggat

SEQ ID NO: 6166746 - DNA, 13 bp, Homo sapiens
ctgcaagccccag

SEQ ID NO: 6166747 - DNA, 15 bp, Homo sapiens
ctgcaagccccaggg

SEQ ID NO: 6166748 - DNA, 21 bp, Homo sapiens
ctgcaagccccagggcctggg

SEQ ID NO: 6166749 - DNA, 19 bp, Homo sapiens
ctgcaagccgactacacct

SEQ ID NO: 6166750 - DNA, 13 bp, Homo sapiens
ctgcaagcctgtc

SEQ ID NO: 6166751 - DNA, 16 bp, Homo sapiens
ctgcaagctccgcctc

SEQ ID NO: 6166752 - DNA, 17 bp, Homo sapiens
ctgcaagctccgcctcc

SEQ ID NO: 6166753 - DNA, 22 bp, Homo sapiens
ctgcaaggaagggtgggaagct

SEQ ID NO: 6166754 - DNA, 19 bp, Homo sapiens
ctgcaaggacattcttgta

SEQ ID NO: 6166755 - DNA, 17 bp, Homo sapiens
ctgcaaggattttttaa

SEQ ID NO: 6166756 - DNA, 22 bp, Homo sapiens
ctgcaaggattttttaaaaatt

SEQ ID NO: 6166757 - DNA, 23 bp, Homo sapiens
ctgcaaggattttttaaaaattg

SEQ ID NO: 6166758 - DNA, 20 bp, Homo sapiens
ctgcaaggcccacaggaggc

SEQ ID NO: 6166759 - DNA, 12 bp, Homo sapiens
ctgcaagggagt

SEQ ID NO: 6166760 - DNA, 22 bp, Homo sapiens
ctgcaagggcagaacactaacc

SEQ ID NO: 6166761 - DNA, 17 bp, Homo sapiens
ctgcaagggccagagtt

SEQ ID NO: 6166762 - DNA, 15 bp, Homo sapiens
ctgcaagggcccaga

SEQ ID NO: 6166763 - DNA, 16 bp, Homo sapiens
ctgcaaggtactctgg

SEQ ID NO: 6166764 - DNA, 13 bp, Homo sapiens
ctgcaaggtggcc

SEQ ID NO: 6166765 - DNA, 18 bp, Homo sapiens
ctgcaaggtggcctctgc

SEQ ID NO: 6166766 - DNA, 19 bp, Homo sapiens
ctgcaaggtggcctctgcc

SEQ ID NO: 6166767 - DNA, 20 bp, Homo sapiens
ctgcaaggtttaggctggtg

SEQ ID NO: 6166768 - DNA, 22 bp, Homo sapiens
ctgcaaggtttaggctggtggc

SEQ ID NO: 6166769 - DNA, 13 bp, Homo sapiens
ctgcaagtcagag

SEQ ID NO: 6166770 - DNA, 23 bp, Homo sapiens
ctgcaagtcccagggagctctgc

SEQ ID NO: 6166771 - DNA, 21 bp, Homo sapiens
ctgcaagtccttttgtaaagt

SEQ ID NO: 6166772 - DNA, 19 bp, Homo sapiens
ctgcaagtgaggtgtgtca

SEQ ID NO: 6166773 - DNA, 20 bp, Homo sapiens
ctgcaagtgcccgccctgcc

SEQ ID NO: 6166774 - DNA, 12 bp, Homo sapiens
ctgcaagtgctc

SEQ ID NO: 6166775 - DNA, 13 bp, Homo sapiens
ctgcaagtgctca

SEQ ID NO: 6166776 - DNA, 14 bp, Homo sapiens
ctgcaagtgctcag

SEQ ID NO: 6166777 - DNA, 19 bp, Homo sapiens
ctgcaagtgctcagggaaa

SEQ ID NO: 6166778 - DNA, 17 bp, Homo sapiens
ctgcaagtgtctggagc

SEQ ID NO: 6166779 - DNA, 19 bp, Homo sapiens
ctgcaagttcaagactgaa

SEQ ID NO: 6166780 - DNA, 17 bp, Homo sapiens
ctgcaagttcattttaa

SEQ ID NO: 6166781 - DNA, 15 bp, Homo sapiens
ctgcaataaaatggg

SEQ ID NO: 6166782 - DNA, 23 bp, Homo sapiens
ctgcaataaatccgcttctcctg

SEQ ID NO: 6166783 - DNA, 20 bp, Homo sapiens
ctgcaataaattatggctct

SEQ ID NO: 6166784 - DNA, 20 bp, Homo sapiens
ctgcaataacagttttaaga

SEQ ID NO: 6166785 - DNA, 21 bp, Homo sapiens
ctgcaataacagttttaagat

SEQ ID NO: 6166786 - DNA, 20 bp, Homo sapiens
ctgcaatactaattgagaaa

SEQ ID NO: 6166787 - DNA, 15 bp, Homo sapiens
ctgcaatagagactg

SEQ ID NO: 6166788 - DNA, 21 bp, Homo sapiens
ctgcaatatcaacaacaagtt

SEQ ID NO: 6166789 - DNA, 12 bp, Homo sapiens
ctgcaatatttg

SEQ ID NO: 6166790 - DNA, 18 bp, Homo sapiens
ctgcaatatttgaatttt

SEQ ID NO: 6166791 - DNA, 19 bp, Homo sapiens
ctgcaatatttgaatttta

SEQ ID NO: 6166792 - DNA, 16 bp, Homo sapiens
ctgcaatcactgtgct

SEQ ID NO: 6166793 - DNA, 18 bp, Homo sapiens
ctgcaatcactttttgga

SEQ ID NO: 6166794 - DNA, 20 bp, Homo sapiens
ctgcaatcactttttggaat

SEQ ID NO: 6166795 - DNA, 16 bp, Homo sapiens
ctgcaatcatatgtga

SEQ ID NO: 6166796 - DNA, 15 bp, Homo sapiens
ctgcaatcccagcac

SEQ ID NO: 6166797 - DNA, 15 bp, Homo sapiens
ctgcaatcctgtctt

SEQ ID NO: 6166798 - DNA, 13 bp, Homo sapiens
ctgcaatctccag

SEQ ID NO: 6166799 - DNA, 17 bp, Homo sapiens
ctgcaatctccagggct

SEQ ID NO: 6166800 - DNA, 14 bp, Homo sapiens
ctgcaatctgggtg

SEQ ID NO: 6166801 - DNA, 21 bp, Homo sapiens
ctgcaatgactgtggagttcc

SEQ ID NO: 6166802 - DNA, 15 bp, Homo sapiens
ctgcaatgagccatg

SEQ ID NO: 6166803 - DNA, 22 bp, Homo sapiens
ctgcaatgccagtcctgcagga

SEQ ID NO: 6166804 - DNA, 14 bp, Homo sapiens
ctgcaatgccctca

SEQ ID NO: 6166805 - DNA, 19 bp, Homo sapiens
ctgcaatgcgtcttgtgaa

SEQ ID NO: 6166806 - DNA, 21 bp, Homo sapiens
ctgcaatgggcactgggatga

SEQ ID NO: 6166807 - DNA, 18 bp, Homo sapiens
ctgcaatgtttttgtgta

SEQ ID NO: 6166808 - DNA, 16 bp, Homo sapiens
ctgcaattcccctctg

SEQ ID NO: 6166809 - DNA, 20 bp, Homo sapiens
ctgcaattcccctctgctgc

SEQ ID NO: 6166810 - DNA, 16 bp, Homo sapiens
ctgcaattgcttagga

SEQ ID NO: 6166811 - DNA, 20 bp, Homo sapiens
ctgcaattgcttaggatgtt

SEQ ID NO: 6166812 - DNA, 15 bp, Homo sapiens
ctgcaatttctacta

SEQ ID NO: 6166813 - DNA, 12 bp, Homo sapiens
ctgcaattttac

SEQ ID NO: 6166814 - DNA, 13 bp, Homo sapiens
ctgcaattttact

SEQ ID NO: 6166815 - DNA, 16 bp, Homo sapiens
ctgcaattttactgtg

SEQ ID NO: 6166816 - DNA, 19 bp, Homo sapiens
ctgcaattttactgtgaaa

SEQ ID NO: 6166817 - DNA, 20 bp, Homo sapiens
ctgcaattttactgtgaaaa

SEQ ID NO: 6166818 - DNA, 17 bp, Homo sapiens
ctgcacaaaagcagata

SEQ ID NO: 6166819 - DNA, 23 bp, Homo sapiens
ctgcacaaaagcagatacttgag

SEQ ID NO: 6166820 - DNA, 21 bp, Homo sapiens
ctgcacaacagccctgcctga

SEQ ID NO: 6166821 - DNA, 23 bp, Homo sapiens
ctgcacaacagccctgcctgaga

SEQ ID NO: 6166822 - DNA, 19 bp, Homo sapiens
ctgcacaagccagggtgtg

SEQ ID NO: 6166823 - DNA, 21 bp, Homo sapiens
ctgcacaagccatgctggctc

SEQ ID NO: 6166824 - DNA, 13 bp, Homo sapiens
ctgcacaagctgc

SEQ ID NO: 6166825 - DNA, 15 bp, Homo sapiens
ctgcacaataaaaat

SEQ ID NO: 6166826 - DNA, 23 bp, Homo sapiens
ctgcacaataactcctcccaggg

SEQ ID NO: 6166827 - DNA, 18 bp, Homo sapiens
ctgcacaatgcattgaac

SEQ ID NO: 6166828 - DNA, 13 bp, Homo sapiens
ctgcacacacagc

SEQ ID NO: 6166829 - DNA, 15 bp, Homo sapiens
ctgcacacacatgca

SEQ ID NO: 6166830 - DNA, 15 bp, Homo sapiens
ctgcacacacctcag

SEQ ID NO: 6166831 - DNA, 14 bp, Homo sapiens
ctgcacacacctgc

SEQ ID NO: 6166832 - DNA, 22 bp, Homo sapiens
ctgcacacacctgcacaccgtc

SEQ ID NO: 6166833 - DNA, 19 bp, Homo sapiens
ctgcacacagaatgctcag

SEQ ID NO: 6166834 - DNA, 21 bp, Homo sapiens
ctgcacacagaatgctcaggg

SEQ ID NO: 6166835 - DNA, 22 bp, Homo sapiens
ctgcacacagaatgctcagggt

SEQ ID NO: 6166836 - DNA, 19 bp, Homo sapiens
ctgcacacagacggcctag

SEQ ID NO: 6166837 - DNA, 23 bp, Homo sapiens
ctgcacacagacggcctaggggt

SEQ ID NO: 6166838 - DNA, 14 bp, Homo sapiens
ctgcacacagcacg

SEQ ID NO: 6166839 - DNA, 20 bp, Homo sapiens
ctgcacacagctaggcatgc

SEQ ID NO: 6166840 - DNA, 11 bp, Homo sapiens
ctgcacacagg

SEQ ID NO: 6166841 - DNA, 14 bp, Homo sapiens
ctgcacacagggca

SEQ ID NO: 6166842 - DNA, 21 bp, Homo sapiens
ctgcacaccaaggccctgcat

SEQ ID NO: 6166843 - DNA, 13 bp, Homo sapiens
ctgcacaccagcc

SEQ ID NO: 6166844 - DNA, 21 bp, Homo sapiens
ctgcacaccagttactgttca

SEQ ID NO: 6166845 - DNA, 20 bp, Homo sapiens
ctgcacaccctccagagaca

SEQ ID NO: 6166846 - DNA, 15 bp, Homo sapiens
ctgcacaccctgggc

SEQ ID NO: 6166847 - DNA, 17 bp, Homo sapiens
ctgcacaccctgggcca

SEQ ID NO: 6166848 - DNA, 21 bp, Homo sapiens
ctgcacaccttgaatctgcct

SEQ ID NO: 6166849 - DNA, 16 bp, Homo sapiens
ctgcacacggcacaga

SEQ ID NO: 6166850 - DNA, 11 bp, Homo sapiens
ctgcacactcc

SEQ ID NO: 6166851 - DNA, 13 bp, Homo sapiens
ctgcacactccag

SEQ ID NO: 6166852 - DNA, 17 bp, Homo sapiens
ctgcacactccaggcct

SEQ ID NO: 6166853 - DNA, 19 bp, Homo sapiens
ctgcacactccaggcctct

SEQ ID NO: 6166854 - DNA, 17 bp, Homo sapiens
ctgcacactctcttctc

SEQ ID NO: 6166855 - DNA, 20 bp, Homo sapiens
ctgcacactctcttctccat

SEQ ID NO: 6166856 - DNA, 15 bp, Homo sapiens
ctgcacactgacata

SEQ ID NO: 6166857 - DNA, 22 bp, Homo sapiens
ctgcacagacaagcagcccttg

SEQ ID NO: 6166858 - DNA, 16 bp, Homo sapiens
ctgcacagacctggag

SEQ ID NO: 6166859 - DNA, 15 bp, Homo sapiens
ctgcacagagcaagt

SEQ ID NO: 6166860 - DNA, 23 bp, Homo sapiens
ctgcacagagcaagtcctcactc

SEQ ID NO: 6166861 - DNA, 22 bp, Homo sapiens
ctgcacagagggtcccattgtg

SEQ ID NO: 6166862 - DNA, 22 bp, Homo sapiens
ctgcacagatatttccatttct

SEQ ID NO: 6166863 - DNA, 12 bp, Homo sapiens
ctgcacagatgg

SEQ ID NO: 6166864 - DNA, 13 bp, Homo sapiens
ctgcacagatgga

SEQ ID NO: 6166865 - DNA, 18 bp, Homo sapiens
ctgcacagattcccaggc

SEQ ID NO: 6166866 - DNA, 22 bp, Homo sapiens
ctgcacagattcccaggccagg

SEQ ID NO: 6166867 - DNA, 23 bp, Homo sapiens
ctgcacagattcccaggccaggg

SEQ ID NO: 6166868 - DNA, 23 bp, Homo sapiens
ctgcacagattctttttttctgt

SEQ ID NO: 6166869 - DNA, 18 bp, Homo sapiens
ctgcacagcaggctgcca

SEQ ID NO: 6166870 - DNA, 19 bp, Homo sapiens
ctgcacagcaggctgccag

SEQ ID NO: 6166871 - DNA, 20 bp, Homo sapiens
ctgcacagcaggctgccagt

SEQ ID NO: 6166872 - DNA, 21 bp, Homo sapiens
ctgcacagcaggctgccagtg

SEQ ID NO: 6166873 - DNA, 16 bp, Homo sapiens
ctgcacagcatttgct

SEQ ID NO: 6166874 - DNA, 19 bp, Homo sapiens
ctgcacagcatttgctttc

SEQ ID NO: 6166875 - DNA, 13 bp, Homo sapiens
ctgcacagcccaa

SEQ ID NO: 6166876 - DNA, 14 bp, Homo sapiens
ctgcacagcccaac

SEQ ID NO: 6166877 - DNA, 19 bp, Homo sapiens
ctgcacagcccaaccagga

SEQ ID NO: 6166878 - DNA, 21 bp, Homo sapiens
ctgcacagcccaaccaggagg

SEQ ID NO: 6166879 - DNA, 19 bp, Homo sapiens
ctgcacagcggcccctgca

SEQ ID NO: 6166880 - DNA, 17 bp, Homo sapiens
ctgcacagcttttccaa

SEQ ID NO: 6166881 - DNA, 21 bp, Homo sapiens
ctgcacaggcacacagggccc

SEQ ID NO: 6166882 - DNA, 15 bp, Homo sapiens
ctgcacaggccctgg

SEQ ID NO: 6166883 - DNA, 16 bp, Homo sapiens
ctgcacaggcttgctg

SEQ ID NO: 6166884 - DNA, 19 bp, Homo sapiens
ctgcacagggcagctgggc

SEQ ID NO: 6166885 - DNA, 20 bp, Homo sapiens
ctgcacagggcagctgggcc

SEQ ID NO: 6166886 - DNA, 16 bp, Homo sapiens
ctgcacagggccctct

SEQ ID NO: 6166887 - DNA, 14 bp, Homo sapiens
ctgcacaggtctct

SEQ ID NO: 6166888 - DNA, 14 bp, Homo sapiens
ctgcacaggtgaca

SEQ ID NO: 6166889 - DNA, 22 bp, Homo sapiens
ctgcacagtagtgttgggtgga

SEQ ID NO: 6166890 - DNA, 13 bp, Homo sapiens
ctgcacagtcaga

SEQ ID NO: 6166891 - DNA, 16 bp, Homo sapiens
ctgcacagtgacttct

SEQ ID NO: 6166892 - DNA, 20 bp, Homo sapiens
ctgcacagtgacttctgaga

SEQ ID NO: 6166893 - DNA, 17 bp, Homo sapiens
ctgcacagtggcacaaa

SEQ ID NO: 6166894 - DNA, 13 bp, Homo sapiens
ctgcacagtgttg

SEQ ID NO: 6166895 - DNA, 16 bp, Homo sapiens
ctgcacagtttagaac

SEQ ID NO: 6166896 - DNA, 21 bp, Homo sapiens
ctgcacagttttctggctgga

SEQ ID NO: 6166897 - DNA, 13 bp, Homo sapiens
ctgcacataaact

SEQ ID NO: 6166898 - DNA, 15 bp, Homo sapiens
ctgcacatagcagac

SEQ ID NO: 6166899 - DNA, 21 bp, Homo sapiens
ctgcacatgaaagttttgcaa

SEQ ID NO: 6166900 - DNA, 18 bp, Homo sapiens
cttaagaaatttgtggaa

SEQ ID NO: 6166901 - DNA, 14 bp, Homo sapiens
cttaagaactgtgt

SEQ ID NO: 6166902 - DNA, 16 bp, Homo sapiens
cttaagaactgtgtct

SEQ ID NO: 6166903 - DNA, 18 bp, Homo sapiens
cttaagaagataaatgag

SEQ ID NO: 6166904 - DNA, 21 bp, Homo sapiens
cttaagaagtatccctgattt

SEQ ID NO: 6166905 - DNA, 19 bp, Homo sapiens
cttaagaatgagtttctta

SEQ ID NO: 6166906 - DNA, 18 bp, Homo sapiens
cttaagaattttgagcag

SEQ ID NO: 6166907 - DNA, 14 bp, Homo sapiens
cttaagacaaatgg

SEQ ID NO: 6166908 - DNA, 17 bp, Homo sapiens
cttaagacaaatgggac

SEQ ID NO: 6166909 - DNA, 20 bp, Homo sapiens
cttaagacaaatgggactga

SEQ ID NO: 6166910 - DNA, 23 bp, Homo sapiens
cttaagacaaatgggactgatgt

SEQ ID NO: 6166911 - DNA, 17 bp, Homo sapiens
cttaagacactgtgaga

SEQ ID NO: 6166912 - DNA, 15 bp, Homo sapiens
cttaagacagcatgt

SEQ ID NO: 6166913 - DNA, 18 bp, Homo sapiens
cttaagacagcatgtgtt

SEQ ID NO: 6166914 - DNA, 19 bp, Homo sapiens
cttaagacagcatgtgtta

SEQ ID NO: 6166915 - DNA, 20 bp, Homo sapiens
cttaagaccacctcaaattt

SEQ ID NO: 6166916 - DNA, 21 bp, Homo sapiens
cttaagaccacctcaaattta

SEQ ID NO: 6166917 - DNA, 17 bp, Homo sapiens
cttaagacggaagtaaa

SEQ ID NO: 6166918 - DNA, 17 bp, Homo sapiens
cttaagagaatccacat

SEQ ID NO: 6166919 - DNA, 17 bp, Homo sapiens
cttaagagatgcctcat

SEQ ID NO: 6166920 - DNA, 20 bp, Homo sapiens
cttaagataatatttaaaat

SEQ ID NO: 6166921 - DNA, 22 bp, Homo sapiens
cttaagataatatttaaaatag

SEQ ID NO: 6166922 - DNA, 18 bp, Homo sapiens
cttaagatgctaatagaa

SEQ ID NO: 6166923 - DNA, 20 bp, Homo sapiens
cttaagatgctaatagaaaa

SEQ ID NO: 6166924 - DNA, 19 bp, Homo sapiens
cttaagatggaaatacagt

SEQ ID NO: 6166925 - DNA, 20 bp, Homo sapiens
cttaagattaattttctctt

SEQ ID NO: 6166926 - DNA, 15 bp, Homo sapiens
cttaagattcagttt

SEQ ID NO: 6166927 - DNA, 18 bp, Homo sapiens
cttaagattccattttgg

SEQ ID NO: 6166928 - DNA, 17 bp, Homo sapiens
cttaagattctttgtga

SEQ ID NO: 6166929 - DNA, 18 bp, Homo sapiens
cttaagatttgtttttct

SEQ ID NO: 6166930 - DNA, 22 bp, Homo sapiens
cttaagatttttcttttccgca

SEQ ID NO: 6166931 - DNA, 18 bp, Homo sapiens
cttaagcaaaagaaaaag

SEQ ID NO: 6166932 - DNA, 12 bp, Homo sapiens
cttaagcaaagg

SEQ ID NO: 6166933 - DNA, 22 bp, Homo sapiens
cttaagcaaaggggacagctgt

SEQ ID NO: 6166934 - DNA, 12 bp, Homo sapiens
cttaagcaaatt

SEQ ID NO: 6166935 - DNA, 17 bp, Homo sapiens
cttaagcaaattttgta

SEQ ID NO: 6166936 - DNA, 11 bp, Homo sapiens
cttaagcacaa

SEQ ID NO: 6166937 - DNA, 18 bp, Homo sapiens
cttaagcagaacaaatgt

SEQ ID NO: 6166938 - DNA, 19 bp, Homo sapiens
cttaagcagaacaaatgtg

SEQ ID NO: 6166939 - DNA, 14 bp, Homo sapiens
cttaagcagaagca

SEQ ID NO: 6166940 - DNA, 18 bp, Homo sapiens
cttaagcagaagcattaa

SEQ ID NO: 6166941 - DNA, 19 bp, Homo sapiens
cttaagcagagataaataa

SEQ ID NO: 6166942 - DNA, 15 bp, Homo sapiens
cttaagcagaggaat

SEQ ID NO: 6166943 - DNA, 16 bp, Homo sapiens
cttaagcagaggaatt

SEQ ID NO: 6166944 - DNA, 19 bp, Homo sapiens
cttaagcagcatggaaaaa

SEQ ID NO: 6166945 - DNA, 20 bp, Homo sapiens
cttaagcagcatggaaaaat

SEQ ID NO: 6166946 - DNA, 13 bp, Homo sapiens
cttaagccaacaa

SEQ ID NO: 6166947 - DNA, 17 bp, Homo sapiens
cttaagccactgcctct

SEQ ID NO: 6166948 - DNA, 19 bp, Homo sapiens
cttaagccactgcctctcc

SEQ ID NO: 6166949 - DNA, 22 bp, Homo sapiens
cttaagcccagtgcactgaaag

SEQ ID NO: 6166950 - DNA, 13 bp, Homo sapiens
cttaagccctggc

SEQ ID NO: 6166951 - DNA, 16 bp, Homo sapiens
cttaagccctggcccc

SEQ ID NO: 6166952 - DNA, 18 bp, Homo sapiens
cttaagccctttgctctg

SEQ ID NO: 6166953 - DNA, 21 bp, Homo sapiens
cttaagcctggaaggtggaag

SEQ ID NO: 6166954 - DNA, 20 bp, Homo sapiens
cttaagcctgtgtataaaaa

SEQ ID NO: 6166955 - DNA, 19 bp, Homo sapiens
cttaagctcccctgcctta

SEQ ID NO: 6166956 - DNA, 13 bp, Homo sapiens
cttaagctgcagg

SEQ ID NO: 6166957 - DNA, 14 bp, Homo sapiens
cttaagctgcccaa

SEQ ID NO: 6166958 - DNA, 23 bp, Homo sapiens
cttaagctgcccaatttcacaga

SEQ ID NO: 6166959 - DNA, 16 bp, Homo sapiens
cttaagctgtagagag

SEQ ID NO: 6166960 - DNA, 13 bp, Homo sapiens
cttaagctttgga

SEQ ID NO: 6166961 - DNA, 18 bp, Homo sapiens
cttaaggaaaagagaaac

SEQ ID NO: 6166962 - DNA, 20 bp, Homo sapiens
cttaaggaagtttgattttt

SEQ ID NO: 6166963 - DNA, 21 bp, Homo sapiens
cttaaggaattgacttcagca

SEQ ID NO: 6166964 - DNA, 18 bp, Homo sapiens
cttaaggacaaagtgcca

SEQ ID NO: 6166965 - DNA, 15 bp, Homo sapiens
cttaaggagaggaga

SEQ ID NO: 6166966 - DNA, 16 bp, Homo sapiens
cttaaggagaggagag

SEQ ID NO: 6166967 - DNA, 17 bp, Homo sapiens
cttaaggagaggagagc

SEQ ID NO: 6166968 - DNA, 18 bp, Homo sapiens
cttaaggaggtagctccc

SEQ ID NO: 6166969 - DNA, 19 bp, Homo sapiens
cttaaggcaataaaactag

SEQ ID NO: 6166970 - DNA, 17 bp, Homo sapiens
cttaaggcatactttta

SEQ ID NO: 6166971 - DNA, 18 bp, Homo sapiens
cttaaggcatacttttaa

SEQ ID NO: 6166972 - DNA, 21 bp, Homo sapiens
cttaaggcatacttttaatca

SEQ ID NO: 6166973 - DNA, 19 bp, Homo sapiens
cttaaggcatatactttgt

SEQ ID NO: 6166974 - DNA, 22 bp, Homo sapiens
cttaaggcatatactttgtctt

SEQ ID NO: 6166975 - DNA, 20 bp, Homo sapiens
cttaaggcattgagggctct

SEQ ID NO: 6166976 - DNA, 15 bp, Homo sapiens
cttaaggccctcatt

SEQ ID NO: 6166977 - DNA, 18 bp, Homo sapiens
cttaaggggcagcttcta

SEQ ID NO: 6166978 - DNA, 19 bp, Homo sapiens
cttaagggtcactggcctc

SEQ ID NO: 6166979 - DNA, 19 bp, Homo sapiens
cttaagggttttttagaaa

SEQ ID NO: 6166980 - DNA, 16 bp, Homo sapiens
cttaaggtccctgctc

SEQ ID NO: 6166981 - DNA, 14 bp, Homo sapiens
cttaaggtgtagcc

SEQ ID NO: 6166982 - DNA, 21 bp, Homo sapiens
cttaaggtgtagccacaccag

SEQ ID NO: 6166983 - DNA, 17 bp, Homo sapiens
cttaagtattgtcacca

SEQ ID NO: 6166984 - DNA, 23 bp, Homo sapiens
cttaagtccagaagcctcctgtt

SEQ ID NO: 6166985 - DNA, 22 bp, Homo sapiens
cttaagtcccagtatacctcat

SEQ ID NO: 6166986 - DNA, 22 bp, Homo sapiens
cttaagtcctaaaagttctcaa

SEQ ID NO: 6166987 - DNA, 19 bp, Homo sapiens
cttaagtctcgaatgtaat

SEQ ID NO: 6166988 - DNA, 15 bp, Homo sapiens
cttaagtcttactgt

SEQ ID NO: 6166989 - DNA, 16 bp, Homo sapiens
cttaagtcttccttaa

SEQ ID NO: 6166990 - DNA, 17 bp, Homo sapiens
cttaagtgagcagaaca

SEQ ID NO: 6166991 - DNA, 20 bp, Homo sapiens
cttaagtgagcagaacaggt

SEQ ID NO: 6166992 - DNA, 18 bp, Homo sapiens
cttaagtgaggaaatcaa

SEQ ID NO: 6166993 - DNA, 21 bp, Homo sapiens
cttaagtgaggaaatcaaagt

SEQ ID NO: 6166994 - DNA, 15 bp, Homo sapiens
cttaagtgcccacat

SEQ ID NO: 6166995 - DNA, 13 bp, Homo sapiens
cttaagtgtttct

SEQ ID NO: 6166996 - DNA, 15 bp, Homo sapiens
cttaagtgtttctca

SEQ ID NO: 6166997 - DNA, 16 bp, Homo sapiens
cttaagtgtttctcaa

SEQ ID NO: 6166998 - DNA, 21 bp, Homo sapiens
cttaagttagttccactgaga

SEQ ID NO: 6166999 - DNA, 15 bp, Homo sapiens
cttaagttctatgaa

SEQ ID NO: 6167000 - DNA, 17 bp, Homo sapiens
cttaagtttagaaatta

SEQ ID NO: 6167001 - DNA, 18 bp, Homo sapiens
cttaagtttccctgtgtt

SEQ ID NO: 6167002 - DNA, 16 bp, Homo sapiens
cttaagtttctcagct

SEQ ID NO: 6167003 - DNA, 14 bp, Homo sapiens
cttaataaaaatga

SEQ ID NO: 6167004 - DNA, 17 bp, Homo sapiens
cttaataaaaatgacag

SEQ ID NO: 6167005 - DNA, 21 bp, Homo sapiens
cttaataaaaatgacagactg

SEQ ID NO: 6167006 - DNA, 14 bp, Homo sapiens
cttaataaaacatt

SEQ ID NO: 6167007 - DNA, 16 bp, Homo sapiens
cttaataaaagaacat

SEQ ID NO: 6167008 - DNA, 13 bp, Homo sapiens
cttaataaatatg

SEQ ID NO: 6167009 - DNA, 13 bp, Homo sapiens
cttaataaatatt

SEQ ID NO: 6167010 - DNA, 12 bp, Homo sapiens
cttaataaattc

SEQ ID NO: 6167011 - DNA, 20 bp, Homo sapiens
cttaataaattgtgtttcct

SEQ ID NO: 6167012 - DNA, 23 bp, Homo sapiens
cttaataaatttaagtttttccc

SEQ ID NO: 6167013 - DNA, 16 bp, Homo sapiens
cttaataactatggta

SEQ ID NO: 6167014 - DNA, 15 bp, Homo sapiens
cttaataactgtgta

SEQ ID NO: 6167015 - DNA, 19 bp, Homo sapiens
cttaataactgtgtactgt

SEQ ID NO: 6167016 - DNA, 13 bp, Homo sapiens
cttaataagtatt

SEQ ID NO: 6167017 - DNA, 20 bp, Homo sapiens
cttaataataattgaagaat

SEQ ID NO: 6167018 - DNA, 11 bp, Homo sapiens
cttaataatac

SEQ ID NO: 6167019 - DNA, 20 bp, Homo sapiens
cttaataatcaagagcctta

SEQ ID NO: 6167020 - DNA, 23 bp, Homo sapiens
cttaataatggttactcatttta

SEQ ID NO: 6167021 - DNA, 17 bp, Homo sapiens
cttaataatttttacct

SEQ ID NO: 6167022 - DNA, 16 bp, Homo sapiens
cttaatactaccttga

SEQ ID NO: 6167023 - DNA, 21 bp, Homo sapiens
cttaatactgttattctttgc

SEQ ID NO: 6167024 - DNA, 20 bp, Homo sapiens
cttaatagaaacattgaaga

SEQ ID NO: 6167025 - DNA, 13 bp, Homo sapiens
cttaatagcaaca

SEQ ID NO: 6167026 - DNA, 18 bp, Homo sapiens
cttaataggcctaaaata

SEQ ID NO: 6167027 - DNA, 24 bp, Homo sapiens
cttaatagtaatatcaataaatag

SEQ ID NO: 6167028 - DNA, 17 bp, Homo sapiens
cttaatagtatttatga

SEQ ID NO: 6167029 - DNA, 23 bp, Homo sapiens
cttaatatccctggagttcctca

SEQ ID NO: 6167030 - DNA, 23 bp, Homo sapiens
cttaatatgtgctgaacattgtt

SEQ ID NO: 6167031 - DNA, 17 bp, Homo sapiens
cttaatattgagaatca

SEQ ID NO: 6167032 - DNA, 18 bp, Homo sapiens
cttaatattgagaatcag

SEQ ID NO: 6167033 - DNA, 11 bp, Homo sapiens
cttaatatttc

SEQ ID NO: 6167034 - DNA, 12 bp, Homo sapiens
cttaatatttct

SEQ ID NO: 6167035 - DNA, 16 bp, Homo sapiens
cttaatatttttacat

SEQ ID NO: 6167036 - DNA, 15 bp, Homo sapiens
cttaatcaacagaag

SEQ ID NO: 6167037 - DNA, 18 bp, Homo sapiens
cttaatcaattaattttt

SEQ ID NO: 6167038 - DNA, 16 bp, Homo sapiens
cttaatcactactgta

SEQ ID NO: 6167039 - DNA, 17 bp, Homo sapiens
cttaatcactactgtat

SEQ ID NO: 6167040 - DNA, 20 bp, Homo sapiens
cttaatcaggtcctcagaga

SEQ ID NO: 6167041 - DNA, 22 bp, Homo sapiens
cttaatcaggtcctcagagaat

SEQ ID NO: 6167042 - DNA, 23 bp, Homo sapiens
cttaatcattttttatatatatg

SEQ ID NO: 6167043 - DNA, 17 bp, Homo sapiens
cttaatccattaaaaag

SEQ ID NO: 6167044 - DNA, 19 bp, Homo sapiens
cttaatcctaccccctctt

SEQ ID NO: 6167045 - DNA, 17 bp, Homo sapiens
cttaatcggttgaccct

SEQ ID NO: 6167046 - DNA, 16 bp, Homo sapiens
cttaatctaaatggaa

SEQ ID NO: 6167047 - DNA, 14 bp, Homo sapiens
cttaatctaagaaa

SEQ ID NO: 6167048 - DNA, 20 bp, Homo sapiens
cttaatctaagaaacaaagt

SEQ ID NO: 6167049 - DNA, 22 bp, Homo sapiens
cttaatctaatctaaaagctct

SEQ ID NO: 6167050 - DNA, 16 bp, Homo sapiens
cttaatctcacttcat

SEQ ID NO: 6167051 - DNA, 19 bp, Homo sapiens
cttaatctcacttcatcaa

SEQ ID NO: 6167052 - DNA, 16 bp, Homo sapiens
cttaatcttaatgtct

SEQ ID NO: 6167053 - DNA, 10 bp, Homo sapiens
cttaatcttc

SEQ ID NO: 6167054 - DNA, 13 bp, Homo sapiens
cttaatcttgctt

SEQ ID NO: 6167055 - DNA, 17 bp, Homo sapiens
cttaatctttattttat

SEQ ID NO: 6167056 - DNA, 14 bp, Homo sapiens
cttaatctttgctg

SEQ ID NO: 6167057 - DNA, 18 bp, Homo sapiens
cttaatcttttcacaaat

SEQ ID NO: 6167058 - DNA, 21 bp, Homo sapiens
cttaatcttttcacaaataaa

SEQ ID NO: 6167059 - DNA, 12 bp, Homo sapiens
cttaatgaaaaa

SEQ ID NO: 6167060 - DNA, 13 bp, Homo sapiens
cttaatgaagaaa

SEQ ID NO: 6167061 - DNA, 15 bp, Homo sapiens
cttaatgaagtttga

SEQ ID NO: 6167062 - DNA, 19 bp, Homo sapiens
cttaatgaagtttgaatgt

SEQ ID NO: 6167063 - DNA, 21 bp, Homo sapiens
cttaatgaatgagtctgttgt

SEQ ID NO: 6167064 - DNA, 14 bp, Homo sapiens
cttaatgacaacac

SEQ ID NO: 6167065 - DNA, 12 bp, Homo sapiens
cttaatgactta

SEQ ID NO: 6167066 - DNA, 17 bp, Homo sapiens
cttaatgagaacattta

SEQ ID NO: 6167067 - DNA, 18 bp, Homo sapiens
cttaatgagatatttgta

SEQ ID NO: 6167068 - DNA, 21 bp, Homo sapiens
cttaatgatccgttccattgc

SEQ ID NO: 6167069 - DNA, 17 bp, Homo sapiens
cttaatgcttgtaattt

SEQ ID NO: 6167070 - DNA, 17 bp, Homo sapiens
cttaatgctttcctccc

SEQ ID NO: 6167071 - DNA, 17 bp, Homo sapiens
cttaatggagttcttgt

SEQ ID NO: 6167072 - DNA, 18 bp, Homo sapiens
cttaatggagttcttgtg

SEQ ID NO: 6167073 - DNA, 14 bp, Homo sapiens
cttaatggatgctc

SEQ ID NO: 6167074 - DNA, 22 bp, Homo sapiens
cttaatggctgataattttaaa

SEQ ID NO: 6167075 - DNA, 19 bp, Homo sapiens
cttaatggtatcctactga

SEQ ID NO: 6167076 - DNA, 17 bp, Homo sapiens
cttaatgtaattcagga

SEQ ID NO: 6167077 - DNA, 19 bp, Homo sapiens
cttaatgtaattcaggact

SEQ ID NO: 6167078 - DNA, 23 bp, Homo sapiens
ctgcacatgaaagttttgcaaag

SEQ ID NO: 6167079 - DNA, 13 bp, Homo sapiens
ctgcacatgaaga

SEQ ID NO: 6167080 - DNA, 17 bp, Homo sapiens
ctgcacatgagtggaaa

SEQ ID NO: 6167081 - DNA, 22 bp, Homo sapiens
ctgcacatgatttcacaaatat

SEQ ID NO: 6167082 - DNA, 21 bp, Homo sapiens
ctgcacatgcagctgcaccct

SEQ ID NO: 6167083 - DNA, 16 bp, Homo sapiens
ctgcacatgtcttgta

SEQ ID NO: 6167084 - DNA, 12 bp, Homo sapiens
ctgcacatgtgc

SEQ ID NO: 6167085 - DNA, 16 bp, Homo sapiens
ctgcacattcctggcc

SEQ ID NO: 6167086 - DNA, 17 bp, Homo sapiens
ctgcacattcctggccc

SEQ ID NO: 6167087 - DNA, 21 bp, Homo sapiens
ctgcacattcctggccccggg

SEQ ID NO: 6167088 - DNA, 23 bp, Homo sapiens
ctgcacattgcctgttctgcttc

SEQ ID NO: 6167089 - DNA, 19 bp, Homo sapiens
ctgcacattgggtggggct

SEQ ID NO: 6167090 - DNA, 17 bp, Homo sapiens
ctgcaccaacccagccg

SEQ ID NO: 6167091 - DNA, 14 bp, Homo sapiens
ctgcaccaccatgc

SEQ ID NO: 6167092 - DNA, 19 bp, Homo sapiens
ctgcaccaccgaccaactc

SEQ ID NO: 6167093 - DNA, 21 bp, Homo sapiens
ctgcaccaccgaccaactcca

SEQ ID NO: 6167094 - DNA, 17 bp, Homo sapiens
ctgcaccactctcttca

SEQ ID NO: 6167095 - DNA, 17 bp, Homo sapiens
ctgcaccagcaggtgcc

SEQ ID NO: 6167096 - DNA, 14 bp, Homo sapiens
ctgcaccaggagac

SEQ ID NO: 6167097 - DNA, 14 bp, Homo sapiens
ctgcaccatcacac

SEQ ID NO: 6167098 - DNA, 16 bp, Homo sapiens
ctgcaccattgctgct

SEQ ID NO: 6167099 - DNA, 17 bp, Homo sapiens
ctgcaccattgctgctc

SEQ ID NO: 6167100 - DNA, 16 bp, Homo sapiens
ctgcacccacccctgc

SEQ ID NO: 6167101 - DNA, 17 bp, Homo sapiens
ctgcacccacccctgcc

SEQ ID NO: 6167102 - DNA, 22 bp, Homo sapiens
ctgcacccacccctgcccaggc

SEQ ID NO: 6167103 - DNA, 19 bp, Homo sapiens
ctgcacccagccaaacaca

SEQ ID NO: 6167104 - DNA, 21 bp, Homo sapiens
ctgcacccagccccaaggggt

SEQ ID NO: 6167105 - DNA, 12 bp, Homo sapiens
ctgcacccagct

SEQ ID NO: 6167106 - DNA, 15 bp, Homo sapiens
ctgcacccagctcca

SEQ ID NO: 6167107 - DNA, 11 bp, Homo sapiens
ctgcacccagg

SEQ ID NO: 6167108 - DNA, 12 bp, Homo sapiens
ctgcacccagga

SEQ ID NO: 6167109 - DNA, 15 bp, Homo sapiens
ctgcacccaggaggg

SEQ ID NO: 6167110 - DNA, 11 bp, Homo sapiens
ctgcacccagt

SEQ ID NO: 6167111 - DNA, 14 bp, Homo sapiens
ctgcaccccacagg

SEQ ID NO: 6167112 - DNA, 18 bp, Homo sapiens
ctgcaccccacaggatga

SEQ ID NO: 6167113 - DNA, 12 bp, Homo sapiens
ctgcaccccagc

SEQ ID NO: 6167114 - DNA, 16 bp, Homo sapiens
ctgcaccccagcattc

SEQ ID NO: 6167115 - DNA, 18 bp, Homo sapiens
ctgcaccccagcattcca

SEQ ID NO: 6167116 - DNA, 21 bp, Homo sapiens
ctgcaccccagcgtcaggcct

SEQ ID NO: 6167117 - DNA, 22 bp, Homo sapiens
ctgcaccccagcgtcaggccta

SEQ ID NO: 6167118 - DNA, 14 bp, Homo sapiens
ctgcacccccctgg

SEQ ID NO: 6167119 - DNA, 19 bp, Homo sapiens
ctgcacccccctgtgcctg

SEQ ID NO: 6167120 - DNA, 21 bp, Homo sapiens
ctgcacccccctgtgcctgct

SEQ ID NO: 6167121 - DNA, 22 bp, Homo sapiens
ctgcacccccctgtgcctgctg

SEQ ID NO: 6167122 - DNA, 18 bp, Homo sapiens
ctgcaccccctcctgctg

SEQ ID NO: 6167123 - DNA, 11 bp, Homo sapiens
ctgcacccctg

SEQ ID NO: 6167124 - DNA, 18 bp, Homo sapiens
ctgcacccctgcccccag

SEQ ID NO: 6167125 - DNA, 13 bp, Homo sapiens
ctgcacccctggg

SEQ ID NO: 6167126 - DNA, 14 bp, Homo sapiens
ctgcacccctgggc

SEQ ID NO: 6167127 - DNA, 17 bp, Homo sapiens
ctgcacccctgggccag

SEQ ID NO: 6167128 - DNA, 14 bp, Homo sapiens
ctgcaccccttcct

SEQ ID NO: 6167129 - DNA, 19 bp, Homo sapiens
ctgcaccccttcctgggca

SEQ ID NO: 6167130 - DNA, 20 bp, Homo sapiens
ctgcaccccttcctgggcac

SEQ ID NO: 6167131 - DNA, 17 bp, Homo sapiens
ctgcacccctttttccc

SEQ ID NO: 6167132 - DNA, 19 bp, Homo sapiens
ctgcaccctcaacctcctg

SEQ ID NO: 6167133 - DNA, 14 bp, Homo sapiens
ctgcaccctcaggc

SEQ ID NO: 6167134 - DNA, 16 bp, Homo sapiens
ctgcaccctcaggcag

SEQ ID NO: 6167135 - DNA, 17 bp, Homo sapiens
ctgcaccctcaggcagg

SEQ ID NO: 6167136 - DNA, 14 bp, Homo sapiens
ctgcaccctccacc

SEQ ID NO: 6167137 - DNA, 23 bp, Homo sapiens
ctgcaccctctgctatgtctgtg

SEQ ID NO: 6167138 - DNA, 16 bp, Homo sapiens
ctgcaccctgcgcctc

SEQ ID NO: 6167139 - DNA, 19 bp, Homo sapiens
ctgcaccctgcgcctccag

SEQ ID NO: 6167140 - DNA, 20 bp, Homo sapiens
ctgcaccctgcgcctccaga

SEQ ID NO: 6167141 - DNA, 12 bp, Homo sapiens
ctgcaccctgga

SEQ ID NO: 6167142 - DNA, 15 bp, Homo sapiens
ctgcaccctggaaag

SEQ ID NO: 6167143 - DNA, 16 bp, Homo sapiens
ctgcaccctggggcct

SEQ ID NO: 6167144 - DNA, 22 bp, Homo sapiens
ctgcaccctggggcctggacct

SEQ ID NO: 6167145 - DNA, 18 bp, Homo sapiens
ctgcacccttccacagct

SEQ ID NO: 6167146 - DNA, 14 bp, Homo sapiens
ctgcacccttccct

SEQ ID NO: 6167147 - DNA, 15 bp, Homo sapiens
ctgcacccttccctc

SEQ ID NO: 6167148 - DNA, 17 bp, Homo sapiens
ctgcacccttcctcctc

SEQ ID NO: 6167149 - DNA, 22 bp, Homo sapiens
ctgcacccttcctcctcctttg

SEQ ID NO: 6167150 - DNA, 19 bp, Homo sapiens
ctgcacccttgtacagtgt

SEQ ID NO: 6167151 - DNA, 16 bp, Homo sapiens
ctgcaccgaccccggg

SEQ ID NO: 6167152 - DNA, 18 bp, Homo sapiens
ctgcaccgaccccgggcc

SEQ ID NO: 6167153 - DNA, 20 bp, Homo sapiens
ctgcaccgacccgaggccca

SEQ ID NO: 6167154 - DNA, 22 bp, Homo sapiens
ctgcaccgacccgaggcccaga

SEQ ID NO: 6167155 - DNA, 20 bp, Homo sapiens
ctgcaccgccgcagaagcag

SEQ ID NO: 6167156 - DNA, 22 bp, Homo sapiens
ctgcaccgccgcagaagcagcc

SEQ ID NO: 6167157 - DNA, 16 bp, Homo sapiens
ctgcaccggctggcct

SEQ ID NO: 6167158 - DNA, 18 bp, Homo sapiens
ctgcaccggctggcctgg

SEQ ID NO: 6167159 - DNA, 22 bp, Homo sapiens
ctgcaccggctggcctggcccc

SEQ ID NO: 6167160 - DNA, 15 bp, Homo sapiens
ctgcaccgggccaca

SEQ ID NO: 6167161 - DNA, 20 bp, Homo sapiens
ctgcaccgggccacagagaa

SEQ ID NO: 6167162 - DNA, 16 bp, Homo sapiens
ctgcacctagaacctc

SEQ ID NO: 6167163 - DNA, 22 bp, Homo sapiens
ctgcacctccccccactgcagg

SEQ ID NO: 6167164 - DNA, 13 bp, Homo sapiens
ctgcacctccgct

SEQ ID NO: 6167165 - DNA, 23 bp, Homo sapiens
ctgcacctccgcttgccagaggc

SEQ ID NO: 6167166 - DNA, 15 bp, Homo sapiens
ctgcacctcctaccc

SEQ ID NO: 6167167 - DNA, 19 bp, Homo sapiens
ctgcacctcctaccctccc

SEQ ID NO: 6167168 - DNA, 19 bp, Homo sapiens
ctgcacctctcttctgcac

SEQ ID NO: 6167169 - DNA, 20 bp, Homo sapiens
ctgcacctctcttctgcaca

SEQ ID NO: 6167170 - DNA, 12 bp, Homo sapiens
ctgcacctctgg

SEQ ID NO: 6167171 - DNA, 20 bp, Homo sapiens
ctgcacctctggctagagcc

SEQ ID NO: 6167172 - DNA, 21 bp, Homo sapiens
ctgcacctgattagttgaaag

SEQ ID NO: 6167173 - DNA, 18 bp, Homo sapiens
ctgcacctgcttctcagc

SEQ ID NO: 6167174 - DNA, 13 bp, Homo sapiens
ctgcacctggcct

SEQ ID NO: 6167175 - DNA, 15 bp, Homo sapiens
ctgcacctggcctgg

SEQ ID NO: 6167176 - DNA, 16 bp, Homo sapiens
ctgcacctggcctggg

SEQ ID NO: 6167177 - DNA, 19 bp, Homo sapiens
ctgcacctggcctgggcca

SEQ ID NO: 6167178 - DNA, 13 bp, Homo sapiens
ctgcacctgggca

SEQ ID NO: 6167179 - DNA, 21 bp, Homo sapiens
ctgcaccttagaaaaaaaaag

SEQ ID NO: 6167180 - DNA, 13 bp, Homo sapiens
ctgcaccttcccc

SEQ ID NO: 6167181 - DNA, 14 bp, Homo sapiens
ctgcaccttctgac

SEQ ID NO: 6167182 - DNA, 14 bp, Homo sapiens
ctgcaccttgccag

SEQ ID NO: 6167183 - DNA, 16 bp, Homo sapiens
ctgcaccttgccaggg

SEQ ID NO: 6167184 - DNA, 23 bp, Homo sapiens
ctgcaccttgggcacgggagagc

SEQ ID NO: 6167185 - DNA, 23 bp, Homo sapiens
ctgcaccttgtgaaggaaaaaca

SEQ ID NO: 6167186 - DNA, 22 bp, Homo sapiens
ctgcacgaatggaagaggcacc

SEQ ID NO: 6167187 - DNA, 15 bp, Homo sapiens
ctgcacgcccaggat

SEQ ID NO: 6167188 - DNA, 22 bp, Homo sapiens
ctgcacgcggactccggggttc

SEQ ID NO: 6167189 - DNA, 19 bp, Homo sapiens
ctgcacgctcaatgcccag

SEQ ID NO: 6167190 - DNA, 20 bp, Homo sapiens
ctgcacgctgcccaggggct

SEQ ID NO: 6167191 - DNA, 23 bp, Homo sapiens
ctgcacgggatgcgtgggaggca

SEQ ID NO: 6167192 - DNA, 17 bp, Homo sapiens
ctgcacggtgaatggct

SEQ ID NO: 6167193 - DNA, 19 bp, Homo sapiens
ctgcacgtatacacccaga

SEQ ID NO: 6167194 - DNA, 20 bp, Homo sapiens
ctgcacgtcaccctcctgag

SEQ ID NO: 6167195 - DNA, 14 bp, Homo sapiens
ctgcacgtgcacac

SEQ ID NO: 6167196 - DNA, 19 bp, Homo sapiens
ctgcacgtgcacacacctg

SEQ ID NO: 6167197 - DNA, 15 bp, Homo sapiens
ctgcacgtgcgggtg

SEQ ID NO: 6167198 - DNA, 19 bp, Homo sapiens
ctgcacgttgctgaaggtc

SEQ ID NO: 6167199 - DNA, 20 bp, Homo sapiens
ctgcactaaagccagcctga

SEQ ID NO: 6167200 - DNA, 21 bp, Homo sapiens
ctgcactaaagccagcctgac

SEQ ID NO: 6167201 - DNA, 16 bp, Homo sapiens
ctgcactaatttgatg

SEQ ID NO: 6167202 - DNA, 19 bp, Homo sapiens
ctgcactactcctctgcag

SEQ ID NO: 6167203 - DNA, 20 bp, Homo sapiens
ctgcactactcctctgcagt

SEQ ID NO: 6167204 - DNA, 23 bp, Homo sapiens
ctgcactactcctctgcagtgcc

SEQ ID NO: 6167205 - DNA, 14 bp, Homo sapiens
ctgcactactgaca

SEQ ID NO: 6167206 - DNA, 18 bp, Homo sapiens
ctgcactatagcctaggt

SEQ ID NO: 6167207 - DNA, 17 bp, Homo sapiens
ctgcactcaaccttaag

SEQ ID NO: 6167208 - DNA, 14 bp, Homo sapiens
ctgcactcaagctt

SEQ ID NO: 6167209 - DNA, 15 bp, Homo sapiens
ctgcactcagaaaat

SEQ ID NO: 6167210 - DNA, 12 bp, Homo sapiens
ctgcactccaga

SEQ ID NO: 6167211 - DNA, 13 bp, Homo sapiens
ctgcactccagcc

SEQ ID NO: 6167212 - DNA, 14 bp, Homo sapiens
ctgcactccagcct

SEQ ID NO: 6167213 - DNA, 16 bp, Homo sapiens
ctgcactccagcctga

SEQ ID NO: 6167214 - DNA, 20 bp, Homo sapiens
ctgcactccagcctgagcga

SEQ ID NO: 6167215 - DNA, 20 bp, Homo sapiens
ctgcactccagcctgagtga

SEQ ID NO: 6167216 - DNA, 24 bp, Homo sapiens
ctgcactccagcctgagtgacaga

SEQ ID NO: 6167217 - DNA, 18 bp, Homo sapiens
ctgcactccagcctgggc

SEQ ID NO: 6167218 - DNA, 19 bp, Homo sapiens
ctgcactccagcctgggcg

SEQ ID NO: 6167219 - DNA, 20 bp, Homo sapiens
ctgcactccagcctggggga

SEQ ID NO: 6167220 - DNA, 21 bp, Homo sapiens
ctgcactccagcctggggtga

SEQ ID NO: 6167221 - DNA, 18 bp, Homo sapiens
ctgcactccagcctgggt

SEQ ID NO: 6167222 - DNA, 19 bp, Homo sapiens
ctgcactccagcctgggtg

SEQ ID NO: 6167223 - DNA, 11 bp, Homo sapiens
ctgcactccat

SEQ ID NO: 6167224 - DNA, 18 bp, Homo sapiens
ctgcactcccacctgaca

SEQ ID NO: 6167225 - DNA, 19 bp, Homo sapiens
ctgcactcccacctgacac

SEQ ID NO: 6167226 - DNA, 14 bp, Homo sapiens
ctgcactcccctgc

SEQ ID NO: 6167227 - DNA, 16 bp, Homo sapiens
ctgcactcccctgctg

SEQ ID NO: 6167228 - DNA, 18 bp, Homo sapiens
ctgcactcccctgctggg

SEQ ID NO: 6167229 - DNA, 20 bp, Homo sapiens
ctgcactccctcctggagct

SEQ ID NO: 6167230 - DNA, 21 bp, Homo sapiens
ctgcactccctcctggagctc

SEQ ID NO: 6167231 - DNA, 14 bp, Homo sapiens
ctgcactccctggc

SEQ ID NO: 6167232 - DNA, 21 bp, Homo sapiens
ctgcactccctggccttgccc

SEQ ID NO: 6167233 - DNA, 14 bp, Homo sapiens
ctgcactcctcagg

SEQ ID NO: 6167234 - DNA, 15 bp, Homo sapiens
ctgcactcctcaggg

SEQ ID NO: 6167235 - DNA, 17 bp, Homo sapiens
ctgcactcctgaacaca

SEQ ID NO: 6167236 - DNA, 14 bp, Homo sapiens
ctgcactcctggaa

SEQ ID NO: 6167237 - DNA, 23 bp, Homo sapiens
ctgcactcctttatctgtaattg

SEQ ID NO: 6167238 - DNA, 20 bp, Homo sapiens
ctgcactctagcctgggtga

SEQ ID NO: 6167239 - DNA, 15 bp, Homo sapiens
ctgcactctcattgt

SEQ ID NO: 6167240 - DNA, 13 bp, Homo sapiens
ctgcactctgtag

SEQ ID NO: 6167241 - DNA, 13 bp, Homo sapiens
ctgcactctgtgc

SEQ ID NO: 6167242 - DNA, 14 bp, Homo sapiens
ctgcactctgtgcc

SEQ ID NO: 6167243 - DNA, 16 bp, Homo sapiens
ctgcactctgtgccca

SEQ ID NO: 6167244 - DNA, 20 bp, Homo sapiens
ctgcactctgtgcccatggg

SEQ ID NO: 6167245 - DNA, 14 bp, Homo sapiens
ctgcactcttaaac

SEQ ID NO: 6167246 - DNA, 11 bp, Homo sapiens
ctgcactgaaa

SEQ ID NO: 6167247 - DNA, 18 bp, Homo sapiens
ctgcactgaaacctgaga

SEQ ID NO: 6167248 - DNA, 14 bp, Homo sapiens
ctgcactgacaccc

SEQ ID NO: 6167249 - DNA, 19 bp, Homo sapiens
ctgcactgacccacagcct

SEQ ID NO: 6167250 - DNA, 14 bp, Homo sapiens
ctgcactgactctg

SEQ ID NO: 6167251 - DNA, 18 bp, Homo sapiens
ctgcactgactctggaaa

SEQ ID NO: 6167252 - DNA, 16 bp, Homo sapiens
ctgcactgcatgcaaa

SEQ ID NO: 6167253 - DNA, 13 bp, Homo sapiens
ctgcactgccctc

SEQ ID NO: 6167254 - DNA, 14 bp, Homo sapiens
ctgcactgccctcc

SEQ ID NO: 6167255 - DNA, 15 bp, Homo sapiens
ctgcactgccctccg

SEQ ID NO: 6167256 - DNA, 22 bp, Homo sapiens
ctgcactgctgtttggtttgga

SEQ ID NO: 6167257 - DNA, 20 bp, Homo sapiens
cttaatgtaattcaggactc

SEQ ID NO: 6167258 - DNA, 21 bp, Homo sapiens
cttaatgtatgttaccaaaaa

SEQ ID NO: 6167259 - DNA, 20 bp, Homo sapiens
cttaatgtctgtcagaagac

SEQ ID NO: 6167260 - DNA, 14 bp, Homo sapiens
cttaatgtctttga

SEQ ID NO: 6167261 - DNA, 20 bp, Homo sapiens
cttaatgtgattactgctct

SEQ ID NO: 6167262 - DNA, 22 bp, Homo sapiens
cttaatgttcacatagtgaaat

SEQ ID NO: 6167263 - DNA, 20 bp, Homo sapiens
cttaatgttctgaataattt

SEQ ID NO: 6167264 - DNA, 15 bp, Homo sapiens
cttaatgttgaatgt

SEQ ID NO: 6167265 - DNA, 16 bp, Homo sapiens
cttaatgtttattcct

SEQ ID NO: 6167266 - DNA, 23 bp, Homo sapiens
cttaatgtttattcctgataata

SEQ ID NO: 6167267 - DNA, 18 bp, Homo sapiens
cttaattaaaaattactg

SEQ ID NO: 6167268 - DNA, 19 bp, Homo sapiens
cttaattaaaagaatattt

SEQ ID NO: 6167269 - DNA, 21 bp, Homo sapiens
cttaattaagatcattgaaga

SEQ ID NO: 6167270 - DNA, 19 bp, Homo sapiens
cttaattaagtaaactaat

SEQ ID NO: 6167271 - DNA, 12 bp, Homo sapiens
cttaattaattc

SEQ ID NO: 6167272 - DNA, 15 bp, Homo sapiens
cttaattaattctca

SEQ ID NO: 6167273 - DNA, 21 bp, Homo sapiens
cttaattaattctcagattcc

SEQ ID NO: 6167274 - DNA, 13 bp, Homo sapiens
cttaattaatttg

SEQ ID NO: 6167275 - DNA, 14 bp, Homo sapiens
cttaattacttaaa

SEQ ID NO: 6167276 - DNA, 17 bp, Homo sapiens
cttaattacttaaaaaa

SEQ ID NO: 6167277 - DNA, 16 bp, Homo sapiens
cttaattatgctaaca

SEQ ID NO: 6167278 - DNA, 10 bp, Homo sapiens
cttaattatt

SEQ ID NO: 6167279 - DNA, 17 bp, Homo sapiens
cttaattattataaaaa

SEQ ID NO: 6167280 - DNA, 13 bp, Homo sapiens
cttaattcaaata

SEQ ID NO: 6167281 - DNA, 23 bp, Homo sapiens
cttaattcagtatgatttatcct

SEQ ID NO: 6167282 - DNA, 15 bp, Homo sapiens
cttaattctctgcaa

SEQ ID NO: 6167283 - DNA, 13 bp, Homo sapiens
cttaattctgttc

SEQ ID NO: 6167284 - DNA, 22 bp, Homo sapiens
cttaattctgttctgatattaa

SEQ ID NO: 6167285 - DNA, 23 bp, Homo sapiens
cttaattctgttctgatattaat

SEQ ID NO: 6167286 - DNA, 22 bp, Homo sapiens
cttaattcttacctcatttgca

SEQ ID NO: 6167287 - DNA, 20 bp, Homo sapiens
cttaattcttagctcattct

SEQ ID NO: 6167288 - DNA, 14 bp, Homo sapiens
cttaattctttgtt

SEQ ID NO: 6167289 - DNA, 18 bp, Homo sapiens
cttaattctttgttctgt

SEQ ID NO: 6167290 - DNA, 14 bp, Homo sapiens
cttaattgactgaa

SEQ ID NO: 6167291 - DNA, 22 bp, Homo sapiens
cttaattgactgaaattacttt

SEQ ID NO: 6167292 - DNA, 18 bp, Homo sapiens
cttaattgccagcaaata

SEQ ID NO: 6167293 - DNA, 21 bp, Homo sapiens
cttaattgccagcaaataaat

SEQ ID NO: 6167294 - DNA, 20 bp, Homo sapiens
cttaattgtattgttttccc

SEQ ID NO: 6167295 - DNA, 14 bp, Homo sapiens
cttaattgtgttta

SEQ ID NO: 6167296 - DNA, 16 bp, Homo sapiens
cttaattgttcatttt

SEQ ID NO: 6167297 - DNA, 18 bp, Homo sapiens
cttaattgttctgctttt

SEQ ID NO: 6167298 - DNA, 23 bp, Homo sapiens
cttaattgttctgctttttctgt

SEQ ID NO: 6167299 - DNA, 17 bp, Homo sapiens
cttaatttaaatagcat

SEQ ID NO: 6167300 - DNA, 15 bp, Homo sapiens
cttaatttaattgct

SEQ ID NO: 6167301 - DNA, 19 bp, Homo sapiens
cttaatttacttaagtgtt

SEQ ID NO: 6167302 - DNA, 13 bp, Homo sapiens
cttaatttagaaa

SEQ ID NO: 6167303 - DNA, 19 bp, Homo sapiens
cttaatttagaaactgaaa

SEQ ID NO: 6167304 - DNA, 16 bp, Homo sapiens
cttaatttattattaa

SEQ ID NO: 6167305 - DNA, 22 bp, Homo sapiens
cttaatttccttctgttaagaa

SEQ ID NO: 6167306 - DNA, 14 bp, Homo sapiens
cttaatttcctttt

SEQ ID NO: 6167307 - DNA, 21 bp, Homo sapiens
cttaatttcctttttgacact

SEQ ID NO: 6167308 - DNA, 15 bp, Homo sapiens
cttaatttctgcctt

SEQ ID NO: 6167309 - DNA, 23 bp, Homo sapiens
cttaatttctgcctttcccccct

SEQ ID NO: 6167310 - DNA, 12 bp, Homo sapiens
cttaatttggaa

SEQ ID NO: 6167311 - DNA, 15 bp, Homo sapiens
cttaatttggaaact

SEQ ID NO: 6167312 - DNA, 19 bp, Homo sapiens
cttaatttggataataaaa

SEQ ID NO: 6167313 - DNA, 22 bp, Homo sapiens
cttaatttggataataaaaatt

SEQ ID NO: 6167314 - DNA, 23 bp, Homo sapiens
cttaatttggataataaaaattg

SEQ ID NO: 6167315 - DNA, 19 bp, Homo sapiens
cttaatttggatctattta

SEQ ID NO: 6167316 - DNA, 19 bp, Homo sapiens
cttaatttgtaaacttctg

SEQ ID NO: 6167317 - DNA, 20 bp, Homo sapiens
cttaatttgtaaacttctga

SEQ ID NO: 6167318 - DNA, 23 bp, Homo sapiens
cttaatttgtaaacttctgaaga

SEQ ID NO: 6167319 - DNA, 20 bp, Homo sapiens
cttaattttaattggaggaa

SEQ ID NO: 6167320 - DNA, 12 bp, Homo sapiens
cttaattttaga

SEQ ID NO: 6167321 - DNA, 16 bp, Homo sapiens
cttaattttagaaaga

SEQ ID NO: 6167322 - DNA, 17 bp, Homo sapiens
cttaattttagaaagaa

SEQ ID NO: 6167323 - DNA, 15 bp, Homo sapiens
cttaattttctaaaa

SEQ ID NO: 6167324 - DNA, 19 bp, Homo sapiens
cttaattttggttgtattc

SEQ ID NO: 6167325 - DNA, 20 bp, Homo sapiens
cttaattttggttgtattct

SEQ ID NO: 6167326 - DNA, 23 bp, Homo sapiens
cttaattttggttgtattctttg

SEQ ID NO: 6167327 - DNA, 23 bp, Homo sapiens
cttaattttgtattttttcctgt

SEQ ID NO: 6167328 - DNA, 22 bp, Homo sapiens
cttaattttgtctttcaaattt

SEQ ID NO: 6167329 - DNA, 12 bp, Homo sapiens
cttaatttttga

SEQ ID NO: 6167330 - DNA, 18 bp, Homo sapiens
cttacaaaagcagctttt

SEQ ID NO: 6167331 - DNA, 16 bp, Homo sapiens
cttacaaaatacacat

SEQ ID NO: 6167332 - DNA, 16 bp, Homo sapiens
cttacaaaatgccaag

SEQ ID NO: 6167333 - DNA, 17 bp, Homo sapiens
cttacaaagaaagcact

SEQ ID NO: 6167334 - DNA, 23 bp, Homo sapiens
cttacaaagggtctatcttgtaa

SEQ ID NO: 6167335 - DNA, 20 bp, Homo sapiens
cttacaaagtgtattttata

SEQ ID NO: 6167336 - DNA, 21 bp, Homo sapiens
cttacaaataaatccaagact

SEQ ID NO: 6167337 - DNA, 14 bp, Homo sapiens
cttacaaatgaaaa

SEQ ID NO: 6167338 - DNA, 18 bp, Homo sapiens
cttacaaatgattgcttt

SEQ ID NO: 6167339 - DNA, 18 bp, Homo sapiens
cttacaaattctacagca

SEQ ID NO: 6167340 - DNA, 21 bp, Homo sapiens
cttacaacccagggtgtgaac

SEQ ID NO: 6167341 - DNA, 15 bp, Homo sapiens
cttacaactccccca

SEQ ID NO: 6167342 - DNA, 21 bp, Homo sapiens
cttacaactcccccaccgccc

SEQ ID NO: 6167343 - DNA, 16 bp, Homo sapiens
cttacaagaaaggcct

SEQ ID NO: 6167344 - DNA, 17 bp, Homo sapiens
cttacaagatattgatg

SEQ ID NO: 6167345 - DNA, 17 bp, Homo sapiens
cttacaagccagctgga

SEQ ID NO: 6167346 - DNA, 18 bp, Homo sapiens
cttacaagcttaaagctt

SEQ ID NO: 6167347 - DNA, 18 bp, Homo sapiens
cttacaaggcaggccttt

SEQ ID NO: 6167348 - DNA, 19 bp, Homo sapiens
cttacaaggcaggcctttc

SEQ ID NO: 6167349 - DNA, 22 bp, Homo sapiens
cttacaaggccctttcctttgg

SEQ ID NO: 6167350 - DNA, 20 bp, Homo sapiens
cttacaagtaatgaatttta

SEQ ID NO: 6167351 - DNA, 22 bp, Homo sapiens
cttacaagtaatgaattttatg

SEQ ID NO: 6167352 - DNA, 22 bp, Homo sapiens
cttacaagtggtgaccaaaatt

SEQ ID NO: 6167353 - DNA, 21 bp, Homo sapiens
cttacaatcgcaaatcaaaac

SEQ ID NO: 6167354 - DNA, 14 bp, Homo sapiens
cttacaatgtaaac

SEQ ID NO: 6167355 - DNA, 15 bp, Homo sapiens
cttacaatgtgaata

SEQ ID NO: 6167356 - DNA, 20 bp, Homo sapiens
cttacaattccctgctgtcg

SEQ ID NO: 6167357 - DNA, 13 bp, Homo sapiens
cttacacaccatt

SEQ ID NO: 6167358 - DNA, 16 bp, Homo sapiens
cttacacacccccaga

SEQ ID NO: 6167359 - DNA, 17 bp, Homo sapiens
cttacacactcaggcct

SEQ ID NO: 6167360 - DNA, 21 bp, Homo sapiens
cttacacactcaggcctgtgc

SEQ ID NO: 6167361 - DNA, 22 bp, Homo sapiens
cttacacactcaggcctgtgcc

SEQ ID NO: 6167362 - DNA, 13 bp, Homo sapiens
cttacacatacag

SEQ ID NO: 6167363 - DNA, 16 bp, Homo sapiens
cttacacatacagttt

SEQ ID NO: 6167364 - DNA, 17 bp, Homo sapiens
cttacacatacagtttt

SEQ ID NO: 6167365 - DNA, 19 bp, Homo sapiens
cttacacatctcagaccct

SEQ ID NO: 6167366 - DNA, 13 bp, Homo sapiens
cttacacattcca

SEQ ID NO: 6167367 - DNA, 17 bp, Homo sapiens
cttacacgaagaaatag

SEQ ID NO: 6167368 - DNA, 12 bp, Homo sapiens
cttacactcccc

SEQ ID NO: 6167369 - DNA, 23 bp, Homo sapiens
cttacactcccccagccccagag

SEQ ID NO: 6167370 - DNA, 12 bp, Homo sapiens
cttacactgagg

SEQ ID NO: 6167371 - DNA, 20 bp, Homo sapiens
cttacactgcctgtatactt

SEQ ID NO: 6167372 - DNA, 20 bp, Homo sapiens
cttacacttaaaagaaaaca

SEQ ID NO: 6167373 - DNA, 17 bp, Homo sapiens
cttacacttactgttgt

SEQ ID NO: 6167374 - DNA, 15 bp, Homo sapiens
cttacacttcttacc

SEQ ID NO: 6167375 - DNA, 18 bp, Homo sapiens
cttacacttggagcccgt

SEQ ID NO: 6167376 - DNA, 21 bp, Homo sapiens
cttacagacacccataataaa

SEQ ID NO: 6167377 - DNA, 22 bp, Homo sapiens
cttacagacacccataataaaa

SEQ ID NO: 6167378 - DNA, 12 bp, Homo sapiens
cttacagagcct

SEQ ID NO: 6167379 - DNA, 22 bp, Homo sapiens
cttacagataggccttcttgtg

SEQ ID NO: 6167380 - DNA, 16 bp, Homo sapiens
cttacagcaaatcctt

SEQ ID NO: 6167381 - DNA, 13 bp, Homo sapiens
cttacagcaggca

SEQ ID NO: 6167382 - DNA, 23 bp, Homo sapiens
cttacagcataagggagcgtaga

SEQ ID NO: 6167383 - DNA, 14 bp, Homo sapiens
cttacagccagagg

SEQ ID NO: 6167384 - DNA, 15 bp, Homo sapiens
cttacagccagagga

SEQ ID NO: 6167385 - DNA, 16 bp, Homo sapiens
cttacagccagaggaa

SEQ ID NO: 6167386 - DNA, 22 bp, Homo sapiens
cttacagctgggtggcactgcc

SEQ ID NO: 6167387 - DNA, 12 bp, Homo sapiens
cttacaggagcc

SEQ ID NO: 6167388 - DNA, 16 bp, Homo sapiens
cttacaggagccagcc

SEQ ID NO: 6167389 - DNA, 20 bp, Homo sapiens
cttacaggctaaaattagtt

SEQ ID NO: 6167390 - DNA, 21 bp, Homo sapiens
cttacaggtatcaggcacagg

SEQ ID NO: 6167391 - DNA, 23 bp, Homo sapiens
cttacagtaggagtgagaaattt

SEQ ID NO: 6167392 - DNA, 22 bp, Homo sapiens
cttacagtgatgccatgaagac

SEQ ID NO: 6167393 - DNA, 20 bp, Homo sapiens
cttacagttaagaagccctg

SEQ ID NO: 6167394 - DNA, 17 bp, Homo sapiens
cttacagttatcctgca

SEQ ID NO: 6167395 - DNA, 23 bp, Homo sapiens
cttacagtttattttctgtgtaa

SEQ ID NO: 6167396 - DNA, 18 bp, Homo sapiens
cttacagttttaaattct

SEQ ID NO: 6167397 - DNA, 17 bp, Homo sapiens
cttacataaacatcagg

SEQ ID NO: 6167398 - DNA, 19 bp, Homo sapiens
cttacataaacatcaggtt

SEQ ID NO: 6167399 - DNA, 20 bp, Homo sapiens
cttacataaaccatttttgt

SEQ ID NO: 6167400 - DNA, 13 bp, Homo sapiens
cttacataatttg

SEQ ID NO: 6167401 - DNA, 22 bp, Homo sapiens
cttacataattttttattcaag

SEQ ID NO: 6167402 - DNA, 17 bp, Homo sapiens
cttacatatctgacttc

SEQ ID NO: 6167403 - DNA, 14 bp, Homo sapiens
cttacatcttttct

SEQ ID NO: 6167404 - DNA, 15 bp, Homo sapiens
cttacatgagaacag

SEQ ID NO: 6167405 - DNA, 24 bp, Homo sapiens
cttacatgggtgttttgatctctg

SEQ ID NO: 6167406 - DNA, 15 bp, Homo sapiens
cttacatgtgtaaag

SEQ ID NO: 6167407 - DNA, 21 bp, Homo sapiens
cttacatgttcccaaaacaat

SEQ ID NO: 6167408 - DNA, 15 bp, Homo sapiens
cttacattcagaaat

SEQ ID NO: 6167409 - DNA, 12 bp, Homo sapiens
cttacattccta

SEQ ID NO: 6167410 - DNA, 16 bp, Homo sapiens
cttacattctctaata

SEQ ID NO: 6167411 - DNA, 13 bp, Homo sapiens
cttacattgaaaa

SEQ ID NO: 6167412 - DNA, 14 bp, Homo sapiens
cttacattgaaaac

SEQ ID NO: 6167413 - DNA, 14 bp, Homo sapiens
cttacattggcttt

SEQ ID NO: 6167414 - DNA, 17 bp, Homo sapiens
cttacatttaaaagaca

SEQ ID NO: 6167415 - DNA, 13 bp, Homo sapiens
cttacatttcacc

SEQ ID NO: 6167416 - DNA, 18 bp, Homo sapiens
cttacatttgaataatgt

SEQ ID NO: 6167417 - DNA, 13 bp, Homo sapiens
cttacatttgtga

SEQ ID NO: 6167418 - DNA, 14 bp, Homo sapiens
cttacattttaata

SEQ ID NO: 6167419 - DNA, 20 bp, Homo sapiens
cttacattttactttttcct

SEQ ID NO: 6167420 - DNA, 22 bp, Homo sapiens
cttacattttcgtcctgtagca

SEQ ID NO: 6167421 - DNA, 14 bp, Homo sapiens
cttacatttttaca

SEQ ID NO: 6167422 - DNA, 22 bp, Homo sapiens
cttacatttttacaataaataa

SEQ ID NO: 6167423 - DNA, 13 bp, Homo sapiens
cttacatttttgt

SEQ ID NO: 6167424 - DNA, 20 bp, Homo sapiens
cttacatttttgtggttttg

SEQ ID NO: 6167425 - DNA, 14 bp, Homo sapiens
cttaccaaaacata

SEQ ID NO: 6167426 - DNA, 16 bp, Homo sapiens
cttaccaagactcctg

SEQ ID NO: 6167427 - DNA, 23 bp, Homo sapiens
cttaccaagttggtcttactttg

SEQ ID NO: 6167428 - DNA, 13 bp, Homo sapiens
cttaccagaagct

SEQ ID NO: 6167429 - DNA, 20 bp, Homo sapiens
cttaccagagacgcccagcc

SEQ ID NO: 6167430 - DNA, 13 bp, Homo sapiens
cttaccagatgct

SEQ ID NO: 6167431 - DNA, 14 bp, Homo sapiens
cttaccagatgcta

SEQ ID NO: 6167432 - DNA, 23 bp, Homo sapiens
cttaccagggtctttgcagatgt

SEQ ID NO: 6167433 - DNA, 17 bp, Homo sapiens
cttaccagtctcctccc

SEQ ID NO: 6167434 - DNA, 15 bp, Homo sapiens
ctgcactggagccac

SEQ ID NO: 6167435 - DNA, 19 bp, Homo sapiens
ctgcactggagccacaggc

SEQ ID NO: 6167436 - DNA, 16 bp, Homo sapiens
ctgcactggagtccag

SEQ ID NO: 6167437 - DNA, 17 bp, Homo sapiens
ctgcactgggaaggaaa

SEQ ID NO: 6167438 - DNA, 20 bp, Homo sapiens
ctgcactgggaaggaaacaa

SEQ ID NO: 6167439 - DNA, 23 bp, Homo sapiens
ctgcactgggaatttatttatgt

SEQ ID NO: 6167440 - DNA, 16 bp, Homo sapiens
ctgcactggggagccc

SEQ ID NO: 6167441 - DNA, 22 bp, Homo sapiens
ctgcactggggagcccgtctca

SEQ ID NO: 6167442 - DNA, 17 bp, Homo sapiens
ctgcactgggtgtggcc

SEQ ID NO: 6167443 - DNA, 11 bp, Homo sapiens
ctgcactgtcc

SEQ ID NO: 6167444 - DNA, 14 bp, Homo sapiens
ctgcactgtcctgc

SEQ ID NO: 6167445 - DNA, 18 bp, Homo sapiens
ctgcactgtcctgctcca

SEQ ID NO: 6167446 - DNA, 17 bp, Homo sapiens
ctgcactgttgctgact

SEQ ID NO: 6167447 - DNA, 18 bp, Homo sapiens
ctgcactgtttatggaaa

SEQ ID NO: 6167448 - DNA, 21 bp, Homo sapiens
ctgcactgtttatggaaatac

SEQ ID NO: 6167449 - DNA, 12 bp, Homo sapiens
ctgcacttcatc

SEQ ID NO: 6167450 - DNA, 14 bp, Homo sapiens
ctgcacttcctgtt

SEQ ID NO: 6167451 - DNA, 14 bp, Homo sapiens
ctgcacttgcagac

SEQ ID NO: 6167452 - DNA, 23 bp, Homo sapiens
ctgcacttgcagactctacagag

SEQ ID NO: 6167453 - DNA, 15 bp, Homo sapiens
ctgcacttgggggct

SEQ ID NO: 6167454 - DNA, 24 bp, Homo sapiens
ctgcacttgggggctcagcaaggc

SEQ ID NO: 6167455 - DNA, 17 bp, Homo sapiens
ctgcacttggtgctgct

SEQ ID NO: 6167456 - DNA, 19 bp, Homo sapiens
ctgcacttggtgctgcttt

SEQ ID NO: 6167457 - DNA, 23 bp, Homo sapiens
ctgcactttagtgtattttctgt

SEQ ID NO: 6167458 - DNA, 22 bp, Homo sapiens
ctgcactttccaatgccacaga

SEQ ID NO: 6167459 - DNA, 18 bp, Homo sapiens
ctgcactttgatgtcatg

SEQ ID NO: 6167460 - DNA, 19 bp, Homo sapiens
ctgcactttgatgtcatgt

SEQ ID NO: 6167461 - DNA, 13 bp, Homo sapiens
ctgcactttgttt

SEQ ID NO: 6167462 - DNA, 18 bp, Homo sapiens
ctgcactttgtttagaaa

SEQ ID NO: 6167463 - DNA, 13 bp, Homo sapiens
ctgcagaaaaaaa

SEQ ID NO: 6167464 - DNA, 15 bp, Homo sapiens
ctgcagaaaaaaaag

SEQ ID NO: 6167465 - DNA, 16 bp, Homo sapiens
ctgcagaaaaaaaaga

SEQ ID NO: 6167466 - DNA, 22 bp, Homo sapiens
ctgcagaaaattaattgaaata

SEQ ID NO: 6167467 - DNA, 15 bp, Homo sapiens
ctgcagaaaattcta

SEQ ID NO: 6167468 - DNA, 17 bp, Homo sapiens
ctgcagaaatttgcaac

SEQ ID NO: 6167469 - DNA, 17 bp, Homo sapiens
ctgcagaaccagtccct

SEQ ID NO: 6167470 - DNA, 13 bp, Homo sapiens
ctgcagaacccac

SEQ ID NO: 6167471 - DNA, 16 bp, Homo sapiens
ctgcagaaccggagag

SEQ ID NO: 6167472 - DNA, 21 bp, Homo sapiens
ctgcagaacgtattggtccag

SEQ ID NO: 6167473 - DNA, 23 bp, Homo sapiens
ctgcagaagacagtatggcagct

SEQ ID NO: 6167474 - DNA, 17 bp, Homo sapiens
ctgcagaagccagaagg

SEQ ID NO: 6167475 - DNA, 23 bp, Homo sapiens
ctgcagaagccagaaggtgcagg

SEQ ID NO: 6167476 - DNA, 13 bp, Homo sapiens
ctgcagaaggaaa

SEQ ID NO: 6167477 - DNA, 14 bp, Homo sapiens
ctgcagaaggaaaa

SEQ ID NO: 6167478 - DNA, 22 bp, Homo sapiens
ctgcagaaggaaaaatgtgtaa

SEQ ID NO: 6167479 - DNA, 23 bp, Homo sapiens
ctgcagaaggaaagaagggggcc

SEQ ID NO: 6167480 - DNA, 16 bp, Homo sapiens
ctgcagaaggccaaga

SEQ ID NO: 6167481 - DNA, 18 bp, Homo sapiens
ctgcagaatgactccacc

SEQ ID NO: 6167482 - DNA, 15 bp, Homo sapiens
ctgcagaatgggcca

SEQ ID NO: 6167483 - DNA, 14 bp, Homo sapiens
ctgcagacaaaaag

SEQ ID NO: 6167484 - DNA, 18 bp, Homo sapiens
ctgcagacaaaaagaaca

SEQ ID NO: 6167485 - DNA, 17 bp, Homo sapiens
ctgcagacacctggact

SEQ ID NO: 6167486 - DNA, 23 bp, Homo sapiens
ctgcagacaggctctgaggggca

SEQ ID NO: 6167487 - DNA, 12 bp, Homo sapiens
ctgcagacattc

SEQ ID NO: 6167488 - DNA, 16 bp, Homo sapiens
ctgcagacattctcaa

SEQ ID NO: 6167489 - DNA, 18 bp, Homo sapiens
ctgcagaccacactctgc

SEQ ID NO: 6167490 - DNA, 13 bp, Homo sapiens
ctgcagaccctgc

SEQ ID NO: 6167491 - DNA, 14 bp, Homo sapiens
ctgcagaccctgcc

SEQ ID NO: 6167492 - DNA, 18 bp, Homo sapiens
ctgcagaccctgccaggg

SEQ ID NO: 6167493 - DNA, 16 bp, Homo sapiens
ctgcagaccctgccct

SEQ ID NO: 6167494 - DNA, 19 bp, Homo sapiens
ctgcagacctcactgtcag

SEQ ID NO: 6167495 - DNA, 22 bp, Homo sapiens
ctgcagacctcactgtcagggt

SEQ ID NO: 6167496 - DNA, 12 bp, Homo sapiens
ctgcagacctgg

SEQ ID NO: 6167497 - DNA, 13 bp, Homo sapiens
ctgcagacctggc

SEQ ID NO: 6167498 - DNA, 20 bp, Homo sapiens
ctgcagacctggctgggcct

SEQ ID NO: 6167499 - DNA, 21 bp, Homo sapiens
ctgcagacctggctgggcctg

SEQ ID NO: 6167500 - DNA, 17 bp, Homo sapiens
ctgcagacctggttccc

SEQ ID NO: 6167501 - DNA, 14 bp, Homo sapiens
ctgcagacctgtcc

SEQ ID NO: 6167502 - DNA, 16 bp, Homo sapiens
ctgcagacctgtcctc

SEQ ID NO: 6167503 - DNA, 19 bp, Homo sapiens
ctgcagacgggaatgccta

SEQ ID NO: 6167504 - DNA, 14 bp, Homo sapiens
ctgcagacgtctgg

SEQ ID NO: 6167505 - DNA, 16 bp, Homo sapiens
ctgcagacgtctggcc

SEQ ID NO: 6167506 - DNA, 18 bp, Homo sapiens
ctgcagacgtctggccct

SEQ ID NO: 6167507 - DNA, 23 bp, Homo sapiens
ctgcagactccaatggggccagc

SEQ ID NO: 6167508 - DNA, 22 bp, Homo sapiens
ctgcagactcgttctcgtgacc

SEQ ID NO: 6167509 - DNA, 15 bp, Homo sapiens
ctgcagactggcagt

SEQ ID NO: 6167510 - DNA, 14 bp, Homo sapiens
ctgcagacttccca

SEQ ID NO: 6167511 - DNA, 15 bp, Homo sapiens
ctgcagacttcccag

SEQ ID NO: 6167512 - DNA, 17 bp, Homo sapiens
ctgcagacttcccagct

SEQ ID NO: 6167513 - DNA, 22 bp, Homo sapiens
ctgcagagaaacgcgctccttg

SEQ ID NO: 6167514 - DNA, 21 bp, Homo sapiens
ctgcagagaataaaaggacca

SEQ ID NO: 6167515 - DNA, 17 bp, Homo sapiens
ctgcagagacagagagg

SEQ ID NO: 6167516 - DNA, 13 bp, Homo sapiens
ctgcagagacctt

SEQ ID NO: 6167517 - DNA, 19 bp, Homo sapiens
ctgcagagagcacctggtg

SEQ ID NO: 6167518 - DNA, 20 bp, Homo sapiens
ctgcagagagcacctggtgg

SEQ ID NO: 6167519 - DNA, 21 bp, Homo sapiens
ctgcagagagcacctggtggg

SEQ ID NO: 6167520 - DNA, 14 bp, Homo sapiens
ctgcagagatttct

SEQ ID NO: 6167521 - DNA, 14 bp, Homo sapiens
ctgcagagcacaaa

SEQ ID NO: 6167522 - DNA, 22 bp, Homo sapiens
ctgcagagcacaaacttcagaa

SEQ ID NO: 6167523 - DNA, 16 bp, Homo sapiens
ctgcagagcacacagg

SEQ ID NO: 6167524 - DNA, 12 bp, Homo sapiens
ctgcagagcaga

SEQ ID NO: 6167525 - DNA, 17 bp, Homo sapiens
ctgcagagcagcagcac

SEQ ID NO: 6167526 - DNA, 16 bp, Homo sapiens
ctgcagagcaggacct

SEQ ID NO: 6167527 - DNA, 21 bp, Homo sapiens
ctgcagagcagtaagggaaca

SEQ ID NO: 6167528 - DNA, 21 bp, Homo sapiens
ctgcagagcagtgggcctggc

SEQ ID NO: 6167529 - DNA, 14 bp, Homo sapiens
ctgcagagcccggc

SEQ ID NO: 6167530 - DNA, 18 bp, Homo sapiens
ctgcagagcccggcccca

SEQ ID NO: 6167531 - DNA, 11 bp, Homo sapiens
ctgcagagcct

SEQ ID NO: 6167532 - DNA, 15 bp, Homo sapiens
ctgcagagctggggg

SEQ ID NO: 6167533 - DNA, 13 bp, Homo sapiens
ctgcagaggacag

SEQ ID NO: 6167534 - DNA, 19 bp, Homo sapiens
ctgcagaggaccacagtgg

SEQ ID NO: 6167535 - DNA, 15 bp, Homo sapiens
ctgcagaggagccac

SEQ ID NO: 6167536 - DNA, 17 bp, Homo sapiens
ctgcagaggccagaggc

SEQ ID NO: 6167537 - DNA, 13 bp, Homo sapiens
ctgcagagggacc

SEQ ID NO: 6167538 - DNA, 14 bp, Homo sapiens
ctgcagagggacca

SEQ ID NO: 6167539 - DNA, 11 bp, Homo sapiens
ctgcagagggg

SEQ ID NO: 6167540 - DNA, 22 bp, Homo sapiens
ctgcagaggggaaagacttcca

SEQ ID NO: 6167541 - DNA, 13 bp, Homo sapiens
ctgcagaggggca

SEQ ID NO: 6167542 - DNA, 19 bp, Homo sapiens
ctgcagaggggcaggccct

SEQ ID NO: 6167543 - DNA, 23 bp, Homo sapiens
ctgcagaggggcaggccctgcac

SEQ ID NO: 6167544 - DNA, 19 bp, Homo sapiens
ctgcagaggggctttctgg

SEQ ID NO: 6167545 - DNA, 13 bp, Homo sapiens
ctgcagagggtta

SEQ ID NO: 6167546 - DNA, 17 bp, Homo sapiens
ctgcagaggtctgtgct

SEQ ID NO: 6167547 - DNA, 23 bp, Homo sapiens
ctgcagaggtctgtgctgaggcc

SEQ ID NO: 6167548 - DNA, 14 bp, Homo sapiens
ctgcagagtggtga

SEQ ID NO: 6167549 - DNA, 21 bp, Homo sapiens
ctgcagagttctcctggaggc

SEQ ID NO: 6167550 - DNA, 17 bp, Homo sapiens
ctgcagagtttccaaaa

SEQ ID NO: 6167551 - DNA, 21 bp, Homo sapiens
ctgcagatactactgaccaga

SEQ ID NO: 6167552 - DNA, 15 bp, Homo sapiens
ctgcagatagccaga

SEQ ID NO: 6167553 - DNA, 18 bp, Homo sapiens
ctgcagatagccagacac

SEQ ID NO: 6167554 - DNA, 20 bp, Homo sapiens
ctgcagatagcccaggagca

SEQ ID NO: 6167555 - DNA, 22 bp, Homo sapiens
ctgcagatagcccaggagcaac

SEQ ID NO: 6167556 - DNA, 18 bp, Homo sapiens
ctgcagatagtgcctctg

SEQ ID NO: 6167557 - DNA, 19 bp, Homo sapiens
ctgcagatagtgcctctgc

SEQ ID NO: 6167558 - DNA, 21 bp, Homo sapiens
ctgcagatgccaccctagcca

SEQ ID NO: 6167559 - DNA, 21 bp, Homo sapiens
ctgcagatggttgcaattgat

SEQ ID NO: 6167560 - DNA, 22 bp, Homo sapiens
ctgcagattagttctttttgcc

SEQ ID NO: 6167561 - DNA, 23 bp, Homo sapiens
ctgcagattagttctttttgcca

SEQ ID NO: 6167562 - DNA, 24 bp, Homo sapiens
ctgcagattagttctttttgccag

SEQ ID NO: 6167563 - DNA, 15 bp, Homo sapiens
ctgcagattcctttg

SEQ ID NO: 6167564 - DNA, 16 bp, Homo sapiens
ctgcagattctgagca

SEQ ID NO: 6167565 - DNA, 18 bp, Homo sapiens
ctgcagattgagacctac

SEQ ID NO: 6167566 - DNA, 20 bp, Homo sapiens
ctgcagcaaacactccaccc

SEQ ID NO: 6167567 - DNA, 20 bp, Homo sapiens
ctgcagcaatcacaaaggct

SEQ ID NO: 6167568 - DNA, 18 bp, Homo sapiens
ctgcagcaatctttgaaa

SEQ ID NO: 6167569 - DNA, 22 bp, Homo sapiens
ctgcagcacatgcgggctcgcc

SEQ ID NO: 6167570 - DNA, 23 bp, Homo sapiens
ctgcagcacattgataagatggt

SEQ ID NO: 6167571 - DNA, 17 bp, Homo sapiens
ctgcagcacattgccct

SEQ ID NO: 6167572 - DNA, 19 bp, Homo sapiens
ctgcagcacattgccctga

SEQ ID NO: 6167573 - DNA, 20 bp, Homo sapiens
ctgcagcacattgccctgag

SEQ ID NO: 6167574 - DNA, 23 bp, Homo sapiens
ctgcagcacattgccctgagggg

SEQ ID NO: 6167575 - DNA, 16 bp, Homo sapiens
ctgcagcaccgagggg

SEQ ID NO: 6167576 - DNA, 18 bp, Homo sapiens
ctgcagcaccgaggggcc

SEQ ID NO: 6167577 - DNA, 19 bp, Homo sapiens
ctgcagcaccgaggggcct

SEQ ID NO: 6167578 - DNA, 22 bp, Homo sapiens
ctgcagcaccgaggggcctttg

SEQ ID NO: 6167579 - DNA, 19 bp, Homo sapiens
ctgcagcacctccaggcct

SEQ ID NO: 6167580 - DNA, 20 bp, Homo sapiens
ctgcagcacctccaggcctg

SEQ ID NO: 6167581 - DNA, 14 bp, Homo sapiens
ctgcagcacctgcc

SEQ ID NO: 6167582 - DNA, 15 bp, Homo sapiens
ctgcagcagagcctg

SEQ ID NO: 6167583 - DNA, 18 bp, Homo sapiens
ctgcagcagaggcactgg

SEQ ID NO: 6167584 - DNA, 19 bp, Homo sapiens
ctgcagcagaggcctgagg

SEQ ID NO: 6167585 - DNA, 21 bp, Homo sapiens
ctgcagcagaggcctgaggag

SEQ ID NO: 6167586 - DNA, 22 bp, Homo sapiens
ctgcagcagagtgagcaagggg

SEQ ID NO: 6167587 - DNA, 15 bp, Homo sapiens
ctgcagcagccggaa

SEQ ID NO: 6167588 - DNA, 15 bp, Homo sapiens
ctgcagcaggcagag

SEQ ID NO: 6167589 - DNA, 21 bp, Homo sapiens
ctgcagcagggcaggaagggg

SEQ ID NO: 6167590 - DNA, 23 bp, Homo sapiens
ctgcagcagggcaggaaggggaa

SEQ ID NO: 6167591 - DNA, 20 bp, Homo sapiens
ctgcagcaggtgctgggctg

SEQ ID NO: 6167592 - DNA, 20 bp, Homo sapiens
ctgcagcagtcgcccaagca

SEQ ID NO: 6167593 - DNA, 21 bp, Homo sapiens
ctgcagcagtcgcccaagcag

SEQ ID NO: 6167594 - DNA, 17 bp, Homo sapiens
ctgcagcatgacctgtg

SEQ ID NO: 6167595 - DNA, 19 bp, Homo sapiens
ctgcagcatgcccagtgcc

SEQ ID NO: 6167596 - DNA, 20 bp, Homo sapiens
ctgcagcatgttgctgagga

SEQ ID NO: 6167597 - DNA, 15 bp, Homo sapiens
ctgcagccaagcaaa

SEQ ID NO: 6167598 - DNA, 15 bp, Homo sapiens
ctgcagccacagggg

SEQ ID NO: 6167599 - DNA, 22 bp, Homo sapiens
ctgcagccaccagacttggcct

SEQ ID NO: 6167600 - DNA, 17 bp, Homo sapiens
ctgcagccaggccactg

SEQ ID NO: 6167601 - DNA, 22 bp, Homo sapiens
ctgcagccaggccactggcccc

SEQ ID NO: 6167602 - DNA, 15 bp, Homo sapiens
ctgcagccaggcctc

SEQ ID NO: 6167603 - DNA, 17 bp, Homo sapiens
ctgcagccaggcctcgc

SEQ ID NO: 6167604 - DNA, 23 bp, Homo sapiens
ctgcagccaggcctcgcctgccc

SEQ ID NO: 6167605 - DNA, 13 bp, Homo sapiens
ctgcagccagggc

SEQ ID NO: 6167606 - DNA, 13 bp, Homo sapiens
ctgcagccagtca

SEQ ID NO: 6167607 - DNA, 18 bp, Homo sapiens
ctgcagccagtcaggcag

SEQ ID NO: 6167608 - DNA, 21 bp, Homo sapiens
ctgcagccatcccgcttagcc

SEQ ID NO: 6167609 - DNA, 17 bp, Homo sapiens
ctgcagccattcttcag

SEQ ID NO: 6167610 - DNA, 20 bp, Homo sapiens
ctgcagcccaaaacccaggg

SEQ ID NO: 6167611 - DNA, 16 bp, Homo sapiens
cttaccatctctacca

SEQ ID NO: 6167612 - DNA, 13 bp, Homo sapiens
cttaccattaaag

SEQ ID NO: 6167613 - DNA, 15 bp, Homo sapiens
cttacccaagctgtg

SEQ ID NO: 6167614 - DNA, 22 bp, Homo sapiens
cttacccaagctgtggcagccg

SEQ ID NO: 6167615 - DNA, 14 bp, Homo sapiens
cttacccacttccc

SEQ ID NO: 6167616 - DNA, 23 bp, Homo sapiens
cttacccatctgcacccccctgg

SEQ ID NO: 6167617 - DNA, 16 bp, Homo sapiens
cttaccccgagacctc

SEQ ID NO: 6167618 - DNA, 18 bp, Homo sapiens
cttaccccgtccctttcc

SEQ ID NO: 6167619 - DNA, 19 bp, Homo sapiens
cttacccgaaagcatcact

SEQ ID NO: 6167620 - DNA, 21 bp, Homo sapiens
cttacccggagaaggccgctg

SEQ ID NO: 6167621 - DNA, 23 bp, Homo sapiens
cttacccggagaaggccgctgcc

SEQ ID NO: 6167622 - DNA, 17 bp, Homo sapiens
cttaccctactggctgt

SEQ ID NO: 6167623 - DNA, 15 bp, Homo sapiens
cttaccctcctctgc

SEQ ID NO: 6167624 - DNA, 16 bp, Homo sapiens
cttaccctcctctgct

SEQ ID NO: 6167625 - DNA, 13 bp, Homo sapiens
cttacccttagaa

SEQ ID NO: 6167626 - DNA, 23 bp, Homo sapiens
cttacccttctgtgcccagctca

SEQ ID NO: 6167627 - DNA, 23 bp, Homo sapiens
cttacccttggtttgcacataaa

SEQ ID NO: 6167628 - DNA, 15 bp, Homo sapiens
cttaccgagagccaa

SEQ ID NO: 6167629 - DNA, 15 bp, Homo sapiens
cttaccgccctgcgg

SEQ ID NO: 6167630 - DNA, 22 bp, Homo sapiens
cttaccgcgtaatgcgccaata

SEQ ID NO: 6167631 - DNA, 15 bp, Homo sapiens
cttaccgtagcctcc

SEQ ID NO: 6167632 - DNA, 16 bp, Homo sapiens
cttaccgtagcctccg

SEQ ID NO: 6167633 - DNA, 20 bp, Homo sapiens
cttaccgtgggcactgaagg

SEQ ID NO: 6167634 - DNA, 19 bp, Homo sapiens
cttacctaaacagatataa

SEQ ID NO: 6167635 - DNA, 21 bp, Homo sapiens
cttacctaagtgacatttgta

SEQ ID NO: 6167636 - DNA, 22 bp, Homo sapiens
cttacctagtgaaacttttcta

SEQ ID NO: 6167637 - DNA, 15 bp, Homo sapiens
cttacctatttcctc

SEQ ID NO: 6167638 - DNA, 18 bp, Homo sapiens
cttacctattttctgcag

SEQ ID NO: 6167639 - DNA, 17 bp, Homo sapiens
cttacctcccctgccag

SEQ ID NO: 6167640 - DNA, 16 bp, Homo sapiens
cttacctcctgcccag

SEQ ID NO: 6167641 - DNA, 17 bp, Homo sapiens
cttacctcctgcccagg

SEQ ID NO: 6167642 - DNA, 21 bp, Homo sapiens
cttacctcggtgccttcctct

SEQ ID NO: 6167643 - DNA, 17 bp, Homo sapiens
cttacctctcatgcgtg

SEQ ID NO: 6167644 - DNA, 13 bp, Homo sapiens
cttacctcttccg

SEQ ID NO: 6167645 - DNA, 11 bp, Homo sapiens
cttacctgaca

SEQ ID NO: 6167646 - DNA, 13 bp, Homo sapiens
cttacctgacaca

SEQ ID NO: 6167647 - DNA, 21 bp, Homo sapiens
cttacctgacctcttgctgtc

SEQ ID NO: 6167648 - DNA, 18 bp, Homo sapiens
cttacctgcaaactcctt

SEQ ID NO: 6167649 - DNA, 20 bp, Homo sapiens
cttacctgccaggaagccag

SEQ ID NO: 6167650 - DNA, 13 bp, Homo sapiens
cttacctggaaaa

SEQ ID NO: 6167651 - DNA, 12 bp, Homo sapiens
cttacctggccc

SEQ ID NO: 6167652 - DNA, 13 bp, Homo sapiens
cttacctggccca

SEQ ID NO: 6167653 - DNA, 18 bp, Homo sapiens
cttacctggcccatcagg

SEQ ID NO: 6167654 - DNA, 21 bp, Homo sapiens
cttacctggcccatcagggta

SEQ ID NO: 6167655 - DNA, 14 bp, Homo sapiens
cttacctgggcaca

SEQ ID NO: 6167656 - DNA, 15 bp, Homo sapiens
cttacctgtacactg

SEQ ID NO: 6167657 - DNA, 17 bp, Homo sapiens
cttacctgtacactgac

SEQ ID NO: 6167658 - DNA, 16 bp, Homo sapiens
cttacctgtctctctc

SEQ ID NO: 6167659 - DNA, 21 bp, Homo sapiens
cttacctgtgaccctctttgc

SEQ ID NO: 6167660 - DNA, 16 bp, Homo sapiens
cttaccttcaataaag

SEQ ID NO: 6167661 - DNA, 20 bp, Homo sapiens
cttaccttcccgcctcggct

SEQ ID NO: 6167662 - DNA, 12 bp, Homo sapiens
cttaccttgggg

SEQ ID NO: 6167663 - DNA, 18 bp, Homo sapiens
cttaccttggttggaagg

SEQ ID NO: 6167664 - DNA, 16 bp, Homo sapiens
cttacctttaccccat

SEQ ID NO: 6167665 - DNA, 17 bp, Homo sapiens
cttacctttcctgatgc

SEQ ID NO: 6167666 - DNA, 22 bp, Homo sapiens
cttacctttcctgatgcccctg

SEQ ID NO: 6167667 - DNA, 14 bp, Homo sapiens
cttaccttttccta

SEQ ID NO: 6167668 - DNA, 18 bp, Homo sapiens
cttaccttttcctattct

SEQ ID NO: 6167669 - DNA, 22 bp, Homo sapiens
cttacgaaaaaatggtagcatt

SEQ ID NO: 6167670 - DNA, 16 bp, Homo sapiens
cttacgatcaggcaca

SEQ ID NO: 6167671 - DNA, 18 bp, Homo sapiens
cttacgatggcacccagt

SEQ ID NO: 6167672 - DNA, 23 bp, Homo sapiens
cttacgccctgttcccttcctgc

SEQ ID NO: 6167673 - DNA, 12 bp, Homo sapiens
cttacgctctct

SEQ ID NO: 6167674 - DNA, 14 bp, Homo sapiens
cttacgctctgctc

SEQ ID NO: 6167675 - DNA, 21 bp, Homo sapiens
cttacgctctgctcaatgaaa

SEQ ID NO: 6167676 - DNA, 19 bp, Homo sapiens
cttacggtcatgatgtctg

SEQ ID NO: 6167677 - DNA, 22 bp, Homo sapiens
cttacggtgcacagtaatatga

SEQ ID NO: 6167678 - DNA, 14 bp, Homo sapiens
cttacgtaaaacat

SEQ ID NO: 6167679 - DNA, 23 bp, Homo sapiens
cttacgtttaagcttaacatttc

SEQ ID NO: 6167680 - DNA, 13 bp, Homo sapiens
cttactaaaaagt

SEQ ID NO: 6167681 - DNA, 22 bp, Homo sapiens
cttactaaaatatatatagaaa

SEQ ID NO: 6167682 - DNA, 22 bp, Homo sapiens
cttactaaacattttgttattg

SEQ ID NO: 6167683 - DNA, 19 bp, Homo sapiens
cttactaaatatgggaatg

SEQ ID NO: 6167684 - DNA, 13 bp, Homo sapiens
cttactaataaaa

SEQ ID NO: 6167685 - DNA, 18 bp, Homo sapiens
cttactaatgtaaaatga

SEQ ID NO: 6167686 - DNA, 17 bp, Homo sapiens
cttactaatgtgcccca

SEQ ID NO: 6167687 - DNA, 18 bp, Homo sapiens
cttactacatgtgggagc

SEQ ID NO: 6167688 - DNA, 20 bp, Homo sapiens
cttactacatgtgggagctt

SEQ ID NO: 6167689 - DNA, 22 bp, Homo sapiens
cttactacttcttggaaaaaaa

SEQ ID NO: 6167690 - DNA, 20 bp, Homo sapiens
cttactatgatctcaggagc

SEQ ID NO: 6167691 - DNA, 21 bp, Homo sapiens
cttactattcattaaatgttt

SEQ ID NO: 6167692 - DNA, 13 bp, Homo sapiens
cttactattccca

SEQ ID NO: 6167693 - DNA, 16 bp, Homo sapiens
cttactattggtaata

SEQ ID NO: 6167694 - DNA, 12 bp, Homo sapiens
cttactatttaa

SEQ ID NO: 6167695 - DNA, 22 bp, Homo sapiens
cttactattttgacagttattt

SEQ ID NO: 6167696 - DNA, 13 bp, Homo sapiens
cttactcagagct

SEQ ID NO: 6167697 - DNA, 14 bp, Homo sapiens
cttactcagagctg

SEQ ID NO: 6167698 - DNA, 15 bp, Homo sapiens
cttactcagagctgc

SEQ ID NO: 6167699 - DNA, 13 bp, Homo sapiens
cttactcagggga

SEQ ID NO: 6167700 - DNA, 22 bp, Homo sapiens
cttactcattaattcaatgaaa

SEQ ID NO: 6167701 - DNA, 14 bp, Homo sapiens
cttactccaggaga

SEQ ID NO: 6167702 - DNA, 23 bp, Homo sapiens
cttactcccccaccactcaggcc

SEQ ID NO: 6167703 - DNA, 14 bp, Homo sapiens
cttactcctcctct

SEQ ID NO: 6167704 - DNA, 15 bp, Homo sapiens
cttactcctcctctt

SEQ ID NO: 6167705 - DNA, 18 bp, Homo sapiens
cttactcctcctctttct

SEQ ID NO: 6167706 - DNA, 22 bp, Homo sapiens
cttactcctcctctttctctcc

SEQ ID NO: 6167707 - DNA, 23 bp, Homo sapiens
cttactcctcctctttctctccc

SEQ ID NO: 6167708 - DNA, 12 bp, Homo sapiens
cttactcctgtg

SEQ ID NO: 6167709 - DNA, 20 bp, Homo sapiens
cttactcctgtgggagcctc

SEQ ID NO: 6167710 - DNA, 21 bp, Homo sapiens
cttactctactgctgctgaca

SEQ ID NO: 6167711 - DNA, 13 bp, Homo sapiens
cttactctgagcc

SEQ ID NO: 6167712 - DNA, 18 bp, Homo sapiens
cttactctgagcccaggc

SEQ ID NO: 6167713 - DNA, 13 bp, Homo sapiens
cttactctgtctc

SEQ ID NO: 6167714 - DNA, 22 bp, Homo sapiens
cttactctgtctcccaggctgc

SEQ ID NO: 6167715 - DNA, 14 bp, Homo sapiens
cttactcttacacc

SEQ ID NO: 6167716 - DNA, 19 bp, Homo sapiens
cttactcttcttgaaattt

SEQ ID NO: 6167717 - DNA, 14 bp, Homo sapiens
cttactctttccta

SEQ ID NO: 6167718 - DNA, 15 bp, Homo sapiens
cttactctttcctat

SEQ ID NO: 6167719 - DNA, 14 bp, Homo sapiens
cttactgaaagaca

SEQ ID NO: 6167720 - DNA, 18 bp, Homo sapiens
cttactgaagaaatcttt

SEQ ID NO: 6167721 - DNA, 15 bp, Homo sapiens
cttactgaagttcag

SEQ ID NO: 6167722 - DNA, 11 bp, Homo sapiens
cttactgagct

SEQ ID NO: 6167723 - DNA, 12 bp, Homo sapiens
cttactgatata

SEQ ID NO: 6167724 - DNA, 15 bp, Homo sapiens
cttactgatatattt

SEQ ID NO: 6167725 - DNA, 15 bp, Homo sapiens
cttactgatgatgtg

SEQ ID NO: 6167726 - DNA, 21 bp, Homo sapiens
cttactgatttttaagttatt

SEQ ID NO: 6167727 - DNA, 12 bp, Homo sapiens
cttactgcctga

SEQ ID NO: 6167728 - DNA, 22 bp, Homo sapiens
cttactgctatctactaagttt

SEQ ID NO: 6167729 - DNA, 18 bp, Homo sapiens
cttactggcactgtggca

SEQ ID NO: 6167730 - DNA, 17 bp, Homo sapiens
cttactggtccttacca

SEQ ID NO: 6167731 - DNA, 16 bp, Homo sapiens
cttactgtaagacatt

SEQ ID NO: 6167732 - DNA, 17 bp, Homo sapiens
cttactgtaagacatta

SEQ ID NO: 6167733 - DNA, 13 bp, Homo sapiens
cttactgtacatg

SEQ ID NO: 6167734 - DNA, 15 bp, Homo sapiens
cttactgtacctgtt

SEQ ID NO: 6167735 - DNA, 16 bp, Homo sapiens
cttactgtagcctcag

SEQ ID NO: 6167736 - DNA, 12 bp, Homo sapiens
cttactgtatat

SEQ ID NO: 6167737 - DNA, 16 bp, Homo sapiens
cttactgtatatgtat

SEQ ID NO: 6167738 - DNA, 22 bp, Homo sapiens
cttactgtcagttgtacttctg

SEQ ID NO: 6167739 - DNA, 22 bp, Homo sapiens
cttactgtctctcttgtcacat

SEQ ID NO: 6167740 - DNA, 19 bp, Homo sapiens
cttactgtggaggaaggat

SEQ ID NO: 6167741 - DNA, 14 bp, Homo sapiens
cttactgtgttaaa

SEQ ID NO: 6167742 - DNA, 18 bp, Homo sapiens
cttactgttaactgtctt

SEQ ID NO: 6167743 - DNA, 21 bp, Homo sapiens
cttactgtttctgtcaggaga

SEQ ID NO: 6167744 - DNA, 16 bp, Homo sapiens
cttactgttttgtgcg

SEQ ID NO: 6167745 - DNA, 16 bp, Homo sapiens
cttacttaaccaggtt

SEQ ID NO: 6167746 - DNA, 20 bp, Homo sapiens
cttacttaagtcgggggtgg

SEQ ID NO: 6167747 - DNA, 13 bp, Homo sapiens
cttacttacagca

SEQ ID NO: 6167748 - DNA, 14 bp, Homo sapiens
cttacttagtgtta

SEQ ID NO: 6167749 - DNA, 21 bp, Homo sapiens
cttacttcaaagtgcctgggc

SEQ ID NO: 6167750 - DNA, 15 bp, Homo sapiens
cttacttcccccacc

SEQ ID NO: 6167751 - DNA, 23 bp, Homo sapiens
cttacttctcttgccttaaatat

SEQ ID NO: 6167752 - DNA, 16 bp, Homo sapiens
cttacttcttgccctg

SEQ ID NO: 6167753 - DNA, 22 bp, Homo sapiens
cttacttgccaagaaaatgaag

SEQ ID NO: 6167754 - DNA, 14 bp, Homo sapiens
cttacttggaactg

SEQ ID NO: 6167755 - DNA, 14 bp, Homo sapiens
cttactttcctgtg

SEQ ID NO: 6167756 - DNA, 13 bp, Homo sapiens
cttactttgctga

SEQ ID NO: 6167757 - DNA, 20 bp, Homo sapiens
cttactttgcttgagaatcc

SEQ ID NO: 6167758 - DNA, 14 bp, Homo sapiens
cttactttgtaaat

SEQ ID NO: 6167759 - DNA, 15 bp, Homo sapiens
cttactttgtaaatt

SEQ ID NO: 6167760 - DNA, 13 bp, Homo sapiens
cttactttgtatg

SEQ ID NO: 6167761 - DNA, 14 bp, Homo sapiens
cttactttgtgcaa

SEQ ID NO: 6167762 - DNA, 23 bp, Homo sapiens
cttactttgtgcaaaagcaggct

SEQ ID NO: 6167763 - DNA, 11 bp, Homo sapiens
cttactttgtt

SEQ ID NO: 6167764 - DNA, 15 bp, Homo sapiens
cttactttgttaatt

SEQ ID NO: 6167765 - DNA, 21 bp, Homo sapiens
cttacttttaaggataaatca

SEQ ID NO: 6167766 - DNA, 14 bp, Homo sapiens
cttactttttgtaa

SEQ ID NO: 6167767 - DNA, 19 bp, Homo sapiens
cttactttttgtaaatgct

SEQ ID NO: 6167768 - DNA, 22 bp, Homo sapiens
cttagaaaacaatggaatgaga

SEQ ID NO: 6167769 - DNA, 19 bp, Homo sapiens
cttagaaaaccagctcagc

SEQ ID NO: 6167770 - DNA, 20 bp, Homo sapiens
cttagaaaaccagctcagca

SEQ ID NO: 6167771 - DNA, 21 bp, Homo sapiens
cttagaaaaccagctcagcac

SEQ ID NO: 6167772 - DNA, 22 bp, Homo sapiens
cttagaaaaggtgataaaatca

SEQ ID NO: 6167773 - DNA, 21 bp, Homo sapiens
cttagaaaattaaaataggca

SEQ ID NO: 6167774 - DNA, 15 bp, Homo sapiens
cttagaaaattcaag

SEQ ID NO: 6167775 - DNA, 21 bp, Homo sapiens
cttagaaacacataaattatg

SEQ ID NO: 6167776 - DNA, 14 bp, Homo sapiens
cttagaaacactgc

SEQ ID NO: 6167777 - DNA, 15 bp, Homo sapiens
cttagaaacatgttc

SEQ ID NO: 6167778 - DNA, 15 bp, Homo sapiens
cttagaaaccaaatt

SEQ ID NO: 6167779 - DNA, 17 bp, Homo sapiens
cttagaaagcaggggct

SEQ ID NO: 6167780 - DNA, 21 bp, Homo sapiens
cttagaaataacagaagaaaa

SEQ ID NO: 6167781 - DNA, 20 bp, Homo sapiens
cttagaaatcattgtagaaa

SEQ ID NO: 6167782 - DNA, 20 bp, Homo sapiens
cttagaaatgtaaactgcca

SEQ ID NO: 6167783 - DNA, 16 bp, Homo sapiens
cttagaaattgcattt

SEQ ID NO: 6167784 - DNA, 12 bp, Homo sapiens
cttagaacattt

SEQ ID NO: 6167785 - DNA, 18 bp, Homo sapiens
cttagaacccttctgctt

SEQ ID NO: 6167786 - DNA, 20 bp, Homo sapiens
cttagaacccttctgctttc

SEQ ID NO: 6167787 - DNA, 17 bp, Homo sapiens
cttagaacctttctgtg

SEQ ID NO: 6167788 - DNA, 18 bp, Homo sapiens
cttagaactatgctaatt

SEQ ID NO: 6167789 - DNA, 18 bp, Homo sapiens
cttagaagaaattaatat

SEQ ID NO: 6167790 - DNA, 22 bp, Homo sapiens
ctgcagcccaaaacccagggca

SEQ ID NO: 6167791 - DNA, 15 bp, Homo sapiens
ctgcagcccacagag

SEQ ID NO: 6167792 - DNA, 16 bp, Homo sapiens
ctgcagcccacagagg

SEQ ID NO: 6167793 - DNA, 15 bp, Homo sapiens
ctgcagcccagaacg

SEQ ID NO: 6167794 - DNA, 14 bp, Homo sapiens
ctgcagcccaggcc

SEQ ID NO: 6167795 - DNA, 15 bp, Homo sapiens
ctgcagcccaggcca

SEQ ID NO: 6167796 - DNA, 14 bp, Homo sapiens
ctgcagcccattcc

SEQ ID NO: 6167797 - DNA, 24 bp, Homo sapiens
ctgcagcccattcccaagggagac

SEQ ID NO: 6167798 - DNA, 16 bp, Homo sapiens
ctgcagccccaggcct

SEQ ID NO: 6167799 - DNA, 15 bp, Homo sapiens
ctgcagccccccaga

SEQ ID NO: 6167800 - DNA, 14 bp, Homo sapiens
ctgcagccccctgc

SEQ ID NO: 6167801 - DNA, 16 bp, Homo sapiens
ctgcagccccctgctt

SEQ ID NO: 6167802 - DNA, 17 bp, Homo sapiens
ctgcagcccctgggacc

SEQ ID NO: 6167803 - DNA, 19 bp, Homo sapiens
ctgcagccccttgctctca

SEQ ID NO: 6167804 - DNA, 21 bp, Homo sapiens
ctgcagccccttgctctcagc

SEQ ID NO: 6167805 - DNA, 21 bp, Homo sapiens
ctgcagcccgtgtccaggagc

SEQ ID NO: 6167806 - DNA, 19 bp, Homo sapiens
ctgcagccctctccaccct

SEQ ID NO: 6167807 - DNA, 13 bp, Homo sapiens
ctgcagcccttgg

SEQ ID NO: 6167808 - DNA, 18 bp, Homo sapiens
ctgcagcccttgggcagt

SEQ ID NO: 6167809 - DNA, 15 bp, Homo sapiens
ctgcagccgtgcagg

SEQ ID NO: 6167810 - DNA, 16 bp, Homo sapiens
ctgcagccgtgcagga

SEQ ID NO: 6167811 - DNA, 20 bp, Homo sapiens
ctgcagccgtgcaggactct

SEQ ID NO: 6167812 - DNA, 16 bp, Homo sapiens
ctgcagccgtggtcca

SEQ ID NO: 6167813 - DNA, 11 bp, Homo sapiens
ctgcagcctca

SEQ ID NO: 6167814 - DNA, 20 bp, Homo sapiens
ctgcagcctcaacctcctgg

SEQ ID NO: 6167815 - DNA, 13 bp, Homo sapiens
ctgcagcctcaga

SEQ ID NO: 6167816 - DNA, 19 bp, Homo sapiens
ctgcagcctcaggactggg

SEQ ID NO: 6167817 - DNA, 17 bp, Homo sapiens
ctgcagcctccacttcc

SEQ ID NO: 6167818 - DNA, 20 bp, Homo sapiens
ctgcagcctccacttccctc

SEQ ID NO: 6167819 - DNA, 13 bp, Homo sapiens
ctgcagcctcccc

SEQ ID NO: 6167820 - DNA, 13 bp, Homo sapiens
ctgcagcctccct

SEQ ID NO: 6167821 - DNA, 22 bp, Homo sapiens
ctgcagcctcccttccatgccc

SEQ ID NO: 6167822 - DNA, 14 bp, Homo sapiens
ctgcagcctccgcc

SEQ ID NO: 6167823 - DNA, 14 bp, Homo sapiens
ctgcagcctccggg

SEQ ID NO: 6167824 - DNA, 13 bp, Homo sapiens
ctgcagcctcctc

SEQ ID NO: 6167825 - DNA, 18 bp, Homo sapiens
ctgcagcctcctcctgac

SEQ ID NO: 6167826 - DNA, 19 bp, Homo sapiens
ctgcagcctcgaactcctg

SEQ ID NO: 6167827 - DNA, 18 bp, Homo sapiens
ctgcagcctcgacctccc

SEQ ID NO: 6167828 - DNA, 21 bp, Homo sapiens
ctgcagcctcgacctccctgg

SEQ ID NO: 6167829 - DNA, 23 bp, Homo sapiens
ctgcagcctcgacctccctggct

SEQ ID NO: 6167830 - DNA, 12 bp, Homo sapiens
ctgcagcctctc

SEQ ID NO: 6167831 - DNA, 18 bp, Homo sapiens
ctgcagcctctctggctg

SEQ ID NO: 6167832 - DNA, 23 bp, Homo sapiens
ctgcagcctctctggctggtctt

SEQ ID NO: 6167833 - DNA, 17 bp, Homo sapiens
ctgcagcctctgcctct

SEQ ID NO: 6167834 - DNA, 13 bp, Homo sapiens
ctgcagcctgagc

SEQ ID NO: 6167835 - DNA, 12 bp, Homo sapiens
ctgcagcctgca

SEQ ID NO: 6167836 - DNA, 12 bp, Homo sapiens
ctgcagcctgct

SEQ ID NO: 6167837 - DNA, 14 bp, Homo sapiens
ctgcagcctgctgg

SEQ ID NO: 6167838 - DNA, 20 bp, Homo sapiens
ctgcagcctggaggccgggt

SEQ ID NO: 6167839 - DNA, 13 bp, Homo sapiens
ctgcagcctggct

SEQ ID NO: 6167840 - DNA, 14 bp, Homo sapiens
ctgcagcctggctg

SEQ ID NO: 6167841 - DNA, 16 bp, Homo sapiens
ctgcagcctggctggt

SEQ ID NO: 6167842 - DNA, 13 bp, Homo sapiens
ctgcagcctgggc

SEQ ID NO: 6167843 - DNA, 13 bp, Homo sapiens
ctgcagcctgggt

SEQ ID NO: 6167844 - DNA, 20 bp, Homo sapiens
ctgcagcctgggtctggatg

SEQ ID NO: 6167845 - DNA, 20 bp, Homo sapiens
ctgcagcctggtagaattgg

SEQ ID NO: 6167846 - DNA, 22 bp, Homo sapiens
ctgcagccttcatcagaactct

SEQ ID NO: 6167847 - DNA, 17 bp, Homo sapiens
ctgcagccttgaactcc

SEQ ID NO: 6167848 - DNA, 17 bp, Homo sapiens
ctgcagccttgaactct

SEQ ID NO: 6167849 - DNA, 15 bp, Homo sapiens
ctgcagcgcgcacac

SEQ ID NO: 6167850 - DNA, 21 bp, Homo sapiens
ctgcagcggaagggactctgg

SEQ ID NO: 6167851 - DNA, 23 bp, Homo sapiens
ctgcagcggaagggactctgggc

SEQ ID NO: 6167852 - DNA, 18 bp, Homo sapiens
ctgcagcggcagagcaat

SEQ ID NO: 6167853 - DNA, 22 bp, Homo sapiens
ctgcagcggcaggaccgccatg

SEQ ID NO: 6167854 - DNA, 21 bp, Homo sapiens
ctgcagcgggcaaagagctcc

SEQ ID NO: 6167855 - DNA, 13 bp, Homo sapiens
ctgcagctaaccc

SEQ ID NO: 6167856 - DNA, 15 bp, Homo sapiens
ctgcagctagtccta

SEQ ID NO: 6167857 - DNA, 19 bp, Homo sapiens
ctgcagctcaagggctggc

SEQ ID NO: 6167858 - DNA, 17 bp, Homo sapiens
ctgcagctcacccagcc

SEQ ID NO: 6167859 - DNA, 11 bp, Homo sapiens
ctgcagctccc

SEQ ID NO: 6167860 - DNA, 19 bp, Homo sapiens
ctgcagctccctcaaagag

SEQ ID NO: 6167861 - DNA, 18 bp, Homo sapiens
ctgcagctccctggcttc

SEQ ID NO: 6167862 - DNA, 22 bp, Homo sapiens
ctgcagctcctggaaggtgtca

SEQ ID NO: 6167863 - DNA, 17 bp, Homo sapiens
ctgcagctctcatgctg

SEQ ID NO: 6167864 - DNA, 21 bp, Homo sapiens
ctgcagctctttcttctttga

SEQ ID NO: 6167865 - DNA, 12 bp, Homo sapiens
ctgcagctgacc

SEQ ID NO: 6167866 - DNA, 12 bp, Homo sapiens
ctgcagctgccg

SEQ ID NO: 6167867 - DNA, 21 bp, Homo sapiens
ctgcagctggaatgtgccaca

SEQ ID NO: 6167868 - DNA, 18 bp, Homo sapiens
ctgcagctggacagaggg

SEQ ID NO: 6167869 - DNA, 19 bp, Homo sapiens
ctgcagctggacagagggg

SEQ ID NO: 6167870 - DNA, 13 bp, Homo sapiens
ctgcagctgggaa

SEQ ID NO: 6167871 - DNA, 12 bp, Homo sapiens
ctgcagctgggc

SEQ ID NO: 6167872 - DNA, 13 bp, Homo sapiens
ctgcagctgggcc

SEQ ID NO: 6167873 - DNA, 16 bp, Homo sapiens
ctgcagctgggcccca

SEQ ID NO: 6167874 - DNA, 20 bp, Homo sapiens
ctgcagctgggccccatgct

SEQ ID NO: 6167875 - DNA, 13 bp, Homo sapiens
ctgcagctgggct

SEQ ID NO: 6167876 - DNA, 13 bp, Homo sapiens
ctgcagctgggga

SEQ ID NO: 6167877 - DNA, 14 bp, Homo sapiens
ctgcagctggtgtg

SEQ ID NO: 6167878 - DNA, 12 bp, Homo sapiens
ctgcagctgtga

SEQ ID NO: 6167879 - DNA, 13 bp, Homo sapiens
ctgcagctgtgag

SEQ ID NO: 6167880 - DNA, 13 bp, Homo sapiens
ctgcagcttcctg

SEQ ID NO: 6167881 - DNA, 23 bp, Homo sapiens
ctgcaggaaacatttctgacacc

SEQ ID NO: 6167882 - DNA, 15 bp, Homo sapiens
ctgcaggaacgagca

SEQ ID NO: 6167883 - DNA, 23 bp, Homo sapiens
ctgcaggaacgagcactggccag

SEQ ID NO: 6167884 - DNA, 24 bp, Homo sapiens
ctgcaggaacgagcactggccaga

SEQ ID NO: 6167885 - DNA, 13 bp, Homo sapiens
ctgcaggaagaaa

SEQ ID NO: 6167886 - DNA, 17 bp, Homo sapiens
ctgcaggaagaaacttt

SEQ ID NO: 6167887 - DNA, 13 bp, Homo sapiens
ctgcaggaagaga

SEQ ID NO: 6167888 - DNA, 15 bp, Homo sapiens
ctgcaggaaggagct

SEQ ID NO: 6167889 - DNA, 17 bp, Homo sapiens
ctgcaggaaggagctgc

SEQ ID NO: 6167890 - DNA, 20 bp, Homo sapiens
ctgcaggaaggagctgcctg

SEQ ID NO: 6167891 - DNA, 22 bp, Homo sapiens
ctgcaggaaggagctgcctgga

SEQ ID NO: 6167892 - DNA, 18 bp, Homo sapiens
ctgcaggaatcacccctc

SEQ ID NO: 6167893 - DNA, 19 bp, Homo sapiens
ctgcaggaatcacccctct

SEQ ID NO: 6167894 - DNA, 22 bp, Homo sapiens
ctgcaggaatcacccctctgcc

SEQ ID NO: 6167895 - DNA, 20 bp, Homo sapiens
ctgcaggaatcccggctcca

SEQ ID NO: 6167896 - DNA, 23 bp, Homo sapiens
ctgcaggaatcccggctccagag

SEQ ID NO: 6167897 - DNA, 14 bp, Homo sapiens
ctgcaggaatcttt

SEQ ID NO: 6167898 - DNA, 22 bp, Homo sapiens
ctgcaggaatgctgacaatgct

SEQ ID NO: 6167899 - DNA, 17 bp, Homo sapiens
ctgcaggacacagatct

SEQ ID NO: 6167900 - DNA, 13 bp, Homo sapiens
ctgcaggacagag

SEQ ID NO: 6167901 - DNA, 14 bp, Homo sapiens
ctgcaggacagagg

SEQ ID NO: 6167902 - DNA, 16 bp, Homo sapiens
ctgcaggacagaggga

SEQ ID NO: 6167903 - DNA, 20 bp, Homo sapiens
ctgcaggaccctgtcctgca

SEQ ID NO: 6167904 - DNA, 18 bp, Homo sapiens
ctgcaggacctgcctgta

SEQ ID NO: 6167905 - DNA, 21 bp, Homo sapiens
ctgcaggacctgcctgtagcc

SEQ ID NO: 6167906 - DNA, 11 bp, Homo sapiens
ctgcaggactt

SEQ ID NO: 6167907 - DNA, 19 bp, Homo sapiens
ctgcaggacttctgcctga

SEQ ID NO: 6167908 - DNA, 19 bp, Homo sapiens
ctgcaggacttgagaagac

SEQ ID NO: 6167909 - DNA, 13 bp, Homo sapiens
ctgcaggagcagg

SEQ ID NO: 6167910 - DNA, 18 bp, Homo sapiens
ctgcaggagcagggcggc

SEQ ID NO: 6167911 - DNA, 17 bp, Homo sapiens
ctgcaggagggcactgg

SEQ ID NO: 6167912 - DNA, 23 bp, Homo sapiens
ctgcaggagggttggagtgctct

SEQ ID NO: 6167913 - DNA, 22 bp, Homo sapiens
ctgcaggagtgctggcattacc

SEQ ID NO: 6167914 - DNA, 20 bp, Homo sapiens
ctgcaggatctcaccaggca

SEQ ID NO: 6167915 - DNA, 21 bp, Homo sapiens
ctgcaggatctcaccaggcag

SEQ ID NO: 6167916 - DNA, 19 bp, Homo sapiens
ctgcaggatgattgtacag

SEQ ID NO: 6167917 - DNA, 20 bp, Homo sapiens
ctgcaggatgattgtacaga

SEQ ID NO: 6167918 - DNA, 15 bp, Homo sapiens
ctgcaggatggactg

SEQ ID NO: 6167919 - DNA, 12 bp, Homo sapiens
ctgcaggcacac

SEQ ID NO: 6167920 - DNA, 17 bp, Homo sapiens
ctgcaggcacacacgcc

SEQ ID NO: 6167921 - DNA, 18 bp, Homo sapiens
ctgcaggcacacacgcct

SEQ ID NO: 6167922 - DNA, 13 bp, Homo sapiens
ctgcaggcaccgc

SEQ ID NO: 6167923 - DNA, 15 bp, Homo sapiens
ctgcaggcaccgggc

SEQ ID NO: 6167924 - DNA, 22 bp, Homo sapiens
ctgcaggcaccgggctggctgc

SEQ ID NO: 6167925 - DNA, 16 bp, Homo sapiens
ctgcaggcagagctgg

SEQ ID NO: 6167926 - DNA, 11 bp, Homo sapiens
ctgcaggcagg

SEQ ID NO: 6167927 - DNA, 14 bp, Homo sapiens
ctgcaggcaggaac

SEQ ID NO: 6167928 - DNA, 15 bp, Homo sapiens
ctgcaggcaggaaca

SEQ ID NO: 6167929 - DNA, 12 bp, Homo sapiens
ctgcaggcaggc

SEQ ID NO: 6167930 - DNA, 13 bp, Homo sapiens
ctgcaggcaggcg

SEQ ID NO: 6167931 - DNA, 19 bp, Homo sapiens
ctgcaggcaggcggctcct

SEQ ID NO: 6167932 - DNA, 22 bp, Homo sapiens
ctgcaggcaggcggctcctcct

SEQ ID NO: 6167933 - DNA, 23 bp, Homo sapiens
ctgcaggccaagagcagaggcag

SEQ ID NO: 6167934 - DNA, 13 bp, Homo sapiens
ctgcaggccacgc

SEQ ID NO: 6167935 - DNA, 11 bp, Homo sapiens
ctgcaggccag

SEQ ID NO: 6167936 - DNA, 18 bp, Homo sapiens
ctgcaggccaggccagct

SEQ ID NO: 6167937 - DNA, 23 bp, Homo sapiens
ctgcaggccagtcccacggctct

SEQ ID NO: 6167938 - DNA, 16 bp, Homo sapiens
ctgcaggccccagcca

SEQ ID NO: 6167939 - DNA, 18 bp, Homo sapiens
ctgcaggccccagccaag

SEQ ID NO: 6167940 - DNA, 19 bp, Homo sapiens
ctgcaggccccagccaagt

SEQ ID NO: 6167941 - DNA, 22 bp, Homo sapiens
ctgcaggccccagccaagtgcc

SEQ ID NO: 6167942 - DNA, 20 bp, Homo sapiens
ctgcaggccccgcttgtcca

SEQ ID NO: 6167943 - DNA, 22 bp, Homo sapiens
ctgcaggccccgcttgtccagc

SEQ ID NO: 6167944 - DNA, 23 bp, Homo sapiens
ctgcaggccccgcttgtccagcg

SEQ ID NO: 6167945 - DNA, 18 bp, Homo sapiens
ctgcaggccctccctcta

SEQ ID NO: 6167946 - DNA, 14 bp, Homo sapiens
ctgcaggccctggc

SEQ ID NO: 6167947 - DNA, 19 bp, Homo sapiens
ctgcaggccctggcctccc

SEQ ID NO: 6167948 - DNA, 21 bp, Homo sapiens
ctgcaggcctgactactgccc

SEQ ID NO: 6167949 - DNA, 15 bp, Homo sapiens
ctgcaggcggggctc

SEQ ID NO: 6167950 - DNA, 23 bp, Homo sapiens
ctgcaggcggggctcctcctgaa

SEQ ID NO: 6167951 - DNA, 20 bp, Homo sapiens
ctgcaggcggtatccagagg

SEQ ID NO: 6167952 - DNA, 11 bp, Homo sapiens
ctgcaggctcc

SEQ ID NO: 6167953 - DNA, 20 bp, Homo sapiens
ctgcaggctccatgcacctc

SEQ ID NO: 6167954 - DNA, 14 bp, Homo sapiens
ctgcaggctgagtg

SEQ ID NO: 6167955 - DNA, 15 bp, Homo sapiens
ctgcaggctgcacct

SEQ ID NO: 6167956 - DNA, 19 bp, Homo sapiens
ctgcaggctgcaggagggc

SEQ ID NO: 6167957 - DNA, 12 bp, Homo sapiens
ctgcaggctggg

SEQ ID NO: 6167958 - DNA, 14 bp, Homo sapiens
ctgcaggctgggga

SEQ ID NO: 6167959 - DNA, 20 bp, Homo sapiens
ctgcaggctggggaggtgct

SEQ ID NO: 6167960 - DNA, 21 bp, Homo sapiens
ctgcaggctggggaggtgctg

SEQ ID NO: 6167961 - DNA, 23 bp, Homo sapiens
ctgcaggcttaataaaaatgaca

SEQ ID NO: 6167962 - DNA, 15 bp, Homo sapiens
ctgcaggctttgcca

SEQ ID NO: 6167963 - DNA, 20 bp, Homo sapiens
ctgcagggacacgggcagcc

SEQ ID NO: 6167964 - DNA, 17 bp, Homo sapiens
ctgcagggacagagcat

SEQ ID NO: 6167965 - DNA, 18 bp, Homo sapiens
ctgcagggacagttgggt

SEQ ID NO: 6167966 - DNA, 23 bp, Homo sapiens
ctgcagggagcaactctccactc

SEQ ID NO: 6167967 - DNA, 21 bp, Homo sapiens
ctgcagggagcaccacggcca

SEQ ID NO: 6167968 - DNA, 15 bp, Homo sapiens
ctgcagggagcagca

SEQ ID NO: 6167969 - DNA, 22 bp, Homo sapiens
ctgcagggagtccgaaagggac

SEQ ID NO: 6167970 - DNA, 16 bp, Homo sapiens
cttagaagaatattgt

SEQ ID NO: 6167971 - DNA, 16 bp, Homo sapiens
cttagaagccaccatg

SEQ ID NO: 6167972 - DNA, 22 bp, Homo sapiens
cttagaagccatgggacctcct

SEQ ID NO: 6167973 - DNA, 21 bp, Homo sapiens
cttagaaggtattaagattat

SEQ ID NO: 6167974 - DNA, 15 bp, Homo sapiens
cttagaagtcacaca

SEQ ID NO: 6167975 - DNA, 20 bp, Homo sapiens
cttagaagtcacacagtatt

SEQ ID NO: 6167976 - DNA, 18 bp, Homo sapiens
cttagaagtggaccagga

SEQ ID NO: 6167977 - DNA, 22 bp, Homo sapiens
cttagaagtggaccaggacagg

SEQ ID NO: 6167978 - DNA, 23 bp, Homo sapiens
cttagaagtggaccaggacagga

SEQ ID NO: 6167979 - DNA, 15 bp, Homo sapiens
cttagaataaaattg

SEQ ID NO: 6167980 - DNA, 17 bp, Homo sapiens
cttagaataaaattgta

SEQ ID NO: 6167981 - DNA, 11 bp, Homo sapiens
cttagaatgtg

SEQ ID NO: 6167982 - DNA, 14 bp, Homo sapiens
cttagaatgtgaaa

SEQ ID NO: 6167983 - DNA, 15 bp, Homo sapiens
cttagaatgtgaaaa

SEQ ID NO: 6167984 - DNA, 22 bp, Homo sapiens
cttagaatgtttctatttccat

SEQ ID NO: 6167985 - DNA, 18 bp, Homo sapiens
cttagaattatttgcact

SEQ ID NO: 6167986 - DNA, 22 bp, Homo sapiens
cttagaattgctggatgcattt

SEQ ID NO: 6167987 - DNA, 23 bp, Homo sapiens
cttagaattgctggatgcatttt

SEQ ID NO: 6167988 - DNA, 14 bp, Homo sapiens
cttagaatttgttt

SEQ ID NO: 6167989 - DNA, 17 bp, Homo sapiens
cttagacacctatcaga

SEQ ID NO: 6167990 - DNA, 19 bp, Homo sapiens
cttagacactttacctctt

SEQ ID NO: 6167991 - DNA, 18 bp, Homo sapiens
cttagacagtccctgcca

SEQ ID NO: 6167992 - DNA, 19 bp, Homo sapiens
cttagacagtccctgccaa

SEQ ID NO: 6167993 - DNA, 18 bp, Homo sapiens
cttagacccgccaggtca

SEQ ID NO: 6167994 - DNA, 18 bp, Homo sapiens
cttagaccctcatgctgc

SEQ ID NO: 6167995 - DNA, 19 bp, Homo sapiens
cttagaccctcatgctgcc

SEQ ID NO: 6167996 - DNA, 21 bp, Homo sapiens
cttagaccctcatgctgccaa

SEQ ID NO: 6167997 - DNA, 22 bp, Homo sapiens
cttagaccctcatgctgccaat

SEQ ID NO: 6167998 - DNA, 19 bp, Homo sapiens
cttagaccgtggtgtcctc

SEQ ID NO: 6167999 - DNA, 20 bp, Homo sapiens
cttagaccgtggtgtcctct

SEQ ID NO: 6168000 - DNA, 17 bp, Homo sapiens
cttagacctatactgaa

SEQ ID NO: 6168001 - DNA, 15 bp, Homo sapiens
cttagacctcagcct

SEQ ID NO: 6168002 - DNA, 20 bp, Homo sapiens
cttagacctgccagccactg

SEQ ID NO: 6168003 - DNA, 16 bp, Homo sapiens
cttagaccttccataa

SEQ ID NO: 6168004 - DNA, 18 bp, Homo sapiens
cttagaccttccataatg

SEQ ID NO: 6168005 - DNA, 19 bp, Homo sapiens
cttagacggaggtgcctga

SEQ ID NO: 6168006 - DNA, 18 bp, Homo sapiens
cttagactcctcttccca

SEQ ID NO: 6168007 - DNA, 14 bp, Homo sapiens
cttagactccttct

SEQ ID NO: 6168008 - DNA, 17 bp, Homo sapiens
cttagactcgcctatct

SEQ ID NO: 6168009 - DNA, 18 bp, Homo sapiens
cttagactttagtagttt

SEQ ID NO: 6168010 - DNA, 13 bp, Homo sapiens
cttagagaataag

SEQ ID NO: 6168011 - DNA, 16 bp, Homo sapiens
cttagagagagagaga

SEQ ID NO: 6168012 - DNA, 20 bp, Homo sapiens
cttagagattgcatttttat

SEQ ID NO: 6168013 - DNA, 16 bp, Homo sapiens
cttagagattgcccca

SEQ ID NO: 6168014 - DNA, 20 bp, Homo sapiens
cttagagattttcattttag

SEQ ID NO: 6168015 - DNA, 19 bp, Homo sapiens
cttagagcagtttctgtcc

SEQ ID NO: 6168016 - DNA, 18 bp, Homo sapiens
cttagagcatctctgcct

SEQ ID NO: 6168017 - DNA, 12 bp, Homo sapiens
cttagagccagg

SEQ ID NO: 6168018 - DNA, 17 bp, Homo sapiens
cttagagccaggcacac

SEQ ID NO: 6168019 - DNA, 23 bp, Homo sapiens
cttagagccaggcacacactgtg

SEQ ID NO: 6168020 - DNA, 16 bp, Homo sapiens
cttagagcctccctca

SEQ ID NO: 6168021 - DNA, 17 bp, Homo sapiens
cttagagcctccctcaa

SEQ ID NO: 6168022 - DNA, 23 bp, Homo sapiens
cttagagcctccctcaattcccc

SEQ ID NO: 6168023 - DNA, 14 bp, Homo sapiens
cttagagcctcgtc

SEQ ID NO: 6168024 - DNA, 14 bp, Homo sapiens
cttagagctcttgt

SEQ ID NO: 6168025 - DNA, 15 bp, Homo sapiens
cttagaggaaaaggg

SEQ ID NO: 6168026 - DNA, 21 bp, Homo sapiens
cttagagggatttctttgctg

SEQ ID NO: 6168027 - DNA, 19 bp, Homo sapiens
cttagaggggaatgaacca

SEQ ID NO: 6168028 - DNA, 17 bp, Homo sapiens
cttagaggttctgcctc

SEQ ID NO: 6168029 - DNA, 14 bp, Homo sapiens
cttagagtgcccag

SEQ ID NO: 6168030 - DNA, 16 bp, Homo sapiens
cttagagtgcccagca

SEQ ID NO: 6168031 - DNA, 17 bp, Homo sapiens
cttagagtgcccagcag

SEQ ID NO: 6168032 - DNA, 18 bp, Homo sapiens
cttagagtgctgtgagat

SEQ ID NO: 6168033 - DNA, 12 bp, Homo sapiens
cttagagtgtag

SEQ ID NO: 6168034 - DNA, 17 bp, Homo sapiens
cttagagtgtagctgta

SEQ ID NO: 6168035 - DNA, 15 bp, Homo sapiens
cttagagttcttctt

SEQ ID NO: 6168036 - DNA, 17 bp, Homo sapiens
cttagagtttctgtttg

SEQ ID NO: 6168037 - DNA, 18 bp, Homo sapiens
cttagagtttctgtttga

SEQ ID NO: 6168038 - DNA, 23 bp, Homo sapiens
cttagagtttctgtttgattctt

SEQ ID NO: 6168039 - DNA, 16 bp, Homo sapiens
cttagagttttattcc

SEQ ID NO: 6168040 - DNA, 17 bp, Homo sapiens
cttagataatatttctg

SEQ ID NO: 6168041 - DNA, 13 bp, Homo sapiens
cttagatatcttt

SEQ ID NO: 6168042 - DNA, 14 bp, Homo sapiens
cttagatatctttt

SEQ ID NO: 6168043 - DNA, 20 bp, Homo sapiens
cttagatattaaaatttggt

SEQ ID NO: 6168044 - DNA, 21 bp, Homo sapiens
cttagatcatagttttattta

SEQ ID NO: 6168045 - DNA, 21 bp, Homo sapiens
cttagatccaaggcagggaaa

SEQ ID NO: 6168046 - DNA, 14 bp, Homo sapiens
cttagatctctcct

SEQ ID NO: 6168047 - DNA, 16 bp, Homo sapiens
cttagatctgagccct

SEQ ID NO: 6168048 - DNA, 16 bp, Homo sapiens
cttagatctggcatgt

SEQ ID NO: 6168049 - DNA, 23 bp, Homo sapiens
cttagatgcagcgactgtttcag

SEQ ID NO: 6168050 - DNA, 22 bp, Homo sapiens
cttagatgggacgcataatcat

SEQ ID NO: 6168051 - DNA, 13 bp, Homo sapiens
cttagatgtatat

SEQ ID NO: 6168052 - DNA, 21 bp, Homo sapiens
cttagatgtgtctcctgtttc

SEQ ID NO: 6168053 - DNA, 18 bp, Homo sapiens
cttagatgttccaaattt

SEQ ID NO: 6168054 - DNA, 18 bp, Homo sapiens
cttagatgttctaagtct

SEQ ID NO: 6168055 - DNA, 16 bp, Homo sapiens
cttagattcaggggaa

SEQ ID NO: 6168056 - DNA, 17 bp, Homo sapiens
cttagattgaagtaaac

SEQ ID NO: 6168057 - DNA, 15 bp, Homo sapiens
cttagattgtgttcc

SEQ ID NO: 6168058 - DNA, 22 bp, Homo sapiens
cttagattgtgttcctgaagaa

SEQ ID NO: 6168059 - DNA, 23 bp, Homo sapiens
cttagatttaaaggcagacagtt

SEQ ID NO: 6168060 - DNA, 12 bp, Homo sapiens
cttagattttac

SEQ ID NO: 6168061 - DNA, 16 bp, Homo sapiens
cttagattttacatga

SEQ ID NO: 6168062 - DNA, 20 bp, Homo sapiens
cttagattttacatgaagta

SEQ ID NO: 6168063 - DNA, 13 bp, Homo sapiens
cttagattttctg

SEQ ID NO: 6168064 - DNA, 15 bp, Homo sapiens
cttagcaaaaagtgg

SEQ ID NO: 6168065 - DNA, 16 bp, Homo sapiens
cttagcaccttcaggg

SEQ ID NO: 6168066 - DNA, 14 bp, Homo sapiens
cttagcagatgctg

SEQ ID NO: 6168067 - DNA, 16 bp, Homo sapiens
cttagcagccctggat

SEQ ID NO: 6168068 - DNA, 16 bp, Homo sapiens
cttagcagctatctct

SEQ ID NO: 6168069 - DNA, 16 bp, Homo sapiens
cttagcagctcaggcg

SEQ ID NO: 6168070 - DNA, 19 bp, Homo sapiens
cttagcagctcaggcgcag

SEQ ID NO: 6168071 - DNA, 13 bp, Homo sapiens
cttagcaggagag

SEQ ID NO: 6168072 - DNA, 21 bp, Homo sapiens
cttagcaggagaggagagcca

SEQ ID NO: 6168073 - DNA, 22 bp, Homo sapiens
cttagcaggagaggagagccag

SEQ ID NO: 6168074 - DNA, 12 bp, Homo sapiens
cttagcagtccc

SEQ ID NO: 6168075 - DNA, 20 bp, Homo sapiens
cttagcatcctaagaaatat

SEQ ID NO: 6168076 - DNA, 21 bp, Homo sapiens
cttagcatgcctccaaaaatt

SEQ ID NO: 6168077 - DNA, 17 bp, Homo sapiens
cttagcatgtgactcct

SEQ ID NO: 6168078 - DNA, 18 bp, Homo sapiens
cttagcatgtgttgaaaa

SEQ ID NO: 6168079 - DNA, 16 bp, Homo sapiens
cttagcatgtttgctg

SEQ ID NO: 6168080 - DNA, 19 bp, Homo sapiens
cttagcattttctgcatct

SEQ ID NO: 6168081 - DNA, 20 bp, Homo sapiens
cttagccagttcaaagtgta

SEQ ID NO: 6168082 - DNA, 15 bp, Homo sapiens
cttagccattgaaat

SEQ ID NO: 6168083 - DNA, 15 bp, Homo sapiens
cttagcccaagaggt

SEQ ID NO: 6168084 - DNA, 21 bp, Homo sapiens
cttagcccaagaggtctgagc

SEQ ID NO: 6168085 - DNA, 20 bp, Homo sapiens
cttagcccccacccacttcc

SEQ ID NO: 6168086 - DNA, 19 bp, Homo sapiens
cttagccccttggattcct

SEQ ID NO: 6168087 - DNA, 23 bp, Homo sapiens
cttagccccttggattcctgcac

SEQ ID NO: 6168088 - DNA, 22 bp, Homo sapiens
cttagcccggatgcccacccct

SEQ ID NO: 6168089 - DNA, 17 bp, Homo sapiens
cttagccctcaccacag

SEQ ID NO: 6168090 - DNA, 15 bp, Homo sapiens
cttagccgcaccctg

SEQ ID NO: 6168091 - DNA, 20 bp, Homo sapiens
cttagccgcaccctgcacct

SEQ ID NO: 6168092 - DNA, 17 bp, Homo sapiens
cttagcctcctgacctg

SEQ ID NO: 6168093 - DNA, 15 bp, Homo sapiens
cttagcctctcccac

SEQ ID NO: 6168094 - DNA, 17 bp, Homo sapiens
cttagcctctggatcta

SEQ ID NO: 6168095 - DNA, 19 bp, Homo sapiens
cttagcctcttggaaatca

SEQ ID NO: 6168096 - DNA, 22 bp, Homo sapiens
cttagcctcttggaaatcaggt

SEQ ID NO: 6168097 - DNA, 15 bp, Homo sapiens
cttagcctgcctcac

SEQ ID NO: 6168098 - DNA, 18 bp, Homo sapiens
cttagcctggacctctga

SEQ ID NO: 6168099 - DNA, 20 bp, Homo sapiens
cttagcctggacctctgaca

SEQ ID NO: 6168100 - DNA, 14 bp, Homo sapiens
cttagcctggagca

SEQ ID NO: 6168101 - DNA, 17 bp, Homo sapiens
cttagcctggagcacct

SEQ ID NO: 6168102 - DNA, 17 bp, Homo sapiens
cttagccttgctgtaga

SEQ ID NO: 6168103 - DNA, 15 bp, Homo sapiens
cttagccttgtgccc

SEQ ID NO: 6168104 - DNA, 16 bp, Homo sapiens
cttagccttgtgccct

SEQ ID NO: 6168105 - DNA, 17 bp, Homo sapiens
cttagccttgtgccctg

SEQ ID NO: 6168106 - DNA, 23 bp, Homo sapiens
cttagccttgtgccctgccccca

SEQ ID NO: 6168107 - DNA, 14 bp, Homo sapiens
cttagcctttcttt

SEQ ID NO: 6168108 - DNA, 17 bp, Homo sapiens
cttagcgttctggactc

SEQ ID NO: 6168109 - DNA, 23 bp, Homo sapiens
cttagcgttctggactctgcccc

SEQ ID NO: 6168110 - DNA, 21 bp, Homo sapiens
cttagctaaatgcaatttaaa

SEQ ID NO: 6168111 - DNA, 20 bp, Homo sapiens
cttagctatccttggctttc

SEQ ID NO: 6168112 - DNA, 20 bp, Homo sapiens
cttagctatgtttccatctt

SEQ ID NO: 6168113 - DNA, 19 bp, Homo sapiens
cttagctatttatcccttt

SEQ ID NO: 6168114 - DNA, 22 bp, Homo sapiens
cttagctcaatgagcatgttta

SEQ ID NO: 6168115 - DNA, 22 bp, Homo sapiens
cttagctcattctccttgtgtt

SEQ ID NO: 6168116 - DNA, 23 bp, Homo sapiens
cttagctcattctccttgtgtta

SEQ ID NO: 6168117 - DNA, 13 bp, Homo sapiens
cttagctcccagc

SEQ ID NO: 6168118 - DNA, 14 bp, Homo sapiens
cttagctcccagct

SEQ ID NO: 6168119 - DNA, 14 bp, Homo sapiens
cttagctcccctcc

SEQ ID NO: 6168120 - DNA, 17 bp, Homo sapiens
cttagctcccctccaac

SEQ ID NO: 6168121 - DNA, 14 bp, Homo sapiens
cttagctctgccct

SEQ ID NO: 6168122 - DNA, 22 bp, Homo sapiens
cttagctctggacgtgaaatac

SEQ ID NO: 6168123 - DNA, 14 bp, Homo sapiens
cttagctctttctc

SEQ ID NO: 6168124 - DNA, 15 bp, Homo sapiens
cttagctgaggctga

SEQ ID NO: 6168125 - DNA, 14 bp, Homo sapiens
cttagctgagtgga

SEQ ID NO: 6168126 - DNA, 16 bp, Homo sapiens
cttagctgccagtgct

SEQ ID NO: 6168127 - DNA, 12 bp, Homo sapiens
cttagctgccat

SEQ ID NO: 6168128 - DNA, 20 bp, Homo sapiens
cttagctgccatcttgcttt

SEQ ID NO: 6168129 - DNA, 12 bp, Homo sapiens
cttagctggaga

SEQ ID NO: 6168130 - DNA, 14 bp, Homo sapiens
cttagctggagatg

SEQ ID NO: 6168131 - DNA, 22 bp, Homo sapiens
cttagctggatataatgtattt

SEQ ID NO: 6168132 - DNA, 17 bp, Homo sapiens
cttagctgttggaatgt

SEQ ID NO: 6168133 - DNA, 15 bp, Homo sapiens
cttagcttacaggaa

SEQ ID NO: 6168134 - DNA, 17 bp, Homo sapiens
cttagcttagaccgtgg

SEQ ID NO: 6168135 - DNA, 19 bp, Homo sapiens
cttagcttagaccgtggtg

SEQ ID NO: 6168136 - DNA, 14 bp, Homo sapiens
cttagcttatcaat

SEQ ID NO: 6168137 - DNA, 16 bp, Homo sapiens
cttagcttatcaattt

SEQ ID NO: 6168138 - DNA, 21 bp, Homo sapiens
cttagcttattgatcccacat

SEQ ID NO: 6168139 - DNA, 18 bp, Homo sapiens
cttagcttcaggaacctc

SEQ ID NO: 6168140 - DNA, 23 bp, Homo sapiens
cttagcttctattatagccacat

SEQ ID NO: 6168141 - DNA, 11 bp, Homo sapiens
cttagcttgca

SEQ ID NO: 6168142 - DNA, 16 bp, Homo sapiens
cttagctttccacagg

SEQ ID NO: 6168143 - DNA, 17 bp, Homo sapiens
cttagctttccctgtgc

SEQ ID NO: 6168144 - DNA, 17 bp, Homo sapiens
cttagctttttaattgt

SEQ ID NO: 6168145 - DNA, 19 bp, Homo sapiens
cttaggaaaatgcttctgt

SEQ ID NO: 6168146 - DNA, 20 bp, Homo sapiens
cttaggaaaatgcttctgtt

SEQ ID NO: 6168147 - DNA, 13 bp, Homo sapiens
cttaggaagaaat

SEQ ID NO: 6168148 - DNA, 11 bp, Homo sapiens
ctgcagggcca

SEQ ID NO: 6168149 - DNA, 16 bp, Homo sapiens
ctgcagggccaagcac

SEQ ID NO: 6168150 - DNA, 16 bp, Homo sapiens
ctgcagggccaggact

SEQ ID NO: 6168151 - DNA, 17 bp, Homo sapiens
ctgcagggccaggactg

SEQ ID NO: 6168152 - DNA, 14 bp, Homo sapiens
ctgcagggccatct

SEQ ID NO: 6168153 - DNA, 23 bp, Homo sapiens
ctgcagggccatctgactgccaa

SEQ ID NO: 6168154 - DNA, 20 bp, Homo sapiens
ctgcagggccatggctcagg

SEQ ID NO: 6168155 - DNA, 20 bp, Homo sapiens
ctgcagggccgcgagaggcc

SEQ ID NO: 6168156 - DNA, 15 bp, Homo sapiens
ctgcagggcctctgt

SEQ ID NO: 6168157 - DNA, 16 bp, Homo sapiens
ctgcagggcctctgtc

SEQ ID NO: 6168158 - DNA, 17 bp, Homo sapiens
ctgcagggcgcccctgg

SEQ ID NO: 6168159 - DNA, 21 bp, Homo sapiens
ctgcagggcgcccctgggaga

SEQ ID NO: 6168160 - DNA, 23 bp, Homo sapiens
ctgcagggcgcccctgggagaca

SEQ ID NO: 6168161 - DNA, 14 bp, Homo sapiens
ctgcagggctccca

SEQ ID NO: 6168162 - DNA, 15 bp, Homo sapiens
ctgcagggctcccat

SEQ ID NO: 6168163 - DNA, 16 bp, Homo sapiens
ctgcagggctcccatg

SEQ ID NO: 6168164 - DNA, 16 bp, Homo sapiens
ctgcagggctgctgtg

SEQ ID NO: 6168165 - DNA, 17 bp, Homo sapiens
ctgcagggctgctgtgg

SEQ ID NO: 6168166 - DNA, 19 bp, Homo sapiens
ctgcagggctgctgtggcc

SEQ ID NO: 6168167 - DNA, 13 bp, Homo sapiens
ctgcagggctggg

SEQ ID NO: 6168168 - DNA, 14 bp, Homo sapiens
ctgcagggcttctc

SEQ ID NO: 6168169 - DNA, 16 bp, Homo sapiens
ctgcagggcttctcct

SEQ ID NO: 6168170 - DNA, 22 bp, Homo sapiens
ctgcaggggcaggagaggctgg

SEQ ID NO: 6168171 - DNA, 16 bp, Homo sapiens
ctgcaggggcctctgt

SEQ ID NO: 6168172 - DNA, 19 bp, Homo sapiens
ctgcaggggcctctgttcc

SEQ ID NO: 6168173 - DNA, 17 bp, Homo sapiens
ctgcaggggcctggagg

SEQ ID NO: 6168174 - DNA, 15 bp, Homo sapiens
ctgcaggggctctgg

SEQ ID NO: 6168175 - DNA, 21 bp, Homo sapiens
ctgcagggggaggaggacttg

SEQ ID NO: 6168176 - DNA, 14 bp, Homo sapiens
ctgcaggggtctgg

SEQ ID NO: 6168177 - DNA, 16 bp, Homo sapiens
ctgcagggtgacgcct

SEQ ID NO: 6168178 - DNA, 19 bp, Homo sapiens
ctgcagggtggtgctggga

SEQ ID NO: 6168179 - DNA, 23 bp, Homo sapiens
ctgcagggtggtgctgggactga

SEQ ID NO: 6168180 - DNA, 20 bp, Homo sapiens
ctgcaggtacttcctcctga

SEQ ID NO: 6168181 - DNA, 17 bp, Homo sapiens
ctgcaggtcagttgtaa

SEQ ID NO: 6168182 - DNA, 21 bp, Homo sapiens
ctgcaggtcagttgtaataaa

SEQ ID NO: 6168183 - DNA, 17 bp, Homo sapiens
ctgcaggtccctaataa

SEQ ID NO: 6168184 - DNA, 18 bp, Homo sapiens
ctgcaggtccctaataaa

SEQ ID NO: 6168185 - DNA, 20 bp, Homo sapiens
ctgcaggtccggggaggagg

SEQ ID NO: 6168186 - DNA, 21 bp, Homo sapiens
ctgcaggtccggggaggaggt

SEQ ID NO: 6168187 - DNA, 17 bp, Homo sapiens
ctgcaggtgagcagaca

SEQ ID NO: 6168188 - DNA, 14 bp, Homo sapiens
ctgcaggtgcccat

SEQ ID NO: 6168189 - DNA, 19 bp, Homo sapiens
ctgcaggtgctgctgcgtg

SEQ ID NO: 6168190 - DNA, 19 bp, Homo sapiens
ctgcaggtggcctccctcc

SEQ ID NO: 6168191 - DNA, 21 bp, Homo sapiens
ctgcaggtggcctccctccag

SEQ ID NO: 6168192 - DNA, 13 bp, Homo sapiens
ctgcaggtgggac

SEQ ID NO: 6168193 - DNA, 14 bp, Homo sapiens
ctgcaggtgggctg

SEQ ID NO: 6168194 - DNA, 13 bp, Homo sapiens
ctgcaggtgtcta

SEQ ID NO: 6168195 - DNA, 21 bp, Homo sapiens
ctgcaggttgaagccatgtct

SEQ ID NO: 6168196 - DNA, 23 bp, Homo sapiens
ctgcaggtttgtaatgcaaaagg

SEQ ID NO: 6168197 - DNA, 17 bp, Homo sapiens
ctgcagtaaatctttta

SEQ ID NO: 6168198 - DNA, 18 bp, Homo sapiens
ctgcagtaacactggcct

SEQ ID NO: 6168199 - DNA, 20 bp, Homo sapiens
ctgcagtaacactggccttc

SEQ ID NO: 6168200 - DNA, 17 bp, Homo sapiens
ctgcagtaatctccagg

SEQ ID NO: 6168201 - DNA, 18 bp, Homo sapiens
ctgcagtaatctccaggg

SEQ ID NO: 6168202 - DNA, 20 bp, Homo sapiens
ctgcagtaggggacccagag

SEQ ID NO: 6168203 - DNA, 16 bp, Homo sapiens
ctgcagtagtctctgt

SEQ ID NO: 6168204 - DNA, 20 bp, Homo sapiens
ctgcagtagtctctgtgctt

SEQ ID NO: 6168205 - DNA, 17 bp, Homo sapiens
ctgcagtatgaaaataa

SEQ ID NO: 6168206 - DNA, 11 bp, Homo sapiens
ctgcagtcaca

SEQ ID NO: 6168207 - DNA, 18 bp, Homo sapiens
ctgcagtcacattgatgt

SEQ ID NO: 6168208 - DNA, 17 bp, Homo sapiens
ctgcagtcacccctgtc

SEQ ID NO: 6168209 - DNA, 15 bp, Homo sapiens
ctgcagtcacctctt

SEQ ID NO: 6168210 - DNA, 22 bp, Homo sapiens
ctgcagtcacgtgaggcccctg

SEQ ID NO: 6168211 - DNA, 12 bp, Homo sapiens
ctgcagtcagat

SEQ ID NO: 6168212 - DNA, 18 bp, Homo sapiens
ctgcagtcagcacagaga

SEQ ID NO: 6168213 - DNA, 13 bp, Homo sapiens
ctgcagtcagccc

SEQ ID NO: 6168214 - DNA, 23 bp, Homo sapiens
ctgcagtcagccctgattgtgcc

SEQ ID NO: 6168215 - DNA, 17 bp, Homo sapiens
ctgcagtcagggcccag

SEQ ID NO: 6168216 - DNA, 19 bp, Homo sapiens
ctgcagtcatcaacaatga

SEQ ID NO: 6168217 - DNA, 21 bp, Homo sapiens
ctgcagtcatctcccctcctg

SEQ ID NO: 6168218 - DNA, 17 bp, Homo sapiens
ctgcagtcccacactgt

SEQ ID NO: 6168219 - DNA, 18 bp, Homo sapiens
ctgcagtcctactcaagc

SEQ ID NO: 6168220 - DNA, 22 bp, Homo sapiens
ctgcagtcctactcaagcgggt

SEQ ID NO: 6168221 - DNA, 23 bp, Homo sapiens
ctgcagtcctactcaagcgggtg

SEQ ID NO: 6168222 - DNA, 16 bp, Homo sapiens
ctgcagtcctccgggg

SEQ ID NO: 6168223 - DNA, 21 bp, Homo sapiens
ctgcagtcctccggggtgggt

SEQ ID NO: 6168224 - DNA, 19 bp, Homo sapiens
ctgcagtcctcggcagctc

SEQ ID NO: 6168225 - DNA, 13 bp, Homo sapiens
ctgcagtcctgga

SEQ ID NO: 6168226 - DNA, 16 bp, Homo sapiens
ctgcagtcgcttgcca

SEQ ID NO: 6168227 - DNA, 22 bp, Homo sapiens
ctgcagtcgcttgccaaagcag

SEQ ID NO: 6168228 - DNA, 19 bp, Homo sapiens
ctgcagtctccgcctcctg

SEQ ID NO: 6168229 - DNA, 21 bp, Homo sapiens
ctgcagtctctataccaataa

SEQ ID NO: 6168230 - DNA, 23 bp, Homo sapiens
ctgcagtctctataccaataaag

SEQ ID NO: 6168231 - DNA, 21 bp, Homo sapiens
ctgcagtctggctgagccctg

SEQ ID NO: 6168232 - DNA, 17 bp, Homo sapiens
ctgcagtcttatttcca

SEQ ID NO: 6168233 - DNA, 23 bp, Homo sapiens
ctgcagtcttctctctggctcag

SEQ ID NO: 6168234 - DNA, 13 bp, Homo sapiens
ctgcagtcttctg

SEQ ID NO: 6168235 - DNA, 15 bp, Homo sapiens
ctgcagtctttattt

SEQ ID NO: 6168236 - DNA, 9 bp, Homo sapiens
ctgcagtga

SEQ ID NO: 6168237 - DNA, 18 bp, Homo sapiens
ctgcagtgagctgtgatt

SEQ ID NO: 6168238 - DNA, 16 bp, Homo sapiens
ctgcagtgaggctgtg

SEQ ID NO: 6168239 - DNA, 15 bp, Homo sapiens
ctgcagtgaggggag

SEQ ID NO: 6168240 - DNA, 20 bp, Homo sapiens
ctgcagtgattcagcaggcc

SEQ ID NO: 6168241 - DNA, 14 bp, Homo sapiens
ctgcagtgccagct

SEQ ID NO: 6168242 - DNA, 16 bp, Homo sapiens
ctgcagtgccagctcc

SEQ ID NO: 6168243 - DNA, 13 bp, Homo sapiens
ctgcagtggctcc

SEQ ID NO: 6168244 - DNA, 19 bp, Homo sapiens
ctgcagtggctcccctgcc

SEQ ID NO: 6168245 - DNA, 20 bp, Homo sapiens
ctgcagtgggttctccaaac

SEQ ID NO: 6168246 - DNA, 14 bp, Homo sapiens
ctgcagtggtgtga

SEQ ID NO: 6168247 - DNA, 13 bp, Homo sapiens
ctgcagtgtccat

SEQ ID NO: 6168248 - DNA, 16 bp, Homo sapiens
ctgcagtgtggagttc

SEQ ID NO: 6168249 - DNA, 22 bp, Homo sapiens
ctgcagtgttcgcttggctcca

SEQ ID NO: 6168250 - DNA, 21 bp, Homo sapiens
ctgcagtgttctgtgaatagc

SEQ ID NO: 6168251 - DNA, 22 bp, Homo sapiens
ctgcagttaccacagcaactga

SEQ ID NO: 6168252 - DNA, 18 bp, Homo sapiens
ctgcagttagcacagagg

SEQ ID NO: 6168253 - DNA, 23 bp, Homo sapiens
ctgcagttcatccgcactgtaaa

SEQ ID NO: 6168254 - DNA, 20 bp, Homo sapiens
ctgcagttcccctggaagca

SEQ ID NO: 6168255 - DNA, 20 bp, Homo sapiens
ctgcagttctactcaggctg

SEQ ID NO: 6168256 - DNA, 17 bp, Homo sapiens
ctgcagttctttttgta

SEQ ID NO: 6168257 - DNA, 21 bp, Homo sapiens
ctgcagttctttttgtacact

SEQ ID NO: 6168258 - DNA, 18 bp, Homo sapiens
ctgcagttgaagagcctg

SEQ ID NO: 6168259 - DNA, 17 bp, Homo sapiens
ctgcagttgactttctc

SEQ ID NO: 6168260 - DNA, 16 bp, Homo sapiens
ctgcagttgccagtca

SEQ ID NO: 6168261 - DNA, 21 bp, Homo sapiens
ctgcagttgccagtcaccccg

SEQ ID NO: 6168262 - DNA, 18 bp, Homo sapiens
ctgcagttggcagaaagg

SEQ ID NO: 6168263 - DNA, 14 bp, Homo sapiens
ctgcagtttcctgg

SEQ ID NO: 6168264 - DNA, 21 bp, Homo sapiens
ctgcagtttgagacaggagac

SEQ ID NO: 6168265 - DNA, 15 bp, Homo sapiens
ctgcagtttggccct

SEQ ID NO: 6168266 - DNA, 18 bp, Homo sapiens
ctgcagtttggccctgga

SEQ ID NO: 6168267 - DNA, 20 bp, Homo sapiens
ctgcagtttggccctggagc

SEQ ID NO: 6168268 - DNA, 15 bp, Homo sapiens
ctgcagtttgtgaac

SEQ ID NO: 6168269 - DNA, 16 bp, Homo sapiens
ctgcagttttgctatc

SEQ ID NO: 6168270 - DNA, 21 bp, Homo sapiens
ctgcagttttgctatctgggc

SEQ ID NO: 6168271 - DNA, 18 bp, Homo sapiens
ctgcagtttttcaggagc

SEQ ID NO: 6168272 - DNA, 24 bp, Homo sapiens
ctgcagtttttcaggagcgcaaga

SEQ ID NO: 6168273 - DNA, 15 bp, Homo sapiens
ctgcagtttttccca

SEQ ID NO: 6168274 - DNA, 22 bp, Homo sapiens
ctgcataaaaaggtctttaaaa

SEQ ID NO: 6168275 - DNA, 13 bp, Homo sapiens
ctgcataaaattc

SEQ ID NO: 6168276 - DNA, 16 bp, Homo sapiens
ctgcataaatttgtaa

SEQ ID NO: 6168277 - DNA, 21 bp, Homo sapiens
ctgcataacagcttgaaaact

SEQ ID NO: 6168278 - DNA, 21 bp, Homo sapiens
ctgcataagattatatacaaa

SEQ ID NO: 6168279 - DNA, 23 bp, Homo sapiens
ctgcataagattatatacaaagc

SEQ ID NO: 6168280 - DNA, 16 bp, Homo sapiens
ctgcatacaggggagg

SEQ ID NO: 6168281 - DNA, 18 bp, Homo sapiens
ctgcatacaggggagggg

SEQ ID NO: 6168282 - DNA, 22 bp, Homo sapiens
ctgcatacaggggaggggcgca

SEQ ID NO: 6168283 - DNA, 16 bp, Homo sapiens
ctgcataccaacctgg

SEQ ID NO: 6168284 - DNA, 17 bp, Homo sapiens
ctgcatacccgggcagg

SEQ ID NO: 6168285 - DNA, 13 bp, Homo sapiens
ctgcataccctca

SEQ ID NO: 6168286 - DNA, 17 bp, Homo sapiens
ctgcatacgagagactt

SEQ ID NO: 6168287 - DNA, 20 bp, Homo sapiens
ctgcatagaaggaggagagg

SEQ ID NO: 6168288 - DNA, 14 bp, Homo sapiens
ctgcatagacaaag

SEQ ID NO: 6168289 - DNA, 19 bp, Homo sapiens
ctgcatagacaaaggcctt

SEQ ID NO: 6168290 - DNA, 14 bp, Homo sapiens
ctgcatagccggtg

SEQ ID NO: 6168291 - DNA, 16 bp, Homo sapiens
ctgcatagctctattt

SEQ ID NO: 6168292 - DNA, 18 bp, Homo sapiens
ctgcatagctctatttta

SEQ ID NO: 6168293 - DNA, 19 bp, Homo sapiens
ctgcatagcttttccctgt

SEQ ID NO: 6168294 - DNA, 19 bp, Homo sapiens
ctgcataggctccttcctg

SEQ ID NO: 6168295 - DNA, 14 bp, Homo sapiens
ctgcatagtctgtt

SEQ ID NO: 6168296 - DNA, 21 bp, Homo sapiens
ctgcatatagataattatcca

SEQ ID NO: 6168297 - DNA, 18 bp, Homo sapiens
ctgcatatcggaggtggt

SEQ ID NO: 6168298 - DNA, 21 bp, Homo sapiens
ctgcatatctctagtccctgt

SEQ ID NO: 6168299 - DNA, 16 bp, Homo sapiens
ctgcatatttctgtat

SEQ ID NO: 6168300 - DNA, 21 bp, Homo sapiens
ctgcatatttctgtatatttg

SEQ ID NO: 6168301 - DNA, 23 bp, Homo sapiens
ctgcatcaagacttcaatcctga

SEQ ID NO: 6168302 - DNA, 19 bp, Homo sapiens
ctgcatcagcctctggcca

SEQ ID NO: 6168303 - DNA, 19 bp, Homo sapiens
ctgcatcagctttttgtat

SEQ ID NO: 6168304 - DNA, 20 bp, Homo sapiens
ctgcatcatatatttaacaa

SEQ ID NO: 6168305 - DNA, 18 bp, Homo sapiens
ctgcatcatctgtagata

SEQ ID NO: 6168306 - DNA, 19 bp, Homo sapiens
ctgcatcatctgtttgtaa

SEQ ID NO: 6168307 - DNA, 12 bp, Homo sapiens
ctgcatcatctt

SEQ ID NO: 6168308 - DNA, 13 bp, Homo sapiens
ctgcatccaggcc

SEQ ID NO: 6168309 - DNA, 19 bp, Homo sapiens
ctgcatccattctcctgag

SEQ ID NO: 6168310 - DNA, 18 bp, Homo sapiens
ctgcatcccagcacctgc

SEQ ID NO: 6168311 - DNA, 14 bp, Homo sapiens
ctgcatccccttcc

SEQ ID NO: 6168312 - DNA, 18 bp, Homo sapiens
ctgcatccccttccagct

SEQ ID NO: 6168313 - DNA, 23 bp, Homo sapiens
ctgcatccccttccagctccctc

SEQ ID NO: 6168314 - DNA, 13 bp, Homo sapiens
ctgcatccctcca

SEQ ID NO: 6168315 - DNA, 14 bp, Homo sapiens
ctgcatccctccac

SEQ ID NO: 6168316 - DNA, 21 bp, Homo sapiens
ctgcatccctccaccccagtc

SEQ ID NO: 6168317 - DNA, 21 bp, Homo sapiens
ctgcatccctgtgtccactga

SEQ ID NO: 6168318 - DNA, 20 bp, Homo sapiens
ctgcatcccttggcccctct

SEQ ID NO: 6168319 - DNA, 19 bp, Homo sapiens
ctgcatccgtagttccctg

SEQ ID NO: 6168320 - DNA, 15 bp, Homo sapiens
ctgcatcctcagccc

SEQ ID NO: 6168321 - DNA, 19 bp, Homo sapiens
ctgcatcctcagccccagg

SEQ ID NO: 6168322 - DNA, 15 bp, Homo sapiens
ctgcatcctctcccc

SEQ ID NO: 6168323 - DNA, 16 bp, Homo sapiens
ctgcatcctctccccc

SEQ ID NO: 6168324 - DNA, 16 bp, Homo sapiens
ctgcatcctgaggcca

SEQ ID NO: 6168325 - DNA, 21 bp, Homo sapiens
cttaggaagaaatcacttaaa

SEQ ID NO: 6168326 - DNA, 22 bp, Homo sapiens
cttaggaagcagtccctggaga

SEQ ID NO: 6168327 - DNA, 21 bp, Homo sapiens
cttaggaatgacttgggttta

SEQ ID NO: 6168328 - DNA, 20 bp, Homo sapiens
cttaggactacattttgctc

SEQ ID NO: 6168329 - DNA, 23 bp, Homo sapiens
cttaggagacagatcactcctgg

SEQ ID NO: 6168330 - DNA, 20 bp, Homo sapiens
cttaggagacgctgcacttg

SEQ ID NO: 6168331 - DNA, 18 bp, Homo sapiens
cttaggagcagagctctg

SEQ ID NO: 6168332 - DNA, 16 bp, Homo sapiens
cttaggagttttgttt

SEQ ID NO: 6168333 - DNA, 15 bp, Homo sapiens
cttaggatatttgag

SEQ ID NO: 6168334 - DNA, 16 bp, Homo sapiens
cttaggatgtgtgcat

SEQ ID NO: 6168335 - DNA, 18 bp, Homo sapiens
cttaggatgtgtgcatgt

SEQ ID NO: 6168336 - DNA, 16 bp, Homo sapiens
cttaggatttaccaaa

SEQ ID NO: 6168337 - DNA, 18 bp, Homo sapiens
cttaggcacatcaattaa

SEQ ID NO: 6168338 - DNA, 18 bp, Homo sapiens
cttaggcactttttaaca

SEQ ID NO: 6168339 - DNA, 14 bp, Homo sapiens
cttaggcagggaag

SEQ ID NO: 6168340 - DNA, 15 bp, Homo sapiens
cttaggcagggaagt

SEQ ID NO: 6168341 - DNA, 16 bp, Homo sapiens
cttaggcatgtgctgg

SEQ ID NO: 6168342 - DNA, 19 bp, Homo sapiens
cttaggcctctctgcctgg

SEQ ID NO: 6168343 - DNA, 15 bp, Homo sapiens
cttaggccttcctct

SEQ ID NO: 6168344 - DNA, 13 bp, Homo sapiens
cttaggctactgt

SEQ ID NO: 6168345 - DNA, 17 bp, Homo sapiens
cttaggctgatagacaa

SEQ ID NO: 6168346 - DNA, 17 bp, Homo sapiens
cttaggctgctgggaga

SEQ ID NO: 6168347 - DNA, 20 bp, Homo sapiens
cttaggcttggctgccctgt

SEQ ID NO: 6168348 - DNA, 23 bp, Homo sapiens
cttaggctttgtatgacagtgaa

SEQ ID NO: 6168349 - DNA, 16 bp, Homo sapiens
cttagggaagaaaaag

SEQ ID NO: 6168350 - DNA, 19 bp, Homo sapiens
cttagggaagaaaaagcaa

SEQ ID NO: 6168351 - DNA, 20 bp, Homo sapiens
cttagggaagctggcctgag

SEQ ID NO: 6168352 - DNA, 20 bp, Homo sapiens
cttagggaagttgtctcctt

SEQ ID NO: 6168353 - DNA, 23 bp, Homo sapiens
cttagggaagttgtctccttcca

SEQ ID NO: 6168354 - DNA, 14 bp, Homo sapiens
cttagggagagcac

SEQ ID NO: 6168355 - DNA, 18 bp, Homo sapiens
cttagggcactgggctgt

SEQ ID NO: 6168356 - DNA, 14 bp, Homo sapiens
cttagggccctgga

SEQ ID NO: 6168357 - DNA, 15 bp, Homo sapiens
cttagggccctggag

SEQ ID NO: 6168358 - DNA, 16 bp, Homo sapiens
cttagggccctggagg

SEQ ID NO: 6168359 - DNA, 16 bp, Homo sapiens
cttaggggctgctgac

SEQ ID NO: 6168360 - DNA, 16 bp, Homo sapiens
cttagggtctcagggt

SEQ ID NO: 6168361 - DNA, 14 bp, Homo sapiens
cttagggtctgtcc

SEQ ID NO: 6168362 - DNA, 18 bp, Homo sapiens
cttagggtggctttaatt

SEQ ID NO: 6168363 - DNA, 20 bp, Homo sapiens
cttaggtagtcatgctgtgc

SEQ ID NO: 6168364 - DNA, 23 bp, Homo sapiens
cttaggtagtcatgctgtgcatt

SEQ ID NO: 6168365 - DNA, 11 bp, Homo sapiens
cttaggtcttc

SEQ ID NO: 6168366 - DNA, 14 bp, Homo sapiens
cttaggtcttcctg

SEQ ID NO: 6168367 - DNA, 16 bp, Homo sapiens
cttaggtcttcctgtg

SEQ ID NO: 6168368 - DNA, 18 bp, Homo sapiens
cttaggtcttcctgtggc

SEQ ID NO: 6168369 - DNA, 19 bp, Homo sapiens
cttaggtcttcctgtggct

SEQ ID NO: 6168370 - DNA, 20 bp, Homo sapiens
cttaggtcttcctgtggctc

SEQ ID NO: 6168371 - DNA, 17 bp, Homo sapiens
cttaggtgaaggcagaa

SEQ ID NO: 6168372 - DNA, 17 bp, Homo sapiens
cttaggtgccaggctgt

SEQ ID NO: 6168373 - DNA, 18 bp, Homo sapiens
cttaggtggcagggctgt

SEQ ID NO: 6168374 - DNA, 23 bp, Homo sapiens
cttaggtggcagggctgttccct

SEQ ID NO: 6168375 - DNA, 20 bp, Homo sapiens
cttaggtggctctgggaatg

SEQ ID NO: 6168376 - DNA, 17 bp, Homo sapiens
cttaggtttcaggaagt

SEQ ID NO: 6168377 - DNA, 14 bp, Homo sapiens
cttagtaaaaagcc

SEQ ID NO: 6168378 - DNA, 22 bp, Homo sapiens
cttagtaaaaattgattacaat

SEQ ID NO: 6168379 - DNA, 15 bp, Homo sapiens
cttagtaaaatttat

SEQ ID NO: 6168380 - DNA, 13 bp, Homo sapiens
cttagtaaattcc

SEQ ID NO: 6168381 - DNA, 14 bp, Homo sapiens
cttagtaaattcct

SEQ ID NO: 6168382 - DNA, 19 bp, Homo sapiens
cttagtaactttttatgta

SEQ ID NO: 6168383 - DNA, 20 bp, Homo sapiens
cttagtaatgctacgtgtga

SEQ ID NO: 6168384 - DNA, 15 bp, Homo sapiens
cttagtacatgctct

SEQ ID NO: 6168385 - DNA, 16 bp, Homo sapiens
cttagtagattaaaaa

SEQ ID NO: 6168386 - DNA, 17 bp, Homo sapiens
cttagtagggacttaat

SEQ ID NO: 6168387 - DNA, 16 bp, Homo sapiens
cttagtagtttttaca

SEQ ID NO: 6168388 - DNA, 13 bp, Homo sapiens
cttagtattgcaa

SEQ ID NO: 6168389 - DNA, 15 bp, Homo sapiens
cttagtatttctcag

SEQ ID NO: 6168390 - DNA, 18 bp, Homo sapiens
cttagtcactgagacagc

SEQ ID NO: 6168391 - DNA, 19 bp, Homo sapiens
cttagtcactgagacagcc

SEQ ID NO: 6168392 - DNA, 23 bp, Homo sapiens
cttagtcactgcctgcagaggtc

SEQ ID NO: 6168393 - DNA, 13 bp, Homo sapiens
cttagtcatacca

SEQ ID NO: 6168394 - DNA, 11 bp, Homo sapiens
cttagtccact

SEQ ID NO: 6168395 - DNA, 15 bp, Homo sapiens
cttagtccactctga

SEQ ID NO: 6168396 - DNA, 23 bp, Homo sapiens
cttagtccagttgtgttgacaca

SEQ ID NO: 6168397 - DNA, 22 bp, Homo sapiens
cttagtcccccaactctgagcc

SEQ ID NO: 6168398 - DNA, 22 bp, Homo sapiens
cttagtccctaatcatgtttct

SEQ ID NO: 6168399 - DNA, 15 bp, Homo sapiens
cttagtctaggtcct

SEQ ID NO: 6168400 - DNA, 20 bp, Homo sapiens
cttagtctcagtttgtgtgt

SEQ ID NO: 6168401 - DNA, 23 bp, Homo sapiens
cttagtctcagtttgtgtgtctt

SEQ ID NO: 6168402 - DNA, 14 bp, Homo sapiens
cttagtctgttttc

SEQ ID NO: 6168403 - DNA, 15 bp, Homo sapiens
cttagtgatgtaatt

SEQ ID NO: 6168404 - DNA, 18 bp, Homo sapiens
cttagtgccacccacctt

SEQ ID NO: 6168405 - DNA, 19 bp, Homo sapiens
cttagtgcccgcctaggag

SEQ ID NO: 6168406 - DNA, 14 bp, Homo sapiens
cttagtgggccagg

SEQ ID NO: 6168407 - DNA, 17 bp, Homo sapiens
cttagtgggccagggct

SEQ ID NO: 6168408 - DNA, 23 bp, Homo sapiens
cttagtgggccagggctgccctg

SEQ ID NO: 6168409 - DNA, 20 bp, Homo sapiens
cttagtggggttttatatcc

SEQ ID NO: 6168410 - DNA, 17 bp, Homo sapiens
cttagtggtatgtctct

SEQ ID NO: 6168411 - DNA, 18 bp, Homo sapiens
cttagtggtatgtctctt

SEQ ID NO: 6168412 - DNA, 17 bp, Homo sapiens
cttagtggttccccacc

SEQ ID NO: 6168413 - DNA, 17 bp, Homo sapiens
cttagtgtcccttacct

SEQ ID NO: 6168414 - DNA, 21 bp, Homo sapiens
cttagtgttcaaaacaaaatg

SEQ ID NO: 6168415 - DNA, 20 bp, Homo sapiens
cttagtgtttagcattaaaa

SEQ ID NO: 6168416 - DNA, 18 bp, Homo sapiens
cttagtgtttctgtgcat

SEQ ID NO: 6168417 - DNA, 19 bp, Homo sapiens
cttagtgtttctgtgcatg

SEQ ID NO: 6168418 - DNA, 12 bp, Homo sapiens
cttagttaaaaa

SEQ ID NO: 6168419 - DNA, 13 bp, Homo sapiens
cttagttaaaaaa

SEQ ID NO: 6168420 - DNA, 16 bp, Homo sapiens
cttagttactttttcc

SEQ ID NO: 6168421 - DNA, 19 bp, Homo sapiens
cttagttcatatatcaaga

SEQ ID NO: 6168422 - DNA, 14 bp, Homo sapiens
cttagttctcactg

SEQ ID NO: 6168423 - DNA, 23 bp, Homo sapiens
cttagttctcactgtctcctggt

SEQ ID NO: 6168424 - DNA, 13 bp, Homo sapiens
cttagttggctgg

SEQ ID NO: 6168425 - DNA, 20 bp, Homo sapiens
cttagttggctttgcccacc

SEQ ID NO: 6168426 - DNA, 23 bp, Homo sapiens
cttagtttctaaccaaagagtct

SEQ ID NO: 6168427 - DNA, 22 bp, Homo sapiens
cttagtttggattcttatgtag

SEQ ID NO: 6168428 - DNA, 22 bp, Homo sapiens
cttagtttgtgtgttgtctctt

SEQ ID NO: 6168429 - DNA, 23 bp, Homo sapiens
cttagtttgtgtgttgtctcttg

SEQ ID NO: 6168430 - DNA, 11 bp, Homo sapiens
cttagttttaa

SEQ ID NO: 6168431 - DNA, 22 bp, Homo sapiens
cttagtttttaccttgttttct

SEQ ID NO: 6168432 - DNA, 23 bp, Homo sapiens
cttagtttttatctttgaccaac

SEQ ID NO: 6168433 - DNA, 16 bp, Homo sapiens
cttagttttttcatct

SEQ ID NO: 6168434 - DNA, 16 bp, Homo sapiens
cttataaaaattctag

SEQ ID NO: 6168435 - DNA, 12 bp, Homo sapiens
cttataaaacag

SEQ ID NO: 6168436 - DNA, 21 bp, Homo sapiens
cttataaaacagagtaatctt

SEQ ID NO: 6168437 - DNA, 22 bp, Homo sapiens
cttataaacaaatgaattgtat

SEQ ID NO: 6168438 - DNA, 16 bp, Homo sapiens
cttataaaccaatctt

SEQ ID NO: 6168439 - DNA, 18 bp, Homo sapiens
cttataaaccaatcttaa

SEQ ID NO: 6168440 - DNA, 18 bp, Homo sapiens
cttataaagtggaagtat

SEQ ID NO: 6168441 - DNA, 20 bp, Homo sapiens
cttataaagtggaagtatgt

SEQ ID NO: 6168442 - DNA, 13 bp, Homo sapiens
cttataaatgtgt

SEQ ID NO: 6168443 - DNA, 21 bp, Homo sapiens
cttataaattctgttagctgc

SEQ ID NO: 6168444 - DNA, 17 bp, Homo sapiens
cttataacctagttaaa

SEQ ID NO: 6168445 - DNA, 16 bp, Homo sapiens
cttataactgttttag

SEQ ID NO: 6168446 - DNA, 18 bp, Homo sapiens
cttataagaaaacatgta

SEQ ID NO: 6168447 - DNA, 18 bp, Homo sapiens
cttataagaattaatctt

SEQ ID NO: 6168448 - DNA, 20 bp, Homo sapiens
cttataagagagagttaaaa

SEQ ID NO: 6168449 - DNA, 13 bp, Homo sapiens
cttataagcccag

SEQ ID NO: 6168450 - DNA, 21 bp, Homo sapiens
cttataaggtgttttctgtgt

SEQ ID NO: 6168451 - DNA, 23 bp, Homo sapiens
cttataaggtgttttctgtgtaa

SEQ ID NO: 6168452 - DNA, 14 bp, Homo sapiens
cttataataaagga

SEQ ID NO: 6168453 - DNA, 19 bp, Homo sapiens
cttataatactctgttgta

SEQ ID NO: 6168454 - DNA, 15 bp, Homo sapiens
cttataatgggctct

SEQ ID NO: 6168455 - DNA, 17 bp, Homo sapiens
cttataatgtgtgttgt

SEQ ID NO: 6168456 - DNA, 22 bp, Homo sapiens
cttataattctttcaatacaga

SEQ ID NO: 6168457 - DNA, 15 bp, Homo sapiens
cttatacaaatttaa

SEQ ID NO: 6168458 - DNA, 13 bp, Homo sapiens
cttatacacccct

SEQ ID NO: 6168459 - DNA, 13 bp, Homo sapiens
cttatacatcact

SEQ ID NO: 6168460 - DNA, 16 bp, Homo sapiens
cttatacatcacttcc

SEQ ID NO: 6168461 - DNA, 18 bp, Homo sapiens
cttatacatcacttcctg

SEQ ID NO: 6168462 - DNA, 14 bp, Homo sapiens
cttatacccatgaa

SEQ ID NO: 6168463 - DNA, 18 bp, Homo sapiens
cttataccttctgacagc

SEQ ID NO: 6168464 - DNA, 20 bp, Homo sapiens
cttatacgaaataattgttg

SEQ ID NO: 6168465 - DNA, 18 bp, Homo sapiens
cttatactgtacaataaa

SEQ ID NO: 6168466 - DNA, 21 bp, Homo sapiens
cttatactgtaggtgttatgt

SEQ ID NO: 6168467 - DNA, 15 bp, Homo sapiens
cttatagaaagcact

SEQ ID NO: 6168468 - DNA, 12 bp, Homo sapiens
cttatagaaagt

SEQ ID NO: 6168469 - DNA, 14 bp, Homo sapiens
cttatagaataaaa

SEQ ID NO: 6168470 - DNA, 19 bp, Homo sapiens
cttatagaataaaagctgt

SEQ ID NO: 6168471 - DNA, 21 bp, Homo sapiens
cttatagaataaaagctgtgg

SEQ ID NO: 6168472 - DNA, 14 bp, Homo sapiens
cttatagaatattt

SEQ ID NO: 6168473 - DNA, 15 bp, Homo sapiens
cttatagagcacaat

SEQ ID NO: 6168474 - DNA, 21 bp, Homo sapiens
cttatagatgcaaagtatttt

SEQ ID NO: 6168475 - DNA, 19 bp, Homo sapiens
cttatagattttttaaaaa

SEQ ID NO: 6168476 - DNA, 17 bp, Homo sapiens
cttatagggtaaaaaaa

SEQ ID NO: 6168477 - DNA, 14 bp, Homo sapiens
cttataggtgttgg

SEQ ID NO: 6168478 - DNA, 20 bp, Homo sapiens
cttatagtacctcactgcac

SEQ ID NO: 6168479 - DNA, 16 bp, Homo sapiens
cttatagtctaagact

SEQ ID NO: 6168480 - DNA, 21 bp, Homo sapiens
cttatagtctaagactatata

SEQ ID NO: 6168481 - DNA, 14 bp, Homo sapiens
cttatagttaatat

SEQ ID NO: 6168482 - DNA, 16 bp, Homo sapiens
cttatagttactgtgt

SEQ ID NO: 6168483 - DNA, 18 bp, Homo sapiens
cttatagttactgtgtaa

SEQ ID NO: 6168484 - DNA, 19 bp, Homo sapiens
cttatagttactgtgtaat

SEQ ID NO: 6168485 - DNA, 16 bp, Homo sapiens
cttatagttctaggca

SEQ ID NO: 6168486 - DNA, 23 bp, Homo sapiens
cttatagtttgggcttcagccta

SEQ ID NO: 6168487 - DNA, 17 bp, Homo sapiens
cttatatagcacctttc

SEQ ID NO: 6168488 - DNA, 23 bp, Homo sapiens
cttatatatatattgattatttg

SEQ ID NO: 6168489 - DNA, 17 bp, Homo sapiens
cttatatatgcacttaa

SEQ ID NO: 6168490 - DNA, 17 bp, Homo sapiens
cttatatatgtgaacat

SEQ ID NO: 6168491 - DNA, 20 bp, Homo sapiens
cttatatatttgaaagaagt

SEQ ID NO: 6168492 - DNA, 16 bp, Homo sapiens
cttatatctggcctct

SEQ ID NO: 6168493 - DNA, 21 bp, Homo sapiens
cttatatctggcctctgcttt

SEQ ID NO: 6168494 - DNA, 22 bp, Homo sapiens
cttatatctggcctctgctttc

SEQ ID NO: 6168495 - DNA, 17 bp, Homo sapiens
cttatatgggaaaccat

SEQ ID NO: 6168496 - DNA, 16 bp, Homo sapiens
cttatatgtgcccctt

SEQ ID NO: 6168497 - DNA, 18 bp, Homo sapiens
cttatatgtgtattgcta

SEQ ID NO: 6168498 - DNA, 21 bp, Homo sapiens
cttatattaatagtaatttgt

SEQ ID NO: 6168499 - DNA, 21 bp, Homo sapiens
cttatattaatattcctcagt

SEQ ID NO: 6168500 - DNA, 17 bp, Homo sapiens
cttatattattttctgt

SEQ ID NO: 6168501 - DNA, 17 bp, Homo sapiens
cttatattcagtctgtg

SEQ ID NO: 6168502 - DNA, 17 bp, Homo sapiens
ctgcatcctgaggccag

SEQ ID NO: 6168503 - DNA, 22 bp, Homo sapiens
ctgcatcctggcttgaaaaaca

SEQ ID NO: 6168504 - DNA, 15 bp, Homo sapiens
ctgcatccttcctgg

SEQ ID NO: 6168505 - DNA, 22 bp, Homo sapiens
ctgcatcgtttcatcttccaac

SEQ ID NO: 6168506 - DNA, 20 bp, Homo sapiens
ctgcatctagaggcttcctt

SEQ ID NO: 6168507 - DNA, 16 bp, Homo sapiens
ctgcatctcaaaaaaa

SEQ ID NO: 6168508 - DNA, 20 bp, Homo sapiens
ctgcatctgaccagcagcgc

SEQ ID NO: 6168509 - DNA, 21 bp, Homo sapiens
ctgcatctgaccagcagcgcc

SEQ ID NO: 6168510 - DNA, 22 bp, Homo sapiens
ctgcatctgaccagcagcgcct

SEQ ID NO: 6168511 - DNA, 14 bp, Homo sapiens
ctgcatctgataaa

SEQ ID NO: 6168512 - DNA, 22 bp, Homo sapiens
ctgcatctgtctgctctgcata

SEQ ID NO: 6168513 - DNA, 14 bp, Homo sapiens
ctgcatcttaacat

SEQ ID NO: 6168514 - DNA, 21 bp, Homo sapiens
ctgcatcttatagcactttga

SEQ ID NO: 6168515 - DNA, 22 bp, Homo sapiens
ctgcatcttatagcactttgaa

SEQ ID NO: 6168516 - DNA, 15 bp, Homo sapiens
ctgcatcttcttgca

SEQ ID NO: 6168517 - DNA, 15 bp, Homo sapiens
ctgcatcttgctctg

SEQ ID NO: 6168518 - DNA, 21 bp, Homo sapiens
ctgcatcttggggacatctct

SEQ ID NO: 6168519 - DNA, 18 bp, Homo sapiens
ctgcatctttagtgcttt

SEQ ID NO: 6168520 - DNA, 14 bp, Homo sapiens
ctgcatctttcata

SEQ ID NO: 6168521 - DNA, 20 bp, Homo sapiens
ctgcatctttcatagttctg

SEQ ID NO: 6168522 - DNA, 15 bp, Homo sapiens
ctgcatgaatatcat

SEQ ID NO: 6168523 - DNA, 13 bp, Homo sapiens
ctgcatgagctga

SEQ ID NO: 6168524 - DNA, 15 bp, Homo sapiens
ctgcatgagctggca

SEQ ID NO: 6168525 - DNA, 20 bp, Homo sapiens
ctgcatgatgtttgcccaaa

SEQ ID NO: 6168526 - DNA, 21 bp, Homo sapiens
ctgcatgatttttgccctgcg

SEQ ID NO: 6168527 - DNA, 18 bp, Homo sapiens
ctgcatgcaaacaagaaa

SEQ ID NO: 6168528 - DNA, 17 bp, Homo sapiens
ctgcatgcaagctcagg

SEQ ID NO: 6168529 - DNA, 11 bp, Homo sapiens
ctgcatgcaga

SEQ ID NO: 6168530 - DNA, 15 bp, Homo sapiens
ctgcatgcagaaagg

SEQ ID NO: 6168531 - DNA, 16 bp, Homo sapiens
ctgcatgcagcaacac

SEQ ID NO: 6168532 - DNA, 21 bp, Homo sapiens
ctgcatgcagcaacacccaag

SEQ ID NO: 6168533 - DNA, 23 bp, Homo sapiens
ctgcatgcagcaacacccaagtc

SEQ ID NO: 6168534 - DNA, 21 bp, Homo sapiens
ctgcatgcccagagacccagc

SEQ ID NO: 6168535 - DNA, 18 bp, Homo sapiens
ctgcatgccctctcaggc

SEQ ID NO: 6168536 - DNA, 21 bp, Homo sapiens
ctgcatgccctctcaggccgg

SEQ ID NO: 6168537 - DNA, 20 bp, Homo sapiens
ctgcatgcctggtctttcct

SEQ ID NO: 6168538 - DNA, 22 bp, Homo sapiens
ctgcatgcctggtctttcctct

SEQ ID NO: 6168539 - DNA, 13 bp, Homo sapiens
ctgcatgcgacag

SEQ ID NO: 6168540 - DNA, 14 bp, Homo sapiens
ctgcatgcggccca

SEQ ID NO: 6168541 - DNA, 16 bp, Homo sapiens
ctgcatgcggcccagc

SEQ ID NO: 6168542 - DNA, 18 bp, Homo sapiens
ctgcatgcgggcttcctc

SEQ ID NO: 6168543 - DNA, 15 bp, Homo sapiens
ctgcatgctcctctg

SEQ ID NO: 6168544 - DNA, 17 bp, Homo sapiens
ctgcatgctcctctgcc

SEQ ID NO: 6168545 - DNA, 22 bp, Homo sapiens
ctgcatgctcctctgcctgtgc

SEQ ID NO: 6168546 - DNA, 12 bp, Homo sapiens
ctgcatgctctg

SEQ ID NO: 6168547 - DNA, 15 bp, Homo sapiens
ctgcatgctctggaa

SEQ ID NO: 6168548 - DNA, 16 bp, Homo sapiens
ctgcatgctctggaag

SEQ ID NO: 6168549 - DNA, 17 bp, Homo sapiens
ctgcatgctctggaagc

SEQ ID NO: 6168550 - DNA, 18 bp, Homo sapiens
ctgcatgctctggaagcc

SEQ ID NO: 6168551 - DNA, 22 bp, Homo sapiens
ctgcatgctgcccagccactcc

SEQ ID NO: 6168552 - DNA, 22 bp, Homo sapiens
ctgcatgctgctggacagtatc

SEQ ID NO: 6168553 - DNA, 19 bp, Homo sapiens
ctgcatgctgggttctgca

SEQ ID NO: 6168554 - DNA, 13 bp, Homo sapiens
ctgcatggaccta

SEQ ID NO: 6168555 - DNA, 24 bp, Homo sapiens
ctgcatggacgcctggctccaggc

SEQ ID NO: 6168556 - DNA, 18 bp, Homo sapiens
ctgcatggagacgcattt

SEQ ID NO: 6168557 - DNA, 13 bp, Homo sapiens
ctgcatggagcct

SEQ ID NO: 6168558 - DNA, 14 bp, Homo sapiens
ctgcatggagcctg

SEQ ID NO: 6168559 - DNA, 17 bp, Homo sapiens
ctgcatggattcagcat

SEQ ID NO: 6168560 - DNA, 17 bp, Homo sapiens
ctgcatggcacatacca

SEQ ID NO: 6168561 - DNA, 22 bp, Homo sapiens
ctgcatggcacataccaaagct

SEQ ID NO: 6168562 - DNA, 17 bp, Homo sapiens
ctgcatggcagaagcgt

SEQ ID NO: 6168563 - DNA, 18 bp, Homo sapiens
ctgcatgggaaaaatgtt

SEQ ID NO: 6168564 - DNA, 22 bp, Homo sapiens
ctgcatgggaaatagcggccct

SEQ ID NO: 6168565 - DNA, 19 bp, Homo sapiens
ctgcatggggaggcagcag

SEQ ID NO: 6168566 - DNA, 21 bp, Homo sapiens
ctgcatggggaggcagcagag

SEQ ID NO: 6168567 - DNA, 22 bp, Homo sapiens
ctgcatggggaggcagcagagc

SEQ ID NO: 6168568 - DNA, 16 bp, Homo sapiens
ctgcatggggagtaca

SEQ ID NO: 6168569 - DNA, 18 bp, Homo sapiens
ctgcatggggcagaggct

SEQ ID NO: 6168570 - DNA, 24 bp, Homo sapiens
ctgcatggggctggggtcctcctg

SEQ ID NO: 6168571 - DNA, 20 bp, Homo sapiens
ctgcatgggggcaccgggct

SEQ ID NO: 6168572 - DNA, 21 bp, Homo sapiens
ctgcatgggggcaccgggctc

SEQ ID NO: 6168573 - DNA, 21 bp, Homo sapiens
ctgcatgggttaattgagaat

SEQ ID NO: 6168574 - DNA, 21 bp, Homo sapiens
ctgcatgtaaaatcttcagct

SEQ ID NO: 6168575 - DNA, 24 bp, Homo sapiens
ctgcatgtactagtcctctagaaa

SEQ ID NO: 6168576 - DNA, 20 bp, Homo sapiens
ctgcatgtagaggcttgttt

SEQ ID NO: 6168577 - DNA, 18 bp, Homo sapiens
ctgcatgtataaatgaag

SEQ ID NO: 6168578 - DNA, 19 bp, Homo sapiens
ctgcatgtcggggcccctg

SEQ ID NO: 6168579 - DNA, 23 bp, Homo sapiens
ctgcatgtcggggcccctgcgtg

SEQ ID NO: 6168580 - DNA, 20 bp, Homo sapiens
ctgcatgtgacttctcccct

SEQ ID NO: 6168581 - DNA, 14 bp, Homo sapiens
ctgcatgtggcttc

SEQ ID NO: 6168582 - DNA, 12 bp, Homo sapiens
ctgcatgtgtat

SEQ ID NO: 6168583 - DNA, 23 bp, Homo sapiens
ctgcatgtgtatatatgtcaaat

SEQ ID NO: 6168584 - DNA, 19 bp, Homo sapiens
ctgcatgtgttgtacaata

SEQ ID NO: 6168585 - DNA, 19 bp, Homo sapiens
ctgcatgtttgctgttcca

SEQ ID NO: 6168586 - DNA, 15 bp, Homo sapiens
ctgcatgtttgtgat

SEQ ID NO: 6168587 - DNA, 22 bp, Homo sapiens
ctgcattaataatagctaataa

SEQ ID NO: 6168588 - DNA, 20 bp, Homo sapiens
ctgcattaccgcgttgtaaa

SEQ ID NO: 6168589 - DNA, 23 bp, Homo sapiens
ctgcattaccgcgttgtaaaata

SEQ ID NO: 6168590 - DNA, 23 bp, Homo sapiens
ctgcattactattaactctgcat

SEQ ID NO: 6168591 - DNA, 15 bp, Homo sapiens
ctgcattatctatgc

SEQ ID NO: 6168592 - DNA, 15 bp, Homo sapiens
ctgcattatcttgct

SEQ ID NO: 6168593 - DNA, 16 bp, Homo sapiens
ctgcattatcttgctc

SEQ ID NO: 6168594 - DNA, 17 bp, Homo sapiens
ctgcattatcttgctca

SEQ ID NO: 6168595 - DNA, 17 bp, Homo sapiens
ctgcattattctctttt

SEQ ID NO: 6168596 - DNA, 17 bp, Homo sapiens
ctgcattatttgagaag

SEQ ID NO: 6168597 - DNA, 16 bp, Homo sapiens
ctgcattcacagctac

SEQ ID NO: 6168598 - DNA, 20 bp, Homo sapiens
ctgcattcaccttagtgcaa

SEQ ID NO: 6168599 - DNA, 18 bp, Homo sapiens
ctgcattcattctgagcc

SEQ ID NO: 6168600 - DNA, 16 bp, Homo sapiens
ctgcattcccaggaaa

SEQ ID NO: 6168601 - DNA, 17 bp, Homo sapiens
ctgcattcccaggaaaa

SEQ ID NO: 6168602 - DNA, 22 bp, Homo sapiens
ctgcattccccgctgcccaatc

SEQ ID NO: 6168603 - DNA, 16 bp, Homo sapiens
ctgcattcctgtgccc

SEQ ID NO: 6168604 - DNA, 17 bp, Homo sapiens
ctgcattcgcagcagct

SEQ ID NO: 6168605 - DNA, 16 bp, Homo sapiens
ctgcattctctcccat

SEQ ID NO: 6168606 - DNA, 22 bp, Homo sapiens
ctgcattctctcccatcctggg

SEQ ID NO: 6168607 - DNA, 18 bp, Homo sapiens
ctgcattctgcacgctgc

SEQ ID NO: 6168608 - DNA, 19 bp, Homo sapiens
ctgcattctgccgtgtgcc

SEQ ID NO: 6168609 - DNA, 21 bp, Homo sapiens
ctgcattctgcctctctagga

SEQ ID NO: 6168610 - DNA, 19 bp, Homo sapiens
ctgcattgaaaagagctga

SEQ ID NO: 6168611 - DNA, 22 bp, Homo sapiens
ctgcattgaaaagagctgaagg

SEQ ID NO: 6168612 - DNA, 17 bp, Homo sapiens
ctgcattgacctggagg

SEQ ID NO: 6168613 - DNA, 19 bp, Homo sapiens
ctgcattgacctggagggg

SEQ ID NO: 6168614 - DNA, 16 bp, Homo sapiens
ctgcattgagaaggaa

SEQ ID NO: 6168615 - DNA, 17 bp, Homo sapiens
ctgcattgagaaggaac

SEQ ID NO: 6168616 - DNA, 23 bp, Homo sapiens
ctgcattgagcttgcatgcttgc

SEQ ID NO: 6168617 - DNA, 22 bp, Homo sapiens
ctgcattgccgaagtccagctt

SEQ ID NO: 6168618 - DNA, 19 bp, Homo sapiens
ctgcattggaactggaggc

SEQ ID NO: 6168619 - DNA, 21 bp, Homo sapiens
ctgcattggaactggaggcag

SEQ ID NO: 6168620 - DNA, 21 bp, Homo sapiens
ctgcattggactgagggctgg

SEQ ID NO: 6168621 - DNA, 23 bp, Homo sapiens
ctgcattggactgagggctgggt

SEQ ID NO: 6168622 - DNA, 16 bp, Homo sapiens
ctgcattggcctggcc

SEQ ID NO: 6168623 - DNA, 17 bp, Homo sapiens
ctgcattggcctggcct

SEQ ID NO: 6168624 - DNA, 21 bp, Homo sapiens
ctgcattggcctggcctccag

SEQ ID NO: 6168625 - DNA, 22 bp, Homo sapiens
ctgcattggcctggcctccagc

SEQ ID NO: 6168626 - DNA, 23 bp, Homo sapiens
ctgcattggcctggcctccagct

SEQ ID NO: 6168627 - DNA, 14 bp, Homo sapiens
ctgcattgtaaata

SEQ ID NO: 6168628 - DNA, 15 bp, Homo sapiens
ctgcattgttattgt

SEQ ID NO: 6168629 - DNA, 19 bp, Homo sapiens
ctgcattgttattgtggaa

SEQ ID NO: 6168630 - DNA, 16 bp, Homo sapiens
ctgcattgttttctag

SEQ ID NO: 6168631 - DNA, 18 bp, Homo sapiens
ctgcatttaaatttgatt

SEQ ID NO: 6168632 - DNA, 13 bp, Homo sapiens
ctgcatttaggga

SEQ ID NO: 6168633 - DNA, 20 bp, Homo sapiens
ctgcatttataaatgtgtgg

SEQ ID NO: 6168634 - DNA, 21 bp, Homo sapiens
ctgcatttataaatgtgtggt

SEQ ID NO: 6168635 - DNA, 13 bp, Homo sapiens
ctgcatttctgag

SEQ ID NO: 6168636 - DNA, 23 bp, Homo sapiens
ctgcatttggcaggaagatgtat

SEQ ID NO: 6168637 - DNA, 17 bp, Homo sapiens
ctgcatttggctggagc

SEQ ID NO: 6168638 - DNA, 21 bp, Homo sapiens
ctgcatttggctggagcccgg

SEQ ID NO: 6168639 - DNA, 18 bp, Homo sapiens
ctgcatttggggtggggg

SEQ ID NO: 6168640 - DNA, 9 bp, Homo sapiens
ctgcatttt

SEQ ID NO: 6168641 - DNA, 13 bp, Homo sapiens
ctgcattttaagc

SEQ ID NO: 6168642 - DNA, 18 bp, Homo sapiens
ctgcattttaagcataat

SEQ ID NO: 6168643 - DNA, 22 bp, Homo sapiens
ctgcattttacacatgtgctga

SEQ ID NO: 6168644 - DNA, 20 bp, Homo sapiens
ctgcattttattctggatgg

SEQ ID NO: 6168645 - DNA, 23 bp, Homo sapiens
ctgcattttcctcttgtcctggc

SEQ ID NO: 6168646 - DNA, 15 bp, Homo sapiens
ctgcattttctcagg

SEQ ID NO: 6168647 - DNA, 20 bp, Homo sapiens
ctgcattttctgaaactaat

SEQ ID NO: 6168648 - DNA, 23 bp, Homo sapiens
ctgcattttgtacaaatccacga

SEQ ID NO: 6168649 - DNA, 19 bp, Homo sapiens
ctgcatttttaaaggacaa

SEQ ID NO: 6168650 - DNA, 23 bp, Homo sapiens
ctgcatttttcactttgctctca

SEQ ID NO: 6168651 - DNA, 17 bp, Homo sapiens
ctgcatttttctgcaga

SEQ ID NO: 6168652 - DNA, 14 bp, Homo sapiens
ctgcattttttact

SEQ ID NO: 6168653 - DNA, 12 bp, Homo sapiens
ctgccaaaacaa

SEQ ID NO: 6168654 - DNA, 14 bp, Homo sapiens
ctgccaaaaccaca

SEQ ID NO: 6168655 - DNA, 19 bp, Homo sapiens
ctgccaaaaccacatgggc

SEQ ID NO: 6168656 - DNA, 21 bp, Homo sapiens
ctgccaaaaccacatgggctg

SEQ ID NO: 6168657 - DNA, 19 bp, Homo sapiens
ctgccaaaagatctgggga

SEQ ID NO: 6168658 - DNA, 16 bp, Homo sapiens
ctgccaaacctcctgt

SEQ ID NO: 6168659 - DNA, 14 bp, Homo sapiens
ctgccaaaggatgt

SEQ ID NO: 6168660 - DNA, 16 bp, Homo sapiens
ctgccaaaggatgtga

SEQ ID NO: 6168661 - DNA, 18 bp, Homo sapiens
ctgccaaaggatgtgata

SEQ ID NO: 6168662 - DNA, 22 bp, Homo sapiens
ctgccaaaggatgtgatatata

SEQ ID NO: 6168663 - DNA, 16 bp, Homo sapiens
ctgccaaagtgcctgg

SEQ ID NO: 6168664 - DNA, 16 bp, Homo sapiens
ctgccaaataaaatgt

SEQ ID NO: 6168665 - DNA, 17 bp, Homo sapiens
ctgccaaataaaatgtt

SEQ ID NO: 6168666 - DNA, 22 bp, Homo sapiens
ctgccaaataaaatgtttacat

SEQ ID NO: 6168667 - DNA, 15 bp, Homo sapiens
ctgccaaataaacag

SEQ ID NO: 6168668 - DNA, 17 bp, Homo sapiens
ctgccaaataaacagct

SEQ ID NO: 6168669 - DNA, 20 bp, Homo sapiens
ctgccaaattttggccaaag

SEQ ID NO: 6168670 - DNA, 23 bp, Homo sapiens
ctgccaaccataccttccttccc

SEQ ID NO: 6168671 - DNA, 15 bp, Homo sapiens
ctgccaaccctcccg

SEQ ID NO: 6168672 - DNA, 17 bp, Homo sapiens
ctgccaaccctcccggg

SEQ ID NO: 6168673 - DNA, 23 bp, Homo sapiens
ctgccaacctcgctccaactcca

SEQ ID NO: 6168674 - DNA, 16 bp, Homo sapiens
ctgccaacgcctcctg

SEQ ID NO: 6168675 - DNA, 17 bp, Homo sapiens
ctgccaacgcctcctgt

SEQ ID NO: 6168676 - DNA, 18 bp, Homo sapiens
ctgccaacgcctcctgtc

SEQ ID NO: 6168677 - DNA, 14 bp, Homo sapiens
cttatattcatcta

SEQ ID NO: 6168678 - DNA, 18 bp, Homo sapiens
cttatattgaagacaatt

SEQ ID NO: 6168679 - DNA, 23 bp, Homo sapiens
cttatattgaagacaatttgata

SEQ ID NO: 6168680 - DNA, 14 bp, Homo sapiens
cttatattgtaaga

SEQ ID NO: 6168681 - DNA, 18 bp, Homo sapiens
cttatattgtaagaaata

SEQ ID NO: 6168682 - DNA, 14 bp, Homo sapiens
cttatattgttcac

SEQ ID NO: 6168683 - DNA, 13 bp, Homo sapiens
cttatatttacaa

SEQ ID NO: 6168684 - DNA, 15 bp, Homo sapiens
cttatatttacaata

SEQ ID NO: 6168685 - DNA, 23 bp, Homo sapiens
cttatatttacaataaatgaaga

SEQ ID NO: 6168686 - DNA, 19 bp, Homo sapiens
cttatatttccctaaaata

SEQ ID NO: 6168687 - DNA, 15 bp, Homo sapiens
cttatatttctgtgt

SEQ ID NO: 6168688 - DNA, 17 bp, Homo sapiens
cttatattttatgaaca

SEQ ID NO: 6168689 - DNA, 18 bp, Homo sapiens
cttatattttatgaacat

SEQ ID NO: 6168690 - DNA, 21 bp, Homo sapiens
cttatattttatgaacattgt

SEQ ID NO: 6168691 - DNA, 22 bp, Homo sapiens
cttatattttatgaacattgta

SEQ ID NO: 6168692 - DNA, 23 bp, Homo sapiens
cttatattttatgaacattgtac

SEQ ID NO: 6168693 - DNA, 19 bp, Homo sapiens
cttatattttcgtatgaaa

SEQ ID NO: 6168694 - DNA, 12 bp, Homo sapiens
cttatattttga

SEQ ID NO: 6168695 - DNA, 14 bp, Homo sapiens
cttatcaaaggaca

SEQ ID NO: 6168696 - DNA, 19 bp, Homo sapiens
cttatcaaagtagcaaatg

SEQ ID NO: 6168697 - DNA, 21 bp, Homo sapiens
cttatcaaggactctggtttc

SEQ ID NO: 6168698 - DNA, 14 bp, Homo sapiens
cttatcaagtgtct

SEQ ID NO: 6168699 - DNA, 16 bp, Homo sapiens
cttatcaagtgtcttc

SEQ ID NO: 6168700 - DNA, 16 bp, Homo sapiens
cttatcaagtgttaca

SEQ ID NO: 6168701 - DNA, 13 bp, Homo sapiens
cttatcacatttt

SEQ ID NO: 6168702 - DNA, 14 bp, Homo sapiens
cttatcacatttta

SEQ ID NO: 6168703 - DNA, 16 bp, Homo sapiens
cttatcaccagctgcc

SEQ ID NO: 6168704 - DNA, 18 bp, Homo sapiens
cttatcactaagaaagaa

SEQ ID NO: 6168705 - DNA, 19 bp, Homo sapiens
cttatcactaagaaagaaa

SEQ ID NO: 6168706 - DNA, 20 bp, Homo sapiens
cttatcactggcgcagactt

SEQ ID NO: 6168707 - DNA, 14 bp, Homo sapiens
cttatcagaggccc

SEQ ID NO: 6168708 - DNA, 18 bp, Homo sapiens
cttatcagcatgaagaat

SEQ ID NO: 6168709 - DNA, 22 bp, Homo sapiens
cttatcagctacttaagagaaa

SEQ ID NO: 6168710 - DNA, 15 bp, Homo sapiens
cttatcagcttcctg

SEQ ID NO: 6168711 - DNA, 15 bp, Homo sapiens
cttatcatccacatt

SEQ ID NO: 6168712 - DNA, 19 bp, Homo sapiens
cttatcatccacattgttt

SEQ ID NO: 6168713 - DNA, 15 bp, Homo sapiens
cttatcatttttgta

SEQ ID NO: 6168714 - DNA, 19 bp, Homo sapiens
cttatcatttttgtataaa

SEQ ID NO: 6168715 - DNA, 16 bp, Homo sapiens
cttatccaaaatgctt

SEQ ID NO: 6168716 - DNA, 15 bp, Homo sapiens
cttatccagctggtg

SEQ ID NO: 6168717 - DNA, 12 bp, Homo sapiens
cttatccaggac

SEQ ID NO: 6168718 - DNA, 18 bp, Homo sapiens
cttatccaggttggtttt

SEQ ID NO: 6168719 - DNA, 15 bp, Homo sapiens
cttatccataaaaaa

SEQ ID NO: 6168720 - DNA, 14 bp, Homo sapiens
cttatccccagctg

SEQ ID NO: 6168721 - DNA, 12 bp, Homo sapiens
cttatccctctc

SEQ ID NO: 6168722 - DNA, 17 bp, Homo sapiens
cttatccctctcttccc

SEQ ID NO: 6168723 - DNA, 18 bp, Homo sapiens
cttatccctctcttcccc

SEQ ID NO: 6168724 - DNA, 19 bp, Homo sapiens
cttatccctgcccatttca

SEQ ID NO: 6168725 - DNA, 19 bp, Homo sapiens
cttatcctaaggctgtcca

SEQ ID NO: 6168726 - DNA, 13 bp, Homo sapiens
cttatcctagcct

SEQ ID NO: 6168727 - DNA, 18 bp, Homo sapiens
cttatcctccctgtaact

SEQ ID NO: 6168728 - DNA, 19 bp, Homo sapiens
cttatcctccctgtaactt

SEQ ID NO: 6168729 - DNA, 18 bp, Homo sapiens
cttatcctctctctcttc

SEQ ID NO: 6168730 - DNA, 22 bp, Homo sapiens
cttatcctctctctcttctagg

SEQ ID NO: 6168731 - DNA, 13 bp, Homo sapiens
cttatcctctgat

SEQ ID NO: 6168732 - DNA, 15 bp, Homo sapiens
cttatcctctgatct

SEQ ID NO: 6168733 - DNA, 16 bp, Homo sapiens
cttatcctctgatctc

SEQ ID NO: 6168734 - DNA, 22 bp, Homo sapiens
cttatcctctgatctccatggc

SEQ ID NO: 6168735 - DNA, 17 bp, Homo sapiens
cttatcctgcattgtta

SEQ ID NO: 6168736 - DNA, 21 bp, Homo sapiens
cttatcctgctagcaggcccc

SEQ ID NO: 6168737 - DNA, 23 bp, Homo sapiens
cttatcctgctagcaggccccct

SEQ ID NO: 6168738 - DNA, 15 bp, Homo sapiens
cttatcgaaactcat

SEQ ID NO: 6168739 - DNA, 14 bp, Homo sapiens
cttatctagttaca

SEQ ID NO: 6168740 - DNA, 14 bp, Homo sapiens
cttatctcactgtt

SEQ ID NO: 6168741 - DNA, 19 bp, Homo sapiens
cttatctcagatatttgca

SEQ ID NO: 6168742 - DNA, 17 bp, Homo sapiens
cttatctcatcctttcc

SEQ ID NO: 6168743 - DNA, 22 bp, Homo sapiens
cttatctccagccaatttcaaa

SEQ ID NO: 6168744 - DNA, 17 bp, Homo sapiens
cttatctccctgcttca

SEQ ID NO: 6168745 - DNA, 19 bp, Homo sapiens
cttatctcgaatttgaaga

SEQ ID NO: 6168746 - DNA, 20 bp, Homo sapiens
cttatctcgaatttgaagag

SEQ ID NO: 6168747 - DNA, 17 bp, Homo sapiens
cttatctctcaaaacaa

SEQ ID NO: 6168748 - DNA, 18 bp, Homo sapiens
cttatctctcaaaacaat

SEQ ID NO: 6168749 - DNA, 12 bp, Homo sapiens
cttatctctctg

SEQ ID NO: 6168750 - DNA, 14 bp, Homo sapiens
cttatctctctgtg

SEQ ID NO: 6168751 - DNA, 15 bp, Homo sapiens
cttatctcttctcac

SEQ ID NO: 6168752 - DNA, 15 bp, Homo sapiens
cttatctctttccac

SEQ ID NO: 6168753 - DNA, 20 bp, Homo sapiens
cttatctgaaacttcccaac

SEQ ID NO: 6168754 - DNA, 20 bp, Homo sapiens
cttatctgaaaggccagcag

SEQ ID NO: 6168755 - DNA, 22 bp, Homo sapiens
cttatctgaaaggccagcagct

SEQ ID NO: 6168756 - DNA, 24 bp, Homo sapiens
cttatctgaaaggccagcagctga

SEQ ID NO: 6168757 - DNA, 18 bp, Homo sapiens
cttatctgagctgagcca

SEQ ID NO: 6168758 - DNA, 20 bp, Homo sapiens
cttatctgagctgagccagg

SEQ ID NO: 6168759 - DNA, 21 bp, Homo sapiens
cttatctgagctgagccaggc

SEQ ID NO: 6168760 - DNA, 12 bp, Homo sapiens
cttatctgcccc

SEQ ID NO: 6168761 - DNA, 19 bp, Homo sapiens
cttatctgtgcgtgaaaca

SEQ ID NO: 6168762 - DNA, 21 bp, Homo sapiens
cttatctgtgcgtgaaacaca

SEQ ID NO: 6168763 - DNA, 16 bp, Homo sapiens
cttatctgtgctcagg

SEQ ID NO: 6168764 - DNA, 22 bp, Homo sapiens
cttatcttacaactcccccacc

SEQ ID NO: 6168765 - DNA, 16 bp, Homo sapiens
cttatcttctggatta

SEQ ID NO: 6168766 - DNA, 14 bp, Homo sapiens
cttatcttgaaaag

SEQ ID NO: 6168767 - DNA, 16 bp, Homo sapiens
cttatctttattggct

SEQ ID NO: 6168768 - DNA, 21 bp, Homo sapiens
cttatctttctaaaactgcct

SEQ ID NO: 6168769 - DNA, 19 bp, Homo sapiens
cttatctttctttccattt

SEQ ID NO: 6168770 - DNA, 12 bp, Homo sapiens
cttatcttttac

SEQ ID NO: 6168771 - DNA, 13 bp, Homo sapiens
cttatgaaaagaa

SEQ ID NO: 6168772 - DNA, 21 bp, Homo sapiens
cttatgaataagcacttgaat

SEQ ID NO: 6168773 - DNA, 14 bp, Homo sapiens
cttatgaatagaca

SEQ ID NO: 6168774 - DNA, 19 bp, Homo sapiens
cttatgaatgatttgcata

SEQ ID NO: 6168775 - DNA, 22 bp, Homo sapiens
cttatgacagaggttttgaaat

SEQ ID NO: 6168776 - DNA, 22 bp, Homo sapiens
cttatgacatcacttgtacaaa

SEQ ID NO: 6168777 - DNA, 23 bp, Homo sapiens
cttatgacgcggctcaaaaggaa

SEQ ID NO: 6168778 - DNA, 14 bp, Homo sapiens
cttatgactatgta

SEQ ID NO: 6168779 - DNA, 18 bp, Homo sapiens
cttatgacttgctacttt

SEQ ID NO: 6168780 - DNA, 13 bp, Homo sapiens
cttatgagaaact

SEQ ID NO: 6168781 - DNA, 23 bp, Homo sapiens
cttatgagaacatggtgtgtgtc

SEQ ID NO: 6168782 - DNA, 18 bp, Homo sapiens
cttatgagactcttaaat

SEQ ID NO: 6168783 - DNA, 22 bp, Homo sapiens
cttatgatattctcattatttc

SEQ ID NO: 6168784 - DNA, 15 bp, Homo sapiens
cttatgattttatta

SEQ ID NO: 6168785 - DNA, 16 bp, Homo sapiens
cttatgcatactgaga

SEQ ID NO: 6168786 - DNA, 21 bp, Homo sapiens
cttatgcatactgagatagct

SEQ ID NO: 6168787 - DNA, 15 bp, Homo sapiens
cttatgcatgaaatg

SEQ ID NO: 6168788 - DNA, 18 bp, Homo sapiens
cttatgcatgaaatgaat

SEQ ID NO: 6168789 - DNA, 22 bp, Homo sapiens
cttatgccacgggaagtttaga

SEQ ID NO: 6168790 - DNA, 15 bp, Homo sapiens
cttatgccatcccgg

SEQ ID NO: 6168791 - DNA, 20 bp, Homo sapiens
cttatgccgtctcatatttt

SEQ ID NO: 6168792 - DNA, 15 bp, Homo sapiens
cttatgcctatacct

SEQ ID NO: 6168793 - DNA, 17 bp, Homo sapiens
cttatgcggttaatttt

SEQ ID NO: 6168794 - DNA, 21 bp, Homo sapiens
cttatgctagtttattggaag

SEQ ID NO: 6168795 - DNA, 19 bp, Homo sapiens
cttatgctcttaattgcca

SEQ ID NO: 6168796 - DNA, 16 bp, Homo sapiens
cttatgctgctgtgaa

SEQ ID NO: 6168797 - DNA, 18 bp, Homo sapiens
cttatgctgtacccagtt

SEQ ID NO: 6168798 - DNA, 14 bp, Homo sapiens
cttatgcttaaaat

SEQ ID NO: 6168799 - DNA, 14 bp, Homo sapiens
cttatgcttccaga

SEQ ID NO: 6168800 - DNA, 15 bp, Homo sapiens
cttatgcttccagaa

SEQ ID NO: 6168801 - DNA, 17 bp, Homo sapiens
cttatggaacactctga

SEQ ID NO: 6168802 - DNA, 17 bp, Homo sapiens
cttatggaattgatttg

SEQ ID NO: 6168803 - DNA, 19 bp, Homo sapiens
cttatggaattgatttgca

SEQ ID NO: 6168804 - DNA, 22 bp, Homo sapiens
cttatggacaaaattaatacat

SEQ ID NO: 6168805 - DNA, 16 bp, Homo sapiens
cttatggacactgcct

SEQ ID NO: 6168806 - DNA, 14 bp, Homo sapiens
cttatggatgtccc

SEQ ID NO: 6168807 - DNA, 16 bp, Homo sapiens
cttatggatgtcccca

SEQ ID NO: 6168808 - DNA, 17 bp, Homo sapiens
cttatggatgtccccag

SEQ ID NO: 6168809 - DNA, 18 bp, Homo sapiens
cttatggatgtccccagc

SEQ ID NO: 6168810 - DNA, 14 bp, Homo sapiens
cttatgggctgaag

SEQ ID NO: 6168811 - DNA, 19 bp, Homo sapiens
cttatgggctgaagtgttc

SEQ ID NO: 6168812 - DNA, 22 bp, Homo sapiens
cttatgggctgggttctaccca

SEQ ID NO: 6168813 - DNA, 14 bp, Homo sapiens
cttatggggtgaga

SEQ ID NO: 6168814 - DNA, 21 bp, Homo sapiens
cttatgggtagggctctgaca

SEQ ID NO: 6168815 - DNA, 15 bp, Homo sapiens
cttatgggtggcttt

SEQ ID NO: 6168816 - DNA, 16 bp, Homo sapiens
cttatgggtggctttc

SEQ ID NO: 6168817 - DNA, 22 bp, Homo sapiens
cttatggtattatatctctgta

SEQ ID NO: 6168818 - DNA, 15 bp, Homo sapiens
cttatggtccagaaa

SEQ ID NO: 6168819 - DNA, 23 bp, Homo sapiens
cttatgtaagtttgcatatcagt

SEQ ID NO: 6168820 - DNA, 15 bp, Homo sapiens
cttatgtacctcttt

SEQ ID NO: 6168821 - DNA, 12 bp, Homo sapiens
cttatgtacttg

SEQ ID NO: 6168822 - DNA, 22 bp, Homo sapiens
cttatgtacttgatactgaatg

SEQ ID NO: 6168823 - DNA, 22 bp, Homo sapiens
cttatgtagaaactgaggccca

SEQ ID NO: 6168824 - DNA, 23 bp, Homo sapiens
cttatgtagagtttttatgcctt

SEQ ID NO: 6168825 - DNA, 19 bp, Homo sapiens
cttatgtagatatttggct

SEQ ID NO: 6168826 - DNA, 21 bp, Homo sapiens
cttatgtatcagtgtcctttc

SEQ ID NO: 6168827 - DNA, 22 bp, Homo sapiens
cttatgtcctccaccacaagag

SEQ ID NO: 6168828 - DNA, 16 bp, Homo sapiens
cttatgtgaaaaatta

SEQ ID NO: 6168829 - DNA, 18 bp, Homo sapiens
cttatgtgaaaaattaac

SEQ ID NO: 6168830 - DNA, 13 bp, Homo sapiens
cttatgtgacatt

SEQ ID NO: 6168831 - DNA, 15 bp, Homo sapiens
cttatgtgttacatt

SEQ ID NO: 6168832 - DNA, 15 bp, Homo sapiens
cttatgttccagatg

SEQ ID NO: 6168833 - DNA, 14 bp, Homo sapiens
cttatgttgaatat

SEQ ID NO: 6168834 - DNA, 13 bp, Homo sapiens
cttattaaaaaat

SEQ ID NO: 6168835 - DNA, 18 bp, Homo sapiens
cttattaaagttctgtaa

SEQ ID NO: 6168836 - DNA, 13 bp, Homo sapiens
cttattaaagttt

SEQ ID NO: 6168837 - DNA, 15 bp, Homo sapiens
cttattaaagtttca

SEQ ID NO: 6168838 - DNA, 16 bp, Homo sapiens
cttattaaagtttcaa

SEQ ID NO: 6168839 - DNA, 19 bp, Homo sapiens
cttattaaatggaaactga

SEQ ID NO: 6168840 - DNA, 20 bp, Homo sapiens
cttattaacaactgtgaata

SEQ ID NO: 6168841 - DNA, 15 bp, Homo sapiens
cttattaaccaaatt

SEQ ID NO: 6168842 - DNA, 13 bp, Homo sapiens
cttattaagactg

SEQ ID NO: 6168843 - DNA, 21 bp, Homo sapiens
cttattaagagcaaactttag

SEQ ID NO: 6168844 - DNA, 22 bp, Homo sapiens
cttattaagttcgaacatgttt

SEQ ID NO: 6168845 - DNA, 14 bp, Homo sapiens
cttattaatgctaa

SEQ ID NO: 6168846 - DNA, 12 bp, Homo sapiens
cttattaattct

SEQ ID NO: 6168847 - DNA, 13 bp, Homo sapiens
cttattacccaaa

SEQ ID NO: 6168848 - DNA, 22 bp, Homo sapiens
cttattactgcttgcagtaatt

SEQ ID NO: 6168849 - DNA, 11 bp, Homo sapiens
cttattagaac

SEQ ID NO: 6168850 - DNA, 19 bp, Homo sapiens
cttattagaagccaagtaa

SEQ ID NO: 6168851 - DNA, 17 bp, Homo sapiens
cttattagagtgtcttt

SEQ ID NO: 6168852 - DNA, 11 bp, Homo sapiens
cttattagcag

SEQ ID NO: 6168853 - DNA, 16 bp, Homo sapiens
cttattagctaaaaat

SEQ ID NO: 6168854 - DNA, 18 bp, Homo sapiens
cttattaggcctcagaaa

SEQ ID NO: 6168855 - DNA, 24 bp, Homo sapiens
cttattataaaatggacacaaatt

SEQ ID NO: 6168856 - DNA, 20 bp, Homo sapiens
ctgccaactccatgaccagg

SEQ ID NO: 6168857 - DNA, 11 bp, Homo sapiens
ctgccaagaaa

SEQ ID NO: 6168858 - DNA, 18 bp, Homo sapiens
ctgccaagactcctcagg

SEQ ID NO: 6168859 - DNA, 12 bp, Homo sapiens
ctgccaagagag

SEQ ID NO: 6168860 - DNA, 22 bp, Homo sapiens
ctgccaagataccttcatggtg

SEQ ID NO: 6168861 - DNA, 19 bp, Homo sapiens
ctgccaagcactcgagacc

SEQ ID NO: 6168862 - DNA, 13 bp, Homo sapiens
ctgccaagccaga

SEQ ID NO: 6168863 - DNA, 22 bp, Homo sapiens
ctgccaagccagattctcttga

SEQ ID NO: 6168864 - DNA, 23 bp, Homo sapiens
ctgccaagccagattctcttgaa

SEQ ID NO: 6168865 - DNA, 21 bp, Homo sapiens
ctgccaagccccatcctgccg

SEQ ID NO: 6168866 - DNA, 13 bp, Homo sapiens
ctgccaagcctgg

SEQ ID NO: 6168867 - DNA, 14 bp, Homo sapiens
ctgccaagcctgga

SEQ ID NO: 6168868 - DNA, 20 bp, Homo sapiens
ctgccaagctcacacagcag

SEQ ID NO: 6168869 - DNA, 18 bp, Homo sapiens
ctgccaagcttcctgtgc

SEQ ID NO: 6168870 - DNA, 23 bp, Homo sapiens
ctgccaagcttggagtgacctaa

SEQ ID NO: 6168871 - DNA, 15 bp, Homo sapiens
ctgccaaggagcatc

SEQ ID NO: 6168872 - DNA, 15 bp, Homo sapiens
ctgccaaggccagag

SEQ ID NO: 6168873 - DNA, 22 bp, Homo sapiens
ctgccaaggccagagtggcctg

SEQ ID NO: 6168874 - DNA, 16 bp, Homo sapiens
ctgccaagggtgctgg

SEQ ID NO: 6168875 - DNA, 17 bp, Homo sapiens
ctgccaaggtggaggga

SEQ ID NO: 6168876 - DNA, 14 bp, Homo sapiens
ctgccaaggtgtgg

SEQ ID NO: 6168877 - DNA, 18 bp, Homo sapiens
ctgccaagtcctgccttt

SEQ ID NO: 6168878 - DNA, 17 bp, Homo sapiens
ctgccaagtggggatgg

SEQ ID NO: 6168879 - DNA, 16 bp, Homo sapiens
ctgccaataaattcta

SEQ ID NO: 6168880 - DNA, 14 bp, Homo sapiens
ctgccaatatccta

SEQ ID NO: 6168881 - DNA, 22 bp, Homo sapiens
ctgccaatatcctaataaaaag

SEQ ID NO: 6168882 - DNA, 23 bp, Homo sapiens
ctgccaatccttaaatatgtgaa

SEQ ID NO: 6168883 - DNA, 18 bp, Homo sapiens
ctgccaatcggctacccc

SEQ ID NO: 6168884 - DNA, 18 bp, Homo sapiens
ctgccaatctgtacaaaa

SEQ ID NO: 6168885 - DNA, 16 bp, Homo sapiens
ctgccaatgccacagc

SEQ ID NO: 6168886 - DNA, 17 bp, Homo sapiens
ctgccaatgccatgact

SEQ ID NO: 6168887 - DNA, 21 bp, Homo sapiens
ctgccaatgccatgactgctc

SEQ ID NO: 6168888 - DNA, 16 bp, Homo sapiens
ctgccaatgctccagc

SEQ ID NO: 6168889 - DNA, 17 bp, Homo sapiens
ctgccaatgctccagct

SEQ ID NO: 6168890 - DNA, 16 bp, Homo sapiens
ctgccaatgtgggctg

SEQ ID NO: 6168891 - DNA, 18 bp, Homo sapiens
ctgccaatgtgggctgcc

SEQ ID NO: 6168892 - DNA, 19 bp, Homo sapiens
ctgccacaaaccaccagga

SEQ ID NO: 6168893 - DNA, 18 bp, Homo sapiens
ctgccacaacagaataaa

SEQ ID NO: 6168894 - DNA, 20 bp, Homo sapiens
ctgccacaacagaataaagc

SEQ ID NO: 6168895 - DNA, 18 bp, Homo sapiens
ctgccacaatgtgatatg

SEQ ID NO: 6168896 - DNA, 21 bp, Homo sapiens
ctgccacaatgtgatatgtgt

SEQ ID NO: 6168897 - DNA, 13 bp, Homo sapiens
ctgccacacccag

SEQ ID NO: 6168898 - DNA, 16 bp, Homo sapiens
ctgccacacccagggg

SEQ ID NO: 6168899 - DNA, 16 bp, Homo sapiens
ctgccacacctgagcc

SEQ ID NO: 6168900 - DNA, 13 bp, Homo sapiens
ctgccacactctg

SEQ ID NO: 6168901 - DNA, 18 bp, Homo sapiens
ctgccacactctgacgca

SEQ ID NO: 6168902 - DNA, 14 bp, Homo sapiens
ctgccacactgatg

SEQ ID NO: 6168903 - DNA, 22 bp, Homo sapiens
ctgccacactgatggctcaaga

SEQ ID NO: 6168904 - DNA, 23 bp, Homo sapiens
ctgccacagagaagtttgtagcc

SEQ ID NO: 6168905 - DNA, 16 bp, Homo sapiens
ctgccacagcaaggaa

SEQ ID NO: 6168906 - DNA, 17 bp, Homo sapiens
ctgccacagccagagga

SEQ ID NO: 6168907 - DNA, 23 bp, Homo sapiens
ctgccacagtaatactcattcct

SEQ ID NO: 6168908 - DNA, 18 bp, Homo sapiens
ctgccacatacaggtgct

SEQ ID NO: 6168909 - DNA, 19 bp, Homo sapiens
ctgccacatacaggtgctc

SEQ ID NO: 6168910 - DNA, 18 bp, Homo sapiens
ctgccaccaaaggccagg

SEQ ID NO: 6168911 - DNA, 18 bp, Homo sapiens
ctgccaccaccctgtctt

SEQ ID NO: 6168912 - DNA, 21 bp, Homo sapiens
ctgccaccaccctgtcttcct

SEQ ID NO: 6168913 - DNA, 20 bp, Homo sapiens
ctgccaccacgtctgccagg

SEQ ID NO: 6168914 - DNA, 21 bp, Homo sapiens
ctgccaccacgtctgccaggc

SEQ ID NO: 6168915 - DNA, 18 bp, Homo sapiens
ctgccaccagcaatgccc

SEQ ID NO: 6168916 - DNA, 20 bp, Homo sapiens
ctgccaccagcaatgccctg

SEQ ID NO: 6168917 - DNA, 21 bp, Homo sapiens
ctgccaccagcaatgccctgc

SEQ ID NO: 6168918 - DNA, 16 bp, Homo sapiens
ctgccaccagcatcca

SEQ ID NO: 6168919 - DNA, 14 bp, Homo sapiens
ctgccaccagcccc

SEQ ID NO: 6168920 - DNA, 17 bp, Homo sapiens
ctgccaccagcgccccc

SEQ ID NO: 6168921 - DNA, 18 bp, Homo sapiens
ctgccaccagcgccccca

SEQ ID NO: 6168922 - DNA, 20 bp, Homo sapiens
ctgccaccagcgcccccact

SEQ ID NO: 6168923 - DNA, 14 bp, Homo sapiens
ctgccaccaggcca

SEQ ID NO: 6168924 - DNA, 15 bp, Homo sapiens
ctgccaccaggccac

SEQ ID NO: 6168925 - DNA, 13 bp, Homo sapiens
ctgccaccaggga

SEQ ID NO: 6168926 - DNA, 14 bp, Homo sapiens
ctgccaccatcctg

SEQ ID NO: 6168927 - DNA, 12 bp, Homo sapiens
ctgccaccatgc

SEQ ID NO: 6168928 - DNA, 14 bp, Homo sapiens
ctgccacccacctc

SEQ ID NO: 6168929 - DNA, 18 bp, Homo sapiens
ctgccacccacctccctg

SEQ ID NO: 6168930 - DNA, 12 bp, Homo sapiens
ctgccacccact

SEQ ID NO: 6168931 - DNA, 17 bp, Homo sapiens
ctgccacccagccccag

SEQ ID NO: 6168932 - DNA, 16 bp, Homo sapiens
ctgccacccaggatcc

SEQ ID NO: 6168933 - DNA, 14 bp, Homo sapiens
ctgccacccccagg

SEQ ID NO: 6168934 - DNA, 15 bp, Homo sapiens
ctgccacccccaggt

SEQ ID NO: 6168935 - DNA, 22 bp, Homo sapiens
ctgccacccccaggtcttcctg

SEQ ID NO: 6168936 - DNA, 24 bp, Homo sapiens
ctgccacccccaggtcttcctgct

SEQ ID NO: 6168937 - DNA, 16 bp, Homo sapiens
ctgccacccccttccc

SEQ ID NO: 6168938 - DNA, 22 bp, Homo sapiens
ctgccacccccttccctgggag

SEQ ID NO: 6168939 - DNA, 12 bp, Homo sapiens
ctgccaccccta

SEQ ID NO: 6168940 - DNA, 16 bp, Homo sapiens
ctgccacccctcttct

SEQ ID NO: 6168941 - DNA, 13 bp, Homo sapiens
ctgccaccccttc

SEQ ID NO: 6168942 - DNA, 15 bp, Homo sapiens
ctgccaccccttcct

SEQ ID NO: 6168943 - DNA, 18 bp, Homo sapiens
ctgccaccccttcctccc

SEQ ID NO: 6168944 - DNA, 20 bp, Homo sapiens
ctgccaccccttcctcccca

SEQ ID NO: 6168945 - DNA, 23 bp, Homo sapiens
ctgccacccgcttcctgtttctt

SEQ ID NO: 6168946 - DNA, 15 bp, Homo sapiens
ctgccaccctacctg

SEQ ID NO: 6168947 - DNA, 19 bp, Homo sapiens
ctgccaccctacctgttca

SEQ ID NO: 6168948 - DNA, 11 bp, Homo sapiens
ctgccaccctc

SEQ ID NO: 6168949 - DNA, 13 bp, Homo sapiens
ctgccaccctcct

SEQ ID NO: 6168950 - DNA, 15 bp, Homo sapiens
ctgccaccctcctgc

SEQ ID NO: 6168951 - DNA, 21 bp, Homo sapiens
ctgccaccctctgctgcacag

SEQ ID NO: 6168952 - DNA, 22 bp, Homo sapiens
ctgccaccctgccccttgccat

SEQ ID NO: 6168953 - DNA, 23 bp, Homo sapiens
ctgccaccctgggcctggcagct

SEQ ID NO: 6168954 - DNA, 15 bp, Homo sapiens
ctgccaccctgggga

SEQ ID NO: 6168955 - DNA, 14 bp, Homo sapiens
ctgccaccgccaga

SEQ ID NO: 6168956 - DNA, 18 bp, Homo sapiens
ctgccaccgccagaggac

SEQ ID NO: 6168957 - DNA, 22 bp, Homo sapiens
ctgccaccgtgggggaactgac

SEQ ID NO: 6168958 - DNA, 12 bp, Homo sapiens
ctgccacctccc

SEQ ID NO: 6168959 - DNA, 17 bp, Homo sapiens
ctgccacctccccccac

SEQ ID NO: 6168960 - DNA, 21 bp, Homo sapiens
ctgccacctccccccacaagt

SEQ ID NO: 6168961 - DNA, 22 bp, Homo sapiens
ctgccacctccccttgccagct

SEQ ID NO: 6168962 - DNA, 15 bp, Homo sapiens
ctgccacctccctga

SEQ ID NO: 6168963 - DNA, 14 bp, Homo sapiens
ctgccacctcctgc

SEQ ID NO: 6168964 - DNA, 15 bp, Homo sapiens
ctgccacctgctgct

SEQ ID NO: 6168965 - DNA, 14 bp, Homo sapiens
ctgccacctggggc

SEQ ID NO: 6168966 - DNA, 18 bp, Homo sapiens
ctgccacctggggcagtc

SEQ ID NO: 6168967 - DNA, 13 bp, Homo sapiens
ctgccacctgtct

SEQ ID NO: 6168968 - DNA, 18 bp, Homo sapiens
ctgccacctgtctgtctg

SEQ ID NO: 6168969 - DNA, 15 bp, Homo sapiens
ctgccaccttcaagt

SEQ ID NO: 6168970 - DNA, 17 bp, Homo sapiens
ctgccaccttgggtctg

SEQ ID NO: 6168971 - DNA, 19 bp, Homo sapiens
ctgccacgtcccgctgcct

SEQ ID NO: 6168972 - DNA, 20 bp, Homo sapiens
ctgccacgtcccgctgcctc

SEQ ID NO: 6168973 - DNA, 21 bp, Homo sapiens
ctgccacgtgccttaggaata

SEQ ID NO: 6168974 - DNA, 20 bp, Homo sapiens
ctgccactaaaatccaccca

SEQ ID NO: 6168975 - DNA, 22 bp, Homo sapiens
ctgccactaaaatccacccagc

SEQ ID NO: 6168976 - DNA, 19 bp, Homo sapiens
ctgccactaggctgggtgc

SEQ ID NO: 6168977 - DNA, 14 bp, Homo sapiens
ctgccactcaatgg

SEQ ID NO: 6168978 - DNA, 15 bp, Homo sapiens
ctgccactcaatggg

SEQ ID NO: 6168979 - DNA, 18 bp, Homo sapiens
ctgccactcaatgggaga

SEQ ID NO: 6168980 - DNA, 18 bp, Homo sapiens
ctgccactcacacagcca

SEQ ID NO: 6168981 - DNA, 14 bp, Homo sapiens
ctgccactcaccct

SEQ ID NO: 6168982 - DNA, 15 bp, Homo sapiens
ctgccactcaccctt

SEQ ID NO: 6168983 - DNA, 19 bp, Homo sapiens
ctgccactcactaggcccc

SEQ ID NO: 6168984 - DNA, 16 bp, Homo sapiens
ctgccactcaggccca

SEQ ID NO: 6168985 - DNA, 16 bp, Homo sapiens
ctgccactccagtcct

SEQ ID NO: 6168986 - DNA, 23 bp, Homo sapiens
ctgccactccagtcctgccacca

SEQ ID NO: 6168987 - DNA, 16 bp, Homo sapiens
ctgccactctcctgag

SEQ ID NO: 6168988 - DNA, 21 bp, Homo sapiens
ctgccactctcctgaggagca

SEQ ID NO: 6168989 - DNA, 19 bp, Homo sapiens
ctgccactctctgggactc

SEQ ID NO: 6168990 - DNA, 23 bp, Homo sapiens
ctgccactctctgggactctcct

SEQ ID NO: 6168991 - DNA, 12 bp, Homo sapiens
ctgccactctgc

SEQ ID NO: 6168992 - DNA, 17 bp, Homo sapiens
ctgccactctgctgcct

SEQ ID NO: 6168993 - DNA, 19 bp, Homo sapiens
ctgccactctgctgcctgt

SEQ ID NO: 6168994 - DNA, 21 bp, Homo sapiens
ctgccactgacaggaaagtgg

SEQ ID NO: 6168995 - DNA, 12 bp, Homo sapiens
ctgccactgacc

SEQ ID NO: 6168996 - DNA, 20 bp, Homo sapiens
ctgccactgactgcagggac

SEQ ID NO: 6168997 - DNA, 19 bp, Homo sapiens
ctgccactgaggagacaga

SEQ ID NO: 6168998 - DNA, 19 bp, Homo sapiens
ctgccactgcacaccagcc

SEQ ID NO: 6168999 - DNA, 23 bp, Homo sapiens
ctgccactgggacggctcctgct

SEQ ID NO: 6169000 - DNA, 24 bp, Homo sapiens
ctgccactgggcacctgcgcacag

SEQ ID NO: 6169001 - DNA, 15 bp, Homo sapiens
ctgccactgggctct

SEQ ID NO: 6169002 - DNA, 17 bp, Homo sapiens
ctgccactgggctctgg

SEQ ID NO: 6169003 - DNA, 12 bp, Homo sapiens
ctgccactgtgt

SEQ ID NO: 6169004 - DNA, 13 bp, Homo sapiens
ctgccactgtgtg

SEQ ID NO: 6169005 - DNA, 14 bp, Homo sapiens
ctgccactgtgtga

SEQ ID NO: 6169006 - DNA, 17 bp, Homo sapiens
ctgccacttaaaaagac

SEQ ID NO: 6169007 - DNA, 21 bp, Homo sapiens
ctgccacttcaacccccagct

SEQ ID NO: 6169008 - DNA, 24 bp, Homo sapiens
ctgccacttctgcgggctccctcc

SEQ ID NO: 6169009 - DNA, 15 bp, Homo sapiens
ctgccacttgcactg

SEQ ID NO: 6169010 - DNA, 17 bp, Homo sapiens
ctgccacttgcactgtg

SEQ ID NO: 6169011 - DNA, 20 bp, Homo sapiens
ctgccacttgcactgtgctt

SEQ ID NO: 6169012 - DNA, 21 bp, Homo sapiens
ctgccactttcacgtggcctc

SEQ ID NO: 6169013 - DNA, 14 bp, Homo sapiens
ctgccactttgcac

SEQ ID NO: 6169014 - DNA, 16 bp, Homo sapiens
ctgccagaagtgtgtt

SEQ ID NO: 6169015 - DNA, 17 bp, Homo sapiens
ctgccagacatggacct

SEQ ID NO: 6169016 - DNA, 20 bp, Homo sapiens
ctgccagacatggacctcca

SEQ ID NO: 6169017 - DNA, 20 bp, Homo sapiens
ctgccagacctgcatggtca

SEQ ID NO: 6169018 - DNA, 21 bp, Homo sapiens
ctgccagacctgcatggtcaa

SEQ ID NO: 6169019 - DNA, 22 bp, Homo sapiens
ctgccagaccttaataaaggcc

SEQ ID NO: 6169020 - DNA, 22 bp, Homo sapiens
ctgccagacggcacccacccag

SEQ ID NO: 6169021 - DNA, 15 bp, Homo sapiens
ctgccagacttaaaa

SEQ ID NO: 6169022 - DNA, 11 bp, Homo sapiens
ctgccagagaa

SEQ ID NO: 6169023 - DNA, 12 bp, Homo sapiens
ctgccagagaag

SEQ ID NO: 6169024 - DNA, 23 bp, Homo sapiens
ctgccagagaagtctggtcagag

SEQ ID NO: 6169025 - DNA, 10 bp, Homo sapiens
ctgccagagg

SEQ ID NO: 6169026 - DNA, 15 bp, Homo sapiens
ctgccagaggcctgg

SEQ ID NO: 6169027 - DNA, 16 bp, Homo sapiens
ctgccagaggcctggt

SEQ ID NO: 6169028 - DNA, 18 bp, Homo sapiens
ctgccagaggcctggtgc

SEQ ID NO: 6169029 - DNA, 22 bp, Homo sapiens
ctgccagaggcctggtgccctg

SEQ ID NO: 6169030 - DNA, 14 bp, Homo sapiens
ctgccagatgctga

SEQ ID NO: 6169031 - DNA, 18 bp, Homo sapiens
ctgccagatgctgatgtt

SEQ ID NO: 6169032 - DNA, 23 bp, Homo sapiens
ctgccagatgctgatgttcagtg

SEQ ID NO: 6169033 - DNA, 15 bp, Homo sapiens
ctgccagcaacgcag

SEQ ID NO: 6169034 - DNA, 20 bp, Homo sapiens
cttattatgtaggtaagact

SEQ ID NO: 6169035 - DNA, 21 bp, Homo sapiens
cttattattaataatgaagta

SEQ ID NO: 6169036 - DNA, 16 bp, Homo sapiens
cttattatttttgaga

SEQ ID NO: 6169037 - DNA, 16 bp, Homo sapiens
cttattcaaagagaaa

SEQ ID NO: 6169038 - DNA, 15 bp, Homo sapiens
cttattcaccttttt

SEQ ID NO: 6169039 - DNA, 19 bp, Homo sapiens
cttattcacctttttaata

SEQ ID NO: 6169040 - DNA, 19 bp, Homo sapiens
cttattcagcaccaagcat

SEQ ID NO: 6169041 - DNA, 14 bp, Homo sapiens
cttattcagtgaaa

SEQ ID NO: 6169042 - DNA, 19 bp, Homo sapiens
cttattcagtgaaaaagat

SEQ ID NO: 6169043 - DNA, 16 bp, Homo sapiens
cttattcagttcttac

SEQ ID NO: 6169044 - DNA, 23 bp, Homo sapiens
cttattcatgctttctccttttt

SEQ ID NO: 6169045 - DNA, 14 bp, Homo sapiens
cttattccatgact

SEQ ID NO: 6169046 - DNA, 14 bp, Homo sapiens
cttattcccatgtg

SEQ ID NO: 6169047 - DNA, 17 bp, Homo sapiens
cttattcccccaaactt

SEQ ID NO: 6169048 - DNA, 18 bp, Homo sapiens
cttattcccccaaacttt

SEQ ID NO: 6169049 - DNA, 22 bp, Homo sapiens
cttattcccccaaactttttgt

SEQ ID NO: 6169050 - DNA, 18 bp, Homo sapiens
cttattccctcatccttt

SEQ ID NO: 6169051 - DNA, 15 bp, Homo sapiens
cttattcccttcctg

SEQ ID NO: 6169052 - DNA, 14 bp, Homo sapiens
cttattccgagaat

SEQ ID NO: 6169053 - DNA, 20 bp, Homo sapiens
cttattccgagcattccagt

SEQ ID NO: 6169054 - DNA, 16 bp, Homo sapiens
cttattcctcagtgag

SEQ ID NO: 6169055 - DNA, 14 bp, Homo sapiens
cttattcctctagg

SEQ ID NO: 6169056 - DNA, 15 bp, Homo sapiens
cttattcctctaggc

SEQ ID NO: 6169057 - DNA, 23 bp, Homo sapiens
cttattcctctaggcaagcagga

SEQ ID NO: 6169058 - DNA, 23 bp, Homo sapiens
cttattctaataaatatactatg

SEQ ID NO: 6169059 - DNA, 15 bp, Homo sapiens
cttattctcctccct

SEQ ID NO: 6169060 - DNA, 15 bp, Homo sapiens
cttattctctgtttg

SEQ ID NO: 6169061 - DNA, 12 bp, Homo sapiens
cttattctgtat

SEQ ID NO: 6169062 - DNA, 13 bp, Homo sapiens
cttattctgtatc

SEQ ID NO: 6169063 - DNA, 12 bp, Homo sapiens
cttattcttaag

SEQ ID NO: 6169064 - DNA, 13 bp, Homo sapiens
cttattcttctca

SEQ ID NO: 6169065 - DNA, 19 bp, Homo sapiens
cttattcttgtggttaaaa

SEQ ID NO: 6169066 - DNA, 17 bp, Homo sapiens
cttattctttccttctt

SEQ ID NO: 6169067 - DNA, 22 bp, Homo sapiens
cttattgaaaaaaaaaatgttg

SEQ ID NO: 6169068 - DNA, 23 bp, Homo sapiens
cttattgaaaaaaaaaatgttga

SEQ ID NO: 6169069 - DNA, 13 bp, Homo sapiens
cttattgaatata

SEQ ID NO: 6169070 - DNA, 16 bp, Homo sapiens
cttattgatcccacat

SEQ ID NO: 6169071 - DNA, 13 bp, Homo sapiens
cttattgcccagg

SEQ ID NO: 6169072 - DNA, 19 bp, Homo sapiens
cttattgcctcacttcagg

SEQ ID NO: 6169073 - DNA, 16 bp, Homo sapiens
cttattgcctcccagg

SEQ ID NO: 6169074 - DNA, 18 bp, Homo sapiens
cttattgcctcccaggca

SEQ ID NO: 6169075 - DNA, 19 bp, Homo sapiens
cttattgcctgggcagtgc

SEQ ID NO: 6169076 - DNA, 14 bp, Homo sapiens
cttattgctgattt

SEQ ID NO: 6169077 - DNA, 15 bp, Homo sapiens
cttattgctgccaaa

SEQ ID NO: 6169078 - DNA, 17 bp, Homo sapiens
cttattgctgccaaaac

SEQ ID NO: 6169079 - DNA, 17 bp, Homo sapiens
cttattgcttcatctgt

SEQ ID NO: 6169080 - DNA, 20 bp, Homo sapiens
cttattgctttgaaactaga

SEQ ID NO: 6169081 - DNA, 17 bp, Homo sapiens
cttattggaactctgct

SEQ ID NO: 6169082 - DNA, 17 bp, Homo sapiens
cttattgggatatcatt

SEQ ID NO: 6169083 - DNA, 19 bp, Homo sapiens
cttattgggatatcatttt

SEQ ID NO: 6169084 - DNA, 20 bp, Homo sapiens
cttattgtagcatcctggaa

SEQ ID NO: 6169085 - DNA, 22 bp, Homo sapiens
cttattgtatctgaattcctgt

SEQ ID NO: 6169086 - DNA, 15 bp, Homo sapiens
cttattgtccccact

SEQ ID NO: 6169087 - DNA, 20 bp, Homo sapiens
cttattgtggataacaaaga

SEQ ID NO: 6169088 - DNA, 21 bp, Homo sapiens
cttattgttccaagacattgt

SEQ ID NO: 6169089 - DNA, 22 bp, Homo sapiens
cttattgttccaagacattgtc

SEQ ID NO: 6169090 - DNA, 16 bp, Homo sapiens
cttattgtttgtaaac

SEQ ID NO: 6169091 - DNA, 18 bp, Homo sapiens
cttattgttttaaaaagt

SEQ ID NO: 6169092 - DNA, 14 bp, Homo sapiens
cttatttaaaagat

SEQ ID NO: 6169093 - DNA, 17 bp, Homo sapiens
cttatttaaaagatttt

SEQ ID NO: 6169094 - DNA, 23 bp, Homo sapiens
cttatttaaaagattttatggtt

SEQ ID NO: 6169095 - DNA, 23 bp, Homo sapiens
cttatttaaccaggggtcctaac

SEQ ID NO: 6169096 - DNA, 20 bp, Homo sapiens
cttatttaagacatgtttaa

SEQ ID NO: 6169097 - DNA, 20 bp, Homo sapiens
cttatttacagataacttct

SEQ ID NO: 6169098 - DNA, 18 bp, Homo sapiens
cttatttagaaaaaaggg

SEQ ID NO: 6169099 - DNA, 13 bp, Homo sapiens
cttatttagagat

SEQ ID NO: 6169100 - DNA, 19 bp, Homo sapiens
cttatttagtattctgcct

SEQ ID NO: 6169101 - DNA, 21 bp, Homo sapiens
cttatttatagaatttaatat

SEQ ID NO: 6169102 - DNA, 19 bp, Homo sapiens
cttatttatatatgaagta

SEQ ID NO: 6169103 - DNA, 14 bp, Homo sapiens
cttatttatatgaa

SEQ ID NO: 6169104 - DNA, 16 bp, Homo sapiens
cttatttatatgaagc

SEQ ID NO: 6169105 - DNA, 22 bp, Homo sapiens
cttatttatgaaagtattaaaa

SEQ ID NO: 6169106 - DNA, 13 bp, Homo sapiens
cttatttatgaat

SEQ ID NO: 6169107 - DNA, 14 bp, Homo sapiens
cttatttattgtat

SEQ ID NO: 6169108 - DNA, 16 bp, Homo sapiens
cttatttattgtattc

SEQ ID NO: 6169109 - DNA, 17 bp, Homo sapiens
cttatttattgtattct

SEQ ID NO: 6169110 - DNA, 17 bp, Homo sapiens
cttatttattgttgcct

SEQ ID NO: 6169111 - DNA, 12 bp, Homo sapiens
cttatttattta

SEQ ID NO: 6169112 - DNA, 13 bp, Homo sapiens
cttatttcactaa

SEQ ID NO: 6169113 - DNA, 23 bp, Homo sapiens
cttatttcactatcttcttcaaa

SEQ ID NO: 6169114 - DNA, 13 bp, Homo sapiens
cttatttcataat

SEQ ID NO: 6169115 - DNA, 16 bp, Homo sapiens
cttatttcataattgc

SEQ ID NO: 6169116 - DNA, 15 bp, Homo sapiens
cttatttcatcattc

SEQ ID NO: 6169117 - DNA, 17 bp, Homo sapiens
cttatttcatgaaaatt

SEQ ID NO: 6169118 - DNA, 14 bp, Homo sapiens
cttatttcatttct

SEQ ID NO: 6169119 - DNA, 15 bp, Homo sapiens
cttatttcatttctt

SEQ ID NO: 6169120 - DNA, 19 bp, Homo sapiens
cttatttccaagtaagagt

SEQ ID NO: 6169121 - DNA, 14 bp, Homo sapiens
cttatttccccttt

SEQ ID NO: 6169122 - DNA, 23 bp, Homo sapiens
cttatttcccctttccaattcca

SEQ ID NO: 6169123 - DNA, 14 bp, Homo sapiens
cttatttccctcat

SEQ ID NO: 6169124 - DNA, 16 bp, Homo sapiens
cttatttccctcatct

SEQ ID NO: 6169125 - DNA, 17 bp, Homo sapiens
cttatttccctcatctt

SEQ ID NO: 6169126 - DNA, 17 bp, Homo sapiens
cttatttcgtttctggg

SEQ ID NO: 6169127 - DNA, 13 bp, Homo sapiens
cttatttctaaat

SEQ ID NO: 6169128 - DNA, 20 bp, Homo sapiens
cttatttctcattgcctctt

SEQ ID NO: 6169129 - DNA, 15 bp, Homo sapiens
cttatttctctctcc

SEQ ID NO: 6169130 - DNA, 18 bp, Homo sapiens
cttatttctctctcctgg

SEQ ID NO: 6169131 - DNA, 19 bp, Homo sapiens
cttatttctctctcctggt

SEQ ID NO: 6169132 - DNA, 14 bp, Homo sapiens
cttatttctgaaca

SEQ ID NO: 6169133 - DNA, 14 bp, Homo sapiens
cttatttctgaatt

SEQ ID NO: 6169134 - DNA, 16 bp, Homo sapiens
cttatttctgaattca

SEQ ID NO: 6169135 - DNA, 12 bp, Homo sapiens
cttatttcttaa

SEQ ID NO: 6169136 - DNA, 19 bp, Homo sapiens
cttatttctttcctttaaa

SEQ ID NO: 6169137 - DNA, 13 bp, Homo sapiens
cttatttgagtga

SEQ ID NO: 6169138 - DNA, 23 bp, Homo sapiens
cttatttgccttctactcccctt

SEQ ID NO: 6169139 - DNA, 16 bp, Homo sapiens
cttatttgtatatggt

SEQ ID NO: 6169140 - DNA, 23 bp, Homo sapiens
cttatttgtcggggaagatgaaa

SEQ ID NO: 6169141 - DNA, 22 bp, Homo sapiens
cttatttgtctgtaaaaaatgg

SEQ ID NO: 6169142 - DNA, 15 bp, Homo sapiens
cttattttaaaataa

SEQ ID NO: 6169143 - DNA, 23 bp, Homo sapiens
cttattttaaaattttatctctt

SEQ ID NO: 6169144 - DNA, 17 bp, Homo sapiens
cttattttacaaatatt

SEQ ID NO: 6169145 - DNA, 22 bp, Homo sapiens
cttattttacaaatattaagaa

SEQ ID NO: 6169146 - DNA, 14 bp, Homo sapiens
cttattttagaaat

SEQ ID NO: 6169147 - DNA, 16 bp, Homo sapiens
cttattttaggaaatt

SEQ ID NO: 6169148 - DNA, 18 bp, Homo sapiens
cttattttaggaaattta

SEQ ID NO: 6169149 - DNA, 13 bp, Homo sapiens
cttattttagtat

SEQ ID NO: 6169150 - DNA, 18 bp, Homo sapiens
cttattttataattttaa

SEQ ID NO: 6169151 - DNA, 23 bp, Homo sapiens
cttattttatcttctttcctcaa

SEQ ID NO: 6169152 - DNA, 20 bp, Homo sapiens
cttattttatgatagtttgt

SEQ ID NO: 6169153 - DNA, 11 bp, Homo sapiens
cttattttatt

SEQ ID NO: 6169154 - DNA, 12 bp, Homo sapiens
cttattttccaa

SEQ ID NO: 6169155 - DNA, 18 bp, Homo sapiens
cttattttccacttatct

SEQ ID NO: 6169156 - DNA, 19 bp, Homo sapiens
cttattttctgaattcata

SEQ ID NO: 6169157 - DNA, 19 bp, Homo sapiens
cttattttcttattttaga

SEQ ID NO: 6169158 - DNA, 14 bp, Homo sapiens
cttattttgattgt

SEQ ID NO: 6169159 - DNA, 18 bp, Homo sapiens
cttattttgcattccaga

SEQ ID NO: 6169160 - DNA, 22 bp, Homo sapiens
cttattttgggttcaggcctgg

SEQ ID NO: 6169161 - DNA, 16 bp, Homo sapiens
cttattttgtaataaa

SEQ ID NO: 6169162 - DNA, 17 bp, Homo sapiens
cttattttgtaataaac

SEQ ID NO: 6169163 - DNA, 23 bp, Homo sapiens
cttattttgtaataaactctcta

SEQ ID NO: 6169164 - DNA, 16 bp, Homo sapiens
cttattttgtcttatt

SEQ ID NO: 6169165 - DNA, 22 bp, Homo sapiens
cttattttgttggtgctttgca

SEQ ID NO: 6169166 - DNA, 20 bp, Homo sapiens
cttatttttaaaataaaaat

SEQ ID NO: 6169167 - DNA, 22 bp, Homo sapiens
cttatttttagatggttacact

SEQ ID NO: 6169168 - DNA, 23 bp, Homo sapiens
cttatttttagatggttacactg

SEQ ID NO: 6169169 - DNA, 16 bp, Homo sapiens
cttatttttagccata

SEQ ID NO: 6169170 - DNA, 21 bp, Homo sapiens
cttatttttagccataatttt

SEQ ID NO: 6169171 - DNA, 14 bp, Homo sapiens
cttatttttataat

SEQ ID NO: 6169172 - DNA, 23 bp, Homo sapiens
cttatttttatttatttttgtac

SEQ ID NO: 6169173 - DNA, 13 bp, Homo sapiens
cttatttttcctg

SEQ ID NO: 6169174 - DNA, 20 bp, Homo sapiens
cttatttttcctgtcctgcc

SEQ ID NO: 6169175 - DNA, 21 bp, Homo sapiens
cttatttttcctgtcctgccc

SEQ ID NO: 6169176 - DNA, 15 bp, Homo sapiens
cttatttttctgtga

SEQ ID NO: 6169177 - DNA, 13 bp, Homo sapiens
cttatttttgaat

SEQ ID NO: 6169178 - DNA, 14 bp, Homo sapiens
cttatttttgaatt

SEQ ID NO: 6169179 - DNA, 15 bp, Homo sapiens
cttatttttggactt

SEQ ID NO: 6169180 - DNA, 19 bp, Homo sapiens
cttatttttgtatgccttt

SEQ ID NO: 6169181 - DNA, 18 bp, Homo sapiens
cttattttttaaaataat

SEQ ID NO: 6169182 - DNA, 16 bp, Homo sapiens
cttatttttttcccaa

SEQ ID NO: 6169183 - DNA, 18 bp, Homo sapiens
cttatttttttctgattg

SEQ ID NO: 6169184 - DNA, 15 bp, Homo sapiens
cttcaaaaactgttt

SEQ ID NO: 6169185 - DNA, 22 bp, Homo sapiens
cttcaaaaagagagattctcca

SEQ ID NO: 6169186 - DNA, 19 bp, Homo sapiens
cttcaaaaagcagagtgga

SEQ ID NO: 6169187 - DNA, 15 bp, Homo sapiens
cttcaaaaagcattt

SEQ ID NO: 6169188 - DNA, 17 bp, Homo sapiens
cttcaaaaagccacagc

SEQ ID NO: 6169189 - DNA, 22 bp, Homo sapiens
cttcaaaaagccacagcagagc

SEQ ID NO: 6169190 - DNA, 14 bp, Homo sapiens
cttcaaaaataaaa

SEQ ID NO: 6169191 - DNA, 21 bp, Homo sapiens
cttcaaaaataaaaaatctga

SEQ ID NO: 6169192 - DNA, 19 bp, Homo sapiens
cttcaaaacaaacagatgc

SEQ ID NO: 6169193 - DNA, 15 bp, Homo sapiens
cttcaaaacagaacg

SEQ ID NO: 6169194 - DNA, 13 bp, Homo sapiens
cttcaaaaggtga

SEQ ID NO: 6169195 - DNA, 21 bp, Homo sapiens
cttcaaaaggtgattaaatat

SEQ ID NO: 6169196 - DNA, 17 bp, Homo sapiens
cttcaaaagtaatgcct

SEQ ID NO: 6169197 - DNA, 15 bp, Homo sapiens
cttcaaaagtatttt

SEQ ID NO: 6169198 - DNA, 16 bp, Homo sapiens
cttcaaaagtattttc

SEQ ID NO: 6169199 - DNA, 17 bp, Homo sapiens
cttcaaaagtattttcc

SEQ ID NO: 6169200 - DNA, 14 bp, Homo sapiens
cttcaaaatattga

SEQ ID NO: 6169201 - DNA, 15 bp, Homo sapiens
cttcaaaatcagtga

SEQ ID NO: 6169202 - DNA, 19 bp, Homo sapiens
cttcaaaatgtatatattt

SEQ ID NO: 6169203 - DNA, 20 bp, Homo sapiens
cttcaaaatgtatatattta

SEQ ID NO: 6169204 - DNA, 22 bp, Homo sapiens
cttcaaaatgttatcttctcaa

SEQ ID NO: 6169205 - DNA, 15 bp, Homo sapiens
cttcaaacatgccct

SEQ ID NO: 6169206 - DNA, 16 bp, Homo sapiens
cttcaaacatgccctc

SEQ ID NO: 6169207 - DNA, 23 bp, Homo sapiens
cttcaaacatgccctcaggcttg

SEQ ID NO: 6169208 - DNA, 14 bp, Homo sapiens
cttcaaactacttt

SEQ ID NO: 6169209 - DNA, 18 bp, Homo sapiens
cttcaaactttcactttg

SEQ ID NO: 6169210 - DNA, 17 bp, Homo sapiens
cttcaaagcaaatgtct

SEQ ID NO: 6169211 - DNA, 13 bp, Homo sapiens
cttcaaagcagag

SEQ ID NO: 6169212 - DNA, 13 bp, Homo sapiens
cttcaaagccttc

SEQ ID NO: 6169213 - DNA, 16 bp, Homo sapiens
ctgccagcacgcctgg

SEQ ID NO: 6169214 - DNA, 13 bp, Homo sapiens
ctgccagcagcag

SEQ ID NO: 6169215 - DNA, 17 bp, Homo sapiens
ctgccagcagcagcagg

SEQ ID NO: 6169216 - DNA, 12 bp, Homo sapiens
ctgccagcagcc

SEQ ID NO: 6169217 - DNA, 13 bp, Homo sapiens
ctgccagcagccc

SEQ ID NO: 6169218 - DNA, 18 bp, Homo sapiens
ctgccagcagccccgtct

SEQ ID NO: 6169219 - DNA, 12 bp, Homo sapiens
ctgccagccagc

SEQ ID NO: 6169220 - DNA, 13 bp, Homo sapiens
ctgccagccagca

SEQ ID NO: 6169221 - DNA, 15 bp, Homo sapiens
ctgccagccagcagc

SEQ ID NO: 6169222 - DNA, 16 bp, Homo sapiens
ctgccagccagcagcc

SEQ ID NO: 6169223 - DNA, 14 bp, Homo sapiens
ctgccagcccactg

SEQ ID NO: 6169224 - DNA, 16 bp, Homo sapiens
ctgccagcccactgcc

SEQ ID NO: 6169225 - DNA, 22 bp, Homo sapiens
ctgccagcccactgcctcctgc

SEQ ID NO: 6169226 - DNA, 12 bp, Homo sapiens
ctgccagcccag

SEQ ID NO: 6169227 - DNA, 13 bp, Homo sapiens
ctgccagcccaga

SEQ ID NO: 6169228 - DNA, 15 bp, Homo sapiens
ctgccagccccacac

SEQ ID NO: 6169229 - DNA, 19 bp, Homo sapiens
ctgccagccccacacagct

SEQ ID NO: 6169230 - DNA, 23 bp, Homo sapiens
ctgccagcccggctcggcccagc

SEQ ID NO: 6169231 - DNA, 14 bp, Homo sapiens
ctgccagccctgca

SEQ ID NO: 6169232 - DNA, 15 bp, Homo sapiens
ctgccagccgaccct

SEQ ID NO: 6169233 - DNA, 22 bp, Homo sapiens
ctgccagccgaccctcctggcc

SEQ ID NO: 6169234 - DNA, 13 bp, Homo sapiens
ctgccagccgctg

SEQ ID NO: 6169235 - DNA, 13 bp, Homo sapiens
ctgccagcctgag

SEQ ID NO: 6169236 - DNA, 20 bp, Homo sapiens
ctgccagcctgagcggaggc

SEQ ID NO: 6169237 - DNA, 13 bp, Homo sapiens
ctgccagcctggc

SEQ ID NO: 6169238 - DNA, 14 bp, Homo sapiens
ctgccagcctggct

SEQ ID NO: 6169239 - DNA, 23 bp, Homo sapiens
ctgccagcctggcttctggagcc

SEQ ID NO: 6169240 - DNA, 13 bp, Homo sapiens
ctgccagccttcc

SEQ ID NO: 6169241 - DNA, 15 bp, Homo sapiens
ctgccagccttgagc

SEQ ID NO: 6169242 - DNA, 14 bp, Homo sapiens
ctgccagcgtctgt

SEQ ID NO: 6169243 - DNA, 16 bp, Homo sapiens
ctgccagcgtctgttg

SEQ ID NO: 6169244 - DNA, 15 bp, Homo sapiens
ctgccagctccacag

SEQ ID NO: 6169245 - DNA, 19 bp, Homo sapiens
ctgccagctccacagggtg

SEQ ID NO: 6169246 - DNA, 12 bp, Homo sapiens
ctgccagctctg

SEQ ID NO: 6169247 - DNA, 21 bp, Homo sapiens
ctgccagctcttcctagctgg

SEQ ID NO: 6169248 - DNA, 16 bp, Homo sapiens
ctgccagctgcactga

SEQ ID NO: 6169249 - DNA, 17 bp, Homo sapiens
ctgccagctgcactgat

SEQ ID NO: 6169250 - DNA, 18 bp, Homo sapiens
ctgccagctgcagcctgg

SEQ ID NO: 6169251 - DNA, 19 bp, Homo sapiens
ctgccagctgcagcctggt

SEQ ID NO: 6169252 - DNA, 13 bp, Homo sapiens
ctgccagctgcct

SEQ ID NO: 6169253 - DNA, 14 bp, Homo sapiens
ctgccagctgcctt

SEQ ID NO: 6169254 - DNA, 16 bp, Homo sapiens
ctgccagctgccttcc

SEQ ID NO: 6169255 - DNA, 19 bp, Homo sapiens
ctgccagctgccttcctca

SEQ ID NO: 6169256 - DNA, 13 bp, Homo sapiens
ctgccagctgctc

SEQ ID NO: 6169257 - DNA, 20 bp, Homo sapiens
ctgccagctggatcgctgca

SEQ ID NO: 6169258 - DNA, 24 bp, Homo sapiens
ctgccagctggatcgctgcacatg

SEQ ID NO: 6169259 - DNA, 17 bp, Homo sapiens
ctgccagctgggcccag

SEQ ID NO: 6169260 - DNA, 19 bp, Homo sapiens
ctgccagctgggcccagca

SEQ ID NO: 6169261 - DNA, 18 bp, Homo sapiens
ctgccaggaaacaaggga

SEQ ID NO: 6169262 - DNA, 14 bp, Homo sapiens
ctgccaggaagcca

SEQ ID NO: 6169263 - DNA, 19 bp, Homo sapiens
ctgccaggaagccagcagg

SEQ ID NO: 6169264 - DNA, 13 bp, Homo sapiens
ctgccaggacacc

SEQ ID NO: 6169265 - DNA, 14 bp, Homo sapiens
ctgccaggacacct

SEQ ID NO: 6169266 - DNA, 21 bp, Homo sapiens
ctgccaggaccccaggtcagg

SEQ ID NO: 6169267 - DNA, 16 bp, Homo sapiens
ctgccaggagacaggt

SEQ ID NO: 6169268 - DNA, 20 bp, Homo sapiens
ctgccaggagcacggctctg

SEQ ID NO: 6169269 - DNA, 16 bp, Homo sapiens
ctgccaggagcagcct

SEQ ID NO: 6169270 - DNA, 13 bp, Homo sapiens
ctgccaggaggga

SEQ ID NO: 6169271 - DNA, 18 bp, Homo sapiens
ctgccaggagggacaaag

SEQ ID NO: 6169272 - DNA, 22 bp, Homo sapiens
ctgccaggattttgtattgcca

SEQ ID NO: 6169273 - DNA, 13 bp, Homo sapiens
ctgccaggcacag

SEQ ID NO: 6169274 - DNA, 21 bp, Homo sapiens
ctgccaggcacaggcagggca

SEQ ID NO: 6169275 - DNA, 13 bp, Homo sapiens
ctgccaggcacct

SEQ ID NO: 6169276 - DNA, 15 bp, Homo sapiens
ctgccaggcacctgg

SEQ ID NO: 6169277 - DNA, 22 bp, Homo sapiens
ctgccaggcacctggcctgctg

SEQ ID NO: 6169278 - DNA, 17 bp, Homo sapiens
ctgccaggcaggggtgg

SEQ ID NO: 6169279 - DNA, 11 bp, Homo sapiens
ctgccaggcat

SEQ ID NO: 6169280 - DNA, 13 bp, Homo sapiens
ctgccaggcatgg

SEQ ID NO: 6169281 - DNA, 15 bp, Homo sapiens
ctgccaggccagcct

SEQ ID NO: 6169282 - DNA, 22 bp, Homo sapiens
ctgccaggccagcctccgagag

SEQ ID NO: 6169283 - DNA, 13 bp, Homo sapiens
ctgccaggcccat

SEQ ID NO: 6169284 - DNA, 18 bp, Homo sapiens
ctgccaggcccccaagcc

SEQ ID NO: 6169285 - DNA, 19 bp, Homo sapiens
ctgccaggcccggcatgag

SEQ ID NO: 6169286 - DNA, 15 bp, Homo sapiens
ctgccaggccctcca

SEQ ID NO: 6169287 - DNA, 18 bp, Homo sapiens
ctgccaggccctccagca

SEQ ID NO: 6169288 - DNA, 20 bp, Homo sapiens
ctgccaggccctccagcagg

SEQ ID NO: 6169289 - DNA, 15 bp, Homo sapiens
ctgccaggcctccct

SEQ ID NO: 6169290 - DNA, 18 bp, Homo sapiens
ctgccaggcggccctggg

SEQ ID NO: 6169291 - DNA, 20 bp, Homo sapiens
ctgccaggcggccctgggga

SEQ ID NO: 6169292 - DNA, 22 bp, Homo sapiens
ctgccaggcgttggtgccactt

SEQ ID NO: 6169293 - DNA, 22 bp, Homo sapiens
ctgccaggctctaaagccaaag

SEQ ID NO: 6169294 - DNA, 22 bp, Homo sapiens
ctgccaggctctccctctctgc

SEQ ID NO: 6169295 - DNA, 14 bp, Homo sapiens
ctgccaggctgcct

SEQ ID NO: 6169296 - DNA, 20 bp, Homo sapiens
ctgccagggaactggcctgc

SEQ ID NO: 6169297 - DNA, 21 bp, Homo sapiens
ctgccagggaactggcctgct

SEQ ID NO: 6169298 - DNA, 16 bp, Homo sapiens
ctgccagggaagacag

SEQ ID NO: 6169299 - DNA, 19 bp, Homo sapiens
ctgccagggaagacagagc

SEQ ID NO: 6169300 - DNA, 21 bp, Homo sapiens
ctgccagggaagacagagcag

SEQ ID NO: 6169301 - DNA, 11 bp, Homo sapiens
ctgccagggac

SEQ ID NO: 6169302 - DNA, 22 bp, Homo sapiens
ctgccagggacagagggggtgg

SEQ ID NO: 6169303 - DNA, 23 bp, Homo sapiens
ctgccagggacagagggggtggc

SEQ ID NO: 6169304 - DNA, 12 bp, Homo sapiens
ctgccagggatg

SEQ ID NO: 6169305 - DNA, 14 bp, Homo sapiens
ctgccagggatggc

SEQ ID NO: 6169306 - DNA, 12 bp, Homo sapiens
ctgccagggcag

SEQ ID NO: 6169307 - DNA, 16 bp, Homo sapiens
ctgccagggcagtgct

SEQ ID NO: 6169308 - DNA, 11 bp, Homo sapiens
ctgccagggcc

SEQ ID NO: 6169309 - DNA, 19 bp, Homo sapiens
ctgccagggcccctctccc

SEQ ID NO: 6169310 - DNA, 20 bp, Homo sapiens
ctgccagggcccctctcccc

SEQ ID NO: 6169311 - DNA, 19 bp, Homo sapiens
ctgccagggcccctgttcc

SEQ ID NO: 6169312 - DNA, 13 bp, Homo sapiens
ctgccagggcccg

SEQ ID NO: 6169313 - DNA, 19 bp, Homo sapiens
ctgccaggggatttcgaag

SEQ ID NO: 6169314 - DNA, 17 bp, Homo sapiens
ctgccaggggctctgtg

SEQ ID NO: 6169315 - DNA, 17 bp, Homo sapiens
ctgccaggggcttccca

SEQ ID NO: 6169316 - DNA, 17 bp, Homo sapiens
ctgccagtccccctgcc

SEQ ID NO: 6169317 - DNA, 17 bp, Homo sapiens
ctgccagtcgggagagc

SEQ ID NO: 6169318 - DNA, 22 bp, Homo sapiens
ctgccagtcgggagagccaggc

SEQ ID NO: 6169319 - DNA, 18 bp, Homo sapiens
ctgccagtctcactgtgg

SEQ ID NO: 6169320 - DNA, 19 bp, Homo sapiens
ctgccagtgacagacaggc

SEQ ID NO: 6169321 - DNA, 21 bp, Homo sapiens
ctgccagtgacagacaggctc

SEQ ID NO: 6169322 - DNA, 14 bp, Homo sapiens
ctgccagtgcagcc

SEQ ID NO: 6169323 - DNA, 18 bp, Homo sapiens
ctgccagtgcagccactg

SEQ ID NO: 6169324 - DNA, 12 bp, Homo sapiens
ctgccagtgcca

SEQ ID NO: 6169325 - DNA, 15 bp, Homo sapiens
ctgccagtgccaggg

SEQ ID NO: 6169326 - DNA, 17 bp, Homo sapiens
ctgccagtgccagggtg

SEQ ID NO: 6169327 - DNA, 12 bp, Homo sapiens
ctgccagtgcct

SEQ ID NO: 6169328 - DNA, 16 bp, Homo sapiens
ctgccagtgcctgggt

SEQ ID NO: 6169329 - DNA, 18 bp, Homo sapiens
ctgccagtgccttacctc

SEQ ID NO: 6169330 - DNA, 22 bp, Homo sapiens
ctgccagtgccttacctcctgc

SEQ ID NO: 6169331 - DNA, 21 bp, Homo sapiens
ctgccagtggggaaggaggcc

SEQ ID NO: 6169332 - DNA, 20 bp, Homo sapiens
ctgccagtggggcctgaggc

SEQ ID NO: 6169333 - DNA, 23 bp, Homo sapiens
ctgccagtgtttagaagagcctg

SEQ ID NO: 6169334 - DNA, 16 bp, Homo sapiens
ctgccagttccctccc

SEQ ID NO: 6169335 - DNA, 13 bp, Homo sapiens
ctgccagttgaag

SEQ ID NO: 6169336 - DNA, 12 bp, Homo sapiens
ctgccagttttg

SEQ ID NO: 6169337 - DNA, 22 bp, Homo sapiens
ctgccataaaacattaagaaaa

SEQ ID NO: 6169338 - DNA, 19 bp, Homo sapiens
ctgccataaatatttctca

SEQ ID NO: 6169339 - DNA, 21 bp, Homo sapiens
ctgccataacttgtttgtaaa

SEQ ID NO: 6169340 - DNA, 15 bp, Homo sapiens
ctgccatacataata

SEQ ID NO: 6169341 - DNA, 15 bp, Homo sapiens
ctgccataccgctgg

SEQ ID NO: 6169342 - DNA, 18 bp, Homo sapiens
ctgccataccgctgggga

SEQ ID NO: 6169343 - DNA, 19 bp, Homo sapiens
ctgccataccgctggggaa

SEQ ID NO: 6169344 - DNA, 18 bp, Homo sapiens
ctgccatagccaggagcg

SEQ ID NO: 6169345 - DNA, 17 bp, Homo sapiens
ctgccatatataacaga

SEQ ID NO: 6169346 - DNA, 14 bp, Homo sapiens
ctgccatatcacca

SEQ ID NO: 6169347 - DNA, 16 bp, Homo sapiens
ctgccatattctgttg

SEQ ID NO: 6169348 - DNA, 16 bp, Homo sapiens
ctgccatattgtgtaa

SEQ ID NO: 6169349 - DNA, 17 bp, Homo sapiens
ctgccatattgtgtaat

SEQ ID NO: 6169350 - DNA, 17 bp, Homo sapiens
ctgccatatttttctgt

SEQ ID NO: 6169351 - DNA, 17 bp, Homo sapiens
ctgccatcaccgctggg

SEQ ID NO: 6169352 - DNA, 14 bp, Homo sapiens
ctgccatcacctgc

SEQ ID NO: 6169353 - DNA, 24 bp, Homo sapiens
ctgccatcagcccctgctgctcct

SEQ ID NO: 6169354 - DNA, 16 bp, Homo sapiens
ctgccatccccctctc

SEQ ID NO: 6169355 - DNA, 15 bp, Homo sapiens
ctgccatcctcccaa

SEQ ID NO: 6169356 - DNA, 13 bp, Homo sapiens
ctgccatcctggc

SEQ ID NO: 6169357 - DNA, 19 bp, Homo sapiens
ctgccatcctggcccaggg

SEQ ID NO: 6169358 - DNA, 23 bp, Homo sapiens
ctgccatcctggcccagggcatc

SEQ ID NO: 6169359 - DNA, 19 bp, Homo sapiens
ctgccatcggacaggagga

SEQ ID NO: 6169360 - DNA, 20 bp, Homo sapiens
ctgccatctagccagcccct

SEQ ID NO: 6169361 - DNA, 20 bp, Homo sapiens
ctgccatctcacctcctgct

SEQ ID NO: 6169362 - DNA, 23 bp, Homo sapiens
ctgccatctcacctcctgctggg

SEQ ID NO: 6169363 - DNA, 15 bp, Homo sapiens
ctgccatcttcccag

SEQ ID NO: 6169364 - DNA, 17 bp, Homo sapiens
ctgccatcttctccccg

SEQ ID NO: 6169365 - DNA, 16 bp, Homo sapiens
ctgccatgacagaggc

SEQ ID NO: 6169366 - DNA, 17 bp, Homo sapiens
ctgccatgacagaggct

SEQ ID NO: 6169367 - DNA, 21 bp, Homo sapiens
ctgccatgatagctggggctt

SEQ ID NO: 6169368 - DNA, 23 bp, Homo sapiens
ctgccatgatagctggggcttca

SEQ ID NO: 6169369 - DNA, 19 bp, Homo sapiens
ctgccatgattttggccac

SEQ ID NO: 6169370 - DNA, 15 bp, Homo sapiens
ctgccatgcagggcc

SEQ ID NO: 6169371 - DNA, 17 bp, Homo sapiens
ctgccatgcagggcctc

SEQ ID NO: 6169372 - DNA, 13 bp, Homo sapiens
ctgccatgccact

SEQ ID NO: 6169373 - DNA, 14 bp, Homo sapiens
ctgccatgccactg

SEQ ID NO: 6169374 - DNA, 17 bp, Homo sapiens
ctgccatgccactgcca

SEQ ID NO: 6169375 - DNA, 20 bp, Homo sapiens
ctgccatgccactgccaggc

SEQ ID NO: 6169376 - DNA, 15 bp, Homo sapiens
ctgccatgccagctt

SEQ ID NO: 6169377 - DNA, 16 bp, Homo sapiens
ctgccatgccaggaac

SEQ ID NO: 6169378 - DNA, 22 bp, Homo sapiens
ctgccatgccaggaacctgtcc

SEQ ID NO: 6169379 - DNA, 23 bp, Homo sapiens
ctgccatgccagtaactgtgctg

SEQ ID NO: 6169380 - DNA, 14 bp, Homo sapiens
ctgccatgctttga

SEQ ID NO: 6169381 - DNA, 18 bp, Homo sapiens
ctgccatggaactgtttc

SEQ ID NO: 6169382 - DNA, 20 bp, Homo sapiens
ctgccatggaattccctcct

SEQ ID NO: 6169383 - DNA, 22 bp, Homo sapiens
ctgccatggaattccctcctga

SEQ ID NO: 6169384 - DNA, 22 bp, Homo sapiens
ctgccatggacatgagtttaaa

SEQ ID NO: 6169385 - DNA, 23 bp, Homo sapiens
ctgccatggaggcacacagctgc

SEQ ID NO: 6169386 - DNA, 13 bp, Homo sapiens
ctgccatggctgt

SEQ ID NO: 6169387 - DNA, 11 bp, Homo sapiens
ctgccatggga

SEQ ID NO: 6169388 - DNA, 20 bp, Homo sapiens
ctgccatgggagagtccagg

SEQ ID NO: 6169389 - DNA, 17 bp, Homo sapiens
ctgccatgggccagcct

SEQ ID NO: 6169390 - DNA, 19 bp, Homo sapiens
ctgccatgtactagtttta

SEQ ID NO: 6169391 - DNA, 16 bp, Homo sapiens
ctgccatgtccatagc

SEQ ID NO: 6169392 - DNA, 22 bp, Homo sapiens
ctgccatgtccatagccataat

SEQ ID NO: 6169393 - DNA, 16 bp, Homo sapiens
cttcaaagcttaaaaa

SEQ ID NO: 6169394 - DNA, 18 bp, Homo sapiens
cttcaaagcttgaagatc

SEQ ID NO: 6169395 - DNA, 13 bp, Homo sapiens
cttcaaagtctca

SEQ ID NO: 6169396 - DNA, 21 bp, Homo sapiens
cttcaaagtgtgtctgggatt

SEQ ID NO: 6169397 - DNA, 22 bp, Homo sapiens
cttcaaagtgtgtctgggattt

SEQ ID NO: 6169398 - DNA, 15 bp, Homo sapiens
cttcaaataaagaaa

SEQ ID NO: 6169399 - DNA, 17 bp, Homo sapiens
cttcaaatacaaagtaa

SEQ ID NO: 6169400 - DNA, 18 bp, Homo sapiens
cttcaaatagtatagaaa

SEQ ID NO: 6169401 - DNA, 23 bp, Homo sapiens
cttcaaatagtatagaaaatgga

SEQ ID NO: 6169402 - DNA, 16 bp, Homo sapiens
cttcaaatccttccaa

SEQ ID NO: 6169403 - DNA, 17 bp, Homo sapiens
cttcaaatccttgaaga

SEQ ID NO: 6169404 - DNA, 15 bp, Homo sapiens
cttcaaatctcagca

SEQ ID NO: 6169405 - DNA, 14 bp, Homo sapiens
cttcaaatgcaaat

SEQ ID NO: 6169406 - DNA, 16 bp, Homo sapiens
cttcaaatgcctgact

SEQ ID NO: 6169407 - DNA, 17 bp, Homo sapiens
cttcaaatgcgaacact

SEQ ID NO: 6169408 - DNA, 16 bp, Homo sapiens
cttcaaatgtcatttc

SEQ ID NO: 6169409 - DNA, 17 bp, Homo sapiens
cttcaaatgtgtaactt

SEQ ID NO: 6169410 - DNA, 19 bp, Homo sapiens
cttcaaatgtgtaacttta

SEQ ID NO: 6169411 - DNA, 13 bp, Homo sapiens
cttcaaatgttta

SEQ ID NO: 6169412 - DNA, 18 bp, Homo sapiens
cttcaaattaaaacagct

SEQ ID NO: 6169413 - DNA, 17 bp, Homo sapiens
cttcaaattgtcttttg

SEQ ID NO: 6169414 - DNA, 12 bp, Homo sapiens
cttcaaatttga

SEQ ID NO: 6169415 - DNA, 22 bp, Homo sapiens
cttcaacaacgtgagagaaaga

SEQ ID NO: 6169416 - DNA, 18 bp, Homo sapiens
cttcaacaactttgtgct

SEQ ID NO: 6169417 - DNA, 12 bp, Homo sapiens
cttcaacaaggc

SEQ ID NO: 6169418 - DNA, 21 bp, Homo sapiens
cttcaacaaggcttgctgcag

SEQ ID NO: 6169419 - DNA, 21 bp, Homo sapiens
cttcaacacagcttgtctctt

SEQ ID NO: 6169420 - DNA, 16 bp, Homo sapiens
cttcaacagctcccca

SEQ ID NO: 6169421 - DNA, 23 bp, Homo sapiens
cttcaacataacccacttgtcac

SEQ ID NO: 6169422 - DNA, 22 bp, Homo sapiens
cttcaacatcaatgttcattgt

SEQ ID NO: 6169423 - DNA, 18 bp, Homo sapiens
cttcaacatcctgccagc

SEQ ID NO: 6169424 - DNA, 20 bp, Homo sapiens
cttcaacatcctgccagccc

SEQ ID NO: 6169425 - DNA, 15 bp, Homo sapiens
cttcaacatgctcca

SEQ ID NO: 6169426 - DNA, 20 bp, Homo sapiens
cttcaaccattccccatggg

SEQ ID NO: 6169427 - DNA, 17 bp, Homo sapiens
cttcaaccccacttcct

SEQ ID NO: 6169428 - DNA, 13 bp, Homo sapiens
cttcaaccctcag

SEQ ID NO: 6169429 - DNA, 19 bp, Homo sapiens
cttcaaccctcagccttga

SEQ ID NO: 6169430 - DNA, 15 bp, Homo sapiens
cttcaaccctgccct

SEQ ID NO: 6169431 - DNA, 17 bp, Homo sapiens
cttcaaccttaaggact

SEQ ID NO: 6169432 - DNA, 16 bp, Homo sapiens
cttcaactccctgccc

SEQ ID NO: 6169433 - DNA, 14 bp, Homo sapiens
cttcaactcctggc

SEQ ID NO: 6169434 - DNA, 16 bp, Homo sapiens
cttcaactcctggctc

SEQ ID NO: 6169435 - DNA, 13 bp, Homo sapiens
cttcaactctgtg

SEQ ID NO: 6169436 - DNA, 16 bp, Homo sapiens
cttcaactctgtgagg

SEQ ID NO: 6169437 - DNA, 17 bp, Homo sapiens
cttcaactctgtgaggt

SEQ ID NO: 6169438 - DNA, 15 bp, Homo sapiens
cttcaactgcccagc

SEQ ID NO: 6169439 - DNA, 18 bp, Homo sapiens
cttcaacttttctcttta

SEQ ID NO: 6169440 - DNA, 18 bp, Homo sapiens
cttcaagaaaacaggcac

SEQ ID NO: 6169441 - DNA, 20 bp, Homo sapiens
cttcaagaaacagcgagagg

SEQ ID NO: 6169442 - DNA, 18 bp, Homo sapiens
cttcaagaatcagaagaa

SEQ ID NO: 6169443 - DNA, 22 bp, Homo sapiens
cttcaagaatcagaagaaaggc

SEQ ID NO: 6169444 - DNA, 18 bp, Homo sapiens
cttcaagatcccatttga

SEQ ID NO: 6169445 - DNA, 22 bp, Homo sapiens
cttcaagatgagcctgggctca

SEQ ID NO: 6169446 - DNA, 16 bp, Homo sapiens
cttcaagatgcctctt

SEQ ID NO: 6169447 - DNA, 17 bp, Homo sapiens
cttcaagattccatttc

SEQ ID NO: 6169448 - DNA, 22 bp, Homo sapiens
cttcaagcaaagacagtttctt

SEQ ID NO: 6169449 - DNA, 18 bp, Homo sapiens
cttcaagcaccagggaag

SEQ ID NO: 6169450 - DNA, 18 bp, Homo sapiens
cttcaagcaccctgttcc

SEQ ID NO: 6169451 - DNA, 20 bp, Homo sapiens
cttcaagcaccctgttccct

SEQ ID NO: 6169452 - DNA, 22 bp, Homo sapiens
cttcaagcatggctattttata

SEQ ID NO: 6169453 - DNA, 17 bp, Homo sapiens
cttcaagccagctctag

SEQ ID NO: 6169454 - DNA, 12 bp, Homo sapiens
cttcaagcctgg

SEQ ID NO: 6169455 - DNA, 15 bp, Homo sapiens
cttcaagcctggccc

SEQ ID NO: 6169456 - DNA, 17 bp, Homo sapiens
cttcaagcctggcccag

SEQ ID NO: 6169457 - DNA, 18 bp, Homo sapiens
cttcaagcctggcccagt

SEQ ID NO: 6169458 - DNA, 21 bp, Homo sapiens
cttcaagctcaccctgctcct

SEQ ID NO: 6169459 - DNA, 15 bp, Homo sapiens
cttcaagctctctgt

SEQ ID NO: 6169460 - DNA, 12 bp, Homo sapiens
cttcaagctctg

SEQ ID NO: 6169461 - DNA, 13 bp, Homo sapiens
cttcaagctctga

SEQ ID NO: 6169462 - DNA, 18 bp, Homo sapiens
cttcaagctctgagggaa

SEQ ID NO: 6169463 - DNA, 14 bp, Homo sapiens
cttcaagctgtccc

SEQ ID NO: 6169464 - DNA, 15 bp, Homo sapiens
cttcaagctgtcccc

SEQ ID NO: 6169465 - DNA, 17 bp, Homo sapiens
cttcaaggaaaataagt

SEQ ID NO: 6169466 - DNA, 19 bp, Homo sapiens
cttcaaggaaaataagtga

SEQ ID NO: 6169467 - DNA, 18 bp, Homo sapiens
cttcaaggactgtttcag

SEQ ID NO: 6169468 - DNA, 20 bp, Homo sapiens
cttcaaggactgtttcagtg

SEQ ID NO: 6169469 - DNA, 23 bp, Homo sapiens
cttcaaggactgtttcagtgtga

SEQ ID NO: 6169470 - DNA, 10 bp, Homo sapiens
cttcaaggat

SEQ ID NO: 6169471 - DNA, 20 bp, Homo sapiens
cttcaaggatatactgcagc

SEQ ID NO: 6169472 - DNA, 22 bp, Homo sapiens
cttcaaggatatactgcagctt

SEQ ID NO: 6169473 - DNA, 19 bp, Homo sapiens
cttcaaggatcctgagcca

SEQ ID NO: 6169474 - DNA, 20 bp, Homo sapiens
cttcaaggatcctgagccag

SEQ ID NO: 6169475 - DNA, 19 bp, Homo sapiens
cttcaaggccctcagagat

SEQ ID NO: 6169476 - DNA, 16 bp, Homo sapiens
cttcaaggctcttctt

SEQ ID NO: 6169477 - DNA, 14 bp, Homo sapiens
cttcaaggcttcag

SEQ ID NO: 6169478 - DNA, 16 bp, Homo sapiens
cttcaaggcttccact

SEQ ID NO: 6169479 - DNA, 20 bp, Homo sapiens
cttcaaggtggcagctgtta

SEQ ID NO: 6169480 - DNA, 13 bp, Homo sapiens
cttcaagtataat

SEQ ID NO: 6169481 - DNA, 22 bp, Homo sapiens
cttcaagtctgtgcctggagct

SEQ ID NO: 6169482 - DNA, 23 bp, Homo sapiens
cttcaagtctgtgcctggagctc

SEQ ID NO: 6169483 - DNA, 18 bp, Homo sapiens
cttcaagtgagtggcatg

SEQ ID NO: 6169484 - DNA, 20 bp, Homo sapiens
cttcaagtgagtggcatgtg

SEQ ID NO: 6169485 - DNA, 17 bp, Homo sapiens
cttcaagtgatatatgt

SEQ ID NO: 6169486 - DNA, 20 bp, Homo sapiens
cttcaagtgatatatgtatt

SEQ ID NO: 6169487 - DNA, 23 bp, Homo sapiens
cttcaagtgatatatgtatttat

SEQ ID NO: 6169488 - DNA, 15 bp, Homo sapiens
cttcaagtgccaaac

SEQ ID NO: 6169489 - DNA, 13 bp, Homo sapiens
cttcaagtgcctt

SEQ ID NO: 6169490 - DNA, 14 bp, Homo sapiens
cttcaagtgccttt

SEQ ID NO: 6169491 - DNA, 15 bp, Homo sapiens
cttcaagtgcctttt

SEQ ID NO: 6169492 - DNA, 17 bp, Homo sapiens
cttcaagttagctcagg

SEQ ID NO: 6169493 - DNA, 22 bp, Homo sapiens
cttcaataaagcctgacttcac

SEQ ID NO: 6169494 - DNA, 20 bp, Homo sapiens
cttcaataaatctttggaaa

SEQ ID NO: 6169495 - DNA, 16 bp, Homo sapiens
cttcaatataagaagc

SEQ ID NO: 6169496 - DNA, 17 bp, Homo sapiens
cttcaatataagaagca

SEQ ID NO: 6169497 - DNA, 19 bp, Homo sapiens
cttcaatcaacatctcttg

SEQ ID NO: 6169498 - DNA, 20 bp, Homo sapiens
cttcaatcactgtaacctga

SEQ ID NO: 6169499 - DNA, 17 bp, Homo sapiens
cttcaatcggcttgtgg

SEQ ID NO: 6169500 - DNA, 22 bp, Homo sapiens
cttcaatctcgtttagtgccaa

SEQ ID NO: 6169501 - DNA, 14 bp, Homo sapiens
cttcaatctctgtt

SEQ ID NO: 6169502 - DNA, 17 bp, Homo sapiens
cttcaatctctgttctg

SEQ ID NO: 6169503 - DNA, 20 bp, Homo sapiens
cttcaatgatcaaattttga

SEQ ID NO: 6169504 - DNA, 14 bp, Homo sapiens
cttcaatgctgcag

SEQ ID NO: 6169505 - DNA, 15 bp, Homo sapiens
cttcaatgctgcagg

SEQ ID NO: 6169506 - DNA, 16 bp, Homo sapiens
cttcaatggcaccttc

SEQ ID NO: 6169507 - DNA, 18 bp, Homo sapiens
cttcaatgggctcttcca

SEQ ID NO: 6169508 - DNA, 18 bp, Homo sapiens
cttcaatgtgcataatga

SEQ ID NO: 6169509 - DNA, 17 bp, Homo sapiens
cttcaatgttaaatcta

SEQ ID NO: 6169510 - DNA, 13 bp, Homo sapiens
cttcaattaaaat

SEQ ID NO: 6169511 - DNA, 15 bp, Homo sapiens
cttcaattaataaaa

SEQ ID NO: 6169512 - DNA, 14 bp, Homo sapiens
cttcaattaatgga

SEQ ID NO: 6169513 - DNA, 15 bp, Homo sapiens
cttcaattaatggaa

SEQ ID NO: 6169514 - DNA, 21 bp, Homo sapiens
cttcaattaatggaaaactgt

SEQ ID NO: 6169515 - DNA, 15 bp, Homo sapiens
cttcaatttatacct

SEQ ID NO: 6169516 - DNA, 21 bp, Homo sapiens
cttcaatttatacctcaattt

SEQ ID NO: 6169517 - DNA, 18 bp, Homo sapiens
cttcaatttattgcacaa

SEQ ID NO: 6169518 - DNA, 13 bp, Homo sapiens
cttcaatttcaaa

SEQ ID NO: 6169519 - DNA, 16 bp, Homo sapiens
cttcaatttcaaactt

SEQ ID NO: 6169520 - DNA, 23 bp, Homo sapiens
cttcaatttcccacccatctcca

SEQ ID NO: 6169521 - DNA, 10 bp, Homo sapiens
cttcaatttg

SEQ ID NO: 6169522 - DNA, 19 bp, Homo sapiens
cttcaatttgttaacagag

SEQ ID NO: 6169523 - DNA, 14 bp, Homo sapiens
cttcacaaaatgca

SEQ ID NO: 6169524 - DNA, 18 bp, Homo sapiens
cttcacaaagccaagcct

SEQ ID NO: 6169525 - DNA, 19 bp, Homo sapiens
cttcacaacctccgtgctg

SEQ ID NO: 6169526 - DNA, 21 bp, Homo sapiens
cttcacaatctgtcagttcta

SEQ ID NO: 6169527 - DNA, 16 bp, Homo sapiens
cttcacaatttcaatg

SEQ ID NO: 6169528 - DNA, 13 bp, Homo sapiens
cttcacacaaagt

SEQ ID NO: 6169529 - DNA, 18 bp, Homo sapiens
cttcacacaaagtgaaat

SEQ ID NO: 6169530 - DNA, 14 bp, Homo sapiens
cttcacacagacac

SEQ ID NO: 6169531 - DNA, 19 bp, Homo sapiens
cttcacacagacccctcgc

SEQ ID NO: 6169532 - DNA, 18 bp, Homo sapiens
cttcacaccccaggccct

SEQ ID NO: 6169533 - DNA, 18 bp, Homo sapiens
cttcacactgcaagagcc

SEQ ID NO: 6169534 - DNA, 23 bp, Homo sapiens
cttcacagatgcctacttttggc

SEQ ID NO: 6169535 - DNA, 14 bp, Homo sapiens
cttcacagccacac

SEQ ID NO: 6169536 - DNA, 15 bp, Homo sapiens
cttcacaggttttat

SEQ ID NO: 6169537 - DNA, 15 bp, Homo sapiens
cttcacagtagagcc

SEQ ID NO: 6169538 - DNA, 21 bp, Homo sapiens
cttcacagtctggtgcttggg

SEQ ID NO: 6169539 - DNA, 22 bp, Homo sapiens
cttcacagtgacactggaccag

SEQ ID NO: 6169540 - DNA, 17 bp, Homo sapiens
cttcacataccctcccc

SEQ ID NO: 6169541 - DNA, 22 bp, Homo sapiens
cttcacataggaagggatctga

SEQ ID NO: 6169542 - DNA, 13 bp, Homo sapiens
cttcacatagttt

SEQ ID NO: 6169543 - DNA, 17 bp, Homo sapiens
cttcacatccaccccgg

SEQ ID NO: 6169544 - DNA, 17 bp, Homo sapiens
cttcacatccattgtct

SEQ ID NO: 6169545 - DNA, 22 bp, Homo sapiens
cttcacatccattgtctcttca

SEQ ID NO: 6169546 - DNA, 17 bp, Homo sapiens
cttcacatcccattggg

SEQ ID NO: 6169547 - DNA, 14 bp, Homo sapiens
cttcacattaaaaa

SEQ ID NO: 6169548 - DNA, 22 bp, Homo sapiens
cttcacattcccctggggaccc

SEQ ID NO: 6169549 - DNA, 21 bp, Homo sapiens
cttcaccaaagatctgctcct

SEQ ID NO: 6169550 - DNA, 13 bp, Homo sapiens
cttcaccaagctt

SEQ ID NO: 6169551 - DNA, 13 bp, Homo sapiens
cttcaccaccccc

SEQ ID NO: 6169552 - DNA, 14 bp, Homo sapiens
cttcaccaccccct

SEQ ID NO: 6169553 - DNA, 20 bp, Homo sapiens
cttcaccaccccctgtccca

SEQ ID NO: 6169554 - DNA, 14 bp, Homo sapiens
cttcaccagagccc

SEQ ID NO: 6169555 - DNA, 22 bp, Homo sapiens
cttcaccagaggaatcactctt

SEQ ID NO: 6169556 - DNA, 15 bp, Homo sapiens
cttcaccaggaagaa

SEQ ID NO: 6169557 - DNA, 22 bp, Homo sapiens
cttcaccaggaagaaggcccgg

SEQ ID NO: 6169558 - DNA, 18 bp, Homo sapiens
cttcaccaggtgcatgca

SEQ ID NO: 6169559 - DNA, 21 bp, Homo sapiens
cttcaccaggtgcatgcatgc

SEQ ID NO: 6169560 - DNA, 16 bp, Homo sapiens
cttcaccatcaatcct

SEQ ID NO: 6169561 - DNA, 18 bp, Homo sapiens
cttcaccatctacctgct

SEQ ID NO: 6169562 - DNA, 18 bp, Homo sapiens
cttcaccatggatcctgg

SEQ ID NO: 6169563 - DNA, 19 bp, Homo sapiens
cttcaccatggatcctgga

SEQ ID NO: 6169564 - DNA, 19 bp, Homo sapiens
cttcaccatggccttatga

SEQ ID NO: 6169565 - DNA, 17 bp, Homo sapiens
cttcacccaccaggcca

SEQ ID NO: 6169566 - DNA, 21 bp, Homo sapiens
cttcacccaccaggccagctc

SEQ ID NO: 6169567 - DNA, 13 bp, Homo sapiens
cttcacccagagc

SEQ ID NO: 6169568 - DNA, 21 bp, Homo sapiens
cttcacccagagctgcctatg

SEQ ID NO: 6169569 - DNA, 17 bp, Homo sapiens
cttcacccaggcctatg

SEQ ID NO: 6169570 - DNA, 17 bp, Homo sapiens
cttcaccccggcaggcc

SEQ ID NO: 6169571 - DNA, 15 bp, Homo sapiens
ctgccatgtggcaga

SEQ ID NO: 6169572 - DNA, 15 bp, Homo sapiens
ctgccattaaagaat

SEQ ID NO: 6169573 - DNA, 23 bp, Homo sapiens
ctgccattaaatccgcaaacagc

SEQ ID NO: 6169574 - DNA, 17 bp, Homo sapiens
ctgccattacccagtgc

SEQ ID NO: 6169575 - DNA, 19 bp, Homo sapiens
ctgccattattttctgtca

SEQ ID NO: 6169576 - DNA, 21 bp, Homo sapiens
ctgccattattttctgtcaga

SEQ ID NO: 6169577 - DNA, 22 bp, Homo sapiens
ctgccattattttctgtcagat

SEQ ID NO: 6169578 - DNA, 16 bp, Homo sapiens
ctgccattctgtgcag

SEQ ID NO: 6169579 - DNA, 15 bp, Homo sapiens
ctgccattcttctgg

SEQ ID NO: 6169580 - DNA, 22 bp, Homo sapiens
ctgccattggcctcttgtccct

SEQ ID NO: 6169581 - DNA, 20 bp, Homo sapiens
ctgccattggtccacccttt

SEQ ID NO: 6169582 - DNA, 16 bp, Homo sapiens
ctgccatttatttcct

SEQ ID NO: 6169583 - DNA, 20 bp, Homo sapiens
ctgccatttgcaccctccgc

SEQ ID NO: 6169584 - DNA, 19 bp, Homo sapiens
ctgccattttttgtctgtg

SEQ ID NO: 6169585 - DNA, 14 bp, Homo sapiens
ctgcccaaaatgtg

SEQ ID NO: 6169586 - DNA, 18 bp, Homo sapiens
ctgcccaaaatgtgaagc

SEQ ID NO: 6169587 - DNA, 23 bp, Homo sapiens
ctgcccaaacagctgtatttata

SEQ ID NO: 6169588 - DNA, 20 bp, Homo sapiens
ctgcccaaacccttaactga

SEQ ID NO: 6169589 - DNA, 23 bp, Homo sapiens
ctgcccaaagcagcacttataaa

SEQ ID NO: 6169590 - DNA, 18 bp, Homo sapiens
ctgcccaaagccatcttc

SEQ ID NO: 6169591 - DNA, 16 bp, Homo sapiens
ctgcccaacctctgtg

SEQ ID NO: 6169592 - DNA, 14 bp, Homo sapiens
ctgcccaactgtgt

SEQ ID NO: 6169593 - DNA, 21 bp, Homo sapiens
ctgcccaagcagcctggagac

SEQ ID NO: 6169594 - DNA, 18 bp, Homo sapiens
ctgcccaagcccaggcca

SEQ ID NO: 6169595 - DNA, 20 bp, Homo sapiens
ctgcccaaggcctaccccag

SEQ ID NO: 6169596 - DNA, 19 bp, Homo sapiens
ctgcccaagggcctcccac

SEQ ID NO: 6169597 - DNA, 18 bp, Homo sapiens
ctgcccaagtgaccaggg

SEQ ID NO: 6169598 - DNA, 16 bp, Homo sapiens
ctgcccaagttgctct

SEQ ID NO: 6169599 - DNA, 21 bp, Homo sapiens
ctgcccaatatgcagttctgc

SEQ ID NO: 6169600 - DNA, 16 bp, Homo sapiens
ctgcccaatcctccct

SEQ ID NO: 6169601 - DNA, 22 bp, Homo sapiens
ctgcccaatcctccctggagaa

SEQ ID NO: 6169602 - DNA, 20 bp, Homo sapiens
ctgcccacaacgtcccctca

SEQ ID NO: 6169603 - DNA, 22 bp, Homo sapiens
ctgcccacaagccataaaccaa

SEQ ID NO: 6169604 - DNA, 20 bp, Homo sapiens
ctgcccacacctcctggggc

SEQ ID NO: 6169605 - DNA, 19 bp, Homo sapiens
ctgcccacatgggacctgg

SEQ ID NO: 6169606 - DNA, 16 bp, Homo sapiens
ctgcccacatttgggc

SEQ ID NO: 6169607 - DNA, 17 bp, Homo sapiens
ctgcccacatttgggct

SEQ ID NO: 6169608 - DNA, 22 bp, Homo sapiens
ctgcccacatttgggctcaggg

SEQ ID NO: 6169609 - DNA, 12 bp, Homo sapiens
ctgcccaccatt

SEQ ID NO: 6169610 - DNA, 17 bp, Homo sapiens
ctgcccaccccatccct

SEQ ID NO: 6169611 - DNA, 13 bp, Homo sapiens
ctgcccacccccg

SEQ ID NO: 6169612 - DNA, 15 bp, Homo sapiens
ctgcccacccccggg

SEQ ID NO: 6169613 - DNA, 21 bp, Homo sapiens
ctgcccacccccgggatcctg

SEQ ID NO: 6169614 - DNA, 21 bp, Homo sapiens
ctgcccaccccctgctggtgc

SEQ ID NO: 6169615 - DNA, 12 bp, Homo sapiens
ctgcccaccccg

SEQ ID NO: 6169616 - DNA, 20 bp, Homo sapiens
ctgcccaccccgcctctggg

SEQ ID NO: 6169617 - DNA, 23 bp, Homo sapiens
ctgcccaccccgcctctgggctc

SEQ ID NO: 6169618 - DNA, 19 bp, Homo sapiens
ctgcccaccctaccagctc

SEQ ID NO: 6169619 - DNA, 12 bp, Homo sapiens
ctgcccaccctc

SEQ ID NO: 6169620 - DNA, 13 bp, Homo sapiens
ctgcccaccctgg

SEQ ID NO: 6169621 - DNA, 15 bp, Homo sapiens
ctgcccaccctgggc

SEQ ID NO: 6169622 - DNA, 17 bp, Homo sapiens
ctgcccaccctgggcct

SEQ ID NO: 6169623 - DNA, 22 bp, Homo sapiens
ctgcccaccgaccccctttcta

SEQ ID NO: 6169624 - DNA, 22 bp, Homo sapiens
ctgcccacctcagcctcccaaa

SEQ ID NO: 6169625 - DNA, 15 bp, Homo sapiens
ctgcccacctccttc

SEQ ID NO: 6169626 - DNA, 19 bp, Homo sapiens
ctgcccacctcggcctccc

SEQ ID NO: 6169627 - DNA, 12 bp, Homo sapiens
ctgcccacctct

SEQ ID NO: 6169628 - DNA, 14 bp, Homo sapiens
ctgcccacctctcc

SEQ ID NO: 6169629 - DNA, 19 bp, Homo sapiens
ctgcccacctctccctgca

SEQ ID NO: 6169630 - DNA, 20 bp, Homo sapiens
ctgcccacctctccctgcat

SEQ ID NO: 6169631 - DNA, 14 bp, Homo sapiens
ctgcccacctctct

SEQ ID NO: 6169632 - DNA, 14 bp, Homo sapiens
ctgcccacctgcca

SEQ ID NO: 6169633 - DNA, 15 bp, Homo sapiens
ctgcccacctgccag

SEQ ID NO: 6169634 - DNA, 15 bp, Homo sapiens
ctgcccacctgccgg

SEQ ID NO: 6169635 - DNA, 14 bp, Homo sapiens
ctgcccacctgcct

SEQ ID NO: 6169636 - DNA, 17 bp, Homo sapiens
ctgcccacctgcctggc

SEQ ID NO: 6169637 - DNA, 21 bp, Homo sapiens
ctgcccacctgcctggccggc

SEQ ID NO: 6169638 - DNA, 13 bp, Homo sapiens
ctgcccacctggc

SEQ ID NO: 6169639 - DNA, 18 bp, Homo sapiens
ctgcccacctggctgcca

SEQ ID NO: 6169640 - DNA, 22 bp, Homo sapiens
ctgcccacctggggtctctctc

SEQ ID NO: 6169641 - DNA, 12 bp, Homo sapiens
ctgcccacctgt

SEQ ID NO: 6169642 - DNA, 20 bp, Homo sapiens
ctgcccacgcagaggacgca

SEQ ID NO: 6169643 - DNA, 12 bp, Homo sapiens
ctgcccacgccc

SEQ ID NO: 6169644 - DNA, 15 bp, Homo sapiens
ctgcccacgcccttg

SEQ ID NO: 6169645 - DNA, 22 bp, Homo sapiens
ctgcccacgcccttggagcctt

SEQ ID NO: 6169646 - DNA, 19 bp, Homo sapiens
ctgcccacgctcctgccct

SEQ ID NO: 6169647 - DNA, 16 bp, Homo sapiens
ctgcccacggccaccc

SEQ ID NO: 6169648 - DNA, 18 bp, Homo sapiens
ctgcccacggccacccac

SEQ ID NO: 6169649 - DNA, 19 bp, Homo sapiens
ctgcccacgtgcagcacct

SEQ ID NO: 6169650 - DNA, 17 bp, Homo sapiens
ctgcccactacctatgc

SEQ ID NO: 6169651 - DNA, 14 bp, Homo sapiens
ctgcccactcccat

SEQ ID NO: 6169652 - DNA, 18 bp, Homo sapiens
ctgcccactccctgcaac

SEQ ID NO: 6169653 - DNA, 22 bp, Homo sapiens
ctgcccactctgaccgggcttc

SEQ ID NO: 6169654 - DNA, 15 bp, Homo sapiens
ctgcccactctgcaa

SEQ ID NO: 6169655 - DNA, 20 bp, Homo sapiens
ctgcccactctgcaagaaga

SEQ ID NO: 6169656 - DNA, 21 bp, Homo sapiens
ctgcccactctgcaagaagaa

SEQ ID NO: 6169657 - DNA, 14 bp, Homo sapiens
ctgcccactctggg

SEQ ID NO: 6169658 - DNA, 15 bp, Homo sapiens
ctgcccactctgggg

SEQ ID NO: 6169659 - DNA, 13 bp, Homo sapiens
ctgcccactgtga

SEQ ID NO: 6169660 - DNA, 24 bp, Homo sapiens
ctgcccacttagccgtccatggca

SEQ ID NO: 6169661 - DNA, 18 bp, Homo sapiens
ctgcccacttcagcccag

SEQ ID NO: 6169662 - DNA, 16 bp, Homo sapiens
ctgcccacttgctccc

SEQ ID NO: 6169663 - DNA, 22 bp, Homo sapiens
ctgcccagaaagtgggggtgga

SEQ ID NO: 6169664 - DNA, 20 bp, Homo sapiens
ctgcccagaattcccagctg

SEQ ID NO: 6169665 - DNA, 15 bp, Homo sapiens
ctgcccagactgatg

SEQ ID NO: 6169666 - DNA, 14 bp, Homo sapiens
ctgcccagagctga

SEQ ID NO: 6169667 - DNA, 17 bp, Homo sapiens
ctgcccagagctgctgg

SEQ ID NO: 6169668 - DNA, 18 bp, Homo sapiens
ctgcccagagctgggtga

SEQ ID NO: 6169669 - DNA, 18 bp, Homo sapiens
ctgcccagatcagccaga

SEQ ID NO: 6169670 - DNA, 22 bp, Homo sapiens
ctgcccagatcagccagaagcc

SEQ ID NO: 6169671 - DNA, 18 bp, Homo sapiens
ctgcccagatcccagaag

SEQ ID NO: 6169672 - DNA, 12 bp, Homo sapiens
ctgcccagcaac

SEQ ID NO: 6169673 - DNA, 18 bp, Homo sapiens
ctgcccagcaacatggag

SEQ ID NO: 6169674 - DNA, 16 bp, Homo sapiens
ctgcccagcacctcct

SEQ ID NO: 6169675 - DNA, 18 bp, Homo sapiens
ctgcccagcacctcctcc

SEQ ID NO: 6169676 - DNA, 20 bp, Homo sapiens
ctgcccagcagcccctgaga

SEQ ID NO: 6169677 - DNA, 22 bp, Homo sapiens
ctgcccagcagcccctgagagc

SEQ ID NO: 6169678 - DNA, 13 bp, Homo sapiens
ctgcccagcccat

SEQ ID NO: 6169679 - DNA, 23 bp, Homo sapiens
ctgcccagccccgctcaggccta

SEQ ID NO: 6169680 - DNA, 13 bp, Homo sapiens
ctgcccagcccct

SEQ ID NO: 6169681 - DNA, 18 bp, Homo sapiens
ctgcccagccccttttct

SEQ ID NO: 6169682 - DNA, 12 bp, Homo sapiens
ctgcccagccct

SEQ ID NO: 6169683 - DNA, 20 bp, Homo sapiens
ctgcccagccctcccagctg

SEQ ID NO: 6169684 - DNA, 16 bp, Homo sapiens
ctgcccagccgggcac

SEQ ID NO: 6169685 - DNA, 18 bp, Homo sapiens
ctgcccagcctgccccag

SEQ ID NO: 6169686 - DNA, 17 bp, Homo sapiens
ctgcccagcctgctcag

SEQ ID NO: 6169687 - DNA, 19 bp, Homo sapiens
ctgcccagcctgctcagca

SEQ ID NO: 6169688 - DNA, 13 bp, Homo sapiens
ctgcccagctccc

SEQ ID NO: 6169689 - DNA, 14 bp, Homo sapiens
ctgcccagctctga

SEQ ID NO: 6169690 - DNA, 20 bp, Homo sapiens
ctgcccagcttttcattgct

SEQ ID NO: 6169691 - DNA, 16 bp, Homo sapiens
ctgcccaggaactcgc

SEQ ID NO: 6169692 - DNA, 20 bp, Homo sapiens
ctgcccaggacggggccggc

SEQ ID NO: 6169693 - DNA, 11 bp, Homo sapiens
ctgcccaggag

SEQ ID NO: 6169694 - DNA, 12 bp, Homo sapiens
ctgcccaggaga

SEQ ID NO: 6169695 - DNA, 13 bp, Homo sapiens
ctgcccaggagac

SEQ ID NO: 6169696 - DNA, 21 bp, Homo sapiens
ctgcccaggagacagaccact

SEQ ID NO: 6169697 - DNA, 19 bp, Homo sapiens
ctgcccaggagagccagcc

SEQ ID NO: 6169698 - DNA, 17 bp, Homo sapiens
ctgcccaggagcagctt

SEQ ID NO: 6169699 - DNA, 15 bp, Homo sapiens
ctgcccaggcactgc

SEQ ID NO: 6169700 - DNA, 16 bp, Homo sapiens
ctgcccaggcactgca

SEQ ID NO: 6169701 - DNA, 16 bp, Homo sapiens
ctgcccaggccacaga

SEQ ID NO: 6169702 - DNA, 20 bp, Homo sapiens
ctgcccaggccacagagaac

SEQ ID NO: 6169703 - DNA, 18 bp, Homo sapiens
ctgcccaggccacagccg

SEQ ID NO: 6169704 - DNA, 14 bp, Homo sapiens
ctgcccaggcccct

SEQ ID NO: 6169705 - DNA, 18 bp, Homo sapiens
ctgcccaggcccctgcca

SEQ ID NO: 6169706 - DNA, 22 bp, Homo sapiens
ctgcccaggccggccagcctca

SEQ ID NO: 6169707 - DNA, 19 bp, Homo sapiens
ctgcccaggcctgcctgtt

SEQ ID NO: 6169708 - DNA, 13 bp, Homo sapiens
ctgcccaggctct

SEQ ID NO: 6169709 - DNA, 20 bp, Homo sapiens
ctgcccaggctctgctgact

SEQ ID NO: 6169710 - DNA, 15 bp, Homo sapiens
ctgcccagggaagcc

SEQ ID NO: 6169711 - DNA, 22 bp, Homo sapiens
ctgcccaggggacgtggcgctg

SEQ ID NO: 6169712 - DNA, 16 bp, Homo sapiens
ctgcccaggggagccc

SEQ ID NO: 6169713 - DNA, 13 bp, Homo sapiens
ctgcccaggggtg

SEQ ID NO: 6169714 - DNA, 15 bp, Homo sapiens
ctgcccaggggtgcc

SEQ ID NO: 6169715 - DNA, 17 bp, Homo sapiens
ctgcccaggggtgcccc

SEQ ID NO: 6169716 - DNA, 21 bp, Homo sapiens
ctgcccaggggtgccccctcc

SEQ ID NO: 6169717 - DNA, 19 bp, Homo sapiens
ctgcccaggtatcctgggg

SEQ ID NO: 6169718 - DNA, 16 bp, Homo sapiens
ctgcccaggtggcctc

SEQ ID NO: 6169719 - DNA, 18 bp, Homo sapiens
ctgcccaggtggcctcct

SEQ ID NO: 6169720 - DNA, 21 bp, Homo sapiens
ctgcccaggtggcctcctggc

SEQ ID NO: 6169721 - DNA, 18 bp, Homo sapiens
ctgcccagtcccccaacc

SEQ ID NO: 6169722 - DNA, 19 bp, Homo sapiens
ctgcccagtcccccaaccc

SEQ ID NO: 6169723 - DNA, 19 bp, Homo sapiens
ctgcccagtcgaccccaaa

SEQ ID NO: 6169724 - DNA, 16 bp, Homo sapiens
ctgcccagtgcacttg

SEQ ID NO: 6169725 - DNA, 21 bp, Homo sapiens
ctgcccagtgcacttgctgga

SEQ ID NO: 6169726 - DNA, 22 bp, Homo sapiens
ctgcccagtgttgtttgtaaat

SEQ ID NO: 6169727 - DNA, 23 bp, Homo sapiens
ctgcccagtgttgtttgtaaata

SEQ ID NO: 6169728 - DNA, 14 bp, Homo sapiens
ctgcccagttagcc

SEQ ID NO: 6169729 - DNA, 19 bp, Homo sapiens
ctgcccatacccctgcctg

SEQ ID NO: 6169730 - DNA, 16 bp, Homo sapiens
ctgcccatactgagcc

SEQ ID NO: 6169731 - DNA, 18 bp, Homo sapiens
ctgcccatactgagcctg

SEQ ID NO: 6169732 - DNA, 18 bp, Homo sapiens
ctgcccatcacagggttg

SEQ ID NO: 6169733 - DNA, 17 bp, Homo sapiens
ctgcccatcccacccca

SEQ ID NO: 6169734 - DNA, 21 bp, Homo sapiens
ctgcccatcgtgaagaagcct

SEQ ID NO: 6169735 - DNA, 19 bp, Homo sapiens
ctgcccatgagcaagccta

SEQ ID NO: 6169736 - DNA, 20 bp, Homo sapiens
ctgcccatgagcaagcctag

SEQ ID NO: 6169737 - DNA, 20 bp, Homo sapiens
ctgcccatgatagtgtattc

SEQ ID NO: 6169738 - DNA, 16 bp, Homo sapiens
ctgcccatgcaccttc

SEQ ID NO: 6169739 - DNA, 18 bp, Homo sapiens
ctgcccatggacaggctg

SEQ ID NO: 6169740 - DNA, 13 bp, Homo sapiens
ctgcccatgtcca

SEQ ID NO: 6169741 - DNA, 18 bp, Homo sapiens
ctgcccatgtccagaggg

SEQ ID NO: 6169742 - DNA, 21 bp, Homo sapiens
ctgcccatgtcgcgctcagca

SEQ ID NO: 6169743 - DNA, 22 bp, Homo sapiens
ctgcccatgtcgcgctcagcat

SEQ ID NO: 6169744 - DNA, 20 bp, Homo sapiens
ctgcccatgtgtcccctcac

SEQ ID NO: 6169745 - DNA, 16 bp, Homo sapiens
ctgccccaaaattata

SEQ ID NO: 6169746 - DNA, 19 bp, Homo sapiens
ctgccccaaaattataaac

SEQ ID NO: 6169747 - DNA, 21 bp, Homo sapiens
ctgccccaaacaaatatgcaa

SEQ ID NO: 6169748 - DNA, 21 bp, Homo sapiens
cttcaccccggcaggccctgc

SEQ ID NO: 6169749 - DNA, 16 bp, Homo sapiens
cttcacccctgcactt

SEQ ID NO: 6169750 - DNA, 21 bp, Homo sapiens
cttcacccgagttcctctggg

SEQ ID NO: 6169751 - DNA, 15 bp, Homo sapiens
cttcacccggctggg

SEQ ID NO: 6169752 - DNA, 24 bp, Homo sapiens
cttcaccctcaccccctcctggca

SEQ ID NO: 6169753 - DNA, 18 bp, Homo sapiens
cttcaccctgtaatggtt

SEQ ID NO: 6169754 - DNA, 14 bp, Homo sapiens
cttcaccctgtcaa

SEQ ID NO: 6169755 - DNA, 21 bp, Homo sapiens
cttcaccctgtcaagttaaca

SEQ ID NO: 6169756 - DNA, 19 bp, Homo sapiens
cttcaccgcattccagggg

SEQ ID NO: 6169757 - DNA, 19 bp, Homo sapiens
cttcaccgtgacattccag

SEQ ID NO: 6169758 - DNA, 10 bp, Homo sapiens
cttcacctca

SEQ ID NO: 6169759 - DNA, 14 bp, Homo sapiens
cttcacctcctcgc

SEQ ID NO: 6169760 - DNA, 13 bp, Homo sapiens
cttcacctctatc

SEQ ID NO: 6169761 - DNA, 21 bp, Homo sapiens
cttcacctctgggaccccagc

SEQ ID NO: 6169762 - DNA, 13 bp, Homo sapiens
cttcacctcttcc

SEQ ID NO: 6169763 - DNA, 16 bp, Homo sapiens
cttcacctcttccact

SEQ ID NO: 6169764 - DNA, 19 bp, Homo sapiens
cttcacctcttccactcct

SEQ ID NO: 6169765 - DNA, 15 bp, Homo sapiens
cttcacctgccacca

SEQ ID NO: 6169766 - DNA, 15 bp, Homo sapiens
cttcacctgttatgt

SEQ ID NO: 6169767 - DNA, 17 bp, Homo sapiens
cttcaccttagggaaga

SEQ ID NO: 6169768 - DNA, 17 bp, Homo sapiens
cttcaccttcaccttca

SEQ ID NO: 6169769 - DNA, 18 bp, Homo sapiens
cttcaccttggagcctga

SEQ ID NO: 6169770 - DNA, 22 bp, Homo sapiens
cttcacctttcctctccctcag

SEQ ID NO: 6169771 - DNA, 23 bp, Homo sapiens
cttcacctttcctctccctcagg

SEQ ID NO: 6169772 - DNA, 13 bp, Homo sapiens
cttcacctttgta

SEQ ID NO: 6169773 - DNA, 22 bp, Homo sapiens
cttcacctttgtccccaccgca

SEQ ID NO: 6169774 - DNA, 18 bp, Homo sapiens
cttcacgaagtgttgcat

SEQ ID NO: 6169775 - DNA, 19 bp, Homo sapiens
cttcacgaagtgttgcatg

SEQ ID NO: 6169776 - DNA, 20 bp, Homo sapiens
cttcacgaagtgttgcatgg

SEQ ID NO: 6169777 - DNA, 14 bp, Homo sapiens
cttcacgattctta

SEQ ID NO: 6169778 - DNA, 17 bp, Homo sapiens
cttcacgcccttggcca

SEQ ID NO: 6169779 - DNA, 19 bp, Homo sapiens
cttcacgcctgggtgaccc

SEQ ID NO: 6169780 - DNA, 19 bp, Homo sapiens
cttcacggactctttgctg

SEQ ID NO: 6169781 - DNA, 21 bp, Homo sapiens
cttcacggactctttgctgtt

SEQ ID NO: 6169782 - DNA, 17 bp, Homo sapiens
cttcacggcaggacaac

SEQ ID NO: 6169783 - DNA, 12 bp, Homo sapiens
cttcactacttt

SEQ ID NO: 6169784 - DNA, 17 bp, Homo sapiens
cttcactcaaattttgg

SEQ ID NO: 6169785 - DNA, 15 bp, Homo sapiens
cttcactcagccaca

SEQ ID NO: 6169786 - DNA, 12 bp, Homo sapiens
cttcactcagct

SEQ ID NO: 6169787 - DNA, 15 bp, Homo sapiens
cttcactccagacag

SEQ ID NO: 6169788 - DNA, 19 bp, Homo sapiens
cttcactccggtgtgcctg

SEQ ID NO: 6169789 - DNA, 15 bp, Homo sapiens
cttcactcctgctgt

SEQ ID NO: 6169790 - DNA, 17 bp, Homo sapiens
cttcactctaaaaatag

SEQ ID NO: 6169791 - DNA, 18 bp, Homo sapiens
cttcactctccagggtac

SEQ ID NO: 6169792 - DNA, 17 bp, Homo sapiens
cttcactctgacagtat

SEQ ID NO: 6169793 - DNA, 15 bp, Homo sapiens
cttcactctggcttc

SEQ ID NO: 6169794 - DNA, 21 bp, Homo sapiens
cttcactctggcttcaaaaag

SEQ ID NO: 6169795 - DNA, 20 bp, Homo sapiens
cttcactctgggcacactct

SEQ ID NO: 6169796 - DNA, 18 bp, Homo sapiens
cttcactcttcacttgag

SEQ ID NO: 6169797 - DNA, 14 bp, Homo sapiens
cttcactgaacatg

SEQ ID NO: 6169798 - DNA, 16 bp, Homo sapiens
cttcactgaacatgcc

SEQ ID NO: 6169799 - DNA, 14 bp, Homo sapiens
cttcactgaatatc

SEQ ID NO: 6169800 - DNA, 19 bp, Homo sapiens
cttcactgaccagcggctg

SEQ ID NO: 6169801 - DNA, 13 bp, Homo sapiens
cttcactgcagcc

SEQ ID NO: 6169802 - DNA, 21 bp, Homo sapiens
cttcactgccccctccgtccc

SEQ ID NO: 6169803 - DNA, 17 bp, Homo sapiens
cttcactgctacatgtg

SEQ ID NO: 6169804 - DNA, 18 bp, Homo sapiens
cttcactgctacatgtgc

SEQ ID NO: 6169805 - DNA, 20 bp, Homo sapiens
cttcactgctacatgtgctg

SEQ ID NO: 6169806 - DNA, 19 bp, Homo sapiens
cttcactgctctgccccca

SEQ ID NO: 6169807 - DNA, 17 bp, Homo sapiens
cttcactggcgccttct

SEQ ID NO: 6169808 - DNA, 21 bp, Homo sapiens
cttcactggcgccttctcgga

SEQ ID NO: 6169809 - DNA, 24 bp, Homo sapiens
cttcactggcgccttctcggagct

SEQ ID NO: 6169810 - DNA, 15 bp, Homo sapiens
cttcactgtaaaata

SEQ ID NO: 6169811 - DNA, 17 bp, Homo sapiens
cttcactgtataaatag

SEQ ID NO: 6169812 - DNA, 14 bp, Homo sapiens
cttcactgtatata

SEQ ID NO: 6169813 - DNA, 17 bp, Homo sapiens
cttcactgtcatcttca

SEQ ID NO: 6169814 - DNA, 22 bp, Homo sapiens
cttcactgtcatgtgcgaacac

SEQ ID NO: 6169815 - DNA, 18 bp, Homo sapiens
cttcactgtcctccaagc

SEQ ID NO: 6169816 - DNA, 19 bp, Homo sapiens
cttcactgtcttactcaag

SEQ ID NO: 6169817 - DNA, 17 bp, Homo sapiens
cttcactgtgaggggaa

SEQ ID NO: 6169818 - DNA, 14 bp, Homo sapiens
cttcactgtgctgt

SEQ ID NO: 6169819 - DNA, 18 bp, Homo sapiens
cttcactgtggccacagc

SEQ ID NO: 6169820 - DNA, 19 bp, Homo sapiens
cttcactgtggccacagcc

SEQ ID NO: 6169821 - DNA, 13 bp, Homo sapiens
cttcactgttccc

SEQ ID NO: 6169822 - DNA, 18 bp, Homo sapiens
cttcactgttccctctgg

SEQ ID NO: 6169823 - DNA, 20 bp, Homo sapiens
cttcactgttccctctggct

SEQ ID NO: 6169824 - DNA, 22 bp, Homo sapiens
cttcactgttccctctggcttc

SEQ ID NO: 6169825 - DNA, 15 bp, Homo sapiens
cttcactgttgaaaa

SEQ ID NO: 6169826 - DNA, 20 bp, Homo sapiens
cttcactgttgcttaattgt

SEQ ID NO: 6169827 - DNA, 16 bp, Homo sapiens
cttcacttacaagaaa

SEQ ID NO: 6169828 - DNA, 16 bp, Homo sapiens
cttcacttcaagctgt

SEQ ID NO: 6169829 - DNA, 22 bp, Homo sapiens
cttcacttcctccagaagcctc

SEQ ID NO: 6169830 - DNA, 14 bp, Homo sapiens
cttcacttctccca

SEQ ID NO: 6169831 - DNA, 13 bp, Homo sapiens
cttcacttctgac

SEQ ID NO: 6169832 - DNA, 15 bp, Homo sapiens
cttcacttctgacca

SEQ ID NO: 6169833 - DNA, 16 bp, Homo sapiens
cttcacttctgaccac

SEQ ID NO: 6169834 - DNA, 16 bp, Homo sapiens
cttcacttctgggaaa

SEQ ID NO: 6169835 - DNA, 12 bp, Homo sapiens
cttcagaaactt

SEQ ID NO: 6169836 - DNA, 19 bp, Homo sapiens
cttcagaaactttttctaa

SEQ ID NO: 6169837 - DNA, 20 bp, Homo sapiens
cttcagaaactttttctaaa

SEQ ID NO: 6169838 - DNA, 14 bp, Homo sapiens
cttcagaacagagg

SEQ ID NO: 6169839 - DNA, 16 bp, Homo sapiens
cttcagaacagaggca

SEQ ID NO: 6169840 - DNA, 18 bp, Homo sapiens
cttcagaacatgctggat

SEQ ID NO: 6169841 - DNA, 21 bp, Homo sapiens
cttcagaaggtaggggccgtg

SEQ ID NO: 6169842 - DNA, 17 bp, Homo sapiens
cttcagaatcagatata

SEQ ID NO: 6169843 - DNA, 21 bp, Homo sapiens
cttcagaattccatatcttgc

SEQ ID NO: 6169844 - DNA, 19 bp, Homo sapiens
cttcagacacaaaagtcca

SEQ ID NO: 6169845 - DNA, 15 bp, Homo sapiens
cttcagacacgcact

SEQ ID NO: 6169846 - DNA, 22 bp, Homo sapiens
cttcagaccatcagttacagag

SEQ ID NO: 6169847 - DNA, 14 bp, Homo sapiens
cttcagacccagag

SEQ ID NO: 6169848 - DNA, 16 bp, Homo sapiens
cttcagactctctcct

SEQ ID NO: 6169849 - DNA, 17 bp, Homo sapiens
cttcagactctctcctc

SEQ ID NO: 6169850 - DNA, 18 bp, Homo sapiens
cttcagactttgcttccc

SEQ ID NO: 6169851 - DNA, 18 bp, Homo sapiens
cttcagagactcctgcag

SEQ ID NO: 6169852 - DNA, 19 bp, Homo sapiens
cttcagagactcctgcagg

SEQ ID NO: 6169853 - DNA, 23 bp, Homo sapiens
cttcagagactcctgcaggcagc

SEQ ID NO: 6169854 - DNA, 12 bp, Homo sapiens
cttcagagcagg

SEQ ID NO: 6169855 - DNA, 11 bp, Homo sapiens
cttcagagcct

SEQ ID NO: 6169856 - DNA, 16 bp, Homo sapiens
cttcagagcctagcca

SEQ ID NO: 6169857 - DNA, 18 bp, Homo sapiens
cttcagagcctagccacc

SEQ ID NO: 6169858 - DNA, 20 bp, Homo sapiens
cttcagagcctagccacctc

SEQ ID NO: 6169859 - DNA, 21 bp, Homo sapiens
cttcagagctcttcaagctgt

SEQ ID NO: 6169860 - DNA, 10 bp, Homo sapiens
cttcagaggc

SEQ ID NO: 6169861 - DNA, 18 bp, Homo sapiens
cttcagaggcctggcatc

SEQ ID NO: 6169862 - DNA, 16 bp, Homo sapiens
cttcagaggctgaggt

SEQ ID NO: 6169863 - DNA, 21 bp, Homo sapiens
cttcagaggtggctctggaat

SEQ ID NO: 6169864 - DNA, 23 bp, Homo sapiens
cttcagagtcctcattataaaat

SEQ ID NO: 6169865 - DNA, 12 bp, Homo sapiens
cttcagagtgaa

SEQ ID NO: 6169866 - DNA, 18 bp, Homo sapiens
cttcagagttctctgtaa

SEQ ID NO: 6169867 - DNA, 13 bp, Homo sapiens
cttcagagtttgt

SEQ ID NO: 6169868 - DNA, 23 bp, Homo sapiens
cttcagagtttgtcatatactgc

SEQ ID NO: 6169869 - DNA, 16 bp, Homo sapiens
cttcagagtttgtgtg

SEQ ID NO: 6169870 - DNA, 17 bp, Homo sapiens
cttcagagtttgtgtgt

SEQ ID NO: 6169871 - DNA, 19 bp, Homo sapiens
cttcagatattattgcttt

SEQ ID NO: 6169872 - DNA, 15 bp, Homo sapiens
cttcagatcagtgct

SEQ ID NO: 6169873 - DNA, 15 bp, Homo sapiens
cttcagatcctgctg

SEQ ID NO: 6169874 - DNA, 16 bp, Homo sapiens
cttcagatcctgctgc

SEQ ID NO: 6169875 - DNA, 17 bp, Homo sapiens
cttcagatcctgctgcc

SEQ ID NO: 6169876 - DNA, 16 bp, Homo sapiens
cttcagatctgaggtt

SEQ ID NO: 6169877 - DNA, 17 bp, Homo sapiens
cttcagatgccacttct

SEQ ID NO: 6169878 - DNA, 17 bp, Homo sapiens
cttcagatgctcttggg

SEQ ID NO: 6169879 - DNA, 18 bp, Homo sapiens
cttcagatggaaactctt

SEQ ID NO: 6169880 - DNA, 23 bp, Homo sapiens
cttcagatgggaggaaagagagc

SEQ ID NO: 6169881 - DNA, 19 bp, Homo sapiens
cttcagatgtggagccagg

SEQ ID NO: 6169882 - DNA, 20 bp, Homo sapiens
cttcagatgtggagccaggc

SEQ ID NO: 6169883 - DNA, 22 bp, Homo sapiens
cttcagatgtggagccaggcgt

SEQ ID NO: 6169884 - DNA, 17 bp, Homo sapiens
cttcagatgtttccaag

SEQ ID NO: 6169885 - DNA, 24 bp, Homo sapiens
cttcagattgttaggagtggttct

SEQ ID NO: 6169886 - DNA, 13 bp, Homo sapiens
cttcagatttcaa

SEQ ID NO: 6169887 - DNA, 23 bp, Homo sapiens
cttcagcaaaaatattttatgat

SEQ ID NO: 6169888 - DNA, 11 bp, Homo sapiens
cttcagcaacc

SEQ ID NO: 6169889 - DNA, 14 bp, Homo sapiens
cttcagcaagagag

SEQ ID NO: 6169890 - DNA, 17 bp, Homo sapiens
cttcagcaagagagaac

SEQ ID NO: 6169891 - DNA, 20 bp, Homo sapiens
cttcagcaagagagaaccta

SEQ ID NO: 6169892 - DNA, 13 bp, Homo sapiens
cttcagcacagga

SEQ ID NO: 6169893 - DNA, 14 bp, Homo sapiens
cttcagcactttag

SEQ ID NO: 6169894 - DNA, 14 bp, Homo sapiens
cttcagcaggaggc

SEQ ID NO: 6169895 - DNA, 12 bp, Homo sapiens
cttcagcagggg

SEQ ID NO: 6169896 - DNA, 15 bp, Homo sapiens
cttcagcaggggtgg

SEQ ID NO: 6169897 - DNA, 16 bp, Homo sapiens
cttcagcaggggtggg

SEQ ID NO: 6169898 - DNA, 15 bp, Homo sapiens
cttcagcatcctcag

SEQ ID NO: 6169899 - DNA, 16 bp, Homo sapiens
cttcagcattccctcc

SEQ ID NO: 6169900 - DNA, 18 bp, Homo sapiens
cttcagcattccctccca

SEQ ID NO: 6169901 - DNA, 21 bp, Homo sapiens
cttcagcattccctcccatca

SEQ ID NO: 6169902 - DNA, 18 bp, Homo sapiens
cttcagccaccctttctg

SEQ ID NO: 6169903 - DNA, 24 bp, Homo sapiens
cttcagccaccctttctggcacga

SEQ ID NO: 6169904 - DNA, 19 bp, Homo sapiens
cttcagccaggagctgggc

SEQ ID NO: 6169905 - DNA, 15 bp, Homo sapiens
cttcagccaggtctg

SEQ ID NO: 6169906 - DNA, 12 bp, Homo sapiens
cttcagcccagc

SEQ ID NO: 6169907 - DNA, 13 bp, Homo sapiens
cttcagcccaggc

SEQ ID NO: 6169908 - DNA, 15 bp, Homo sapiens
cttcagcccaggctt

SEQ ID NO: 6169909 - DNA, 17 bp, Homo sapiens
cttcagcccaggctttt

SEQ ID NO: 6169910 - DNA, 16 bp, Homo sapiens
cttcagcccccaccag

SEQ ID NO: 6169911 - DNA, 21 bp, Homo sapiens
cttcagcccccaccaggggaa

SEQ ID NO: 6169912 - DNA, 17 bp, Homo sapiens
cttcagcccccagcccc

SEQ ID NO: 6169913 - DNA, 21 bp, Homo sapiens
cttcagcccccagcccctccc

SEQ ID NO: 6169914 - DNA, 12 bp, Homo sapiens
cttcagcccctg

SEQ ID NO: 6169915 - DNA, 13 bp, Homo sapiens
cttcagccccttc

SEQ ID NO: 6169916 - DNA, 18 bp, Homo sapiens
cttcagccccttctcccc

SEQ ID NO: 6169917 - DNA, 19 bp, Homo sapiens
cttcagccccttctcccct

SEQ ID NO: 6169918 - DNA, 15 bp, Homo sapiens
cttcagccctcaccc

SEQ ID NO: 6169919 - DNA, 16 bp, Homo sapiens
cttcagccctcacccc

SEQ ID NO: 6169920 - DNA, 12 bp, Homo sapiens
cttcagccctgg

SEQ ID NO: 6169921 - DNA, 14 bp, Homo sapiens
cttcagccctggcc

SEQ ID NO: 6169922 - DNA, 16 bp, Homo sapiens
cttcagccctggcccc

SEQ ID NO: 6169923 - DNA, 13 bp, Homo sapiens
cttcagcctagcc

SEQ ID NO: 6169924 - DNA, 20 bp, Homo sapiens
cttcagcctagccgacctca

SEQ ID NO: 6169925 - DNA, 23 bp, Homo sapiens
cttcagcctagccgacctcagcc

SEQ ID NO: 6169926 - DNA, 19 bp, Homo sapiens
cttcagcctagtggcttgt

SEQ ID NO: 6169927 - DNA, 13 bp, Homo sapiens
cttcagcctctcc

SEQ ID NO: 6169928 - DNA, 19 bp, Homo sapiens
ctgccccaaaggaagcttt

SEQ ID NO: 6169929 - DNA, 23 bp, Homo sapiens
ctgccccaaataacttcagtcct

SEQ ID NO: 6169930 - DNA, 16 bp, Homo sapiens
ctgccccaacccccac

SEQ ID NO: 6169931 - DNA, 17 bp, Homo sapiens
ctgccccaacctgctga

SEQ ID NO: 6169932 - DNA, 12 bp, Homo sapiens
ctgccccaactc

SEQ ID NO: 6169933 - DNA, 17 bp, Homo sapiens
ctgccccaactcctgga

SEQ ID NO: 6169934 - DNA, 20 bp, Homo sapiens
ctgccccaactcctggaagc

SEQ ID NO: 6169935 - DNA, 20 bp, Homo sapiens
ctgccccaactccttccagc

SEQ ID NO: 6169936 - DNA, 13 bp, Homo sapiens
ctgccccaactct

SEQ ID NO: 6169937 - DNA, 17 bp, Homo sapiens
ctgccccaactgcagga

SEQ ID NO: 6169938 - DNA, 19 bp, Homo sapiens
ctgccccaagcagccagcc

SEQ ID NO: 6169939 - DNA, 21 bp, Homo sapiens
ctgccccaagcagccagccag

SEQ ID NO: 6169940 - DNA, 13 bp, Homo sapiens
ctgccccaagccc

SEQ ID NO: 6169941 - DNA, 23 bp, Homo sapiens
ctgccccaagcccccaaccccgc

SEQ ID NO: 6169942 - DNA, 20 bp, Homo sapiens
ctgccccaaggccccaggga

SEQ ID NO: 6169943 - DNA, 13 bp, Homo sapiens
ctgccccaagggg

SEQ ID NO: 6169944 - DNA, 13 bp, Homo sapiens
ctgccccaagttg

SEQ ID NO: 6169945 - DNA, 21 bp, Homo sapiens
ctgccccaatcgggtccagag

SEQ ID NO: 6169946 - DNA, 19 bp, Homo sapiens
ctgccccaatgtgacctgg

SEQ ID NO: 6169947 - DNA, 18 bp, Homo sapiens
ctgccccacacaggcctg

SEQ ID NO: 6169948 - DNA, 22 bp, Homo sapiens
ctgccccacacaggcctggccc

SEQ ID NO: 6169949 - DNA, 16 bp, Homo sapiens
ctgccccacacccagc

SEQ ID NO: 6169950 - DNA, 18 bp, Homo sapiens
ctgccccacacctcctct

SEQ ID NO: 6169951 - DNA, 16 bp, Homo sapiens
ctgccccacacggact

SEQ ID NO: 6169952 - DNA, 17 bp, Homo sapiens
ctgccccacaggccaca

SEQ ID NO: 6169953 - DNA, 21 bp, Homo sapiens
ctgccccacataattctgtta

SEQ ID NO: 6169954 - DNA, 20 bp, Homo sapiens
ctgccccacatccccacctg

SEQ ID NO: 6169955 - DNA, 23 bp, Homo sapiens
ctgccccacatgcatgtctgcct

SEQ ID NO: 6169956 - DNA, 16 bp, Homo sapiens
ctgccccaccagccac

SEQ ID NO: 6169957 - DNA, 18 bp, Homo sapiens
ctgccccaccagccacct

SEQ ID NO: 6169958 - DNA, 19 bp, Homo sapiens
ctgccccaccagccacctc

SEQ ID NO: 6169959 - DNA, 20 bp, Homo sapiens
ctgccccaccagccacctct

SEQ ID NO: 6169960 - DNA, 22 bp, Homo sapiens
ctgccccacccaactccacagg

SEQ ID NO: 6169961 - DNA, 21 bp, Homo sapiens
ctgccccacccaccccacaga

SEQ ID NO: 6169962 - DNA, 14 bp, Homo sapiens
ctgccccaccccac

SEQ ID NO: 6169963 - DNA, 15 bp, Homo sapiens
ctgccccaccccacc

SEQ ID NO: 6169964 - DNA, 23 bp, Homo sapiens
ctgccccaccccacctcacagct

SEQ ID NO: 6169965 - DNA, 14 bp, Homo sapiens
ctgccccaccccat

SEQ ID NO: 6169966 - DNA, 18 bp, Homo sapiens
ctgccccaccccatccag

SEQ ID NO: 6169967 - DNA, 23 bp, Homo sapiens
ctgccccaccccatccagccaga

SEQ ID NO: 6169968 - DNA, 18 bp, Homo sapiens
ctgccccacggagacaga

SEQ ID NO: 6169969 - DNA, 20 bp, Homo sapiens
ctgccccacggccctgtcag

SEQ ID NO: 6169970 - DNA, 18 bp, Homo sapiens
ctgccccacgttgtccct

SEQ ID NO: 6169971 - DNA, 18 bp, Homo sapiens
ctgccccactcctgtcag

SEQ ID NO: 6169972 - DNA, 16 bp, Homo sapiens
ctgccccacttctggc

SEQ ID NO: 6169973 - DNA, 18 bp, Homo sapiens
ctgccccacttctggcat

SEQ ID NO: 6169974 - DNA, 22 bp, Homo sapiens
ctgccccacttctggcatggga

SEQ ID NO: 6169975 - DNA, 22 bp, Homo sapiens
ctgccccagaacaattctgcag

SEQ ID NO: 6169976 - DNA, 20 bp, Homo sapiens
ctgccccagagaagcctcag

SEQ ID NO: 6169977 - DNA, 21 bp, Homo sapiens
ctgccccagagaagcctcagt

SEQ ID NO: 6169978 - DNA, 14 bp, Homo sapiens
ctgccccagaggtc

SEQ ID NO: 6169979 - DNA, 13 bp, Homo sapiens
ctgccccagagtg

SEQ ID NO: 6169980 - DNA, 15 bp, Homo sapiens
ctgccccagcactca

SEQ ID NO: 6169981 - DNA, 18 bp, Homo sapiens
ctgccccagcccaagtcc

SEQ ID NO: 6169982 - DNA, 19 bp, Homo sapiens
ctgccccagcccaagtcca

SEQ ID NO: 6169983 - DNA, 14 bp, Homo sapiens
ctgccccagcccag

SEQ ID NO: 6169984 - DNA, 17 bp, Homo sapiens
ctgccccagcctcccag

SEQ ID NO: 6169985 - DNA, 15 bp, Homo sapiens
ctgccccagcgcggc

SEQ ID NO: 6169986 - DNA, 23 bp, Homo sapiens
ctgccccagcgcggcttggccgc

SEQ ID NO: 6169987 - DNA, 18 bp, Homo sapiens
ctgccccagctctggctt

SEQ ID NO: 6169988 - DNA, 16 bp, Homo sapiens
ctgccccagctgggct

SEQ ID NO: 6169989 - DNA, 19 bp, Homo sapiens
ctgccccagcttgggcaga

SEQ ID NO: 6169990 - DNA, 16 bp, Homo sapiens
ctgccccagctttatc

SEQ ID NO: 6169991 - DNA, 12 bp, Homo sapiens
ctgccccaggcc

SEQ ID NO: 6169992 - DNA, 13 bp, Homo sapiens
ctgccccaggccg

SEQ ID NO: 6169993 - DNA, 21 bp, Homo sapiens
ctgccccaggccggagcccag

SEQ ID NO: 6169994 - DNA, 23 bp, Homo sapiens
ctgccccaggccggagcccagat

SEQ ID NO: 6169995 - DNA, 16 bp, Homo sapiens
ctgccccaggcctgga

SEQ ID NO: 6169996 - DNA, 12 bp, Homo sapiens
ctgccccaggct

SEQ ID NO: 6169997 - DNA, 11 bp, Homo sapiens
ctgccccaggg

SEQ ID NO: 6169998 - DNA, 14 bp, Homo sapiens
ctgccccaggggga

SEQ ID NO: 6169999 - DNA, 22 bp, Homo sapiens
ctgccccaggtacacctccccc

SEQ ID NO: 6170000 - DNA, 23 bp, Homo sapiens
ctgccccaggtacacctccccct

SEQ ID NO: 6170001 - DNA, 23 bp, Homo sapiens
ctgccccagtcgttagaatatag

SEQ ID NO: 6170002 - DNA, 19 bp, Homo sapiens
ctgccccatcattgcacct

SEQ ID NO: 6170003 - DNA, 12 bp, Homo sapiens
ctgccccatccc

SEQ ID NO: 6170004 - DNA, 13 bp, Homo sapiens
ctgccccatccca

SEQ ID NO: 6170005 - DNA, 19 bp, Homo sapiens
ctgccccatcccatccctt

SEQ ID NO: 6170006 - DNA, 22 bp, Homo sapiens
ctgccccatcctccagcaggga

SEQ ID NO: 6170007 - DNA, 20 bp, Homo sapiens
ctgccccatcctgggcctta

SEQ ID NO: 6170008 - DNA, 21 bp, Homo sapiens
ctgccccatctcccctcagct

SEQ ID NO: 6170009 - DNA, 22 bp, Homo sapiens
ctgccccatctcccctcagctc

SEQ ID NO: 6170010 - DNA, 15 bp, Homo sapiens
ctgccccattgagat

SEQ ID NO: 6170011 - DNA, 21 bp, Homo sapiens
ctgccccatttatccacctcc

SEQ ID NO: 6170012 - DNA, 17 bp, Homo sapiens
ctgcccccaaaagtgtc

SEQ ID NO: 6170013 - DNA, 15 bp, Homo sapiens
ctgcccccaaataag

SEQ ID NO: 6170014 - DNA, 16 bp, Homo sapiens
ctgcccccaacactcc

SEQ ID NO: 6170015 - DNA, 21 bp, Homo sapiens
ctgcccccaacactccaggcc

SEQ ID NO: 6170016 - DNA, 20 bp, Homo sapiens
ctgcccccaaggaggcagcc

SEQ ID NO: 6170017 - DNA, 15 bp, Homo sapiens
ctgcccccacaccca

SEQ ID NO: 6170018 - DNA, 17 bp, Homo sapiens
ctgcccccacacccact

SEQ ID NO: 6170019 - DNA, 17 bp, Homo sapiens
ctgcccccacacctggc

SEQ ID NO: 6170020 - DNA, 14 bp, Homo sapiens
ctgcccccacagct

SEQ ID NO: 6170021 - DNA, 20 bp, Homo sapiens
ctgcccccacagctccttgc

SEQ ID NO: 6170022 - DNA, 21 bp, Homo sapiens
ctgcccccacagctccttgca

SEQ ID NO: 6170023 - DNA, 13 bp, Homo sapiens
ctgcccccacccc

SEQ ID NO: 6170024 - DNA, 15 bp, Homo sapiens
ctgcccccaccccag

SEQ ID NO: 6170025 - DNA, 22 bp, Homo sapiens
ctgcccccaccccattcccgca

SEQ ID NO: 6170026 - DNA, 15 bp, Homo sapiens
ctgcccccaccccgg

SEQ ID NO: 6170027 - DNA, 23 bp, Homo sapiens
ctgcccccaccccttcctgtctc

SEQ ID NO: 6170028 - DNA, 14 bp, Homo sapiens
ctgcccccaccctg

SEQ ID NO: 6170029 - DNA, 17 bp, Homo sapiens
ctgcccccactcagcat

SEQ ID NO: 6170030 - DNA, 12 bp, Homo sapiens
ctgcccccactg

SEQ ID NO: 6170031 - DNA, 13 bp, Homo sapiens
ctgcccccactgt

SEQ ID NO: 6170032 - DNA, 20 bp, Homo sapiens
ctgcccccagaaagcctcct

SEQ ID NO: 6170033 - DNA, 19 bp, Homo sapiens
ctgcccccagagccacagt

SEQ ID NO: 6170034 - DNA, 15 bp, Homo sapiens
ctgcccccagcactc

SEQ ID NO: 6170035 - DNA, 17 bp, Homo sapiens
ctgcccccagcactcct

SEQ ID NO: 6170036 - DNA, 14 bp, Homo sapiens
ctgcccccagccca

SEQ ID NO: 6170037 - DNA, 22 bp, Homo sapiens
ctgcccccagcgtgggggtggc

SEQ ID NO: 6170038 - DNA, 21 bp, Homo sapiens
ctgcccccagctgctcctcgc

SEQ ID NO: 6170039 - DNA, 17 bp, Homo sapiens
ctgcccccaggactggg

SEQ ID NO: 6170040 - DNA, 14 bp, Homo sapiens
ctgcccccatcacc

SEQ ID NO: 6170041 - DNA, 19 bp, Homo sapiens
ctgcccccatccagccacg

SEQ ID NO: 6170042 - DNA, 22 bp, Homo sapiens
ctgcccccatccagccacggag

SEQ ID NO: 6170043 - DNA, 14 bp, Homo sapiens
ctgcccccatctcc

SEQ ID NO: 6170044 - DNA, 22 bp, Homo sapiens
ctgccccccaaggttctggttc

SEQ ID NO: 6170045 - DNA, 19 bp, Homo sapiens
ctgccccccacattctggc

SEQ ID NO: 6170046 - DNA, 20 bp, Homo sapiens
ctgccccccaccccaccctc

SEQ ID NO: 6170047 - DNA, 14 bp, Homo sapiens
ctgccccccagggc

SEQ ID NO: 6170048 - DNA, 16 bp, Homo sapiens
ctgccccccagggcta

SEQ ID NO: 6170049 - DNA, 18 bp, Homo sapiens
ctgcccccccaccccact

SEQ ID NO: 6170050 - DNA, 19 bp, Homo sapiens
ctgccccccgaggctgcta

SEQ ID NO: 6170051 - DNA, 15 bp, Homo sapiens
ctgcccccctccttt

SEQ ID NO: 6170052 - DNA, 22 bp, Homo sapiens
ctgccccccttcccacccctat

SEQ ID NO: 6170053 - DNA, 18 bp, Homo sapiens
ctgcccccgacagcccag

SEQ ID NO: 6170054 - DNA, 14 bp, Homo sapiens
ctgcccccgcatcc

SEQ ID NO: 6170055 - DNA, 21 bp, Homo sapiens
ctgcccccgcatcccctgcct

SEQ ID NO: 6170056 - DNA, 16 bp, Homo sapiens
ctgcccccgccctgct

SEQ ID NO: 6170057 - DNA, 17 bp, Homo sapiens
ctgcccccgccctgctg

SEQ ID NO: 6170058 - DNA, 22 bp, Homo sapiens
ctgcccccgcgggttctagacg

SEQ ID NO: 6170059 - DNA, 19 bp, Homo sapiens
ctgcccccgctctgccatc

SEQ ID NO: 6170060 - DNA, 17 bp, Homo sapiens
ctgcccccggccccctg

SEQ ID NO: 6170061 - DNA, 18 bp, Homo sapiens
ctgcccccgttccagctg

SEQ ID NO: 6170062 - DNA, 21 bp, Homo sapiens
ctgcccccgttccagctgaca

SEQ ID NO: 6170063 - DNA, 18 bp, Homo sapiens
ctgccccctatcttgtcc

SEQ ID NO: 6170064 - DNA, 20 bp, Homo sapiens
ctgccccctatcttgtcctg

SEQ ID NO: 6170065 - DNA, 13 bp, Homo sapiens
ctgccccctcagg

SEQ ID NO: 6170066 - DNA, 17 bp, Homo sapiens
ctgccccctcccactct

SEQ ID NO: 6170067 - DNA, 20 bp, Homo sapiens
ctgccccctcccactcttga

SEQ ID NO: 6170068 - DNA, 22 bp, Homo sapiens
ctgccccctcccccgcagacag

SEQ ID NO: 6170069 - DNA, 17 bp, Homo sapiens
ctgccccctccccttca

SEQ ID NO: 6170070 - DNA, 18 bp, Homo sapiens
ctgccccctccccttcac

SEQ ID NO: 6170071 - DNA, 20 bp, Homo sapiens
ctgccccctccgtcccaccc

SEQ ID NO: 6170072 - DNA, 14 bp, Homo sapiens
ctgccccctcctga

SEQ ID NO: 6170073 - DNA, 15 bp, Homo sapiens
ctgccccctcctgtg

SEQ ID NO: 6170074 - DNA, 13 bp, Homo sapiens
ctgccccctcctt

SEQ ID NO: 6170075 - DNA, 19 bp, Homo sapiens
ctgccccctcgggggcctg

SEQ ID NO: 6170076 - DNA, 18 bp, Homo sapiens
ctgccccctgaaacttat

SEQ ID NO: 6170077 - DNA, 14 bp, Homo sapiens
ctgccccctgcagg

SEQ ID NO: 6170078 - DNA, 15 bp, Homo sapiens
ctgccccctgccagt

SEQ ID NO: 6170079 - DNA, 14 bp, Homo sapiens
ctgccccctgctgg

SEQ ID NO: 6170080 - DNA, 19 bp, Homo sapiens
ctgccccctgctggctctt

SEQ ID NO: 6170081 - DNA, 13 bp, Homo sapiens
ctgccccctggct

SEQ ID NO: 6170082 - DNA, 14 bp, Homo sapiens
ctgccccctggctg

SEQ ID NO: 6170083 - DNA, 20 bp, Homo sapiens
ctgccccctggctgactggc

SEQ ID NO: 6170084 - DNA, 12 bp, Homo sapiens
ctgccccctggg

SEQ ID NO: 6170085 - DNA, 13 bp, Homo sapiens
ctgccccctgggc

SEQ ID NO: 6170086 - DNA, 14 bp, Homo sapiens
ctgccccctgggct

SEQ ID NO: 6170087 - DNA, 21 bp, Homo sapiens
ctgccccctgggctggggcct

SEQ ID NO: 6170088 - DNA, 14 bp, Homo sapiens
ctgccccctgggga

SEQ ID NO: 6170089 - DNA, 18 bp, Homo sapiens
ctgcccccttccccagcc

SEQ ID NO: 6170090 - DNA, 16 bp, Homo sapiens
ctgcccccttctccca

SEQ ID NO: 6170091 - DNA, 17 bp, Homo sapiens
ctgccccgcaggcctgc

SEQ ID NO: 6170092 - DNA, 15 bp, Homo sapiens
ctgccccgcccagct

SEQ ID NO: 6170093 - DNA, 14 bp, Homo sapiens
ctgccccgccccca

SEQ ID NO: 6170094 - DNA, 15 bp, Homo sapiens
ctgccccgcccccaa

SEQ ID NO: 6170095 - DNA, 17 bp, Homo sapiens
ctgccccgcccccaagc

SEQ ID NO: 6170096 - DNA, 16 bp, Homo sapiens
ctgccccgcccccagt

SEQ ID NO: 6170097 - DNA, 18 bp, Homo sapiens
ctgccccgcccccagtcc

SEQ ID NO: 6170098 - DNA, 16 bp, Homo sapiens
ctgccccgccccccag

SEQ ID NO: 6170099 - DNA, 17 bp, Homo sapiens
ctgccccgccccccaga

SEQ ID NO: 6170100 - DNA, 20 bp, Homo sapiens
ctgccccgccccccagagcc

SEQ ID NO: 6170101 - DNA, 21 bp, Homo sapiens
ctgccccgccggccgcgcacc

SEQ ID NO: 6170102 - DNA, 13 bp, Homo sapiens
ctgccccgcttcc

SEQ ID NO: 6170103 - DNA, 14 bp, Homo sapiens
ctgccccggccact

SEQ ID NO: 6170104 - DNA, 16 bp, Homo sapiens
ctgccccggcccaacc

SEQ ID NO: 6170105 - DNA, 17 bp, Homo sapiens
ctgccccggcccaacct

SEQ ID NO: 6170106 - DNA, 23 bp, Homo sapiens
cttcagcgagacccttgcattag

SEQ ID NO: 6170107 - DNA, 16 bp, Homo sapiens
cttcagcgtaaaatgg

SEQ ID NO: 6170108 - DNA, 17 bp, Homo sapiens
cttcagcgtaaaatggt

SEQ ID NO: 6170109 - DNA, 21 bp, Homo sapiens
cttcagctaaagtaacagagc

SEQ ID NO: 6170110 - DNA, 21 bp, Homo sapiens
cttcagctcaactcacagctt

SEQ ID NO: 6170111 - DNA, 17 bp, Homo sapiens
cttcagctcacgcttca

SEQ ID NO: 6170112 - DNA, 15 bp, Homo sapiens
cttcagctccagccc

SEQ ID NO: 6170113 - DNA, 23 bp, Homo sapiens
cttcagctccagcccctttccaa

SEQ ID NO: 6170114 - DNA, 13 bp, Homo sapiens
cttcagctccagg

SEQ ID NO: 6170115 - DNA, 23 bp, Homo sapiens
cttcagctccagggaatccaagc

SEQ ID NO: 6170116 - DNA, 16 bp, Homo sapiens
cttcagctcccatagc

SEQ ID NO: 6170117 - DNA, 11 bp, Homo sapiens
cttcagctcct

SEQ ID NO: 6170118 - DNA, 11 bp, Homo sapiens
cttcagctgac

SEQ ID NO: 6170119 - DNA, 15 bp, Homo sapiens
cttcagctgactttt

SEQ ID NO: 6170120 - DNA, 14 bp, Homo sapiens
cttcagctgccagt

SEQ ID NO: 6170121 - DNA, 15 bp, Homo sapiens
cttcagctgcctgaa

SEQ ID NO: 6170122 - DNA, 23 bp, Homo sapiens
cttcagctgcctgaaacagccat

SEQ ID NO: 6170123 - DNA, 13 bp, Homo sapiens
cttcagctgctga

SEQ ID NO: 6170124 - DNA, 21 bp, Homo sapiens
cttcagctgctgaagggaggg

SEQ ID NO: 6170125 - DNA, 12 bp, Homo sapiens
cttcagctggtg

SEQ ID NO: 6170126 - DNA, 13 bp, Homo sapiens
cttcagctggtgg

SEQ ID NO: 6170127 - DNA, 23 bp, Homo sapiens
cttcaggaacaagtaatgtatta

SEQ ID NO: 6170128 - DNA, 21 bp, Homo sapiens
cttcaggaacctcgagtactg

SEQ ID NO: 6170129 - DNA, 17 bp, Homo sapiens
cttcaggaactggggct

SEQ ID NO: 6170130 - DNA, 22 bp, Homo sapiens
cttcaggaagcataaagcaatt

SEQ ID NO: 6170131 - DNA, 16 bp, Homo sapiens
cttcaggacactcact

SEQ ID NO: 6170132 - DNA, 17 bp, Homo sapiens
cttcaggagaaactgct

SEQ ID NO: 6170133 - DNA, 13 bp, Homo sapiens
cttcaggagcctg

SEQ ID NO: 6170134 - DNA, 15 bp, Homo sapiens
cttcaggagcctggc

SEQ ID NO: 6170135 - DNA, 19 bp, Homo sapiens
cttcaggagcctggccagg

SEQ ID NO: 6170136 - DNA, 20 bp, Homo sapiens
cttcaggagcctggccaggc

SEQ ID NO: 6170137 - DNA, 22 bp, Homo sapiens
cttcaggagcctggccaggcag

SEQ ID NO: 6170138 - DNA, 16 bp, Homo sapiens
cttcaggagctgacag

SEQ ID NO: 6170139 - DNA, 16 bp, Homo sapiens
cttcaggaggccctgg

SEQ ID NO: 6170140 - DNA, 16 bp, Homo sapiens
cttcaggagggagcat

SEQ ID NO: 6170141 - DNA, 16 bp, Homo sapiens
cttcaggagtttcatg

SEQ ID NO: 6170142 - DNA, 21 bp, Homo sapiens
cttcaggatacgctgctctca

SEQ ID NO: 6170143 - DNA, 18 bp, Homo sapiens
cttcaggcaattctcctg

SEQ ID NO: 6170144 - DNA, 23 bp, Homo sapiens
cttcaggcaattctcctgccttt

SEQ ID NO: 6170145 - DNA, 14 bp, Homo sapiens
cttcaggcaccaca

SEQ ID NO: 6170146 - DNA, 17 bp, Homo sapiens
cttcaggcaccacagat

SEQ ID NO: 6170147 - DNA, 16 bp, Homo sapiens
cttcaggccagctggg

SEQ ID NO: 6170148 - DNA, 17 bp, Homo sapiens
cttcaggccgagccagg

SEQ ID NO: 6170149 - DNA, 15 bp, Homo sapiens
cttcaggcctccctc

SEQ ID NO: 6170150 - DNA, 15 bp, Homo sapiens
cttcaggctctgccc

SEQ ID NO: 6170151 - DNA, 17 bp, Homo sapiens
cttcaggctctgcccag

SEQ ID NO: 6170152 - DNA, 18 bp, Homo sapiens
cttcaggctcttctcctt

SEQ ID NO: 6170153 - DNA, 20 bp, Homo sapiens
cttcagggaaggtgaaacag

SEQ ID NO: 6170154 - DNA, 23 bp, Homo sapiens
cttcagggactcaagggtccaga

SEQ ID NO: 6170155 - DNA, 19 bp, Homo sapiens
cttcagggagcatatgaaa

SEQ ID NO: 6170156 - DNA, 13 bp, Homo sapiens
cttcagggagggt

SEQ ID NO: 6170157 - DNA, 19 bp, Homo sapiens
cttcagggaggtagtttca

SEQ ID NO: 6170158 - DNA, 20 bp, Homo sapiens
cttcagggcagggctctgat

SEQ ID NO: 6170159 - DNA, 14 bp, Homo sapiens
cttcagggcaggtg

SEQ ID NO: 6170160 - DNA, 22 bp, Homo sapiens
cttcagggccagaaggagggca

SEQ ID NO: 6170161 - DNA, 17 bp, Homo sapiens
cttcaggggcacttcat

SEQ ID NO: 6170162 - DNA, 14 bp, Homo sapiens
cttcaggggctgcc

SEQ ID NO: 6170163 - DNA, 16 bp, Homo sapiens
cttcaggggctgcccg

SEQ ID NO: 6170164 - DNA, 17 bp, Homo sapiens
cttcaggggctgcccgc

SEQ ID NO: 6170165 - DNA, 22 bp, Homo sapiens
cttcaggggctgcccgctccca

SEQ ID NO: 6170166 - DNA, 19 bp, Homo sapiens
cttcaggggtcacctcctc

SEQ ID NO: 6170167 - DNA, 18 bp, Homo sapiens
cttcagggtgatgccagg

SEQ ID NO: 6170168 - DNA, 18 bp, Homo sapiens
cttcagggttctcctctc

SEQ ID NO: 6170169 - DNA, 21 bp, Homo sapiens
cttcagggttctcctctcccc

SEQ ID NO: 6170170 - DNA, 17 bp, Homo sapiens
cttcaggtcccctggcc

SEQ ID NO: 6170171 - DNA, 18 bp, Homo sapiens
cttcaggtcccctggccc

SEQ ID NO: 6170172 - DNA, 15 bp, Homo sapiens
cttcaggtccgtggg

SEQ ID NO: 6170173 - DNA, 16 bp, Homo sapiens
cttcaggtccgtgggc

SEQ ID NO: 6170174 - DNA, 14 bp, Homo sapiens
cttcaggtctctgt

SEQ ID NO: 6170175 - DNA, 15 bp, Homo sapiens
cttcaggtctctgtg

SEQ ID NO: 6170176 - DNA, 19 bp, Homo sapiens
cttcaggtggagagcacta

SEQ ID NO: 6170177 - DNA, 20 bp, Homo sapiens
cttcaggtggatgaggagac

SEQ ID NO: 6170178 - DNA, 18 bp, Homo sapiens
cttcaggttcctcctagg

SEQ ID NO: 6170179 - DNA, 20 bp, Homo sapiens
cttcaggttcctcctaggcg

SEQ ID NO: 6170180 - DNA, 12 bp, Homo sapiens
cttcaggttctc

SEQ ID NO: 6170181 - DNA, 20 bp, Homo sapiens
cttcaggttgttctgtataa

SEQ ID NO: 6170182 - DNA, 11 bp, Homo sapiens
cttcaggtttt

SEQ ID NO: 6170183 - DNA, 18 bp, Homo sapiens
cttcagtaaaaggacctc

SEQ ID NO: 6170184 - DNA, 15 bp, Homo sapiens
cttcagtaagccgtg

SEQ ID NO: 6170185 - DNA, 15 bp, Homo sapiens
cttcagtactcaaat

SEQ ID NO: 6170186 - DNA, 15 bp, Homo sapiens
cttcagtatcaaggc

SEQ ID NO: 6170187 - DNA, 22 bp, Homo sapiens
cttcagtatcaaggctgcctgg

SEQ ID NO: 6170188 - DNA, 19 bp, Homo sapiens
cttcagtatgttgtcaaag

SEQ ID NO: 6170189 - DNA, 22 bp, Homo sapiens
cttcagtatgttgtcaaagaga

SEQ ID NO: 6170190 - DNA, 14 bp, Homo sapiens
cttcagtcagggtt

SEQ ID NO: 6170191 - DNA, 18 bp, Homo sapiens
cttcagtcatcagccagc

SEQ ID NO: 6170192 - DNA, 16 bp, Homo sapiens
cttcagtcatggcatt

SEQ ID NO: 6170193 - DNA, 14 bp, Homo sapiens
cttcagtccctgag

SEQ ID NO: 6170194 - DNA, 22 bp, Homo sapiens
cttcagtcccttccccatgctt

SEQ ID NO: 6170195 - DNA, 11 bp, Homo sapiens
cttcagtcctg

SEQ ID NO: 6170196 - DNA, 12 bp, Homo sapiens
cttcagtcctgc

SEQ ID NO: 6170197 - DNA, 15 bp, Homo sapiens
cttcagtcctttgtc

SEQ ID NO: 6170198 - DNA, 17 bp, Homo sapiens
cttcagtcgtctgtccc

SEQ ID NO: 6170199 - DNA, 13 bp, Homo sapiens
cttcagtctctat

SEQ ID NO: 6170200 - DNA, 21 bp, Homo sapiens
cttcagtctctataccaataa

SEQ ID NO: 6170201 - DNA, 22 bp, Homo sapiens
cttcagtctctataccaataaa

SEQ ID NO: 6170202 - DNA, 15 bp, Homo sapiens
cttcagtctgctcca

SEQ ID NO: 6170203 - DNA, 18 bp, Homo sapiens
cttcagtctggactatat

SEQ ID NO: 6170204 - DNA, 23 bp, Homo sapiens
cttcagtgaatatttttgtattt

SEQ ID NO: 6170205 - DNA, 19 bp, Homo sapiens
cttcagtgactcctgctgg

SEQ ID NO: 6170206 - DNA, 21 bp, Homo sapiens
cttcagtgactcctgctggta

SEQ ID NO: 6170207 - DNA, 20 bp, Homo sapiens
cttcagtgagcccctcccca

SEQ ID NO: 6170208 - DNA, 14 bp, Homo sapiens
cttcagtgcaagag

SEQ ID NO: 6170209 - DNA, 18 bp, Homo sapiens
cttcagtgcaagagactt

SEQ ID NO: 6170210 - DNA, 15 bp, Homo sapiens
cttcagtgcccacca

SEQ ID NO: 6170211 - DNA, 14 bp, Homo sapiens
cttcagtgccttat

SEQ ID NO: 6170212 - DNA, 18 bp, Homo sapiens
cttcagtggcagctgctt

SEQ ID NO: 6170213 - DNA, 13 bp, Homo sapiens
cttcagtgggaga

SEQ ID NO: 6170214 - DNA, 17 bp, Homo sapiens
cttcagtgtatggaaat

SEQ ID NO: 6170215 - DNA, 16 bp, Homo sapiens
cttcagtgtctctgtt

SEQ ID NO: 6170216 - DNA, 18 bp, Homo sapiens
cttcagttaagcctttgg

SEQ ID NO: 6170217 - DNA, 17 bp, Homo sapiens
cttcagttattggtgga

SEQ ID NO: 6170218 - DNA, 14 bp, Homo sapiens
cttcagttctcatc

SEQ ID NO: 6170219 - DNA, 16 bp, Homo sapiens
cttcagttctcatctt

SEQ ID NO: 6170220 - DNA, 17 bp, Homo sapiens
cttcagttctcatcttg

SEQ ID NO: 6170221 - DNA, 22 bp, Homo sapiens
cttcagttctctactccctctt

SEQ ID NO: 6170222 - DNA, 14 bp, Homo sapiens
cttcagttctgctt

SEQ ID NO: 6170223 - DNA, 19 bp, Homo sapiens
cttcagttctgcttgctcc

SEQ ID NO: 6170224 - DNA, 20 bp, Homo sapiens
cttcagttggtgtgtttttg

SEQ ID NO: 6170225 - DNA, 14 bp, Homo sapiens
cttcagttgtggcc

SEQ ID NO: 6170226 - DNA, 11 bp, Homo sapiens
cttcagttgtt

SEQ ID NO: 6170227 - DNA, 14 bp, Homo sapiens
cttcagttgttttc

SEQ ID NO: 6170228 - DNA, 17 bp, Homo sapiens
cttcagtttaatgcaag

SEQ ID NO: 6170229 - DNA, 23 bp, Homo sapiens
cttcagtttaatgtctcctttgc

SEQ ID NO: 6170230 - DNA, 15 bp, Homo sapiens
cttcagtttcacaga

SEQ ID NO: 6170231 - DNA, 20 bp, Homo sapiens
cttcagtttcacagaaaata

SEQ ID NO: 6170232 - DNA, 21 bp, Homo sapiens
cttcagtttcattttcctgtg

SEQ ID NO: 6170233 - DNA, 20 bp, Homo sapiens
cttcagtttccgaatctctt

SEQ ID NO: 6170234 - DNA, 14 bp, Homo sapiens
cttcagtttgtaaa

SEQ ID NO: 6170235 - DNA, 14 bp, Homo sapiens
cttcagttttactg

SEQ ID NO: 6170236 - DNA, 21 bp, Homo sapiens
cttcagttttactgcattttc

SEQ ID NO: 6170237 - DNA, 16 bp, Homo sapiens
cttcagtttttgtgtt

SEQ ID NO: 6170238 - DNA, 16 bp, Homo sapiens
cttcataaaactcatg

SEQ ID NO: 6170239 - DNA, 15 bp, Homo sapiens
cttcataacaatttt

SEQ ID NO: 6170240 - DNA, 22 bp, Homo sapiens
cttcataagatattctttacaa

SEQ ID NO: 6170241 - DNA, 22 bp, Homo sapiens
cttcataattttcaaaagaaaa

SEQ ID NO: 6170242 - DNA, 9 bp, Homo sapiens
cttcataca

SEQ ID NO: 6170243 - DNA, 23 bp, Homo sapiens
cttcatacaaaggacagtacaca

SEQ ID NO: 6170244 - DNA, 16 bp, Homo sapiens
cttcatacagaaggca

SEQ ID NO: 6170245 - DNA, 18 bp, Homo sapiens
cttcataccgcctcgtgc

SEQ ID NO: 6170246 - DNA, 21 bp, Homo sapiens
cttcatactttttttcacagt

SEQ ID NO: 6170247 - DNA, 16 bp, Homo sapiens
cttcatagaatactca

SEQ ID NO: 6170248 - DNA, 22 bp, Homo sapiens
cttcatagatgcaggaggctca

SEQ ID NO: 6170249 - DNA, 16 bp, Homo sapiens
cttcatagctccttgg

SEQ ID NO: 6170250 - DNA, 20 bp, Homo sapiens
cttcataggcagagcccgcc

SEQ ID NO: 6170251 - DNA, 21 bp, Homo sapiens
cttcataggcggtcatgtgtg

SEQ ID NO: 6170252 - DNA, 22 bp, Homo sapiens
cttcataggcggtcatgtgtgc

SEQ ID NO: 6170253 - DNA, 17 bp, Homo sapiens
cttcatagggaccttta

SEQ ID NO: 6170254 - DNA, 21 bp, Homo sapiens
cttcatagggacctttaaaaa

SEQ ID NO: 6170255 - DNA, 17 bp, Homo sapiens
cttcatataactgagat

SEQ ID NO: 6170256 - DNA, 23 bp, Homo sapiens
cttcatatcctctcgttcagttt

SEQ ID NO: 6170257 - DNA, 14 bp, Homo sapiens
cttcatatctaatt

SEQ ID NO: 6170258 - DNA, 18 bp, Homo sapiens
cttcatatctctcccttc

SEQ ID NO: 6170259 - DNA, 23 bp, Homo sapiens
cttcatatgaaaggtgccatgga

SEQ ID NO: 6170260 - DNA, 20 bp, Homo sapiens
cttcatatgtcacctttgct

SEQ ID NO: 6170261 - DNA, 16 bp, Homo sapiens
cttcatattaatataa

SEQ ID NO: 6170262 - DNA, 20 bp, Homo sapiens
cttcatattctaaaaccatt

SEQ ID NO: 6170263 - DNA, 13 bp, Homo sapiens
cttcatattggct

SEQ ID NO: 6170264 - DNA, 14 bp, Homo sapiens
cttcatattttata

SEQ ID NO: 6170265 - DNA, 18 bp, Homo sapiens
cttcatatttttgatcat

SEQ ID NO: 6170266 - DNA, 18 bp, Homo sapiens
cttcatcaaaatcatgga

SEQ ID NO: 6170267 - DNA, 14 bp, Homo sapiens
cttcatcaagaaat

SEQ ID NO: 6170268 - DNA, 22 bp, Homo sapiens
cttcatcaatttttatacatat

SEQ ID NO: 6170269 - DNA, 20 bp, Homo sapiens
cttcatcagaactcttcctc

SEQ ID NO: 6170270 - DNA, 17 bp, Homo sapiens
cttcatcattccctctc

SEQ ID NO: 6170271 - DNA, 18 bp, Homo sapiens
cttcatccaatgtgaagt

SEQ ID NO: 6170272 - DNA, 20 bp, Homo sapiens
cttcatccacccatgtttat

SEQ ID NO: 6170273 - DNA, 14 bp, Homo sapiens
cttcatccatagac

SEQ ID NO: 6170274 - DNA, 21 bp, Homo sapiens
cttcatccatagacacagtat

SEQ ID NO: 6170275 - DNA, 12 bp, Homo sapiens
cttcatcccagc

SEQ ID NO: 6170276 - DNA, 13 bp, Homo sapiens
cttcatcccagct

SEQ ID NO: 6170277 - DNA, 15 bp, Homo sapiens
cttcatcccagctgc

SEQ ID NO: 6170278 - DNA, 17 bp, Homo sapiens
cttcatcccattccagg

SEQ ID NO: 6170279 - DNA, 15 bp, Homo sapiens
cttcatccctttcca

SEQ ID NO: 6170280 - DNA, 16 bp, Homo sapiens
cttcatccctttccag

SEQ ID NO: 6170281 - DNA, 19 bp, Homo sapiens
cttcatccggcagcctgga

SEQ ID NO: 6170282 - DNA, 15 bp, Homo sapiens
cttcatcctcctccc

SEQ ID NO: 6170283 - DNA, 19 bp, Homo sapiens
cttcatcctcctccccagc

SEQ ID NO: 6170284 - DNA, 11 bp, Homo sapiens
cttcatcctct

SEQ ID NO: 6170285 - DNA, 22 bp, Homo sapiens
ctgccccggcccctccccctga

SEQ ID NO: 6170286 - DNA, 18 bp, Homo sapiens
ctgccccgggtccccagc

SEQ ID NO: 6170287 - DNA, 18 bp, Homo sapiens
ctgccccgtcaccatctc

SEQ ID NO: 6170288 - DNA, 19 bp, Homo sapiens
ctgccccgtcaccatctca

SEQ ID NO: 6170289 - DNA, 21 bp, Homo sapiens
ctgccccgtcaccatctcagg

SEQ ID NO: 6170290 - DNA, 23 bp, Homo sapiens
ctgccccgtcccctgggccaccc

SEQ ID NO: 6170291 - DNA, 22 bp, Homo sapiens
ctgccccgtgcagactggaggg

SEQ ID NO: 6170292 - DNA, 18 bp, Homo sapiens
ctgccccgttccctgtca

SEQ ID NO: 6170293 - DNA, 20 bp, Homo sapiens
ctgccccgttccctgtcaga

SEQ ID NO: 6170294 - DNA, 21 bp, Homo sapiens
ctgccccgttccctgtcagag

SEQ ID NO: 6170295 - DNA, 21 bp, Homo sapiens
ctgcccctaccctggacttgc

SEQ ID NO: 6170296 - DNA, 13 bp, Homo sapiens
ctgcccctaggat

SEQ ID NO: 6170297 - DNA, 15 bp, Homo sapiens
ctgcccctcaccttg

SEQ ID NO: 6170298 - DNA, 12 bp, Homo sapiens
ctgcccctcact

SEQ ID NO: 6170299 - DNA, 13 bp, Homo sapiens
ctgcccctcactt

SEQ ID NO: 6170300 - DNA, 13 bp, Homo sapiens
ctgcccctcaggg

SEQ ID NO: 6170301 - DNA, 15 bp, Homo sapiens
ctgcccctcaggggg

SEQ ID NO: 6170302 - DNA, 21 bp, Homo sapiens
ctgcccctcagggggccagct

SEQ ID NO: 6170303 - DNA, 11 bp, Homo sapiens
ctgcccctccc

SEQ ID NO: 6170304 - DNA, 14 bp, Homo sapiens
ctgcccctccccca

SEQ ID NO: 6170305 - DNA, 16 bp, Homo sapiens
ctgcccctcccccact

SEQ ID NO: 6170306 - DNA, 14 bp, Homo sapiens
ctgcccctccccct

SEQ ID NO: 6170307 - DNA, 22 bp, Homo sapiens
ctgcccctccccctaccgcatg

SEQ ID NO: 6170308 - DNA, 14 bp, Homo sapiens
ctgcccctccctag

SEQ ID NO: 6170309 - DNA, 23 bp, Homo sapiens
ctgcccctccctagatccaggct

SEQ ID NO: 6170310 - DNA, 22 bp, Homo sapiens
ctgcccctccctgccagcaccc

SEQ ID NO: 6170311 - DNA, 14 bp, Homo sapiens
ctgcccctcccttc

SEQ ID NO: 6170312 - DNA, 18 bp, Homo sapiens
ctgcccctccgtccccag

SEQ ID NO: 6170313 - DNA, 19 bp, Homo sapiens
ctgcccctccgtccccagg

SEQ ID NO: 6170314 - DNA, 20 bp, Homo sapiens
ctgcccctccgtccccaggg

SEQ ID NO: 6170315 - DNA, 18 bp, Homo sapiens
ctgcccctcctctctgcc

SEQ ID NO: 6170316 - DNA, 19 bp, Homo sapiens
ctgcccctcctctctgccc

SEQ ID NO: 6170317 - DNA, 13 bp, Homo sapiens
ctgcccctcctgg

SEQ ID NO: 6170318 - DNA, 20 bp, Homo sapiens
ctgcccctcctggagcagaa

SEQ ID NO: 6170319 - DNA, 14 bp, Homo sapiens
ctgcccctcgcaca

SEQ ID NO: 6170320 - DNA, 15 bp, Homo sapiens
ctgcccctcgcacac

SEQ ID NO: 6170321 - DNA, 20 bp, Homo sapiens
ctgcccctcgcacacagggc

SEQ ID NO: 6170322 - DNA, 23 bp, Homo sapiens
ctgcccctcgcacacagggctca

SEQ ID NO: 6170323 - DNA, 13 bp, Homo sapiens
ctgcccctctcac

SEQ ID NO: 6170324 - DNA, 17 bp, Homo sapiens
ctgcccctctcaccaaa

SEQ ID NO: 6170325 - DNA, 14 bp, Homo sapiens
ctgcccctctccga

SEQ ID NO: 6170326 - DNA, 12 bp, Homo sapiens
ctgcccctctct

SEQ ID NO: 6170327 - DNA, 14 bp, Homo sapiens
ctgcccctctctgg

SEQ ID NO: 6170328 - DNA, 16 bp, Homo sapiens
ctgcccctctctgggc

SEQ ID NO: 6170329 - DNA, 18 bp, Homo sapiens
ctgcccctctctgggcct

SEQ ID NO: 6170330 - DNA, 22 bp, Homo sapiens
ctgcccctctctgggcctcaga

SEQ ID NO: 6170331 - DNA, 15 bp, Homo sapiens
ctgcccctctgttct

SEQ ID NO: 6170332 - DNA, 12 bp, Homo sapiens
ctgcccctcttt

SEQ ID NO: 6170333 - DNA, 13 bp, Homo sapiens
ctgcccctctttc

SEQ ID NO: 6170334 - DNA, 21 bp, Homo sapiens
ctgcccctgagttctgacact

SEQ ID NO: 6170335 - DNA, 14 bp, Homo sapiens
ctgcccctgcagct

SEQ ID NO: 6170336 - DNA, 15 bp, Homo sapiens
ctgcccctgcagctg

SEQ ID NO: 6170337 - DNA, 12 bp, Homo sapiens
ctgcccctgccc

SEQ ID NO: 6170338 - DNA, 13 bp, Homo sapiens
ctgcccctgcccc

SEQ ID NO: 6170339 - DNA, 14 bp, Homo sapiens
ctgcccctgccccg

SEQ ID NO: 6170340 - DNA, 16 bp, Homo sapiens
ctgcccctgcccgaga

SEQ ID NO: 6170341 - DNA, 17 bp, Homo sapiens
ctgcccctgcccgagag

SEQ ID NO: 6170342 - DNA, 12 bp, Homo sapiens
ctgcccctgcct

SEQ ID NO: 6170343 - DNA, 14 bp, Homo sapiens
ctgcccctgcctga

SEQ ID NO: 6170344 - DNA, 13 bp, Homo sapiens
ctgcccctgcgtg

SEQ ID NO: 6170345 - DNA, 22 bp, Homo sapiens
ctgcccctgctactgccaacct

SEQ ID NO: 6170346 - DNA, 15 bp, Homo sapiens
ctgcccctgctgctt

SEQ ID NO: 6170347 - DNA, 16 bp, Homo sapiens
ctgcccctgctgtgct

SEQ ID NO: 6170348 - DNA, 11 bp, Homo sapiens
ctgcccctggc

SEQ ID NO: 6170349 - DNA, 13 bp, Homo sapiens
ctgcccctggcac

SEQ ID NO: 6170350 - DNA, 19 bp, Homo sapiens
ctgcccctggcagcccctg

SEQ ID NO: 6170351 - DNA, 15 bp, Homo sapiens
ctgcccctgtccgga

SEQ ID NO: 6170352 - DNA, 17 bp, Homo sapiens
ctgcccctgtctggaag

SEQ ID NO: 6170353 - DNA, 18 bp, Homo sapiens
ctgcccctgtctggaaga

SEQ ID NO: 6170354 - DNA, 16 bp, Homo sapiens
ctgcccctgtgcctct

SEQ ID NO: 6170355 - DNA, 18 bp, Homo sapiens
ctgcccctgttctcttcc

SEQ ID NO: 6170356 - DNA, 13 bp, Homo sapiens
ctgcccctgttga

SEQ ID NO: 6170357 - DNA, 18 bp, Homo sapiens
ctgccccttaaccccaag

SEQ ID NO: 6170358 - DNA, 18 bp, Homo sapiens
ctgccccttctacactct

SEQ ID NO: 6170359 - DNA, 20 bp, Homo sapiens
ctgccccttctacactctcc

SEQ ID NO: 6170360 - DNA, 24 bp, Homo sapiens
ctgccccttctacactctcctggg

SEQ ID NO: 6170361 - DNA, 19 bp, Homo sapiens
ctgccccttgaccccacac

SEQ ID NO: 6170362 - DNA, 19 bp, Homo sapiens
ctgccccttgcaagccata

SEQ ID NO: 6170363 - DNA, 16 bp, Homo sapiens
ctgccccttgcttctc

SEQ ID NO: 6170364 - DNA, 17 bp, Homo sapiens
ctgccccttgcttctca

SEQ ID NO: 6170365 - DNA, 22 bp, Homo sapiens
ctgccccttggacacgctcagt

SEQ ID NO: 6170366 - DNA, 18 bp, Homo sapiens
ctgccccttgggcctccc

SEQ ID NO: 6170367 - DNA, 20 bp, Homo sapiens
ctgcccctttcttccccacc

SEQ ID NO: 6170368 - DNA, 23 bp, Homo sapiens
ctgcccgagagagaccccaccgc

SEQ ID NO: 6170369 - DNA, 16 bp, Homo sapiens
ctgcccgagagagctc

SEQ ID NO: 6170370 - DNA, 13 bp, Homo sapiens
ctgcccgagctgg

SEQ ID NO: 6170371 - DNA, 21 bp, Homo sapiens
ctgcccgagctggtgcattac

SEQ ID NO: 6170372 - DNA, 18 bp, Homo sapiens
ctgcccgagggcaggggc

SEQ ID NO: 6170373 - DNA, 22 bp, Homo sapiens
ctgcccgaggtcgctgcagccc

SEQ ID NO: 6170374 - DNA, 16 bp, Homo sapiens
ctgcccgatccagatt

SEQ ID NO: 6170375 - DNA, 21 bp, Homo sapiens
ctgcccgatccagattcccag

SEQ ID NO: 6170376 - DNA, 22 bp, Homo sapiens
ctgcccgatccagattcccagg

SEQ ID NO: 6170377 - DNA, 16 bp, Homo sapiens
ctgcccgcacagcagc

SEQ ID NO: 6170378 - DNA, 18 bp, Homo sapiens
ctgcccgcacagcagcct

SEQ ID NO: 6170379 - DNA, 16 bp, Homo sapiens
ctgcccgcaccctggc

SEQ ID NO: 6170380 - DNA, 19 bp, Homo sapiens
ctgcccgcaccctggcctg

SEQ ID NO: 6170381 - DNA, 17 bp, Homo sapiens
ctgcccgcagacctctg

SEQ ID NO: 6170382 - DNA, 17 bp, Homo sapiens
ctgcccgcagagcccac

SEQ ID NO: 6170383 - DNA, 22 bp, Homo sapiens
ctgcccgccacatggtgtggcc

SEQ ID NO: 6170384 - DNA, 18 bp, Homo sapiens
ctgcccgccccaagccct

SEQ ID NO: 6170385 - DNA, 13 bp, Homo sapiens
ctgcccgcccgcc

SEQ ID NO: 6170386 - DNA, 16 bp, Homo sapiens
ctgcccgcctgcccac

SEQ ID NO: 6170387 - DNA, 17 bp, Homo sapiens
ctgcccgcctgcccacc

SEQ ID NO: 6170388 - DNA, 19 bp, Homo sapiens
ctgcccgcctgcccacctg

SEQ ID NO: 6170389 - DNA, 13 bp, Homo sapiens
ctgcccgcgcccg

SEQ ID NO: 6170390 - DNA, 15 bp, Homo sapiens
ctgcccgcgcccgcc

SEQ ID NO: 6170391 - DNA, 14 bp, Homo sapiens
ctgcccgctcccag

SEQ ID NO: 6170392 - DNA, 18 bp, Homo sapiens
ctgcccgctgcaatgcct

SEQ ID NO: 6170393 - DNA, 23 bp, Homo sapiens
ctgcccggagcagcagcttctcc

SEQ ID NO: 6170394 - DNA, 18 bp, Homo sapiens
ctgcccgggagctcagga

SEQ ID NO: 6170395 - DNA, 19 bp, Homo sapiens
ctgcccgggcgcggccagc

SEQ ID NO: 6170396 - DNA, 21 bp, Homo sapiens
ctgcccgggcgcggccagccc

SEQ ID NO: 6170397 - DNA, 18 bp, Homo sapiens
ctgcccggggagctgcag

SEQ ID NO: 6170398 - DNA, 23 bp, Homo sapiens
ctgcccggggagctgcagagcag

SEQ ID NO: 6170399 - DNA, 15 bp, Homo sapiens
ctgcccggggcagct

SEQ ID NO: 6170400 - DNA, 21 bp, Homo sapiens
ctgcccggggcagctgccaga

SEQ ID NO: 6170401 - DNA, 22 bp, Homo sapiens
ctgcccggggcagctgccagag

SEQ ID NO: 6170402 - DNA, 20 bp, Homo sapiens
ctgcccggtgggggggcaga

SEQ ID NO: 6170403 - DNA, 21 bp, Homo sapiens
ctgcccggtggtttgccatgt

SEQ ID NO: 6170404 - DNA, 17 bp, Homo sapiens
ctgcccggttgccatgg

SEQ ID NO: 6170405 - DNA, 21 bp, Homo sapiens
ctgcccgtaaacacgcctgca

SEQ ID NO: 6170406 - DNA, 19 bp, Homo sapiens
ctgcccgtctctctcccat

SEQ ID NO: 6170407 - DNA, 23 bp, Homo sapiens
ctgcccgtctctctcccatggag

SEQ ID NO: 6170408 - DNA, 16 bp, Homo sapiens
ctgcccgtgaggaggg

SEQ ID NO: 6170409 - DNA, 16 bp, Homo sapiens
ctgcccgtgccctggt

SEQ ID NO: 6170410 - DNA, 19 bp, Homo sapiens
ctgcccgttgccgggcctg

SEQ ID NO: 6170411 - DNA, 21 bp, Homo sapiens
ctgcccgttgccgggcctgga

SEQ ID NO: 6170412 - DNA, 13 bp, Homo sapiens
ctgccctaacctg

SEQ ID NO: 6170413 - DNA, 17 bp, Homo sapiens
ctgccctaagcccccag

SEQ ID NO: 6170414 - DNA, 20 bp, Homo sapiens
ctgccctaatgcgcaggctg

SEQ ID NO: 6170415 - DNA, 18 bp, Homo sapiens
ctgccctacagaggtctc

SEQ ID NO: 6170416 - DNA, 16 bp, Homo sapiens
ctgccctacatatcta

SEQ ID NO: 6170417 - DNA, 16 bp, Homo sapiens
ctgccctactcactct

SEQ ID NO: 6170418 - DNA, 18 bp, Homo sapiens
ctgccctactgggagact

SEQ ID NO: 6170419 - DNA, 15 bp, Homo sapiens
ctgccctagagcaca

SEQ ID NO: 6170420 - DNA, 15 bp, Homo sapiens
ctgccctagctccac

SEQ ID NO: 6170421 - DNA, 22 bp, Homo sapiens
ctgccctagctccacaccctct

SEQ ID NO: 6170422 - DNA, 15 bp, Homo sapiens
ctgccctagctgacc

SEQ ID NO: 6170423 - DNA, 16 bp, Homo sapiens
ctgccctagctgaccc

SEQ ID NO: 6170424 - DNA, 20 bp, Homo sapiens
ctgccctaggatatgccctc

SEQ ID NO: 6170425 - DNA, 23 bp, Homo sapiens
ctgccctagttttctttcctcct

SEQ ID NO: 6170426 - DNA, 17 bp, Homo sapiens
ctgccctatgggcctgc

SEQ ID NO: 6170427 - DNA, 16 bp, Homo sapiens
ctgccctcaagagcaa

SEQ ID NO: 6170428 - DNA, 12 bp, Homo sapiens
ctgccctcactc

SEQ ID NO: 6170429 - DNA, 13 bp, Homo sapiens
ctgccctcactcc

SEQ ID NO: 6170430 - DNA, 14 bp, Homo sapiens
ctgccctcactcca

SEQ ID NO: 6170431 - DNA, 16 bp, Homo sapiens
ctgccctcactccact

SEQ ID NO: 6170432 - DNA, 19 bp, Homo sapiens
ctgccctcactccactccc

SEQ ID NO: 6170433 - DNA, 20 bp, Homo sapiens
ctgccctcactccactcccc

SEQ ID NO: 6170434 - DNA, 16 bp, Homo sapiens
ctgccctcagatgaaa

SEQ ID NO: 6170435 - DNA, 16 bp, Homo sapiens
ctgccctcagcacaga

SEQ ID NO: 6170436 - DNA, 19 bp, Homo sapiens
ctgccctccaagaccttct

SEQ ID NO: 6170437 - DNA, 16 bp, Homo sapiens
ctgccctccagggcca

SEQ ID NO: 6170438 - DNA, 19 bp, Homo sapiens
ctgccctccagggccagga

SEQ ID NO: 6170439 - DNA, 15 bp, Homo sapiens
ctgccctccatcccg

SEQ ID NO: 6170440 - DNA, 22 bp, Homo sapiens
ctgccctccatcccttccccag

SEQ ID NO: 6170441 - DNA, 15 bp, Homo sapiens
ctgccctcccaagtc

SEQ ID NO: 6170442 - DNA, 19 bp, Homo sapiens
ctgccctcccacagcctcc

SEQ ID NO: 6170443 - DNA, 22 bp, Homo sapiens
ctgccctcccaccccctccccg

SEQ ID NO: 6170444 - DNA, 21 bp, Homo sapiens
ctgccctcccacctccgctgg

SEQ ID NO: 6170445 - DNA, 14 bp, Homo sapiens
ctgccctcccccac

SEQ ID NO: 6170446 - DNA, 16 bp, Homo sapiens
ctgccctcccccacgg

SEQ ID NO: 6170447 - DNA, 17 bp, Homo sapiens
ctgccctcccccacggc

SEQ ID NO: 6170448 - DNA, 18 bp, Homo sapiens
ctgccctcccccacggcc

SEQ ID NO: 6170449 - DNA, 21 bp, Homo sapiens
ctgccctcccccacggccgtc

SEQ ID NO: 6170450 - DNA, 22 bp, Homo sapiens
ctgccctcccccacggccgtcc

SEQ ID NO: 6170451 - DNA, 17 bp, Homo sapiens
ctgccctccccttcccc

SEQ ID NO: 6170452 - DNA, 15 bp, Homo sapiens
ctgccctcccgcacc

SEQ ID NO: 6170453 - DNA, 17 bp, Homo sapiens
ctgccctcccgcacctt

SEQ ID NO: 6170454 - DNA, 23 bp, Homo sapiens
ctgccctcccgcaccttcctcct

SEQ ID NO: 6170455 - DNA, 20 bp, Homo sapiens
ctgccctccctcggccccac

SEQ ID NO: 6170456 - DNA, 17 bp, Homo sapiens
ctgccctccctggcctc

SEQ ID NO: 6170457 - DNA, 21 bp, Homo sapiens
ctgccctccgaagagagttct

SEQ ID NO: 6170458 - DNA, 21 bp, Homo sapiens
ctgccctccgccccgtccccc

SEQ ID NO: 6170459 - DNA, 14 bp, Homo sapiens
ctgccctccggagg

SEQ ID NO: 6170460 - DNA, 19 bp, Homo sapiens
ctgccctccggaggagcag

SEQ ID NO: 6170461 - DNA, 23 bp, Homo sapiens
ctgccctccggaggagcagcctc

SEQ ID NO: 6170462 - DNA, 12 bp, Homo sapiens
ctgccctcctgc

SEQ ID NO: 6170463 - DNA, 19 bp, Homo sapiens
cttcatcgtggggctctca

SEQ ID NO: 6170464 - DNA, 16 bp, Homo sapiens
cttcatctaatatgat

SEQ ID NO: 6170465 - DNA, 17 bp, Homo sapiens
cttcatctccagggagt

SEQ ID NO: 6170466 - DNA, 22 bp, Homo sapiens
cttcatctcccaaagtgctggg

SEQ ID NO: 6170467 - DNA, 15 bp, Homo sapiens
cttcatctccctgcc

SEQ ID NO: 6170468 - DNA, 23 bp, Homo sapiens
cttcatctccctgccatccccct

SEQ ID NO: 6170469 - DNA, 15 bp, Homo sapiens
cttcatctctttaga

SEQ ID NO: 6170470 - DNA, 12 bp, Homo sapiens
cttcatctgcca

SEQ ID NO: 6170471 - DNA, 15 bp, Homo sapiens
cttcatctgcccaac

SEQ ID NO: 6170472 - DNA, 12 bp, Homo sapiens
cttcatctggaa

SEQ ID NO: 6170473 - DNA, 13 bp, Homo sapiens
cttcatctggagt

SEQ ID NO: 6170474 - DNA, 19 bp, Homo sapiens
cttcatctggagtccctcc

SEQ ID NO: 6170475 - DNA, 20 bp, Homo sapiens
cttcatctggctgcctttgc

SEQ ID NO: 6170476 - DNA, 12 bp, Homo sapiens
cttcatcttccc

SEQ ID NO: 6170477 - DNA, 13 bp, Homo sapiens
cttcatcttcctg

SEQ ID NO: 6170478 - DNA, 19 bp, Homo sapiens
cttcatcttcctgtgtcct

SEQ ID NO: 6170479 - DNA, 17 bp, Homo sapiens
cttcatcttctcagctc

SEQ ID NO: 6170480 - DNA, 12 bp, Homo sapiens
cttcatcttgac

SEQ ID NO: 6170481 - DNA, 12 bp, Homo sapiens
cttcatctttta

SEQ ID NO: 6170482 - DNA, 17 bp, Homo sapiens
cttcatgaaaatcctac

SEQ ID NO: 6170483 - DNA, 18 bp, Homo sapiens
cttcatgaaaatcctacc

SEQ ID NO: 6170484 - DNA, 13 bp, Homo sapiens
cttcatgaaatgc

SEQ ID NO: 6170485 - DNA, 15 bp, Homo sapiens
cttcatgaaatgtgt

SEQ ID NO: 6170486 - DNA, 16 bp, Homo sapiens
cttcatgaatctttca

SEQ ID NO: 6170487 - DNA, 16 bp, Homo sapiens
cttcatgacagcctcc

SEQ ID NO: 6170488 - DNA, 13 bp, Homo sapiens
cttcatgcactta

SEQ ID NO: 6170489 - DNA, 20 bp, Homo sapiens
cttcatgcataggtttagca

SEQ ID NO: 6170490 - DNA, 13 bp, Homo sapiens
cttcatgcatgga

SEQ ID NO: 6170491 - DNA, 22 bp, Homo sapiens
cttcatgcattacttactgtta

SEQ ID NO: 6170492 - DNA, 14 bp, Homo sapiens
cttcatgccagcta

SEQ ID NO: 6170493 - DNA, 15 bp, Homo sapiens
cttcatgccagctac

SEQ ID NO: 6170494 - DNA, 15 bp, Homo sapiens
cttcatgccagtgca

SEQ ID NO: 6170495 - DNA, 13 bp, Homo sapiens
cttcatgcccact

SEQ ID NO: 6170496 - DNA, 17 bp, Homo sapiens
cttcatgcccactgccg

SEQ ID NO: 6170497 - DNA, 11 bp, Homo sapiens
cttcatgcctc

SEQ ID NO: 6170498 - DNA, 17 bp, Homo sapiens
cttcatgcctcagtttc

SEQ ID NO: 6170499 - DNA, 14 bp, Homo sapiens
cttcatgcctttgt

SEQ ID NO: 6170500 - DNA, 19 bp, Homo sapiens
cttcatgcctttgtaagtt

SEQ ID NO: 6170501 - DNA, 17 bp, Homo sapiens
cttcatgcttgacatac

SEQ ID NO: 6170502 - DNA, 19 bp, Homo sapiens
cttcatgcttgacatacct

SEQ ID NO: 6170503 - DNA, 20 bp, Homo sapiens
cttcatgcttttgcttgcaa

SEQ ID NO: 6170504 - DNA, 14 bp, Homo sapiens
cttcatggaactca

SEQ ID NO: 6170505 - DNA, 20 bp, Homo sapiens
cttcatggaatggacatcct

SEQ ID NO: 6170506 - DNA, 13 bp, Homo sapiens
cttcatggaccaa

SEQ ID NO: 6170507 - DNA, 22 bp, Homo sapiens
cttcatggaccaagaatgagct

SEQ ID NO: 6170508 - DNA, 10 bp, Homo sapiens
cttcatggat

SEQ ID NO: 6170509 - DNA, 13 bp, Homo sapiens
cttcatggatggg

SEQ ID NO: 6170510 - DNA, 15 bp, Homo sapiens
cttcatggcagaagg

SEQ ID NO: 6170511 - DNA, 19 bp, Homo sapiens
cttcatggcagtaattctc

SEQ ID NO: 6170512 - DNA, 12 bp, Homo sapiens
cttcatggtctc

SEQ ID NO: 6170513 - DNA, 17 bp, Homo sapiens
cttcatggtctcttcca

SEQ ID NO: 6170514 - DNA, 22 bp, Homo sapiens
cttcatgtaaattgactgtact

SEQ ID NO: 6170515 - DNA, 20 bp, Homo sapiens
cttcatgtcattaatcaatt

SEQ ID NO: 6170516 - DNA, 15 bp, Homo sapiens
cttcatgtccagtga

SEQ ID NO: 6170517 - DNA, 14 bp, Homo sapiens
cttcatgtcctaaa

SEQ ID NO: 6170518 - DNA, 18 bp, Homo sapiens
cttcatgtcctaaagaag

SEQ ID NO: 6170519 - DNA, 22 bp, Homo sapiens
cttcatgtctattccattccct

SEQ ID NO: 6170520 - DNA, 16 bp, Homo sapiens
cttcatgtgatgtcat

SEQ ID NO: 6170521 - DNA, 10 bp, Homo sapiens
cttcatgtgg

SEQ ID NO: 6170522 - DNA, 13 bp, Homo sapiens
cttcatgtgtccc

SEQ ID NO: 6170523 - DNA, 15 bp, Homo sapiens
cttcatgttcccact

SEQ ID NO: 6170524 - DNA, 20 bp, Homo sapiens
cttcatgttcccacttcaaa

SEQ ID NO: 6170525 - DNA, 14 bp, Homo sapiens
cttcattaaatgtt

SEQ ID NO: 6170526 - DNA, 20 bp, Homo sapiens
cttcattaagccctcttcca

SEQ ID NO: 6170527 - DNA, 18 bp, Homo sapiens
cttcattaatttcaatca

SEQ ID NO: 6170528 - DNA, 23 bp, Homo sapiens
cttcattaatttcaatcaaccaa

SEQ ID NO: 6170529 - DNA, 18 bp, Homo sapiens
cttcattattttaaaaat

SEQ ID NO: 6170530 - DNA, 14 bp, Homo sapiens
cttcattcaagctt

SEQ ID NO: 6170531 - DNA, 21 bp, Homo sapiens
cttcattcaagtcagctcttc

SEQ ID NO: 6170532 - DNA, 22 bp, Homo sapiens
cttcattcaagtctatgatgct

SEQ ID NO: 6170533 - DNA, 13 bp, Homo sapiens
cttcattccagca

SEQ ID NO: 6170534 - DNA, 14 bp, Homo sapiens
cttcattccattga

SEQ ID NO: 6170535 - DNA, 13 bp, Homo sapiens
cttcattcccact

SEQ ID NO: 6170536 - DNA, 14 bp, Homo sapiens
cttcattccggact

SEQ ID NO: 6170537 - DNA, 20 bp, Homo sapiens
cttcattctaaaccaaaaca

SEQ ID NO: 6170538 - DNA, 15 bp, Homo sapiens
cttcattctggaaac

SEQ ID NO: 6170539 - DNA, 18 bp, Homo sapiens
cttcattctttactgcac

SEQ ID NO: 6170540 - DNA, 21 bp, Homo sapiens
cttcattctttactgcactca

SEQ ID NO: 6170541 - DNA, 15 bp, Homo sapiens
cttcattctttgcag

SEQ ID NO: 6170542 - DNA, 21 bp, Homo sapiens
cttcattgagagttttgtctt

SEQ ID NO: 6170543 - DNA, 18 bp, Homo sapiens
cttcattgatttcctgtg

SEQ ID NO: 6170544 - DNA, 19 bp, Homo sapiens
cttcattgccttaactgga

SEQ ID NO: 6170545 - DNA, 23 bp, Homo sapiens
cttcattgtactacctgtgtata

SEQ ID NO: 6170546 - DNA, 11 bp, Homo sapiens
cttcattgttt

SEQ ID NO: 6170547 - DNA, 23 bp, Homo sapiens
cttcattgtttggacctgcatat

SEQ ID NO: 6170548 - DNA, 13 bp, Homo sapiens
cttcatttaaaaa

SEQ ID NO: 6170549 - DNA, 18 bp, Homo sapiens
cttcatttaaactaaatt

SEQ ID NO: 6170550 - DNA, 22 bp, Homo sapiens
cttcatttaaactaaattactg

SEQ ID NO: 6170551 - DNA, 21 bp, Homo sapiens
cttcatttaacactgagtgaa

SEQ ID NO: 6170552 - DNA, 15 bp, Homo sapiens
cttcatttaactctt

SEQ ID NO: 6170553 - DNA, 22 bp, Homo sapiens
cttcatttaactctttgaaact

SEQ ID NO: 6170554 - DNA, 13 bp, Homo sapiens
cttcatttcaatc

SEQ ID NO: 6170555 - DNA, 16 bp, Homo sapiens
cttcatttcaatcatt

SEQ ID NO: 6170556 - DNA, 16 bp, Homo sapiens
cttcatttccaccagg

SEQ ID NO: 6170557 - DNA, 14 bp, Homo sapiens
cttcatttcctccg

SEQ ID NO: 6170558 - DNA, 18 bp, Homo sapiens
cttcatttctatagccaa

SEQ ID NO: 6170559 - DNA, 13 bp, Homo sapiens
cttcatttctctg

SEQ ID NO: 6170560 - DNA, 14 bp, Homo sapiens
cttcatttctctgc

SEQ ID NO: 6170561 - DNA, 21 bp, Homo sapiens
cttcatttctctttttatctc

SEQ ID NO: 6170562 - DNA, 19 bp, Homo sapiens
cttcatttctgatatagaa

SEQ ID NO: 6170563 - DNA, 14 bp, Homo sapiens
cttcatttgcaatt

SEQ ID NO: 6170564 - DNA, 11 bp, Homo sapiens
cttcatttgta

SEQ ID NO: 6170565 - DNA, 13 bp, Homo sapiens
cttcatttgtgtc

SEQ ID NO: 6170566 - DNA, 18 bp, Homo sapiens
cttcatttgtgtcaatgg

SEQ ID NO: 6170567 - DNA, 22 bp, Homo sapiens
cttcattttagattaagctttt

SEQ ID NO: 6170568 - DNA, 22 bp, Homo sapiens
cttcattttaggaataataaat

SEQ ID NO: 6170569 - DNA, 15 bp, Homo sapiens
cttcattttcagagt

SEQ ID NO: 6170570 - DNA, 17 bp, Homo sapiens
cttcattttcagagtga

SEQ ID NO: 6170571 - DNA, 20 bp, Homo sapiens
cttcattttcaggaaatcta

SEQ ID NO: 6170572 - DNA, 21 bp, Homo sapiens
cttcattttcaggaaatctac

SEQ ID NO: 6170573 - DNA, 14 bp, Homo sapiens
cttcattttcatta

SEQ ID NO: 6170574 - DNA, 12 bp, Homo sapiens
cttcattttccc

SEQ ID NO: 6170575 - DNA, 23 bp, Homo sapiens
cttcattttggtttatttttgta

SEQ ID NO: 6170576 - DNA, 13 bp, Homo sapiens
cttcattttgtat

SEQ ID NO: 6170577 - DNA, 13 bp, Homo sapiens
cttcatttttcct

SEQ ID NO: 6170578 - DNA, 14 bp, Homo sapiens
cttcatttttgtaa

SEQ ID NO: 6170579 - DNA, 23 bp, Homo sapiens
cttcattttttaatgtgctctgt

SEQ ID NO: 6170580 - DNA, 17 bp, Homo sapiens
cttccaaaaattattat

SEQ ID NO: 6170581 - DNA, 19 bp, Homo sapiens
cttccaaaacctgcttcct

SEQ ID NO: 6170582 - DNA, 15 bp, Homo sapiens
cttccaaaattctta

SEQ ID NO: 6170583 - DNA, 22 bp, Homo sapiens
cttccaaagaatgttagagcac

SEQ ID NO: 6170584 - DNA, 22 bp, Homo sapiens
cttccaaagactccctccatag

SEQ ID NO: 6170585 - DNA, 22 bp, Homo sapiens
cttccaaagagggatgtttgga

SEQ ID NO: 6170586 - DNA, 16 bp, Homo sapiens
cttccaaaggcagcgt

SEQ ID NO: 6170587 - DNA, 17 bp, Homo sapiens
cttccaaatcaggctgg

SEQ ID NO: 6170588 - DNA, 16 bp, Homo sapiens
cttccaaatcctggaa

SEQ ID NO: 6170589 - DNA, 21 bp, Homo sapiens
cttccaaatttgaatggatta

SEQ ID NO: 6170590 - DNA, 17 bp, Homo sapiens
cttccaaatttggctca

SEQ ID NO: 6170591 - DNA, 21 bp, Homo sapiens
cttccaacaaaagaaggtcaa

SEQ ID NO: 6170592 - DNA, 13 bp, Homo sapiens
cttccaacacatt

SEQ ID NO: 6170593 - DNA, 16 bp, Homo sapiens
cttccaacacatttca

SEQ ID NO: 6170594 - DNA, 15 bp, Homo sapiens
cttccaacactccat

SEQ ID NO: 6170595 - DNA, 20 bp, Homo sapiens
cttccaacatatatttattg

SEQ ID NO: 6170596 - DNA, 19 bp, Homo sapiens
cttccaacccattagccat

SEQ ID NO: 6170597 - DNA, 16 bp, Homo sapiens
cttccaaccccagctg

SEQ ID NO: 6170598 - DNA, 19 bp, Homo sapiens
cttccaaccccagctggcc

SEQ ID NO: 6170599 - DNA, 14 bp, Homo sapiens
cttccaagaaaaat

SEQ ID NO: 6170600 - DNA, 16 bp, Homo sapiens
cttccaagaaaaataa

SEQ ID NO: 6170601 - DNA, 13 bp, Homo sapiens
cttccaagacctg

SEQ ID NO: 6170602 - DNA, 16 bp, Homo sapiens
cttccaagcaaaggtg

SEQ ID NO: 6170603 - DNA, 22 bp, Homo sapiens
cttccaagcccttccctctgtt

SEQ ID NO: 6170604 - DNA, 15 bp, Homo sapiens
cttccaaggagacca

SEQ ID NO: 6170605 - DNA, 15 bp, Homo sapiens
cttccaaggccagaa

SEQ ID NO: 6170606 - DNA, 15 bp, Homo sapiens
cttccaaggtggtct

SEQ ID NO: 6170607 - DNA, 20 bp, Homo sapiens
cttccaaggtggtctgctcg

SEQ ID NO: 6170608 - DNA, 16 bp, Homo sapiens
cttccaatcttgcttt

SEQ ID NO: 6170609 - DNA, 15 bp, Homo sapiens
cttccaatgtctgga

SEQ ID NO: 6170610 - DNA, 16 bp, Homo sapiens
cttccaatgtctggag

SEQ ID NO: 6170611 - DNA, 15 bp, Homo sapiens
cttccacaagagccc

SEQ ID NO: 6170612 - DNA, 16 bp, Homo sapiens
cttccacaagagccca

SEQ ID NO: 6170613 - DNA, 19 bp, Homo sapiens
cttccacaagagcccaggc

SEQ ID NO: 6170614 - DNA, 18 bp, Homo sapiens
cttccacaagagtgaatt

SEQ ID NO: 6170615 - DNA, 22 bp, Homo sapiens
cttccacagcacaaacacacct

SEQ ID NO: 6170616 - DNA, 13 bp, Homo sapiens
cttccacagcagc

SEQ ID NO: 6170617 - DNA, 23 bp, Homo sapiens
cttccacagggtcccacagccac

SEQ ID NO: 6170618 - DNA, 23 bp, Homo sapiens
cttccacagtggcgggcccactc

SEQ ID NO: 6170619 - DNA, 13 bp, Homo sapiens
cttccacatgtac

SEQ ID NO: 6170620 - DNA, 14 bp, Homo sapiens
cttccacatgtaca

SEQ ID NO: 6170621 - DNA, 15 bp, Homo sapiens
cttccacatgtacat

SEQ ID NO: 6170622 - DNA, 16 bp, Homo sapiens
cttccacatgtacata

SEQ ID NO: 6170623 - DNA, 12 bp, Homo sapiens
cttccacatttt

SEQ ID NO: 6170624 - DNA, 15 bp, Homo sapiens
cttccacattttccc

SEQ ID NO: 6170625 - DNA, 23 bp, Homo sapiens
cttccaccaagttggaacatcct

SEQ ID NO: 6170626 - DNA, 13 bp, Homo sapiens
cttccaccagagc

SEQ ID NO: 6170627 - DNA, 21 bp, Homo sapiens
cttccaccagagcaggggctg

SEQ ID NO: 6170628 - DNA, 12 bp, Homo sapiens
cttccaccagcc

SEQ ID NO: 6170629 - DNA, 13 bp, Homo sapiens
cttccaccagcct

SEQ ID NO: 6170630 - DNA, 21 bp, Homo sapiens
cttccaccagcctgcactact

SEQ ID NO: 6170631 - DNA, 15 bp, Homo sapiens
cttccacccacaaac

SEQ ID NO: 6170632 - DNA, 22 bp, Homo sapiens
cttccacccacaaactccaggc

SEQ ID NO: 6170633 - DNA, 13 bp, Homo sapiens
cttccacccaggg

SEQ ID NO: 6170634 - DNA, 21 bp, Homo sapiens
cttccacccattcccccatgt

SEQ ID NO: 6170635 - DNA, 18 bp, Homo sapiens
cttccacccccagctcct

SEQ ID NO: 6170636 - DNA, 22 bp, Homo sapiens
cttccacccccgttagcttcct

SEQ ID NO: 6170637 - DNA, 18 bp, Homo sapiens
cttccacccgtctctctg

SEQ ID NO: 6170638 - DNA, 16 bp, Homo sapiens
cttccaccctgccctg

SEQ ID NO: 6170639 - DNA, 19 bp, Homo sapiens
cttccaccctgccctggcc

SEQ ID NO: 6170640 - DNA, 20 bp, Homo sapiens
cttccaccctgccctggcct

SEQ ID NO: 6170641 - DNA, 21 bp, Homo sapiens
cttccaccctgccctggccta

SEQ ID NO: 6170642 - DNA, 15 bp, Homo sapiens
cttccaccggcactc

SEQ ID NO: 6170643 - DNA, 18 bp, Homo sapiens
cttccaccggcactcatg

SEQ ID NO: 6170644 - DNA, 13 bp, Homo sapiens
ctgccctcctgcc

SEQ ID NO: 6170645 - DNA, 20 bp, Homo sapiens
ctgccctcgggtggggctgg

SEQ ID NO: 6170646 - DNA, 16 bp, Homo sapiens
ctgccctcgtggccag

SEQ ID NO: 6170647 - DNA, 18 bp, Homo sapiens
ctgccctcgtggccagcc

SEQ ID NO: 6170648 - DNA, 12 bp, Homo sapiens
ctgccctctaga

SEQ ID NO: 6170649 - DNA, 20 bp, Homo sapiens
ctgccctctagagccttcag

SEQ ID NO: 6170650 - DNA, 17 bp, Homo sapiens
ctgccctctccacaccc

SEQ ID NO: 6170651 - DNA, 19 bp, Homo sapiens
ctgccctctccacacccat

SEQ ID NO: 6170652 - DNA, 16 bp, Homo sapiens
ctgccctctcctgggc

SEQ ID NO: 6170653 - DNA, 20 bp, Homo sapiens
ctgccctctcctgggcagct

SEQ ID NO: 6170654 - DNA, 14 bp, Homo sapiens
ctgccctctctgcg

SEQ ID NO: 6170655 - DNA, 11 bp, Homo sapiens
ctgccctctgc

SEQ ID NO: 6170656 - DNA, 13 bp, Homo sapiens
ctgccctctgccc

SEQ ID NO: 6170657 - DNA, 16 bp, Homo sapiens
ctgccctctgccccat

SEQ ID NO: 6170658 - DNA, 19 bp, Homo sapiens
ctgccctctgctctgcctg

SEQ ID NO: 6170659 - DNA, 13 bp, Homo sapiens
ctgccctctgctg

SEQ ID NO: 6170660 - DNA, 14 bp, Homo sapiens
ctgccctctgctgc

SEQ ID NO: 6170661 - DNA, 15 bp, Homo sapiens
ctgccctctgggtcc

SEQ ID NO: 6170662 - DNA, 11 bp, Homo sapiens
ctgccctgaga

SEQ ID NO: 6170663 - DNA, 21 bp, Homo sapiens
ctgccctgagaagctgctcca

SEQ ID NO: 6170664 - DNA, 14 bp, Homo sapiens
ctgccctgaggagg

SEQ ID NO: 6170665 - DNA, 19 bp, Homo sapiens
ctgccctgaggagggccct

SEQ ID NO: 6170666 - DNA, 15 bp, Homo sapiens
ctgccctgaggggct

SEQ ID NO: 6170667 - DNA, 23 bp, Homo sapiens
ctgccctgaggggctggggaggg

SEQ ID NO: 6170668 - DNA, 11 bp, Homo sapiens
ctgccctgcaa

SEQ ID NO: 6170669 - DNA, 15 bp, Homo sapiens
ctgccctgcaaaccg

SEQ ID NO: 6170670 - DNA, 20 bp, Homo sapiens
ctgccctgcaaaccgtgagg

SEQ ID NO: 6170671 - DNA, 20 bp, Homo sapiens
ctgccctgcaccttgggcac

SEQ ID NO: 6170672 - DNA, 20 bp, Homo sapiens
ctgccctgcacgtcatggga

SEQ ID NO: 6170673 - DNA, 11 bp, Homo sapiens
ctgccctgcca

SEQ ID NO: 6170674 - DNA, 13 bp, Homo sapiens
ctgccctgccacc

SEQ ID NO: 6170675 - DNA, 16 bp, Homo sapiens
ctgccctgccacctgt

SEQ ID NO: 6170676 - DNA, 17 bp, Homo sapiens
ctgccctgccacctgtc

SEQ ID NO: 6170677 - DNA, 14 bp, Homo sapiens
ctgccctgcccaag

SEQ ID NO: 6170678 - DNA, 14 bp, Homo sapiens
ctgccctgcccacc

SEQ ID NO: 6170679 - DNA, 15 bp, Homo sapiens
ctgccctgcccacct

SEQ ID NO: 6170680 - DNA, 16 bp, Homo sapiens
ctgccctgcccacctg

SEQ ID NO: 6170681 - DNA, 21 bp, Homo sapiens
ctgccctgcccacctggcctc

SEQ ID NO: 6170682 - DNA, 13 bp, Homo sapiens
ctgccctgcccag

SEQ ID NO: 6170683 - DNA, 16 bp, Homo sapiens
ctgccctgcccaggta

SEQ ID NO: 6170684 - DNA, 22 bp, Homo sapiens
ctgccctgcccatactgagcct

SEQ ID NO: 6170685 - DNA, 23 bp, Homo sapiens
ctgccctgccccaccccacctca

SEQ ID NO: 6170686 - DNA, 13 bp, Homo sapiens
ctgccctgccccc

SEQ ID NO: 6170687 - DNA, 18 bp, Homo sapiens
ctgccctgccctagctcc

SEQ ID NO: 6170688 - DNA, 14 bp, Homo sapiens
ctgccctgccctgg

SEQ ID NO: 6170689 - DNA, 17 bp, Homo sapiens
ctgccctgccctggcca

SEQ ID NO: 6170690 - DNA, 17 bp, Homo sapiens
ctgccctgcctcagcca

SEQ ID NO: 6170691 - DNA, 14 bp, Homo sapiens
ctgccctgcctccc

SEQ ID NO: 6170692 - DNA, 15 bp, Homo sapiens
ctgccctgcctccct

SEQ ID NO: 6170693 - DNA, 21 bp, Homo sapiens
ctgccctgcctccctttctgg

SEQ ID NO: 6170694 - DNA, 16 bp, Homo sapiens
ctgccctgcctgaggg

SEQ ID NO: 6170695 - DNA, 15 bp, Homo sapiens
ctgccctgcctgccc

SEQ ID NO: 6170696 - DNA, 16 bp, Homo sapiens
ctgccctgcctgccca

SEQ ID NO: 6170697 - DNA, 17 bp, Homo sapiens
ctgccctgcctgcccac

SEQ ID NO: 6170698 - DNA, 18 bp, Homo sapiens
ctgccctgcctgggcctt

SEQ ID NO: 6170699 - DNA, 12 bp, Homo sapiens
ctgccctgcctt

SEQ ID NO: 6170700 - DNA, 13 bp, Homo sapiens
ctgccctgccttg

SEQ ID NO: 6170701 - DNA, 11 bp, Homo sapiens
ctgccctgcta

SEQ ID NO: 6170702 - DNA, 16 bp, Homo sapiens
ctgccctgctctgccc

SEQ ID NO: 6170703 - DNA, 14 bp, Homo sapiens
ctgccctgctgcca

SEQ ID NO: 6170704 - DNA, 16 bp, Homo sapiens
ctgccctgctgccaca

SEQ ID NO: 6170705 - DNA, 22 bp, Homo sapiens
ctgccctgctgccgcctcccag

SEQ ID NO: 6170706 - DNA, 12 bp, Homo sapiens
ctgccctggaaa

SEQ ID NO: 6170707 - DNA, 12 bp, Homo sapiens
ctgccctggagg

SEQ ID NO: 6170708 - DNA, 15 bp, Homo sapiens
ctgccctggcagcag

SEQ ID NO: 6170709 - DNA, 16 bp, Homo sapiens
ctgccctggcagcagc

SEQ ID NO: 6170710 - DNA, 18 bp, Homo sapiens
ctgccctggcagcagcag

SEQ ID NO: 6170711 - DNA, 17 bp, Homo sapiens
ctgccctggccccagcc

SEQ ID NO: 6170712 - DNA, 16 bp, Homo sapiens
ctgccctggccctgag

SEQ ID NO: 6170713 - DNA, 17 bp, Homo sapiens
ctgccctggccctgagg

SEQ ID NO: 6170714 - DNA, 23 bp, Homo sapiens
ctgccctggccctgaggtgtggg

SEQ ID NO: 6170715 - DNA, 12 bp, Homo sapiens
ctgccctggcct

SEQ ID NO: 6170716 - DNA, 18 bp, Homo sapiens
ctgccctggcctaccaca

SEQ ID NO: 6170717 - DNA, 21 bp, Homo sapiens
ctgccctggcctaccacagct

SEQ ID NO: 6170718 - DNA, 15 bp, Homo sapiens
ctgccctggctccag

SEQ ID NO: 6170719 - DNA, 15 bp, Homo sapiens
ctgccctggctgtgg

SEQ ID NO: 6170720 - DNA, 11 bp, Homo sapiens
ctgccctggga

SEQ ID NO: 6170721 - DNA, 13 bp, Homo sapiens
ctgccctgggagg

SEQ ID NO: 6170722 - DNA, 13 bp, Homo sapiens
ctgccctgggctc

SEQ ID NO: 6170723 - DNA, 19 bp, Homo sapiens
ctgccctgggctcctctta

SEQ ID NO: 6170724 - DNA, 16 bp, Homo sapiens
ctgccctggggcatca

SEQ ID NO: 6170725 - DNA, 14 bp, Homo sapiens
ctgccctgggtcct

SEQ ID NO: 6170726 - DNA, 19 bp, Homo sapiens
ctgccctgggtcctgcctg

SEQ ID NO: 6170727 - DNA, 20 bp, Homo sapiens
ctgccctgggtcctgcctgc

SEQ ID NO: 6170728 - DNA, 15 bp, Homo sapiens
ctgccctggtccagg

SEQ ID NO: 6170729 - DNA, 21 bp, Homo sapiens
ctgccctggtccagggaagct

SEQ ID NO: 6170730 - DNA, 23 bp, Homo sapiens
ctgccctggtccagggaagctgg

SEQ ID NO: 6170731 - DNA, 13 bp, Homo sapiens
ctgccctggtgct

SEQ ID NO: 6170732 - DNA, 14 bp, Homo sapiens
ctgccctggtgctg

SEQ ID NO: 6170733 - DNA, 16 bp, Homo sapiens
ctgccctggtgctgcc

SEQ ID NO: 6170734 - DNA, 17 bp, Homo sapiens
ctgccctggtgctgcca

SEQ ID NO: 6170735 - DNA, 18 bp, Homo sapiens
ctgccctggtggccctct

SEQ ID NO: 6170736 - DNA, 21 bp, Homo sapiens
ctgccctggtttcctgccctg

SEQ ID NO: 6170737 - DNA, 22 bp, Homo sapiens
ctgccctggtttcctgccctgg

SEQ ID NO: 6170738 - DNA, 13 bp, Homo sapiens
ctgccctgtatat

SEQ ID NO: 6170739 - DNA, 17 bp, Homo sapiens
ctgccctgtcaggaggc

SEQ ID NO: 6170740 - DNA, 20 bp, Homo sapiens
ctgccctgtcaggaggcaga

SEQ ID NO: 6170741 - DNA, 17 bp, Homo sapiens
ctgccctgtccactctg

SEQ ID NO: 6170742 - DNA, 15 bp, Homo sapiens
ctgccctgtccctgt

SEQ ID NO: 6170743 - DNA, 18 bp, Homo sapiens
ctgccctgtccctgtccc

SEQ ID NO: 6170744 - DNA, 12 bp, Homo sapiens
ctgccctgtgag

SEQ ID NO: 6170745 - DNA, 13 bp, Homo sapiens
ctgccctgtgaga

SEQ ID NO: 6170746 - DNA, 16 bp, Homo sapiens
ctgccctgtgagagcc

SEQ ID NO: 6170747 - DNA, 13 bp, Homo sapiens
ctgccctgtgagt

SEQ ID NO: 6170748 - DNA, 20 bp, Homo sapiens
ctgccctgtgatatgtctgc

SEQ ID NO: 6170749 - DNA, 18 bp, Homo sapiens
ctgccctgtgccgcactc

SEQ ID NO: 6170750 - DNA, 11 bp, Homo sapiens
ctgccctgtgg

SEQ ID NO: 6170751 - DNA, 15 bp, Homo sapiens
ctgccctgtggacag

SEQ ID NO: 6170752 - DNA, 16 bp, Homo sapiens
ctgccctgtgggcccc

SEQ ID NO: 6170753 - DNA, 13 bp, Homo sapiens
ctgccctgtgtac

SEQ ID NO: 6170754 - DNA, 17 bp, Homo sapiens
ctgccctgttagctttc

SEQ ID NO: 6170755 - DNA, 20 bp, Homo sapiens
ctgccctgttcatgtgcctc

SEQ ID NO: 6170756 - DNA, 22 bp, Homo sapiens
ctgccctgttcatgtgcctctg

SEQ ID NO: 6170757 - DNA, 23 bp, Homo sapiens
ctgccctgttcatgtgcctctgc

SEQ ID NO: 6170758 - DNA, 23 bp, Homo sapiens
ctgcccttacctgccaggaagcc

SEQ ID NO: 6170759 - DNA, 21 bp, Homo sapiens
ctgcccttcaccccagtggcc

SEQ ID NO: 6170760 - DNA, 12 bp, Homo sapiens
ctgcccttccct

SEQ ID NO: 6170761 - DNA, 18 bp, Homo sapiens
ctgcccttccctctgggc

SEQ ID NO: 6170762 - DNA, 15 bp, Homo sapiens
ctgcccttccgcagt

SEQ ID NO: 6170763 - DNA, 15 bp, Homo sapiens
ctgcccttcctcagt

SEQ ID NO: 6170764 - DNA, 22 bp, Homo sapiens
ctgcccttcctcagtttaatcc

SEQ ID NO: 6170765 - DNA, 13 bp, Homo sapiens
ctgcccttcctcc

SEQ ID NO: 6170766 - DNA, 14 bp, Homo sapiens
ctgcccttcctcca

SEQ ID NO: 6170767 - DNA, 16 bp, Homo sapiens
ctgcccttcctccagg

SEQ ID NO: 6170768 - DNA, 18 bp, Homo sapiens
ctgcccttcctccaggag

SEQ ID NO: 6170769 - DNA, 15 bp, Homo sapiens
ctgcccttcctgcag

SEQ ID NO: 6170770 - DNA, 14 bp, Homo sapiens
ctgcccttcgctgc

SEQ ID NO: 6170771 - DNA, 15 bp, Homo sapiens
ctgcccttcgctgcc

SEQ ID NO: 6170772 - DNA, 20 bp, Homo sapiens
ctgcccttcgctgccaggac

SEQ ID NO: 6170773 - DNA, 23 bp, Homo sapiens
ctgcccttcgctgccaggacacc

SEQ ID NO: 6170774 - DNA, 17 bp, Homo sapiens
ctgcccttctcaagact

SEQ ID NO: 6170775 - DNA, 16 bp, Homo sapiens
ctgcccttgatcagcc

SEQ ID NO: 6170776 - DNA, 17 bp, Homo sapiens
ctgcccttgatcagccc

SEQ ID NO: 6170777 - DNA, 13 bp, Homo sapiens
ctgcccttgcagg

SEQ ID NO: 6170778 - DNA, 15 bp, Homo sapiens
ctgcccttgcagggt

SEQ ID NO: 6170779 - DNA, 18 bp, Homo sapiens
ctgcccttgctccagcct

SEQ ID NO: 6170780 - DNA, 19 bp, Homo sapiens
ctgcccttgctccagcctg

SEQ ID NO: 6170781 - DNA, 15 bp, Homo sapiens
ctgcccttgctgccc

SEQ ID NO: 6170782 - DNA, 15 bp, Homo sapiens
ctgcccttggcacca

SEQ ID NO: 6170783 - DNA, 21 bp, Homo sapiens
ctgcccttggcaccaccaggg

SEQ ID NO: 6170784 - DNA, 23 bp, Homo sapiens
ctgcccttggcaccaccagggtg

SEQ ID NO: 6170785 - DNA, 12 bp, Homo sapiens
ctgcccttgggc

SEQ ID NO: 6170786 - DNA, 15 bp, Homo sapiens
ctgcccttgtcccac

SEQ ID NO: 6170787 - DNA, 17 bp, Homo sapiens
ctgcccttgtcccactc

SEQ ID NO: 6170788 - DNA, 21 bp, Homo sapiens
ctgcccttgttgcctgcaccc

SEQ ID NO: 6170789 - DNA, 20 bp, Homo sapiens
ctgcccttgtttggggcagg

SEQ ID NO: 6170790 - DNA, 22 bp, Homo sapiens
ctgcccttgtttggggcaggag

SEQ ID NO: 6170791 - DNA, 14 bp, Homo sapiens
ctgccctttggcca

SEQ ID NO: 6170792 - DNA, 18 bp, Homo sapiens
ctgccctttggccaacag

SEQ ID NO: 6170793 - DNA, 14 bp, Homo sapiens
ctgccctttgtcct

SEQ ID NO: 6170794 - DNA, 17 bp, Homo sapiens
ctgcccttttcaggaag

SEQ ID NO: 6170795 - DNA, 20 bp, Homo sapiens
ctgcccttttcctgggcctt

SEQ ID NO: 6170796 - DNA, 22 bp, Homo sapiens
ctgcccttttcctgggccttct

SEQ ID NO: 6170797 - DNA, 18 bp, Homo sapiens
ctgcccttttttctgcct

SEQ ID NO: 6170798 - DNA, 20 bp, Homo sapiens
ctgcccttttttctgcctcc

SEQ ID NO: 6170799 - DNA, 19 bp, Homo sapiens
ctgccgaaacccttgactg

SEQ ID NO: 6170800 - DNA, 14 bp, Homo sapiens
ctgccgaacacaca

SEQ ID NO: 6170801 - DNA, 20 bp, Homo sapiens
ctgccgaagaattgtcttgc

SEQ ID NO: 6170802 - DNA, 15 bp, Homo sapiens
ctgccgacatcagca

SEQ ID NO: 6170803 - DNA, 14 bp, Homo sapiens
ctgccgacatccct

SEQ ID NO: 6170804 - DNA, 22 bp, Homo sapiens
ctgccgacatccctcccccagc

SEQ ID NO: 6170805 - DNA, 23 bp, Homo sapiens
ctgccgacatccctcccccagca

SEQ ID NO: 6170806 - DNA, 15 bp, Homo sapiens
ctgccgaccagagcc

SEQ ID NO: 6170807 - DNA, 16 bp, Homo sapiens
ctgccgaccagagccc

SEQ ID NO: 6170808 - DNA, 22 bp, Homo sapiens
ctgccgaccgaggctggagctg

SEQ ID NO: 6170809 - DNA, 17 bp, Homo sapiens
ctgccgacctcgtcctc

SEQ ID NO: 6170810 - DNA, 19 bp, Homo sapiens
ctgccgacctcgtcctccc

SEQ ID NO: 6170811 - DNA, 14 bp, Homo sapiens
ctgccgacggagcc

SEQ ID NO: 6170812 - DNA, 22 bp, Homo sapiens
ctgccgacggagccactggggt

SEQ ID NO: 6170813 - DNA, 13 bp, Homo sapiens
ctgccgactcccc

SEQ ID NO: 6170814 - DNA, 22 bp, Homo sapiens
ctgccgagagtccatcagcctc

SEQ ID NO: 6170815 - DNA, 14 bp, Homo sapiens
ctgccgagcaaccg

SEQ ID NO: 6170816 - DNA, 14 bp, Homo sapiens
ctgccgagggctgg

SEQ ID NO: 6170817 - DNA, 17 bp, Homo sapiens
ctgccgagggctggccg

SEQ ID NO: 6170818 - DNA, 21 bp, Homo sapiens
ctgccgagggctggccgggac

SEQ ID NO: 6170819 - DNA, 23 bp, Homo sapiens
ctgccgagggctggccgggactg

SEQ ID NO: 6170820 - DNA, 17 bp, Homo sapiens
ctgccgcaacagttttt

SEQ ID NO: 6170821 - DNA, 15 bp, Homo sapiens
ctgccgcaaggccct

SEQ ID NO: 6170822 - DNA, 22 bp, Homo sapiens
ctgccgcaaggccctgtcccag

SEQ ID NO: 6170823 - DNA, 23 bp, Homo sapiens
ctgccgcaaggccctgtcccagc

SEQ ID NO: 6170824 - DNA, 14 bp, Homo sapiens
ctgccgcaccagcc

SEQ ID NO: 6170825 - DNA, 20 bp, Homo sapiens
cttccaccgggcctgaacca

SEQ ID NO: 6170826 - DNA, 11 bp, Homo sapiens
cttccacctca

SEQ ID NO: 6170827 - DNA, 16 bp, Homo sapiens
cttccacctcacaact

SEQ ID NO: 6170828 - DNA, 18 bp, Homo sapiens
cttccacctcacaactcc

SEQ ID NO: 6170829 - DNA, 19 bp, Homo sapiens
cttccacctcacaactcct

SEQ ID NO: 6170830 - DNA, 23 bp, Homo sapiens
cttccacctcacctctttgttct

SEQ ID NO: 6170831 - DNA, 16 bp, Homo sapiens
cttccacctcagcctc

SEQ ID NO: 6170832 - DNA, 12 bp, Homo sapiens
cttccacctcat

SEQ ID NO: 6170833 - DNA, 13 bp, Homo sapiens
cttccacctcatg

SEQ ID NO: 6170834 - DNA, 15 bp, Homo sapiens
cttccacctcatgga

SEQ ID NO: 6170835 - DNA, 19 bp, Homo sapiens
cttccacctccagcctctg

SEQ ID NO: 6170836 - DNA, 14 bp, Homo sapiens
cttccacctccctc

SEQ ID NO: 6170837 - DNA, 17 bp, Homo sapiens
cttccacctcctagagg

SEQ ID NO: 6170838 - DNA, 13 bp, Homo sapiens
cttccacctctgg

SEQ ID NO: 6170839 - DNA, 17 bp, Homo sapiens
cttccacctgctctgct

SEQ ID NO: 6170840 - DNA, 20 bp, Homo sapiens
cttccacctgtgccctcacc

SEQ ID NO: 6170841 - DNA, 19 bp, Homo sapiens
cttccacgggggctgtggc

SEQ ID NO: 6170842 - DNA, 20 bp, Homo sapiens
cttccacgtactgcagcctc

SEQ ID NO: 6170843 - DNA, 17 bp, Homo sapiens
cttccactccttctctc

SEQ ID NO: 6170844 - DNA, 17 bp, Homo sapiens
cttccactctggaacct

SEQ ID NO: 6170845 - DNA, 14 bp, Homo sapiens
cttccactgagggc

SEQ ID NO: 6170846 - DNA, 17 bp, Homo sapiens
cttccactgatggaaac

SEQ ID NO: 6170847 - DNA, 16 bp, Homo sapiens
cttccactgcctctgc

SEQ ID NO: 6170848 - DNA, 17 bp, Homo sapiens
cttccactgcctctgcc

SEQ ID NO: 6170849 - DNA, 18 bp, Homo sapiens
cttccactgcctctgcct

SEQ ID NO: 6170850 - DNA, 14 bp, Homo sapiens
cttccactgtcagc

SEQ ID NO: 6170851 - DNA, 18 bp, Homo sapiens
cttccactgtcagccctc

SEQ ID NO: 6170852 - DNA, 19 bp, Homo sapiens
cttccactgtgcacctgcg

SEQ ID NO: 6170853 - DNA, 18 bp, Homo sapiens
cttccactgttaaaataa

SEQ ID NO: 6170854 - DNA, 21 bp, Homo sapiens
cttccactttttccagaattt

SEQ ID NO: 6170855 - DNA, 15 bp, Homo sapiens
cttccagaaagcaag

SEQ ID NO: 6170856 - DNA, 22 bp, Homo sapiens
cttccagaaagcaggagcagct

SEQ ID NO: 6170857 - DNA, 18 bp, Homo sapiens
cttccagaaatgccacac

SEQ ID NO: 6170858 - DNA, 16 bp, Homo sapiens
cttccagaaggcagca

SEQ ID NO: 6170859 - DNA, 17 bp, Homo sapiens
cttccagaagtgtgatt

SEQ ID NO: 6170860 - DNA, 16 bp, Homo sapiens
cttccagaatcccaag

SEQ ID NO: 6170861 - DNA, 17 bp, Homo sapiens
cttccagaatcccaaga

SEQ ID NO: 6170862 - DNA, 16 bp, Homo sapiens
cttccagaccacctgc

SEQ ID NO: 6170863 - DNA, 18 bp, Homo sapiens
cttccagaccacctgcca

SEQ ID NO: 6170864 - DNA, 19 bp, Homo sapiens
cttccagaccacctgccag

SEQ ID NO: 6170865 - DNA, 20 bp, Homo sapiens
cttccagaccacctgccagc

SEQ ID NO: 6170866 - DNA, 21 bp, Homo sapiens
cttccagaccacctgccagcc

SEQ ID NO: 6170867 - DNA, 22 bp, Homo sapiens
cttccagaccacctgccagcca

SEQ ID NO: 6170868 - DNA, 23 bp, Homo sapiens
cttccagacctgcttcctgaaat

SEQ ID NO: 6170869 - DNA, 22 bp, Homo sapiens
cttccagagaacctgtgggctg

SEQ ID NO: 6170870 - DNA, 23 bp, Homo sapiens
cttccagagcccaaggtcaggga

SEQ ID NO: 6170871 - DNA, 19 bp, Homo sapiens
cttccagaggacagctctg

SEQ ID NO: 6170872 - DNA, 21 bp, Homo sapiens
cttccagaggacagctctggg

SEQ ID NO: 6170873 - DNA, 12 bp, Homo sapiens
cttccagaggag

SEQ ID NO: 6170874 - DNA, 21 bp, Homo sapiens
cttccagaggagagtggcctg

SEQ ID NO: 6170875 - DNA, 12 bp, Homo sapiens
cttccagagggg

SEQ ID NO: 6170876 - DNA, 19 bp, Homo sapiens
cttccagagggggccagag

SEQ ID NO: 6170877 - DNA, 22 bp, Homo sapiens
cttccagagggggccagaggga

SEQ ID NO: 6170878 - DNA, 23 bp, Homo sapiens
cttccagagggggccagagggac

SEQ ID NO: 6170879 - DNA, 18 bp, Homo sapiens
cttccagatcactgccac

SEQ ID NO: 6170880 - DNA, 18 bp, Homo sapiens
cttccagatgcccgagca

SEQ ID NO: 6170881 - DNA, 20 bp, Homo sapiens
cttccagatggtcatccaga

SEQ ID NO: 6170882 - DNA, 21 bp, Homo sapiens
cttccagatggtcatccagac

SEQ ID NO: 6170883 - DNA, 22 bp, Homo sapiens
cttccagattgggggccctggg

SEQ ID NO: 6170884 - DNA, 12 bp, Homo sapiens
cttccagcaaaa

SEQ ID NO: 6170885 - DNA, 16 bp, Homo sapiens
cttccagcaaaatcca

SEQ ID NO: 6170886 - DNA, 20 bp, Homo sapiens
cttccagcaaaatccaaact

SEQ ID NO: 6170887 - DNA, 23 bp, Homo sapiens
cttccagcaaaatccaaactgct

SEQ ID NO: 6170888 - DNA, 14 bp, Homo sapiens
cttccagcaccctg

SEQ ID NO: 6170889 - DNA, 11 bp, Homo sapiens
cttccagcagg

SEQ ID NO: 6170890 - DNA, 23 bp, Homo sapiens
cttccagcaggagggacagtctc

SEQ ID NO: 6170891 - DNA, 21 bp, Homo sapiens
cttccagcatttagctggcca

SEQ ID NO: 6170892 - DNA, 12 bp, Homo sapiens
cttccagcccag

SEQ ID NO: 6170893 - DNA, 22 bp, Homo sapiens
cttccagcccagacccccagtg

SEQ ID NO: 6170894 - DNA, 14 bp, Homo sapiens
cttccagcccatcc

SEQ ID NO: 6170895 - DNA, 15 bp, Homo sapiens
cttccagcctgagat

SEQ ID NO: 6170896 - DNA, 14 bp, Homo sapiens
cttccagcctggga

SEQ ID NO: 6170897 - DNA, 15 bp, Homo sapiens
cttccagcctgggac

SEQ ID NO: 6170898 - DNA, 16 bp, Homo sapiens
cttccagcctgggaca

SEQ ID NO: 6170899 - DNA, 19 bp, Homo sapiens
cttccagcctgggacacac

SEQ ID NO: 6170900 - DNA, 21 bp, Homo sapiens
cttccagcctgggacacacac

SEQ ID NO: 6170901 - DNA, 22 bp, Homo sapiens
cttccagcctgggacacacaca

SEQ ID NO: 6170902 - DNA, 18 bp, Homo sapiens
cttccagcgaaatggtac

SEQ ID NO: 6170903 - DNA, 16 bp, Homo sapiens
cttccagcgggccctc

SEQ ID NO: 6170904 - DNA, 19 bp, Homo sapiens
cttccagcgggccctctgc

SEQ ID NO: 6170905 - DNA, 21 bp, Homo sapiens
cttccagcgggccctctgccg

SEQ ID NO: 6170906 - DNA, 16 bp, Homo sapiens
cttccagctagtgacc

SEQ ID NO: 6170907 - DNA, 13 bp, Homo sapiens
cttccagctcctg

SEQ ID NO: 6170908 - DNA, 15 bp, Homo sapiens
cttccagctcctgta

SEQ ID NO: 6170909 - DNA, 16 bp, Homo sapiens
cttccagctgctgtct

SEQ ID NO: 6170910 - DNA, 17 bp, Homo sapiens
cttccagcttcaggcac

SEQ ID NO: 6170911 - DNA, 13 bp, Homo sapiens
cttccagctttct

SEQ ID NO: 6170912 - DNA, 15 bp, Homo sapiens
cttccagctttctct

SEQ ID NO: 6170913 - DNA, 19 bp, Homo sapiens
cttccagctttctctttgt

SEQ ID NO: 6170914 - DNA, 19 bp, Homo sapiens
cttccaggaaactccacat

SEQ ID NO: 6170915 - DNA, 18 bp, Homo sapiens
cttccaggaatgctgggc

SEQ ID NO: 6170916 - DNA, 20 bp, Homo sapiens
cttccaggaatgctgggccc

SEQ ID NO: 6170917 - DNA, 19 bp, Homo sapiens
cttccaggactctctgctt

SEQ ID NO: 6170918 - DNA, 23 bp, Homo sapiens
cttccaggagcaatttgcacatg

SEQ ID NO: 6170919 - DNA, 16 bp, Homo sapiens
cttccaggaggacata

SEQ ID NO: 6170920 - DNA, 13 bp, Homo sapiens
cttccaggagtgg

SEQ ID NO: 6170921 - DNA, 18 bp, Homo sapiens
cttccaggatcaggggtt

SEQ ID NO: 6170922 - DNA, 17 bp, Homo sapiens
cttccaggatggtgtta

SEQ ID NO: 6170923 - DNA, 16 bp, Homo sapiens
cttccaggccccaggc

SEQ ID NO: 6170924 - DNA, 17 bp, Homo sapiens
cttccaggccccaggct

SEQ ID NO: 6170925 - DNA, 16 bp, Homo sapiens
cttccaggcccccacc

SEQ ID NO: 6170926 - DNA, 17 bp, Homo sapiens
cttccaggcctgaagtc

SEQ ID NO: 6170927 - DNA, 12 bp, Homo sapiens
cttccaggctct

SEQ ID NO: 6170928 - DNA, 15 bp, Homo sapiens
cttccaggctcttcc

SEQ ID NO: 6170929 - DNA, 23 bp, Homo sapiens
cttccaggctcttcctggacctg

SEQ ID NO: 6170930 - DNA, 21 bp, Homo sapiens
cttccaggctgcatagaagga

SEQ ID NO: 6170931 - DNA, 15 bp, Homo sapiens
cttccaggctgggag

SEQ ID NO: 6170932 - DNA, 16 bp, Homo sapiens
cttccaggctgggaga

SEQ ID NO: 6170933 - DNA, 16 bp, Homo sapiens
cttccagggacaagct

SEQ ID NO: 6170934 - DNA, 13 bp, Homo sapiens
cttccagggccct

SEQ ID NO: 6170935 - DNA, 20 bp, Homo sapiens
cttccagggctcttccagat

SEQ ID NO: 6170936 - DNA, 16 bp, Homo sapiens
cttccaggggaacctg

SEQ ID NO: 6170937 - DNA, 13 bp, Homo sapiens
cttccagggggaa

SEQ ID NO: 6170938 - DNA, 21 bp, Homo sapiens
cttccaggggtcaccttgaga

SEQ ID NO: 6170939 - DNA, 14 bp, Homo sapiens
cttccaggggtggg

SEQ ID NO: 6170940 - DNA, 15 bp, Homo sapiens
cttccaggggtggga

SEQ ID NO: 6170941 - DNA, 17 bp, Homo sapiens
cttccaggggtgggaca

SEQ ID NO: 6170942 - DNA, 21 bp, Homo sapiens
cttccaggggtgggacaccct

SEQ ID NO: 6170943 - DNA, 22 bp, Homo sapiens
cttccaggggtgggacaccctg

SEQ ID NO: 6170944 - DNA, 20 bp, Homo sapiens
cttccaggtatctccaggat

SEQ ID NO: 6170945 - DNA, 22 bp, Homo sapiens
cttccaggtatgggacctgcta

SEQ ID NO: 6170946 - DNA, 23 bp, Homo sapiens
cttccaggtccaaacccttcaac

SEQ ID NO: 6170947 - DNA, 15 bp, Homo sapiens
cttccaggtctgcct

SEQ ID NO: 6170948 - DNA, 16 bp, Homo sapiens
cttccaggtctgcctg

SEQ ID NO: 6170949 - DNA, 19 bp, Homo sapiens
cttccaggtctgcctggtt

SEQ ID NO: 6170950 - DNA, 19 bp, Homo sapiens
cttccaggtgcctggccct

SEQ ID NO: 6170951 - DNA, 13 bp, Homo sapiens
cttccaggtggcg

SEQ ID NO: 6170952 - DNA, 23 bp, Homo sapiens
cttccaggtggcgtgagaggcaa

SEQ ID NO: 6170953 - DNA, 20 bp, Homo sapiens
cttccaggtgttactgtaat

SEQ ID NO: 6170954 - DNA, 20 bp, Homo sapiens
cttccaggttccatccacca

SEQ ID NO: 6170955 - DNA, 21 bp, Homo sapiens
cttccagtcatgtgtgcatca

SEQ ID NO: 6170956 - DNA, 20 bp, Homo sapiens
cttccagtccaatctcatgg

SEQ ID NO: 6170957 - DNA, 22 bp, Homo sapiens
cttccagtcttcctgacacttt

SEQ ID NO: 6170958 - DNA, 15 bp, Homo sapiens
cttccagtgaacatt

SEQ ID NO: 6170959 - DNA, 23 bp, Homo sapiens
cttccagtgaggcatctctctgg

SEQ ID NO: 6170960 - DNA, 18 bp, Homo sapiens
cttccagtgatgttgaaa

SEQ ID NO: 6170961 - DNA, 14 bp, Homo sapiens
cttccagtgcatgt

SEQ ID NO: 6170962 - DNA, 19 bp, Homo sapiens
cttccagtggcttctccca

SEQ ID NO: 6170963 - DNA, 20 bp, Homo sapiens
cttccagtggcttctcccaa

SEQ ID NO: 6170964 - DNA, 12 bp, Homo sapiens
cttccagtggga

SEQ ID NO: 6170965 - DNA, 18 bp, Homo sapiens
cttccagtggtaccagct

SEQ ID NO: 6170966 - DNA, 20 bp, Homo sapiens
cttccagtggtaccagctca

SEQ ID NO: 6170967 - DNA, 23 bp, Homo sapiens
cttccagtggtttgagacactgg

SEQ ID NO: 6170968 - DNA, 23 bp, Homo sapiens
cttccagtgttggctgtgtgaca

SEQ ID NO: 6170969 - DNA, 19 bp, Homo sapiens
cttccagttactttccaat

SEQ ID NO: 6170970 - DNA, 19 bp, Homo sapiens
cttccagtttctgtaaggt

SEQ ID NO: 6170971 - DNA, 21 bp, Homo sapiens
cttccagtttgctttgccctt

SEQ ID NO: 6170972 - DNA, 13 bp, Homo sapiens
cttccataacatt

SEQ ID NO: 6170973 - DNA, 18 bp, Homo sapiens
cttccatacacagaggag

SEQ ID NO: 6170974 - DNA, 22 bp, Homo sapiens
cttccatagcctaatccctggg

SEQ ID NO: 6170975 - DNA, 15 bp, Homo sapiens
cttccatagctgctg

SEQ ID NO: 6170976 - DNA, 17 bp, Homo sapiens
cttccatagctgctgcc

SEQ ID NO: 6170977 - DNA, 21 bp, Homo sapiens
cttccatagctgctgccctag

SEQ ID NO: 6170978 - DNA, 19 bp, Homo sapiens
cttccatatccgggtgctc

SEQ ID NO: 6170979 - DNA, 20 bp, Homo sapiens
cttccatatccgggtgctca

SEQ ID NO: 6170980 - DNA, 21 bp, Homo sapiens
cttccatatccgggtgctcaa

SEQ ID NO: 6170981 - DNA, 14 bp, Homo sapiens
cttccatatgacct

SEQ ID NO: 6170982 - DNA, 15 bp, Homo sapiens
cttccatatgctctt

SEQ ID NO: 6170983 - DNA, 15 bp, Homo sapiens
cttccatatttggaa

SEQ ID NO: 6170984 - DNA, 23 bp, Homo sapiens
cttccatcagcagtgattgaagt

SEQ ID NO: 6170985 - DNA, 16 bp, Homo sapiens
cttccatcagcgggtc

SEQ ID NO: 6170986 - DNA, 14 bp, Homo sapiens
cttccatcagctct

SEQ ID NO: 6170987 - DNA, 18 bp, Homo sapiens
cttccatcagctctctgc

SEQ ID NO: 6170988 - DNA, 16 bp, Homo sapiens
cttccatcatcactgt

SEQ ID NO: 6170989 - DNA, 18 bp, Homo sapiens
cttccatcatcactgtaa

SEQ ID NO: 6170990 - DNA, 14 bp, Homo sapiens
cttccatcccagag

SEQ ID NO: 6170991 - DNA, 12 bp, Homo sapiens
cttccatcccta

SEQ ID NO: 6170992 - DNA, 17 bp, Homo sapiens
cttccatccctaccccc

SEQ ID NO: 6170993 - DNA, 13 bp, Homo sapiens
cttccatcctgag

SEQ ID NO: 6170994 - DNA, 14 bp, Homo sapiens
cttccatcctgagg

SEQ ID NO: 6170995 - DNA, 16 bp, Homo sapiens
cttccatcctgaggac

SEQ ID NO: 6170996 - DNA, 15 bp, Homo sapiens
cttccatctcttcct

SEQ ID NO: 6170997 - DNA, 16 bp, Homo sapiens
cttccatctcttcctt

SEQ ID NO: 6170998 - DNA, 17 bp, Homo sapiens
cttccatctcttccttc

SEQ ID NO: 6170999 - DNA, 18 bp, Homo sapiens
cttccatctcttcctttc

SEQ ID NO: 6171000 - DNA, 21 bp, Homo sapiens
cttccatcttgtggggccagg

SEQ ID NO: 6171001 - DNA, 13 bp, Homo sapiens
cttccatgaattt

SEQ ID NO: 6171002 - DNA, 14 bp, Homo sapiens
cttccatgacctcc

SEQ ID NO: 6171003 - DNA, 14 bp, Homo sapiens
ctgccgcaccccag

SEQ ID NO: 6171004 - DNA, 22 bp, Homo sapiens
ctgccgcagacgggcacagaca

SEQ ID NO: 6171005 - DNA, 12 bp, Homo sapiens
ctgccgcagccc

SEQ ID NO: 6171006 - DNA, 14 bp, Homo sapiens
ctgccgcagccctg

SEQ ID NO: 6171007 - DNA, 15 bp, Homo sapiens
ctgccgcagccctgc

SEQ ID NO: 6171008 - DNA, 14 bp, Homo sapiens
ctgccgcatctgcc

SEQ ID NO: 6171009 - DNA, 15 bp, Homo sapiens
ctgccgcatctgcct

SEQ ID NO: 6171010 - DNA, 18 bp, Homo sapiens
ctgccgcatctgcctgga

SEQ ID NO: 6171011 - DNA, 20 bp, Homo sapiens
ctgccgcatctgcctggagc

SEQ ID NO: 6171012 - DNA, 15 bp, Homo sapiens
ctgccgcatgctccc

SEQ ID NO: 6171013 - DNA, 15 bp, Homo sapiens
ctgccgcccaaagag

SEQ ID NO: 6171014 - DNA, 20 bp, Homo sapiens
ctgccgcccacctcgctccc

SEQ ID NO: 6171015 - DNA, 13 bp, Homo sapiens
ctgccgcccccgc

SEQ ID NO: 6171016 - DNA, 18 bp, Homo sapiens
ctgccgcccccgcctggg

SEQ ID NO: 6171017 - DNA, 19 bp, Homo sapiens
ctgccgcccccgcctgggc

SEQ ID NO: 6171018 - DNA, 21 bp, Homo sapiens
ctgccgcccccgcctgggcac

SEQ ID NO: 6171019 - DNA, 19 bp, Homo sapiens
ctgccgccccctcctgaac

SEQ ID NO: 6171020 - DNA, 16 bp, Homo sapiens
ctgccgccctgtggga

SEQ ID NO: 6171021 - DNA, 15 bp, Homo sapiens
ctgccgcccttcctg

SEQ ID NO: 6171022 - DNA, 20 bp, Homo sapiens
ctgccgccgctaggtagagt

SEQ ID NO: 6171023 - DNA, 14 bp, Homo sapiens
ctgccgcctcacct

SEQ ID NO: 6171024 - DNA, 13 bp, Homo sapiens
ctgccgcctcctt

SEQ ID NO: 6171025 - DNA, 23 bp, Homo sapiens
ctgccgcctgtgcccttgctggg

SEQ ID NO: 6171026 - DNA, 15 bp, Homo sapiens
ctgccgcgcagtgtg

SEQ ID NO: 6171027 - DNA, 17 bp, Homo sapiens
ctgccgctacctccctc

SEQ ID NO: 6171028 - DNA, 18 bp, Homo sapiens
ctgccgctacctccctcc

SEQ ID NO: 6171029 - DNA, 16 bp, Homo sapiens
ctgccgctcctctcta

SEQ ID NO: 6171030 - DNA, 13 bp, Homo sapiens
ctgccgctgcacc

SEQ ID NO: 6171031 - DNA, 13 bp, Homo sapiens
ctgccgctgcagg

SEQ ID NO: 6171032 - DNA, 13 bp, Homo sapiens
ctgccgctgccat

SEQ ID NO: 6171033 - DNA, 14 bp, Homo sapiens
ctgccgctgccccc

SEQ ID NO: 6171034 - DNA, 20 bp, Homo sapiens
ctgccgctgcccccaccctg

SEQ ID NO: 6171035 - DNA, 20 bp, Homo sapiens
ctgccgctgccgctgcacca

SEQ ID NO: 6171036 - DNA, 19 bp, Homo sapiens
ctgccgctgcttccaggct

SEQ ID NO: 6171037 - DNA, 22 bp, Homo sapiens
ctgccgctgcttccaggctggg

SEQ ID NO: 6171038 - DNA, 14 bp, Homo sapiens
ctgccgctgcttga

SEQ ID NO: 6171039 - DNA, 14 bp, Homo sapiens
ctgccgctgtcaag

SEQ ID NO: 6171040 - DNA, 19 bp, Homo sapiens
ctgccgctttgtctgtcca

SEQ ID NO: 6171041 - DNA, 14 bp, Homo sapiens
ctgccggagggagc

SEQ ID NO: 6171042 - DNA, 17 bp, Homo sapiens
ctgccggagggagccct

SEQ ID NO: 6171043 - DNA, 21 bp, Homo sapiens
ctgccggagggagccctgagc

SEQ ID NO: 6171044 - DNA, 12 bp, Homo sapiens
ctgccggcacag

SEQ ID NO: 6171045 - DNA, 13 bp, Homo sapiens
ctgccggcagtgc

SEQ ID NO: 6171046 - DNA, 14 bp, Homo sapiens
ctgccggcccccag

SEQ ID NO: 6171047 - DNA, 18 bp, Homo sapiens
ctgccggccccccaagga

SEQ ID NO: 6171048 - DNA, 14 bp, Homo sapiens
ctgccggccttggc

SEQ ID NO: 6171049 - DNA, 13 bp, Homo sapiens
ctgccggctctgg

SEQ ID NO: 6171050 - DNA, 18 bp, Homo sapiens
ctgccggctctgggcctg

SEQ ID NO: 6171051 - DNA, 22 bp, Homo sapiens
ctgccgggcaggtcccaggttg

SEQ ID NO: 6171052 - DNA, 23 bp, Homo sapiens
ctgccgggctgagggcctgctgg

SEQ ID NO: 6171053 - DNA, 19 bp, Homo sapiens
ctgccggggcagccccctc

SEQ ID NO: 6171054 - DNA, 20 bp, Homo sapiens
ctgccggggcagccccctca

SEQ ID NO: 6171055 - DNA, 23 bp, Homo sapiens
ctgccggggcagccccctcacag

SEQ ID NO: 6171056 - DNA, 20 bp, Homo sapiens
ctgccgggtggggggagggc

SEQ ID NO: 6171057 - DNA, 21 bp, Homo sapiens
ctgccgggtggggggagggca

SEQ ID NO: 6171058 - DNA, 22 bp, Homo sapiens
ctgccgggtggggggagggcac

SEQ ID NO: 6171059 - DNA, 20 bp, Homo sapiens
ctgccgggttctagtctcct

SEQ ID NO: 6171060 - DNA, 16 bp, Homo sapiens
ctgccggtcatttgaa

SEQ ID NO: 6171061 - DNA, 14 bp, Homo sapiens
ctgccggtccccca

SEQ ID NO: 6171062 - DNA, 18 bp, Homo sapiens
ctgccggtcccccatgcc

SEQ ID NO: 6171063 - DNA, 21 bp, Homo sapiens
ctgccggtcgggcagccagca

SEQ ID NO: 6171064 - DNA, 23 bp, Homo sapiens
ctgccggtgcacaggcctctgcc

SEQ ID NO: 6171065 - DNA, 15 bp, Homo sapiens
ctgccggtgggaccc

SEQ ID NO: 6171066 - DNA, 18 bp, Homo sapiens
ctgccggttccgcccgcc

SEQ ID NO: 6171067 - DNA, 13 bp, Homo sapiens
ctgccgtaagtta

SEQ ID NO: 6171068 - DNA, 15 bp, Homo sapiens
ctgccgtaatttaac

SEQ ID NO: 6171069 - DNA, 19 bp, Homo sapiens
ctgccgtcagtgctgtgct

SEQ ID NO: 6171070 - DNA, 20 bp, Homo sapiens
ctgccgtcagtgctgtgctg

SEQ ID NO: 6171071 - DNA, 14 bp, Homo sapiens
ctgccgtctctgga

SEQ ID NO: 6171072 - DNA, 17 bp, Homo sapiens
ctgccgtctctggagcg

SEQ ID NO: 6171073 - DNA, 15 bp, Homo sapiens
ctgccgtgagagccc

SEQ ID NO: 6171074 - DNA, 22 bp, Homo sapiens
ctgccgtgagagcccaatcact

SEQ ID NO: 6171075 - DNA, 14 bp, Homo sapiens
ctgccgtgcatggc

SEQ ID NO: 6171076 - DNA, 18 bp, Homo sapiens
ctgccgtgcatggctcct

SEQ ID NO: 6171077 - DNA, 20 bp, Homo sapiens
ctgccgtgcattagcacaga

SEQ ID NO: 6171078 - DNA, 22 bp, Homo sapiens
ctgccgtgccgcctgcactcct

SEQ ID NO: 6171079 - DNA, 14 bp, Homo sapiens
ctgccgtgcctgtg

SEQ ID NO: 6171080 - DNA, 20 bp, Homo sapiens
ctgccgtgggcaaggatacc

SEQ ID NO: 6171081 - DNA, 13 bp, Homo sapiens
ctgccgtggggcc

SEQ ID NO: 6171082 - DNA, 14 bp, Homo sapiens
ctgccgtgtgccct

SEQ ID NO: 6171083 - DNA, 14 bp, Homo sapiens
ctgcctaaccaggc

SEQ ID NO: 6171084 - DNA, 15 bp, Homo sapiens
ctgcctaaccaggcc

SEQ ID NO: 6171085 - DNA, 19 bp, Homo sapiens
ctgcctaaccaggcccagc

SEQ ID NO: 6171086 - DNA, 15 bp, Homo sapiens
ctgcctaaccatggg

SEQ ID NO: 6171087 - DNA, 15 bp, Homo sapiens
ctgcctaagacatgt

SEQ ID NO: 6171088 - DNA, 15 bp, Homo sapiens
ctgcctaagaggcaa

SEQ ID NO: 6171089 - DNA, 15 bp, Homo sapiens
ctgcctaaggaagct

SEQ ID NO: 6171090 - DNA, 12 bp, Homo sapiens
ctgcctaaggac

SEQ ID NO: 6171091 - DNA, 14 bp, Homo sapiens
ctgcctaaggactt

SEQ ID NO: 6171092 - DNA, 15 bp, Homo sapiens
ctgcctaagtgcagc

SEQ ID NO: 6171093 - DNA, 15 bp, Homo sapiens
ctgcctaagtggctg

SEQ ID NO: 6171094 - DNA, 18 bp, Homo sapiens
ctgcctaataaagagact

SEQ ID NO: 6171095 - DNA, 16 bp, Homo sapiens
ctgcctacagccaggt

SEQ ID NO: 6171096 - DNA, 19 bp, Homo sapiens
ctgcctacattccctggcc

SEQ ID NO: 6171097 - DNA, 20 bp, Homo sapiens
ctgcctacattccctggcct

SEQ ID NO: 6171098 - DNA, 12 bp, Homo sapiens
ctgcctaccagt

SEQ ID NO: 6171099 - DNA, 15 bp, Homo sapiens
ctgcctacgccagga

SEQ ID NO: 6171100 - DNA, 23 bp, Homo sapiens
ctgcctacggagggtgggctctg

SEQ ID NO: 6171101 - DNA, 17 bp, Homo sapiens
ctgcctacgtgctgccc

SEQ ID NO: 6171102 - DNA, 20 bp, Homo sapiens
ctgcctacgttctctttaaa

SEQ ID NO: 6171103 - DNA, 14 bp, Homo sapiens
ctgcctactcacga

SEQ ID NO: 6171104 - DNA, 17 bp, Homo sapiens
ctgcctactgcccctgc

SEQ ID NO: 6171105 - DNA, 18 bp, Homo sapiens
ctgcctagaaacaacact

SEQ ID NO: 6171106 - DNA, 20 bp, Homo sapiens
ctgcctagaaacaacactgt

SEQ ID NO: 6171107 - DNA, 21 bp, Homo sapiens
ctgcctagaaacaacactgta

SEQ ID NO: 6171108 - DNA, 23 bp, Homo sapiens
ctgcctagaaacaacactgtagt

SEQ ID NO: 6171109 - DNA, 18 bp, Homo sapiens
ctgcctagaatctttatt

SEQ ID NO: 6171110 - DNA, 20 bp, Homo sapiens
ctgcctagaatctttattca

SEQ ID NO: 6171111 - DNA, 15 bp, Homo sapiens
ctgcctagagtgtag

SEQ ID NO: 6171112 - DNA, 15 bp, Homo sapiens
ctgcctagattcagg

SEQ ID NO: 6171113 - DNA, 19 bp, Homo sapiens
ctgcctagattcagggaaa

SEQ ID NO: 6171114 - DNA, 19 bp, Homo sapiens
ctgcctagcaagctggcct

SEQ ID NO: 6171115 - DNA, 20 bp, Homo sapiens
ctgcctagcactcacatgct

SEQ ID NO: 6171116 - DNA, 23 bp, Homo sapiens
ctgcctagcactcacatgctgga

SEQ ID NO: 6171117 - DNA, 14 bp, Homo sapiens
ctgcctagcatggg

SEQ ID NO: 6171118 - DNA, 22 bp, Homo sapiens
ctgcctagcatggggtcagccc

SEQ ID NO: 6171119 - DNA, 23 bp, Homo sapiens
ctgcctagctcttgggcctgacc

SEQ ID NO: 6171120 - DNA, 17 bp, Homo sapiens
ctgcctaggcagccagc

SEQ ID NO: 6171121 - DNA, 18 bp, Homo sapiens
ctgcctagggttgcttgg

SEQ ID NO: 6171122 - DNA, 20 bp, Homo sapiens
ctgcctagggttgcttgggc

SEQ ID NO: 6171123 - DNA, 16 bp, Homo sapiens
ctgcctaggtccccca

SEQ ID NO: 6171124 - DNA, 21 bp, Homo sapiens
ctgcctaggtcccccaagcat

SEQ ID NO: 6171125 - DNA, 16 bp, Homo sapiens
ctgcctaggtttttcc

SEQ ID NO: 6171126 - DNA, 17 bp, Homo sapiens
ctgcctataaatttact

SEQ ID NO: 6171127 - DNA, 22 bp, Homo sapiens
ctgcctataatcttatacaaca

SEQ ID NO: 6171128 - DNA, 14 bp, Homo sapiens
ctgcctatatatgt

SEQ ID NO: 6171129 - DNA, 14 bp, Homo sapiens
ctgcctatcctctg

SEQ ID NO: 6171130 - DNA, 15 bp, Homo sapiens
ctgcctatcctctgt

SEQ ID NO: 6171131 - DNA, 19 bp, Homo sapiens
ctgcctatgaacagaccat

SEQ ID NO: 6171132 - DNA, 24 bp, Homo sapiens
ctgcctatgcactgaagagctctt

SEQ ID NO: 6171133 - DNA, 19 bp, Homo sapiens
ctgcctatgcccagcctcc

SEQ ID NO: 6171134 - DNA, 20 bp, Homo sapiens
ctgcctatgcccagcctcca

SEQ ID NO: 6171135 - DNA, 15 bp, Homo sapiens
ctgcctatgtctcct

SEQ ID NO: 6171136 - DNA, 22 bp, Homo sapiens
ctgcctatgttgggggggaccc

SEQ ID NO: 6171137 - DNA, 21 bp, Homo sapiens
ctgcctattgcagctgggaga

SEQ ID NO: 6171138 - DNA, 19 bp, Homo sapiens
ctgcctcaaattctgcgtt

SEQ ID NO: 6171139 - DNA, 24 bp, Homo sapiens
ctgcctcaatgtgaatcagaccct

SEQ ID NO: 6171140 - DNA, 19 bp, Homo sapiens
ctgcctcacatctcccttc

SEQ ID NO: 6171141 - DNA, 15 bp, Homo sapiens
ctgcctcacccacac

SEQ ID NO: 6171142 - DNA, 18 bp, Homo sapiens
ctgcctcaccgcttccct

SEQ ID NO: 6171143 - DNA, 16 bp, Homo sapiens
ctgcctcactcctccg

SEQ ID NO: 6171144 - DNA, 17 bp, Homo sapiens
ctgcctcactcctccgt

SEQ ID NO: 6171145 - DNA, 21 bp, Homo sapiens
ctgcctcactgtgacctgctc

SEQ ID NO: 6171146 - DNA, 19 bp, Homo sapiens
ctgcctcagacgttgcctg

SEQ ID NO: 6171147 - DNA, 18 bp, Homo sapiens
ctgcctcagccaggccct

SEQ ID NO: 6171148 - DNA, 21 bp, Homo sapiens
ctgcctcagccagtggcacag

SEQ ID NO: 6171149 - DNA, 12 bp, Homo sapiens
ctgcctcagcct

SEQ ID NO: 6171150 - DNA, 19 bp, Homo sapiens
ctgcctcagcctcccaaag

SEQ ID NO: 6171151 - DNA, 21 bp, Homo sapiens
ctgcctcagcctcccatagct

SEQ ID NO: 6171152 - DNA, 23 bp, Homo sapiens
ctgcctcagcctccccagtagct

SEQ ID NO: 6171153 - DNA, 16 bp, Homo sapiens
ctgcctcagcctcctg

SEQ ID NO: 6171154 - DNA, 17 bp, Homo sapiens
ctgcctcagcctcctga

SEQ ID NO: 6171155 - DNA, 19 bp, Homo sapiens
ctgcctcagcctcctgagt

SEQ ID NO: 6171156 - DNA, 16 bp, Homo sapiens
ctgcctcagctcagct

SEQ ID NO: 6171157 - DNA, 23 bp, Homo sapiens
ctgcctcagctgacccggcctct

SEQ ID NO: 6171158 - DNA, 18 bp, Homo sapiens
ctgcctcagcttcccaag

SEQ ID NO: 6171159 - DNA, 11 bp, Homo sapiens
ctgcctcagga

SEQ ID NO: 6171160 - DNA, 12 bp, Homo sapiens
ctgcctcaggac

SEQ ID NO: 6171161 - DNA, 15 bp, Homo sapiens
ctgcctcaggaccca

SEQ ID NO: 6171162 - DNA, 20 bp, Homo sapiens
ctgcctcaggacccatccct

SEQ ID NO: 6171163 - DNA, 22 bp, Homo sapiens
ctgcctcaggaggcaggacctt

SEQ ID NO: 6171164 - DNA, 23 bp, Homo sapiens
ctgcctcaggaggcaggaccttc

SEQ ID NO: 6171165 - DNA, 18 bp, Homo sapiens
ctgcctcaggcactctcc

SEQ ID NO: 6171166 - DNA, 15 bp, Homo sapiens
ctgcctcaggcctct

SEQ ID NO: 6171167 - DNA, 17 bp, Homo sapiens
ctgcctcaggcctctgt

SEQ ID NO: 6171168 - DNA, 14 bp, Homo sapiens
ctgcctcagtggct

SEQ ID NO: 6171169 - DNA, 21 bp, Homo sapiens
ctgcctcagtggctctgggta

SEQ ID NO: 6171170 - DNA, 16 bp, Homo sapiens
ctgcctcatcctcctc

SEQ ID NO: 6171171 - DNA, 21 bp, Homo sapiens
ctgcctcatcttccttctcag

SEQ ID NO: 6171172 - DNA, 12 bp, Homo sapiens
ctgcctcattta

SEQ ID NO: 6171173 - DNA, 13 bp, Homo sapiens
ctgcctcatttag

SEQ ID NO: 6171174 - DNA, 21 bp, Homo sapiens
ctgcctcattttcacagcact

SEQ ID NO: 6171175 - DNA, 13 bp, Homo sapiens
ctgcctccaaccc

SEQ ID NO: 6171176 - DNA, 19 bp, Homo sapiens
ctgcctccaacccagcagt

SEQ ID NO: 6171177 - DNA, 14 bp, Homo sapiens
ctgcctccaccagc

SEQ ID NO: 6171178 - DNA, 12 bp, Homo sapiens
ctgcctccaccc

SEQ ID NO: 6171179 - DNA, 17 bp, Homo sapiens
ctgcctccacccgtcct

SEQ ID NO: 6171180 - DNA, 15 bp, Homo sapiens
ctgcctccaccctcc

SEQ ID NO: 6171181 - DNA, 21 bp, Homo sapiens
ctgcctccaccctctgagctt

SEQ ID NO: 6171182 - DNA, 17 bp, Homo sapiens
cttccatgacctcccct

SEQ ID NO: 6171183 - DNA, 22 bp, Homo sapiens
cttccatgacctcccctcccca

SEQ ID NO: 6171184 - DNA, 16 bp, Homo sapiens
cttccatgatacttta

SEQ ID NO: 6171185 - DNA, 16 bp, Homo sapiens
cttccatgatgcacag

SEQ ID NO: 6171186 - DNA, 16 bp, Homo sapiens
cttccatgccccagga

SEQ ID NO: 6171187 - DNA, 14 bp, Homo sapiens
cttccatgcctgta

SEQ ID NO: 6171188 - DNA, 13 bp, Homo sapiens
cttccatgctccc

SEQ ID NO: 6171189 - DNA, 17 bp, Homo sapiens
cttccatgctccgcctg

SEQ ID NO: 6171190 - DNA, 16 bp, Homo sapiens
cttccatggactttgt

SEQ ID NO: 6171191 - DNA, 17 bp, Homo sapiens
cttccatggcttcctga

SEQ ID NO: 6171192 - DNA, 19 bp, Homo sapiens
cttccatgtatcttttgaa

SEQ ID NO: 6171193 - DNA, 16 bp, Homo sapiens
cttccatgtcgcctct

SEQ ID NO: 6171194 - DNA, 20 bp, Homo sapiens
cttccatgtcgcctctgcat

SEQ ID NO: 6171195 - DNA, 18 bp, Homo sapiens
cttccatgtcggcctcta

SEQ ID NO: 6171196 - DNA, 16 bp, Homo sapiens
cttccatgtctccatt

SEQ ID NO: 6171197 - DNA, 13 bp, Homo sapiens
cttccatgtgcct

SEQ ID NO: 6171198 - DNA, 15 bp, Homo sapiens
cttccatgtgccttt

SEQ ID NO: 6171199 - DNA, 23 bp, Homo sapiens
cttccatgtgcctttctttgcct

SEQ ID NO: 6171200 - DNA, 12 bp, Homo sapiens
cttccatgtgga

SEQ ID NO: 6171201 - DNA, 15 bp, Homo sapiens
cttccatgttctggg

SEQ ID NO: 6171202 - DNA, 22 bp, Homo sapiens
cttccatgttctgggtgatgga

SEQ ID NO: 6171203 - DNA, 20 bp, Homo sapiens
cttccatgttgtcttataaa

SEQ ID NO: 6171204 - DNA, 13 bp, Homo sapiens
cttccattattga

SEQ ID NO: 6171205 - DNA, 16 bp, Homo sapiens
cttccattattgagtt

SEQ ID NO: 6171206 - DNA, 12 bp, Homo sapiens
cttccattccac

SEQ ID NO: 6171207 - DNA, 15 bp, Homo sapiens
cttccattccacaca

SEQ ID NO: 6171208 - DNA, 22 bp, Homo sapiens
cttccattccacacagaatgca

SEQ ID NO: 6171209 - DNA, 16 bp, Homo sapiens
cttccattccacatcc

SEQ ID NO: 6171210 - DNA, 13 bp, Homo sapiens
cttccattctttc

SEQ ID NO: 6171211 - DNA, 20 bp, Homo sapiens
cttccattctttcttcctcc

SEQ ID NO: 6171212 - DNA, 17 bp, Homo sapiens
cttccattgcaaaatag

SEQ ID NO: 6171213 - DNA, 22 bp, Homo sapiens
cttccattgcaaaatagaagaa

SEQ ID NO: 6171214 - DNA, 23 bp, Homo sapiens
cttccattgcaaaatagaagaag

SEQ ID NO: 6171215 - DNA, 21 bp, Homo sapiens
cttccattgctcccagtgcca

SEQ ID NO: 6171216 - DNA, 18 bp, Homo sapiens
cttccattggttcttcct

SEQ ID NO: 6171217 - DNA, 19 bp, Homo sapiens
cttccattggttcttcctt

SEQ ID NO: 6171218 - DNA, 15 bp, Homo sapiens
cttccatttctgcct

SEQ ID NO: 6171219 - DNA, 15 bp, Homo sapiens
cttccatttcttcca

SEQ ID NO: 6171220 - DNA, 19 bp, Homo sapiens
cttccatttgacaaagtgc

SEQ ID NO: 6171221 - DNA, 14 bp, Homo sapiens
cttccatttgcaag

SEQ ID NO: 6171222 - DNA, 20 bp, Homo sapiens
cttccatttggaatcatatg

SEQ ID NO: 6171223 - DNA, 16 bp, Homo sapiens
cttccatttgtgtgtg

SEQ ID NO: 6171224 - DNA, 16 bp, Homo sapiens
cttccattttaatttt

SEQ ID NO: 6171225 - DNA, 17 bp, Homo sapiens
cttccattttcattctg

SEQ ID NO: 6171226 - DNA, 19 bp, Homo sapiens
cttccattttcccccacta

SEQ ID NO: 6171227 - DNA, 19 bp, Homo sapiens
cttcccaaaccaagtgcct

SEQ ID NO: 6171228 - DNA, 18 bp, Homo sapiens
cttcccaaacccagtctc

SEQ ID NO: 6171229 - DNA, 17 bp, Homo sapiens
cttcccaaactcccagg

SEQ ID NO: 6171230 - DNA, 17 bp, Homo sapiens
cttcccaaagcacaaag

SEQ ID NO: 6171231 - DNA, 14 bp, Homo sapiens
cttcccaaaggact

SEQ ID NO: 6171232 - DNA, 19 bp, Homo sapiens
cttcccaaaggactccacc

SEQ ID NO: 6171233 - DNA, 22 bp, Homo sapiens
cttcccaaatacattaacaagc

SEQ ID NO: 6171234 - DNA, 18 bp, Homo sapiens
cttcccaaatcaaaataa

SEQ ID NO: 6171235 - DNA, 23 bp, Homo sapiens
cttcccaaatgtgtgcccagctt

SEQ ID NO: 6171236 - DNA, 19 bp, Homo sapiens
cttcccaacaatactttgt

SEQ ID NO: 6171237 - DNA, 16 bp, Homo sapiens
cttcccaactgcaagt

SEQ ID NO: 6171238 - DNA, 17 bp, Homo sapiens
cttcccaacttccctgt

SEQ ID NO: 6171239 - DNA, 17 bp, Homo sapiens
cttcccaacttgccttt

SEQ ID NO: 6171240 - DNA, 17 bp, Homo sapiens
cttcccaagaagagaga

SEQ ID NO: 6171241 - DNA, 18 bp, Homo sapiens
cttcccaaggccttaagc

SEQ ID NO: 6171242 - DNA, 22 bp, Homo sapiens
cttcccaaggttactcagcagc

SEQ ID NO: 6171243 - DNA, 23 bp, Homo sapiens
cttcccaagtagctgggattaca

SEQ ID NO: 6171244 - DNA, 16 bp, Homo sapiens
cttcccaagtcctcgc

SEQ ID NO: 6171245 - DNA, 17 bp, Homo sapiens
cttcccaatcagcactg

SEQ ID NO: 6171246 - DNA, 22 bp, Homo sapiens
cttcccaatcagcactgaaaat

SEQ ID NO: 6171247 - DNA, 15 bp, Homo sapiens
cttcccaatcttctt

SEQ ID NO: 6171248 - DNA, 24 bp, Homo sapiens
cttcccacaactactagtgtgact

SEQ ID NO: 6171249 - DNA, 20 bp, Homo sapiens
cttcccacacgattagcttt

SEQ ID NO: 6171250 - DNA, 19 bp, Homo sapiens
cttcccacagcctcttcct

SEQ ID NO: 6171251 - DNA, 23 bp, Homo sapiens
cttcccacatacattaaacacac

SEQ ID NO: 6171252 - DNA, 20 bp, Homo sapiens
cttcccaccaactctctctg

SEQ ID NO: 6171253 - DNA, 21 bp, Homo sapiens
cttcccaccaactctctctgc

SEQ ID NO: 6171254 - DNA, 18 bp, Homo sapiens
cttcccacccctacacac

SEQ ID NO: 6171255 - DNA, 22 bp, Homo sapiens
cttcccacctactgcactttcc

SEQ ID NO: 6171256 - DNA, 11 bp, Homo sapiens
cttcccacctc

SEQ ID NO: 6171257 - DNA, 18 bp, Homo sapiens
cttcccacggccactgca

SEQ ID NO: 6171258 - DNA, 21 bp, Homo sapiens
cttcccacggccactgcagtc

SEQ ID NO: 6171259 - DNA, 22 bp, Homo sapiens
cttcccacgtccctcgagctct

SEQ ID NO: 6171260 - DNA, 17 bp, Homo sapiens
cttcccacgtgggcctc

SEQ ID NO: 6171261 - DNA, 15 bp, Homo sapiens
cttcccactcacccc

SEQ ID NO: 6171262 - DNA, 15 bp, Homo sapiens
cttcccactccagct

SEQ ID NO: 6171263 - DNA, 17 bp, Homo sapiens
cttcccactccagctga

SEQ ID NO: 6171264 - DNA, 15 bp, Homo sapiens
cttcccactcttctc

SEQ ID NO: 6171265 - DNA, 13 bp, Homo sapiens
cttcccactgtcc

SEQ ID NO: 6171266 - DNA, 18 bp, Homo sapiens
cttcccactgtcctttct

SEQ ID NO: 6171267 - DNA, 22 bp, Homo sapiens
cttcccactgtcctttctccag

SEQ ID NO: 6171268 - DNA, 16 bp, Homo sapiens
cttcccacttcttgga

SEQ ID NO: 6171269 - DNA, 10 bp, Homo sapiens
cttcccagac

SEQ ID NO: 6171270 - DNA, 12 bp, Homo sapiens
cttcccagacca

SEQ ID NO: 6171271 - DNA, 16 bp, Homo sapiens
cttcccagaccaggaa

SEQ ID NO: 6171272 - DNA, 23 bp, Homo sapiens
cttcccagaccccgcagcacgcc

SEQ ID NO: 6171273 - DNA, 20 bp, Homo sapiens
cttcccagaggagcagctct

SEQ ID NO: 6171274 - DNA, 15 bp, Homo sapiens
cttcccagaggcaga

SEQ ID NO: 6171275 - DNA, 17 bp, Homo sapiens
cttcccagaggcagagc

SEQ ID NO: 6171276 - DNA, 16 bp, Homo sapiens
cttcccagagggagca

SEQ ID NO: 6171277 - DNA, 19 bp, Homo sapiens
cttcccagagggagcaggc

SEQ ID NO: 6171278 - DNA, 21 bp, Homo sapiens
cttcccagaggggcctgccac

SEQ ID NO: 6171279 - DNA, 22 bp, Homo sapiens
cttcccagaggggcctgccacc

SEQ ID NO: 6171280 - DNA, 13 bp, Homo sapiens
cttcccagcaatt

SEQ ID NO: 6171281 - DNA, 13 bp, Homo sapiens
cttcccagccctc

SEQ ID NO: 6171282 - DNA, 16 bp, Homo sapiens
cttcccagcgctgctg

SEQ ID NO: 6171283 - DNA, 21 bp, Homo sapiens
cttcccagcggttcctgtgca

SEQ ID NO: 6171284 - DNA, 16 bp, Homo sapiens
cttcccagctaggaag

SEQ ID NO: 6171285 - DNA, 13 bp, Homo sapiens
cttcccagctctg

SEQ ID NO: 6171286 - DNA, 16 bp, Homo sapiens
cttcccagctgcccct

SEQ ID NO: 6171287 - DNA, 15 bp, Homo sapiens
cttcccagctggcag

SEQ ID NO: 6171288 - DNA, 18 bp, Homo sapiens
cttcccagctggcagcgc

SEQ ID NO: 6171289 - DNA, 19 bp, Homo sapiens
cttcccagctggcagcgcc

SEQ ID NO: 6171290 - DNA, 20 bp, Homo sapiens
cttcccagctggcagcgcct

SEQ ID NO: 6171291 - DNA, 11 bp, Homo sapiens
cttcccagctt

SEQ ID NO: 6171292 - DNA, 11 bp, Homo sapiens
cttcccaggag

SEQ ID NO: 6171293 - DNA, 19 bp, Homo sapiens
cttcccaggagtggaggag

SEQ ID NO: 6171294 - DNA, 15 bp, Homo sapiens
cttcccaggcccttt

SEQ ID NO: 6171295 - DNA, 20 bp, Homo sapiens
cttcccaggccctttggctt

SEQ ID NO: 6171296 - DNA, 17 bp, Homo sapiens
cttcccaggcctttgga

SEQ ID NO: 6171297 - DNA, 18 bp, Homo sapiens
cttcccaggctggggctg

SEQ ID NO: 6171298 - DNA, 13 bp, Homo sapiens
cttcccagggacc

SEQ ID NO: 6171299 - DNA, 20 bp, Homo sapiens
cttcccagggaccagcacct

SEQ ID NO: 6171300 - DNA, 15 bp, Homo sapiens
cttcccagggcaccc

SEQ ID NO: 6171301 - DNA, 17 bp, Homo sapiens
cttcccagggcacccag

SEQ ID NO: 6171302 - DNA, 19 bp, Homo sapiens
cttcccagggcacccaggc

SEQ ID NO: 6171303 - DNA, 11 bp, Homo sapiens
cttcccagggt

SEQ ID NO: 6171304 - DNA, 19 bp, Homo sapiens
cttcccagggtagcccgcc

SEQ ID NO: 6171305 - DNA, 21 bp, Homo sapiens
cttcccagtaagtttcccctc

SEQ ID NO: 6171306 - DNA, 15 bp, Homo sapiens
cttcccagtggctgc

SEQ ID NO: 6171307 - DNA, 20 bp, Homo sapiens
cttcccagtggctgctgccc

SEQ ID NO: 6171308 - DNA, 22 bp, Homo sapiens
cttcccagttcaggagtcccaa

SEQ ID NO: 6171309 - DNA, 23 bp, Homo sapiens
cttcccagttcaggagtcccaag

SEQ ID NO: 6171310 - DNA, 13 bp, Homo sapiens
cttcccataataa

SEQ ID NO: 6171311 - DNA, 14 bp, Homo sapiens
cttcccataataaa

SEQ ID NO: 6171312 - DNA, 17 bp, Homo sapiens
cttcccataataaagca

SEQ ID NO: 6171313 - DNA, 11 bp, Homo sapiens
cttcccatcac

SEQ ID NO: 6171314 - DNA, 16 bp, Homo sapiens
cttcccatcactggag

SEQ ID NO: 6171315 - DNA, 14 bp, Homo sapiens
cttcccatccccag

SEQ ID NO: 6171316 - DNA, 20 bp, Homo sapiens
cttcccatgacccaggctgg

SEQ ID NO: 6171317 - DNA, 22 bp, Homo sapiens
cttcccatgacccaggctgggc

SEQ ID NO: 6171318 - DNA, 23 bp, Homo sapiens
cttcccatgactgcacccagctc

SEQ ID NO: 6171319 - DNA, 23 bp, Homo sapiens
cttcccatgatgccgctcttctg

SEQ ID NO: 6171320 - DNA, 20 bp, Homo sapiens
cttcccatgcaacaccctct

SEQ ID NO: 6171321 - DNA, 21 bp, Homo sapiens
cttcccatgcaacaccctctt

SEQ ID NO: 6171322 - DNA, 23 bp, Homo sapiens
cttcccatgccggtacacagcca

SEQ ID NO: 6171323 - DNA, 21 bp, Homo sapiens
cttcccatgcctgtctctgtt

SEQ ID NO: 6171324 - DNA, 16 bp, Homo sapiens
cttcccatgtcccacc

SEQ ID NO: 6171325 - DNA, 15 bp, Homo sapiens
cttcccattaaaaat

SEQ ID NO: 6171326 - DNA, 19 bp, Homo sapiens
cttcccattctgccccaga

SEQ ID NO: 6171327 - DNA, 15 bp, Homo sapiens
cttcccattgtggct

SEQ ID NO: 6171328 - DNA, 19 bp, Homo sapiens
cttcccatttcttcccact

SEQ ID NO: 6171329 - DNA, 18 bp, Homo sapiens
cttccccaacacgcagga

SEQ ID NO: 6171330 - DNA, 16 bp, Homo sapiens
cttccccaacttccct

SEQ ID NO: 6171331 - DNA, 18 bp, Homo sapiens
cttccccaacttccctag

SEQ ID NO: 6171332 - DNA, 13 bp, Homo sapiens
cttccccaagatc

SEQ ID NO: 6171333 - DNA, 20 bp, Homo sapiens
cttccccaagcctggcaggg

SEQ ID NO: 6171334 - DNA, 18 bp, Homo sapiens
cttccccaagctttaggt

SEQ ID NO: 6171335 - DNA, 18 bp, Homo sapiens
cttccccaaggcactgag

SEQ ID NO: 6171336 - DNA, 19 bp, Homo sapiens
cttccccaaggcactgagc

SEQ ID NO: 6171337 - DNA, 20 bp, Homo sapiens
cttccccaagggccaaaccc

SEQ ID NO: 6171338 - DNA, 22 bp, Homo sapiens
cttccccaagggccaaacccac

SEQ ID NO: 6171339 - DNA, 13 bp, Homo sapiens
cttccccacaata

SEQ ID NO: 6171340 - DNA, 18 bp, Homo sapiens
cttccccacaataggctt

SEQ ID NO: 6171341 - DNA, 12 bp, Homo sapiens
cttccccacaga

SEQ ID NO: 6171342 - DNA, 14 bp, Homo sapiens
cttccccacagaac

SEQ ID NO: 6171343 - DNA, 20 bp, Homo sapiens
cttccccacccaccaaccct

SEQ ID NO: 6171344 - DNA, 13 bp, Homo sapiens
cttccccacccca

SEQ ID NO: 6171345 - DNA, 22 bp, Homo sapiens
cttccccaccccagtttttgtt

SEQ ID NO: 6171346 - DNA, 14 bp, Homo sapiens
cttccccaccccat

SEQ ID NO: 6171347 - DNA, 23 bp, Homo sapiens
cttccccaccccataagccctga

SEQ ID NO: 6171348 - DNA, 22 bp, Homo sapiens
cttccccacggatggcggtgga

SEQ ID NO: 6171349 - DNA, 13 bp, Homo sapiens
cttccccactccc

SEQ ID NO: 6171350 - DNA, 18 bp, Homo sapiens
cttccccactctgctccc

SEQ ID NO: 6171351 - DNA, 19 bp, Homo sapiens
cttccccactctgctccca

SEQ ID NO: 6171352 - DNA, 21 bp, Homo sapiens
cttccccactctgctcccagc

SEQ ID NO: 6171353 - DNA, 11 bp, Homo sapiens
cttccccactg

SEQ ID NO: 6171354 - DNA, 19 bp, Homo sapiens
cttccccactgcctgccca

SEQ ID NO: 6171355 - DNA, 14 bp, Homo sapiens
cttccccagaccca

SEQ ID NO: 6171356 - DNA, 20 bp, Homo sapiens
cttccccagacccagaggtc

SEQ ID NO: 6171357 - DNA, 21 bp, Homo sapiens
cttccccagacccagaggtcc

SEQ ID NO: 6171358 - DNA, 21 bp, Homo sapiens
cttccccagacgcctggctgc

SEQ ID NO: 6171359 - DNA, 12 bp, Homo sapiens
cttccccagact

SEQ ID NO: 6171360 - DNA, 16 bp, Homo sapiens
ctgcctccaccgagcc

SEQ ID NO: 6171361 - DNA, 17 bp, Homo sapiens
ctgcctccaccgagcca

SEQ ID NO: 6171362 - DNA, 14 bp, Homo sapiens
ctgcctccactccc

SEQ ID NO: 6171363 - DNA, 17 bp, Homo sapiens
ctgcctccactcccact

SEQ ID NO: 6171364 - DNA, 13 bp, Homo sapiens
ctgcctccagccg

SEQ ID NO: 6171365 - DNA, 21 bp, Homo sapiens
ctgcctccagcctggtggccc

SEQ ID NO: 6171366 - DNA, 22 bp, Homo sapiens
ctgcctccagcctggtggccca

SEQ ID NO: 6171367 - DNA, 12 bp, Homo sapiens
ctgcctccagct

SEQ ID NO: 6171368 - DNA, 15 bp, Homo sapiens
ctgcctccagctgtc

SEQ ID NO: 6171369 - DNA, 21 bp, Homo sapiens
ctgcctccagctgtcagcctg

SEQ ID NO: 6171370 - DNA, 15 bp, Homo sapiens
ctgcctccaggaggg

SEQ ID NO: 6171371 - DNA, 20 bp, Homo sapiens
ctgcctccagggctggactg

SEQ ID NO: 6171372 - DNA, 23 bp, Homo sapiens
ctgcctccagggctggactgagg

SEQ ID NO: 6171373 - DNA, 20 bp, Homo sapiens
ctgcctccatggcagcagcc

SEQ ID NO: 6171374 - DNA, 16 bp, Homo sapiens
ctgcctccattatcca

SEQ ID NO: 6171375 - DNA, 21 bp, Homo sapiens
ctgcctccattatccattccc

SEQ ID NO: 6171376 - DNA, 18 bp, Homo sapiens
ctgcctccattctgacca

SEQ ID NO: 6171377 - DNA, 11 bp, Homo sapiens
ctgcctcccaa

SEQ ID NO: 6171378 - DNA, 21 bp, Homo sapiens
ctgcctcccaacagtggggaa

SEQ ID NO: 6171379 - DNA, 17 bp, Homo sapiens
ctgcctcccaagcagct

SEQ ID NO: 6171380 - DNA, 23 bp, Homo sapiens
ctgcctcccaagcagctgaaggg

SEQ ID NO: 6171381 - DNA, 23 bp, Homo sapiens
ctgcctcccaaggtcctctcagt

SEQ ID NO: 6171382 - DNA, 12 bp, Homo sapiens
ctgcctcccact

SEQ ID NO: 6171383 - DNA, 14 bp, Homo sapiens
ctgcctcccacttc

SEQ ID NO: 6171384 - DNA, 22 bp, Homo sapiens
ctgcctcccagccctgccagga

SEQ ID NO: 6171385 - DNA, 14 bp, Homo sapiens
ctgcctcccaggtt

SEQ ID NO: 6171386 - DNA, 12 bp, Homo sapiens
ctgcctcccatc

SEQ ID NO: 6171387 - DNA, 13 bp, Homo sapiens
ctgcctcccatgc

SEQ ID NO: 6171388 - DNA, 20 bp, Homo sapiens
ctgcctcccattctgcacca

SEQ ID NO: 6171389 - DNA, 12 bp, Homo sapiens
ctgcctccccaa

SEQ ID NO: 6171390 - DNA, 15 bp, Homo sapiens
ctgcctccccaaccc

SEQ ID NO: 6171391 - DNA, 16 bp, Homo sapiens
ctgcctccccaaccct

SEQ ID NO: 6171392 - DNA, 18 bp, Homo sapiens
ctgcctccccaaccctgc

SEQ ID NO: 6171393 - DNA, 19 bp, Homo sapiens
ctgcctccccaaccctgcc

SEQ ID NO: 6171394 - DNA, 16 bp, Homo sapiens
ctgcctcccctgtgca

SEQ ID NO: 6171395 - DNA, 20 bp, Homo sapiens
ctgcctccctcaccctgagc

SEQ ID NO: 6171396 - DNA, 22 bp, Homo sapiens
ctgcctccctcaccctgagccc

SEQ ID NO: 6171397 - DNA, 13 bp, Homo sapiens
ctgcctccctctc

SEQ ID NO: 6171398 - DNA, 23 bp, Homo sapiens
ctgcctccctctccatatctcct

SEQ ID NO: 6171399 - DNA, 18 bp, Homo sapiens
ctgcctccctctcttccg

SEQ ID NO: 6171400 - DNA, 19 bp, Homo sapiens
ctgcctccctctcttccgg

SEQ ID NO: 6171401 - DNA, 22 bp, Homo sapiens
ctgcctccctctcttccgggag

SEQ ID NO: 6171402 - DNA, 15 bp, Homo sapiens
ctgcctccctgggga

SEQ ID NO: 6171403 - DNA, 21 bp, Homo sapiens
ctgcctcccttcatgcatgga

SEQ ID NO: 6171404 - DNA, 16 bp, Homo sapiens
ctgcctcccttgtggc

SEQ ID NO: 6171405 - DNA, 23 bp, Homo sapiens
ctgcctccgcgtgatcaaagcca

SEQ ID NO: 6171406 - DNA, 14 bp, Homo sapiens
ctgcctccgctggc

SEQ ID NO: 6171407 - DNA, 23 bp, Homo sapiens
ctgcctccgggaggtcatttttt

SEQ ID NO: 6171408 - DNA, 20 bp, Homo sapiens
ctgcctccgggcaggcaagg

SEQ ID NO: 6171409 - DNA, 21 bp, Homo sapiens
ctgcctccgggcctcggcctg

SEQ ID NO: 6171410 - DNA, 17 bp, Homo sapiens
ctgcctcctaggctgga

SEQ ID NO: 6171411 - DNA, 11 bp, Homo sapiens
ctgcctcctca

SEQ ID NO: 6171412 - DNA, 14 bp, Homo sapiens
ctgcctcctcagca

SEQ ID NO: 6171413 - DNA, 22 bp, Homo sapiens
ctgcctcctccctcccagctgc

SEQ ID NO: 6171414 - DNA, 19 bp, Homo sapiens
ctgcctcctccctggctgc

SEQ ID NO: 6171415 - DNA, 22 bp, Homo sapiens
ctgcctcctccctggctgcagc

SEQ ID NO: 6171416 - DNA, 14 bp, Homo sapiens
ctgcctcctcctca

SEQ ID NO: 6171417 - DNA, 18 bp, Homo sapiens
ctgcctcctcctcacgca

SEQ ID NO: 6171418 - DNA, 19 bp, Homo sapiens
ctgcctcctcgttcctttc

SEQ ID NO: 6171419 - DNA, 13 bp, Homo sapiens
ctgcctcctcttc

SEQ ID NO: 6171420 - DNA, 12 bp, Homo sapiens
ctgcctcctgcc

SEQ ID NO: 6171421 - DNA, 14 bp, Homo sapiens
ctgcctcctgccac

SEQ ID NO: 6171422 - DNA, 15 bp, Homo sapiens
ctgcctcctgccacc

SEQ ID NO: 6171423 - DNA, 21 bp, Homo sapiens
ctgcctcctgccaccccttcc

SEQ ID NO: 6171424 - DNA, 15 bp, Homo sapiens
ctgcctcctgccggc

SEQ ID NO: 6171425 - DNA, 14 bp, Homo sapiens
ctgcctcctgccta

SEQ ID NO: 6171426 - DNA, 14 bp, Homo sapiens
ctgcctcctgcctc

SEQ ID NO: 6171427 - DNA, 16 bp, Homo sapiens
ctgcctcctgcctgcc

SEQ ID NO: 6171428 - DNA, 16 bp, Homo sapiens
ctgcctcctgcctggg

SEQ ID NO: 6171429 - DNA, 17 bp, Homo sapiens
ctgcctcctgcctgggg

SEQ ID NO: 6171430 - DNA, 12 bp, Homo sapiens
ctgcctcctgct

SEQ ID NO: 6171431 - DNA, 20 bp, Homo sapiens
ctgcctcctggctcaggccc

SEQ ID NO: 6171432 - DNA, 14 bp, Homo sapiens
ctgcctcctgggtt

SEQ ID NO: 6171433 - DNA, 20 bp, Homo sapiens
ctgcctcctgttttctccct

SEQ ID NO: 6171434 - DNA, 18 bp, Homo sapiens
ctgcctccttcagtgaca

SEQ ID NO: 6171435 - DNA, 23 bp, Homo sapiens
ctgcctcctttgtgaggaagccg

SEQ ID NO: 6171436 - DNA, 18 bp, Homo sapiens
ctgcctcgaaacacagaa

SEQ ID NO: 6171437 - DNA, 19 bp, Homo sapiens
ctgcctcgaaacacagaaa

SEQ ID NO: 6171438 - DNA, 18 bp, Homo sapiens
ctgcctcgcccccacttt

SEQ ID NO: 6171439 - DNA, 23 bp, Homo sapiens
ctgcctcgcccccacttttctag

SEQ ID NO: 6171440 - DNA, 15 bp, Homo sapiens
ctgcctcgccttgtg

SEQ ID NO: 6171441 - DNA, 20 bp, Homo sapiens
ctgcctcggactccatggct

SEQ ID NO: 6171442 - DNA, 21 bp, Homo sapiens
ctgcctcggttgattgtgcat

SEQ ID NO: 6171443 - DNA, 17 bp, Homo sapiens
ctgcctctaactccctc

SEQ ID NO: 6171444 - DNA, 23 bp, Homo sapiens
ctgcctctaactccctcctcaca

SEQ ID NO: 6171445 - DNA, 17 bp, Homo sapiens
ctgcctctactgggaag

SEQ ID NO: 6171446 - DNA, 21 bp, Homo sapiens
ctgcctctatccctggccacc

SEQ ID NO: 6171447 - DNA, 19 bp, Homo sapiens
ctgcctctatgccctgcag

SEQ ID NO: 6171448 - DNA, 21 bp, Homo sapiens
ctgcctctatgccctgcagag

SEQ ID NO: 6171449 - DNA, 22 bp, Homo sapiens
ctgcctctatgccctgcagagc

SEQ ID NO: 6171450 - DNA, 19 bp, Homo sapiens
ctgcctctatttttgttgg

SEQ ID NO: 6171451 - DNA, 16 bp, Homo sapiens
ctgcctctcacacaca

SEQ ID NO: 6171452 - DNA, 21 bp, Homo sapiens
ctgcctctcacacacatagat

SEQ ID NO: 6171453 - DNA, 11 bp, Homo sapiens
ctgcctctccc

SEQ ID NO: 6171454 - DNA, 18 bp, Homo sapiens
ctgcctctcccaggcagg

SEQ ID NO: 6171455 - DNA, 20 bp, Homo sapiens
ctgcctctcccaggcagggg

SEQ ID NO: 6171456 - DNA, 15 bp, Homo sapiens
ctgcctctcccatca

SEQ ID NO: 6171457 - DNA, 23 bp, Homo sapiens
ctgcctctcccatcacttcccta

SEQ ID NO: 6171458 - DNA, 15 bp, Homo sapiens
ctgcctctccccaaa

SEQ ID NO: 6171459 - DNA, 12 bp, Homo sapiens
ctgcctctccct

SEQ ID NO: 6171460 - DNA, 17 bp, Homo sapiens
ctgcctctccctggccc

SEQ ID NO: 6171461 - DNA, 22 bp, Homo sapiens
ctgcctctccgcccctgagccc

SEQ ID NO: 6171462 - DNA, 23 bp, Homo sapiens
ctgcctctccgcccctgagccca

SEQ ID NO: 6171463 - DNA, 21 bp, Homo sapiens
ctgcctctcgctcctcaaccc

SEQ ID NO: 6171464 - DNA, 14 bp, Homo sapiens
ctgcctctctagga

SEQ ID NO: 6171465 - DNA, 23 bp, Homo sapiens
ctgcctctctcatggcttgggct

SEQ ID NO: 6171466 - DNA, 14 bp, Homo sapiens
ctgcctctctgcag

SEQ ID NO: 6171467 - DNA, 16 bp, Homo sapiens
ctgcctctctgcaggt

SEQ ID NO: 6171468 - DNA, 18 bp, Homo sapiens
ctgcctctctgcaggtcc

SEQ ID NO: 6171469 - DNA, 17 bp, Homo sapiens
ctgcctctctgctccag

SEQ ID NO: 6171470 - DNA, 18 bp, Homo sapiens
ctgcctctctgctccaga

SEQ ID NO: 6171471 - DNA, 12 bp, Homo sapiens
ctgcctctctgg

SEQ ID NO: 6171472 - DNA, 14 bp, Homo sapiens
ctgcctctgaactg

SEQ ID NO: 6171473 - DNA, 20 bp, Homo sapiens
ctgcctctgacagcagcctg

SEQ ID NO: 6171474 - DNA, 22 bp, Homo sapiens
ctgcctctgacagcagcctgtg

SEQ ID NO: 6171475 - DNA, 12 bp, Homo sapiens
ctgcctctgacc

SEQ ID NO: 6171476 - DNA, 10 bp, Homo sapiens
ctgcctctgc

SEQ ID NO: 6171477 - DNA, 13 bp, Homo sapiens
ctgcctctgccac

SEQ ID NO: 6171478 - DNA, 14 bp, Homo sapiens
ctgcctctgccaca

SEQ ID NO: 6171479 - DNA, 16 bp, Homo sapiens
ctgcctctgccacact

SEQ ID NO: 6171480 - DNA, 17 bp, Homo sapiens
ctgcctctgccacagca

SEQ ID NO: 6171481 - DNA, 14 bp, Homo sapiens
ctgcctctgcctgc

SEQ ID NO: 6171482 - DNA, 20 bp, Homo sapiens
ctgcctctgcctgcattctg

SEQ ID NO: 6171483 - DNA, 12 bp, Homo sapiens
ctgcctctgctc

SEQ ID NO: 6171484 - DNA, 14 bp, Homo sapiens
ctgcctctgctccc

SEQ ID NO: 6171485 - DNA, 16 bp, Homo sapiens
ctgcctctgctccctc

SEQ ID NO: 6171486 - DNA, 17 bp, Homo sapiens
ctgcctctgctccctct

SEQ ID NO: 6171487 - DNA, 11 bp, Homo sapiens
ctgcctctggg

SEQ ID NO: 6171488 - DNA, 12 bp, Homo sapiens
ctgcctctgggc

SEQ ID NO: 6171489 - DNA, 13 bp, Homo sapiens
ctgcctctgggca

SEQ ID NO: 6171490 - DNA, 19 bp, Homo sapiens
ctgcctctgggcagcctgc

SEQ ID NO: 6171491 - DNA, 20 bp, Homo sapiens
ctgcctctgggcagcctgct

SEQ ID NO: 6171492 - DNA, 23 bp, Homo sapiens
ctgcctctgggcagcctgctttg

SEQ ID NO: 6171493 - DNA, 14 bp, Homo sapiens
ctgcctctgggtga

SEQ ID NO: 6171494 - DNA, 19 bp, Homo sapiens
ctgcctctgtggaagagat

SEQ ID NO: 6171495 - DNA, 12 bp, Homo sapiens
ctgcctctgtgt

SEQ ID NO: 6171496 - DNA, 19 bp, Homo sapiens
ctgcctcttaaataaacct

SEQ ID NO: 6171497 - DNA, 16 bp, Homo sapiens
ctgcctcttaactcct

SEQ ID NO: 6171498 - DNA, 23 bp, Homo sapiens
ctgcctcttagacttctgctttc

SEQ ID NO: 6171499 - DNA, 21 bp, Homo sapiens
ctgcctcttccccctgcttcc

SEQ ID NO: 6171500 - DNA, 18 bp, Homo sapiens
ctgcctcttccctcttcc

SEQ ID NO: 6171501 - DNA, 19 bp, Homo sapiens
ctgcctcttccctcttcct

SEQ ID NO: 6171502 - DNA, 19 bp, Homo sapiens
ctgcctcttggcttctcag

SEQ ID NO: 6171503 - DNA, 22 bp, Homo sapiens
ctgcctcttgggttcaagtgat

SEQ ID NO: 6171504 - DNA, 20 bp, Homo sapiens
ctgcctcttgtttctgtgcc

SEQ ID NO: 6171505 - DNA, 19 bp, Homo sapiens
ctgcctctttccctaggaa

SEQ ID NO: 6171506 - DNA, 16 bp, Homo sapiens
ctgcctgaaaaccatc

SEQ ID NO: 6171507 - DNA, 16 bp, Homo sapiens
ctgcctgaaacagcca

SEQ ID NO: 6171508 - DNA, 17 bp, Homo sapiens
ctgcctgaaacagccat

SEQ ID NO: 6171509 - DNA, 18 bp, Homo sapiens
ctgcctgaaacagccatg

SEQ ID NO: 6171510 - DNA, 19 bp, Homo sapiens
ctgcctgaacctggggtca

SEQ ID NO: 6171511 - DNA, 15 bp, Homo sapiens
ctgcctgaagtcaca

SEQ ID NO: 6171512 - DNA, 16 bp, Homo sapiens
ctgcctgaagtcacac

SEQ ID NO: 6171513 - DNA, 15 bp, Homo sapiens
ctgcctgacaaggcc

SEQ ID NO: 6171514 - DNA, 17 bp, Homo sapiens
ctgcctgacaaggccag

SEQ ID NO: 6171515 - DNA, 18 bp, Homo sapiens
ctgcctgacaaggccagc

SEQ ID NO: 6171516 - DNA, 21 bp, Homo sapiens
ctgcctgacactgagccccac

SEQ ID NO: 6171517 - DNA, 20 bp, Homo sapiens
ctgcctgacagagggatgga

SEQ ID NO: 6171518 - DNA, 23 bp, Homo sapiens
ctgcctgacatttggagtgttcc

SEQ ID NO: 6171519 - DNA, 11 bp, Homo sapiens
ctgcctgaccc

SEQ ID NO: 6171520 - DNA, 18 bp, Homo sapiens
ctgcctgacccatccctt

SEQ ID NO: 6171521 - DNA, 17 bp, Homo sapiens
ctgcctgaccccaggcc

SEQ ID NO: 6171522 - DNA, 15 bp, Homo sapiens
ctgcctgaccttgga

SEQ ID NO: 6171523 - DNA, 21 bp, Homo sapiens
ctgcctgagaatgttaccaga

SEQ ID NO: 6171524 - DNA, 13 bp, Homo sapiens
ctgcctgagattc

SEQ ID NO: 6171525 - DNA, 12 bp, Homo sapiens
ctgcctgagccc

SEQ ID NO: 6171526 - DNA, 14 bp, Homo sapiens
ctgcctgagcccag

SEQ ID NO: 6171527 - DNA, 12 bp, Homo sapiens
ctgcctgagctt

SEQ ID NO: 6171528 - DNA, 15 bp, Homo sapiens
ctgcctgaggaggag

SEQ ID NO: 6171529 - DNA, 18 bp, Homo sapiens
ctgcctgagggcccctct

SEQ ID NO: 6171530 - DNA, 20 bp, Homo sapiens
ctgcctgaggggcagcctgc

SEQ ID NO: 6171531 - DNA, 23 bp, Homo sapiens
ctgcctgaggggcagcctgcctt

SEQ ID NO: 6171532 - DNA, 16 bp, Homo sapiens
ctgcctgagggtgggc

SEQ ID NO: 6171533 - DNA, 18 bp, Homo sapiens
ctgcctgagtattactag

SEQ ID NO: 6171534 - DNA, 20 bp, Homo sapiens
ctgcctgagtcgtgacctgc

SEQ ID NO: 6171535 - DNA, 18 bp, Homo sapiens
ctgcctgataccctgctt

SEQ ID NO: 6171536 - DNA, 16 bp, Homo sapiens
ctgcctgatggacctg

SEQ ID NO: 6171537 - DNA, 18 bp, Homo sapiens
ctgcctgcaaacctgctg

SEQ ID NO: 6171538 - DNA, 20 bp, Homo sapiens
ctgcctgcaatatttgaatt

SEQ ID NO: 6171539 - DNA, 17 bp, Homo sapiens
cttccccagactcagct

SEQ ID NO: 6171540 - DNA, 18 bp, Homo sapiens
cttccccagactcagctc

SEQ ID NO: 6171541 - DNA, 20 bp, Homo sapiens
cttccccagactcagctcca

SEQ ID NO: 6171542 - DNA, 14 bp, Homo sapiens
cttccccagacttg

SEQ ID NO: 6171543 - DNA, 17 bp, Homo sapiens
cttccccagacttgcac

SEQ ID NO: 6171544 - DNA, 13 bp, Homo sapiens
cttccccagccct

SEQ ID NO: 6171545 - DNA, 19 bp, Homo sapiens
cttccccagcccttagcac

SEQ ID NO: 6171546 - DNA, 13 bp, Homo sapiens
cttccccagcctc

SEQ ID NO: 6171547 - DNA, 14 bp, Homo sapiens
cttccccagcctct

SEQ ID NO: 6171548 - DNA, 14 bp, Homo sapiens
cttccccagcgtcc

SEQ ID NO: 6171549 - DNA, 13 bp, Homo sapiens
cttccccagctca

SEQ ID NO: 6171550 - DNA, 15 bp, Homo sapiens
cttccccagctcaga

SEQ ID NO: 6171551 - DNA, 21 bp, Homo sapiens
cttccccagctcagagccccg

SEQ ID NO: 6171552 - DNA, 10 bp, Homo sapiens
cttccccagg

SEQ ID NO: 6171553 - DNA, 17 bp, Homo sapiens
cttccccaggagctctc

SEQ ID NO: 6171554 - DNA, 12 bp, Homo sapiens
cttccccaggat

SEQ ID NO: 6171555 - DNA, 13 bp, Homo sapiens
cttccccaggccc

SEQ ID NO: 6171556 - DNA, 18 bp, Homo sapiens
cttccccaggcccaccat

SEQ ID NO: 6171557 - DNA, 19 bp, Homo sapiens
cttccccaggcccaccatc

SEQ ID NO: 6171558 - DNA, 13 bp, Homo sapiens
cttccccatcagc

SEQ ID NO: 6171559 - DNA, 18 bp, Homo sapiens
cttccccatcagctccca

SEQ ID NO: 6171560 - DNA, 14 bp, Homo sapiens
cttccccatcccga

SEQ ID NO: 6171561 - DNA, 18 bp, Homo sapiens
cttccccatcttctaaac

SEQ ID NO: 6171562 - DNA, 19 bp, Homo sapiens
cttccccatgcttccttgc

SEQ ID NO: 6171563 - DNA, 12 bp, Homo sapiens
cttccccatggg

SEQ ID NO: 6171564 - DNA, 13 bp, Homo sapiens
cttccccatggga

SEQ ID NO: 6171565 - DNA, 14 bp, Homo sapiens
cttccccatgggaa

SEQ ID NO: 6171566 - DNA, 18 bp, Homo sapiens
cttccccatttccactgt

SEQ ID NO: 6171567 - DNA, 13 bp, Homo sapiens
cttcccccaaggc

SEQ ID NO: 6171568 - DNA, 16 bp, Homo sapiens
cttcccccaaggctga

SEQ ID NO: 6171569 - DNA, 15 bp, Homo sapiens
cttcccccaccacca

SEQ ID NO: 6171570 - DNA, 20 bp, Homo sapiens
cttcccccaccccagaagat

SEQ ID NO: 6171571 - DNA, 18 bp, Homo sapiens
cttcccccacccctccac

SEQ ID NO: 6171572 - DNA, 15 bp, Homo sapiens
cttcccccaccctgg

SEQ ID NO: 6171573 - DNA, 16 bp, Homo sapiens
cttcccccaccctggg

SEQ ID NO: 6171574 - DNA, 14 bp, Homo sapiens
cttcccccacttca

SEQ ID NO: 6171575 - DNA, 17 bp, Homo sapiens
cttcccccagcccaata

SEQ ID NO: 6171576 - DNA, 19 bp, Homo sapiens
cttcccccagcccaataaa

SEQ ID NO: 6171577 - DNA, 20 bp, Homo sapiens
cttcccccagcccaataaag

SEQ ID NO: 6171578 - DNA, 16 bp, Homo sapiens
cttcccccagcccatc

SEQ ID NO: 6171579 - DNA, 15 bp, Homo sapiens
cttcccccagctttc

SEQ ID NO: 6171580 - DNA, 18 bp, Homo sapiens
cttcccccatagccaccc

SEQ ID NO: 6171581 - DNA, 13 bp, Homo sapiens
cttcccccatccc

SEQ ID NO: 6171582 - DNA, 22 bp, Homo sapiens
cttcccccatcccctttcctcc

SEQ ID NO: 6171583 - DNA, 14 bp, Homo sapiens
cttcccccatccct

SEQ ID NO: 6171584 - DNA, 23 bp, Homo sapiens
cttcccccatccctaccactgtg

SEQ ID NO: 6171585 - DNA, 17 bp, Homo sapiens
cttcccccatgtgcctg

SEQ ID NO: 6171586 - DNA, 21 bp, Homo sapiens
cttccccccagatacccatct

SEQ ID NO: 6171587 - DNA, 12 bp, Homo sapiens
cttccccctcca

SEQ ID NO: 6171588 - DNA, 13 bp, Homo sapiens
cttccccctccat

SEQ ID NO: 6171589 - DNA, 15 bp, Homo sapiens
cttccccctccccct

SEQ ID NO: 6171590 - DNA, 20 bp, Homo sapiens
cttccccctccccctcctgc

SEQ ID NO: 6171591 - DNA, 15 bp, Homo sapiens
cttccccctgctgat

SEQ ID NO: 6171592 - DNA, 13 bp, Homo sapiens
cttcccccttcca

SEQ ID NO: 6171593 - DNA, 20 bp, Homo sapiens
cttcccccttcccctgcgcc

SEQ ID NO: 6171594 - DNA, 16 bp, Homo sapiens
cttccccctttactat

SEQ ID NO: 6171595 - DNA, 23 bp, Homo sapiens
cttccccctttctctgcctggca

SEQ ID NO: 6171596 - DNA, 17 bp, Homo sapiens
cttccccgatgtgagcc

SEQ ID NO: 6171597 - DNA, 22 bp, Homo sapiens
cttccccgatgtgagccgcctc

SEQ ID NO: 6171598 - DNA, 15 bp, Homo sapiens
cttccccgtcccctg

SEQ ID NO: 6171599 - DNA, 12 bp, Homo sapiens
cttcccctagac

SEQ ID NO: 6171600 - DNA, 16 bp, Homo sapiens
cttcccctagacctcc

SEQ ID NO: 6171601 - DNA, 17 bp, Homo sapiens
cttcccctagacctccc

SEQ ID NO: 6171602 - DNA, 13 bp, Homo sapiens
cttcccctatgat

SEQ ID NO: 6171603 - DNA, 12 bp, Homo sapiens
cttcccctcact

SEQ ID NO: 6171604 - DNA, 14 bp, Homo sapiens
cttcccctccagga

SEQ ID NO: 6171605 - DNA, 15 bp, Homo sapiens
cttcccctccaggag

SEQ ID NO: 6171606 - DNA, 16 bp, Homo sapiens
cttcccctcccagccc

SEQ ID NO: 6171607 - DNA, 19 bp, Homo sapiens
cttcccctcccagccctga

SEQ ID NO: 6171608 - DNA, 21 bp, Homo sapiens
cttcccctcccagccctgagg

SEQ ID NO: 6171609 - DNA, 22 bp, Homo sapiens
cttcccctcccagccctgaggg

SEQ ID NO: 6171610 - DNA, 23 bp, Homo sapiens
cttcccctcccagccctgagggg

SEQ ID NO: 6171611 - DNA, 13 bp, Homo sapiens
cttcccctcccta

SEQ ID NO: 6171612 - DNA, 17 bp, Homo sapiens
cttcccctccctaccct

SEQ ID NO: 6171613 - DNA, 14 bp, Homo sapiens
cttcccctccctgg

SEQ ID NO: 6171614 - DNA, 20 bp, Homo sapiens
cttcccctccctggctccca

SEQ ID NO: 6171615 - DNA, 14 bp, Homo sapiens
cttcccctccctgt

SEQ ID NO: 6171616 - DNA, 23 bp, Homo sapiens
cttcccctcctacccctcccagc

SEQ ID NO: 6171617 - DNA, 14 bp, Homo sapiens
cttcccctcctgta

SEQ ID NO: 6171618 - DNA, 19 bp, Homo sapiens
cttcccctctaatgctcac

SEQ ID NO: 6171619 - DNA, 21 bp, Homo sapiens
cttcccctgagagtttcctca

SEQ ID NO: 6171620 - DNA, 14 bp, Homo sapiens
cttcccctgaggac

SEQ ID NO: 6171621 - DNA, 15 bp, Homo sapiens
cttcccctgcctcct

SEQ ID NO: 6171622 - DNA, 15 bp, Homo sapiens
cttcccctgcctggt

SEQ ID NO: 6171623 - DNA, 15 bp, Homo sapiens
cttcccctgcgccct

SEQ ID NO: 6171624 - DNA, 19 bp, Homo sapiens
cttcccctgcgccctccct

SEQ ID NO: 6171625 - DNA, 16 bp, Homo sapiens
cttcccctgctgacct

SEQ ID NO: 6171626 - DNA, 13 bp, Homo sapiens
cttcccctgggaa

SEQ ID NO: 6171627 - DNA, 14 bp, Homo sapiens
cttcccctgggaac

SEQ ID NO: 6171628 - DNA, 15 bp, Homo sapiens
cttcccctgggaact

SEQ ID NO: 6171629 - DNA, 22 bp, Homo sapiens
cttcccctgggaactctcctgg

SEQ ID NO: 6171630 - DNA, 15 bp, Homo sapiens
cttcccctgggatgc

SEQ ID NO: 6171631 - DNA, 14 bp, Homo sapiens
cttcccctgggccc

SEQ ID NO: 6171632 - DNA, 13 bp, Homo sapiens
cttcccctgtctt

SEQ ID NO: 6171633 - DNA, 21 bp, Homo sapiens
cttccccttagagtgctgtga

SEQ ID NO: 6171634 - DNA, 13 bp, Homo sapiens
cttccccttccct

SEQ ID NO: 6171635 - DNA, 14 bp, Homo sapiens
cttccccttccctt

SEQ ID NO: 6171636 - DNA, 14 bp, Homo sapiens
cttccccttcctaa

SEQ ID NO: 6171637 - DNA, 17 bp, Homo sapiens
cttccccttcctgtttc

SEQ ID NO: 6171638 - DNA, 19 bp, Homo sapiens
cttccccttgaacctcatt

SEQ ID NO: 6171639 - DNA, 20 bp, Homo sapiens
cttccccttgaacctcatta

SEQ ID NO: 6171640 - DNA, 12 bp, Homo sapiens
cttccccttgca

SEQ ID NO: 6171641 - DNA, 12 bp, Homo sapiens
cttccccttgcc

SEQ ID NO: 6171642 - DNA, 13 bp, Homo sapiens
cttccccttgccc

SEQ ID NO: 6171643 - DNA, 16 bp, Homo sapiens
cttccccttgcccagg

SEQ ID NO: 6171644 - DNA, 23 bp, Homo sapiens
cttccccttgcccagggctcagc

SEQ ID NO: 6171645 - DNA, 22 bp, Homo sapiens
cttccccttgcccttgccctga

SEQ ID NO: 6171646 - DNA, 18 bp, Homo sapiens
cttccccttgtccctggg

SEQ ID NO: 6171647 - DNA, 19 bp, Homo sapiens
cttccccttgtccctgggg

SEQ ID NO: 6171648 - DNA, 20 bp, Homo sapiens
cttccccttgtccctggggc

SEQ ID NO: 6171649 - DNA, 21 bp, Homo sapiens
cttccccttgtccctggggca

SEQ ID NO: 6171650 - DNA, 17 bp, Homo sapiens
cttcccctttactcagc

SEQ ID NO: 6171651 - DNA, 18 bp, Homo sapiens
cttcccctttactcagcc

SEQ ID NO: 6171652 - DNA, 23 bp, Homo sapiens
cttcccctttactcagcccagct

SEQ ID NO: 6171653 - DNA, 14 bp, Homo sapiens
cttcccctttcctg

SEQ ID NO: 6171654 - DNA, 16 bp, Homo sapiens
cttcccctttgtcctg

SEQ ID NO: 6171655 - DNA, 17 bp, Homo sapiens
cttcccctttgtcctgc

SEQ ID NO: 6171656 - DNA, 19 bp, Homo sapiens
cttcccctttgtcctgcgt

SEQ ID NO: 6171657 - DNA, 20 bp, Homo sapiens
cttcccgacccagccagctg

SEQ ID NO: 6171658 - DNA, 13 bp, Homo sapiens
cttcccgcagcac

SEQ ID NO: 6171659 - DNA, 16 bp, Homo sapiens
cttcccgcagcaccag

SEQ ID NO: 6171660 - DNA, 15 bp, Homo sapiens
cttcccgccagaggg

SEQ ID NO: 6171661 - DNA, 14 bp, Homo sapiens
cttcccgccccacc

SEQ ID NO: 6171662 - DNA, 16 bp, Homo sapiens
cttcccgccccacctc

SEQ ID NO: 6171663 - DNA, 19 bp, Homo sapiens
cttcccgccggaggccagc

SEQ ID NO: 6171664 - DNA, 15 bp, Homo sapiens
cttcccgcctcagcc

SEQ ID NO: 6171665 - DNA, 15 bp, Homo sapiens
cttcccgcctcggct

SEQ ID NO: 6171666 - DNA, 20 bp, Homo sapiens
cttcccgccttcaggttcct

SEQ ID NO: 6171667 - DNA, 14 bp, Homo sapiens
cttcccgccttcca

SEQ ID NO: 6171668 - DNA, 16 bp, Homo sapiens
cttcccgctcagccct

SEQ ID NO: 6171669 - DNA, 23 bp, Homo sapiens
cttcccgctcagccctccctgcc

SEQ ID NO: 6171670 - DNA, 17 bp, Homo sapiens
cttcccgctccccacct

SEQ ID NO: 6171671 - DNA, 14 bp, Homo sapiens
cttcccgctgcaca

SEQ ID NO: 6171672 - DNA, 18 bp, Homo sapiens
cttcccgctgcacatgga

SEQ ID NO: 6171673 - DNA, 13 bp, Homo sapiens
cttcccgggcggg

SEQ ID NO: 6171674 - DNA, 18 bp, Homo sapiens
cttcccgtagctgccagt

SEQ ID NO: 6171675 - DNA, 22 bp, Homo sapiens
cttcccgtcccatatcctgcct

SEQ ID NO: 6171676 - DNA, 23 bp, Homo sapiens
cttcccgtcccatatcctgcctc

SEQ ID NO: 6171677 - DNA, 15 bp, Homo sapiens
cttccctaaactgca

SEQ ID NO: 6171678 - DNA, 17 bp, Homo sapiens
cttccctaaactgcagc

SEQ ID NO: 6171679 - DNA, 21 bp, Homo sapiens
cttccctaaactgcagcctct

SEQ ID NO: 6171680 - DNA, 17 bp, Homo sapiens
cttccctaacttaacat

SEQ ID NO: 6171681 - DNA, 19 bp, Homo sapiens
cttccctaatagcttttta

SEQ ID NO: 6171682 - DNA, 22 bp, Homo sapiens
cttccctaatcctccaagtctt

SEQ ID NO: 6171683 - DNA, 19 bp, Homo sapiens
cttccctacacagggcctg

SEQ ID NO: 6171684 - DNA, 21 bp, Homo sapiens
cttccctacacgatccgcaac

SEQ ID NO: 6171685 - DNA, 14 bp, Homo sapiens
cttccctacccaca

SEQ ID NO: 6171686 - DNA, 16 bp, Homo sapiens
cttccctacccacagg

SEQ ID NO: 6171687 - DNA, 18 bp, Homo sapiens
cttccctacccacagggc

SEQ ID NO: 6171688 - DNA, 19 bp, Homo sapiens
cttccctacccacagggcc

SEQ ID NO: 6171689 - DNA, 20 bp, Homo sapiens
cttccctacccacagggcct

SEQ ID NO: 6171690 - DNA, 21 bp, Homo sapiens
cttccctacccacagggcctg

SEQ ID NO: 6171691 - DNA, 18 bp, Homo sapiens
cttccctacccttcctgc

SEQ ID NO: 6171692 - DNA, 19 bp, Homo sapiens
cttccctacccttcctgcc

SEQ ID NO: 6171693 - DNA, 16 bp, Homo sapiens
cttccctacctcaggc

SEQ ID NO: 6171694 - DNA, 17 bp, Homo sapiens
cttccctacctcaggca

SEQ ID NO: 6171695 - DNA, 20 bp, Homo sapiens
cttccctacctcaggcagga

SEQ ID NO: 6171696 - DNA, 22 bp, Homo sapiens
cttccctagctttagaccctgg

SEQ ID NO: 6171697 - DNA, 22 bp, Homo sapiens
cttccctaggcacctctgtgct

SEQ ID NO: 6171698 - DNA, 13 bp, Homo sapiens
cttccctatagga

SEQ ID NO: 6171699 - DNA, 22 bp, Homo sapiens
cttccctatctttgccaccctc

SEQ ID NO: 6171700 - DNA, 23 bp, Homo sapiens
cttccctatctttgccaccctca

SEQ ID NO: 6171701 - DNA, 13 bp, Homo sapiens
cttccctatttat

SEQ ID NO: 6171702 - DNA, 23 bp, Homo sapiens
cttccctcaaagcttccattcca

SEQ ID NO: 6171703 - DNA, 15 bp, Homo sapiens
cttccctcacaccgc

SEQ ID NO: 6171704 - DNA, 13 bp, Homo sapiens
cttccctcacccc

SEQ ID NO: 6171705 - DNA, 18 bp, Homo sapiens
cttccctcacccccagca

SEQ ID NO: 6171706 - DNA, 19 bp, Homo sapiens
cttccctcacccccagcac

SEQ ID NO: 6171707 - DNA, 16 bp, Homo sapiens
cttccctcactcttcc

SEQ ID NO: 6171708 - DNA, 16 bp, Homo sapiens
cttccctcatctctcc

SEQ ID NO: 6171709 - DNA, 17 bp, Homo sapiens
cttccctccctgaggca

SEQ ID NO: 6171710 - DNA, 17 bp, Homo sapiens
cttccctcctcccatgt

SEQ ID NO: 6171711 - DNA, 18 bp, Homo sapiens
cttccctcctcccatgtc

SEQ ID NO: 6171712 - DNA, 15 bp, Homo sapiens
cttccctcctgcttt

SEQ ID NO: 6171713 - DNA, 19 bp, Homo sapiens
cttccctcctgtgccccag

SEQ ID NO: 6171714 - DNA, 13 bp, Homo sapiens
cttccctccttca

SEQ ID NO: 6171715 - DNA, 15 bp, Homo sapiens
cttccctccttccct

SEQ ID NO: 6171716 - DNA, 17 bp, Homo sapiens
cttccctctccctctct

SEQ ID NO: 6171717 - DNA, 23 bp, Homo sapiens
cttccctctccctctctctggga

SEQ ID NO: 6171718 - DNA, 14 bp, Homo sapiens
cttccctctcctgc

SEQ ID NO: 6171719 - DNA, 15 bp, Homo sapiens
cttccctctcgctcc

SEQ ID NO: 6171720 - DNA, 15 bp, Homo sapiens
ctgcctgcacccctg

SEQ ID NO: 6171721 - DNA, 15 bp, Homo sapiens
ctgcctgcacctttc

SEQ ID NO: 6171722 - DNA, 13 bp, Homo sapiens
ctgcctgcactcc

SEQ ID NO: 6171723 - DNA, 15 bp, Homo sapiens
ctgcctgcagagcag

SEQ ID NO: 6171724 - DNA, 14 bp, Homo sapiens
ctgcctgcagcagg

SEQ ID NO: 6171725 - DNA, 16 bp, Homo sapiens
ctgcctgcagcaggca

SEQ ID NO: 6171726 - DNA, 16 bp, Homo sapiens
ctgcctgcagccaggg

SEQ ID NO: 6171727 - DNA, 16 bp, Homo sapiens
ctgcctgcagcctccc

SEQ ID NO: 6171728 - DNA, 13 bp, Homo sapiens
ctgcctgcagctg

SEQ ID NO: 6171729 - DNA, 15 bp, Homo sapiens
ctgcctgcagctgag

SEQ ID NO: 6171730 - DNA, 11 bp, Homo sapiens
ctgcctgcagt

SEQ ID NO: 6171731 - DNA, 20 bp, Homo sapiens
ctgcctgcagtactttacct

SEQ ID NO: 6171732 - DNA, 13 bp, Homo sapiens
ctgcctgcagtgt

SEQ ID NO: 6171733 - DNA, 15 bp, Homo sapiens
ctgcctgcagtgtca

SEQ ID NO: 6171734 - DNA, 18 bp, Homo sapiens
ctgcctgcatgagctggc

SEQ ID NO: 6171735 - DNA, 21 bp, Homo sapiens
ctgcctgcatgagctggcaac

SEQ ID NO: 6171736 - DNA, 23 bp, Homo sapiens
ctgcctgcatgagctggcaacca

SEQ ID NO: 6171737 - DNA, 14 bp, Homo sapiens
ctgcctgccaaagt

SEQ ID NO: 6171738 - DNA, 13 bp, Homo sapiens
ctgcctgccaagc

SEQ ID NO: 6171739 - DNA, 17 bp, Homo sapiens
ctgcctgccaccctgcc

SEQ ID NO: 6171740 - DNA, 21 bp, Homo sapiens
ctgcctgccagctgcactgat

SEQ ID NO: 6171741 - DNA, 12 bp, Homo sapiens
ctgcctgccatg

SEQ ID NO: 6171742 - DNA, 15 bp, Homo sapiens
ctgcctgccatgtgt

SEQ ID NO: 6171743 - DNA, 13 bp, Homo sapiens
ctgcctgcccaca

SEQ ID NO: 6171744 - DNA, 16 bp, Homo sapiens
ctgcctgccccacacg

SEQ ID NO: 6171745 - DNA, 21 bp, Homo sapiens
ctgcctgccccacacggactc

SEQ ID NO: 6171746 - DNA, 19 bp, Homo sapiens
ctgcctgccccacccaccc

SEQ ID NO: 6171747 - DNA, 13 bp, Homo sapiens
ctgcctgccccca

SEQ ID NO: 6171748 - DNA, 18 bp, Homo sapiens
ctgcctgccccgccccca

SEQ ID NO: 6171749 - DNA, 19 bp, Homo sapiens
ctgcctgccccgcccccag

SEQ ID NO: 6171750 - DNA, 21 bp, Homo sapiens
ctgcctgccccgcccccagtc

SEQ ID NO: 6171751 - DNA, 18 bp, Homo sapiens
ctgcctgcccctgctgct

SEQ ID NO: 6171752 - DNA, 23 bp, Homo sapiens
ctgcctgcccgcacagcagcctg

SEQ ID NO: 6171753 - DNA, 11 bp, Homo sapiens
ctgcctgccct

SEQ ID NO: 6171754 - DNA, 18 bp, Homo sapiens
ctgcctgccctctgtctg

SEQ ID NO: 6171755 - DNA, 19 bp, Homo sapiens
ctgcctgccctgcctcagc

SEQ ID NO: 6171756 - DNA, 23 bp, Homo sapiens
ctgcctgccctttgtcctcctgc

SEQ ID NO: 6171757 - DNA, 17 bp, Homo sapiens
ctgcctgccgcccaaag

SEQ ID NO: 6171758 - DNA, 17 bp, Homo sapiens
ctgcctgccgctgcacc

SEQ ID NO: 6171759 - DNA, 23 bp, Homo sapiens
ctgcctgccggtaaacacgcctg

SEQ ID NO: 6171760 - DNA, 14 bp, Homo sapiens
ctgcctgcctccac

SEQ ID NO: 6171761 - DNA, 22 bp, Homo sapiens
ctgcctgcctcccctccgcagc

SEQ ID NO: 6171762 - DNA, 21 bp, Homo sapiens
ctgcctgcctccggccctgcc

SEQ ID NO: 6171763 - DNA, 19 bp, Homo sapiens
ctgcctgcctcctccctcc

SEQ ID NO: 6171764 - DNA, 15 bp, Homo sapiens
ctgcctgcctcttgg

SEQ ID NO: 6171765 - DNA, 13 bp, Homo sapiens
ctgcctgcctggg

SEQ ID NO: 6171766 - DNA, 15 bp, Homo sapiens
ctgcctgcctgggaa

SEQ ID NO: 6171767 - DNA, 15 bp, Homo sapiens
ctgcctgcctgtctg

SEQ ID NO: 6171768 - DNA, 16 bp, Homo sapiens
ctgcctgccttggcct

SEQ ID NO: 6171769 - DNA, 18 bp, Homo sapiens
ctgcctgcgaaacccagc

SEQ ID NO: 6171770 - DNA, 22 bp, Homo sapiens
ctgcctgcgaaacccagcgttc

SEQ ID NO: 6171771 - DNA, 14 bp, Homo sapiens
ctgcctgcggccca

SEQ ID NO: 6171772 - DNA, 15 bp, Homo sapiens
ctgcctgcggcccag

SEQ ID NO: 6171773 - DNA, 23 bp, Homo sapiens
ctgcctgctacttgagggccagg

SEQ ID NO: 6171774 - DNA, 19 bp, Homo sapiens
ctgcctgctcatggccctc

SEQ ID NO: 6171775 - DNA, 14 bp, Homo sapiens
ctgcctgctccatc

SEQ ID NO: 6171776 - DNA, 15 bp, Homo sapiens
ctgcctgctcccatc

SEQ ID NO: 6171777 - DNA, 15 bp, Homo sapiens
ctgcctgctccttgg

SEQ ID NO: 6171778 - DNA, 22 bp, Homo sapiens
ctgcctgctctgcagcccacag

SEQ ID NO: 6171779 - DNA, 15 bp, Homo sapiens
ctgcctgctgagatg

SEQ ID NO: 6171780 - DNA, 15 bp, Homo sapiens
ctgcctgctgcagtc

SEQ ID NO: 6171781 - DNA, 12 bp, Homo sapiens
ctgcctgctggg

SEQ ID NO: 6171782 - DNA, 15 bp, Homo sapiens
ctgcctgctgggctc

SEQ ID NO: 6171783 - DNA, 20 bp, Homo sapiens
ctgcctgctgggctcttaac

SEQ ID NO: 6171784 - DNA, 13 bp, Homo sapiens
ctgcctgcttggg

SEQ ID NO: 6171785 - DNA, 12 bp, Homo sapiens
ctgcctgctttg

SEQ ID NO: 6171786 - DNA, 22 bp, Homo sapiens
ctgcctgctttgtgcagggtcc

SEQ ID NO: 6171787 - DNA, 20 bp, Homo sapiens
ctgcctgcttttcactgctg

SEQ ID NO: 6171788 - DNA, 18 bp, Homo sapiens
ctgcctggaacaccagca

SEQ ID NO: 6171789 - DNA, 20 bp, Homo sapiens
ctgcctggaagagcagccct

SEQ ID NO: 6171790 - DNA, 12 bp, Homo sapiens
ctgcctggaccc

SEQ ID NO: 6171791 - DNA, 23 bp, Homo sapiens
ctgcctggacttggcccctgcca

SEQ ID NO: 6171792 - DNA, 22 bp, Homo sapiens
ctgcctggagacttagggcacc

SEQ ID NO: 6171793 - DNA, 14 bp, Homo sapiens
ctgcctggagaggg

SEQ ID NO: 6171794 - DNA, 23 bp, Homo sapiens
ctgcctggagagggtctcgctgt

SEQ ID NO: 6171795 - DNA, 14 bp, Homo sapiens
ctgcctggagcagg

SEQ ID NO: 6171796 - DNA, 17 bp, Homo sapiens
ctgcctggagcaggggt

SEQ ID NO: 6171797 - DNA, 19 bp, Homo sapiens
ctgcctggagcctgggcag

SEQ ID NO: 6171798 - DNA, 15 bp, Homo sapiens
ctgcctggaggacct

SEQ ID NO: 6171799 - DNA, 19 bp, Homo sapiens
ctgcctggaggacctgagc

SEQ ID NO: 6171800 - DNA, 23 bp, Homo sapiens
ctgcctggaggacctgagcctgc

SEQ ID NO: 6171801 - DNA, 22 bp, Homo sapiens
ctgcctggaggagaaggaggaa

SEQ ID NO: 6171802 - DNA, 21 bp, Homo sapiens
ctgcctggaggatccctccat

SEQ ID NO: 6171803 - DNA, 14 bp, Homo sapiens
ctgcctggaggcaa

SEQ ID NO: 6171804 - DNA, 14 bp, Homo sapiens
ctgcctggaggctc

SEQ ID NO: 6171805 - DNA, 19 bp, Homo sapiens
ctgcctggagtcagtagcc

SEQ ID NO: 6171806 - DNA, 21 bp, Homo sapiens
ctgcctggagtcagtagccag

SEQ ID NO: 6171807 - DNA, 18 bp, Homo sapiens
ctgcctggagtgctgtgc

SEQ ID NO: 6171808 - DNA, 22 bp, Homo sapiens
ctgcctggatgaggcacttctg

SEQ ID NO: 6171809 - DNA, 20 bp, Homo sapiens
ctgcctggattccatttatg

SEQ ID NO: 6171810 - DNA, 11 bp, Homo sapiens
ctgcctggcaa

SEQ ID NO: 6171811 - DNA, 11 bp, Homo sapiens
ctgcctggcca

SEQ ID NO: 6171812 - DNA, 13 bp, Homo sapiens
ctgcctggccagg

SEQ ID NO: 6171813 - DNA, 17 bp, Homo sapiens
ctgcctggccaggcaga

SEQ ID NO: 6171814 - DNA, 13 bp, Homo sapiens
ctgcctggcccag

SEQ ID NO: 6171815 - DNA, 18 bp, Homo sapiens
ctgcctggcccagggagg

SEQ ID NO: 6171816 - DNA, 14 bp, Homo sapiens
ctgcctggccccca

SEQ ID NO: 6171817 - DNA, 15 bp, Homo sapiens
ctgcctggcccccaa

SEQ ID NO: 6171818 - DNA, 22 bp, Homo sapiens
ctgcctggcccccaacctcagg

SEQ ID NO: 6171819 - DNA, 20 bp, Homo sapiens
ctgcctggcccccagctgtg

SEQ ID NO: 6171820 - DNA, 18 bp, Homo sapiens
ctgcctggccccctgtcc

SEQ ID NO: 6171821 - DNA, 13 bp, Homo sapiens
ctgcctggcccct

SEQ ID NO: 6171822 - DNA, 19 bp, Homo sapiens
ctgcctggccctccccaca

SEQ ID NO: 6171823 - DNA, 18 bp, Homo sapiens
ctgcctggccggccagcc

SEQ ID NO: 6171824 - DNA, 12 bp, Homo sapiens
ctgcctggcctt

SEQ ID NO: 6171825 - DNA, 13 bp, Homo sapiens
ctgcctggccttg

SEQ ID NO: 6171826 - DNA, 16 bp, Homo sapiens
ctgcctggcggcaggg

SEQ ID NO: 6171827 - DNA, 22 bp, Homo sapiens
ctgcctggcgggcagcccctgc

SEQ ID NO: 6171828 - DNA, 12 bp, Homo sapiens
ctgcctgggaac

SEQ ID NO: 6171829 - DNA, 15 bp, Homo sapiens
ctgcctgggacactg

SEQ ID NO: 6171830 - DNA, 21 bp, Homo sapiens
ctgcctgggacagccactgga

SEQ ID NO: 6171831 - DNA, 23 bp, Homo sapiens
ctgcctgggatccctcatcctca

SEQ ID NO: 6171832 - DNA, 19 bp, Homo sapiens
ctgcctgggatgcccttcc

SEQ ID NO: 6171833 - DNA, 20 bp, Homo sapiens
ctgcctgggatgcccttccc

SEQ ID NO: 6171834 - DNA, 22 bp, Homo sapiens
ctgcctgggatgcccttccccc

SEQ ID NO: 6171835 - DNA, 17 bp, Homo sapiens
ctgcctgggatgggctc

SEQ ID NO: 6171836 - DNA, 20 bp, Homo sapiens
ctgcctgggcaatggccagg

SEQ ID NO: 6171837 - DNA, 12 bp, Homo sapiens
ctgcctgggcct

SEQ ID NO: 6171838 - DNA, 15 bp, Homo sapiens
ctgcctgggcctccc

SEQ ID NO: 6171839 - DNA, 16 bp, Homo sapiens
ctgcctgggcctgtgc

SEQ ID NO: 6171840 - DNA, 19 bp, Homo sapiens
ctgcctgggcctgtgcagc

SEQ ID NO: 6171841 - DNA, 20 bp, Homo sapiens
ctgcctgggcctgtgcagca

SEQ ID NO: 6171842 - DNA, 23 bp, Homo sapiens
ctgcctgggctgaccccggtggc

SEQ ID NO: 6171843 - DNA, 15 bp, Homo sapiens
ctgcctgggctgttg

SEQ ID NO: 6171844 - DNA, 20 bp, Homo sapiens
ctgcctgggctgttggcact

SEQ ID NO: 6171845 - DNA, 13 bp, Homo sapiens
ctgcctggggccc

SEQ ID NO: 6171846 - DNA, 20 bp, Homo sapiens
ctgcctggggcctccagaag

SEQ ID NO: 6171847 - DNA, 22 bp, Homo sapiens
ctgcctggggcctccagaagct

SEQ ID NO: 6171848 - DNA, 19 bp, Homo sapiens
ctgcctggggcgggcccct

SEQ ID NO: 6171849 - DNA, 22 bp, Homo sapiens
ctgcctggggcgggcccctcat

SEQ ID NO: 6171850 - DNA, 12 bp, Homo sapiens
ctgcctgggtag

SEQ ID NO: 6171851 - DNA, 14 bp, Homo sapiens
ctgcctgggtaggc

SEQ ID NO: 6171852 - DNA, 20 bp, Homo sapiens
ctgcctgggtaggccccaca

SEQ ID NO: 6171853 - DNA, 23 bp, Homo sapiens
ctgcctgggtctccacatcccca

SEQ ID NO: 6171854 - DNA, 12 bp, Homo sapiens
ctgcctgggtgg

SEQ ID NO: 6171855 - DNA, 18 bp, Homo sapiens
ctgcctgggtgggacagc

SEQ ID NO: 6171856 - DNA, 19 bp, Homo sapiens
ctgcctgggtgggacagcc

SEQ ID NO: 6171857 - DNA, 21 bp, Homo sapiens
ctgcctgggttgggggcactc

SEQ ID NO: 6171858 - DNA, 22 bp, Homo sapiens
ctgcctgggttttctaactgta

SEQ ID NO: 6171859 - DNA, 20 bp, Homo sapiens
ctgcctgggttttgttccct

SEQ ID NO: 6171860 - DNA, 13 bp, Homo sapiens
ctgcctggtcctc

SEQ ID NO: 6171861 - DNA, 17 bp, Homo sapiens
ctgcctggtcctcacac

SEQ ID NO: 6171862 - DNA, 16 bp, Homo sapiens
ctgcctggtcctccct

SEQ ID NO: 6171863 - DNA, 17 bp, Homo sapiens
ctgcctggtcctccctc

SEQ ID NO: 6171864 - DNA, 15 bp, Homo sapiens
ctgcctggtctcctg

SEQ ID NO: 6171865 - DNA, 18 bp, Homo sapiens
ctgcctggtctgtctgga

SEQ ID NO: 6171866 - DNA, 18 bp, Homo sapiens
ctgcctggtgcattgctg

SEQ ID NO: 6171867 - DNA, 20 bp, Homo sapiens
ctgcctggttccctccccaa

SEQ ID NO: 6171868 - DNA, 17 bp, Homo sapiens
ctgcctggttctaggct

SEQ ID NO: 6171869 - DNA, 21 bp, Homo sapiens
ctgcctggttctaggctgctg

SEQ ID NO: 6171870 - DNA, 19 bp, Homo sapiens
ctgcctggttttatttata

SEQ ID NO: 6171871 - DNA, 15 bp, Homo sapiens
ctgcctgtaattaaa

SEQ ID NO: 6171872 - DNA, 22 bp, Homo sapiens
ctgcctgtaattaaactagttt

SEQ ID NO: 6171873 - DNA, 17 bp, Homo sapiens
ctgcctgtactactcta

SEQ ID NO: 6171874 - DNA, 21 bp, Homo sapiens
ctgcctgtagcaatggccaga

SEQ ID NO: 6171875 - DNA, 15 bp, Homo sapiens
ctgcctgtagcccac

SEQ ID NO: 6171876 - DNA, 17 bp, Homo sapiens
ctgcctgtatttgagag

SEQ ID NO: 6171877 - DNA, 18 bp, Homo sapiens
ctgcctgtatttgagaga

SEQ ID NO: 6171878 - DNA, 14 bp, Homo sapiens
ctgcctgtattttc

SEQ ID NO: 6171879 - DNA, 15 bp, Homo sapiens
ctgcctgtcaagttt

SEQ ID NO: 6171880 - DNA, 14 bp, Homo sapiens
ctgcctgtccccat

SEQ ID NO: 6171881 - DNA, 21 bp, Homo sapiens
ctgcctgtccccccgcacttt

SEQ ID NO: 6171882 - DNA, 19 bp, Homo sapiens
ctgcctgtccctctcaggc

SEQ ID NO: 6171883 - DNA, 21 bp, Homo sapiens
ctgcctgtcctagtctccttt

SEQ ID NO: 6171884 - DNA, 23 bp, Homo sapiens
ctgcctgtctcccaccctttctg

SEQ ID NO: 6171885 - DNA, 14 bp, Homo sapiens
ctgcctgtctgccc

SEQ ID NO: 6171886 - DNA, 14 bp, Homo sapiens
ctgcctgtctgctt

SEQ ID NO: 6171887 - DNA, 15 bp, Homo sapiens
ctgcctgtctgcttg

SEQ ID NO: 6171888 - DNA, 15 bp, Homo sapiens
ctgcctgtctgtctc

SEQ ID NO: 6171889 - DNA, 17 bp, Homo sapiens
ctgcctgtgagccagtc

SEQ ID NO: 6171890 - DNA, 14 bp, Homo sapiens
ctgcctgtgagtga

SEQ ID NO: 6171891 - DNA, 18 bp, Homo sapiens
ctgcctgtgcatgacctg

SEQ ID NO: 6171892 - DNA, 12 bp, Homo sapiens
ctgcctgtgcct

SEQ ID NO: 6171893 - DNA, 14 bp, Homo sapiens
ctgcctgtgcctgc

SEQ ID NO: 6171894 - DNA, 15 bp, Homo sapiens
ctgcctgtgcctgcc

SEQ ID NO: 6171895 - DNA, 16 bp, Homo sapiens
ctgcctgtgcctgcca

SEQ ID NO: 6171896 - DNA, 17 bp, Homo sapiens
ctgcctgtgcctgccat

SEQ ID NO: 6171897 - DNA, 20 bp, Homo sapiens
ctgcctgtggagacagccct

SEQ ID NO: 6171898 - DNA, 22 bp, Homo sapiens
ctgcctgtggagacagccctgc

SEQ ID NO: 6171899 - DNA, 17 bp, Homo sapiens
cttccctctcgctcccc

SEQ ID NO: 6171900 - DNA, 12 bp, Homo sapiens
cttccctctctg

SEQ ID NO: 6171901 - DNA, 23 bp, Homo sapiens
cttccctctctgatgtcccagtg

SEQ ID NO: 6171902 - DNA, 14 bp, Homo sapiens
cttccctctctgga

SEQ ID NO: 6171903 - DNA, 16 bp, Homo sapiens
cttccctctctggaga

SEQ ID NO: 6171904 - DNA, 20 bp, Homo sapiens
cttccctctgatttttcctt

SEQ ID NO: 6171905 - DNA, 13 bp, Homo sapiens
cttccctctgcat

SEQ ID NO: 6171906 - DNA, 14 bp, Homo sapiens
cttccctctgcatt

SEQ ID NO: 6171907 - DNA, 15 bp, Homo sapiens
cttccctctgcattg

SEQ ID NO: 6171908 - DNA, 19 bp, Homo sapiens
cttccctctgcctgtccct

SEQ ID NO: 6171909 - DNA, 19 bp, Homo sapiens
cttccctctgggcacgcct

SEQ ID NO: 6171910 - DNA, 14 bp, Homo sapiens
cttccctctgggcc

SEQ ID NO: 6171911 - DNA, 15 bp, Homo sapiens
cttccctctgggcct

SEQ ID NO: 6171912 - DNA, 16 bp, Homo sapiens
cttccctctgtttctc

SEQ ID NO: 6171913 - DNA, 18 bp, Homo sapiens
cttccctcttccctctcc

SEQ ID NO: 6171914 - DNA, 13 bp, Homo sapiens
cttccctctttcc

SEQ ID NO: 6171915 - DNA, 14 bp, Homo sapiens
cttccctctttccc

SEQ ID NO: 6171916 - DNA, 17 bp, Homo sapiens
cttccctgaacactcat

SEQ ID NO: 6171917 - DNA, 15 bp, Homo sapiens
cttccctgaagctcc

SEQ ID NO: 6171918 - DNA, 17 bp, Homo sapiens
cttccctgaagctccca

SEQ ID NO: 6171919 - DNA, 13 bp, Homo sapiens
cttccctgactca

SEQ ID NO: 6171920 - DNA, 14 bp, Homo sapiens
cttccctgactcat

SEQ ID NO: 6171921 - DNA, 20 bp, Homo sapiens
cttccctgactcattctgaa

SEQ ID NO: 6171922 - DNA, 18 bp, Homo sapiens
cttccctgacttgcttta

SEQ ID NO: 6171923 - DNA, 13 bp, Homo sapiens
cttccctgatggc

SEQ ID NO: 6171924 - DNA, 22 bp, Homo sapiens
cttccctgatggcctttggacc

SEQ ID NO: 6171925 - DNA, 20 bp, Homo sapiens
cttccctgattgacctgctc

SEQ ID NO: 6171926 - DNA, 15 bp, Homo sapiens
cttccctgcagctga

SEQ ID NO: 6171927 - DNA, 22 bp, Homo sapiens
cttccctgcagggcgcccctgg

SEQ ID NO: 6171928 - DNA, 12 bp, Homo sapiens
cttccctgcagt

SEQ ID NO: 6171929 - DNA, 10 bp, Homo sapiens
cttccctgcc

SEQ ID NO: 6171930 - DNA, 11 bp, Homo sapiens
cttccctgccc

SEQ ID NO: 6171931 - DNA, 15 bp, Homo sapiens
cttccctgcccctgt

SEQ ID NO: 6171932 - DNA, 20 bp, Homo sapiens
cttccctgcctccagctgtc

SEQ ID NO: 6171933 - DNA, 17 bp, Homo sapiens
cttccctgctatttccc

SEQ ID NO: 6171934 - DNA, 14 bp, Homo sapiens
cttccctgctccca

SEQ ID NO: 6171935 - DNA, 13 bp, Homo sapiens
cttccctgctctt

SEQ ID NO: 6171936 - DNA, 14 bp, Homo sapiens
cttccctgctgcct

SEQ ID NO: 6171937 - DNA, 17 bp, Homo sapiens
cttccctgctttgagga

SEQ ID NO: 6171938 - DNA, 16 bp, Homo sapiens
cttccctgctttgcat

SEQ ID NO: 6171939 - DNA, 18 bp, Homo sapiens
cttccctgctttgcatct

SEQ ID NO: 6171940 - DNA, 21 bp, Homo sapiens
cttccctgcttttctcccaga

SEQ ID NO: 6171941 - DNA, 23 bp, Homo sapiens
cttccctgcttttctcccagaag

SEQ ID NO: 6171942 - DNA, 13 bp, Homo sapiens
cttccctggaagc

SEQ ID NO: 6171943 - DNA, 17 bp, Homo sapiens
cttccctggaggagaag

SEQ ID NO: 6171944 - DNA, 19 bp, Homo sapiens
cttccctggaggagaagta

SEQ ID NO: 6171945 - DNA, 10 bp, Homo sapiens
cttccctggc

SEQ ID NO: 6171946 - DNA, 15 bp, Homo sapiens
cttccctggccccgc

SEQ ID NO: 6171947 - DNA, 20 bp, Homo sapiens
cttccctggcgtcctctccc

SEQ ID NO: 6171948 - DNA, 22 bp, Homo sapiens
cttccctggctacttcccttcc

SEQ ID NO: 6171949 - DNA, 12 bp, Homo sapiens
cttccctggctt

SEQ ID NO: 6171950 - DNA, 12 bp, Homo sapiens
cttccctgggaa

SEQ ID NO: 6171951 - DNA, 13 bp, Homo sapiens
cttccctgggaac

SEQ ID NO: 6171952 - DNA, 19 bp, Homo sapiens
cttccctgggaaggctaag

SEQ ID NO: 6171953 - DNA, 13 bp, Homo sapiens
cttccctgggagg

SEQ ID NO: 6171954 - DNA, 18 bp, Homo sapiens
cttccctgggagggaggt

SEQ ID NO: 6171955 - DNA, 13 bp, Homo sapiens
cttccctgggctg

SEQ ID NO: 6171956 - DNA, 12 bp, Homo sapiens
cttccctgggga

SEQ ID NO: 6171957 - DNA, 13 bp, Homo sapiens
cttccctggggag

SEQ ID NO: 6171958 - DNA, 14 bp, Homo sapiens
cttccctggggagc

SEQ ID NO: 6171959 - DNA, 19 bp, Homo sapiens
cttccctggggagccctca

SEQ ID NO: 6171960 - DNA, 22 bp, Homo sapiens
cttccctggggagccctcaggc

SEQ ID NO: 6171961 - DNA, 12 bp, Homo sapiens
cttccctggggc

SEQ ID NO: 6171962 - DNA, 23 bp, Homo sapiens
cttccctgggttagactgccagc

SEQ ID NO: 6171963 - DNA, 21 bp, Homo sapiens
cttccctgggtttgggagcca

SEQ ID NO: 6171964 - DNA, 18 bp, Homo sapiens
cttccctggtaagaaaaa

SEQ ID NO: 6171965 - DNA, 13 bp, Homo sapiens
cttccctggtcac

SEQ ID NO: 6171966 - DNA, 16 bp, Homo sapiens
cttccctggtcaccaa

SEQ ID NO: 6171967 - DNA, 12 bp, Homo sapiens
cttccctggtcc

SEQ ID NO: 6171968 - DNA, 12 bp, Homo sapiens
cttccctggttc

SEQ ID NO: 6171969 - DNA, 20 bp, Homo sapiens
cttccctggttcaagcgatt

SEQ ID NO: 6171970 - DNA, 22 bp, Homo sapiens
cttccctgtatgattccttgat

SEQ ID NO: 6171971 - DNA, 14 bp, Homo sapiens
cttccctgtccctc

SEQ ID NO: 6171972 - DNA, 16 bp, Homo sapiens
cttccctgtgcctcct

SEQ ID NO: 6171973 - DNA, 22 bp, Homo sapiens
cttccctgtgtagtttgtgctg

SEQ ID NO: 6171974 - DNA, 13 bp, Homo sapiens
cttccctgttctt

SEQ ID NO: 6171975 - DNA, 15 bp, Homo sapiens
cttccctgttcttta

SEQ ID NO: 6171976 - DNA, 18 bp, Homo sapiens
cttcccttaactccaaga

SEQ ID NO: 6171977 - DNA, 18 bp, Homo sapiens
cttcccttagcctctccc

SEQ ID NO: 6171978 - DNA, 19 bp, Homo sapiens
cttcccttccatctcttcc

SEQ ID NO: 6171979 - DNA, 17 bp, Homo sapiens
cttcccttcccagacca

SEQ ID NO: 6171980 - DNA, 14 bp, Homo sapiens
cttcccttcctcca

SEQ ID NO: 6171981 - DNA, 15 bp, Homo sapiens
cttcccttcctccat

SEQ ID NO: 6171982 - DNA, 12 bp, Homo sapiens
cttcccttctcc

SEQ ID NO: 6171983 - DNA, 16 bp, Homo sapiens
cttcccttctccatct

SEQ ID NO: 6171984 - DNA, 17 bp, Homo sapiens
cttcccttctccccagc

SEQ ID NO: 6171985 - DNA, 20 bp, Homo sapiens
cttcccttctccccagccag

SEQ ID NO: 6171986 - DNA, 23 bp, Homo sapiens
cttcccttctccccagccagagg

SEQ ID NO: 6171987 - DNA, 18 bp, Homo sapiens
cttcccttctctccttcc

SEQ ID NO: 6171988 - DNA, 19 bp, Homo sapiens
cttcccttctctccttccc

SEQ ID NO: 6171989 - DNA, 20 bp, Homo sapiens
cttcccttctctccttccct

SEQ ID NO: 6171990 - DNA, 22 bp, Homo sapiens
cttcccttctctggtctccttg

SEQ ID NO: 6171991 - DNA, 23 bp, Homo sapiens
cttcccttcttttcctgggtgct

SEQ ID NO: 6171992 - DNA, 19 bp, Homo sapiens
cttcccttgagatgagttt

SEQ ID NO: 6171993 - DNA, 16 bp, Homo sapiens
cttcccttgccacttt

SEQ ID NO: 6171994 - DNA, 17 bp, Homo sapiens
cttcccttgccactttg

SEQ ID NO: 6171995 - DNA, 12 bp, Homo sapiens
cttcccttgctc

SEQ ID NO: 6171996 - DNA, 17 bp, Homo sapiens
cttcccttggagggaga

SEQ ID NO: 6171997 - DNA, 20 bp, Homo sapiens
cttccctttacagctctcct

SEQ ID NO: 6171998 - DNA, 20 bp, Homo sapiens
cttcccttttaaacacattt

SEQ ID NO: 6171999 - DNA, 14 bp, Homo sapiens
cttcccttttctgt

SEQ ID NO: 6172000 - DNA, 18 bp, Homo sapiens
cttcccttttttttctgg

SEQ ID NO: 6172001 - DNA, 23 bp, Homo sapiens
cttccgaaaaatcctcttcctct

SEQ ID NO: 6172002 - DNA, 16 bp, Homo sapiens
cttccgacaccactgg

SEQ ID NO: 6172003 - DNA, 19 bp, Homo sapiens
cttccgaccctctgggaac

SEQ ID NO: 6172004 - DNA, 22 bp, Homo sapiens
cttccgagattcagactgcttc

SEQ ID NO: 6172005 - DNA, 19 bp, Homo sapiens
cttccgagctgctttgtgg

SEQ ID NO: 6172006 - DNA, 19 bp, Homo sapiens
cttccgatcaacatttatg

SEQ ID NO: 6172007 - DNA, 20 bp, Homo sapiens
cttccgatcaacatttatga

SEQ ID NO: 6172008 - DNA, 18 bp, Homo sapiens
cttccgcagcccctttcc

SEQ ID NO: 6172009 - DNA, 14 bp, Homo sapiens
cttccgcagtgtgg

SEQ ID NO: 6172010 - DNA, 17 bp, Homo sapiens
cttccgcatcctagtct

SEQ ID NO: 6172011 - DNA, 18 bp, Homo sapiens
cttccgccaatctggccc

SEQ ID NO: 6172012 - DNA, 20 bp, Homo sapiens
cttccgccaatctggccctt

SEQ ID NO: 6172013 - DNA, 12 bp, Homo sapiens
cttccgccactc

SEQ ID NO: 6172014 - DNA, 18 bp, Homo sapiens
cttccgcccctgcctgcc

SEQ ID NO: 6172015 - DNA, 15 bp, Homo sapiens
cttccgccccttccc

SEQ ID NO: 6172016 - DNA, 18 bp, Homo sapiens
cttccgccccttcccttc

SEQ ID NO: 6172017 - DNA, 14 bp, Homo sapiens
cttccgcctcctgt

SEQ ID NO: 6172018 - DNA, 16 bp, Homo sapiens
cttccgcgcccagcgc

SEQ ID NO: 6172019 - DNA, 20 bp, Homo sapiens
cttccgcgcccagcgctcgc

SEQ ID NO: 6172020 - DNA, 14 bp, Homo sapiens
cttccgctctgagg

SEQ ID NO: 6172021 - DNA, 21 bp, Homo sapiens
cttccgctgaggggtctcgga

SEQ ID NO: 6172022 - DNA, 22 bp, Homo sapiens
cttccgctgaggggtctcggat

SEQ ID NO: 6172023 - DNA, 19 bp, Homo sapiens
cttccgctgcgggcccagc

SEQ ID NO: 6172024 - DNA, 12 bp, Homo sapiens
cttccgctgtca

SEQ ID NO: 6172025 - DNA, 16 bp, Homo sapiens
cttccgctgtcaccca

SEQ ID NO: 6172026 - DNA, 17 bp, Homo sapiens
cttccgctgtcacccag

SEQ ID NO: 6172027 - DNA, 19 bp, Homo sapiens
cttccgctgtcacccagca

SEQ ID NO: 6172028 - DNA, 22 bp, Homo sapiens
cttccgcttggagctattttcc

SEQ ID NO: 6172029 - DNA, 19 bp, Homo sapiens
cttccgctttgaaagaagc

SEQ ID NO: 6172030 - DNA, 23 bp, Homo sapiens
cttccgctttgaaagaagcaaga

SEQ ID NO: 6172031 - DNA, 13 bp, Homo sapiens
cttccggcccctc

SEQ ID NO: 6172032 - DNA, 15 bp, Homo sapiens
cttccggctcctgtg

SEQ ID NO: 6172033 - DNA, 16 bp, Homo sapiens
cttccggctgagctgt

SEQ ID NO: 6172034 - DNA, 23 bp, Homo sapiens
cttccggctgagctgtgccagct

SEQ ID NO: 6172035 - DNA, 17 bp, Homo sapiens
cttccgggagctggtga

SEQ ID NO: 6172036 - DNA, 23 bp, Homo sapiens
cttccgggagctggtgacagcct

SEQ ID NO: 6172037 - DNA, 22 bp, Homo sapiens
cttccggggaaggattttgcag

SEQ ID NO: 6172038 - DNA, 21 bp, Homo sapiens
cttccgggtctcgcagcctga

SEQ ID NO: 6172039 - DNA, 22 bp, Homo sapiens
cttccggtagggaggcagcctc

SEQ ID NO: 6172040 - DNA, 23 bp, Homo sapiens
cttccggtagggaggcagcctcc

SEQ ID NO: 6172041 - DNA, 20 bp, Homo sapiens
cttccggttggaggctctca

SEQ ID NO: 6172042 - DNA, 23 bp, Homo sapiens
cttccgtaacccaactctcctgg

SEQ ID NO: 6172043 - DNA, 18 bp, Homo sapiens
cttccgtcacccttggta

SEQ ID NO: 6172044 - DNA, 18 bp, Homo sapiens
cttccgtgggtcatccca

SEQ ID NO: 6172045 - DNA, 15 bp, Homo sapiens
cttccgttccccgct

SEQ ID NO: 6172046 - DNA, 16 bp, Homo sapiens
cttccgttggaaagaa

SEQ ID NO: 6172047 - DNA, 21 bp, Homo sapiens
cttccgttggaaagaacattt

SEQ ID NO: 6172048 - DNA, 12 bp, Homo sapiens
cttcctaaatat

SEQ ID NO: 6172049 - DNA, 17 bp, Homo sapiens
cttcctaaatatccaaa

SEQ ID NO: 6172050 - DNA, 13 bp, Homo sapiens
cttcctaaatttc

SEQ ID NO: 6172051 - DNA, 20 bp, Homo sapiens
cttcctaaattttcctgtcc

SEQ ID NO: 6172052 - DNA, 15 bp, Homo sapiens
cttcctaacttattg

SEQ ID NO: 6172053 - DNA, 21 bp, Homo sapiens
cttcctaacttattgcctggg

SEQ ID NO: 6172054 - DNA, 20 bp, Homo sapiens
cttcctaagcctgtggctgt

SEQ ID NO: 6172055 - DNA, 18 bp, Homo sapiens
cttcctaattccacagct

SEQ ID NO: 6172056 - DNA, 19 bp, Homo sapiens
cttcctaattccacagctg

SEQ ID NO: 6172057 - DNA, 22 bp, Homo sapiens
cttcctaattgtgcccctaaag

SEQ ID NO: 6172058 - DNA, 18 bp, Homo sapiens
cttcctacaagagcagcc

SEQ ID NO: 6172059 - DNA, 21 bp, Homo sapiens
cttcctacaagagcagcctgt

SEQ ID NO: 6172060 - DNA, 23 bp, Homo sapiens
cttcctacacccttggacttgag

SEQ ID NO: 6172061 - DNA, 21 bp, Homo sapiens
cttcctacatcttcttcccag

SEQ ID NO: 6172062 - DNA, 22 bp, Homo sapiens
cttcctacatcttcttcccagt

SEQ ID NO: 6172063 - DNA, 22 bp, Homo sapiens
cttcctaccaaatataaacttg

SEQ ID NO: 6172064 - DNA, 19 bp, Homo sapiens
cttcctaccctccttccac

SEQ ID NO: 6172065 - DNA, 14 bp, Homo sapiens
cttcctacctctgg

SEQ ID NO: 6172066 - DNA, 14 bp, Homo sapiens
cttcctactcttct

SEQ ID NO: 6172067 - DNA, 15 bp, Homo sapiens
cttcctactcttctc

SEQ ID NO: 6172068 - DNA, 22 bp, Homo sapiens
cttcctactcttctctctgctc

SEQ ID NO: 6172069 - DNA, 17 bp, Homo sapiens
cttcctactttgcttct

SEQ ID NO: 6172070 - DNA, 19 bp, Homo sapiens
cttcctagagcatctgtcc

SEQ ID NO: 6172071 - DNA, 21 bp, Homo sapiens
cttcctagagcatctgtccca

SEQ ID NO: 6172072 - DNA, 16 bp, Homo sapiens
cttcctagatctgcag

SEQ ID NO: 6172073 - DNA, 17 bp, Homo sapiens
cttcctagatctgcagg

SEQ ID NO: 6172074 - DNA, 17 bp, Homo sapiens
cttcctagccttgcact

SEQ ID NO: 6172075 - DNA, 20 bp, Homo sapiens
cttcctagctggagaggagc

SEQ ID NO: 6172076 - DNA, 12 bp, Homo sapiens
cttcctagctta

SEQ ID NO: 6172077 - DNA, 18 bp, Homo sapiens
cttcctagcttatctccc

SEQ ID NO: 6172078 - DNA, 23 bp, Homo sapiens
ctgcctgtggagacagccctgcc

SEQ ID NO: 6172079 - DNA, 14 bp, Homo sapiens
ctgcctgtggccat

SEQ ID NO: 6172080 - DNA, 15 bp, Homo sapiens
ctgcctgtggcccct

SEQ ID NO: 6172081 - DNA, 23 bp, Homo sapiens
ctgcctgtggcccctcccctgca

SEQ ID NO: 6172082 - DNA, 21 bp, Homo sapiens
ctgcctgtggccttgcccgcc

SEQ ID NO: 6172083 - DNA, 23 bp, Homo sapiens
ctgcctgtggcgccgtctccagg

SEQ ID NO: 6172084 - DNA, 13 bp, Homo sapiens
ctgcctgtgtgct

SEQ ID NO: 6172085 - DNA, 17 bp, Homo sapiens
ctgcctgttataactct

SEQ ID NO: 6172086 - DNA, 18 bp, Homo sapiens
ctgcctgttcagctccag

SEQ ID NO: 6172087 - DNA, 19 bp, Homo sapiens
ctgcctgttcccattcttg

SEQ ID NO: 6172088 - DNA, 15 bp, Homo sapiens
ctgcctgttcctccc

SEQ ID NO: 6172089 - DNA, 20 bp, Homo sapiens
ctgcctgttcctcccaagag

SEQ ID NO: 6172090 - DNA, 15 bp, Homo sapiens
ctgcctgttctccag

SEQ ID NO: 6172091 - DNA, 20 bp, Homo sapiens
ctgcctgttctccagatgga

SEQ ID NO: 6172092 - DNA, 14 bp, Homo sapiens
ctgcctgttctgag

SEQ ID NO: 6172093 - DNA, 21 bp, Homo sapiens
ctgcctgttgcgtgacactct

SEQ ID NO: 6172094 - DNA, 16 bp, Homo sapiens
ctgcctgttgggccag

SEQ ID NO: 6172095 - DNA, 20 bp, Homo sapiens
ctgcctgttgggccaggagc

SEQ ID NO: 6172096 - DNA, 14 bp, Homo sapiens
ctgcctgtttcccg

SEQ ID NO: 6172097 - DNA, 16 bp, Homo sapiens
ctgccttaaaaccaaa

SEQ ID NO: 6172098 - DNA, 17 bp, Homo sapiens
ctgccttaaaaccaaag

SEQ ID NO: 6172099 - DNA, 17 bp, Homo sapiens
ctgccttaaacacacat

SEQ ID NO: 6172100 - DNA, 19 bp, Homo sapiens
ctgccttaacctgggacca

SEQ ID NO: 6172101 - DNA, 18 bp, Homo sapiens
ctgccttaaccttctggg

SEQ ID NO: 6172102 - DNA, 19 bp, Homo sapiens
ctgccttaatttttgaaaa

SEQ ID NO: 6172103 - DNA, 21 bp, Homo sapiens
ctgccttaccgagagccaaac

SEQ ID NO: 6172104 - DNA, 16 bp, Homo sapiens
ctgccttaccttcact

SEQ ID NO: 6172105 - DNA, 15 bp, Homo sapiens
ctgccttagaggagc

SEQ ID NO: 6172106 - DNA, 15 bp, Homo sapiens
ctgccttagcttcag

SEQ ID NO: 6172107 - DNA, 16 bp, Homo sapiens
ctgccttagcttcagg

SEQ ID NO: 6172108 - DNA, 17 bp, Homo sapiens
ctgccttaggcctacct

SEQ ID NO: 6172109 - DNA, 23 bp, Homo sapiens
ctgccttagggtttgcagagtgg

SEQ ID NO: 6172110 - DNA, 21 bp, Homo sapiens
ctgccttatattattttctgt

SEQ ID NO: 6172111 - DNA, 22 bp, Homo sapiens
ctgccttatctaaatcaccaga

SEQ ID NO: 6172112 - DNA, 17 bp, Homo sapiens
ctgccttatcttgcacc

SEQ ID NO: 6172113 - DNA, 21 bp, Homo sapiens
ctgccttattcagggaaggag

SEQ ID NO: 6172114 - DNA, 17 bp, Homo sapiens
ctgccttcaccctgaac

SEQ ID NO: 6172115 - DNA, 20 bp, Homo sapiens
ctgccttcagagtatctaat

SEQ ID NO: 6172116 - DNA, 13 bp, Homo sapiens
ctgccttcaggga

SEQ ID NO: 6172117 - DNA, 23 bp, Homo sapiens
ctgccttcagtaggaacaagctg

SEQ ID NO: 6172118 - DNA, 21 bp, Homo sapiens
ctgccttcagtatcaaggctg

SEQ ID NO: 6172119 - DNA, 24 bp, Homo sapiens
ctgccttcagtatcaaggctgcct

SEQ ID NO: 6172120 - DNA, 13 bp, Homo sapiens
ctgccttccagcc

SEQ ID NO: 6172121 - DNA, 15 bp, Homo sapiens
ctgccttccagccca

SEQ ID NO: 6172122 - DNA, 16 bp, Homo sapiens
ctgccttccagcccag

SEQ ID NO: 6172123 - DNA, 16 bp, Homo sapiens
ctgccttccaggagca

SEQ ID NO: 6172124 - DNA, 16 bp, Homo sapiens
ctgccttccctagctt

SEQ ID NO: 6172125 - DNA, 10 bp, Homo sapiens
ctgccttcct

SEQ ID NO: 6172126 - DNA, 13 bp, Homo sapiens
ctgccttcctcct

SEQ ID NO: 6172127 - DNA, 15 bp, Homo sapiens
ctgccttcctcctgg

SEQ ID NO: 6172128 - DNA, 16 bp, Homo sapiens
ctgccttcctcctggg

SEQ ID NO: 6172129 - DNA, 18 bp, Homo sapiens
ctgccttcctcctgggcc

SEQ ID NO: 6172130 - DNA, 16 bp, Homo sapiens
ctgccttcctctgagg

SEQ ID NO: 6172131 - DNA, 12 bp, Homo sapiens
ctgccttccttg

SEQ ID NO: 6172132 - DNA, 14 bp, Homo sapiens
ctgccttccttgct

SEQ ID NO: 6172133 - DNA, 15 bp, Homo sapiens
ctgccttccttgcta

SEQ ID NO: 6172134 - DNA, 19 bp, Homo sapiens
ctgccttcgcaccttgctg

SEQ ID NO: 6172135 - DNA, 21 bp, Homo sapiens
ctgccttcgcttcttgcctct

SEQ ID NO: 6172136 - DNA, 13 bp, Homo sapiens
ctgccttcgttaa

SEQ ID NO: 6172137 - DNA, 19 bp, Homo sapiens
ctgccttcgttaactgtgt

SEQ ID NO: 6172138 - DNA, 17 bp, Homo sapiens
ctgccttctaccctctg

SEQ ID NO: 6172139 - DNA, 18 bp, Homo sapiens
ctgccttctcaggccccg

SEQ ID NO: 6172140 - DNA, 14 bp, Homo sapiens
ctgccttctcccct

SEQ ID NO: 6172141 - DNA, 17 bp, Homo sapiens
ctgccttctcccctcca

SEQ ID NO: 6172142 - DNA, 19 bp, Homo sapiens
ctgccttctcccctccaag

SEQ ID NO: 6172143 - DNA, 17 bp, Homo sapiens
ctgccttctcctctctg

SEQ ID NO: 6172144 - DNA, 22 bp, Homo sapiens
ctgccttctcctctctgggcct

SEQ ID NO: 6172145 - DNA, 13 bp, Homo sapiens
ctgccttctcttc

SEQ ID NO: 6172146 - DNA, 14 bp, Homo sapiens
ctgccttctcttct

SEQ ID NO: 6172147 - DNA, 24 bp, Homo sapiens
ctgccttctgcggagcttctccag

SEQ ID NO: 6172148 - DNA, 13 bp, Homo sapiens
ctgccttctgctg

SEQ ID NO: 6172149 - DNA, 14 bp, Homo sapiens
ctgccttctgggca

SEQ ID NO: 6172150 - DNA, 12 bp, Homo sapiens
ctgccttctgtc

SEQ ID NO: 6172151 - DNA, 17 bp, Homo sapiens
ctgccttctgtcctggt

SEQ ID NO: 6172152 - DNA, 21 bp, Homo sapiens
ctgccttctgtcctggtgtca

SEQ ID NO: 6172153 - DNA, 22 bp, Homo sapiens
ctgccttcttctttttgctgtt

SEQ ID NO: 6172154 - DNA, 16 bp, Homo sapiens
ctgccttgaaaaatga

SEQ ID NO: 6172155 - DNA, 13 bp, Homo sapiens
ctgccttgagcta

SEQ ID NO: 6172156 - DNA, 19 bp, Homo sapiens
ctgccttgagtccccaggg

SEQ ID NO: 6172157 - DNA, 19 bp, Homo sapiens
ctgccttgatgaagcccgt

SEQ ID NO: 6172158 - DNA, 23 bp, Homo sapiens
ctgccttgatgaagcctgtgcca

SEQ ID NO: 6172159 - DNA, 19 bp, Homo sapiens
ctgccttgccctcctgggc

SEQ ID NO: 6172160 - DNA, 23 bp, Homo sapiens
ctgccttgccctcctgggccctg

SEQ ID NO: 6172161 - DNA, 14 bp, Homo sapiens
ctgccttgcctcct

SEQ ID NO: 6172162 - DNA, 19 bp, Homo sapiens
ctgccttgctgacaataaa

SEQ ID NO: 6172163 - DNA, 20 bp, Homo sapiens
ctgccttgctgacaataaag

SEQ ID NO: 6172164 - DNA, 14 bp, Homo sapiens
ctgccttgctgcac

SEQ ID NO: 6172165 - DNA, 19 bp, Homo sapiens
ctgccttgctgttcttgaa

SEQ ID NO: 6172166 - DNA, 21 bp, Homo sapiens
ctgccttgctgttggtcatgt

SEQ ID NO: 6172167 - DNA, 13 bp, Homo sapiens
ctgccttggacac

SEQ ID NO: 6172168 - DNA, 21 bp, Homo sapiens
ctgccttggacaccatcccct

SEQ ID NO: 6172169 - DNA, 23 bp, Homo sapiens
ctgccttggactgtgtttttcct

SEQ ID NO: 6172170 - DNA, 22 bp, Homo sapiens
ctgccttggccccccaaagtgc

SEQ ID NO: 6172171 - DNA, 19 bp, Homo sapiens
ctgccttggcccctccctc

SEQ ID NO: 6172172 - DNA, 16 bp, Homo sapiens
ctgccttggcctccca

SEQ ID NO: 6172173 - DNA, 17 bp, Homo sapiens
ctgccttggcctcccaa

SEQ ID NO: 6172174 - DNA, 15 bp, Homo sapiens
ctgccttggctcaga

SEQ ID NO: 6172175 - DNA, 19 bp, Homo sapiens
ctgccttgggccttgctgc

SEQ ID NO: 6172176 - DNA, 22 bp, Homo sapiens
ctgccttgggccttgctgctgc

SEQ ID NO: 6172177 - DNA, 23 bp, Homo sapiens
ctgccttgggccttgctgctgct

SEQ ID NO: 6172178 - DNA, 19 bp, Homo sapiens
ctgccttggttctggccac

SEQ ID NO: 6172179 - DNA, 19 bp, Homo sapiens
ctgccttgtccctctcact

SEQ ID NO: 6172180 - DNA, 19 bp, Homo sapiens
ctgccttgtttaatgttaa

SEQ ID NO: 6172181 - DNA, 15 bp, Homo sapiens
ctgcctttagaaaat

SEQ ID NO: 6172182 - DNA, 18 bp, Homo sapiens
ctgcctttattgtgtttg

SEQ ID NO: 6172183 - DNA, 13 bp, Homo sapiens
ctgcctttcaaag

SEQ ID NO: 6172184 - DNA, 22 bp, Homo sapiens
ctgcctttccatccatggccag

SEQ ID NO: 6172185 - DNA, 11 bp, Homo sapiens
ctgcctttccc

SEQ ID NO: 6172186 - DNA, 15 bp, Homo sapiens
ctgcctttcccccct

SEQ ID NO: 6172187 - DNA, 14 bp, Homo sapiens
ctgcctttcttcca

SEQ ID NO: 6172188 - DNA, 22 bp, Homo sapiens
ctgcctttcttccatcagctct

SEQ ID NO: 6172189 - DNA, 21 bp, Homo sapiens
ctgcctttgacatttaattta

SEQ ID NO: 6172190 - DNA, 19 bp, Homo sapiens
ctgcctttgagcttctcct

SEQ ID NO: 6172191 - DNA, 18 bp, Homo sapiens
ctgcctttgatcacagga

SEQ ID NO: 6172192 - DNA, 21 bp, Homo sapiens
ctgcctttgatcacaggagca

SEQ ID NO: 6172193 - DNA, 21 bp, Homo sapiens
ctgcctttgcagaaacagatt

SEQ ID NO: 6172194 - DNA, 14 bp, Homo sapiens
ctgcctttgccagg

SEQ ID NO: 6172195 - DNA, 15 bp, Homo sapiens
ctgcctttgccaggt

SEQ ID NO: 6172196 - DNA, 14 bp, Homo sapiens
ctgcctttgcctcc

SEQ ID NO: 6172197 - DNA, 15 bp, Homo sapiens
ctgcctttgctgcct

SEQ ID NO: 6172198 - DNA, 17 bp, Homo sapiens
ctgcctttgctgccttc

SEQ ID NO: 6172199 - DNA, 19 bp, Homo sapiens
ctgcctttgctgccttctg

SEQ ID NO: 6172200 - DNA, 13 bp, Homo sapiens
ctgcctttggaag

SEQ ID NO: 6172201 - DNA, 18 bp, Homo sapiens
ctgcctttggaagaaaca

SEQ ID NO: 6172202 - DNA, 21 bp, Homo sapiens
ctgcctttggcactctgactt

SEQ ID NO: 6172203 - DNA, 18 bp, Homo sapiens
ctgcctttggcagagttc

SEQ ID NO: 6172204 - DNA, 21 bp, Homo sapiens
ctgcctttgtatgtggaagta

SEQ ID NO: 6172205 - DNA, 19 bp, Homo sapiens
ctgcctttgtccccacaca

SEQ ID NO: 6172206 - DNA, 19 bp, Homo sapiens
ctgcctttgtggtgggcgc

SEQ ID NO: 6172207 - DNA, 23 bp, Homo sapiens
ctgcctttgtggtgggcgctggg

SEQ ID NO: 6172208 - DNA, 11 bp, Homo sapiens
ctgcctttgtt

SEQ ID NO: 6172209 - DNA, 20 bp, Homo sapiens
ctgcctttgttcactgtgag

SEQ ID NO: 6172210 - DNA, 19 bp, Homo sapiens
ctgccttttagttcctgtg

SEQ ID NO: 6172211 - DNA, 14 bp, Homo sapiens
ctgcctttttgtcg

SEQ ID NO: 6172212 - DNA, 21 bp, Homo sapiens
ctgccttttttaacactagaa

SEQ ID NO: 6172213 - DNA, 18 bp, Homo sapiens
ctgccttttttcacagcc

SEQ ID NO: 6172214 - DNA, 21 bp, Homo sapiens
ctgccttttttcacagcccgg

SEQ ID NO: 6172215 - DNA, 14 bp, Homo sapiens
ctgcgaaacccagc

SEQ ID NO: 6172216 - DNA, 21 bp, Homo sapiens
ctgcgaagaccctcttgccca

SEQ ID NO: 6172217 - DNA, 22 bp, Homo sapiens
ctgcgaagaccctcttgcccat

SEQ ID NO: 6172218 - DNA, 21 bp, Homo sapiens
ctgcgaatctagaggaggggg

SEQ ID NO: 6172219 - DNA, 21 bp, Homo sapiens
ctgcgaccctgggggcacagg

SEQ ID NO: 6172220 - DNA, 22 bp, Homo sapiens
ctgcgaccctgggggcacagga

SEQ ID NO: 6172221 - DNA, 23 bp, Homo sapiens
ctgcgacgcttgctctgtttgtg

SEQ ID NO: 6172222 - DNA, 16 bp, Homo sapiens
ctgcgactttctgcct

SEQ ID NO: 6172223 - DNA, 19 bp, Homo sapiens
ctgcgactttctgcctgga

SEQ ID NO: 6172224 - DNA, 20 bp, Homo sapiens
ctgcgactttctgcctggag

SEQ ID NO: 6172225 - DNA, 20 bp, Homo sapiens
ctgcgagagaccctacagac

SEQ ID NO: 6172226 - DNA, 19 bp, Homo sapiens
ctgcgagaggtccctgctt

SEQ ID NO: 6172227 - DNA, 17 bp, Homo sapiens
ctgcgagcaacagtgcc

SEQ ID NO: 6172228 - DNA, 16 bp, Homo sapiens
ctgcgagcatttccct

SEQ ID NO: 6172229 - DNA, 19 bp, Homo sapiens
ctgcgagcatttccctccc

SEQ ID NO: 6172230 - DNA, 15 bp, Homo sapiens
ctgcgagtggtttct

SEQ ID NO: 6172231 - DNA, 20 bp, Homo sapiens
ctgcgatccggcagcctctc

SEQ ID NO: 6172232 - DNA, 14 bp, Homo sapiens
ctgcgatcttcaga

SEQ ID NO: 6172233 - DNA, 17 bp, Homo sapiens
ctgcgatcttcagagca

SEQ ID NO: 6172234 - DNA, 19 bp, Homo sapiens
ctgcgatcttcagagcagg

SEQ ID NO: 6172235 - DNA, 20 bp, Homo sapiens
ctgcgatcttcagagcaggg

SEQ ID NO: 6172236 - DNA, 17 bp, Homo sapiens
ctgcgatggtgctgcac

SEQ ID NO: 6172237 - DNA, 13 bp, Homo sapiens
ctgcgattttatc

SEQ ID NO: 6172238 - DNA, 17 bp, Homo sapiens
ctgcgattttgcctgtg

SEQ ID NO: 6172239 - DNA, 14 bp, Homo sapiens
ctgcgcaagtgcct

SEQ ID NO: 6172240 - DNA, 16 bp, Homo sapiens
ctgcgcaagtgcctgg

SEQ ID NO: 6172241 - DNA, 18 bp, Homo sapiens
ctgcgcaccaatgcccag

SEQ ID NO: 6172242 - DNA, 17 bp, Homo sapiens
ctgcgcaccaggctgag

SEQ ID NO: 6172243 - DNA, 16 bp, Homo sapiens
ctgcgcagctccttcc

SEQ ID NO: 6172244 - DNA, 18 bp, Homo sapiens
ctgcgcagctccttccct

SEQ ID NO: 6172245 - DNA, 17 bp, Homo sapiens
ctgcgcaggccctccgc

SEQ ID NO: 6172246 - DNA, 18 bp, Homo sapiens
ctgcgcagggccctctgg

SEQ ID NO: 6172247 - DNA, 22 bp, Homo sapiens
ctgcgcagggccctctggggct

SEQ ID NO: 6172248 - DNA, 15 bp, Homo sapiens
ctgcgccacccacca

SEQ ID NO: 6172249 - DNA, 16 bp, Homo sapiens
ctgcgccacggcactc

SEQ ID NO: 6172250 - DNA, 12 bp, Homo sapiens
ctgcgccaggca

SEQ ID NO: 6172251 - DNA, 14 bp, Homo sapiens
ctgcgccaggcaga

SEQ ID NO: 6172252 - DNA, 17 bp, Homo sapiens
ctgcgccaggcagagct

SEQ ID NO: 6172253 - DNA, 18 bp, Homo sapiens
ctgcgccaggcagagctg

SEQ ID NO: 6172254 - DNA, 20 bp, Homo sapiens
ctgcgccaggcagagctgag

SEQ ID NO: 6172255 - DNA, 21 bp, Homo sapiens
cttcctagcttatctccctgc

SEQ ID NO: 6172256 - DNA, 20 bp, Homo sapiens
cttcctagggatctgaaatc

SEQ ID NO: 6172257 - DNA, 13 bp, Homo sapiens
cttcctagtaagt

SEQ ID NO: 6172258 - DNA, 17 bp, Homo sapiens
cttcctagtaagtcagg

SEQ ID NO: 6172259 - DNA, 10 bp, Homo sapiens
cttcctagtg

SEQ ID NO: 6172260 - DNA, 14 bp, Homo sapiens
cttcctagtgccta

SEQ ID NO: 6172261 - DNA, 16 bp, Homo sapiens
cttcctagttcatccc

SEQ ID NO: 6172262 - DNA, 17 bp, Homo sapiens
cttcctagttttctcct

SEQ ID NO: 6172263 - DNA, 22 bp, Homo sapiens
cttcctagttttctcctcccag

SEQ ID NO: 6172264 - DNA, 19 bp, Homo sapiens
cttcctataacttcttcct

SEQ ID NO: 6172265 - DNA, 21 bp, Homo sapiens
cttcctataacttcttcctgc

SEQ ID NO: 6172266 - DNA, 23 bp, Homo sapiens
cttcctataacttcttcctgctg

SEQ ID NO: 6172267 - DNA, 21 bp, Homo sapiens
cttcctataccggagctccag

SEQ ID NO: 6172268 - DNA, 18 bp, Homo sapiens
cttcctatatgcacttat

SEQ ID NO: 6172269 - DNA, 16 bp, Homo sapiens
cttcctatcccatccc

SEQ ID NO: 6172270 - DNA, 18 bp, Homo sapiens
cttcctatgcccaggtac

SEQ ID NO: 6172271 - DNA, 19 bp, Homo sapiens
cttcctatgtgtgcattgg

SEQ ID NO: 6172272 - DNA, 21 bp, Homo sapiens
cttcctattaatttattaaat

SEQ ID NO: 6172273 - DNA, 22 bp, Homo sapiens
cttcctattccaagcttccata

SEQ ID NO: 6172274 - DNA, 19 bp, Homo sapiens
cttcctattctcctgccat

SEQ ID NO: 6172275 - DNA, 14 bp, Homo sapiens
cttcctatttcaga

SEQ ID NO: 6172276 - DNA, 17 bp, Homo sapiens
cttcctatttctagggc

SEQ ID NO: 6172277 - DNA, 18 bp, Homo sapiens
cttcctatttctagggct

SEQ ID NO: 6172278 - DNA, 22 bp, Homo sapiens
cttcctcaaaataaagaagtat

SEQ ID NO: 6172279 - DNA, 14 bp, Homo sapiens
cttcctcaaataca

SEQ ID NO: 6172280 - DNA, 19 bp, Homo sapiens
cttcctcaaatacatgcac

SEQ ID NO: 6172281 - DNA, 20 bp, Homo sapiens
cttcctcacacccctgtccc

SEQ ID NO: 6172282 - DNA, 13 bp, Homo sapiens
cttcctcacactg

SEQ ID NO: 6172283 - DNA, 14 bp, Homo sapiens
cttcctcacactgc

SEQ ID NO: 6172284 - DNA, 20 bp, Homo sapiens
cttcctcactatgacactga

SEQ ID NO: 6172285 - DNA, 13 bp, Homo sapiens
cttcctcactgcc

SEQ ID NO: 6172286 - DNA, 23 bp, Homo sapiens
cttcctcagatgatgtttgcttt

SEQ ID NO: 6172287 - DNA, 16 bp, Homo sapiens
cttcctcagcaggcca

SEQ ID NO: 6172288 - DNA, 11 bp, Homo sapiens
cttcctcagcc

SEQ ID NO: 6172289 - DNA, 12 bp, Homo sapiens
cttcctcagcca

SEQ ID NO: 6172290 - DNA, 14 bp, Homo sapiens
cttcctcagcctcc

SEQ ID NO: 6172291 - DNA, 15 bp, Homo sapiens
cttcctcagcctggg

SEQ ID NO: 6172292 - DNA, 20 bp, Homo sapiens
cttcctcagctcagctgggc

SEQ ID NO: 6172293 - DNA, 22 bp, Homo sapiens
cttcctcagctcagctgggcca

SEQ ID NO: 6172294 - DNA, 12 bp, Homo sapiens
cttcctcagctg

SEQ ID NO: 6172295 - DNA, 18 bp, Homo sapiens
cttcctcagctgcctcct

SEQ ID NO: 6172296 - DNA, 14 bp, Homo sapiens
cttcctcagctggt

SEQ ID NO: 6172297 - DNA, 22 bp, Homo sapiens
cttcctcagctggttactcagg

SEQ ID NO: 6172298 - DNA, 19 bp, Homo sapiens
cttcctcagggcccagcag

SEQ ID NO: 6172299 - DNA, 20 bp, Homo sapiens
cttcctcagggcccagcagg

SEQ ID NO: 6172300 - DNA, 21 bp, Homo sapiens
cttcctcagtaacatttctgt

SEQ ID NO: 6172301 - DNA, 20 bp, Homo sapiens
cttcctcagtttaatccttc

SEQ ID NO: 6172302 - DNA, 18 bp, Homo sapiens
cttcctcatccaccccat

SEQ ID NO: 6172303 - DNA, 11 bp, Homo sapiens
cttcctcatct

SEQ ID NO: 6172304 - DNA, 20 bp, Homo sapiens
cttcctcatctgtgcctgtc

SEQ ID NO: 6172305 - DNA, 21 bp, Homo sapiens
cttcctcatctgtgcctgtct

SEQ ID NO: 6172306 - DNA, 22 bp, Homo sapiens
cttcctcatctgtgcctgtctg

SEQ ID NO: 6172307 - DNA, 22 bp, Homo sapiens
cttcctccaaagcctgggcaga

SEQ ID NO: 6172308 - DNA, 22 bp, Homo sapiens
cttcctccaatccccactcctc

SEQ ID NO: 6172309 - DNA, 13 bp, Homo sapiens
cttcctccacaag

SEQ ID NO: 6172310 - DNA, 13 bp, Homo sapiens
cttcctccacagt

SEQ ID NO: 6172311 - DNA, 15 bp, Homo sapiens
cttcctccacatcct

SEQ ID NO: 6172312 - DNA, 11 bp, Homo sapiens
cttcctccaga

SEQ ID NO: 6172313 - DNA, 21 bp, Homo sapiens
cttcctccagacccctgtggc

SEQ ID NO: 6172314 - DNA, 12 bp, Homo sapiens
cttcctccagag

SEQ ID NO: 6172315 - DNA, 13 bp, Homo sapiens
cttcctccagctg

SEQ ID NO: 6172316 - DNA, 20 bp, Homo sapiens
cttcctccagctgcaccaga

SEQ ID NO: 6172317 - DNA, 13 bp, Homo sapiens
cttcctccaggag

SEQ ID NO: 6172318 - DNA, 22 bp, Homo sapiens
cttcctccaggagaaggggccc

SEQ ID NO: 6172319 - DNA, 19 bp, Homo sapiens
cttcctccagtctgttctc

SEQ ID NO: 6172320 - DNA, 14 bp, Homo sapiens
cttcctccatcctc

SEQ ID NO: 6172321 - DNA, 16 bp, Homo sapiens
cttcctccatggccca

SEQ ID NO: 6172322 - DNA, 18 bp, Homo sapiens
cttcctccatggcccatc

SEQ ID NO: 6172323 - DNA, 22 bp, Homo sapiens
cttcctccatggcccatcactc

SEQ ID NO: 6172324 - DNA, 21 bp, Homo sapiens
cttcctcccaagtggtgccta

SEQ ID NO: 6172325 - DNA, 19 bp, Homo sapiens
cttcctccccaacctgcaa

SEQ ID NO: 6172326 - DNA, 21 bp, Homo sapiens
cttcctccccacactccactc

SEQ ID NO: 6172327 - DNA, 20 bp, Homo sapiens
cttcctccccaggacttggt

SEQ ID NO: 6172328 - DNA, 22 bp, Homo sapiens
cttcctccccgcctcctcccac

SEQ ID NO: 6172329 - DNA, 14 bp, Homo sapiens
cttcctcccctcaa

SEQ ID NO: 6172330 - DNA, 14 bp, Homo sapiens
cttcctcccctcgc

SEQ ID NO: 6172331 - DNA, 18 bp, Homo sapiens
cttcctcccggggccttc

SEQ ID NO: 6172332 - DNA, 13 bp, Homo sapiens
cttcctccctccc

SEQ ID NO: 6172333 - DNA, 18 bp, Homo sapiens
cttcctccctccctcttt

SEQ ID NO: 6172334 - DNA, 21 bp, Homo sapiens
cttcctccctccctgcagggt

SEQ ID NO: 6172335 - DNA, 18 bp, Homo sapiens
cttcctccctgtctctgc

SEQ ID NO: 6172336 - DNA, 22 bp, Homo sapiens
cttcctccctgtctctgcatct

SEQ ID NO: 6172337 - DNA, 23 bp, Homo sapiens
cttcctccggctggacctggggt

SEQ ID NO: 6172338 - DNA, 16 bp, Homo sapiens
cttcctccgtccaccc

SEQ ID NO: 6172339 - DNA, 13 bp, Homo sapiens
cttcctcctacca

SEQ ID NO: 6172340 - DNA, 13 bp, Homo sapiens
cttcctcctacct

SEQ ID NO: 6172341 - DNA, 17 bp, Homo sapiens
cttcctcctacctgggg

SEQ ID NO: 6172342 - DNA, 23 bp, Homo sapiens
cttcctcctacctggggactcct

SEQ ID NO: 6172343 - DNA, 15 bp, Homo sapiens
cttcctcctcccaag

SEQ ID NO: 6172344 - DNA, 18 bp, Homo sapiens
cttcctcctcctttgcct

SEQ ID NO: 6172345 - DNA, 17 bp, Homo sapiens
cttcctcctctcctgga

SEQ ID NO: 6172346 - DNA, 17 bp, Homo sapiens
cttcctcctgaagcctc

SEQ ID NO: 6172347 - DNA, 19 bp, Homo sapiens
cttcctcctgaagcctctg

SEQ ID NO: 6172348 - DNA, 22 bp, Homo sapiens
cttcctcctgaagcctctgccc

SEQ ID NO: 6172349 - DNA, 12 bp, Homo sapiens
cttcctcctgat

SEQ ID NO: 6172350 - DNA, 22 bp, Homo sapiens
cttcctcctgatggccaagagc

SEQ ID NO: 6172351 - DNA, 13 bp, Homo sapiens
cttcctcctgcag

SEQ ID NO: 6172352 - DNA, 15 bp, Homo sapiens
cttcctcctgggccc

SEQ ID NO: 6172353 - DNA, 14 bp, Homo sapiens
cttcctcctggttc

SEQ ID NO: 6172354 - DNA, 19 bp, Homo sapiens
cttcctccttccagatgcc

SEQ ID NO: 6172355 - DNA, 14 bp, Homo sapiens
cttcctcgcacagg

SEQ ID NO: 6172356 - DNA, 22 bp, Homo sapiens
cttcctcgcacagggcatgcct

SEQ ID NO: 6172357 - DNA, 23 bp, Homo sapiens
cttcctcgcacagggcatgcctg

SEQ ID NO: 6172358 - DNA, 17 bp, Homo sapiens
cttcctcgctctcctaa

SEQ ID NO: 6172359 - DNA, 22 bp, Homo sapiens
cttcctcgggattggcgggtcc

SEQ ID NO: 6172360 - DNA, 16 bp, Homo sapiens
cttcctcggtggctct

SEQ ID NO: 6172361 - DNA, 19 bp, Homo sapiens
cttcctcggtggctctggg

SEQ ID NO: 6172362 - DNA, 15 bp, Homo sapiens
cttcctcgtgggtcc

SEQ ID NO: 6172363 - DNA, 22 bp, Homo sapiens
cttcctcgtgggtcccagagac

SEQ ID NO: 6172364 - DNA, 22 bp, Homo sapiens
cttcctctacgtttatcctggc

SEQ ID NO: 6172365 - DNA, 18 bp, Homo sapiens
cttcctctagaagccaag

SEQ ID NO: 6172366 - DNA, 19 bp, Homo sapiens
cttcctctagaagccaagg

SEQ ID NO: 6172367 - DNA, 15 bp, Homo sapiens
cttcctctaggaaat

SEQ ID NO: 6172368 - DNA, 22 bp, Homo sapiens
cttcctctcaagctagccagag

SEQ ID NO: 6172369 - DNA, 14 bp, Homo sapiens
cttcctctcactcc

SEQ ID NO: 6172370 - DNA, 15 bp, Homo sapiens
cttcctctcactcct

SEQ ID NO: 6172371 - DNA, 15 bp, Homo sapiens
cttcctctccactgc

SEQ ID NO: 6172372 - DNA, 12 bp, Homo sapiens
cttcctctccag

SEQ ID NO: 6172373 - DNA, 13 bp, Homo sapiens
cttcctctccagc

SEQ ID NO: 6172374 - DNA, 12 bp, Homo sapiens
cttcctctccca

SEQ ID NO: 6172375 - DNA, 13 bp, Homo sapiens
cttcctctccctc

SEQ ID NO: 6172376 - DNA, 15 bp, Homo sapiens
cttcctctcctgtct

SEQ ID NO: 6172377 - DNA, 19 bp, Homo sapiens
cttcctctcctgtctccct

SEQ ID NO: 6172378 - DNA, 12 bp, Homo sapiens
cttcctctcctt

SEQ ID NO: 6172379 - DNA, 14 bp, Homo sapiens
cttcctctccttcc

SEQ ID NO: 6172380 - DNA, 17 bp, Homo sapiens
cttcctctccttcccac

SEQ ID NO: 6172381 - DNA, 15 bp, Homo sapiens
cttcctctccttcct

SEQ ID NO: 6172382 - DNA, 17 bp, Homo sapiens
cttcctctccttccttg

SEQ ID NO: 6172383 - DNA, 16 bp, Homo sapiens
cttcctctctccagat

SEQ ID NO: 6172384 - DNA, 15 bp, Homo sapiens
cttcctctctcggag

SEQ ID NO: 6172385 - DNA, 23 bp, Homo sapiens
cttcctctctcggagccctcaga

SEQ ID NO: 6172386 - DNA, 17 bp, Homo sapiens
cttcctctgagccgcag

SEQ ID NO: 6172387 - DNA, 14 bp, Homo sapiens
cttcctctgagcct

SEQ ID NO: 6172388 - DNA, 13 bp, Homo sapiens
cttcctctgcaag

SEQ ID NO: 6172389 - DNA, 21 bp, Homo sapiens
cttcctctgcaagtgctcagg

SEQ ID NO: 6172390 - DNA, 14 bp, Homo sapiens
cttcctctgcagct

SEQ ID NO: 6172391 - DNA, 20 bp, Homo sapiens
cttcctctgcagctgacctc

SEQ ID NO: 6172392 - DNA, 22 bp, Homo sapiens
cttcctctgcagctgacctctg

SEQ ID NO: 6172393 - DNA, 12 bp, Homo sapiens
cttcctctgctc

SEQ ID NO: 6172394 - DNA, 14 bp, Homo sapiens
cttcctctgctccc

SEQ ID NO: 6172395 - DNA, 14 bp, Homo sapiens
cttcctctgctgca

SEQ ID NO: 6172396 - DNA, 19 bp, Homo sapiens
cttcctctgctgcatcccc

SEQ ID NO: 6172397 - DNA, 22 bp, Homo sapiens
cttcctctgctgcatccccttc

SEQ ID NO: 6172398 - DNA, 15 bp, Homo sapiens
cttcctctggagctt

SEQ ID NO: 6172399 - DNA, 20 bp, Homo sapiens
cttcctctggctccccaagg

SEQ ID NO: 6172400 - DNA, 17 bp, Homo sapiens
cttcctctgggcagcgc

SEQ ID NO: 6172401 - DNA, 20 bp, Homo sapiens
cttcctctggggctctaggg

SEQ ID NO: 6172402 - DNA, 19 bp, Homo sapiens
cttcctctggtgtttatta

SEQ ID NO: 6172403 - DNA, 12 bp, Homo sapiens
cttcctctgtga

SEQ ID NO: 6172404 - DNA, 14 bp, Homo sapiens
cttcctctgttcta

SEQ ID NO: 6172405 - DNA, 19 bp, Homo sapiens
cttcctctgttctatccca

SEQ ID NO: 6172406 - DNA, 13 bp, Homo sapiens
cttcctcttacct

SEQ ID NO: 6172407 - DNA, 13 bp, Homo sapiens
cttcctcttagcc

SEQ ID NO: 6172408 - DNA, 14 bp, Homo sapiens
cttcctcttagcct

SEQ ID NO: 6172409 - DNA, 17 bp, Homo sapiens
cttcctcttcccccaag

SEQ ID NO: 6172410 - DNA, 15 bp, Homo sapiens
cttcctcttcctgcc

SEQ ID NO: 6172411 - DNA, 20 bp, Homo sapiens
cttcctcttcggccctcaga

SEQ ID NO: 6172412 - DNA, 14 bp, Homo sapiens
cttcctcttgaccc

SEQ ID NO: 6172413 - DNA, 22 bp, Homo sapiens
cttcctcttgaccctgcaccct

SEQ ID NO: 6172414 - DNA, 21 bp, Homo sapiens
cttcctctttccatctaccct

SEQ ID NO: 6172415 - DNA, 14 bp, Homo sapiens
cttcctctttgctt

SEQ ID NO: 6172416 - DNA, 20 bp, Homo sapiens
cttcctctttggtggcatgg

SEQ ID NO: 6172417 - DNA, 19 bp, Homo sapiens
cttcctcttttccttccca

SEQ ID NO: 6172418 - DNA, 15 bp, Homo sapiens
cttcctgaaagctgt

SEQ ID NO: 6172419 - DNA, 14 bp, Homo sapiens
cttcctgaaataaa

SEQ ID NO: 6172420 - DNA, 16 bp, Homo sapiens
cttcctgaaataaaca

SEQ ID NO: 6172421 - DNA, 18 bp, Homo sapiens
cttcctgaaataaacact

SEQ ID NO: 6172422 - DNA, 20 bp, Homo sapiens
cttcctgaaataaacactgg

SEQ ID NO: 6172423 - DNA, 18 bp, Homo sapiens
cttcctgaactcccagtc

SEQ ID NO: 6172424 - DNA, 13 bp, Homo sapiens
cttcctgaagctg

SEQ ID NO: 6172425 - DNA, 15 bp, Homo sapiens
cttcctgaaggggga

SEQ ID NO: 6172426 - DNA, 22 bp, Homo sapiens
cttcctgaagggggacactcca

SEQ ID NO: 6172427 - DNA, 16 bp, Homo sapiens
cttcctgacactttaa

SEQ ID NO: 6172428 - DNA, 21 bp, Homo sapiens
cttcctgactgacacaggcca

SEQ ID NO: 6172429 - DNA, 22 bp, Homo sapiens
cttcctgactgacacaggccag

SEQ ID NO: 6172430 - DNA, 22 bp, Homo sapiens
cttcctgagaaagcccacctgg

SEQ ID NO: 6172431 - DNA, 23 bp, Homo sapiens
cttcctgagggctaattctggga

SEQ ID NO: 6172432 - DNA, 19 bp, Homo sapiens
cttcctgattaccagtctg

SEQ ID NO: 6172433 - DNA, 19 bp, Homo sapiens
cttcctgattggtttctct

SEQ ID NO: 6172434 - DNA, 23 bp, Homo sapiens
ctgcgccaggcagagctgagggc

SEQ ID NO: 6172435 - DNA, 20 bp, Homo sapiens
ctgcgccagtcctgctacct

SEQ ID NO: 6172436 - DNA, 18 bp, Homo sapiens
ctgcgcccagagctggcc

SEQ ID NO: 6172437 - DNA, 21 bp, Homo sapiens
ctgcgcccagagctggcctcc

SEQ ID NO: 6172438 - DNA, 12 bp, Homo sapiens
ctgcgccccagc

SEQ ID NO: 6172439 - DNA, 14 bp, Homo sapiens
ctgcgccccaggcc

SEQ ID NO: 6172440 - DNA, 15 bp, Homo sapiens
ctgcgccccaggccc

SEQ ID NO: 6172441 - DNA, 13 bp, Homo sapiens
ctgcgcccccagc

SEQ ID NO: 6172442 - DNA, 14 bp, Homo sapiens
ctgcgcccccagct

SEQ ID NO: 6172443 - DNA, 23 bp, Homo sapiens
ctgcgccccgcacgactgcggga

SEQ ID NO: 6172444 - DNA, 22 bp, Homo sapiens
ctgcgccccgcccacaccctcg

SEQ ID NO: 6172445 - DNA, 20 bp, Homo sapiens
ctgcgccccgcctgacctgg

SEQ ID NO: 6172446 - DNA, 12 bp, Homo sapiens
ctgcgcccctgc

SEQ ID NO: 6172447 - DNA, 18 bp, Homo sapiens
ctgcgcccctgcccagca

SEQ ID NO: 6172448 - DNA, 22 bp, Homo sapiens
ctgcgcccggccacattcagtt

SEQ ID NO: 6172449 - DNA, 21 bp, Homo sapiens
ctgcgccctccctccctccac

SEQ ID NO: 6172450 - DNA, 16 bp, Homo sapiens
ctgcgccctgtgcagg

SEQ ID NO: 6172451 - DNA, 18 bp, Homo sapiens
ctgcgccctgtgcaggga

SEQ ID NO: 6172452 - DNA, 14 bp, Homo sapiens
ctgcgcccttcccc

SEQ ID NO: 6172453 - DNA, 16 bp, Homo sapiens
ctgcgcccttccccag

SEQ ID NO: 6172454 - DNA, 15 bp, Homo sapiens
ctgcgcccttgaggg

SEQ ID NO: 6172455 - DNA, 18 bp, Homo sapiens
ctgcgcccttgaggggcc

SEQ ID NO: 6172456 - DNA, 15 bp, Homo sapiens
ctgcgccgctgtgct

SEQ ID NO: 6172457 - DNA, 13 bp, Homo sapiens
ctgcgcctcaggc

SEQ ID NO: 6172458 - DNA, 15 bp, Homo sapiens
ctgcgcctccagagg

SEQ ID NO: 6172459 - DNA, 17 bp, Homo sapiens
ctgcgcctccagaggtc

SEQ ID NO: 6172460 - DNA, 20 bp, Homo sapiens
ctgcgcctccatccatctgt

SEQ ID NO: 6172461 - DNA, 15 bp, Homo sapiens
ctgcgcctcctcctg

SEQ ID NO: 6172462 - DNA, 13 bp, Homo sapiens
ctgcgcctgaaaa

SEQ ID NO: 6172463 - DNA, 15 bp, Homo sapiens
ctgcgcctgaaaagg

SEQ ID NO: 6172464 - DNA, 20 bp, Homo sapiens
ctgcgcctgaaaagggcgga

SEQ ID NO: 6172465 - DNA, 14 bp, Homo sapiens
ctgcgcctgcaggc

SEQ ID NO: 6172466 - DNA, 17 bp, Homo sapiens
ctgcgcctgcaggcaga

SEQ ID NO: 6172467 - DNA, 13 bp, Homo sapiens
ctgcgcctgcccg

SEQ ID NO: 6172468 - DNA, 15 bp, Homo sapiens
ctgcgcctgcgcctc

SEQ ID NO: 6172469 - DNA, 23 bp, Homo sapiens
ctgcgcctgctgcatgccctctc

SEQ ID NO: 6172470 - DNA, 16 bp, Homo sapiens
ctgcgcctgctgcctg

SEQ ID NO: 6172471 - DNA, 12 bp, Homo sapiens
ctgcgccttggg

SEQ ID NO: 6172472 - DNA, 23 bp, Homo sapiens
ctgcgccttgggatggggagtcc

SEQ ID NO: 6172473 - DNA, 15 bp, Homo sapiens
ctgcgcgcagctggc

SEQ ID NO: 6172474 - DNA, 16 bp, Homo sapiens
ctgcgcggactcgccc

SEQ ID NO: 6172475 - DNA, 20 bp, Homo sapiens
ctgcgcggactcgcccccag

SEQ ID NO: 6172476 - DNA, 20 bp, Homo sapiens
ctgcgcgtgtgggtctctgg

SEQ ID NO: 6172477 - DNA, 15 bp, Homo sapiens
ctgcgcgttcctccg

SEQ ID NO: 6172478 - DNA, 14 bp, Homo sapiens
ctgcgctagcagcc

SEQ ID NO: 6172479 - DNA, 19 bp, Homo sapiens
ctgcgctcccacctcggac

SEQ ID NO: 6172480 - DNA, 14 bp, Homo sapiens
ctgcgctcctctgc

SEQ ID NO: 6172481 - DNA, 19 bp, Homo sapiens
ctgcgctcctctgcagcct

SEQ ID NO: 6172482 - DNA, 23 bp, Homo sapiens
ctgcgctcctctgcagcctgagc

SEQ ID NO: 6172483 - DNA, 12 bp, Homo sapiens
ctgcgctgccct

SEQ ID NO: 6172484 - DNA, 13 bp, Homo sapiens
ctgcgctgccctg

SEQ ID NO: 6172485 - DNA, 14 bp, Homo sapiens
ctgcgctgccctgc

SEQ ID NO: 6172486 - DNA, 14 bp, Homo sapiens
ctgcgctgcttggt

SEQ ID NO: 6172487 - DNA, 17 bp, Homo sapiens
ctgcgcttaccttccca

SEQ ID NO: 6172488 - DNA, 19 bp, Homo sapiens
ctgcgcttcatctcatgag

SEQ ID NO: 6172489 - DNA, 15 bp, Homo sapiens
ctgcgcttcctgagc

SEQ ID NO: 6172490 - DNA, 13 bp, Homo sapiens
ctgcgcttgcttt

SEQ ID NO: 6172491 - DNA, 23 bp, Homo sapiens
ctgcgctttgaacgtgccagcag

SEQ ID NO: 6172492 - DNA, 21 bp, Homo sapiens
ctgcggaacaggagtgactct

SEQ ID NO: 6172493 - DNA, 15 bp, Homo sapiens
ctgcggaagccaaag

SEQ ID NO: 6172494 - DNA, 16 bp, Homo sapiens
ctgcggaagccaaagg

SEQ ID NO: 6172495 - DNA, 23 bp, Homo sapiens
ctgcggaatcttcttactaagct

SEQ ID NO: 6172496 - DNA, 21 bp, Homo sapiens
ctgcggaatgaaccacatctt

SEQ ID NO: 6172497 - DNA, 21 bp, Homo sapiens
ctgcggacaccgtggcctggg

SEQ ID NO: 6172498 - DNA, 16 bp, Homo sapiens
ctgcggaccaagggac

SEQ ID NO: 6172499 - DNA, 14 bp, Homo sapiens
ctgcggaccccagc

SEQ ID NO: 6172500 - DNA, 20 bp, Homo sapiens
ctgcggaccccagctgtgag

SEQ ID NO: 6172501 - DNA, 14 bp, Homo sapiens
ctgcggactccatg

SEQ ID NO: 6172502 - DNA, 19 bp, Homo sapiens
ctgcggagcacactggctc

SEQ ID NO: 6172503 - DNA, 15 bp, Homo sapiens
ctgcggagccagcgc

SEQ ID NO: 6172504 - DNA, 15 bp, Homo sapiens
ctgcggaggcggtgg

SEQ ID NO: 6172505 - DNA, 19 bp, Homo sapiens
ctgcggagtgaagaggggc

SEQ ID NO: 6172506 - DNA, 22 bp, Homo sapiens
ctgcggagtgaagaggggcagc

SEQ ID NO: 6172507 - DNA, 15 bp, Homo sapiens
ctgcggatctcagct

SEQ ID NO: 6172508 - DNA, 23 bp, Homo sapiens
ctgcggattgctttttcattttc

SEQ ID NO: 6172509 - DNA, 19 bp, Homo sapiens
ctgcggcagacgggagggg

SEQ ID NO: 6172510 - DNA, 15 bp, Homo sapiens
ctgcggcaggactgc

SEQ ID NO: 6172511 - DNA, 19 bp, Homo sapiens
ctgcggcaggactgcagag

SEQ ID NO: 6172512 - DNA, 16 bp, Homo sapiens
ctgcggccagagccga

SEQ ID NO: 6172513 - DNA, 16 bp, Homo sapiens
ctgcggccaggcctgc

SEQ ID NO: 6172514 - DNA, 18 bp, Homo sapiens
ctgcggccaggcctgcgg

SEQ ID NO: 6172515 - DNA, 15 bp, Homo sapiens
ctgcggcctgctgga

SEQ ID NO: 6172516 - DNA, 17 bp, Homo sapiens
ctgcggcgcgggcccct

SEQ ID NO: 6172517 - DNA, 16 bp, Homo sapiens
ctgcggctcagccttg

SEQ ID NO: 6172518 - DNA, 18 bp, Homo sapiens
ctgcggctcagccttgca

SEQ ID NO: 6172519 - DNA, 12 bp, Homo sapiens
ctgcggctctgg

SEQ ID NO: 6172520 - DNA, 12 bp, Homo sapiens
ctgcggctgctg

SEQ ID NO: 6172521 - DNA, 17 bp, Homo sapiens
ctgcggctgctgtgtgc

SEQ ID NO: 6172522 - DNA, 14 bp, Homo sapiens
ctgcgggaagctga

SEQ ID NO: 6172523 - DNA, 18 bp, Homo sapiens
ctgcgggaagctgacctt

SEQ ID NO: 6172524 - DNA, 17 bp, Homo sapiens
ctgcgggaggccctggc

SEQ ID NO: 6172525 - DNA, 18 bp, Homo sapiens
ctgcgggaggccctggcc

SEQ ID NO: 6172526 - DNA, 20 bp, Homo sapiens
ctgcgggaggccctggccct

SEQ ID NO: 6172527 - DNA, 13 bp, Homo sapiens
ctgcgggaggctg

SEQ ID NO: 6172528 - DNA, 19 bp, Homo sapiens
ctgcgggaggctggggccc

SEQ ID NO: 6172529 - DNA, 17 bp, Homo sapiens
ctgcgggatggtcctgg

SEQ ID NO: 6172530 - DNA, 13 bp, Homo sapiens
ctgcgggccacag

SEQ ID NO: 6172531 - DNA, 17 bp, Homo sapiens
ctgcgggccacagggca

SEQ ID NO: 6172532 - DNA, 18 bp, Homo sapiens
ctgcgggcccagctgagt

SEQ ID NO: 6172533 - DNA, 20 bp, Homo sapiens
ctgcgggcgcgggcagccac

SEQ ID NO: 6172534 - DNA, 22 bp, Homo sapiens
ctgcgggcgcgggcagccaccc

SEQ ID NO: 6172535 - DNA, 14 bp, Homo sapiens
ctgcgggctccctc

SEQ ID NO: 6172536 - DNA, 22 bp, Homo sapiens
ctgcgggctccctcctctggca

SEQ ID NO: 6172537 - DNA, 20 bp, Homo sapiens
ctgcgggctccctggcagga

SEQ ID NO: 6172538 - DNA, 14 bp, Homo sapiens
ctgcgggctgaggg

SEQ ID NO: 6172539 - DNA, 20 bp, Homo sapiens
ctgcgggctgagggcatctc

SEQ ID NO: 6172540 - DNA, 18 bp, Homo sapiens
ctgcggggagacagaagc

SEQ ID NO: 6172541 - DNA, 16 bp, Homo sapiens
ctgcggggcagggcct

SEQ ID NO: 6172542 - DNA, 22 bp, Homo sapiens
ctgcggggcggcatccgagccc

SEQ ID NO: 6172543 - DNA, 19 bp, Homo sapiens
ctgcggggcgggcacacct

SEQ ID NO: 6172544 - DNA, 22 bp, Homo sapiens
ctgcggggcgggcacacctcct

SEQ ID NO: 6172545 - DNA, 18 bp, Homo sapiens
ctgcggggctgagacgcc

SEQ ID NO: 6172546 - DNA, 22 bp, Homo sapiens
ctgcggggctgagacgccggct

SEQ ID NO: 6172547 - DNA, 15 bp, Homo sapiens
ctgcggggcttctgg

SEQ ID NO: 6172548 - DNA, 15 bp, Homo sapiens
ctgcgggggagccag

SEQ ID NO: 6172549 - DNA, 21 bp, Homo sapiens
ctgcgggggcagtgctcaccc

SEQ ID NO: 6172550 - DNA, 18 bp, Homo sapiens
ctgcgggggcgaggcccc

SEQ ID NO: 6172551 - DNA, 15 bp, Homo sapiens
ctgcggggttccctg

SEQ ID NO: 6172552 - DNA, 21 bp, Homo sapiens
ctgcgggtcacaggagggagg

SEQ ID NO: 6172553 - DNA, 22 bp, Homo sapiens
ctgcgggtcacaggagggaggg

SEQ ID NO: 6172554 - DNA, 23 bp, Homo sapiens
ctgcgggtcacaggagggagggg

SEQ ID NO: 6172555 - DNA, 16 bp, Homo sapiens
ctgcgggtcctcagct

SEQ ID NO: 6172556 - DNA, 15 bp, Homo sapiens
ctgcggtcactcagg

SEQ ID NO: 6172557 - DNA, 20 bp, Homo sapiens
ctgcggtcactcaggcctct

SEQ ID NO: 6172558 - DNA, 14 bp, Homo sapiens
ctgcggtcaggctg

SEQ ID NO: 6172559 - DNA, 16 bp, Homo sapiens
ctgcggtccacccagg

SEQ ID NO: 6172560 - DNA, 23 bp, Homo sapiens
ctgcggtccacccaggagccccg

SEQ ID NO: 6172561 - DNA, 16 bp, Homo sapiens
ctgcggtgaggcaggg

SEQ ID NO: 6172562 - DNA, 22 bp, Homo sapiens
ctgcggtgctatctcccccagc

SEQ ID NO: 6172563 - DNA, 13 bp, Homo sapiens
ctgcggtgggcag

SEQ ID NO: 6172564 - DNA, 16 bp, Homo sapiens
ctgcggtgggcagcca

SEQ ID NO: 6172565 - DNA, 19 bp, Homo sapiens
ctgcggtggtgccagaggt

SEQ ID NO: 6172566 - DNA, 23 bp, Homo sapiens
ctgcgtaactccatctgacaaat

SEQ ID NO: 6172567 - DNA, 21 bp, Homo sapiens
ctgcgtactccactggtctgt

SEQ ID NO: 6172568 - DNA, 13 bp, Homo sapiens
ctgcgtccaccag

SEQ ID NO: 6172569 - DNA, 18 bp, Homo sapiens
ctgcgtccaccaggcctc

SEQ ID NO: 6172570 - DNA, 17 bp, Homo sapiens
ctgcgtccaccctgagc

SEQ ID NO: 6172571 - DNA, 13 bp, Homo sapiens
ctgcgtcccactg

SEQ ID NO: 6172572 - DNA, 13 bp, Homo sapiens
ctgcgtcccagcc

SEQ ID NO: 6172573 - DNA, 15 bp, Homo sapiens
ctgcgtcccagcctg

SEQ ID NO: 6172574 - DNA, 20 bp, Homo sapiens
ctgcgtcccagcctgcaccc

SEQ ID NO: 6172575 - DNA, 16 bp, Homo sapiens
ctgcgtccccactccc

SEQ ID NO: 6172576 - DNA, 13 bp, Homo sapiens
ctgcgtcccccag

SEQ ID NO: 6172577 - DNA, 18 bp, Homo sapiens
ctgcgtcccccagccctc

SEQ ID NO: 6172578 - DNA, 19 bp, Homo sapiens
ctgcgtcccccagccctca

SEQ ID NO: 6172579 - DNA, 20 bp, Homo sapiens
ctgcgtccctccgagcttgg

SEQ ID NO: 6172580 - DNA, 13 bp, Homo sapiens
ctgcgtccctgct

SEQ ID NO: 6172581 - DNA, 15 bp, Homo sapiens
ctgcgtcccttctct

SEQ ID NO: 6172582 - DNA, 13 bp, Homo sapiens
ctgcgtcctcatt

SEQ ID NO: 6172583 - DNA, 14 bp, Homo sapiens
ctgcgtcctcctca

SEQ ID NO: 6172584 - DNA, 18 bp, Homo sapiens
ctgcgtcctcctcacctc

SEQ ID NO: 6172585 - DNA, 19 bp, Homo sapiens
ctgcgtcctcctcacctca

SEQ ID NO: 6172586 - DNA, 20 bp, Homo sapiens
ctgcgtcctgacgccctgcg

SEQ ID NO: 6172587 - DNA, 23 bp, Homo sapiens
ctgcgtcctgaggagtgtcctgt

SEQ ID NO: 6172588 - DNA, 15 bp, Homo sapiens
ctgcgtcgagctggg

SEQ ID NO: 6172589 - DNA, 18 bp, Homo sapiens
ctgcgtcggtcctggtgc

SEQ ID NO: 6172590 - DNA, 13 bp, Homo sapiens
ctgcgtctatcct

SEQ ID NO: 6172591 - DNA, 14 bp, Homo sapiens
ctgcgtctccatca

SEQ ID NO: 6172592 - DNA, 13 bp, Homo sapiens
ctgcgtctgtgtt

SEQ ID NO: 6172593 - DNA, 21 bp, Homo sapiens
ctgcgtcttttttctcttccc

SEQ ID NO: 6172594 - DNA, 20 bp, Homo sapiens
ctgcgtgcagggacaaagag

SEQ ID NO: 6172595 - DNA, 15 bp, Homo sapiens
ctgcgtggcctgggg

SEQ ID NO: 6172596 - DNA, 22 bp, Homo sapiens
ctgcgtggcgcaggtgccatgc

SEQ ID NO: 6172597 - DNA, 17 bp, Homo sapiens
ctgcgtggctgaccccc

SEQ ID NO: 6172598 - DNA, 20 bp, Homo sapiens
ctgcgtggctgacccccctc

SEQ ID NO: 6172599 - DNA, 23 bp, Homo sapiens
ctgcgtggctgacccccctcagg

SEQ ID NO: 6172600 - DNA, 15 bp, Homo sapiens
ctgcgtggggacagg

SEQ ID NO: 6172601 - DNA, 17 bp, Homo sapiens
ctgcgtgtgtatatttg

SEQ ID NO: 6172602 - DNA, 21 bp, Homo sapiens
ctgcgttcccagaccatggga

SEQ ID NO: 6172603 - DNA, 17 bp, Homo sapiens
ctgcgttctcatcccag

SEQ ID NO: 6172604 - DNA, 16 bp, Homo sapiens
ctgcgttggagccact

SEQ ID NO: 6172605 - DNA, 17 bp, Homo sapiens
ctgcgttggagccactc

SEQ ID NO: 6172606 - DNA, 19 bp, Homo sapiens
ctgcgttggagccactcct

SEQ ID NO: 6172607 - DNA, 17 bp, Homo sapiens
ctgcgtttggaggcccc

SEQ ID NO: 6172608 - DNA, 18 bp, Homo sapiens
ctgcgtttggaggcccct

SEQ ID NO: 6172609 - DNA, 20 bp, Homo sapiens
ctgcgtttggaggcccctgg

SEQ ID NO: 6172610 - DNA, 23 bp, Homo sapiens
ctgcgtttggaggcccctgggct

SEQ ID NO: 6172611 - DNA, 21 bp, Homo sapiens
ctgcgttttcctagctgtgtt

SEQ ID NO: 6172612 - DNA, 16 bp, Homo sapiens
ctgctaaaataaacct

SEQ ID NO: 6172613 - DNA, 15 bp, Homo sapiens
cttcctgcaaggact

SEQ ID NO: 6172614 - DNA, 20 bp, Homo sapiens
cttcctgcagacctggctgg

SEQ ID NO: 6172615 - DNA, 13 bp, Homo sapiens
cttcctgcaggac

SEQ ID NO: 6172616 - DNA, 18 bp, Homo sapiens
cttcctgcaggactctat

SEQ ID NO: 6172617 - DNA, 17 bp, Homo sapiens
cttcctgcattcaccca

SEQ ID NO: 6172618 - DNA, 15 bp, Homo sapiens
cttcctgccaagcca

SEQ ID NO: 6172619 - DNA, 12 bp, Homo sapiens
cttcctgccagc

SEQ ID NO: 6172620 - DNA, 14 bp, Homo sapiens
cttcctgccagccc

SEQ ID NO: 6172621 - DNA, 18 bp, Homo sapiens
cttcctgccagcccctgc

SEQ ID NO: 6172622 - DNA, 22 bp, Homo sapiens
cttcctgccagcccctgccatt

SEQ ID NO: 6172623 - DNA, 12 bp, Homo sapiens
cttcctgcccag

SEQ ID NO: 6172624 - DNA, 13 bp, Homo sapiens
cttcctgcccagg

SEQ ID NO: 6172625 - DNA, 12 bp, Homo sapiens
cttcctgcccca

SEQ ID NO: 6172626 - DNA, 20 bp, Homo sapiens
cttcctgccccaaaattata

SEQ ID NO: 6172627 - DNA, 21 bp, Homo sapiens
cttcctgccccaactccttcc

SEQ ID NO: 6172628 - DNA, 17 bp, Homo sapiens
cttcctgccccccttgg

SEQ ID NO: 6172629 - DNA, 17 bp, Homo sapiens
cttcctgccctacagag

SEQ ID NO: 6172630 - DNA, 13 bp, Homo sapiens
cttcctgccctag

SEQ ID NO: 6172631 - DNA, 12 bp, Homo sapiens
cttcctgccctg

SEQ ID NO: 6172632 - DNA, 15 bp, Homo sapiens
cttcctgccctgtac

SEQ ID NO: 6172633 - DNA, 16 bp, Homo sapiens
cttcctgccctgtacc

SEQ ID NO: 6172634 - DNA, 17 bp, Homo sapiens
cttcctgccctgtacct

SEQ ID NO: 6172635 - DNA, 14 bp, Homo sapiens
cttcctgccctgtg

SEQ ID NO: 6172636 - DNA, 15 bp, Homo sapiens
cttcctgccctgtgg

SEQ ID NO: 6172637 - DNA, 12 bp, Homo sapiens
cttcctgccctt

SEQ ID NO: 6172638 - DNA, 13 bp, Homo sapiens
cttcctgcccttc

SEQ ID NO: 6172639 - DNA, 16 bp, Homo sapiens
cttcctgcccttgaac

SEQ ID NO: 6172640 - DNA, 20 bp, Homo sapiens
cttcctgcctactgcccctg

SEQ ID NO: 6172641 - DNA, 16 bp, Homo sapiens
cttcctgcctagtctc

SEQ ID NO: 6172642 - DNA, 15 bp, Homo sapiens
cttcctgcctggtct

SEQ ID NO: 6172643 - DNA, 17 bp, Homo sapiens
cttcctgcctggtctcc

SEQ ID NO: 6172644 - DNA, 18 bp, Homo sapiens
cttcctgcctggtctcct

SEQ ID NO: 6172645 - DNA, 15 bp, Homo sapiens
cttcctgcgtcctcc

SEQ ID NO: 6172646 - DNA, 16 bp, Homo sapiens
cttcctgcgtcctcct

SEQ ID NO: 6172647 - DNA, 14 bp, Homo sapiens
cttcctgctacagg

SEQ ID NO: 6172648 - DNA, 17 bp, Homo sapiens
cttcctgctacaggagg

SEQ ID NO: 6172649 - DNA, 14 bp, Homo sapiens
cttcctgctccttt

SEQ ID NO: 6172650 - DNA, 15 bp, Homo sapiens
cttcctgctcctttt

SEQ ID NO: 6172651 - DNA, 16 bp, Homo sapiens
cttcctgctgcaccct

SEQ ID NO: 6172652 - DNA, 17 bp, Homo sapiens
cttcctgctgcaccctg

SEQ ID NO: 6172653 - DNA, 14 bp, Homo sapiens
cttcctgctgctgt

SEQ ID NO: 6172654 - DNA, 12 bp, Homo sapiens
cttcctgctgga

SEQ ID NO: 6172655 - DNA, 23 bp, Homo sapiens
cttcctgctggacagagactcag

SEQ ID NO: 6172656 - DNA, 12 bp, Homo sapiens
cttcctgctgta

SEQ ID NO: 6172657 - DNA, 23 bp, Homo sapiens
cttcctgcttaaacttgacccag

SEQ ID NO: 6172658 - DNA, 19 bp, Homo sapiens
cttcctgcttcctcagagg

SEQ ID NO: 6172659 - DNA, 17 bp, Homo sapiens
cttcctggaaacagcat

SEQ ID NO: 6172660 - DNA, 19 bp, Homo sapiens
cttcctggaaacagcatga

SEQ ID NO: 6172661 - DNA, 20 bp, Homo sapiens
cttcctggaacttgctctca

SEQ ID NO: 6172662 - DNA, 21 bp, Homo sapiens
cttcctggaacttgctctcat

SEQ ID NO: 6172663 - DNA, 13 bp, Homo sapiens
cttcctggacaca

SEQ ID NO: 6172664 - DNA, 16 bp, Homo sapiens
cttcctggacacactc

SEQ ID NO: 6172665 - DNA, 16 bp, Homo sapiens
cttcctggacagctgt

SEQ ID NO: 6172666 - DNA, 20 bp, Homo sapiens
cttcctggacagctgtgcct

SEQ ID NO: 6172667 - DNA, 22 bp, Homo sapiens
cttcctggacagctgtgcctcg

SEQ ID NO: 6172668 - DNA, 18 bp, Homo sapiens
cttcctggaccggggcct

SEQ ID NO: 6172669 - DNA, 16 bp, Homo sapiens
cttcctggacctgagt

SEQ ID NO: 6172670 - DNA, 18 bp, Homo sapiens
cttcctggacctgagtcg

SEQ ID NO: 6172671 - DNA, 22 bp, Homo sapiens
cttcctggactggcccttgccc

SEQ ID NO: 6172672 - DNA, 22 bp, Homo sapiens
cttcctggagactgcccagcta

SEQ ID NO: 6172673 - DNA, 12 bp, Homo sapiens
cttcctggagca

SEQ ID NO: 6172674 - DNA, 18 bp, Homo sapiens
cttcctggagcagaagca

SEQ ID NO: 6172675 - DNA, 13 bp, Homo sapiens
cttcctggaggct

SEQ ID NO: 6172676 - DNA, 15 bp, Homo sapiens
cttcctggatggggc

SEQ ID NO: 6172677 - DNA, 19 bp, Homo sapiens
cttcctggatggggcagag

SEQ ID NO: 6172678 - DNA, 21 bp, Homo sapiens
cttcctggatggggcagagct

SEQ ID NO: 6172679 - DNA, 21 bp, Homo sapiens
cttcctggattttctttctat

SEQ ID NO: 6172680 - DNA, 19 bp, Homo sapiens
cttcctggcacattgcccc

SEQ ID NO: 6172681 - DNA, 23 bp, Homo sapiens
cttcctggcacattgcccctctg

SEQ ID NO: 6172682 - DNA, 11 bp, Homo sapiens
cttcctggccg

SEQ ID NO: 6172683 - DNA, 23 bp, Homo sapiens
cttcctggccggtgtgggggccc

SEQ ID NO: 6172684 - DNA, 18 bp, Homo sapiens
cttcctggcctcactggc

SEQ ID NO: 6172685 - DNA, 19 bp, Homo sapiens
cttcctggcctcactggct

SEQ ID NO: 6172686 - DNA, 13 bp, Homo sapiens
cttcctggcctct

SEQ ID NO: 6172687 - DNA, 14 bp, Homo sapiens
cttcctggcctgag

SEQ ID NO: 6172688 - DNA, 19 bp, Homo sapiens
cttcctggcctgagagtca

SEQ ID NO: 6172689 - DNA, 20 bp, Homo sapiens
cttcctggctaggactgtgg

SEQ ID NO: 6172690 - DNA, 12 bp, Homo sapiens
cttcctggctct

SEQ ID NO: 6172691 - DNA, 12 bp, Homo sapiens
cttcctgggacc

SEQ ID NO: 6172692 - DNA, 17 bp, Homo sapiens
cttcctgggaccccctc

SEQ ID NO: 6172693 - DNA, 11 bp, Homo sapiens
cttcctgggca

SEQ ID NO: 6172694 - DNA, 18 bp, Homo sapiens
cttcctgggcacacgctg

SEQ ID NO: 6172695 - DNA, 16 bp, Homo sapiens
cttcctgggcagccca

SEQ ID NO: 6172696 - DNA, 18 bp, Homo sapiens
cttcctgggcagcccaga

SEQ ID NO: 6172697 - DNA, 21 bp, Homo sapiens
cttcctgggcagcccagagag

SEQ ID NO: 6172698 - DNA, 21 bp, Homo sapiens
cttcctgggcagcctttccag

SEQ ID NO: 6172699 - DNA, 12 bp, Homo sapiens
cttcctggggac

SEQ ID NO: 6172700 - DNA, 20 bp, Homo sapiens
cttcctggggcatctggcga

SEQ ID NO: 6172701 - DNA, 23 bp, Homo sapiens
cttcctggggcatctggcgaatc

SEQ ID NO: 6172702 - DNA, 17 bp, Homo sapiens
cttcctggggccccgct

SEQ ID NO: 6172703 - DNA, 21 bp, Homo sapiens
cttcctggggccccgctggga

SEQ ID NO: 6172704 - DNA, 22 bp, Homo sapiens
cttcctggggccccgctgggat

SEQ ID NO: 6172705 - DNA, 15 bp, Homo sapiens
cttcctgggtcctgc

SEQ ID NO: 6172706 - DNA, 18 bp, Homo sapiens
cttcctgggtcctgcctg

SEQ ID NO: 6172707 - DNA, 23 bp, Homo sapiens
cttcctgggtcctgcctggtcct

SEQ ID NO: 6172708 - DNA, 19 bp, Homo sapiens
cttcctgggttggccagag

SEQ ID NO: 6172709 - DNA, 18 bp, Homo sapiens
cttcctggtgaggcccag

SEQ ID NO: 6172710 - DNA, 24 bp, Homo sapiens
cttcctggtgaggcccagcctgtc

SEQ ID NO: 6172711 - DNA, 22 bp, Homo sapiens
cttcctgtaacacaagccacag

SEQ ID NO: 6172712 - DNA, 23 bp, Homo sapiens
cttcctgtaacacaagccacaga

SEQ ID NO: 6172713 - DNA, 21 bp, Homo sapiens
cttcctgtcaagcaatcaaga

SEQ ID NO: 6172714 - DNA, 16 bp, Homo sapiens
cttcctgtccagagag

SEQ ID NO: 6172715 - DNA, 19 bp, Homo sapiens
cttcctgtccagagagaga

SEQ ID NO: 6172716 - DNA, 16 bp, Homo sapiens
cttcctgtccagctcc

SEQ ID NO: 6172717 - DNA, 22 bp, Homo sapiens
cttcctgtccccaaaatgtgat

SEQ ID NO: 6172718 - DNA, 18 bp, Homo sapiens
cttcctgtccccagggga

SEQ ID NO: 6172719 - DNA, 14 bp, Homo sapiens
cttcctgtccctga

SEQ ID NO: 6172720 - DNA, 15 bp, Homo sapiens
cttcctgtccgccct

SEQ ID NO: 6172721 - DNA, 18 bp, Homo sapiens
cttcctgtcctgcctcct

SEQ ID NO: 6172722 - DNA, 15 bp, Homo sapiens
cttcctgtcctgctc

SEQ ID NO: 6172723 - DNA, 16 bp, Homo sapiens
cttcctgtctcactct

SEQ ID NO: 6172724 - DNA, 20 bp, Homo sapiens
cttcctgtctcactcttctg

SEQ ID NO: 6172725 - DNA, 15 bp, Homo sapiens
cttcctgtctcccag

SEQ ID NO: 6172726 - DNA, 15 bp, Homo sapiens
cttcctgtctggccc

SEQ ID NO: 6172727 - DNA, 17 bp, Homo sapiens
cttcctgtctggcccaa

SEQ ID NO: 6172728 - DNA, 22 bp, Homo sapiens
cttcctgtgaagtttaattgtc

SEQ ID NO: 6172729 - DNA, 16 bp, Homo sapiens
cttcctgtgacttcag

SEQ ID NO: 6172730 - DNA, 18 bp, Homo sapiens
cttcctgtgatccaccca

SEQ ID NO: 6172731 - DNA, 14 bp, Homo sapiens
cttcctgtgccttt

SEQ ID NO: 6172732 - DNA, 10 bp, Homo sapiens
cttcctgtgg

SEQ ID NO: 6172733 - DNA, 14 bp, Homo sapiens
cttcctgtggcctc

SEQ ID NO: 6172734 - DNA, 15 bp, Homo sapiens
cttcctgtggcctca

SEQ ID NO: 6172735 - DNA, 16 bp, Homo sapiens
cttcctgtggcctgaa

SEQ ID NO: 6172736 - DNA, 21 bp, Homo sapiens
cttcctgtggcctgaagaagc

SEQ ID NO: 6172737 - DNA, 13 bp, Homo sapiens
cttcctgtggctc

SEQ ID NO: 6172738 - DNA, 21 bp, Homo sapiens
cttcctgtggctttgttttct

SEQ ID NO: 6172739 - DNA, 22 bp, Homo sapiens
cttcctgtgtaacatctgccat

SEQ ID NO: 6172740 - DNA, 12 bp, Homo sapiens
cttcctgtgtcc

SEQ ID NO: 6172741 - DNA, 16 bp, Homo sapiens
cttcctgttacctgtc

SEQ ID NO: 6172742 - DNA, 17 bp, Homo sapiens
cttcctgttctgtgact

SEQ ID NO: 6172743 - DNA, 16 bp, Homo sapiens
cttcctgttcttcctt

SEQ ID NO: 6172744 - DNA, 23 bp, Homo sapiens
cttcctgtttcagacccccccat

SEQ ID NO: 6172745 - DNA, 22 bp, Homo sapiens
cttcctgttttaagcagctcta

SEQ ID NO: 6172746 - DNA, 16 bp, Homo sapiens
cttcctgtttttcaca

SEQ ID NO: 6172747 - DNA, 13 bp, Homo sapiens
cttccttaacagc

SEQ ID NO: 6172748 - DNA, 19 bp, Homo sapiens
cttccttactcccaggcac

SEQ ID NO: 6172749 - DNA, 17 bp, Homo sapiens
cttccttattttaagca

SEQ ID NO: 6172750 - DNA, 17 bp, Homo sapiens
cttccttcacccaccac

SEQ ID NO: 6172751 - DNA, 15 bp, Homo sapiens
cttccttcagagagc

SEQ ID NO: 6172752 - DNA, 14 bp, Homo sapiens
cttccttcaggact

SEQ ID NO: 6172753 - DNA, 14 bp, Homo sapiens
cttccttcagggtt

SEQ ID NO: 6172754 - DNA, 18 bp, Homo sapiens
cttccttcagggtttaat

SEQ ID NO: 6172755 - DNA, 13 bp, Homo sapiens
cttccttcatttc

SEQ ID NO: 6172756 - DNA, 15 bp, Homo sapiens
cttccttcatttcct

SEQ ID NO: 6172757 - DNA, 16 bp, Homo sapiens
cttccttcatttcctc

SEQ ID NO: 6172758 - DNA, 22 bp, Homo sapiens
cttccttccattgctcccagtg

SEQ ID NO: 6172759 - DNA, 12 bp, Homo sapiens
cttccttcccac

SEQ ID NO: 6172760 - DNA, 13 bp, Homo sapiens
cttccttccccca

SEQ ID NO: 6172761 - DNA, 13 bp, Homo sapiens
cttccttccctgg

SEQ ID NO: 6172762 - DNA, 16 bp, Homo sapiens
cttccttccctgggct

SEQ ID NO: 6172763 - DNA, 21 bp, Homo sapiens
cttccttccctgggctgtgct

SEQ ID NO: 6172764 - DNA, 10 bp, Homo sapiens
cttccttcct

SEQ ID NO: 6172765 - DNA, 13 bp, Homo sapiens
cttccttcctaga

SEQ ID NO: 6172766 - DNA, 14 bp, Homo sapiens
cttccttcctctcc

SEQ ID NO: 6172767 - DNA, 21 bp, Homo sapiens
cttccttctaccccaaggcca

SEQ ID NO: 6172768 - DNA, 15 bp, Homo sapiens
cttccttctcagcac

SEQ ID NO: 6172769 - DNA, 16 bp, Homo sapiens
cttccttctcagcact

SEQ ID NO: 6172770 - DNA, 14 bp, Homo sapiens
cttccttctctact

SEQ ID NO: 6172771 - DNA, 15 bp, Homo sapiens
cttccttctctactc

SEQ ID NO: 6172772 - DNA, 16 bp, Homo sapiens
cttccttctgctccca

SEQ ID NO: 6172773 - DNA, 11 bp, Homo sapiens
cttccttctgg

SEQ ID NO: 6172774 - DNA, 13 bp, Homo sapiens
cttccttcttccc

SEQ ID NO: 6172775 - DNA, 20 bp, Homo sapiens
cttccttctttattgcccct

SEQ ID NO: 6172776 - DNA, 18 bp, Homo sapiens
cttccttctttgcccttt

SEQ ID NO: 6172777 - DNA, 22 bp, Homo sapiens
cttccttgaagaactgcaggcc

SEQ ID NO: 6172778 - DNA, 13 bp, Homo sapiens
cttccttgccaca

SEQ ID NO: 6172779 - DNA, 14 bp, Homo sapiens
cttccttgccacaa

SEQ ID NO: 6172780 - DNA, 18 bp, Homo sapiens
cttccttgccacaatcac

SEQ ID NO: 6172781 - DNA, 23 bp, Homo sapiens
cttccttgccacaatcactaaat

SEQ ID NO: 6172782 - DNA, 17 bp, Homo sapiens
cttccttgccagtcttt

SEQ ID NO: 6172783 - DNA, 16 bp, Homo sapiens
cttccttgcccctgct

SEQ ID NO: 6172784 - DNA, 14 bp, Homo sapiens
cttccttgctctcc

SEQ ID NO: 6172785 - DNA, 17 bp, Homo sapiens
cttccttgctgtcctag

SEQ ID NO: 6172786 - DNA, 17 bp, Homo sapiens
cttccttgcttaaggta

SEQ ID NO: 6172787 - DNA, 20 bp, Homo sapiens
cttccttggactcattttaa

SEQ ID NO: 6172788 - DNA, 13 bp, Homo sapiens
cttccttgtctct

SEQ ID NO: 6172789 - DNA, 19 bp, Homo sapiens
cttccttgttgtttgcttt

SEQ ID NO: 6172790 - DNA, 15 bp, Homo sapiens
cttcctttactttcc

SEQ ID NO: 6172791 - DNA, 18 bp, Homo sapiens
cttcctttactttccctt

SEQ ID NO: 6172792 - DNA, 20 bp, Homo sapiens
cttcctttactttcccttgc

SEQ ID NO: 6172793 - DNA, 19 bp, Homo sapiens
cttcctttaggtctggttg

SEQ ID NO: 6172794 - DNA, 15 bp, Homo sapiens
cttcctttcaggcca

SEQ ID NO: 6172795 - DNA, 11 bp, Homo sapiens
cttcctttcat

SEQ ID NO: 6172796 - DNA, 11 bp, Homo sapiens
cttcctttcct

SEQ ID NO: 6172797 - DNA, 14 bp, Homo sapiens
cttcctttcctact

SEQ ID NO: 6172798 - DNA, 14 bp, Homo sapiens
cttcctttcctctg

SEQ ID NO: 6172799 - DNA, 17 bp, Homo sapiens
cttcctttcctctgcag

SEQ ID NO: 6172800 - DNA, 12 bp, Homo sapiens
cttcctttctcc

SEQ ID NO: 6172801 - DNA, 15 bp, Homo sapiens
cttcctttctcccct

SEQ ID NO: 6172802 - DNA, 19 bp, Homo sapiens
cttcctttctcctgcccca

SEQ ID NO: 6172803 - DNA, 20 bp, Homo sapiens
cttcctttctcctgccccaa

SEQ ID NO: 6172804 - DNA, 17 bp, Homo sapiens
cttcctttctctcctgg

SEQ ID NO: 6172805 - DNA, 13 bp, Homo sapiens
cttcctttcttga

SEQ ID NO: 6172806 - DNA, 12 bp, Homo sapiens
cttcctttgaaa

SEQ ID NO: 6172807 - DNA, 21 bp, Homo sapiens
cttcctttgaccactgtcttt

SEQ ID NO: 6172808 - DNA, 19 bp, Homo sapiens
cttcctttgactttctgtg

SEQ ID NO: 6172809 - DNA, 18 bp, Homo sapiens
cttcctttgcccttcctc

SEQ ID NO: 6172810 - DNA, 21 bp, Homo sapiens
cttcctttgcccttcctcctg

SEQ ID NO: 6172811 - DNA, 12 bp, Homo sapiens
cttcctttgctc

SEQ ID NO: 6172812 - DNA, 19 bp, Homo sapiens
cttcctttggtgcctcact

SEQ ID NO: 6172813 - DNA, 15 bp, Homo sapiens
cttcctttgtaaaaa

SEQ ID NO: 6172814 - DNA, 17 bp, Homo sapiens
cttcctttgtgtttata

SEQ ID NO: 6172815 - DNA, 21 bp, Homo sapiens
cttccttttaagtaaggtcca

SEQ ID NO: 6172816 - DNA, 12 bp, Homo sapiens
cttccttttcac

SEQ ID NO: 6172817 - DNA, 13 bp, Homo sapiens
cttccttttcact

SEQ ID NO: 6172818 - DNA, 16 bp, Homo sapiens
cttccttttccctgct

SEQ ID NO: 6172819 - DNA, 17 bp, Homo sapiens
cttccttttccctgctt

SEQ ID NO: 6172820 - DNA, 15 bp, Homo sapiens
cttccttttgaggga

SEQ ID NO: 6172821 - DNA, 22 bp, Homo sapiens
cttccttttttaaaataaaata

SEQ ID NO: 6172822 - DNA, 21 bp, Homo sapiens
cttccttttttctttctttac

SEQ ID NO: 6172823 - DNA, 17 bp, Homo sapiens
cttcctttttttaaatt

SEQ ID NO: 6172824 - DNA, 23 bp, Homo sapiens
cttcgaaaagaaattgtccttga

SEQ ID NO: 6172825 - DNA, 16 bp, Homo sapiens
cttcgaaaggccttca

SEQ ID NO: 6172826 - DNA, 17 bp, Homo sapiens
cttcgaaaggccttcag

SEQ ID NO: 6172827 - DNA, 18 bp, Homo sapiens
cttcgaaaggccttcaga

SEQ ID NO: 6172828 - DNA, 13 bp, Homo sapiens
cttcgaactccag

SEQ ID NO: 6172829 - DNA, 15 bp, Homo sapiens
cttcgacagcatttt

SEQ ID NO: 6172830 - DNA, 17 bp, Homo sapiens
cttcgacatgctgccag

SEQ ID NO: 6172831 - DNA, 18 bp, Homo sapiens
cttcgacatgctgccagg

SEQ ID NO: 6172832 - DNA, 19 bp, Homo sapiens
cttcgacatgctgccagga

SEQ ID NO: 6172833 - DNA, 13 bp, Homo sapiens
cttcgactactgc

SEQ ID NO: 6172834 - DNA, 14 bp, Homo sapiens
cttcgactcaggat

SEQ ID NO: 6172835 - DNA, 14 bp, Homo sapiens
cttcgactgttgtt

SEQ ID NO: 6172836 - DNA, 23 bp, Homo sapiens
cttcgactgttgttatctgtttg

SEQ ID NO: 6172837 - DNA, 16 bp, Homo sapiens
cttcgagttcccaggg

SEQ ID NO: 6172838 - DNA, 19 bp, Homo sapiens
cttcgatcaagctacttta

SEQ ID NO: 6172839 - DNA, 17 bp, Homo sapiens
cttcgcaaactgatgga

SEQ ID NO: 6172840 - DNA, 17 bp, Homo sapiens
cttcgcatcaaaagaca

SEQ ID NO: 6172841 - DNA, 20 bp, Homo sapiens
cttcgccatgtgctgtgcac

SEQ ID NO: 6172842 - DNA, 16 bp, Homo sapiens
cttcgccctctgaaat

SEQ ID NO: 6172843 - DNA, 13 bp, Homo sapiens
cttcgcctgcagc

SEQ ID NO: 6172844 - DNA, 19 bp, Homo sapiens
cttcgcctttcccaccctc

SEQ ID NO: 6172845 - DNA, 20 bp, Homo sapiens
cttcgctattcccaggcagg

SEQ ID NO: 6172846 - DNA, 21 bp, Homo sapiens
cttcgctattcccaggcaggg

SEQ ID NO: 6172847 - DNA, 15 bp, Homo sapiens
cttcgctcctgtgtc

SEQ ID NO: 6172848 - DNA, 12 bp, Homo sapiens
cttcgctctgct

SEQ ID NO: 6172849 - DNA, 14 bp, Homo sapiens
cttcgctctgctgg

SEQ ID NO: 6172850 - DNA, 14 bp, Homo sapiens
cttcgctcttgagg

SEQ ID NO: 6172851 - DNA, 19 bp, Homo sapiens
cttcgctgccaggacacct

SEQ ID NO: 6172852 - DNA, 22 bp, Homo sapiens
cttcgctgccaggacacctgcc

SEQ ID NO: 6172853 - DNA, 17 bp, Homo sapiens
cttcgctggactattgt

SEQ ID NO: 6172854 - DNA, 12 bp, Homo sapiens
cttcgctggctc

SEQ ID NO: 6172855 - DNA, 15 bp, Homo sapiens
cttcgcttcttgcct

SEQ ID NO: 6172856 - DNA, 17 bp, Homo sapiens
cttcgcttcttgcctct

SEQ ID NO: 6172857 - DNA, 21 bp, Homo sapiens
cttcgcttcttgcctctgtgc

SEQ ID NO: 6172858 - DNA, 16 bp, Homo sapiens
cttcgcttggagaccc

SEQ ID NO: 6172859 - DNA, 17 bp, Homo sapiens
cttcgcttggagaccca

SEQ ID NO: 6172860 - DNA, 19 bp, Homo sapiens
cttcggaaaccttggtgta

SEQ ID NO: 6172861 - DNA, 23 bp, Homo sapiens
cttcggaatccagtgcttccaca

SEQ ID NO: 6172862 - DNA, 15 bp, Homo sapiens
cttcggacaaaatat

SEQ ID NO: 6172863 - DNA, 19 bp, Homo sapiens
cttcggagaggacacttca

SEQ ID NO: 6172864 - DNA, 17 bp, Homo sapiens
cttcggaggaccagggc

SEQ ID NO: 6172865 - DNA, 19 bp, Homo sapiens
cttcggaggaggtggacat

SEQ ID NO: 6172866 - DNA, 14 bp, Homo sapiens
cttcggaggtggca

SEQ ID NO: 6172867 - DNA, 16 bp, Homo sapiens
cttcggaggtggcagc

SEQ ID NO: 6172868 - DNA, 17 bp, Homo sapiens
cttcggcagtggctggg

SEQ ID NO: 6172869 - DNA, 18 bp, Homo sapiens
cttcggcagtggctgggg

SEQ ID NO: 6172870 - DNA, 19 bp, Homo sapiens
cttcggcagtggctggggg

SEQ ID NO: 6172871 - DNA, 18 bp, Homo sapiens
cttcggcctccatcctga

SEQ ID NO: 6172872 - DNA, 19 bp, Homo sapiens
cttcggcctccatcctgag

SEQ ID NO: 6172873 - DNA, 20 bp, Homo sapiens
cttcggcctccatcctgagg

SEQ ID NO: 6172874 - DNA, 13 bp, Homo sapiens
cttcggcctgctt

SEQ ID NO: 6172875 - DNA, 23 bp, Homo sapiens
cttcgggaagagaggagttcaat

SEQ ID NO: 6172876 - DNA, 12 bp, Homo sapiens
cttcgggaagat

SEQ ID NO: 6172877 - DNA, 12 bp, Homo sapiens
cttcgggaccag

SEQ ID NO: 6172878 - DNA, 16 bp, Homo sapiens
cttcgggaccctgggg

SEQ ID NO: 6172879 - DNA, 16 bp, Homo sapiens
cttcggggaagataca

SEQ ID NO: 6172880 - DNA, 14 bp, Homo sapiens
cttcggggaccagc

SEQ ID NO: 6172881 - DNA, 16 bp, Homo sapiens
cttcggggaccagccc

SEQ ID NO: 6172882 - DNA, 14 bp, Homo sapiens
cttcggggctggga

SEQ ID NO: 6172883 - DNA, 21 bp, Homo sapiens
cttcggggtagaggctgggag

SEQ ID NO: 6172884 - DNA, 17 bp, Homo sapiens
cttcgggtgtgatcata

SEQ ID NO: 6172885 - DNA, 17 bp, Homo sapiens
cttcggtggaagagctc

SEQ ID NO: 6172886 - DNA, 15 bp, Homo sapiens
cttcggtgtgcagat

SEQ ID NO: 6172887 - DNA, 19 bp, Homo sapiens
cttcggtgtttaaagtcaa

SEQ ID NO: 6172888 - DNA, 22 bp, Homo sapiens
cttcggttcctctgatttcaag

SEQ ID NO: 6172889 - DNA, 16 bp, Homo sapiens
cttcggtttctgagca

SEQ ID NO: 6172890 - DNA, 21 bp, Homo sapiens
cttcgtaagaaggaatgcgag

SEQ ID NO: 6172891 - DNA, 19 bp, Homo sapiens
cttcgtcctgatccctcca

SEQ ID NO: 6172892 - DNA, 17 bp, Homo sapiens
cttcgtctcagaaggct

SEQ ID NO: 6172893 - DNA, 14 bp, Homo sapiens
cttcgtctttccca

SEQ ID NO: 6172894 - DNA, 21 bp, Homo sapiens
cttcgtctttcccatggggag

SEQ ID NO: 6172895 - DNA, 13 bp, Homo sapiens
cttcgtgaacata

SEQ ID NO: 6172896 - DNA, 19 bp, Homo sapiens
cttcgtgacaatgtttaca

SEQ ID NO: 6172897 - DNA, 17 bp, Homo sapiens
cttcgtgcccccccttc

SEQ ID NO: 6172898 - DNA, 14 bp, Homo sapiens
cttcgtgctggagg

SEQ ID NO: 6172899 - DNA, 15 bp, Homo sapiens
cttcgtgctggagga

SEQ ID NO: 6172900 - DNA, 18 bp, Homo sapiens
cttcgtggagctctaact

SEQ ID NO: 6172901 - DNA, 20 bp, Homo sapiens
cttcgtggctaaggtaagaa

SEQ ID NO: 6172902 - DNA, 22 bp, Homo sapiens
cttcgtgggatctgcccctccc

SEQ ID NO: 6172903 - DNA, 13 bp, Homo sapiens
cttcgtgtgctgc

SEQ ID NO: 6172904 - DNA, 16 bp, Homo sapiens
cttcgtgtgctgctgc

SEQ ID NO: 6172905 - DNA, 15 bp, Homo sapiens
cttcgtgtggctcct

SEQ ID NO: 6172906 - DNA, 19 bp, Homo sapiens
cttcgtgtgtgcgcccctc

SEQ ID NO: 6172907 - DNA, 17 bp, Homo sapiens
cttcgttcgcagagctt

SEQ ID NO: 6172908 - DNA, 13 bp, Homo sapiens
cttcgttcttttt

SEQ ID NO: 6172909 - DNA, 15 bp, Homo sapiens
cttcgttctttttaa

SEQ ID NO: 6172910 - DNA, 15 bp, Homo sapiens
cttcgtttattttca

SEQ ID NO: 6172911 - DNA, 16 bp, Homo sapiens
cttcgtttattttcaa

SEQ ID NO: 6172912 - DNA, 18 bp, Homo sapiens
cttcgtttattttcaaga

SEQ ID NO: 6172913 - DNA, 21 bp, Homo sapiens
cttcgtttgcctccagaacct

SEQ ID NO: 6172914 - DNA, 19 bp, Homo sapiens
cttctaaaaaaaaacaaaa

SEQ ID NO: 6172915 - DNA, 16 bp, Homo sapiens
cttctaaaacaataaa

SEQ ID NO: 6172916 - DNA, 18 bp, Homo sapiens
cttctaaaactactgcct

SEQ ID NO: 6172917 - DNA, 19 bp, Homo sapiens
cttctaaaactgtactttg

SEQ ID NO: 6172918 - DNA, 20 bp, Homo sapiens
cttctaaaactgtactttga

SEQ ID NO: 6172919 - DNA, 16 bp, Homo sapiens
cttctaaaagccatta

SEQ ID NO: 6172920 - DNA, 19 bp, Homo sapiens
cttctaaaagttttctaat

SEQ ID NO: 6172921 - DNA, 17 bp, Homo sapiens
cttctaaacacttcatt

SEQ ID NO: 6172922 - DNA, 13 bp, Homo sapiens
cttctaaacattt

SEQ ID NO: 6172923 - DNA, 15 bp, Homo sapiens
cttctaaacattttt

SEQ ID NO: 6172924 - DNA, 19 bp, Homo sapiens
cttctaaacccaatccaaa

SEQ ID NO: 6172925 - DNA, 21 bp, Homo sapiens
cttctaaactgaagctgctgt

SEQ ID NO: 6172926 - DNA, 22 bp, Homo sapiens
cttctaaacttccccatcttct

SEQ ID NO: 6172927 - DNA, 13 bp, Homo sapiens
cttctaaagaagt

SEQ ID NO: 6172928 - DNA, 16 bp, Homo sapiens
cttctaaaggcggagg

SEQ ID NO: 6172929 - DNA, 21 bp, Homo sapiens
cttctaaaggtgttgtccctt

SEQ ID NO: 6172930 - DNA, 17 bp, Homo sapiens
cttctaaagtgctggga

SEQ ID NO: 6172931 - DNA, 19 bp, Homo sapiens
cttctaaagtgctgggatt

SEQ ID NO: 6172932 - DNA, 18 bp, Homo sapiens
cttctaaatcagaaatag

SEQ ID NO: 6172933 - DNA, 13 bp, Homo sapiens
cttctaaatcata

SEQ ID NO: 6172934 - DNA, 19 bp, Homo sapiens
cttctaaatcataatcatc

SEQ ID NO: 6172935 - DNA, 23 bp, Homo sapiens
cttctaaatggcaaaggaaggtg

SEQ ID NO: 6172936 - DNA, 20 bp, Homo sapiens
cttctaaatgttggaatttt

SEQ ID NO: 6172937 - DNA, 14 bp, Homo sapiens
cttctaacacctct

SEQ ID NO: 6172938 - DNA, 15 bp, Homo sapiens
cttctaacatgaaat

SEQ ID NO: 6172939 - DNA, 14 bp, Homo sapiens
cttctaacctcagc

SEQ ID NO: 6172940 - DNA, 16 bp, Homo sapiens
cttctaacctcagcca

SEQ ID NO: 6172941 - DNA, 22 bp, Homo sapiens
cttctaacctcagccaaacaca

SEQ ID NO: 6172942 - DNA, 15 bp, Homo sapiens
cttctaactaaacta

SEQ ID NO: 6172943 - DNA, 21 bp, Homo sapiens
cttctaactccactggctcca

SEQ ID NO: 6172944 - DNA, 13 bp, Homo sapiens
cttctaagaagac

SEQ ID NO: 6172945 - DNA, 16 bp, Homo sapiens
cttctaagaagacatt

SEQ ID NO: 6172946 - DNA, 13 bp, Homo sapiens
cttctaagacttt

SEQ ID NO: 6172947 - DNA, 23 bp, Homo sapiens
cttctaagagcgaacttcacata

SEQ ID NO: 6172948 - DNA, 13 bp, Homo sapiens
cttctaagataaa

SEQ ID NO: 6172949 - DNA, 22 bp, Homo sapiens
cttctaaggaaatggagaagct

SEQ ID NO: 6172950 - DNA, 23 bp, Homo sapiens
cttctaaggaaatggagaagctc

SEQ ID NO: 6172951 - DNA, 22 bp, Homo sapiens
cttctaagggatccagagacct

SEQ ID NO: 6172952 - DNA, 13 bp, Homo sapiens
cttctaagtaaaa

SEQ ID NO: 6172953 - DNA, 14 bp, Homo sapiens
cttctaagtaaata

SEQ ID NO: 6172954 - DNA, 16 bp, Homo sapiens
cttctaataaagtcat

SEQ ID NO: 6172955 - DNA, 12 bp, Homo sapiens
cttctaatatat

SEQ ID NO: 6172956 - DNA, 14 bp, Homo sapiens
cttctaatatattt

SEQ ID NO: 6172957 - DNA, 15 bp, Homo sapiens
cttctaatatatttt

SEQ ID NO: 6172958 - DNA, 20 bp, Homo sapiens
cttctaatatatttttatat

SEQ ID NO: 6172959 - DNA, 21 bp, Homo sapiens
cttctaatatttattgcttta

SEQ ID NO: 6172960 - DNA, 20 bp, Homo sapiens
cttctaatccatgtgctgct

SEQ ID NO: 6172961 - DNA, 21 bp, Homo sapiens
cttctaatccatgtgctgctg

SEQ ID NO: 6172962 - DNA, 22 bp, Homo sapiens
cttctaatctgctatgcttgaa

SEQ ID NO: 6172963 - DNA, 12 bp, Homo sapiens
cttctaatctta

SEQ ID NO: 6172964 - DNA, 14 bp, Homo sapiens
cttctaatcttaaa

SEQ ID NO: 6172965 - DNA, 17 bp, Homo sapiens
cttctaatcttaaatca

SEQ ID NO: 6172966 - DNA, 19 bp, Homo sapiens
cttctaatgaagacaatga

SEQ ID NO: 6172967 - DNA, 11 bp, Homo sapiens
cttctaatgac

SEQ ID NO: 6172968 - DNA, 17 bp, Homo sapiens
cttctaatgacccagat

SEQ ID NO: 6172969 - DNA, 14 bp, Homo sapiens
cttctaatgtaaat

SEQ ID NO: 6172970 - DNA, 23 bp, Homo sapiens
cttctaatgttcccctaacccta

SEQ ID NO: 6172971 - DNA, 13 bp, Homo sapiens
cttctaattattt

SEQ ID NO: 6172972 - DNA, 15 bp, Homo sapiens
cttctaattgccatg

SEQ ID NO: 6172973 - DNA, 16 bp, Homo sapiens
cttctaattgccatgt

SEQ ID NO: 6172974 - DNA, 14 bp, Homo sapiens
cttctaatttatat

SEQ ID NO: 6172975 - DNA, 21 bp, Homo sapiens
ctgctaaagggagaaatgcca

SEQ ID NO: 6172976 - DNA, 23 bp, Homo sapiens
ctgctaaataaaatttgttgcat

SEQ ID NO: 6172977 - DNA, 18 bp, Homo sapiens
ctgctaaatctcctattt

SEQ ID NO: 6172978 - DNA, 14 bp, Homo sapiens
ctgctaaatgaaga

SEQ ID NO: 6172979 - DNA, 22 bp, Homo sapiens
ctgctaaattctatgttaaata

SEQ ID NO: 6172980 - DNA, 19 bp, Homo sapiens
ctgctaaattgatgttgat

SEQ ID NO: 6172981 - DNA, 22 bp, Homo sapiens
ctgctaaattgatgttgatgca

SEQ ID NO: 6172982 - DNA, 18 bp, Homo sapiens
ctgctaaatttttgttgg

SEQ ID NO: 6172983 - DNA, 15 bp, Homo sapiens
ctgctaacctggaaa

SEQ ID NO: 6172984 - DNA, 16 bp, Homo sapiens
ctgctaacctggaaag

SEQ ID NO: 6172985 - DNA, 21 bp, Homo sapiens
ctgctaacttggagccccagt

SEQ ID NO: 6172986 - DNA, 13 bp, Homo sapiens
ctgctaagaagct

SEQ ID NO: 6172987 - DNA, 13 bp, Homo sapiens
ctgctaagctaaa

SEQ ID NO: 6172988 - DNA, 22 bp, Homo sapiens
ctgctaagtaggggcagtgatg

SEQ ID NO: 6172989 - DNA, 17 bp, Homo sapiens
ctgctaagtatttccca

SEQ ID NO: 6172990 - DNA, 21 bp, Homo sapiens
ctgctaagtcattggcaaagt

SEQ ID NO: 6172991 - DNA, 18 bp, Homo sapiens
ctgctaagtggaagacag

SEQ ID NO: 6172992 - DNA, 14 bp, Homo sapiens
ctgctaataaatga

SEQ ID NO: 6172993 - DNA, 19 bp, Homo sapiens
ctgctaataaatgaccagt

SEQ ID NO: 6172994 - DNA, 15 bp, Homo sapiens
ctgctaatattttcc

SEQ ID NO: 6172995 - DNA, 18 bp, Homo sapiens
ctgctaatcttcagggca

SEQ ID NO: 6172996 - DNA, 21 bp, Homo sapiens
ctgctaattcccaacatttct

SEQ ID NO: 6172997 - DNA, 15 bp, Homo sapiens
ctgctaattctttgc

SEQ ID NO: 6172998 - DNA, 23 bp, Homo sapiens
ctgctaattctttgcaaaaatcc

SEQ ID NO: 6172999 - DNA, 22 bp, Homo sapiens
ctgctaatttatgaagatagtt

SEQ ID NO: 6173000 - DNA, 17 bp, Homo sapiens
ctgctacaaagaagaca

SEQ ID NO: 6173001 - DNA, 22 bp, Homo sapiens
ctgctacaaagaagacatgttt

SEQ ID NO: 6173002 - DNA, 18 bp, Homo sapiens
ctgctacaagtgttttag

SEQ ID NO: 6173003 - DNA, 13 bp, Homo sapiens
ctgctacatgtgc

SEQ ID NO: 6173004 - DNA, 15 bp, Homo sapiens
ctgctaccctagatg

SEQ ID NO: 6173005 - DNA, 13 bp, Homo sapiens
ctgctaccctccc

SEQ ID NO: 6173006 - DNA, 17 bp, Homo sapiens
ctgctaccctccctgct

SEQ ID NO: 6173007 - DNA, 21 bp, Homo sapiens
ctgctaccgttgacttccagg

SEQ ID NO: 6173008 - DNA, 20 bp, Homo sapiens
ctgctacctctgagaagaca

SEQ ID NO: 6173009 - DNA, 19 bp, Homo sapiens
ctgctacctggttttcatt

SEQ ID NO: 6173010 - DNA, 20 bp, Homo sapiens
ctgctacctggttttcatta

SEQ ID NO: 6173011 - DNA, 20 bp, Homo sapiens
ctgctacctttcaaagcttg

SEQ ID NO: 6173012 - DNA, 18 bp, Homo sapiens
ctgctacctttgtctcac

SEQ ID NO: 6173013 - DNA, 24 bp, Homo sapiens
ctgctacctttgtctcacgattcc

SEQ ID NO: 6173014 - DNA, 17 bp, Homo sapiens
ctgctactacccgagcc

SEQ ID NO: 6173015 - DNA, 19 bp, Homo sapiens
ctgctactacccgagccca

SEQ ID NO: 6173016 - DNA, 20 bp, Homo sapiens
ctgctactacccgagcccag

SEQ ID NO: 6173017 - DNA, 23 bp, Homo sapiens
ctgctactacccgagcccagcta

SEQ ID NO: 6173018 - DNA, 20 bp, Homo sapiens
ctgctactcaagtagcattt

SEQ ID NO: 6173019 - DNA, 16 bp, Homo sapiens
ctgctactccactgac

SEQ ID NO: 6173020 - DNA, 19 bp, Homo sapiens
ctgctactccactgacctg

SEQ ID NO: 6173021 - DNA, 19 bp, Homo sapiens
ctgctactgacccagaggg

SEQ ID NO: 6173022 - DNA, 17 bp, Homo sapiens
ctgctactggcaaaagg

SEQ ID NO: 6173023 - DNA, 17 bp, Homo sapiens
ctgctacttccccagct

SEQ ID NO: 6173024 - DNA, 20 bp, Homo sapiens
ctgctacttccccagctctc

SEQ ID NO: 6173025 - DNA, 17 bp, Homo sapiens
ctgctacttgctctgct

SEQ ID NO: 6173026 - DNA, 24 bp, Homo sapiens
ctgctacttgtggacctcaccaga

SEQ ID NO: 6173027 - DNA, 18 bp, Homo sapiens
ctgctagaacctctcgta

SEQ ID NO: 6173028 - DNA, 12 bp, Homo sapiens
ctgctagaactt

SEQ ID NO: 6173029 - DNA, 13 bp, Homo sapiens
ctgctagaacttt

SEQ ID NO: 6173030 - DNA, 14 bp, Homo sapiens
ctgctagaactttt

SEQ ID NO: 6173031 - DNA, 16 bp, Homo sapiens
ctgctagacgcaccgc

SEQ ID NO: 6173032 - DNA, 13 bp, Homo sapiens
ctgctagactcct

SEQ ID NO: 6173033 - DNA, 19 bp, Homo sapiens
ctgctagagacgctgatcc

SEQ ID NO: 6173034 - DNA, 17 bp, Homo sapiens
ctgctagatttctacat

SEQ ID NO: 6173035 - DNA, 23 bp, Homo sapiens
ctgctagattttaatttatttgt

SEQ ID NO: 6173036 - DNA, 14 bp, Homo sapiens
ctgctagcacagag

SEQ ID NO: 6173037 - DNA, 18 bp, Homo sapiens
ctgctagcacagaggcct

SEQ ID NO: 6173038 - DNA, 19 bp, Homo sapiens
ctgctagcacagaggcctg

SEQ ID NO: 6173039 - DNA, 22 bp, Homo sapiens
ctgctagcacctccccagacag

SEQ ID NO: 6173040 - DNA, 14 bp, Homo sapiens
ctgctagcaggccc

SEQ ID NO: 6173041 - DNA, 15 bp, Homo sapiens
ctgctagcaggcccc

SEQ ID NO: 6173042 - DNA, 20 bp, Homo sapiens
ctgctagcaggccccctagg

SEQ ID NO: 6173043 - DNA, 21 bp, Homo sapiens
ctgctagcaggccccctagga

SEQ ID NO: 6173044 - DNA, 14 bp, Homo sapiens
ctgctagcggctga

SEQ ID NO: 6173045 - DNA, 14 bp, Homo sapiens
ctgctagctagctc

SEQ ID NO: 6173046 - DNA, 19 bp, Homo sapiens
ctgctagctgtagaaatgt

SEQ ID NO: 6173047 - DNA, 12 bp, Homo sapiens
ctgctagctgtc

SEQ ID NO: 6173048 - DNA, 19 bp, Homo sapiens
ctgctaggccagagcccac

SEQ ID NO: 6173049 - DNA, 18 bp, Homo sapiens
ctgctaggctaccctcct

SEQ ID NO: 6173050 - DNA, 17 bp, Homo sapiens
ctgctagtatatgtcag

SEQ ID NO: 6173051 - DNA, 12 bp, Homo sapiens
ctgctagtcact

SEQ ID NO: 6173052 - DNA, 17 bp, Homo sapiens
ctgctagtcactggaaa

SEQ ID NO: 6173053 - DNA, 19 bp, Homo sapiens
ctgctagtcgcccctcaga

SEQ ID NO: 6173054 - DNA, 15 bp, Homo sapiens
ctgctagtgaaaaga

SEQ ID NO: 6173055 - DNA, 20 bp, Homo sapiens
ctgctagtgaaatggctggg

SEQ ID NO: 6173056 - DNA, 21 bp, Homo sapiens
ctgctataaataggtttatat

SEQ ID NO: 6173057 - DNA, 22 bp, Homo sapiens
ctgctatacacaagcaatgcaa

SEQ ID NO: 6173058 - DNA, 14 bp, Homo sapiens
ctgctatagcctgg

SEQ ID NO: 6173059 - DNA, 15 bp, Homo sapiens
ctgctatagcctggg

SEQ ID NO: 6173060 - DNA, 20 bp, Homo sapiens
ctgctatatgccttaagcca

SEQ ID NO: 6173061 - DNA, 20 bp, Homo sapiens
ctgctatattaacatcatct

SEQ ID NO: 6173062 - DNA, 22 bp, Homo sapiens
ctgctatattaacatcatctta

SEQ ID NO: 6173063 - DNA, 15 bp, Homo sapiens
ctgctatcattattc

SEQ ID NO: 6173064 - DNA, 16 bp, Homo sapiens
ctgctatccagccgca

SEQ ID NO: 6173065 - DNA, 20 bp, Homo sapiens
ctgctatccccatctccctg

SEQ ID NO: 6173066 - DNA, 18 bp, Homo sapiens
ctgctatgacagctggct

SEQ ID NO: 6173067 - DNA, 19 bp, Homo sapiens
ctgctatgacagctggcta

SEQ ID NO: 6173068 - DNA, 23 bp, Homo sapiens
ctgctatgcagatgtctaagaca

SEQ ID NO: 6173069 - DNA, 18 bp, Homo sapiens
ctgctatgccatttcttc

SEQ ID NO: 6173070 - DNA, 22 bp, Homo sapiens
ctgctatgctgttcattgatga

SEQ ID NO: 6173071 - DNA, 19 bp, Homo sapiens
ctgctatgtatttgcaagg

SEQ ID NO: 6173072 - DNA, 18 bp, Homo sapiens
ctgctatgtctgtgatgt

SEQ ID NO: 6173073 - DNA, 14 bp, Homo sapiens
ctgctattaacctt

SEQ ID NO: 6173074 - DNA, 22 bp, Homo sapiens
ctgctattatgatgttttgcaa

SEQ ID NO: 6173075 - DNA, 22 bp, Homo sapiens
ctgctattatgtaacatccaga

SEQ ID NO: 6173076 - DNA, 21 bp, Homo sapiens
ctgctattctagagcttttat

SEQ ID NO: 6173077 - DNA, 19 bp, Homo sapiens
ctgctatttattttcctaa

SEQ ID NO: 6173078 - DNA, 18 bp, Homo sapiens
ctgctatttcaggccctc

SEQ ID NO: 6173079 - DNA, 23 bp, Homo sapiens
ctgctatttcaggccctcagctg

SEQ ID NO: 6173080 - DNA, 24 bp, Homo sapiens
ctgctatttcaggccctcagctgt

SEQ ID NO: 6173081 - DNA, 16 bp, Homo sapiens
ctgctatttctcttgc

SEQ ID NO: 6173082 - DNA, 13 bp, Homo sapiens
ctgctattttact

SEQ ID NO: 6173083 - DNA, 22 bp, Homo sapiens
ctgctattttttttaaatcaaa

SEQ ID NO: 6173084 - DNA, 18 bp, Homo sapiens
ctgctcaacctctctcct

SEQ ID NO: 6173085 - DNA, 23 bp, Homo sapiens
ctgctcaacctctctccttctgg

SEQ ID NO: 6173086 - DNA, 16 bp, Homo sapiens
ctgctcaacttgcaaa

SEQ ID NO: 6173087 - DNA, 21 bp, Homo sapiens
ctgctcaaggaccaagagcaa

SEQ ID NO: 6173088 - DNA, 21 bp, Homo sapiens
ctgctcaagtctaccctgatc

SEQ ID NO: 6173089 - DNA, 15 bp, Homo sapiens
ctgctcaatacatct

SEQ ID NO: 6173090 - DNA, 22 bp, Homo sapiens
ctgctcaatgaaaccttcctct

SEQ ID NO: 6173091 - DNA, 22 bp, Homo sapiens
ctgctcaatgccattgtgcaga

SEQ ID NO: 6173092 - DNA, 16 bp, Homo sapiens
ctgctcacagggatgc

SEQ ID NO: 6173093 - DNA, 14 bp, Homo sapiens
ctgctcacattccc

SEQ ID NO: 6173094 - DNA, 19 bp, Homo sapiens
ctgctcacattccctctca

SEQ ID NO: 6173095 - DNA, 21 bp, Homo sapiens
ctgctcacattccctctcatc

SEQ ID NO: 6173096 - DNA, 17 bp, Homo sapiens
ctgctcaccacctgcct

SEQ ID NO: 6173097 - DNA, 21 bp, Homo sapiens
ctgctcaccctcctagcctgc

SEQ ID NO: 6173098 - DNA, 20 bp, Homo sapiens
ctgctcaccgcccatcaggg

SEQ ID NO: 6173099 - DNA, 19 bp, Homo sapiens
ctgctcacggaccccatgt

SEQ ID NO: 6173100 - DNA, 18 bp, Homo sapiens
ctgctcacgtcaaatgca

SEQ ID NO: 6173101 - DNA, 14 bp, Homo sapiens
ctgctcacgtctct

SEQ ID NO: 6173102 - DNA, 15 bp, Homo sapiens
ctgctcacgtctctg

SEQ ID NO: 6173103 - DNA, 18 bp, Homo sapiens
ctgctcacgtctctgccg

SEQ ID NO: 6173104 - DNA, 19 bp, Homo sapiens
ctgctcacgtctctgccgc

SEQ ID NO: 6173105 - DNA, 16 bp, Homo sapiens
ctgctcacgtctgtga

SEQ ID NO: 6173106 - DNA, 17 bp, Homo sapiens
ctgctcacgtctgtgag

SEQ ID NO: 6173107 - DNA, 18 bp, Homo sapiens
ctgctcacgtctgtgagt

SEQ ID NO: 6173108 - DNA, 23 bp, Homo sapiens
ctgctcactcccgctgagcccac

SEQ ID NO: 6173109 - DNA, 14 bp, Homo sapiens
ctgctcactgtcca

SEQ ID NO: 6173110 - DNA, 20 bp, Homo sapiens
ctgctcacttaaacaatgtc

SEQ ID NO: 6173111 - DNA, 18 bp, Homo sapiens
ctgctcagaacttgctgc

SEQ ID NO: 6173112 - DNA, 14 bp, Homo sapiens
ctgctcagaattca

SEQ ID NO: 6173113 - DNA, 16 bp, Homo sapiens
ctgctcagagccaagg

SEQ ID NO: 6173114 - DNA, 23 bp, Homo sapiens
ctgctcagagccaagggggcaga

SEQ ID NO: 6173115 - DNA, 18 bp, Homo sapiens
ctgctcagagctttaaaa

SEQ ID NO: 6173116 - DNA, 19 bp, Homo sapiens
ctgctcagaggccttgctg

SEQ ID NO: 6173117 - DNA, 20 bp, Homo sapiens
ctgctcagaggccttgctgt

SEQ ID NO: 6173118 - DNA, 16 bp, Homo sapiens
ctgctcagaggggccc

SEQ ID NO: 6173119 - DNA, 23 bp, Homo sapiens
ctgctcagatcccacttttgcca

SEQ ID NO: 6173120 - DNA, 14 bp, Homo sapiens
ctgctcagatgctg

SEQ ID NO: 6173121 - DNA, 23 bp, Homo sapiens
ctgctcagatgctggtcatcctg

SEQ ID NO: 6173122 - DNA, 22 bp, Homo sapiens
ctgctcagattccccccatctc

SEQ ID NO: 6173123 - DNA, 22 bp, Homo sapiens
ctgctcagcaattcagacccct

SEQ ID NO: 6173124 - DNA, 16 bp, Homo sapiens
ctgctcagcagccagt

SEQ ID NO: 6173125 - DNA, 20 bp, Homo sapiens
ctgctcagcagccagtctca

SEQ ID NO: 6173126 - DNA, 16 bp, Homo sapiens
ctgctcagcaggccct

SEQ ID NO: 6173127 - DNA, 16 bp, Homo sapiens
ctgctcagccaagctt

SEQ ID NO: 6173128 - DNA, 13 bp, Homo sapiens
ctgctcagcccat

SEQ ID NO: 6173129 - DNA, 14 bp, Homo sapiens
ctgctcagcccatc

SEQ ID NO: 6173130 - DNA, 21 bp, Homo sapiens
ctgctcagccctgcaccatgc

SEQ ID NO: 6173131 - DNA, 18 bp, Homo sapiens
ctgctcagcctcatcctg

SEQ ID NO: 6173132 - DNA, 21 bp, Homo sapiens
ctgctcagcctcatcctgaga

SEQ ID NO: 6173133 - DNA, 13 bp, Homo sapiens
ctgctcagctctg

SEQ ID NO: 6173134 - DNA, 23 bp, Homo sapiens
ctgctcagctctggtccaggccc

SEQ ID NO: 6173135 - DNA, 22 bp, Homo sapiens
ctgctcagctgcgcccccttct

SEQ ID NO: 6173136 - DNA, 15 bp, Homo sapiens
ctgctcagcttctcc

SEQ ID NO: 6173137 - DNA, 18 bp, Homo sapiens
ctgctcagcttctcctgt

SEQ ID NO: 6173138 - DNA, 21 bp, Homo sapiens
ctgctcaggaaaccacaacct

SEQ ID NO: 6173139 - DNA, 15 bp, Homo sapiens
ctgctcaggaattga

SEQ ID NO: 6173140 - DNA, 17 bp, Homo sapiens
ctgctcaggcccatgct

SEQ ID NO: 6173141 - DNA, 14 bp, Homo sapiens
ctgctcaggcctca

SEQ ID NO: 6173142 - DNA, 24 bp, Homo sapiens
ctgctcaggcctcacctcccaggg

SEQ ID NO: 6173143 - DNA, 21 bp, Homo sapiens
ctgctcaggcctcacctggct

SEQ ID NO: 6173144 - DNA, 23 bp, Homo sapiens
ctgctcaggcctcacctggcttc

SEQ ID NO: 6173145 - DNA, 24 bp, Homo sapiens
ctgctcaggcctcacctggcttcc

SEQ ID NO: 6173146 - DNA, 14 bp, Homo sapiens
ctgctcaggcctcc

SEQ ID NO: 6173147 - DNA, 15 bp, Homo sapiens
ctgctcaggcctccc

SEQ ID NO: 6173148 - DNA, 20 bp, Homo sapiens
ctgctcaggcctccctagca

SEQ ID NO: 6173149 - DNA, 19 bp, Homo sapiens
ctgctcaggctccccaaga

SEQ ID NO: 6173150 - DNA, 18 bp, Homo sapiens
cttctaatttatattatc

SEQ ID NO: 6173151 - DNA, 18 bp, Homo sapiens
cttctaattttgtgctct

SEQ ID NO: 6173152 - DNA, 21 bp, Homo sapiens
cttctaattttgtgctctttc

SEQ ID NO: 6173153 - DNA, 23 bp, Homo sapiens
cttctaattttgtgctctttcct

SEQ ID NO: 6173154 - DNA, 14 bp, Homo sapiens
cttctacaaaagaa

SEQ ID NO: 6173155 - DNA, 19 bp, Homo sapiens
cttctacaaccagagcccc

SEQ ID NO: 6173156 - DNA, 14 bp, Homo sapiens
cttctaccccacct

SEQ ID NO: 6173157 - DNA, 13 bp, Homo sapiens
cttctaccctggg

SEQ ID NO: 6173158 - DNA, 14 bp, Homo sapiens
cttctaccctgggt

SEQ ID NO: 6173159 - DNA, 17 bp, Homo sapiens
cttctaccctgggtcct

SEQ ID NO: 6173160 - DNA, 21 bp, Homo sapiens
cttctaccctgggtcctcggg

SEQ ID NO: 6173161 - DNA, 17 bp, Homo sapiens
cttctacctacatattt

SEQ ID NO: 6173162 - DNA, 17 bp, Homo sapiens
cttctacctcttggctg

SEQ ID NO: 6173163 - DNA, 19 bp, Homo sapiens
cttctacctgccctcaagg

SEQ ID NO: 6173164 - DNA, 17 bp, Homo sapiens
cttctacggccatgaga

SEQ ID NO: 6173165 - DNA, 20 bp, Homo sapiens
cttctactcacttttcccac

SEQ ID NO: 6173166 - DNA, 23 bp, Homo sapiens
cttctactcacttttcccactcc

SEQ ID NO: 6173167 - DNA, 14 bp, Homo sapiens
cttctactccatgg

SEQ ID NO: 6173168 - DNA, 22 bp, Homo sapiens
cttctactccatggtgaactga

SEQ ID NO: 6173169 - DNA, 23 bp, Homo sapiens
cttctactccatggtgaactgaa

SEQ ID NO: 6173170 - DNA, 14 bp, Homo sapiens
cttctactcctgcc

SEQ ID NO: 6173171 - DNA, 15 bp, Homo sapiens
cttctactcctgcct

SEQ ID NO: 6173172 - DNA, 14 bp, Homo sapiens
cttctactgagcaa

SEQ ID NO: 6173173 - DNA, 14 bp, Homo sapiens
cttctactgccttg

SEQ ID NO: 6173174 - DNA, 15 bp, Homo sapiens
cttctactgccttga

SEQ ID NO: 6173175 - DNA, 17 bp, Homo sapiens
cttctactgccttgaaa

SEQ ID NO: 6173176 - DNA, 19 bp, Homo sapiens
cttctacttatcatgtaaa

SEQ ID NO: 6173177 - DNA, 17 bp, Homo sapiens
cttctacttgtaaaatg

SEQ ID NO: 6173178 - DNA, 21 bp, Homo sapiens
cttctacttttaagttgctga

SEQ ID NO: 6173179 - DNA, 18 bp, Homo sapiens
cttctagaaactctggct

SEQ ID NO: 6173180 - DNA, 19 bp, Homo sapiens
cttctagaaactctggctc

SEQ ID NO: 6173181 - DNA, 21 bp, Homo sapiens
cttctagaaactctggctcag

SEQ ID NO: 6173182 - DNA, 13 bp, Homo sapiens
cttctagaaccag

SEQ ID NO: 6173183 - DNA, 19 bp, Homo sapiens
cttctagaagataacattt

SEQ ID NO: 6173184 - DNA, 20 bp, Homo sapiens
cttctagacactccttgaaa

SEQ ID NO: 6173185 - DNA, 23 bp, Homo sapiens
cttctagagatgtgcctgtggga

SEQ ID NO: 6173186 - DNA, 14 bp, Homo sapiens
cttctagagcctcg

SEQ ID NO: 6173187 - DNA, 17 bp, Homo sapiens
cttctagaggctcatgg

SEQ ID NO: 6173188 - DNA, 20 bp, Homo sapiens
cttctagagtaattatctgt

SEQ ID NO: 6173189 - DNA, 14 bp, Homo sapiens
cttctagagttcag

SEQ ID NO: 6173190 - DNA, 13 bp, Homo sapiens
cttctagagtttt

SEQ ID NO: 6173191 - DNA, 16 bp, Homo sapiens
cttctagatctcagcc

SEQ ID NO: 6173192 - DNA, 18 bp, Homo sapiens
cttctagatctcagccat

SEQ ID NO: 6173193 - DNA, 19 bp, Homo sapiens
cttctagatggaccccagc

SEQ ID NO: 6173194 - DNA, 14 bp, Homo sapiens
cttctagctcggaa

SEQ ID NO: 6173195 - DNA, 13 bp, Homo sapiens
cttctaggaatgg

SEQ ID NO: 6173196 - DNA, 19 bp, Homo sapiens
cttctaggacgccacccag

SEQ ID NO: 6173197 - DNA, 23 bp, Homo sapiens
cttctaggagtcaactggctggc

SEQ ID NO: 6173198 - DNA, 22 bp, Homo sapiens
cttctaggatagctaactgtaa

SEQ ID NO: 6173199 - DNA, 20 bp, Homo sapiens
cttctaggcatctcctctcc

SEQ ID NO: 6173200 - DNA, 22 bp, Homo sapiens
cttctaggcatctcctctcccc

SEQ ID NO: 6173201 - DNA, 20 bp, Homo sapiens
cttctaggcccattgtcctc

SEQ ID NO: 6173202 - DNA, 19 bp, Homo sapiens
cttctaggggtagctggtg

SEQ ID NO: 6173203 - DNA, 21 bp, Homo sapiens
cttctaggggtagctggtggt

SEQ ID NO: 6173204 - DNA, 20 bp, Homo sapiens
cttctaggtggcaaggctgt

SEQ ID NO: 6173205 - DNA, 22 bp, Homo sapiens
cttctagtctggaactgctgct

SEQ ID NO: 6173206 - DNA, 20 bp, Homo sapiens
cttctagtgagcctgggcca

SEQ ID NO: 6173207 - DNA, 21 bp, Homo sapiens
cttctagtgagcctgggccag

SEQ ID NO: 6173208 - DNA, 13 bp, Homo sapiens
cttctagtgcttt

SEQ ID NO: 6173209 - DNA, 18 bp, Homo sapiens
cttctagttctgccagga

SEQ ID NO: 6173210 - DNA, 13 bp, Homo sapiens
cttctagtttaga

SEQ ID NO: 6173211 - DNA, 14 bp, Homo sapiens
cttctagtttccca

SEQ ID NO: 6173212 - DNA, 15 bp, Homo sapiens
cttctagtttcccac

SEQ ID NO: 6173213 - DNA, 12 bp, Homo sapiens
cttctataaaat

SEQ ID NO: 6173214 - DNA, 20 bp, Homo sapiens
cttctataatatttcctttt

SEQ ID NO: 6173215 - DNA, 19 bp, Homo sapiens
cttctataattttgccttt

SEQ ID NO: 6173216 - DNA, 16 bp, Homo sapiens
cttctatactttctca

SEQ ID NO: 6173217 - DNA, 14 bp, Homo sapiens
cttctatataattc

SEQ ID NO: 6173218 - DNA, 13 bp, Homo sapiens
cttctatatcatt

SEQ ID NO: 6173219 - DNA, 20 bp, Homo sapiens
cttctatcagactcagtttt

SEQ ID NO: 6173220 - DNA, 23 bp, Homo sapiens
cttctatcagactcagttttttg

SEQ ID NO: 6173221 - DNA, 22 bp, Homo sapiens
cttctatcattccaattctaaa

SEQ ID NO: 6173222 - DNA, 15 bp, Homo sapiens
cttctatcctgttaa

SEQ ID NO: 6173223 - DNA, 18 bp, Homo sapiens
cttctatgtaggaaaaaa

SEQ ID NO: 6173224 - DNA, 16 bp, Homo sapiens
cttctatgttcataaa

SEQ ID NO: 6173225 - DNA, 13 bp, Homo sapiens
cttctatgttggt

SEQ ID NO: 6173226 - DNA, 14 bp, Homo sapiens
cttctatgttggtt

SEQ ID NO: 6173227 - DNA, 22 bp, Homo sapiens
cttctatgttggtttcagtggc

SEQ ID NO: 6173228 - DNA, 13 bp, Homo sapiens
cttctattaaatg

SEQ ID NO: 6173229 - DNA, 23 bp, Homo sapiens
cttctattaatcaagagaaactt

SEQ ID NO: 6173230 - DNA, 21 bp, Homo sapiens
cttctattatccagagtcatg

SEQ ID NO: 6173231 - DNA, 20 bp, Homo sapiens
cttctattctagcctgcatt

SEQ ID NO: 6173232 - DNA, 21 bp, Homo sapiens
cttctattctagcctgcattg

SEQ ID NO: 6173233 - DNA, 14 bp, Homo sapiens
cttctattgccatg

SEQ ID NO: 6173234 - DNA, 13 bp, Homo sapiens
cttctattgcctc

SEQ ID NO: 6173235 - DNA, 19 bp, Homo sapiens
cttctattgcctctgagag

SEQ ID NO: 6173236 - DNA, 14 bp, Homo sapiens
cttctattggtctc

SEQ ID NO: 6173237 - DNA, 19 bp, Homo sapiens
cttctatttaaaaaataaa

SEQ ID NO: 6173238 - DNA, 21 bp, Homo sapiens
cttctatttaaaaaataaaaa

SEQ ID NO: 6173239 - DNA, 15 bp, Homo sapiens
cttctattttcccta

SEQ ID NO: 6173240 - DNA, 21 bp, Homo sapiens
cttctattttccttaatcaaa

SEQ ID NO: 6173241 - DNA, 14 bp, Homo sapiens
cttctattttgtaa

SEQ ID NO: 6173242 - DNA, 17 bp, Homo sapiens
cttctattttgtaaact

SEQ ID NO: 6173243 - DNA, 12 bp, Homo sapiens
cttctattttta

SEQ ID NO: 6173244 - DNA, 19 bp, Homo sapiens
cttctatttttatcatgaa

SEQ ID NO: 6173245 - DNA, 21 bp, Homo sapiens
cttctcaaaagattgttttat

SEQ ID NO: 6173246 - DNA, 19 bp, Homo sapiens
cttctcaaagagaattgta

SEQ ID NO: 6173247 - DNA, 17 bp, Homo sapiens
cttctcaaccttatcaa

SEQ ID NO: 6173248 - DNA, 14 bp, Homo sapiens
cttctcaagtgcct

SEQ ID NO: 6173249 - DNA, 13 bp, Homo sapiens
cttctcacagcac

SEQ ID NO: 6173250 - DNA, 18 bp, Homo sapiens
cttctcacagcacatgct

SEQ ID NO: 6173251 - DNA, 18 bp, Homo sapiens
cttctcacatccatctac

SEQ ID NO: 6173252 - DNA, 21 bp, Homo sapiens
cttctcacatggaatgagggt

SEQ ID NO: 6173253 - DNA, 13 bp, Homo sapiens
cttctcacattta

SEQ ID NO: 6173254 - DNA, 12 bp, Homo sapiens
cttctcaccagc

SEQ ID NO: 6173255 - DNA, 21 bp, Homo sapiens
cttctcaccagctgcaaagtg

SEQ ID NO: 6173256 - DNA, 16 bp, Homo sapiens
cttctcaccccaggat

SEQ ID NO: 6173257 - DNA, 20 bp, Homo sapiens
cttctcaccgtgcagagctg

SEQ ID NO: 6173258 - DNA, 16 bp, Homo sapiens
cttctcacctgctcca

SEQ ID NO: 6173259 - DNA, 15 bp, Homo sapiens
cttctcacctgtgag

SEQ ID NO: 6173260 - DNA, 13 bp, Homo sapiens
cttctcacgcttt

SEQ ID NO: 6173261 - DNA, 17 bp, Homo sapiens
cttctcacgctttgttt

SEQ ID NO: 6173262 - DNA, 19 bp, Homo sapiens
cttctcacgctttgtttac

SEQ ID NO: 6173263 - DNA, 13 bp, Homo sapiens
cttctcacggcga

SEQ ID NO: 6173264 - DNA, 16 bp, Homo sapiens
cttctcactcccttct

SEQ ID NO: 6173265 - DNA, 20 bp, Homo sapiens
cttctcactcccttctcctt

SEQ ID NO: 6173266 - DNA, 21 bp, Homo sapiens
cttctcactgccatgccagct

SEQ ID NO: 6173267 - DNA, 17 bp, Homo sapiens
cttctcactgccatgga

SEQ ID NO: 6173268 - DNA, 13 bp, Homo sapiens
cttctcacttttt

SEQ ID NO: 6173269 - DNA, 16 bp, Homo sapiens
cttctcagaaggcaaa

SEQ ID NO: 6173270 - DNA, 13 bp, Homo sapiens
cttctcagaatct

SEQ ID NO: 6173271 - DNA, 16 bp, Homo sapiens
cttctcagagtggtgg

SEQ ID NO: 6173272 - DNA, 20 bp, Homo sapiens
cttctcagccacaaaccctg

SEQ ID NO: 6173273 - DNA, 20 bp, Homo sapiens
cttctcagccccgggcctgc

SEQ ID NO: 6173274 - DNA, 12 bp, Homo sapiens
cttctcagccta

SEQ ID NO: 6173275 - DNA, 22 bp, Homo sapiens
cttctcagccttggttcctgat

SEQ ID NO: 6173276 - DNA, 15 bp, Homo sapiens
cttctcagctccact

SEQ ID NO: 6173277 - DNA, 17 bp, Homo sapiens
cttctcagctctccacc

SEQ ID NO: 6173278 - DNA, 18 bp, Homo sapiens
cttctcagctcttccatg

SEQ ID NO: 6173279 - DNA, 19 bp, Homo sapiens
cttctcaggaaatggcttt

SEQ ID NO: 6173280 - DNA, 19 bp, Homo sapiens
cttctcaggacacaggcct

SEQ ID NO: 6173281 - DNA, 15 bp, Homo sapiens
cttctcaggacgacg

SEQ ID NO: 6173282 - DNA, 24 bp, Homo sapiens
cttctcaggccccgggcttccctt

SEQ ID NO: 6173283 - DNA, 15 bp, Homo sapiens
cttctcaggctctgc

SEQ ID NO: 6173284 - DNA, 19 bp, Homo sapiens
cttctcaggctctgccctg

SEQ ID NO: 6173285 - DNA, 13 bp, Homo sapiens
cttctcaggctgg

SEQ ID NO: 6173286 - DNA, 17 bp, Homo sapiens
cttctcaggctggcatc

SEQ ID NO: 6173287 - DNA, 21 bp, Homo sapiens
cttctcagttgcagaaaatga

SEQ ID NO: 6173288 - DNA, 18 bp, Homo sapiens
cttctcagtttctgcctg

SEQ ID NO: 6173289 - DNA, 20 bp, Homo sapiens
cttctcagtttctgcctggg

SEQ ID NO: 6173290 - DNA, 21 bp, Homo sapiens
cttctcagtttctgcctgggc

SEQ ID NO: 6173291 - DNA, 22 bp, Homo sapiens
cttctcatagcattaactaatc

SEQ ID NO: 6173292 - DNA, 19 bp, Homo sapiens
cttctcataggtgtccagc

SEQ ID NO: 6173293 - DNA, 17 bp, Homo sapiens
cttctcatcacacacat

SEQ ID NO: 6173294 - DNA, 17 bp, Homo sapiens
cttctcatcctgcaggc

SEQ ID NO: 6173295 - DNA, 20 bp, Homo sapiens
cttctcatcttgacagagcc

SEQ ID NO: 6173296 - DNA, 23 bp, Homo sapiens
cttctcatcttgacagagcctgc

SEQ ID NO: 6173297 - DNA, 16 bp, Homo sapiens
cttctcatcttgtgaa

SEQ ID NO: 6173298 - DNA, 17 bp, Homo sapiens
cttctcatgctatttct

SEQ ID NO: 6173299 - DNA, 18 bp, Homo sapiens
cttctcattacccacccg

SEQ ID NO: 6173300 - DNA, 14 bp, Homo sapiens
cttctcattacttg

SEQ ID NO: 6173301 - DNA, 14 bp, Homo sapiens
cttctcattcccat

SEQ ID NO: 6173302 - DNA, 12 bp, Homo sapiens
cttctcattttt

SEQ ID NO: 6173303 - DNA, 21 bp, Homo sapiens
cttctccaaaaatctgcctgg

SEQ ID NO: 6173304 - DNA, 15 bp, Homo sapiens
cttctccaacactga

SEQ ID NO: 6173305 - DNA, 15 bp, Homo sapiens
cttctccaagcatca

SEQ ID NO: 6173306 - DNA, 18 bp, Homo sapiens
cttctccaattctgaaat

SEQ ID NO: 6173307 - DNA, 16 bp, Homo sapiens
cttctccaccagcccc

SEQ ID NO: 6173308 - DNA, 21 bp, Homo sapiens
cttctccaccctgctctccga

SEQ ID NO: 6173309 - DNA, 17 bp, Homo sapiens
cttctccaccgcacaga

SEQ ID NO: 6173310 - DNA, 20 bp, Homo sapiens
cttctccacgtctttcctgc

SEQ ID NO: 6173311 - DNA, 21 bp, Homo sapiens
cttctccacgtctttcctgct

SEQ ID NO: 6173312 - DNA, 14 bp, Homo sapiens
cttctccactggat

SEQ ID NO: 6173313 - DNA, 14 bp, Homo sapiens
cttctccacttact

SEQ ID NO: 6173314 - DNA, 13 bp, Homo sapiens
cttctccagattt

SEQ ID NO: 6173315 - DNA, 21 bp, Homo sapiens
cttctccagcaagcagtgccc

SEQ ID NO: 6173316 - DNA, 21 bp, Homo sapiens
cttctccagccaccaaggctg

SEQ ID NO: 6173317 - DNA, 11 bp, Homo sapiens
cttctccagga

SEQ ID NO: 6173318 - DNA, 12 bp, Homo sapiens
cttctccaggct

SEQ ID NO: 6173319 - DNA, 13 bp, Homo sapiens
cttctccaggctg

SEQ ID NO: 6173320 - DNA, 22 bp, Homo sapiens
cttctccagggaattcttacag

SEQ ID NO: 6173321 - DNA, 21 bp, Homo sapiens
cttctccagggacagaagcag

SEQ ID NO: 6173322 - DNA, 13 bp, Homo sapiens
cttctccagggtc

SEQ ID NO: 6173323 - DNA, 14 bp, Homo sapiens
cttctccatcctca

SEQ ID NO: 6173324 - DNA, 18 bp, Homo sapiens
cttctccatctctctggc

SEQ ID NO: 6173325 - DNA, 19 bp, Homo sapiens
cttctccatggccctgcca

SEQ ID NO: 6173326 - DNA, 17 bp, Homo sapiens
cttctccattccctagc

SEQ ID NO: 6173327 - DNA, 18 bp, Homo sapiens
cttctccattccctagca

SEQ ID NO: 6173328 - DNA, 20 bp, Homo sapiens
cttctccattccctagcagg

SEQ ID NO: 6173329 - DNA, 18 bp, Homo sapiens
ctgctcaggctgcagctg

SEQ ID NO: 6173330 - DNA, 19 bp, Homo sapiens
ctgctcaggctgcagctgg

SEQ ID NO: 6173331 - DNA, 20 bp, Homo sapiens
ctgctcaggtgctatgtccc

SEQ ID NO: 6173332 - DNA, 13 bp, Homo sapiens
ctgctcagtgatc

SEQ ID NO: 6173333 - DNA, 23 bp, Homo sapiens
ctgctcagtgcttgggctccacg

SEQ ID NO: 6173334 - DNA, 14 bp, Homo sapiens
ctgctcatactggt

SEQ ID NO: 6173335 - DNA, 21 bp, Homo sapiens
ctgctcataggacctgcatcc

SEQ ID NO: 6173336 - DNA, 20 bp, Homo sapiens
ctgctcatcacccagtcctg

SEQ ID NO: 6173337 - DNA, 17 bp, Homo sapiens
ctgctcatcattctctg

SEQ ID NO: 6173338 - DNA, 15 bp, Homo sapiens
ctgctcatccaaagt

SEQ ID NO: 6173339 - DNA, 18 bp, Homo sapiens
ctgctcattacagttctt

SEQ ID NO: 6173340 - DNA, 21 bp, Homo sapiens
ctgctcattacagttctttcc

SEQ ID NO: 6173341 - DNA, 23 bp, Homo sapiens
ctgctcattactacactggtgtg

SEQ ID NO: 6173342 - DNA, 17 bp, Homo sapiens
ctgctcattccacactg

SEQ ID NO: 6173343 - DNA, 14 bp, Homo sapiens
ctgctcattccgag

SEQ ID NO: 6173344 - DNA, 17 bp, Homo sapiens
ctgctcattttgacaaa

SEQ ID NO: 6173345 - DNA, 13 bp, Homo sapiens
ctgctccaaattt

SEQ ID NO: 6173346 - DNA, 17 bp, Homo sapiens
ctgctccaacagacacc

SEQ ID NO: 6173347 - DNA, 13 bp, Homo sapiens
ctgctccaactcc

SEQ ID NO: 6173348 - DNA, 15 bp, Homo sapiens
ctgctccaaggcagt

SEQ ID NO: 6173349 - DNA, 16 bp, Homo sapiens
ctgctccaagggacag

SEQ ID NO: 6173350 - DNA, 17 bp, Homo sapiens
ctgctccaagggacagg

SEQ ID NO: 6173351 - DNA, 14 bp, Homo sapiens
ctgctccaagtggt

SEQ ID NO: 6173352 - DNA, 19 bp, Homo sapiens
ctgctccaatgactgagca

SEQ ID NO: 6173353 - DNA, 19 bp, Homo sapiens
ctgctccacagccatccca

SEQ ID NO: 6173354 - DNA, 21 bp, Homo sapiens
ctgctccacagtgttggcgag

SEQ ID NO: 6173355 - DNA, 16 bp, Homo sapiens
ctgctccacccttggc

SEQ ID NO: 6173356 - DNA, 17 bp, Homo sapiens
ctgctccacccttggcc

SEQ ID NO: 6173357 - DNA, 20 bp, Homo sapiens
ctgctccacccttggcctgt

SEQ ID NO: 6173358 - DNA, 14 bp, Homo sapiens
ctgctccacgcgct

SEQ ID NO: 6173359 - DNA, 15 bp, Homo sapiens
ctgctccagaagatg

SEQ ID NO: 6173360 - DNA, 13 bp, Homo sapiens
ctgctccagacct

SEQ ID NO: 6173361 - DNA, 15 bp, Homo sapiens
ctgctccagacctga

SEQ ID NO: 6173362 - DNA, 22 bp, Homo sapiens
ctgctccagacctgatcctgga

SEQ ID NO: 6173363 - DNA, 11 bp, Homo sapiens
ctgctccagag

SEQ ID NO: 6173364 - DNA, 13 bp, Homo sapiens
ctgctccagatcc

SEQ ID NO: 6173365 - DNA, 14 bp, Homo sapiens
ctgctccagatcct

SEQ ID NO: 6173366 - DNA, 12 bp, Homo sapiens
ctgctccagccc

SEQ ID NO: 6173367 - DNA, 13 bp, Homo sapiens
ctgctccagcccc

SEQ ID NO: 6173368 - DNA, 23 bp, Homo sapiens
ctgctccagcccctttgcctctg

SEQ ID NO: 6173369 - DNA, 13 bp, Homo sapiens
ctgctccagcctc

SEQ ID NO: 6173370 - DNA, 16 bp, Homo sapiens
ctgctccagcctctgc

SEQ ID NO: 6173371 - DNA, 15 bp, Homo sapiens
ctgctccaggcctgc

SEQ ID NO: 6173372 - DNA, 12 bp, Homo sapiens
ctgctccaggga

SEQ ID NO: 6173373 - DNA, 20 bp, Homo sapiens
ctgctccataccttttctct

SEQ ID NO: 6173374 - DNA, 15 bp, Homo sapiens
ctgctccatgactgg

SEQ ID NO: 6173375 - DNA, 15 bp, Homo sapiens
ctgctccatgagggt

SEQ ID NO: 6173376 - DNA, 15 bp, Homo sapiens
ctgctccatgcacag

SEQ ID NO: 6173377 - DNA, 17 bp, Homo sapiens
ctgctccatgcagatct

SEQ ID NO: 6173378 - DNA, 11 bp, Homo sapiens
ctgctccatgg

SEQ ID NO: 6173379 - DNA, 22 bp, Homo sapiens
ctgctccatggatgcatgccct

SEQ ID NO: 6173380 - DNA, 16 bp, Homo sapiens
ctgctccatgggcacc

SEQ ID NO: 6173381 - DNA, 23 bp, Homo sapiens
ctgctccatttataaccccagcc

SEQ ID NO: 6173382 - DNA, 22 bp, Homo sapiens
ctgctcccaaggggcctgagca

SEQ ID NO: 6173383 - DNA, 18 bp, Homo sapiens
ctgctcccaattcacctc

SEQ ID NO: 6173384 - DNA, 10 bp, Homo sapiens
ctgctcccac

SEQ ID NO: 6173385 - DNA, 20 bp, Homo sapiens
ctgctcccacacttgtgcca

SEQ ID NO: 6173386 - DNA, 17 bp, Homo sapiens
ctgctcccacaggggcc

SEQ ID NO: 6173387 - DNA, 14 bp, Homo sapiens
ctgctcccaccacc

SEQ ID NO: 6173388 - DNA, 15 bp, Homo sapiens
ctgctcccaccccag

SEQ ID NO: 6173389 - DNA, 17 bp, Homo sapiens
ctgctcccacctcctga

SEQ ID NO: 6173390 - DNA, 17 bp, Homo sapiens
ctgctcccacctggctc

SEQ ID NO: 6173391 - DNA, 20 bp, Homo sapiens
ctgctcccacgcctgcttct

SEQ ID NO: 6173392 - DNA, 11 bp, Homo sapiens
ctgctcccagc

SEQ ID NO: 6173393 - DNA, 12 bp, Homo sapiens
ctgctcccagcc

SEQ ID NO: 6173394 - DNA, 12 bp, Homo sapiens
ctgctcccagct

SEQ ID NO: 6173395 - DNA, 20 bp, Homo sapiens
ctgctcccagtcctgcctga

SEQ ID NO: 6173396 - DNA, 14 bp, Homo sapiens
ctgctcccagtggg

SEQ ID NO: 6173397 - DNA, 21 bp, Homo sapiens
ctgctcccatcctcacccaga

SEQ ID NO: 6173398 - DNA, 15 bp, Homo sapiens
ctgctcccatctgca

SEQ ID NO: 6173399 - DNA, 12 bp, Homo sapiens
ctgctcccccac

SEQ ID NO: 6173400 - DNA, 14 bp, Homo sapiens
ctgctcccccaccc

SEQ ID NO: 6173401 - DNA, 22 bp, Homo sapiens
ctgctcccccaccccctcccca

SEQ ID NO: 6173402 - DNA, 19 bp, Homo sapiens
ctgctcccctaaagccagg

SEQ ID NO: 6173403 - DNA, 19 bp, Homo sapiens
ctgctcccctaaagcctca

SEQ ID NO: 6173404 - DNA, 23 bp, Homo sapiens
ctgctcccctgagaccaccccca

SEQ ID NO: 6173405 - DNA, 13 bp, Homo sapiens
ctgctcccctgga

SEQ ID NO: 6173406 - DNA, 21 bp, Homo sapiens
ctgctcccggcccgcctgccc

SEQ ID NO: 6173407 - DNA, 14 bp, Homo sapiens
ctgctcccggtgtg

SEQ ID NO: 6173408 - DNA, 22 bp, Homo sapiens
ctgctccctaccccagggccct

SEQ ID NO: 6173409 - DNA, 13 bp, Homo sapiens
ctgctccctccag

SEQ ID NO: 6173410 - DNA, 17 bp, Homo sapiens
ctgctccctgaagccag

SEQ ID NO: 6173411 - DNA, 20 bp, Homo sapiens
ctgctccctgaagccagcct

SEQ ID NO: 6173412 - DNA, 15 bp, Homo sapiens
ctgctccctgcaagc

SEQ ID NO: 6173413 - DNA, 16 bp, Homo sapiens
ctgctccctgcaagct

SEQ ID NO: 6173414 - DNA, 13 bp, Homo sapiens
ctgctccctggca

SEQ ID NO: 6173415 - DNA, 12 bp, Homo sapiens
ctgctccctgtc

SEQ ID NO: 6173416 - DNA, 14 bp, Homo sapiens
ctgctccctgtctg

SEQ ID NO: 6173417 - DNA, 15 bp, Homo sapiens
ctgctccctgtctgt

SEQ ID NO: 6173418 - DNA, 17 bp, Homo sapiens
ctgctccctgtctgtgt

SEQ ID NO: 6173419 - DNA, 18 bp, Homo sapiens
ctgctccctgtctgtgtc

SEQ ID NO: 6173420 - DNA, 22 bp, Homo sapiens
ctgctcccttcgctctgctgga

SEQ ID NO: 6173421 - DNA, 12 bp, Homo sapiens
ctgctccgaggg

SEQ ID NO: 6173422 - DNA, 15 bp, Homo sapiens
ctgctccgctgcctg

SEQ ID NO: 6173423 - DNA, 19 bp, Homo sapiens
ctgctccgctgcctggaac

SEQ ID NO: 6173424 - DNA, 14 bp, Homo sapiens
ctgctccgctgctc

SEQ ID NO: 6173425 - DNA, 18 bp, Homo sapiens
ctgctccgctgctccttg

SEQ ID NO: 6173426 - DNA, 15 bp, Homo sapiens
ctgctccgtggactg

SEQ ID NO: 6173427 - DNA, 16 bp, Homo sapiens
ctgctccgtgtgtctc

SEQ ID NO: 6173428 - DNA, 22 bp, Homo sapiens
ctgctccgtgtgtctcatgcca

SEQ ID NO: 6173429 - DNA, 17 bp, Homo sapiens
ctgctcctacatccagc

SEQ ID NO: 6173430 - DNA, 16 bp, Homo sapiens
ctgctcctacctatca

SEQ ID NO: 6173431 - DNA, 23 bp, Homo sapiens
ctgctcctagcaccctggagagt

SEQ ID NO: 6173432 - DNA, 17 bp, Homo sapiens
ctgctcctagcccagca

SEQ ID NO: 6173433 - DNA, 13 bp, Homo sapiens
ctgctcctccagc

SEQ ID NO: 6173434 - DNA, 24 bp, Homo sapiens
ctgctcctccagggccacgtgcca

SEQ ID NO: 6173435 - DNA, 23 bp, Homo sapiens
ctgctcctccagtacaataaata

SEQ ID NO: 6173436 - DNA, 13 bp, Homo sapiens
ctgctcctcccaa

SEQ ID NO: 6173437 - DNA, 12 bp, Homo sapiens
ctgctcctccct

SEQ ID NO: 6173438 - DNA, 14 bp, Homo sapiens
ctgctcctccctcc

SEQ ID NO: 6173439 - DNA, 17 bp, Homo sapiens
ctgctcctccctctgac

SEQ ID NO: 6173440 - DNA, 16 bp, Homo sapiens
ctgctcctccctgccc

SEQ ID NO: 6173441 - DNA, 17 bp, Homo sapiens
ctgctcctccctgcccc

SEQ ID NO: 6173442 - DNA, 20 bp, Homo sapiens
ctgctcctccctgcccccca

SEQ ID NO: 6173443 - DNA, 14 bp, Homo sapiens
ctgctcctccctgg

SEQ ID NO: 6173444 - DNA, 18 bp, Homo sapiens
ctgctcctccctggctgc

SEQ ID NO: 6173445 - DNA, 19 bp, Homo sapiens
ctgctcctccctggctgcc

SEQ ID NO: 6173446 - DNA, 20 bp, Homo sapiens
ctgctcctccctggctgccc

SEQ ID NO: 6173447 - DNA, 21 bp, Homo sapiens
ctgctcctccctggctgccct

SEQ ID NO: 6173448 - DNA, 22 bp, Homo sapiens
ctgctcctccctggctgccctg

SEQ ID NO: 6173449 - DNA, 16 bp, Homo sapiens
ctgctcctcctggcct

SEQ ID NO: 6173450 - DNA, 12 bp, Homo sapiens
ctgctcctcgca

SEQ ID NO: 6173451 - DNA, 14 bp, Homo sapiens
ctgctcctcggcca

SEQ ID NO: 6173452 - DNA, 13 bp, Homo sapiens
ctgctcctctcca

SEQ ID NO: 6173453 - DNA, 15 bp, Homo sapiens
ctgctcctctccagg

SEQ ID NO: 6173454 - DNA, 16 bp, Homo sapiens
ctgctcctctccccag

SEQ ID NO: 6173455 - DNA, 23 bp, Homo sapiens
ctgctcctcttgttcctgaaatg

SEQ ID NO: 6173456 - DNA, 23 bp, Homo sapiens
ctgctcctgaatgaggcggagct

SEQ ID NO: 6173457 - DNA, 12 bp, Homo sapiens
ctgctcctgagc

SEQ ID NO: 6173458 - DNA, 15 bp, Homo sapiens
ctgctcctgagcccc

SEQ ID NO: 6173459 - DNA, 17 bp, Homo sapiens
ctgctcctgagccccca

SEQ ID NO: 6173460 - DNA, 18 bp, Homo sapiens
ctgctcctgagcccccag

SEQ ID NO: 6173461 - DNA, 14 bp, Homo sapiens
ctgctcctgcagca

SEQ ID NO: 6173462 - DNA, 18 bp, Homo sapiens
ctgctcctgcccacgtgc

SEQ ID NO: 6173463 - DNA, 15 bp, Homo sapiens
ctgctcctggagcct

SEQ ID NO: 6173464 - DNA, 14 bp, Homo sapiens
ctgctcctgggcat

SEQ ID NO: 6173465 - DNA, 22 bp, Homo sapiens
ctgctcctgtacttgtcctcag

SEQ ID NO: 6173466 - DNA, 15 bp, Homo sapiens
ctgctcctgtggcag

SEQ ID NO: 6173467 - DNA, 14 bp, Homo sapiens
ctgctcctgtggcg

SEQ ID NO: 6173468 - DNA, 20 bp, Homo sapiens
ctgctccttagctgccaagc

SEQ ID NO: 6173469 - DNA, 19 bp, Homo sapiens
ctgctccttcactgttccc

SEQ ID NO: 6173470 - DNA, 21 bp, Homo sapiens
ctgctccttcactgttccctc

SEQ ID NO: 6173471 - DNA, 13 bp, Homo sapiens
ctgctccttcagg

SEQ ID NO: 6173472 - DNA, 13 bp, Homo sapiens
ctgctccttccat

SEQ ID NO: 6173473 - DNA, 14 bp, Homo sapiens
ctgctccttcccca

SEQ ID NO: 6173474 - DNA, 14 bp, Homo sapiens
ctgctccttccctt

SEQ ID NO: 6173475 - DNA, 16 bp, Homo sapiens
ctgctccttcccttgc

SEQ ID NO: 6173476 - DNA, 15 bp, Homo sapiens
ctgctccttcctgtg

SEQ ID NO: 6173477 - DNA, 19 bp, Homo sapiens
ctgctccttggcaccccca

SEQ ID NO: 6173478 - DNA, 21 bp, Homo sapiens
ctgctccttggcctagtcaga

SEQ ID NO: 6173479 - DNA, 16 bp, Homo sapiens
ctgctcctttaccctc

SEQ ID NO: 6173480 - DNA, 20 bp, Homo sapiens
ctgctcctttaccctcttgg

SEQ ID NO: 6173481 - DNA, 19 bp, Homo sapiens
ctgctcctttctgcccagc

SEQ ID NO: 6173482 - DNA, 23 bp, Homo sapiens
ctgctccttttgtatcttccttt

SEQ ID NO: 6173483 - DNA, 14 bp, Homo sapiens
ctgctcgaagaaca

SEQ ID NO: 6173484 - DNA, 17 bp, Homo sapiens
ctgctcgcccaggaagg

SEQ ID NO: 6173485 - DNA, 18 bp, Homo sapiens
ctgctcgcccaggaaggc

SEQ ID NO: 6173486 - DNA, 23 bp, Homo sapiens
ctgctcgcccaggaaggcctagg

SEQ ID NO: 6173487 - DNA, 18 bp, Homo sapiens
ctgctcgccctcctttct

SEQ ID NO: 6173488 - DNA, 19 bp, Homo sapiens
ctgctcgccctcctttctg

SEQ ID NO: 6173489 - DNA, 19 bp, Homo sapiens
ctgctcgccctgtgccctc

SEQ ID NO: 6173490 - DNA, 23 bp, Homo sapiens
ctgctcgccctgtgccctctcac

SEQ ID NO: 6173491 - DNA, 15 bp, Homo sapiens
ctgctcgccttagca

SEQ ID NO: 6173492 - DNA, 16 bp, Homo sapiens
ctgctcgccttagcac

SEQ ID NO: 6173493 - DNA, 23 bp, Homo sapiens
ctgctcgcgaaggtcccacagcc

SEQ ID NO: 6173494 - DNA, 19 bp, Homo sapiens
ctgctcggcaccgccagcc

SEQ ID NO: 6173495 - DNA, 21 bp, Homo sapiens
ctgctcggcttcttggacctt

SEQ ID NO: 6173496 - DNA, 22 bp, Homo sapiens
ctgctcggcttcttggaccttg

SEQ ID NO: 6173497 - DNA, 12 bp, Homo sapiens
ctgctcgggaag

SEQ ID NO: 6173498 - DNA, 13 bp, Homo sapiens
ctgctcgggaagg

SEQ ID NO: 6173499 - DNA, 15 bp, Homo sapiens
ctgctcgggaaggcc

SEQ ID NO: 6173500 - DNA, 17 bp, Homo sapiens
ctgctcgggaaggcctg

SEQ ID NO: 6173501 - DNA, 13 bp, Homo sapiens
ctgctcgggccca

SEQ ID NO: 6173502 - DNA, 18 bp, Homo sapiens
ctgctcggggctgagctg

SEQ ID NO: 6173503 - DNA, 15 bp, Homo sapiens
ctgctcgtctatcac

SEQ ID NO: 6173504 - DNA, 19 bp, Homo sapiens
ctgctcgtggactgtgctg

SEQ ID NO: 6173505 - DNA, 14 bp, Homo sapiens
ctgctctaaataaa

SEQ ID NO: 6173506 - DNA, 20 bp, Homo sapiens
ctgctctaaataaagacgac

SEQ ID NO: 6173507 - DNA, 12 bp, Homo sapiens
ctgctctaacag

SEQ ID NO: 6173508 - DNA, 21 bp, Homo sapiens
ctgctctaagaagctgcaata

SEQ ID NO: 6173509 - DNA, 17 bp, Homo sapiens
ctgctctaagcacacgg

SEQ ID NO: 6173510 - DNA, 17 bp, Homo sapiens
cttctcccaacactctt

SEQ ID NO: 6173511 - DNA, 16 bp, Homo sapiens
cttctcccaactcagc

SEQ ID NO: 6173512 - DNA, 13 bp, Homo sapiens
cttctcccacact

SEQ ID NO: 6173513 - DNA, 14 bp, Homo sapiens
cttctcccacactg

SEQ ID NO: 6173514 - DNA, 16 bp, Homo sapiens
cttctcccacatgagg

SEQ ID NO: 6173515 - DNA, 17 bp, Homo sapiens
cttctcccacatgaggc

SEQ ID NO: 6173516 - DNA, 12 bp, Homo sapiens
cttctcccaccc

SEQ ID NO: 6173517 - DNA, 13 bp, Homo sapiens
cttctcccactct

SEQ ID NO: 6173518 - DNA, 17 bp, Homo sapiens
cttctcccactctccta

SEQ ID NO: 6173519 - DNA, 18 bp, Homo sapiens
cttctcccacttggccaa

SEQ ID NO: 6173520 - DNA, 20 bp, Homo sapiens
cttctcccagaatcccagcc

SEQ ID NO: 6173521 - DNA, 23 bp, Homo sapiens
cttctcccagagcacaagaaggc

SEQ ID NO: 6173522 - DNA, 15 bp, Homo sapiens
cttctcccagcacac

SEQ ID NO: 6173523 - DNA, 12 bp, Homo sapiens
cttctcccaggc

SEQ ID NO: 6173524 - DNA, 14 bp, Homo sapiens
cttctcccaggcaa

SEQ ID NO: 6173525 - DNA, 17 bp, Homo sapiens
cttctcccaggcaaggc

SEQ ID NO: 6173526 - DNA, 17 bp, Homo sapiens
cttctcccaggcctctg

SEQ ID NO: 6173527 - DNA, 19 bp, Homo sapiens
cttctcccaggcctctgcc

SEQ ID NO: 6173528 - DNA, 17 bp, Homo sapiens
cttctcccatctcttcc

SEQ ID NO: 6173529 - DNA, 20 bp, Homo sapiens
cttctcccatctcttccttg

SEQ ID NO: 6173530 - DNA, 13 bp, Homo sapiens
cttctcccatgag

SEQ ID NO: 6173531 - DNA, 16 bp, Homo sapiens
cttctcccatttcctg

SEQ ID NO: 6173532 - DNA, 22 bp, Homo sapiens
cttctcccatttcctgatctag

SEQ ID NO: 6173533 - DNA, 14 bp, Homo sapiens
cttctccccacagc

SEQ ID NO: 6173534 - DNA, 15 bp, Homo sapiens
cttctccccacagcc

SEQ ID NO: 6173535 - DNA, 16 bp, Homo sapiens
cttctccccacagcct

SEQ ID NO: 6173536 - DNA, 14 bp, Homo sapiens
cttctccccagaat

SEQ ID NO: 6173537 - DNA, 15 bp, Homo sapiens
cttctccccagccag

SEQ ID NO: 6173538 - DNA, 16 bp, Homo sapiens
cttctccccagccaga

SEQ ID NO: 6173539 - DNA, 22 bp, Homo sapiens
cttctccccagccagaggtgga

SEQ ID NO: 6173540 - DNA, 15 bp, Homo sapiens
cttctcccccacggt

SEQ ID NO: 6173541 - DNA, 20 bp, Homo sapiens
cttctccccccatcccaggg

SEQ ID NO: 6173542 - DNA, 20 bp, Homo sapiens
cttctcccccccggggctgg

SEQ ID NO: 6173543 - DNA, 22 bp, Homo sapiens
cttctcccccccggggctgggt

SEQ ID NO: 6173544 - DNA, 18 bp, Homo sapiens
cttctcccccgccctgcc

SEQ ID NO: 6173545 - DNA, 14 bp, Homo sapiens
cttctcccccttgt

SEQ ID NO: 6173546 - DNA, 16 bp, Homo sapiens
cttctcccccttgtct

SEQ ID NO: 6173547 - DNA, 21 bp, Homo sapiens
cttctccccgaggctgcccca

SEQ ID NO: 6173548 - DNA, 16 bp, Homo sapiens
cttctcccctccagac

SEQ ID NO: 6173549 - DNA, 17 bp, Homo sapiens
cttctcccctccagacc

SEQ ID NO: 6173550 - DNA, 20 bp, Homo sapiens
cttctcccctccagacccct

SEQ ID NO: 6173551 - DNA, 21 bp, Homo sapiens
cttctcccctccccgcctggc

SEQ ID NO: 6173552 - DNA, 18 bp, Homo sapiens
cttctcccctctcccagg

SEQ ID NO: 6173553 - DNA, 13 bp, Homo sapiens
cttctcccctgcc

SEQ ID NO: 6173554 - DNA, 14 bp, Homo sapiens
cttctccccttcca

SEQ ID NO: 6173555 - DNA, 15 bp, Homo sapiens
cttctccccttccat

SEQ ID NO: 6173556 - DNA, 15 bp, Homo sapiens
cttctccccttcctg

SEQ ID NO: 6173557 - DNA, 16 bp, Homo sapiens
cttctcccctttcaaa

SEQ ID NO: 6173558 - DNA, 18 bp, Homo sapiens
cttctcccgccattggcc

SEQ ID NO: 6173559 - DNA, 20 bp, Homo sapiens
cttctcccggacctggacta

SEQ ID NO: 6173560 - DNA, 15 bp, Homo sapiens
cttctcccggccctc

SEQ ID NO: 6173561 - DNA, 18 bp, Homo sapiens
cttctcccggccctcact

SEQ ID NO: 6173562 - DNA, 14 bp, Homo sapiens
cttctcccggggac

SEQ ID NO: 6173563 - DNA, 13 bp, Homo sapiens
cttctccctggct

SEQ ID NO: 6173564 - DNA, 12 bp, Homo sapiens
cttctccctggg

SEQ ID NO: 6173565 - DNA, 14 bp, Homo sapiens
cttctccctgggga

SEQ ID NO: 6173566 - DNA, 15 bp, Homo sapiens
cttctccctggggac

SEQ ID NO: 6173567 - DNA, 14 bp, Homo sapiens
cttctcccttcttg

SEQ ID NO: 6173568 - DNA, 17 bp, Homo sapiens
cttctcccttcttgggt

SEQ ID NO: 6173569 - DNA, 18 bp, Homo sapiens
cttctccctttagttctg

SEQ ID NO: 6173570 - DNA, 19 bp, Homo sapiens
cttctcctcccagcgtgtg

SEQ ID NO: 6173571 - DNA, 13 bp, Homo sapiens
cttctcctctgct

SEQ ID NO: 6173572 - DNA, 21 bp, Homo sapiens
cttctcctctgctccaacaga

SEQ ID NO: 6173573 - DNA, 15 bp, Homo sapiens
cttctcctcttgtaa

SEQ ID NO: 6173574 - DNA, 18 bp, Homo sapiens
cttctcctcttgtaaata

SEQ ID NO: 6173575 - DNA, 15 bp, Homo sapiens
cttctcctgaaatct

SEQ ID NO: 6173576 - DNA, 18 bp, Homo sapiens
cttctcctgaccagggca

SEQ ID NO: 6173577 - DNA, 11 bp, Homo sapiens
cttctcctgca

SEQ ID NO: 6173578 - DNA, 16 bp, Homo sapiens
cttctcctgcagcctg

SEQ ID NO: 6173579 - DNA, 19 bp, Homo sapiens
cttctcctgcagcctgaga

SEQ ID NO: 6173580 - DNA, 17 bp, Homo sapiens
cttctcctgcagtctgt

SEQ ID NO: 6173581 - DNA, 19 bp, Homo sapiens
cttctcctgcagtctgtgg

SEQ ID NO: 6173582 - DNA, 15 bp, Homo sapiens
cttctcctgcagtgg

SEQ ID NO: 6173583 - DNA, 15 bp, Homo sapiens
cttctcctgcctaca

SEQ ID NO: 6173584 - DNA, 21 bp, Homo sapiens
cttctcctgcgggggcgaggc

SEQ ID NO: 6173585 - DNA, 15 bp, Homo sapiens
cttctcctgttttat

SEQ ID NO: 6173586 - DNA, 17 bp, Homo sapiens
cttctcctgttttatat

SEQ ID NO: 6173587 - DNA, 22 bp, Homo sapiens
cttctccttcacctttgtcccc

SEQ ID NO: 6173588 - DNA, 18 bp, Homo sapiens
cttctccttccaactgct

SEQ ID NO: 6173589 - DNA, 16 bp, Homo sapiens
cttctccttccccagg

SEQ ID NO: 6173590 - DNA, 20 bp, Homo sapiens
cttctccttgataacagcta

SEQ ID NO: 6173591 - DNA, 20 bp, Homo sapiens
cttctccttgccttgcttct

SEQ ID NO: 6173592 - DNA, 23 bp, Homo sapiens
cttctccttggaggacagtggga

SEQ ID NO: 6173593 - DNA, 20 bp, Homo sapiens
cttctcctttcacaaccttc

SEQ ID NO: 6173594 - DNA, 22 bp, Homo sapiens
cttctcctttcacaaccttctg

SEQ ID NO: 6173595 - DNA, 15 bp, Homo sapiens
cttctcctttccttc

SEQ ID NO: 6173596 - DNA, 21 bp, Homo sapiens
cttctcctttccttcccaggc

SEQ ID NO: 6173597 - DNA, 14 bp, Homo sapiens
cttctcgacttcag

SEQ ID NO: 6173598 - DNA, 19 bp, Homo sapiens
cttctcgcaactgaaggaa

SEQ ID NO: 6173599 - DNA, 23 bp, Homo sapiens
cttctcgctgcgcagcctccagg

SEQ ID NO: 6173600 - DNA, 19 bp, Homo sapiens
cttctcggagctggcccag

SEQ ID NO: 6173601 - DNA, 16 bp, Homo sapiens
cttctcggaggccagg

SEQ ID NO: 6173602 - DNA, 13 bp, Homo sapiens
cttctcggccagc

SEQ ID NO: 6173603 - DNA, 13 bp, Homo sapiens
cttctcggctcag

SEQ ID NO: 6173604 - DNA, 16 bp, Homo sapiens
cttctcggctcaggct

SEQ ID NO: 6173605 - DNA, 17 bp, Homo sapiens
cttctcggctcaggctc

SEQ ID NO: 6173606 - DNA, 23 bp, Homo sapiens
cttctcggctcaggctctgctgg

SEQ ID NO: 6173607 - DNA, 23 bp, Homo sapiens
cttctcggcttggatcctgggct

SEQ ID NO: 6173608 - DNA, 19 bp, Homo sapiens
cttctcggggtccagtgca

SEQ ID NO: 6173609 - DNA, 20 bp, Homo sapiens
cttctcggggtccagtgcat

SEQ ID NO: 6173610 - DNA, 21 bp, Homo sapiens
cttctcgtcctcgtttgtgtt

SEQ ID NO: 6173611 - DNA, 15 bp, Homo sapiens
cttctcgtgtttgct

SEQ ID NO: 6173612 - DNA, 17 bp, Homo sapiens
cttctcgtgtttgctta

SEQ ID NO: 6173613 - DNA, 22 bp, Homo sapiens
cttctcgtgtttgcttaaaata

SEQ ID NO: 6173614 - DNA, 19 bp, Homo sapiens
cttctctaatagaaaagtc

SEQ ID NO: 6173615 - DNA, 23 bp, Homo sapiens
cttctctaattcttcctttgtaa

SEQ ID NO: 6173616 - DNA, 15 bp, Homo sapiens
cttctctacagactt

SEQ ID NO: 6173617 - DNA, 12 bp, Homo sapiens
cttctctaccca

SEQ ID NO: 6173618 - DNA, 18 bp, Homo sapiens
cttctctacccatctccc

SEQ ID NO: 6173619 - DNA, 20 bp, Homo sapiens
cttctctactcatgccagat

SEQ ID NO: 6173620 - DNA, 15 bp, Homo sapiens
cttctctagctggtg

SEQ ID NO: 6173621 - DNA, 13 bp, Homo sapiens
cttctctataaaa

SEQ ID NO: 6173622 - DNA, 18 bp, Homo sapiens
cttctctataaaaaatat

SEQ ID NO: 6173623 - DNA, 14 bp, Homo sapiens
cttctctatcctct

SEQ ID NO: 6173624 - DNA, 23 bp, Homo sapiens
cttctctatcctctctctctcta

SEQ ID NO: 6173625 - DNA, 15 bp, Homo sapiens
cttctctatgataat

SEQ ID NO: 6173626 - DNA, 17 bp, Homo sapiens
cttctctattcctgacc

SEQ ID NO: 6173627 - DNA, 13 bp, Homo sapiens
cttctctattgca

SEQ ID NO: 6173628 - DNA, 15 bp, Homo sapiens
cttctctcaatccct

SEQ ID NO: 6173629 - DNA, 12 bp, Homo sapiens
cttctctcagac

SEQ ID NO: 6173630 - DNA, 22 bp, Homo sapiens
cttctctcagaccgtcttcctc

SEQ ID NO: 6173631 - DNA, 23 bp, Homo sapiens
cttctctcagaccgtcttcctcc

SEQ ID NO: 6173632 - DNA, 18 bp, Homo sapiens
cttctctcagccagctgt

SEQ ID NO: 6173633 - DNA, 13 bp, Homo sapiens
cttctctcagctc

SEQ ID NO: 6173634 - DNA, 14 bp, Homo sapiens
cttctctcagctcc

SEQ ID NO: 6173635 - DNA, 15 bp, Homo sapiens
cttctctcagctccc

SEQ ID NO: 6173636 - DNA, 17 bp, Homo sapiens
cttctctcagctcccag

SEQ ID NO: 6173637 - DNA, 15 bp, Homo sapiens
cttctctccacttct

SEQ ID NO: 6173638 - DNA, 13 bp, Homo sapiens
cttctctccagcc

SEQ ID NO: 6173639 - DNA, 15 bp, Homo sapiens
cttctctccagcccc

SEQ ID NO: 6173640 - DNA, 16 bp, Homo sapiens
cttctctccagctgac

SEQ ID NO: 6173641 - DNA, 20 bp, Homo sapiens
cttctctccaggctgtttct

SEQ ID NO: 6173642 - DNA, 21 bp, Homo sapiens
cttctctcccacgtgcacagc

SEQ ID NO: 6173643 - DNA, 14 bp, Homo sapiens
cttctctccccagc

SEQ ID NO: 6173644 - DNA, 15 bp, Homo sapiens
cttctctccctgcca

SEQ ID NO: 6173645 - DNA, 22 bp, Homo sapiens
cttctctccgcgggtgggactc

SEQ ID NO: 6173646 - DNA, 16 bp, Homo sapiens
cttctctccttccctc

SEQ ID NO: 6173647 - DNA, 23 bp, Homo sapiens
cttctctctccagaaacagctgc

SEQ ID NO: 6173648 - DNA, 14 bp, Homo sapiens
cttctctctccagg

SEQ ID NO: 6173649 - DNA, 13 bp, Homo sapiens
cttctctctccct

SEQ ID NO: 6173650 - DNA, 21 bp, Homo sapiens
cttctctctctctcacacaca

SEQ ID NO: 6173651 - DNA, 21 bp, Homo sapiens
cttctctctctctctctcgct

SEQ ID NO: 6173652 - DNA, 12 bp, Homo sapiens
cttctctctctg

SEQ ID NO: 6173653 - DNA, 13 bp, Homo sapiens
cttctctctctgg

SEQ ID NO: 6173654 - DNA, 14 bp, Homo sapiens
cttctctctctggt

SEQ ID NO: 6173655 - DNA, 16 bp, Homo sapiens
cttctctctctggtca

SEQ ID NO: 6173656 - DNA, 13 bp, Homo sapiens
cttctctctgagc

SEQ ID NO: 6173657 - DNA, 13 bp, Homo sapiens
cttctctctgctc

SEQ ID NO: 6173658 - DNA, 15 bp, Homo sapiens
cttctctctggctca

SEQ ID NO: 6173659 - DNA, 16 bp, Homo sapiens
cttctctctggctcag

SEQ ID NO: 6173660 - DNA, 19 bp, Homo sapiens
cttctctctgttcccttcc

SEQ ID NO: 6173661 - DNA, 23 bp, Homo sapiens
cttctctctgttcccttcctcac

SEQ ID NO: 6173662 - DNA, 14 bp, Homo sapiens
cttctctcttcaat

SEQ ID NO: 6173663 - DNA, 20 bp, Homo sapiens
cttctctcttcaatctctgg

SEQ ID NO: 6173664 - DNA, 21 bp, Homo sapiens
cttctctcttcaatctctgga

SEQ ID NO: 6173665 - DNA, 13 bp, Homo sapiens
cttctctcttgat

SEQ ID NO: 6173666 - DNA, 19 bp, Homo sapiens
cttctctcttgattgattt

SEQ ID NO: 6173667 - DNA, 23 bp, Homo sapiens
cttctctgaacacaggcagcttt

SEQ ID NO: 6173668 - DNA, 17 bp, Homo sapiens
cttctctgaagggaggt

SEQ ID NO: 6173669 - DNA, 14 bp, Homo sapiens
cttctctgacttct

SEQ ID NO: 6173670 - DNA, 19 bp, Homo sapiens
cttctctgagtcagctgac

SEQ ID NO: 6173671 - DNA, 15 bp, Homo sapiens
cttctctgcaatgct

SEQ ID NO: 6173672 - DNA, 19 bp, Homo sapiens
cttctctgcaatgcttctg

SEQ ID NO: 6173673 - DNA, 22 bp, Homo sapiens
cttctctgcagtaaaacacatt

SEQ ID NO: 6173674 - DNA, 12 bp, Homo sapiens
cttctctgccca

SEQ ID NO: 6173675 - DNA, 13 bp, Homo sapiens
cttctctgcccac

SEQ ID NO: 6173676 - DNA, 21 bp, Homo sapiens
cttctctgcccattccccagc

SEQ ID NO: 6173677 - DNA, 22 bp, Homo sapiens
cttctctgcccattccccagcc

SEQ ID NO: 6173678 - DNA, 12 bp, Homo sapiens
cttctctgcctc

SEQ ID NO: 6173679 - DNA, 18 bp, Homo sapiens
cttctctgctagatttct

SEQ ID NO: 6173680 - DNA, 14 bp, Homo sapiens
cttctctgctgcct

SEQ ID NO: 6173681 - DNA, 23 bp, Homo sapiens
cttctctgctgcctctgtggaag

SEQ ID NO: 6173682 - DNA, 19 bp, Homo sapiens
cttctctggaaagggggga

SEQ ID NO: 6173683 - DNA, 20 bp, Homo sapiens
cttctctggagccaagtcca

SEQ ID NO: 6173684 - DNA, 22 bp, Homo sapiens
cttctctgggggcctctttctg

SEQ ID NO: 6173685 - DNA, 16 bp, Homo sapiens
cttctctgggtcccgg

SEQ ID NO: 6173686 - DNA, 21 bp, Homo sapiens
cttctctgggtctgattttct

SEQ ID NO: 6173687 - DNA, 15 bp, Homo sapiens
cttctctggtctcct

SEQ ID NO: 6173688 - DNA, 11 bp, Homo sapiens
cttctctgtaa

SEQ ID NO: 6173689 - DNA, 15 bp, Homo sapiens
cttctctgtctctgt

SEQ ID NO: 6173690 - DNA, 22 bp, Homo sapiens
ctgctctacccatgagcctgcc

SEQ ID NO: 6173691 - DNA, 23 bp, Homo sapiens
ctgctctagattcataaatacaa

SEQ ID NO: 6173692 - DNA, 14 bp, Homo sapiens
ctgctctagccagg

SEQ ID NO: 6173693 - DNA, 16 bp, Homo sapiens
ctgctctagccaggag

SEQ ID NO: 6173694 - DNA, 23 bp, Homo sapiens
ctgctctagccaggagtctgtgc

SEQ ID NO: 6173695 - DNA, 15 bp, Homo sapiens
ctgctctagctggca

SEQ ID NO: 6173696 - DNA, 18 bp, Homo sapiens
ctgctctagctggcagga

SEQ ID NO: 6173697 - DNA, 22 bp, Homo sapiens
ctgctctagctggcaggacaca

SEQ ID NO: 6173698 - DNA, 18 bp, Homo sapiens
ctgctctaggcccacaag

SEQ ID NO: 6173699 - DNA, 17 bp, Homo sapiens
ctgctctataaatagta

SEQ ID NO: 6173700 - DNA, 21 bp, Homo sapiens
ctgctctataaatagtattcc

SEQ ID NO: 6173701 - DNA, 15 bp, Homo sapiens
ctgctctatactgtg

SEQ ID NO: 6173702 - DNA, 13 bp, Homo sapiens
ctgctctatatta

SEQ ID NO: 6173703 - DNA, 17 bp, Homo sapiens
ctgctctatgccaggct

SEQ ID NO: 6173704 - DNA, 18 bp, Homo sapiens
ctgctctatgccaggctg

SEQ ID NO: 6173705 - DNA, 22 bp, Homo sapiens
ctgctctatgccaggctgtgct

SEQ ID NO: 6173706 - DNA, 21 bp, Homo sapiens
ctgctctattccaaaaaggtt

SEQ ID NO: 6173707 - DNA, 22 bp, Homo sapiens
ctgctctcaaaatgtgaactga

SEQ ID NO: 6173708 - DNA, 19 bp, Homo sapiens
ctgctctcagcctcccaca

SEQ ID NO: 6173709 - DNA, 16 bp, Homo sapiens
ctgctctcagcttgtg

SEQ ID NO: 6173710 - DNA, 17 bp, Homo sapiens
ctgctctcagcttgtgc

SEQ ID NO: 6173711 - DNA, 16 bp, Homo sapiens
ctgctctcatgcctgc

SEQ ID NO: 6173712 - DNA, 15 bp, Homo sapiens
ctgctctccatctct

SEQ ID NO: 6173713 - DNA, 16 bp, Homo sapiens
ctgctctcccactgca

SEQ ID NO: 6173714 - DNA, 15 bp, Homo sapiens
ctgctctcccaggtg

SEQ ID NO: 6173715 - DNA, 17 bp, Homo sapiens
ctgctctccccacccag

SEQ ID NO: 6173716 - DNA, 17 bp, Homo sapiens
ctgctctcccctcccag

SEQ ID NO: 6173717 - DNA, 16 bp, Homo sapiens
ctgctctcccttgtgg

SEQ ID NO: 6173718 - DNA, 19 bp, Homo sapiens
ctgctctccgcgcctaccc

SEQ ID NO: 6173719 - DNA, 15 bp, Homo sapiens
ctgctctcctcgggc

SEQ ID NO: 6173720 - DNA, 14 bp, Homo sapiens
ctgctctcctcttc

SEQ ID NO: 6173721 - DNA, 18 bp, Homo sapiens
ctgctctcctcttctact

SEQ ID NO: 6173722 - DNA, 20 bp, Homo sapiens
ctgctctcctcttgccactg

SEQ ID NO: 6173723 - DNA, 21 bp, Homo sapiens
ctgctctcctcttgccactgc

SEQ ID NO: 6173724 - DNA, 20 bp, Homo sapiens
ctgctctcctgacagccaca

SEQ ID NO: 6173725 - DNA, 12 bp, Homo sapiens
ctgctctccttc

SEQ ID NO: 6173726 - DNA, 15 bp, Homo sapiens
ctgctctccttcact

SEQ ID NO: 6173727 - DNA, 18 bp, Homo sapiens
ctgctctccttcactctg

SEQ ID NO: 6173728 - DNA, 15 bp, Homo sapiens
ctgctctccttcctg

SEQ ID NO: 6173729 - DNA, 18 bp, Homo sapiens
ctgctctccttgccctgg

SEQ ID NO: 6173730 - DNA, 22 bp, Homo sapiens
ctgctctccttgccctgggcca

SEQ ID NO: 6173731 - DNA, 22 bp, Homo sapiens
ctgctctctacccagcccatct

SEQ ID NO: 6173732 - DNA, 12 bp, Homo sapiens
ctgctctctgct

SEQ ID NO: 6173733 - DNA, 14 bp, Homo sapiens
ctgctctctgctca

SEQ ID NO: 6173734 - DNA, 16 bp, Homo sapiens
ctgctctgaacacgaa

SEQ ID NO: 6173735 - DNA, 22 bp, Homo sapiens
ctgctctgaattagtccttgct

SEQ ID NO: 6173736 - DNA, 11 bp, Homo sapiens
ctgctctgacg

SEQ ID NO: 6173737 - DNA, 13 bp, Homo sapiens
ctgctctgagaat

SEQ ID NO: 6173738 - DNA, 20 bp, Homo sapiens
ctgctctgaggcttccagag

SEQ ID NO: 6173739 - DNA, 21 bp, Homo sapiens
ctgctctgaggcttccagaga

SEQ ID NO: 6173740 - DNA, 12 bp, Homo sapiens
ctgctctgatga

SEQ ID NO: 6173741 - DNA, 17 bp, Homo sapiens
ctgctctgcaagcccac

SEQ ID NO: 6173742 - DNA, 21 bp, Homo sapiens
ctgctctgcacggtctgcggc

SEQ ID NO: 6173743 - DNA, 17 bp, Homo sapiens
ctgctctgcagcccaca

SEQ ID NO: 6173744 - DNA, 21 bp, Homo sapiens
ctgctctgcagcccacagagg

SEQ ID NO: 6173745 - DNA, 24 bp, Homo sapiens
ctgctctgcagcccacagaggaca

SEQ ID NO: 6173746 - DNA, 13 bp, Homo sapiens
ctgctctgccact

SEQ ID NO: 6173747 - DNA, 19 bp, Homo sapiens
ctgctctgccatcttcagg

SEQ ID NO: 6173748 - DNA, 11 bp, Homo sapiens
ctgctctgccc

SEQ ID NO: 6173749 - DNA, 13 bp, Homo sapiens
ctgctctgcccag

SEQ ID NO: 6173750 - DNA, 17 bp, Homo sapiens
ctgctctgcccagagct

SEQ ID NO: 6173751 - DNA, 21 bp, Homo sapiens
ctgctctgcccagagctgggt

SEQ ID NO: 6173752 - DNA, 23 bp, Homo sapiens
ctgctctgcccagagctgggtga

SEQ ID NO: 6173753 - DNA, 17 bp, Homo sapiens
ctgctctgcccatgcct

SEQ ID NO: 6173754 - DNA, 18 bp, Homo sapiens
ctgctctgcccatgccta

SEQ ID NO: 6173755 - DNA, 15 bp, Homo sapiens
ctgctctgccccagc

SEQ ID NO: 6173756 - DNA, 17 bp, Homo sapiens
ctgctctgccccagctt

SEQ ID NO: 6173757 - DNA, 13 bp, Homo sapiens
ctgctctgcccct

SEQ ID NO: 6173758 - DNA, 23 bp, Homo sapiens
ctgctctgccccttgggcatcca

SEQ ID NO: 6173759 - DNA, 22 bp, Homo sapiens
ctgctctgcccttgttccctag

SEQ ID NO: 6173760 - DNA, 16 bp, Homo sapiens
ctgctctgcctggagt

SEQ ID NO: 6173761 - DNA, 20 bp, Homo sapiens
ctgctctgcgtgtcacctgt

SEQ ID NO: 6173762 - DNA, 21 bp, Homo sapiens
ctgctctgcgtgtcacctgtg

SEQ ID NO: 6173763 - DNA, 22 bp, Homo sapiens
ctgctctgcgtgtcacctgtgc

SEQ ID NO: 6173764 - DNA, 11 bp, Homo sapiens
ctgctctgctg

SEQ ID NO: 6173765 - DNA, 15 bp, Homo sapiens
ctgctctgcttcctc

SEQ ID NO: 6173766 - DNA, 13 bp, Homo sapiens
ctgctctggaaaa

SEQ ID NO: 6173767 - DNA, 18 bp, Homo sapiens
ctgctctggaatttgcaa

SEQ ID NO: 6173768 - DNA, 14 bp, Homo sapiens
ctgctctgggaagg

SEQ ID NO: 6173769 - DNA, 15 bp, Homo sapiens
ctgctctggtgcacg

SEQ ID NO: 6173770 - DNA, 14 bp, Homo sapiens
ctgctctgtagcca

SEQ ID NO: 6173771 - DNA, 15 bp, Homo sapiens
ctgctctgtcttggt

SEQ ID NO: 6173772 - DNA, 16 bp, Homo sapiens
ctgctctgtcttggtc

SEQ ID NO: 6173773 - DNA, 18 bp, Homo sapiens
ctgctctgtcttggtcct

SEQ ID NO: 6173774 - DNA, 16 bp, Homo sapiens
ctgctctgtgcctggg

SEQ ID NO: 6173775 - DNA, 18 bp, Homo sapiens
ctgctctgtgcctgggat

SEQ ID NO: 6173776 - DNA, 20 bp, Homo sapiens
ctgctcttacttcccccacc

SEQ ID NO: 6173777 - DNA, 21 bp, Homo sapiens
ctgctcttacttcccccaccc

SEQ ID NO: 6173778 - DNA, 17 bp, Homo sapiens
ctgctcttagtgcccgc

SEQ ID NO: 6173779 - DNA, 18 bp, Homo sapiens
ctgctcttagtgcccgcc

SEQ ID NO: 6173780 - DNA, 15 bp, Homo sapiens
ctgctcttcatccca

SEQ ID NO: 6173781 - DNA, 14 bp, Homo sapiens
ctgctcttcccagt

SEQ ID NO: 6173782 - DNA, 19 bp, Homo sapiens
ctgctcttctctccccagc

SEQ ID NO: 6173783 - DNA, 22 bp, Homo sapiens
ctgctcttctctccccagcccc

SEQ ID NO: 6173784 - DNA, 18 bp, Homo sapiens
ctgctcttctgtgcccag

SEQ ID NO: 6173785 - DNA, 14 bp, Homo sapiens
ctgctcttgaacat

SEQ ID NO: 6173786 - DNA, 15 bp, Homo sapiens
ctgctcttgaacatt

SEQ ID NO: 6173787 - DNA, 17 bp, Homo sapiens
ctgctcttgaacattgt

SEQ ID NO: 6173788 - DNA, 19 bp, Homo sapiens
ctgctcttgaactcctgac

SEQ ID NO: 6173789 - DNA, 18 bp, Homo sapiens
ctgctcttgtttcactcc

SEQ ID NO: 6173790 - DNA, 21 bp, Homo sapiens
ctgctctttattgcagaatgt

SEQ ID NO: 6173791 - DNA, 12 bp, Homo sapiens
ctgctctttctc

SEQ ID NO: 6173792 - DNA, 15 bp, Homo sapiens
ctgctctttctctgc

SEQ ID NO: 6173793 - DNA, 19 bp, Homo sapiens
ctgctctttctctgccagt

SEQ ID NO: 6173794 - DNA, 22 bp, Homo sapiens
ctgctctttctctgccagtgac

SEQ ID NO: 6173795 - DNA, 14 bp, Homo sapiens
ctgctctttgaact

SEQ ID NO: 6173796 - DNA, 14 bp, Homo sapiens
ctgctcttttacta

SEQ ID NO: 6173797 - DNA, 19 bp, Homo sapiens
ctgctcttttatactgtac

SEQ ID NO: 6173798 - DNA, 21 bp, Homo sapiens
ctgctcttttgtgatgaacat

SEQ ID NO: 6173799 - DNA, 16 bp, Homo sapiens
ctgctgaaaaagaaaa

SEQ ID NO: 6173800 - DNA, 17 bp, Homo sapiens
ctgctgaaaaagaaaaa

SEQ ID NO: 6173801 - DNA, 21 bp, Homo sapiens
ctgctgaaaaccatctggcct

SEQ ID NO: 6173802 - DNA, 14 bp, Homo sapiens
ctgctgaaaataac

SEQ ID NO: 6173803 - DNA, 13 bp, Homo sapiens
ctgctgaaacaac

SEQ ID NO: 6173804 - DNA, 17 bp, Homo sapiens
ctgctgaaacacctccc

SEQ ID NO: 6173805 - DNA, 19 bp, Homo sapiens
ctgctgaaacacctcccag

SEQ ID NO: 6173806 - DNA, 12 bp, Homo sapiens
ctgctgaaactg

SEQ ID NO: 6173807 - DNA, 18 bp, Homo sapiens
ctgctgaaactgcccact

SEQ ID NO: 6173808 - DNA, 17 bp, Homo sapiens
ctgctgaaagtcctgct

SEQ ID NO: 6173809 - DNA, 19 bp, Homo sapiens
ctgctgaaagtcctgcttt

SEQ ID NO: 6173810 - DNA, 21 bp, Homo sapiens
ctgctgaacacagtgtctgtt

SEQ ID NO: 6173811 - DNA, 17 bp, Homo sapiens
ctgctgaagctgctgca

SEQ ID NO: 6173812 - DNA, 18 bp, Homo sapiens
ctgctgaaggaataaatt

SEQ ID NO: 6173813 - DNA, 12 bp, Homo sapiens
ctgctgaaggct

SEQ ID NO: 6173814 - DNA, 22 bp, Homo sapiens
ctgctgaatgatttccaaagag

SEQ ID NO: 6173815 - DNA, 23 bp, Homo sapiens
ctgctgaatgatttccaaagaga

SEQ ID NO: 6173816 - DNA, 22 bp, Homo sapiens
ctgctgaatgcctcgctccctt

SEQ ID NO: 6173817 - DNA, 23 bp, Homo sapiens
ctgctgaatgcctcgctcccttc

SEQ ID NO: 6173818 - DNA, 15 bp, Homo sapiens
ctgctgaatgtaaaa

SEQ ID NO: 6173819 - DNA, 20 bp, Homo sapiens
ctgctgacagacacaggccc

SEQ ID NO: 6173820 - DNA, 23 bp, Homo sapiens
ctgctgacagacacaggcccggc

SEQ ID NO: 6173821 - DNA, 20 bp, Homo sapiens
ctgctgacagacactaactt

SEQ ID NO: 6173822 - DNA, 19 bp, Homo sapiens
ctgctgacagatgttccat

SEQ ID NO: 6173823 - DNA, 23 bp, Homo sapiens
ctgctgacaggatgtggcactgc

SEQ ID NO: 6173824 - DNA, 15 bp, Homo sapiens
ctgctgacagtgttg

SEQ ID NO: 6173825 - DNA, 22 bp, Homo sapiens
ctgctgacatagtggatggaca

SEQ ID NO: 6173826 - DNA, 11 bp, Homo sapiens
ctgctgaccaa

SEQ ID NO: 6173827 - DNA, 23 bp, Homo sapiens
ctgctgaccaattgtgctgccat

SEQ ID NO: 6173828 - DNA, 20 bp, Homo sapiens
ctgctgaccataacagtgcc

SEQ ID NO: 6173829 - DNA, 23 bp, Homo sapiens
ctgctgaccataacagtgccagc

SEQ ID NO: 6173830 - DNA, 15 bp, Homo sapiens
ctgctgacccctgtg

SEQ ID NO: 6173831 - DNA, 16 bp, Homo sapiens
ctgctgacccctgtgt

SEQ ID NO: 6173832 - DNA, 17 bp, Homo sapiens
ctgctgacccctgtgtg

SEQ ID NO: 6173833 - DNA, 19 bp, Homo sapiens
ctgctgacctccacagctt

SEQ ID NO: 6173834 - DNA, 24 bp, Homo sapiens
ctgctgaccttggaggaatgacaa

SEQ ID NO: 6173835 - DNA, 13 bp, Homo sapiens
ctgctgactgttt

SEQ ID NO: 6173836 - DNA, 16 bp, Homo sapiens
ctgctgactgtttcat

SEQ ID NO: 6173837 - DNA, 22 bp, Homo sapiens
ctgctgactgtttcattcactg

SEQ ID NO: 6173838 - DNA, 16 bp, Homo sapiens
ctgctgagaacctggc

SEQ ID NO: 6173839 - DNA, 18 bp, Homo sapiens
ctgctgagaacctggcct

SEQ ID NO: 6173840 - DNA, 15 bp, Homo sapiens
ctgctgagactgagc

SEQ ID NO: 6173841 - DNA, 20 bp, Homo sapiens
ctgctgagagcccccacctt

SEQ ID NO: 6173842 - DNA, 22 bp, Homo sapiens
ctgctgagatgaggaggggagc

SEQ ID NO: 6173843 - DNA, 13 bp, Homo sapiens
ctgctgagcacat

SEQ ID NO: 6173844 - DNA, 15 bp, Homo sapiens
ctgctgagcagccca

SEQ ID NO: 6173845 - DNA, 17 bp, Homo sapiens
ctgctgagcagcccagc

SEQ ID NO: 6173846 - DNA, 19 bp, Homo sapiens
ctgctgagcagcccagcac

SEQ ID NO: 6173847 - DNA, 12 bp, Homo sapiens
ctgctgagccac

SEQ ID NO: 6173848 - DNA, 14 bp, Homo sapiens
ctgctgagccactc

SEQ ID NO: 6173849 - DNA, 17 bp, Homo sapiens
ctgctgagccactcgca

SEQ ID NO: 6173850 - DNA, 18 bp, Homo sapiens
ctgctgagccgcagagaa

SEQ ID NO: 6173851 - DNA, 22 bp, Homo sapiens
ctgctgagcctcacagcagtga

SEQ ID NO: 6173852 - DNA, 14 bp, Homo sapiens
ctgctgagctctga

SEQ ID NO: 6173853 - DNA, 19 bp, Homo sapiens
ctgctgagctctgagaggc

SEQ ID NO: 6173854 - DNA, 21 bp, Homo sapiens
ctgctgagctctgagaggccc

SEQ ID NO: 6173855 - DNA, 23 bp, Homo sapiens
ctgctgagctgcccctgctgctt

SEQ ID NO: 6173856 - DNA, 19 bp, Homo sapiens
ctgctgagctgggcccagc

SEQ ID NO: 6173857 - DNA, 20 bp, Homo sapiens
ctgctgagctgggcccagcc

SEQ ID NO: 6173858 - DNA, 16 bp, Homo sapiens
ctgctgagctgtgccc

SEQ ID NO: 6173859 - DNA, 22 bp, Homo sapiens
ctgctgaggagtctgaggactg

SEQ ID NO: 6173860 - DNA, 13 bp, Homo sapiens
ctgctgaggccag

SEQ ID NO: 6173861 - DNA, 18 bp, Homo sapiens
ctgctgaggccagaggaa

SEQ ID NO: 6173862 - DNA, 12 bp, Homo sapiens
ctgctgaggccc

SEQ ID NO: 6173863 - DNA, 14 bp, Homo sapiens
ctgctgaggcccag

SEQ ID NO: 6173864 - DNA, 19 bp, Homo sapiens
ctgctgaggcccagtgcat

SEQ ID NO: 6173865 - DNA, 22 bp, Homo sapiens
ctgctgaggcccagtgcatatg

SEQ ID NO: 6173866 - DNA, 12 bp, Homo sapiens
ctgctgaggcct

SEQ ID NO: 6173867 - DNA, 14 bp, Homo sapiens
ctgctgaggccttc

SEQ ID NO: 6173868 - DNA, 11 bp, Homo sapiens
cttctctgtga

SEQ ID NO: 6173869 - DNA, 22 bp, Homo sapiens
cttctctgtgaacgatttagaa

SEQ ID NO: 6173870 - DNA, 15 bp, Homo sapiens
cttctctgtgagaag

SEQ ID NO: 6173871 - DNA, 18 bp, Homo sapiens
cttctctgtgagaaggtt

SEQ ID NO: 6173872 - DNA, 14 bp, Homo sapiens
cttctctgtgtgca

SEQ ID NO: 6173873 - DNA, 12 bp, Homo sapiens
cttctctgtgtt

SEQ ID NO: 6173874 - DNA, 14 bp, Homo sapiens
cttctcttaattta

SEQ ID NO: 6173875 - DNA, 19 bp, Homo sapiens
cttctcttatctgccatgt

SEQ ID NO: 6173876 - DNA, 14 bp, Homo sapiens
cttctcttctgagc

SEQ ID NO: 6173877 - DNA, 18 bp, Homo sapiens
cttctcttgacagtctga

SEQ ID NO: 6173878 - DNA, 23 bp, Homo sapiens
cttctcttgacagtctgaagctc

SEQ ID NO: 6173879 - DNA, 17 bp, Homo sapiens
cttctcttgctacctgt

SEQ ID NO: 6173880 - DNA, 13 bp, Homo sapiens
cttctcttgctct

SEQ ID NO: 6173881 - DNA, 13 bp, Homo sapiens
cttctcttgcttt

SEQ ID NO: 6173882 - DNA, 16 bp, Homo sapiens
cttctcttgctttcta

SEQ ID NO: 6173883 - DNA, 18 bp, Homo sapiens
cttctcttgggtgggaca

SEQ ID NO: 6173884 - DNA, 19 bp, Homo sapiens
cttctcttgggtgggacag

SEQ ID NO: 6173885 - DNA, 21 bp, Homo sapiens
cttctctttaactcaggactc

SEQ ID NO: 6173886 - DNA, 17 bp, Homo sapiens
cttctctttcaatgtgt

SEQ ID NO: 6173887 - DNA, 22 bp, Homo sapiens
cttctctttcttattttgtaat

SEQ ID NO: 6173888 - DNA, 13 bp, Homo sapiens
cttctctttgcct

SEQ ID NO: 6173889 - DNA, 15 bp, Homo sapiens
cttctctttgcctca

SEQ ID NO: 6173890 - DNA, 18 bp, Homo sapiens
cttctctttggggctcct

SEQ ID NO: 6173891 - DNA, 17 bp, Homo sapiens
cttctcttttcccagag

SEQ ID NO: 6173892 - DNA, 18 bp, Homo sapiens
cttctctttttccagaat

SEQ ID NO: 6173893 - DNA, 21 bp, Homo sapiens
cttctctttttccagaatttg

SEQ ID NO: 6173894 - DNA, 21 bp, Homo sapiens
cttctgaaaacattcacttgt

SEQ ID NO: 6173895 - DNA, 17 bp, Homo sapiens
cttctgaactcaaactg

SEQ ID NO: 6173896 - DNA, 22 bp, Homo sapiens
cttctgaactcaaactgaggaa

SEQ ID NO: 6173897 - DNA, 16 bp, Homo sapiens
cttctgaactccatac

SEQ ID NO: 6173898 - DNA, 19 bp, Homo sapiens
cttctgaactccatacagc

SEQ ID NO: 6173899 - DNA, 18 bp, Homo sapiens
cttctgaactttggaagc

SEQ ID NO: 6173900 - DNA, 21 bp, Homo sapiens
cttctgaagactgagaacttt

SEQ ID NO: 6173901 - DNA, 21 bp, Homo sapiens
cttctgaagagaccactcaat

SEQ ID NO: 6173902 - DNA, 21 bp, Homo sapiens
cttctgaagatttgtccacct

SEQ ID NO: 6173903 - DNA, 14 bp, Homo sapiens
cttctgaagtaatt

SEQ ID NO: 6173904 - DNA, 17 bp, Homo sapiens
cttctgaagtctgagcc

SEQ ID NO: 6173905 - DNA, 22 bp, Homo sapiens
cttctgaataaagcaattagca

SEQ ID NO: 6173906 - DNA, 13 bp, Homo sapiens
cttctgaatgaag

SEQ ID NO: 6173907 - DNA, 15 bp, Homo sapiens
cttctgaatgaagcc

SEQ ID NO: 6173908 - DNA, 15 bp, Homo sapiens
cttctgaatgctgct

SEQ ID NO: 6173909 - DNA, 19 bp, Homo sapiens
cttctgaatgctgctactt

SEQ ID NO: 6173910 - DNA, 20 bp, Homo sapiens
cttctgaattattctggata

SEQ ID NO: 6173911 - DNA, 15 bp, Homo sapiens
cttctgaccacactt

SEQ ID NO: 6173912 - DNA, 19 bp, Homo sapiens
cttctgaccacacttcctg

SEQ ID NO: 6173913 - DNA, 21 bp, Homo sapiens
cttctgaccacagcatcattt

SEQ ID NO: 6173914 - DNA, 23 bp, Homo sapiens
cttctgacccatgctgccctgtg

SEQ ID NO: 6173915 - DNA, 14 bp, Homo sapiens
cttctgaccccact

SEQ ID NO: 6173916 - DNA, 15 bp, Homo sapiens
cttctgacctcagca

SEQ ID NO: 6173917 - DNA, 17 bp, Homo sapiens
cttctgacgcagcctga

SEQ ID NO: 6173918 - DNA, 21 bp, Homo sapiens
cttctgacgcagcctgagaat

SEQ ID NO: 6173919 - DNA, 14 bp, Homo sapiens
cttctgacggccct

SEQ ID NO: 6173920 - DNA, 15 bp, Homo sapiens
cttctgactacttgt

SEQ ID NO: 6173921 - DNA, 21 bp, Homo sapiens
cttctgactgccccctcctgt

SEQ ID NO: 6173922 - DNA, 21 bp, Homo sapiens
cttctgactgctgattctccc

SEQ ID NO: 6173923 - DNA, 13 bp, Homo sapiens
cttctgactgttt

SEQ ID NO: 6173924 - DNA, 16 bp, Homo sapiens
cttctgactgtttatt

SEQ ID NO: 6173925 - DNA, 18 bp, Homo sapiens
cttctgactgtttattta

SEQ ID NO: 6173926 - DNA, 19 bp, Homo sapiens
cttctgactgtttatttaa

SEQ ID NO: 6173927 - DNA, 21 bp, Homo sapiens
cttctgactgtttatttaagg

SEQ ID NO: 6173928 - DNA, 14 bp, Homo sapiens
cttctgactttact

SEQ ID NO: 6173929 - DNA, 22 bp, Homo sapiens
cttctgagacgtcatgaggaga

SEQ ID NO: 6173930 - DNA, 20 bp, Homo sapiens
cttctgagcagcgagcctgc

SEQ ID NO: 6173931 - DNA, 21 bp, Homo sapiens
cttctgagcagcgagcctgct

SEQ ID NO: 6173932 - DNA, 13 bp, Homo sapiens
cttctgagcaggg

SEQ ID NO: 6173933 - DNA, 19 bp, Homo sapiens
cttctgagcaggggcccct

SEQ ID NO: 6173934 - DNA, 22 bp, Homo sapiens
cttctgagcagttttccaggag

SEQ ID NO: 6173935 - DNA, 13 bp, Homo sapiens
cttctgagcccca

SEQ ID NO: 6173936 - DNA, 16 bp, Homo sapiens
cttctgagccccagcc

SEQ ID NO: 6173937 - DNA, 16 bp, Homo sapiens
cttctgagctatttca

SEQ ID NO: 6173938 - DNA, 17 bp, Homo sapiens
cttctgagctatttcat

SEQ ID NO: 6173939 - DNA, 20 bp, Homo sapiens
cttctgagctatttcatcta

SEQ ID NO: 6173940 - DNA, 12 bp, Homo sapiens
cttctgagctcc

SEQ ID NO: 6173941 - DNA, 13 bp, Homo sapiens
cttctgagctcca

SEQ ID NO: 6173942 - DNA, 20 bp, Homo sapiens
cttctgagctccacctctgg

SEQ ID NO: 6173943 - DNA, 19 bp, Homo sapiens
cttctgagctcctgtcccc

SEQ ID NO: 6173944 - DNA, 22 bp, Homo sapiens
cttctgagctcctgtcccctgc

SEQ ID NO: 6173945 - DNA, 23 bp, Homo sapiens
cttctgagctcctgtcccctgct

SEQ ID NO: 6173946 - DNA, 20 bp, Homo sapiens
cttctgaggacattccaaga

SEQ ID NO: 6173947 - DNA, 23 bp, Homo sapiens
cttctgaggaccgctgataagca

SEQ ID NO: 6173948 - DNA, 15 bp, Homo sapiens
cttctgagtgaatgt

SEQ ID NO: 6173949 - DNA, 23 bp, Homo sapiens
cttctgagtgaatgttaacatgc

SEQ ID NO: 6173950 - DNA, 23 bp, Homo sapiens
cttctgataagactggaaaatag

SEQ ID NO: 6173951 - DNA, 14 bp, Homo sapiens
cttctgatacttta

SEQ ID NO: 6173952 - DNA, 20 bp, Homo sapiens
cttctgatcactgaaataaa

SEQ ID NO: 6173953 - DNA, 23 bp, Homo sapiens
cttctgatcagtctgtctggatt

SEQ ID NO: 6173954 - DNA, 14 bp, Homo sapiens
cttctgatctgaga

SEQ ID NO: 6173955 - DNA, 20 bp, Homo sapiens
cttctgattatttgcagctg

SEQ ID NO: 6173956 - DNA, 14 bp, Homo sapiens
cttctgatttttct

SEQ ID NO: 6173957 - DNA, 18 bp, Homo sapiens
cttctgatttttctcttt

SEQ ID NO: 6173958 - DNA, 18 bp, Homo sapiens
cttctgcaaagtggcagg

SEQ ID NO: 6173959 - DNA, 19 bp, Homo sapiens
cttctgcaaagtggcaggg

SEQ ID NO: 6173960 - DNA, 16 bp, Homo sapiens
cttctgcaagcctcat

SEQ ID NO: 6173961 - DNA, 23 bp, Homo sapiens
cttctgcaagcctcatgccaacc

SEQ ID NO: 6173962 - DNA, 22 bp, Homo sapiens
cttctgcacataaactctttta

SEQ ID NO: 6173963 - DNA, 13 bp, Homo sapiens
cttctgcaccctc

SEQ ID NO: 6173964 - DNA, 16 bp, Homo sapiens
cttctgcaccttatct

SEQ ID NO: 6173965 - DNA, 15 bp, Homo sapiens
cttctgcagcaactc

SEQ ID NO: 6173966 - DNA, 16 bp, Homo sapiens
cttctgcagcaactcc

SEQ ID NO: 6173967 - DNA, 18 bp, Homo sapiens
cttctgcagcaactccca

SEQ ID NO: 6173968 - DNA, 19 bp, Homo sapiens
cttctgcagcaactcccac

SEQ ID NO: 6173969 - DNA, 20 bp, Homo sapiens
cttctgcagcaactcccacg

SEQ ID NO: 6173970 - DNA, 22 bp, Homo sapiens
cttctgcagcaactcccacgac

SEQ ID NO: 6173971 - DNA, 22 bp, Homo sapiens
cttctgcagcaggaactctgga

SEQ ID NO: 6173972 - DNA, 14 bp, Homo sapiens
cttctgcagcctcg

SEQ ID NO: 6173973 - DNA, 17 bp, Homo sapiens
cttctgcagcctcggcc

SEQ ID NO: 6173974 - DNA, 14 bp, Homo sapiens
cttctgcaggaatc

SEQ ID NO: 6173975 - DNA, 10 bp, Homo sapiens
cttctgcagt

SEQ ID NO: 6173976 - DNA, 17 bp, Homo sapiens
cttctgcagtcagactg

SEQ ID NO: 6173977 - DNA, 20 bp, Homo sapiens
cttctgcattactattaact

SEQ ID NO: 6173978 - DNA, 16 bp, Homo sapiens
cttctgccaccagccc

SEQ ID NO: 6173979 - DNA, 18 bp, Homo sapiens
cttctgccaccagcccct

SEQ ID NO: 6173980 - DNA, 20 bp, Homo sapiens
cttctgccacttctgcgggc

SEQ ID NO: 6173981 - DNA, 15 bp, Homo sapiens
cttctgccatattct

SEQ ID NO: 6173982 - DNA, 17 bp, Homo sapiens
cttctgccatattctgt

SEQ ID NO: 6173983 - DNA, 20 bp, Homo sapiens
cttctgccatttctgagatc

SEQ ID NO: 6173984 - DNA, 23 bp, Homo sapiens
cttctgcccaattggaggaaagc

SEQ ID NO: 6173985 - DNA, 17 bp, Homo sapiens
cttctgccccctgcaga

SEQ ID NO: 6173986 - DNA, 20 bp, Homo sapiens
cttctgccctaacctgacag

SEQ ID NO: 6173987 - DNA, 16 bp, Homo sapiens
cttctgccctcctgcc

SEQ ID NO: 6173988 - DNA, 21 bp, Homo sapiens
cttctgccctcctgccaaaag

SEQ ID NO: 6173989 - DNA, 17 bp, Homo sapiens
cttctgcccttcctcca

SEQ ID NO: 6173990 - DNA, 23 bp, Homo sapiens
cttctgccctttcctaggcccag

SEQ ID NO: 6173991 - DNA, 17 bp, Homo sapiens
cttctgccggccctggg

SEQ ID NO: 6173992 - DNA, 18 bp, Homo sapiens
cttctgccggccctgggg

SEQ ID NO: 6173993 - DNA, 12 bp, Homo sapiens
cttctgcctcag

SEQ ID NO: 6173994 - DNA, 14 bp, Homo sapiens
cttctgcctgagct

SEQ ID NO: 6173995 - DNA, 15 bp, Homo sapiens
cttctgcctgagctt

SEQ ID NO: 6173996 - DNA, 12 bp, Homo sapiens
cttctgcctgca

SEQ ID NO: 6173997 - DNA, 19 bp, Homo sapiens
cttctgcctgctgaccata

SEQ ID NO: 6173998 - DNA, 13 bp, Homo sapiens
cttctgcctggag

SEQ ID NO: 6173999 - DNA, 18 bp, Homo sapiens
cttctgcctgtggaactg

SEQ ID NO: 6174000 - DNA, 13 bp, Homo sapiens
cttctgccttttc

SEQ ID NO: 6174001 - DNA, 21 bp, Homo sapiens
cttctgcgggctccctcctct

SEQ ID NO: 6174002 - DNA, 14 bp, Homo sapiens
cttctgcggggctg

SEQ ID NO: 6174003 - DNA, 20 bp, Homo sapiens
cttctgcgtccaccaggcct

SEQ ID NO: 6174004 - DNA, 24 bp, Homo sapiens
cttctgcgtccaccaggcctcact

SEQ ID NO: 6174005 - DNA, 11 bp, Homo sapiens
cttctgctact

SEQ ID NO: 6174006 - DNA, 21 bp, Homo sapiens
cttctgctcacattccctctc

SEQ ID NO: 6174007 - DNA, 13 bp, Homo sapiens
cttctgctccacc

SEQ ID NO: 6174008 - DNA, 17 bp, Homo sapiens
cttctgctccacccttg

SEQ ID NO: 6174009 - DNA, 19 bp, Homo sapiens
cttctgctccacccttggc

SEQ ID NO: 6174010 - DNA, 15 bp, Homo sapiens
cttctgctccagccc

SEQ ID NO: 6174011 - DNA, 17 bp, Homo sapiens
cttctgctccagcccct

SEQ ID NO: 6174012 - DNA, 17 bp, Homo sapiens
cttctgctcccacccca

SEQ ID NO: 6174013 - DNA, 14 bp, Homo sapiens
cttctgctcttttc

SEQ ID NO: 6174014 - DNA, 16 bp, Homo sapiens
cttctgctcttttcct

SEQ ID NO: 6174015 - DNA, 17 bp, Homo sapiens
cttctgctcttttcctg

SEQ ID NO: 6174016 - DNA, 21 bp, Homo sapiens
cttctgctgcccaggccacag

SEQ ID NO: 6174017 - DNA, 14 bp, Homo sapiens
cttctgctgccctg

SEQ ID NO: 6174018 - DNA, 14 bp, Homo sapiens
cttctgctgggctg

SEQ ID NO: 6174019 - DNA, 19 bp, Homo sapiens
cttctgctgggctggggcc

SEQ ID NO: 6174020 - DNA, 21 bp, Homo sapiens
cttctgctggggcctgggaca

SEQ ID NO: 6174021 - DNA, 11 bp, Homo sapiens
cttctgctgtg

SEQ ID NO: 6174022 - DNA, 17 bp, Homo sapiens
cttctgctgttcttcac

SEQ ID NO: 6174023 - DNA, 21 bp, Homo sapiens
cttctgctgttcttcacttct

SEQ ID NO: 6174024 - DNA, 17 bp, Homo sapiens
cttctgcttcagcctcc

SEQ ID NO: 6174025 - DNA, 18 bp, Homo sapiens
cttctgcttccaacaggc

SEQ ID NO: 6174026 - DNA, 23 bp, Homo sapiens
cttctgcttgtcccaaatccgcc

SEQ ID NO: 6174027 - DNA, 13 bp, Homo sapiens
cttctgctttcta

SEQ ID NO: 6174028 - DNA, 11 bp, Homo sapiens
cttctgctttg

SEQ ID NO: 6174029 - DNA, 17 bp, Homo sapiens
cttctgcttttctgccc

SEQ ID NO: 6174030 - DNA, 23 bp, Homo sapiens
cttctgcttttctgccctggctg

SEQ ID NO: 6174031 - DNA, 17 bp, Homo sapiens
cttctggaaactaccag

SEQ ID NO: 6174032 - DNA, 15 bp, Homo sapiens
cttctggaaggctgg

SEQ ID NO: 6174033 - DNA, 16 bp, Homo sapiens
cttctggaaggctggc

SEQ ID NO: 6174034 - DNA, 17 bp, Homo sapiens
cttctggaaggctggct

SEQ ID NO: 6174035 - DNA, 19 bp, Homo sapiens
cttctggaaggctggctga

SEQ ID NO: 6174036 - DNA, 14 bp, Homo sapiens
cttctggaatattg

SEQ ID NO: 6174037 - DNA, 16 bp, Homo sapiens
cttctggaatttgttc

SEQ ID NO: 6174038 - DNA, 18 bp, Homo sapiens
cttctggaatttgttcaa

SEQ ID NO: 6174039 - DNA, 19 bp, Homo sapiens
cttctggacactgagaggg

SEQ ID NO: 6174040 - DNA, 15 bp, Homo sapiens
cttctggacaggctc

SEQ ID NO: 6174041 - DNA, 19 bp, Homo sapiens
cttctggagatggaagctt

SEQ ID NO: 6174042 - DNA, 23 bp, Homo sapiens
cttctggagatggatccttccat

SEQ ID NO: 6174043 - DNA, 17 bp, Homo sapiens
cttctggagcagaactt

SEQ ID NO: 6174044 - DNA, 13 bp, Homo sapiens
cttctggagccct

SEQ ID NO: 6174045 - DNA, 14 bp, Homo sapiens
cttctggagccctt

SEQ ID NO: 6174046 - DNA, 16 bp, Homo sapiens
ctgctgaggccttctc

SEQ ID NO: 6174047 - DNA, 21 bp, Homo sapiens
ctgctgagggaccttggagag

SEQ ID NO: 6174048 - DNA, 22 bp, Homo sapiens
ctgctgagggggctctttccct

SEQ ID NO: 6174049 - DNA, 23 bp, Homo sapiens
ctgctgagggggctctttccctc

SEQ ID NO: 6174050 - DNA, 11 bp, Homo sapiens
ctgctgagggt

SEQ ID NO: 6174051 - DNA, 16 bp, Homo sapiens
ctgctgagggtccaga

SEQ ID NO: 6174052 - DNA, 16 bp, Homo sapiens
ctgctgaggtcccggg

SEQ ID NO: 6174053 - DNA, 23 bp, Homo sapiens
ctgctgagtcccaggctgagcct

SEQ ID NO: 6174054 - DNA, 19 bp, Homo sapiens
ctgctgagtccgacctggc

SEQ ID NO: 6174055 - DNA, 18 bp, Homo sapiens
ctgctgagtcctttccag

SEQ ID NO: 6174056 - DNA, 14 bp, Homo sapiens
ctgctgagtgacag

SEQ ID NO: 6174057 - DNA, 15 bp, Homo sapiens
ctgctgagttggcct

SEQ ID NO: 6174058 - DNA, 22 bp, Homo sapiens
ctgctgagttggcctggccatt

SEQ ID NO: 6174059 - DNA, 23 bp, Homo sapiens
ctgctgatatcaacagcttccct

SEQ ID NO: 6174060 - DNA, 14 bp, Homo sapiens
ctgctgatattttc

SEQ ID NO: 6174061 - DNA, 12 bp, Homo sapiens
ctgctgatgcag

SEQ ID NO: 6174062 - DNA, 15 bp, Homo sapiens
ctgctgatgcgctgg

SEQ ID NO: 6174063 - DNA, 15 bp, Homo sapiens
ctgctgatgctcatg

SEQ ID NO: 6174064 - DNA, 16 bp, Homo sapiens
ctgctgatgctcatgg

SEQ ID NO: 6174065 - DNA, 17 bp, Homo sapiens
ctgctgatgctcatggt

SEQ ID NO: 6174066 - DNA, 20 bp, Homo sapiens
ctgctgatgctgaaataaac

SEQ ID NO: 6174067 - DNA, 17 bp, Homo sapiens
ctgctgatgtaggagct

SEQ ID NO: 6174068 - DNA, 18 bp, Homo sapiens
ctgctgatgtaggagctg

SEQ ID NO: 6174069 - DNA, 19 bp, Homo sapiens
ctgctgatgtaggagctgg

SEQ ID NO: 6174070 - DNA, 21 bp, Homo sapiens
ctgctgatgtaggagctggat

SEQ ID NO: 6174071 - DNA, 16 bp, Homo sapiens
ctgctgatttaaacac

SEQ ID NO: 6174072 - DNA, 13 bp, Homo sapiens
ctgctgatttcta

SEQ ID NO: 6174073 - DNA, 21 bp, Homo sapiens
ctgctgcaaaggacagtgggc

SEQ ID NO: 6174074 - DNA, 14 bp, Homo sapiens
ctgctgcaaagtgc

SEQ ID NO: 6174075 - DNA, 15 bp, Homo sapiens
ctgctgcaaagtgca

SEQ ID NO: 6174076 - DNA, 20 bp, Homo sapiens
ctgctgcaacaagctcatcc

SEQ ID NO: 6174077 - DNA, 16 bp, Homo sapiens
ctgctgcaaggccttt

SEQ ID NO: 6174078 - DNA, 21 bp, Homo sapiens
ctgctgcaaggcctttctgtg

SEQ ID NO: 6174079 - DNA, 22 bp, Homo sapiens
ctgctgcaaggtggcctctgcc

SEQ ID NO: 6174080 - DNA, 15 bp, Homo sapiens
ctgctgcacatagca

SEQ ID NO: 6174081 - DNA, 21 bp, Homo sapiens
ctgctgcacatagcagactag

SEQ ID NO: 6174082 - DNA, 17 bp, Homo sapiens
ctgctgcaccaacccag

SEQ ID NO: 6174083 - DNA, 20 bp, Homo sapiens
ctgctgcaccaacccagccg

SEQ ID NO: 6174084 - DNA, 16 bp, Homo sapiens
ctgctgcaccagagtg

SEQ ID NO: 6174085 - DNA, 18 bp, Homo sapiens
ctgctgcacccaactact

SEQ ID NO: 6174086 - DNA, 19 bp, Homo sapiens
ctgctgcacccaactactg

SEQ ID NO: 6174087 - DNA, 13 bp, Homo sapiens
ctgctgcaccctg

SEQ ID NO: 6174088 - DNA, 23 bp, Homo sapiens
ctgctgcaccctgcgcctccaga

SEQ ID NO: 6174089 - DNA, 16 bp, Homo sapiens
ctgctgcactaggact

SEQ ID NO: 6174090 - DNA, 18 bp, Homo sapiens
ctgctgcactgccctccg

SEQ ID NO: 6174091 - DNA, 21 bp, Homo sapiens
ctgctgcagagcagtaaggga

SEQ ID NO: 6174092 - DNA, 18 bp, Homo sapiens
ctgctgcagaggggcagg

SEQ ID NO: 6174093 - DNA, 14 bp, Homo sapiens
ctgctgcagccctg

SEQ ID NO: 6174094 - DNA, 22 bp, Homo sapiens
ctgctgcagctccctcctcagg

SEQ ID NO: 6174095 - DNA, 12 bp, Homo sapiens
ctgctgcagggg

SEQ ID NO: 6174096 - DNA, 17 bp, Homo sapiens
ctgctgcaggggctctg

SEQ ID NO: 6174097 - DNA, 19 bp, Homo sapiens
ctgctgcaggggctctgga

SEQ ID NO: 6174098 - DNA, 17 bp, Homo sapiens
ctgctgcagtcagcaca

SEQ ID NO: 6174099 - DNA, 19 bp, Homo sapiens
ctgctgcagtcagcacaga

SEQ ID NO: 6174100 - DNA, 21 bp, Homo sapiens
ctgctgcagtcagcacagaga

SEQ ID NO: 6174101 - DNA, 15 bp, Homo sapiens
ctgctgcagttgcca

SEQ ID NO: 6174102 - DNA, 13 bp, Homo sapiens
ctgctgcatactt

SEQ ID NO: 6174103 - DNA, 15 bp, Homo sapiens
ctgctgcatcccctt

SEQ ID NO: 6174104 - DNA, 12 bp, Homo sapiens
ctgctgcatggc

SEQ ID NO: 6174105 - DNA, 16 bp, Homo sapiens
ctgctgcatggcactg

SEQ ID NO: 6174106 - DNA, 14 bp, Homo sapiens
ctgctgccaactcc

SEQ ID NO: 6174107 - DNA, 18 bp, Homo sapiens
ctgctgccaactccatgt

SEQ ID NO: 6174108 - DNA, 19 bp, Homo sapiens
ctgctgccacagcaaggaa

SEQ ID NO: 6174109 - DNA, 23 bp, Homo sapiens
ctgctgccaccaaatctgtctag

SEQ ID NO: 6174110 - DNA, 20 bp, Homo sapiens
ctgctgccactctgctgcct

SEQ ID NO: 6174111 - DNA, 21 bp, Homo sapiens
ctgctgccactctgctgcctg

SEQ ID NO: 6174112 - DNA, 15 bp, Homo sapiens
ctgctgccactgagg

SEQ ID NO: 6174113 - DNA, 15 bp, Homo sapiens
ctgctgccagcacag

SEQ ID NO: 6174114 - DNA, 18 bp, Homo sapiens
ctgctgccagcttcaggt

SEQ ID NO: 6174115 - DNA, 20 bp, Homo sapiens
ctgctgccagcttcaggtga

SEQ ID NO: 6174116 - DNA, 13 bp, Homo sapiens
ctgctgccaggcc

SEQ ID NO: 6174117 - DNA, 14 bp, Homo sapiens
ctgctgccaggccc

SEQ ID NO: 6174118 - DNA, 15 bp, Homo sapiens
ctgctgccagggctt

SEQ ID NO: 6174119 - DNA, 16 bp, Homo sapiens
ctgctgccatccatgt

SEQ ID NO: 6174120 - DNA, 18 bp, Homo sapiens
ctgctgccatccatgtgc

SEQ ID NO: 6174121 - DNA, 17 bp, Homo sapiens
ctgctgccatgattttg

SEQ ID NO: 6174122 - DNA, 18 bp, Homo sapiens
ctgctgccatgattttgg

SEQ ID NO: 6174123 - DNA, 14 bp, Homo sapiens
ctgctgcccaatct

SEQ ID NO: 6174124 - DNA, 15 bp, Homo sapiens
ctgctgcccacggcc

SEQ ID NO: 6174125 - DNA, 16 bp, Homo sapiens
ctgctgcccacggcca

SEQ ID NO: 6174126 - DNA, 20 bp, Homo sapiens
ctgctgcccacggccaccca

SEQ ID NO: 6174127 - DNA, 15 bp, Homo sapiens
ctgctgcccagcctc

SEQ ID NO: 6174128 - DNA, 22 bp, Homo sapiens
ctgctgcccagcctccaagctc

SEQ ID NO: 6174129 - DNA, 15 bp, Homo sapiens
ctgctgcccaggcca

SEQ ID NO: 6174130 - DNA, 16 bp, Homo sapiens
ctgctgcccaggccac

SEQ ID NO: 6174131 - DNA, 18 bp, Homo sapiens
ctgctgccccaaaggaag

SEQ ID NO: 6174132 - DNA, 19 bp, Homo sapiens
ctgctgccccaaaggaagc

SEQ ID NO: 6174133 - DNA, 16 bp, Homo sapiens
ctgctgccccagctga

SEQ ID NO: 6174134 - DNA, 22 bp, Homo sapiens
ctgctgccccagctgactgtgg

SEQ ID NO: 6174135 - DNA, 15 bp, Homo sapiens
ctgctgcccccaccc

SEQ ID NO: 6174136 - DNA, 18 bp, Homo sapiens
ctgctgcccccagacccc

SEQ ID NO: 6174137 - DNA, 22 bp, Homo sapiens
ctgctgcccccttccccagccc

SEQ ID NO: 6174138 - DNA, 20 bp, Homo sapiens
ctgctgccccgcttccccac

SEQ ID NO: 6174139 - DNA, 12 bp, Homo sapiens
ctgctgcccctc

SEQ ID NO: 6174140 - DNA, 15 bp, Homo sapiens
ctgctgcccctccct

SEQ ID NO: 6174141 - DNA, 23 bp, Homo sapiens
ctgctgcccctgcacagcaggct

SEQ ID NO: 6174142 - DNA, 17 bp, Homo sapiens
ctgctgcccctgcagtt

SEQ ID NO: 6174143 - DNA, 20 bp, Homo sapiens
ctgctgcccgtgaggagggg

SEQ ID NO: 6174144 - DNA, 12 bp, Homo sapiens
ctgctgccctcc

SEQ ID NO: 6174145 - DNA, 20 bp, Homo sapiens
ctgctgccctgctgtggaag

SEQ ID NO: 6174146 - DNA, 20 bp, Homo sapiens
ctgctgccgccactggctgt

SEQ ID NO: 6174147 - DNA, 21 bp, Homo sapiens
ctgctgccgcccttcctggag

SEQ ID NO: 6174148 - DNA, 14 bp, Homo sapiens
ctgctgccgccgcc

SEQ ID NO: 6174149 - DNA, 14 bp, Homo sapiens
ctgctgccgcctca

SEQ ID NO: 6174150 - DNA, 16 bp, Homo sapiens
ctgctgccgcctcacc

SEQ ID NO: 6174151 - DNA, 17 bp, Homo sapiens
ctgctgccgcctcacct

SEQ ID NO: 6174152 - DNA, 20 bp, Homo sapiens
ctgctgccgcctcccagcct

SEQ ID NO: 6174153 - DNA, 15 bp, Homo sapiens
ctgctgccggctctg

SEQ ID NO: 6174154 - DNA, 20 bp, Homo sapiens
ctgctgccggctctgggcct

SEQ ID NO: 6174155 - DNA, 21 bp, Homo sapiens
ctgctgccggctctgggcctg

SEQ ID NO: 6174156 - DNA, 11 bp, Homo sapiens
ctgctgcctca

SEQ ID NO: 6174157 - DNA, 13 bp, Homo sapiens
ctgctgcctccaa

SEQ ID NO: 6174158 - DNA, 14 bp, Homo sapiens
ctgctgcctccaag

SEQ ID NO: 6174159 - DNA, 15 bp, Homo sapiens
ctgctgcctccccaa

SEQ ID NO: 6174160 - DNA, 15 bp, Homo sapiens
ctgctgcctccctct

SEQ ID NO: 6174161 - DNA, 17 bp, Homo sapiens
ctgctgcctctgtggaa

SEQ ID NO: 6174162 - DNA, 12 bp, Homo sapiens
ctgctgcctctt

SEQ ID NO: 6174163 - DNA, 13 bp, Homo sapiens
ctgctgcctcttt

SEQ ID NO: 6174164 - DNA, 21 bp, Homo sapiens
ctgctgcctctttccctagga

SEQ ID NO: 6174165 - DNA, 18 bp, Homo sapiens
ctgctgcctgctcatggc

SEQ ID NO: 6174166 - DNA, 16 bp, Homo sapiens
ctgctgcctgctgaga

SEQ ID NO: 6174167 - DNA, 14 bp, Homo sapiens
ctgctgcctgcttt

SEQ ID NO: 6174168 - DNA, 11 bp, Homo sapiens
ctgctgcctgg

SEQ ID NO: 6174169 - DNA, 14 bp, Homo sapiens
ctgctgcctggagt

SEQ ID NO: 6174170 - DNA, 14 bp, Homo sapiens
ctgctgcctggcct

SEQ ID NO: 6174171 - DNA, 15 bp, Homo sapiens
ctgctgcctgtacag

SEQ ID NO: 6174172 - DNA, 15 bp, Homo sapiens
ctgctgccttcacat

SEQ ID NO: 6174173 - DNA, 15 bp, Homo sapiens
ctgctgccttttctg

SEQ ID NO: 6174174 - DNA, 17 bp, Homo sapiens
ctgctgcgccccaggcc

SEQ ID NO: 6174175 - DNA, 19 bp, Homo sapiens
ctgctgcgccccaggcccc

SEQ ID NO: 6174176 - DNA, 16 bp, Homo sapiens
ctgctgcgccctgggc

SEQ ID NO: 6174177 - DNA, 17 bp, Homo sapiens
ctgctgcgccctgggct

SEQ ID NO: 6174178 - DNA, 17 bp, Homo sapiens
ctgctgcgcccttacct

SEQ ID NO: 6174179 - DNA, 16 bp, Homo sapiens
ctgctgcgctgtgctg

SEQ ID NO: 6174180 - DNA, 17 bp, Homo sapiens
ctgctgcgctgtgctgg

SEQ ID NO: 6174181 - DNA, 18 bp, Homo sapiens
ctgctgcgctgtgctggt

SEQ ID NO: 6174182 - DNA, 14 bp, Homo sapiens
ctgctgcggaggag

SEQ ID NO: 6174183 - DNA, 17 bp, Homo sapiens
ctgctgcggcgaccgcc

SEQ ID NO: 6174184 - DNA, 17 bp, Homo sapiens
ctgctgcggctgtgggc

SEQ ID NO: 6174185 - DNA, 18 bp, Homo sapiens
ctgctgcgggggagccag

SEQ ID NO: 6174186 - DNA, 19 bp, Homo sapiens
ctgctgcgggggagccagt

SEQ ID NO: 6174187 - DNA, 22 bp, Homo sapiens
ctgctgctactacccgagccca

SEQ ID NO: 6174188 - DNA, 14 bp, Homo sapiens
ctgctgctactgct

SEQ ID NO: 6174189 - DNA, 16 bp, Homo sapiens
ctgctgctactgctgc

SEQ ID NO: 6174190 - DNA, 21 bp, Homo sapiens
ctgctgctaggggctgttgca

SEQ ID NO: 6174191 - DNA, 11 bp, Homo sapiens
ctgctgctcac

SEQ ID NO: 6174192 - DNA, 22 bp, Homo sapiens
ctgctgctcattccacactgtt

SEQ ID NO: 6174193 - DNA, 11 bp, Homo sapiens
ctgctgctccc

SEQ ID NO: 6174194 - DNA, 15 bp, Homo sapiens
ctgctgctcccagcc

SEQ ID NO: 6174195 - DNA, 17 bp, Homo sapiens
ctgctgctccctcagac

SEQ ID NO: 6174196 - DNA, 15 bp, Homo sapiens
ctgctgctcctccct

SEQ ID NO: 6174197 - DNA, 19 bp, Homo sapiens
ctgctgctcctccctctga

SEQ ID NO: 6174198 - DNA, 20 bp, Homo sapiens
ctgctgctcctccctctgac

SEQ ID NO: 6174199 - DNA, 17 bp, Homo sapiens
ctgctgctcctcggcca

SEQ ID NO: 6174200 - DNA, 18 bp, Homo sapiens
ctgctgctcctcggccag

SEQ ID NO: 6174201 - DNA, 23 bp, Homo sapiens
ctgctgctcctcggccagagctc

SEQ ID NO: 6174202 - DNA, 13 bp, Homo sapiens
ctgctgctcctct

SEQ ID NO: 6174203 - DNA, 13 bp, Homo sapiens
ctgctgctcctgt

SEQ ID NO: 6174204 - DNA, 17 bp, Homo sapiens
ctgctgctcgggaaggc

SEQ ID NO: 6174205 - DNA, 18 bp, Homo sapiens
ctgctgctcgggaaggcc

SEQ ID NO: 6174206 - DNA, 11 bp, Homo sapiens
ctgctgctctc

SEQ ID NO: 6174207 - DNA, 16 bp, Homo sapiens
ctgctgctctcccaag

SEQ ID NO: 6174208 - DNA, 20 bp, Homo sapiens
ctgctgctctcccctcccag

SEQ ID NO: 6174209 - DNA, 21 bp, Homo sapiens
ctgctgctctcccctcccagt

SEQ ID NO: 6174210 - DNA, 22 bp, Homo sapiens
ctgctgctcttggctggaccca

SEQ ID NO: 6174211 - DNA, 12 bp, Homo sapiens
ctgctgctgacc

SEQ ID NO: 6174212 - DNA, 17 bp, Homo sapiens
ctgctgctgacccctgt

SEQ ID NO: 6174213 - DNA, 18 bp, Homo sapiens
ctgctgctgacccctgtg

SEQ ID NO: 6174214 - DNA, 21 bp, Homo sapiens
ctgctgctgacccctgtgtga

SEQ ID NO: 6174215 - DNA, 11 bp, Homo sapiens
ctgctgctgag

SEQ ID NO: 6174216 - DNA, 14 bp, Homo sapiens
ctgctgctgagaac

SEQ ID NO: 6174217 - DNA, 17 bp, Homo sapiens
ctgctgctgagaacctg

SEQ ID NO: 6174218 - DNA, 19 bp, Homo sapiens
ctgctgctgagaacctggc

SEQ ID NO: 6174219 - DNA, 22 bp, Homo sapiens
ctgctgctgagaacctggcctt

SEQ ID NO: 6174220 - DNA, 12 bp, Homo sapiens
ctgctgctgcac

SEQ ID NO: 6174221 - DNA, 14 bp, Homo sapiens
ctgctgctgcaccc

SEQ ID NO: 6174222 - DNA, 15 bp, Homo sapiens
ctgctgctgcctgcc

SEQ ID NO: 6174223 - DNA, 15 bp, Homo sapiens
ctgctgctgcgccct

SEQ ID NO: 6174224 - DNA, 15 bp, Homo sapiens
ctgctgctgctgctg

SEQ ID NO: 6174225 - DNA, 13 bp, Homo sapiens
ctgctgctggaga

SEQ ID NO: 6174226 - DNA, 14 bp, Homo sapiens
ctgctgctggagat

SEQ ID NO: 6174227 - DNA, 17 bp, Homo sapiens
cttctggaggtggggag

SEQ ID NO: 6174228 - DNA, 20 bp, Homo sapiens
cttctggaggtggggagggc

SEQ ID NO: 6174229 - DNA, 21 bp, Homo sapiens
cttctggaggtggggagggcc

SEQ ID NO: 6174230 - DNA, 13 bp, Homo sapiens
cttctggatccat

SEQ ID NO: 6174231 - DNA, 14 bp, Homo sapiens
cttctggatccatg

SEQ ID NO: 6174232 - DNA, 21 bp, Homo sapiens
cttctggcataactaaaatta

SEQ ID NO: 6174233 - DNA, 16 bp, Homo sapiens
cttctggcatgggaca

SEQ ID NO: 6174234 - DNA, 17 bp, Homo sapiens
cttctggcatgggacag

SEQ ID NO: 6174235 - DNA, 19 bp, Homo sapiens
cttctggccacatcagccc

SEQ ID NO: 6174236 - DNA, 16 bp, Homo sapiens
cttctggccgctgcag

SEQ ID NO: 6174237 - DNA, 18 bp, Homo sapiens
cttctggccgctgcagtc

SEQ ID NO: 6174238 - DNA, 15 bp, Homo sapiens
cttctggccggtgct

SEQ ID NO: 6174239 - DNA, 19 bp, Homo sapiens
cttctggccggtgctgggt

SEQ ID NO: 6174240 - DNA, 14 bp, Homo sapiens
cttctggcctagga

SEQ ID NO: 6174241 - DNA, 20 bp, Homo sapiens
cttctggcctaggacccctc

SEQ ID NO: 6174242 - DNA, 13 bp, Homo sapiens
cttctggcctcca

SEQ ID NO: 6174243 - DNA, 15 bp, Homo sapiens
cttctggcctccagc

SEQ ID NO: 6174244 - DNA, 17 bp, Homo sapiens
cttctggcctccagcct

SEQ ID NO: 6174245 - DNA, 14 bp, Homo sapiens
cttctggcctccca

SEQ ID NO: 6174246 - DNA, 13 bp, Homo sapiens
cttctggccttgt

SEQ ID NO: 6174247 - DNA, 12 bp, Homo sapiens
cttctggccttt

SEQ ID NO: 6174248 - DNA, 21 bp, Homo sapiens
cttctggcctttcctctctcc

SEQ ID NO: 6174249 - DNA, 12 bp, Homo sapiens
cttctggctcaa

SEQ ID NO: 6174250 - DNA, 15 bp, Homo sapiens
cttctggctcacagg

SEQ ID NO: 6174251 - DNA, 23 bp, Homo sapiens
cttctggctgctgcagtcagcac

SEQ ID NO: 6174252 - DNA, 13 bp, Homo sapiens
cttctggctgtgc

SEQ ID NO: 6174253 - DNA, 14 bp, Homo sapiens
cttctggcttcctt

SEQ ID NO: 6174254 - DNA, 20 bp, Homo sapiens
cttctggcttccttctctca

SEQ ID NO: 6174255 - DNA, 18 bp, Homo sapiens
cttctggctttctgagca

SEQ ID NO: 6174256 - DNA, 15 bp, Homo sapiens
cttctggctttgttc

SEQ ID NO: 6174257 - DNA, 22 bp, Homo sapiens
cttctggctttgttcttgtcat

SEQ ID NO: 6174258 - DNA, 23 bp, Homo sapiens
cttctgggaaaaacaacatcatt

SEQ ID NO: 6174259 - DNA, 19 bp, Homo sapiens
cttctgggacttgaaatca

SEQ ID NO: 6174260 - DNA, 22 bp, Homo sapiens
cttctgggagggcagcagggct

SEQ ID NO: 6174261 - DNA, 19 bp, Homo sapiens
cttctgggcagagcctgtc

SEQ ID NO: 6174262 - DNA, 21 bp, Homo sapiens
cttctgggcctgatggagagg

SEQ ID NO: 6174263 - DNA, 22 bp, Homo sapiens
cttctgggcctgatggagagga

SEQ ID NO: 6174264 - DNA, 23 bp, Homo sapiens
cttctgggcctgatggagaggag

SEQ ID NO: 6174265 - DNA, 20 bp, Homo sapiens
cttctgggctgcgggaggcc

SEQ ID NO: 6174266 - DNA, 22 bp, Homo sapiens
cttctgggctgcgggaggccct

SEQ ID NO: 6174267 - DNA, 21 bp, Homo sapiens
cttctggggagggacacagag

SEQ ID NO: 6174268 - DNA, 15 bp, Homo sapiens
cttctggggaggggc

SEQ ID NO: 6174269 - DNA, 15 bp, Homo sapiens
cttctggggcaggct

SEQ ID NO: 6174270 - DNA, 20 bp, Homo sapiens
cttctggggcaggctgggcc

SEQ ID NO: 6174271 - DNA, 22 bp, Homo sapiens
cttctggggcaggctgggccat

SEQ ID NO: 6174272 - DNA, 12 bp, Homo sapiens
cttctggggcca

SEQ ID NO: 6174273 - DNA, 14 bp, Homo sapiens
cttctggggctccc

SEQ ID NO: 6174274 - DNA, 12 bp, Homo sapiens
cttctgggggaa

SEQ ID NO: 6174275 - DNA, 11 bp, Homo sapiens
cttctggggtc

SEQ ID NO: 6174276 - DNA, 18 bp, Homo sapiens
cttctggggtcaggtgcc

SEQ ID NO: 6174277 - DNA, 20 bp, Homo sapiens
cttctggggtccccagggct

SEQ ID NO: 6174278 - DNA, 17 bp, Homo sapiens
cttctgggtccagggag

SEQ ID NO: 6174279 - DNA, 15 bp, Homo sapiens
cttctgggtggctcc

SEQ ID NO: 6174280 - DNA, 23 bp, Homo sapiens
cttctgggttccttcctctgagc

SEQ ID NO: 6174281 - DNA, 18 bp, Homo sapiens
cttctggtactctcctag

SEQ ID NO: 6174282 - DNA, 20 bp, Homo sapiens
cttctggtactctcctagag

SEQ ID NO: 6174283 - DNA, 14 bp, Homo sapiens
cttctggtctgtgt

SEQ ID NO: 6174284 - DNA, 20 bp, Homo sapiens
cttctggtctgtgtgtgttc

SEQ ID NO: 6174285 - DNA, 20 bp, Homo sapiens
cttctggtgaccttccaaga

SEQ ID NO: 6174286 - DNA, 21 bp, Homo sapiens
cttctggtgaccttccaagag

SEQ ID NO: 6174287 - DNA, 15 bp, Homo sapiens
cttctggtgcatgtt

SEQ ID NO: 6174288 - DNA, 18 bp, Homo sapiens
cttctggtgccagatcct

SEQ ID NO: 6174289 - DNA, 20 bp, Homo sapiens
cttctggttacaatttacag

SEQ ID NO: 6174290 - DNA, 16 bp, Homo sapiens
cttctggtttcttcca

SEQ ID NO: 6174291 - DNA, 14 bp, Homo sapiens
cttctgtaatattt

SEQ ID NO: 6174292 - DNA, 16 bp, Homo sapiens
cttctgtaatcaatat

SEQ ID NO: 6174293 - DNA, 14 bp, Homo sapiens
cttctgtacagtaa

SEQ ID NO: 6174294 - DNA, 17 bp, Homo sapiens
cttctgtagcctgaaga

SEQ ID NO: 6174295 - DNA, 21 bp, Homo sapiens
cttctgtagcctgaagagttt

SEQ ID NO: 6174296 - DNA, 18 bp, Homo sapiens
cttctgtagctattcttt

SEQ ID NO: 6174297 - DNA, 20 bp, Homo sapiens
cttctgtagcttctaatgtt

SEQ ID NO: 6174298 - DNA, 15 bp, Homo sapiens
cttctgtagtactcc

SEQ ID NO: 6174299 - DNA, 18 bp, Homo sapiens
cttctgtagtttttaatt

SEQ ID NO: 6174300 - DNA, 12 bp, Homo sapiens
cttctgtatata

SEQ ID NO: 6174301 - DNA, 16 bp, Homo sapiens
cttctgtatataaatg

SEQ ID NO: 6174302 - DNA, 15 bp, Homo sapiens
cttctgtattcactt

SEQ ID NO: 6174303 - DNA, 21 bp, Homo sapiens
cttctgtatttctaggcacaa

SEQ ID NO: 6174304 - DNA, 14 bp, Homo sapiens
cttctgtattttca

SEQ ID NO: 6174305 - DNA, 17 bp, Homo sapiens
cttctgtattttcaaag

SEQ ID NO: 6174306 - DNA, 22 bp, Homo sapiens
cttctgtatttttttttctaag

SEQ ID NO: 6174307 - DNA, 13 bp, Homo sapiens
cttctgtcatccc

SEQ ID NO: 6174308 - DNA, 15 bp, Homo sapiens
cttctgtccaagcag

SEQ ID NO: 6174309 - DNA, 16 bp, Homo sapiens
cttctgtcccaagtct

SEQ ID NO: 6174310 - DNA, 19 bp, Homo sapiens
cttctgtcccaagtctcca

SEQ ID NO: 6174311 - DNA, 15 bp, Homo sapiens
cttctgtccccagcc

SEQ ID NO: 6174312 - DNA, 14 bp, Homo sapiens
cttctgtccctcac

SEQ ID NO: 6174313 - DNA, 15 bp, Homo sapiens
cttctgtccctcaca

SEQ ID NO: 6174314 - DNA, 21 bp, Homo sapiens
cttctgtcctactctgtgtca

SEQ ID NO: 6174315 - DNA, 21 bp, Homo sapiens
cttctgtcctcttctgtgagt

SEQ ID NO: 6174316 - DNA, 22 bp, Homo sapiens
cttctgtcgtccccagaccagt

SEQ ID NO: 6174317 - DNA, 14 bp, Homo sapiens
cttctgtctccagc

SEQ ID NO: 6174318 - DNA, 15 bp, Homo sapiens
cttctgtctcttgca

SEQ ID NO: 6174319 - DNA, 16 bp, Homo sapiens
cttctgtctcttgcat

SEQ ID NO: 6174320 - DNA, 15 bp, Homo sapiens
cttctgtctgtaaga

SEQ ID NO: 6174321 - DNA, 12 bp, Homo sapiens
cttctgtctgtc

SEQ ID NO: 6174322 - DNA, 22 bp, Homo sapiens
cttctgtcttcacaacagatta

SEQ ID NO: 6174323 - DNA, 19 bp, Homo sapiens
cttctgtcttgtccccacc

SEQ ID NO: 6174324 - DNA, 17 bp, Homo sapiens
cttctgtgaaaaacctg

SEQ ID NO: 6174325 - DNA, 14 bp, Homo sapiens
cttctgtgaaagta

SEQ ID NO: 6174326 - DNA, 13 bp, Homo sapiens
cttctgtgaagaa

SEQ ID NO: 6174327 - DNA, 15 bp, Homo sapiens
cttctgtgaagaagc

SEQ ID NO: 6174328 - DNA, 20 bp, Homo sapiens
cttctgtgaagaagccctgt

SEQ ID NO: 6174329 - DNA, 20 bp, Homo sapiens
cttctgtgagacccccacac

SEQ ID NO: 6174330 - DNA, 17 bp, Homo sapiens
cttctgtgagtcagtca

SEQ ID NO: 6174331 - DNA, 14 bp, Homo sapiens
cttctgtgatgagc

SEQ ID NO: 6174332 - DNA, 19 bp, Homo sapiens
cttctgtgatgagctgatc

SEQ ID NO: 6174333 - DNA, 14 bp, Homo sapiens
cttctgtgcacctg

SEQ ID NO: 6174334 - DNA, 18 bp, Homo sapiens
cttctgtgcacctgggct

SEQ ID NO: 6174335 - DNA, 14 bp, Homo sapiens
cttctgtgcatctg

SEQ ID NO: 6174336 - DNA, 18 bp, Homo sapiens
cttctgtgcatctggcct

SEQ ID NO: 6174337 - DNA, 20 bp, Homo sapiens
cttctgtgcatctggcctgg

SEQ ID NO: 6174338 - DNA, 14 bp, Homo sapiens
cttctgtgccaccc

SEQ ID NO: 6174339 - DNA, 21 bp, Homo sapiens
cttctgtgcccagaatactga

SEQ ID NO: 6174340 - DNA, 18 bp, Homo sapiens
cttctgtgcccagctcag

SEQ ID NO: 6174341 - DNA, 22 bp, Homo sapiens
cttctgtggaagtagctttgaa

SEQ ID NO: 6174342 - DNA, 13 bp, Homo sapiens
cttctgtggctca

SEQ ID NO: 6174343 - DNA, 11 bp, Homo sapiens
cttctgtgggc

SEQ ID NO: 6174344 - DNA, 13 bp, Homo sapiens
cttctgtgggccc

SEQ ID NO: 6174345 - DNA, 19 bp, Homo sapiens
cttctgtgggcccctcaac

SEQ ID NO: 6174346 - DNA, 20 bp, Homo sapiens
cttctgtggggctgggcacc

SEQ ID NO: 6174347 - DNA, 13 bp, Homo sapiens
cttctgtgggttt

SEQ ID NO: 6174348 - DNA, 20 bp, Homo sapiens
cttctgtggtccctctgtgt

SEQ ID NO: 6174349 - DNA, 20 bp, Homo sapiens
cttctgtggttgtggatggg

SEQ ID NO: 6174350 - DNA, 22 bp, Homo sapiens
cttctgtgtaccacttctgtgg

SEQ ID NO: 6174351 - DNA, 23 bp, Homo sapiens
cttctgtgtaccacttctgtggg

SEQ ID NO: 6174352 - DNA, 24 bp, Homo sapiens
cttctgtgtaccacttctgtgggc

SEQ ID NO: 6174353 - DNA, 13 bp, Homo sapiens
cttctgtgtatct

SEQ ID NO: 6174354 - DNA, 22 bp, Homo sapiens
cttctgtgtatctctttcacat

SEQ ID NO: 6174355 - DNA, 16 bp, Homo sapiens
cttctgtgttcatttt

SEQ ID NO: 6174356 - DNA, 14 bp, Homo sapiens
cttctgtgtttata

SEQ ID NO: 6174357 - DNA, 13 bp, Homo sapiens
cttctgttaagaa

SEQ ID NO: 6174358 - DNA, 17 bp, Homo sapiens
cttctgttaagaaagga

SEQ ID NO: 6174359 - DNA, 21 bp, Homo sapiens
cttctgttatttatttcagca

SEQ ID NO: 6174360 - DNA, 14 bp, Homo sapiens
cttctgttcccaag

SEQ ID NO: 6174361 - DNA, 15 bp, Homo sapiens
cttctgttctctgct

SEQ ID NO: 6174362 - DNA, 14 bp, Homo sapiens
cttctgttctgcag

SEQ ID NO: 6174363 - DNA, 17 bp, Homo sapiens
cttctgttgctgcctca

SEQ ID NO: 6174364 - DNA, 19 bp, Homo sapiens
cttctgttgctgcctcatg

SEQ ID NO: 6174365 - DNA, 14 bp, Homo sapiens
cttctgttgtaata

SEQ ID NO: 6174366 - DNA, 13 bp, Homo sapiens
cttctgtttctag

SEQ ID NO: 6174367 - DNA, 23 bp, Homo sapiens
cttctgtttgtcgagcatttctt

SEQ ID NO: 6174368 - DNA, 13 bp, Homo sapiens
cttctgttttcaa

SEQ ID NO: 6174369 - DNA, 17 bp, Homo sapiens
cttctgttttccaaagg

SEQ ID NO: 6174370 - DNA, 17 bp, Homo sapiens
cttctgttttctgtttc

SEQ ID NO: 6174371 - DNA, 12 bp, Homo sapiens
cttctgttttga

SEQ ID NO: 6174372 - DNA, 16 bp, Homo sapiens
cttctgttttgagttt

SEQ ID NO: 6174373 - DNA, 13 bp, Homo sapiens
cttctgtttttct

SEQ ID NO: 6174374 - DNA, 18 bp, Homo sapiens
cttctgtttttctcaaat

SEQ ID NO: 6174375 - DNA, 19 bp, Homo sapiens
cttctgtttttctcaaata

SEQ ID NO: 6174376 - DNA, 20 bp, Homo sapiens
cttctgtttttctcaaataa

SEQ ID NO: 6174377 - DNA, 13 bp, Homo sapiens
cttcttaaaaact

SEQ ID NO: 6174378 - DNA, 18 bp, Homo sapiens
cttcttaaaaactgtgta

SEQ ID NO: 6174379 - DNA, 16 bp, Homo sapiens
cttcttaaaggcctgg

SEQ ID NO: 6174380 - DNA, 17 bp, Homo sapiens
cttcttaaaggcctgga

SEQ ID NO: 6174381 - DNA, 14 bp, Homo sapiens
cttcttaaagtatt

SEQ ID NO: 6174382 - DNA, 19 bp, Homo sapiens
cttcttaaagtattcttct

SEQ ID NO: 6174383 - DNA, 16 bp, Homo sapiens
cttcttaaatgagaag

SEQ ID NO: 6174384 - DNA, 18 bp, Homo sapiens
cttcttaaggacagtgtt

SEQ ID NO: 6174385 - DNA, 19 bp, Homo sapiens
cttcttaaggacagtgttc

SEQ ID NO: 6174386 - DNA, 23 bp, Homo sapiens
cttcttaaggacagtgttcaaat

SEQ ID NO: 6174387 - DNA, 13 bp, Homo sapiens
cttcttaagtgtt

SEQ ID NO: 6174388 - DNA, 16 bp, Homo sapiens
cttcttaatcttttca

SEQ ID NO: 6174389 - DNA, 17 bp, Homo sapiens
cttcttaatcttttcac

SEQ ID NO: 6174390 - DNA, 22 bp, Homo sapiens
cttcttaatgctttcctccctg

SEQ ID NO: 6174391 - DNA, 23 bp, Homo sapiens
cttcttaatgctttcctccctgg

SEQ ID NO: 6174392 - DNA, 20 bp, Homo sapiens
cttcttaatgtacatagtgc

SEQ ID NO: 6174393 - DNA, 18 bp, Homo sapiens
cttcttaattaatttgat

SEQ ID NO: 6174394 - DNA, 22 bp, Homo sapiens
cttcttacgaacgccacggccg

SEQ ID NO: 6174395 - DNA, 22 bp, Homo sapiens
cttcttacttgtctgtacagta

SEQ ID NO: 6174396 - DNA, 17 bp, Homo sapiens
cttcttagagttttatt

SEQ ID NO: 6174397 - DNA, 16 bp, Homo sapiens
cttcttatacatttga

SEQ ID NO: 6174398 - DNA, 20 bp, Homo sapiens
cttcttatattaaagaagtt

SEQ ID NO: 6174399 - DNA, 23 bp, Homo sapiens
cttcttatggaattgatttgcat

SEQ ID NO: 6174400 - DNA, 19 bp, Homo sapiens
cttcttatggtataataaa

SEQ ID NO: 6174401 - DNA, 13 bp, Homo sapiens
cttcttattttgg

SEQ ID NO: 6174402 - DNA, 12 bp, Homo sapiens
cttcttcaaata

SEQ ID NO: 6174403 - DNA, 18 bp, Homo sapiens
cttcttcaaatacaaagt

SEQ ID NO: 6174404 - DNA, 19 bp, Homo sapiens
cttcttcaaatacaaagta

SEQ ID NO: 6174405 - DNA, 14 bp, Homo sapiens
cttcttcacccagc

SEQ ID NO: 6174406 - DNA, 14 bp, Homo sapiens
ctgctgctggctgg

SEQ ID NO: 6174407 - DNA, 12 bp, Homo sapiens
ctgctgctgggc

SEQ ID NO: 6174408 - DNA, 14 bp, Homo sapiens
ctgctgctgggctc

SEQ ID NO: 6174409 - DNA, 13 bp, Homo sapiens
ctgctgctggggc

SEQ ID NO: 6174410 - DNA, 14 bp, Homo sapiens
ctgctgctggtcac

SEQ ID NO: 6174411 - DNA, 18 bp, Homo sapiens
ctgctgctggtcaccccc

SEQ ID NO: 6174412 - DNA, 14 bp, Homo sapiens
ctgctgctgtccct

SEQ ID NO: 6174413 - DNA, 23 bp, Homo sapiens
ctgctgcttaagtgcatgcattg

SEQ ID NO: 6174414 - DNA, 13 bp, Homo sapiens
ctgctgcttccta

SEQ ID NO: 6174415 - DNA, 15 bp, Homo sapiens
ctgctgcttcctaac

SEQ ID NO: 6174416 - DNA, 16 bp, Homo sapiens
ctgctgcttctccaaa

SEQ ID NO: 6174417 - DNA, 17 bp, Homo sapiens
ctgctgcttctccctgg

SEQ ID NO: 6174418 - DNA, 12 bp, Homo sapiens
ctgctgcttctg

SEQ ID NO: 6174419 - DNA, 14 bp, Homo sapiens
ctgctgcttctgct

SEQ ID NO: 6174420 - DNA, 18 bp, Homo sapiens
ctgctgcttctgctccag

SEQ ID NO: 6174421 - DNA, 21 bp, Homo sapiens
ctgctgcttctgctccagccc

SEQ ID NO: 6174422 - DNA, 17 bp, Homo sapiens
ctgctgcttctgggcct

SEQ ID NO: 6174423 - DNA, 13 bp, Homo sapiens
ctgctgcttggga

SEQ ID NO: 6174424 - DNA, 14 bp, Homo sapiens
ctgctgcttgggac

SEQ ID NO: 6174425 - DNA, 15 bp, Homo sapiens
ctgctgctttccttc

SEQ ID NO: 6174426 - DNA, 17 bp, Homo sapiens
ctgctgctttgggctgg

SEQ ID NO: 6174427 - DNA, 22 bp, Homo sapiens
ctgctgctttgttgttctgcct

SEQ ID NO: 6174428 - DNA, 19 bp, Homo sapiens
ctgctggaagaactgcatg

SEQ ID NO: 6174429 - DNA, 20 bp, Homo sapiens
ctgctggaagaactgcatgg

SEQ ID NO: 6174430 - DNA, 21 bp, Homo sapiens
ctgctggaagctgtcaggctg

SEQ ID NO: 6174431 - DNA, 18 bp, Homo sapiens
ctgctggaaggggcagca

SEQ ID NO: 6174432 - DNA, 19 bp, Homo sapiens
ctgctggaaggggcagcag

SEQ ID NO: 6174433 - DNA, 21 bp, Homo sapiens
ctgctggaaggggcagcagga

SEQ ID NO: 6174434 - DNA, 11 bp, Homo sapiens
ctgctggacat

SEQ ID NO: 6174435 - DNA, 22 bp, Homo sapiens
ctgctggaccaaggtgcggacc

SEQ ID NO: 6174436 - DNA, 14 bp, Homo sapiens
ctgctggaggcctc

SEQ ID NO: 6174437 - DNA, 18 bp, Homo sapiens
ctgctggaggcctcaggt

SEQ ID NO: 6174438 - DNA, 21 bp, Homo sapiens
ctgctggaggcctcaggtgct

SEQ ID NO: 6174439 - DNA, 17 bp, Homo sapiens
ctgctggagtccagtgc

SEQ ID NO: 6174440 - DNA, 18 bp, Homo sapiens
ctgctggagtccagtgct

SEQ ID NO: 6174441 - DNA, 20 bp, Homo sapiens
ctgctggagtccagtgcttt

SEQ ID NO: 6174442 - DNA, 19 bp, Homo sapiens
ctgctggagtctggcttta

SEQ ID NO: 6174443 - DNA, 21 bp, Homo sapiens
ctgctggagtctggctttacc

SEQ ID NO: 6174444 - DNA, 14 bp, Homo sapiens
ctgctggagtgcag

SEQ ID NO: 6174445 - DNA, 20 bp, Homo sapiens
ctgctggagtttcatgtaca

SEQ ID NO: 6174446 - DNA, 21 bp, Homo sapiens
ctgctggagtttcatgtacaa

SEQ ID NO: 6174447 - DNA, 21 bp, Homo sapiens
ctgctggatcacagctgcttt

SEQ ID NO: 6174448 - DNA, 16 bp, Homo sapiens
ctgctggatcttgcct

SEQ ID NO: 6174449 - DNA, 15 bp, Homo sapiens
ctgctggcacctcag

SEQ ID NO: 6174450 - DNA, 23 bp, Homo sapiens
ctgctggcacctcagacaatcca

SEQ ID NO: 6174451 - DNA, 11 bp, Homo sapiens
ctgctggcagg

SEQ ID NO: 6174452 - DNA, 18 bp, Homo sapiens
ctgctggcagggccaggg

SEQ ID NO: 6174453 - DNA, 21 bp, Homo sapiens
ctgctggcagggccagggcaa

SEQ ID NO: 6174454 - DNA, 15 bp, Homo sapiens
ctgctggcatcaaga

SEQ ID NO: 6174455 - DNA, 20 bp, Homo sapiens
ctgctggccaaatagcaaag

SEQ ID NO: 6174456 - DNA, 17 bp, Homo sapiens
ctgctggccaagaagtt

SEQ ID NO: 6174457 - DNA, 12 bp, Homo sapiens
ctgctggccagg

SEQ ID NO: 6174458 - DNA, 21 bp, Homo sapiens
ctgctggccatgaatctctgc

SEQ ID NO: 6174459 - DNA, 11 bp, Homo sapiens
ctgctggcccc

SEQ ID NO: 6174460 - DNA, 14 bp, Homo sapiens
ctgctggccgaccc

SEQ ID NO: 6174461 - DNA, 22 bp, Homo sapiens
ctgctggccgacccactgaccc

SEQ ID NO: 6174462 - DNA, 15 bp, Homo sapiens
ctgctggcctccctc

SEQ ID NO: 6174463 - DNA, 17 bp, Homo sapiens
ctgctggcctccctccg

SEQ ID NO: 6174464 - DNA, 15 bp, Homo sapiens
ctgctggcctctgcg

SEQ ID NO: 6174465 - DNA, 11 bp, Homo sapiens
ctgctggcctg

SEQ ID NO: 6174466 - DNA, 13 bp, Homo sapiens
ctgctggcctgct

SEQ ID NO: 6174467 - DNA, 12 bp, Homo sapiens
ctgctggcctgg

SEQ ID NO: 6174468 - DNA, 15 bp, Homo sapiens
ctgctggcctggatc

SEQ ID NO: 6174469 - DNA, 16 bp, Homo sapiens
ctgctggcctggccct

SEQ ID NO: 6174470 - DNA, 18 bp, Homo sapiens
ctgctggcgcctctgcaa

SEQ ID NO: 6174471 - DNA, 22 bp, Homo sapiens
ctgctggcgggaatactcttgg

SEQ ID NO: 6174472 - DNA, 16 bp, Homo sapiens
ctgctggctcacgccc

SEQ ID NO: 6174473 - DNA, 15 bp, Homo sapiens
ctgctggctcaggag

SEQ ID NO: 6174474 - DNA, 19 bp, Homo sapiens
ctgctggctcccatctccc

SEQ ID NO: 6174475 - DNA, 20 bp, Homo sapiens
ctgctggctgacctgggccc

SEQ ID NO: 6174476 - DNA, 18 bp, Homo sapiens
ctgctggctgaggcttgg

SEQ ID NO: 6174477 - DNA, 16 bp, Homo sapiens
ctgctggctggtgcct

SEQ ID NO: 6174478 - DNA, 15 bp, Homo sapiens
ctgctggcttcaggg

SEQ ID NO: 6174479 - DNA, 19 bp, Homo sapiens
ctgctggcttcagggaggg

SEQ ID NO: 6174480 - DNA, 15 bp, Homo sapiens
ctgctggcttccagc

SEQ ID NO: 6174481 - DNA, 14 bp, Homo sapiens
ctgctggcttgcag

SEQ ID NO: 6174482 - DNA, 17 bp, Homo sapiens
ctgctgggaaccccgca

SEQ ID NO: 6174483 - DNA, 16 bp, Homo sapiens
ctgctgggaagagctc

SEQ ID NO: 6174484 - DNA, 23 bp, Homo sapiens
ctgctgggaagtggcttaatagt

SEQ ID NO: 6174485 - DNA, 17 bp, Homo sapiens
ctgctgggacccacctc

SEQ ID NO: 6174486 - DNA, 21 bp, Homo sapiens
ctgctgggacccacctccccc

SEQ ID NO: 6174487 - DNA, 22 bp, Homo sapiens
ctgctgggacccacctccccct

SEQ ID NO: 6174488 - DNA, 23 bp, Homo sapiens
ctgctgggaccccagctagggct

SEQ ID NO: 6174489 - DNA, 17 bp, Homo sapiens
ctgctgggactgagaag

SEQ ID NO: 6174490 - DNA, 22 bp, Homo sapiens
ctgctgggagatgccattctcc

SEQ ID NO: 6174491 - DNA, 16 bp, Homo sapiens
ctgctgggagttctag

SEQ ID NO: 6174492 - DNA, 17 bp, Homo sapiens
ctgctgggagttctaga

SEQ ID NO: 6174493 - DNA, 21 bp, Homo sapiens
ctgctgggagttctagaacca

SEQ ID NO: 6174494 - DNA, 14 bp, Homo sapiens
ctgctgggatcctt

SEQ ID NO: 6174495 - DNA, 19 bp, Homo sapiens
ctgctgggcactgggcact

SEQ ID NO: 6174496 - DNA, 23 bp, Homo sapiens
ctgctgggcactgggcactagct

SEQ ID NO: 6174497 - DNA, 15 bp, Homo sapiens
ctgctgggccagtgg

SEQ ID NO: 6174498 - DNA, 17 bp, Homo sapiens
ctgctgggccagtggca

SEQ ID NO: 6174499 - DNA, 18 bp, Homo sapiens
ctgctgggccagtggcac

SEQ ID NO: 6174500 - DNA, 13 bp, Homo sapiens
ctgctgggccccg

SEQ ID NO: 6174501 - DNA, 16 bp, Homo sapiens
ctgctgggcgtctgtt

SEQ ID NO: 6174502 - DNA, 21 bp, Homo sapiens
ctgctgggcgtgtgtgacact

SEQ ID NO: 6174503 - DNA, 17 bp, Homo sapiens
ctgctgggctcccccca

SEQ ID NO: 6174504 - DNA, 18 bp, Homo sapiens
ctgctgggctccccccag

SEQ ID NO: 6174505 - DNA, 19 bp, Homo sapiens
ctgctgggctccccccagt

SEQ ID NO: 6174506 - DNA, 17 bp, Homo sapiens
ctgctgggctctccacc

SEQ ID NO: 6174507 - DNA, 18 bp, Homo sapiens
ctgctgggctctccacct

SEQ ID NO: 6174508 - DNA, 19 bp, Homo sapiens
ctgctgggctctccacctc

SEQ ID NO: 6174509 - DNA, 16 bp, Homo sapiens
ctgctgggctgagtga

SEQ ID NO: 6174510 - DNA, 22 bp, Homo sapiens
ctgctgggctgagtgacacaag

SEQ ID NO: 6174511 - DNA, 16 bp, Homo sapiens
ctgctgggcttggctc

SEQ ID NO: 6174512 - DNA, 17 bp, Homo sapiens
ctgctggggaagaacag

SEQ ID NO: 6174513 - DNA, 21 bp, Homo sapiens
ctgctggggaagaacagcccc

SEQ ID NO: 6174514 - DNA, 18 bp, Homo sapiens
ctgctggggaagacagtg

SEQ ID NO: 6174515 - DNA, 19 bp, Homo sapiens
ctgctggggaagacagtgg

SEQ ID NO: 6174516 - DNA, 20 bp, Homo sapiens
ctgctggggaagacagtggc

SEQ ID NO: 6174517 - DNA, 20 bp, Homo sapiens
ctgctggggaagggttttct

SEQ ID NO: 6174518 - DNA, 14 bp, Homo sapiens
ctgctggggagtcc

SEQ ID NO: 6174519 - DNA, 21 bp, Homo sapiens
ctgctggggatccccgcctgg

SEQ ID NO: 6174520 - DNA, 14 bp, Homo sapiens
ctgctggggcaggg

SEQ ID NO: 6174521 - DNA, 20 bp, Homo sapiens
ctgctggggcagggcccagg

SEQ ID NO: 6174522 - DNA, 21 bp, Homo sapiens
ctgctggggcatgtgtgcctg

SEQ ID NO: 6174523 - DNA, 22 bp, Homo sapiens
ctgctggggcctgggacaactg

SEQ ID NO: 6174524 - DNA, 23 bp, Homo sapiens
ctgctggggctaagcggtggagg

SEQ ID NO: 6174525 - DNA, 15 bp, Homo sapiens
ctgctgggggctccc

SEQ ID NO: 6174526 - DNA, 21 bp, Homo sapiens
ctgctgggggctccccttgcc

SEQ ID NO: 6174527 - DNA, 22 bp, Homo sapiens
ctgctgggggtgagctgtactc

SEQ ID NO: 6174528 - DNA, 20 bp, Homo sapiens
ctgctggggtctcaggtcca

SEQ ID NO: 6174529 - DNA, 15 bp, Homo sapiens
ctgctgggtgccagg

SEQ ID NO: 6174530 - DNA, 16 bp, Homo sapiens
ctgctgggtgccaggt

SEQ ID NO: 6174531 - DNA, 17 bp, Homo sapiens
ctgctgggtgccaggtg

SEQ ID NO: 6174532 - DNA, 19 bp, Homo sapiens
ctgctgggtgccaggtgct

SEQ ID NO: 6174533 - DNA, 21 bp, Homo sapiens
ctgctgggtgccaggtgctgg

SEQ ID NO: 6174534 - DNA, 22 bp, Homo sapiens
ctgctgggtgccaggtgctggg

SEQ ID NO: 6174535 - DNA, 11 bp, Homo sapiens
ctgctgggtgg

SEQ ID NO: 6174536 - DNA, 17 bp, Homo sapiens
ctgctgggtggcagggg

SEQ ID NO: 6174537 - DNA, 16 bp, Homo sapiens
ctgctgggtggcccat

SEQ ID NO: 6174538 - DNA, 22 bp, Homo sapiens
ctgctgggtttccacacagcct

SEQ ID NO: 6174539 - DNA, 16 bp, Homo sapiens
ctgctggtaacagtgg

SEQ ID NO: 6174540 - DNA, 16 bp, Homo sapiens
ctgctggtacctgccc

SEQ ID NO: 6174541 - DNA, 17 bp, Homo sapiens
ctgctggtatttctaat

SEQ ID NO: 6174542 - DNA, 15 bp, Homo sapiens
ctgctggtcacagcc

SEQ ID NO: 6174543 - DNA, 18 bp, Homo sapiens
ctgctggtcacagcctcc

SEQ ID NO: 6174544 - DNA, 20 bp, Homo sapiens
ctgctggtcacagcctcctc

SEQ ID NO: 6174545 - DNA, 19 bp, Homo sapiens
ctgctggtcacttcttctg

SEQ ID NO: 6174546 - DNA, 20 bp, Homo sapiens
ctgctggtcacttcttctgt

SEQ ID NO: 6174547 - DNA, 20 bp, Homo sapiens
ctgctggtctctggctctac

SEQ ID NO: 6174548 - DNA, 17 bp, Homo sapiens
ctgctggtgccagggtg

SEQ ID NO: 6174549 - DNA, 14 bp, Homo sapiens
ctgctggtgcccac

SEQ ID NO: 6174550 - DNA, 23 bp, Homo sapiens
ctgctggtgggcttgtcatagcc

SEQ ID NO: 6174551 - DNA, 14 bp, Homo sapiens
ctgctggtggggca

SEQ ID NO: 6174552 - DNA, 15 bp, Homo sapiens
ctgctggttcagggt

SEQ ID NO: 6174553 - DNA, 20 bp, Homo sapiens
ctgctggttcctgactggca

SEQ ID NO: 6174554 - DNA, 23 bp, Homo sapiens
ctgctggttgttgccaggttgca

SEQ ID NO: 6174555 - DNA, 21 bp, Homo sapiens
ctgctggttttaacaactgtg

SEQ ID NO: 6174556 - DNA, 19 bp, Homo sapiens
ctgctggttttggtttcca

SEQ ID NO: 6174557 - DNA, 16 bp, Homo sapiens
ctgctgtaaaattata

SEQ ID NO: 6174558 - DNA, 20 bp, Homo sapiens
ctgctgtaaaattataaact

SEQ ID NO: 6174559 - DNA, 19 bp, Homo sapiens
ctgctgtaaagcaaaatat

SEQ ID NO: 6174560 - DNA, 15 bp, Homo sapiens
ctgctgtaactgctg

SEQ ID NO: 6174561 - DNA, 18 bp, Homo sapiens
ctgctgtaactgctgagc

SEQ ID NO: 6174562 - DNA, 22 bp, Homo sapiens
ctgctgtaactgctgagccact

SEQ ID NO: 6174563 - DNA, 15 bp, Homo sapiens
ctgctgtaagaaatc

SEQ ID NO: 6174564 - DNA, 19 bp, Homo sapiens
ctgctgtaagacggccttg

SEQ ID NO: 6174565 - DNA, 20 bp, Homo sapiens
ctgctgtacaacttctgggc

SEQ ID NO: 6174566 - DNA, 17 bp, Homo sapiens
ctgctgtacccagatgc

SEQ ID NO: 6174567 - DNA, 18 bp, Homo sapiens
ctgctgtacccagatgcc

SEQ ID NO: 6174568 - DNA, 15 bp, Homo sapiens
ctgctgtactgaagt

SEQ ID NO: 6174569 - DNA, 18 bp, Homo sapiens
ctgctgtagcaacagagc

SEQ ID NO: 6174570 - DNA, 22 bp, Homo sapiens
ctgctgtagtcctttctgcctt

SEQ ID NO: 6174571 - DNA, 23 bp, Homo sapiens
ctgctgtagtcctttctgccttg

SEQ ID NO: 6174572 - DNA, 22 bp, Homo sapiens
ctgctgtataaggtaataaaac

SEQ ID NO: 6174573 - DNA, 19 bp, Homo sapiens
ctgctgtatccagaagaaa

SEQ ID NO: 6174574 - DNA, 17 bp, Homo sapiens
ctgctgtatgaatagct

SEQ ID NO: 6174575 - DNA, 22 bp, Homo sapiens
ctgctgtatgaatagctgtgta

SEQ ID NO: 6174576 - DNA, 14 bp, Homo sapiens
ctgctgtatgtgag

SEQ ID NO: 6174577 - DNA, 12 bp, Homo sapiens
ctgctgtattta

SEQ ID NO: 6174578 - DNA, 16 bp, Homo sapiens
ctgctgtatttgagga

SEQ ID NO: 6174579 - DNA, 15 bp, Homo sapiens
ctgctgtatttttat

SEQ ID NO: 6174580 - DNA, 17 bp, Homo sapiens
ctgctgtatttttattt

SEQ ID NO: 6174581 - DNA, 22 bp, Homo sapiens
ctgctgtatttttatttttgca

SEQ ID NO: 6174582 - DNA, 23 bp, Homo sapiens
ctgctgtcaataaatgacaccca

SEQ ID NO: 6174583 - DNA, 16 bp, Homo sapiens
cttcttcacccagcta

SEQ ID NO: 6174584 - DNA, 17 bp, Homo sapiens
cttcttcacctcttcca

SEQ ID NO: 6174585 - DNA, 13 bp, Homo sapiens
cttcttcagagac

SEQ ID NO: 6174586 - DNA, 20 bp, Homo sapiens
cttcttcagagactcctgca

SEQ ID NO: 6174587 - DNA, 14 bp, Homo sapiens
cttcttcagagctg

SEQ ID NO: 6174588 - DNA, 16 bp, Homo sapiens
cttcttcagagtgaag

SEQ ID NO: 6174589 - DNA, 17 bp, Homo sapiens
cttcttcagcaggaagg

SEQ ID NO: 6174590 - DNA, 19 bp, Homo sapiens
cttcttcagcaggaagggt

SEQ ID NO: 6174591 - DNA, 13 bp, Homo sapiens
cttcttcagctga

SEQ ID NO: 6174592 - DNA, 22 bp, Homo sapiens
cttcttcatccaacttccaaga

SEQ ID NO: 6174593 - DNA, 16 bp, Homo sapiens
cttcttcatcttgaca

SEQ ID NO: 6174594 - DNA, 16 bp, Homo sapiens
cttcttcattctatca

SEQ ID NO: 6174595 - DNA, 20 bp, Homo sapiens
cttcttccaaaaggaagcac

SEQ ID NO: 6174596 - DNA, 19 bp, Homo sapiens
cttcttccaaggagcagag

SEQ ID NO: 6174597 - DNA, 20 bp, Homo sapiens
cttcttccatcccaggacac

SEQ ID NO: 6174598 - DNA, 18 bp, Homo sapiens
cttcttccattcccagac

SEQ ID NO: 6174599 - DNA, 18 bp, Homo sapiens
cttcttccattggaaaat

SEQ ID NO: 6174600 - DNA, 22 bp, Homo sapiens
cttcttccccaaggcactgagc

SEQ ID NO: 6174601 - DNA, 16 bp, Homo sapiens
cttcttccccagggtt

SEQ ID NO: 6174602 - DNA, 23 bp, Homo sapiens
cttcttccccagggttctgtatt

SEQ ID NO: 6174603 - DNA, 13 bp, Homo sapiens
cttcttcccccag

SEQ ID NO: 6174604 - DNA, 19 bp, Homo sapiens
cttcttcccctttgtcctg

SEQ ID NO: 6174605 - DNA, 17 bp, Homo sapiens
cttcttcccgccccacc

SEQ ID NO: 6174606 - DNA, 14 bp, Homo sapiens
cttcttcctaggtc

SEQ ID NO: 6174607 - DNA, 13 bp, Homo sapiens
cttcttcctattg

SEQ ID NO: 6174608 - DNA, 20 bp, Homo sapiens
cttcttcctcaagtcttgac

SEQ ID NO: 6174609 - DNA, 14 bp, Homo sapiens
cttcttcctcccct

SEQ ID NO: 6174610 - DNA, 19 bp, Homo sapiens
cttcttcctgctggacaga

SEQ ID NO: 6174611 - DNA, 21 bp, Homo sapiens
cttcttcctgctggacagaga

SEQ ID NO: 6174612 - DNA, 13 bp, Homo sapiens
cttcttcctggat

SEQ ID NO: 6174613 - DNA, 13 bp, Homo sapiens
cttcttcctgtga

SEQ ID NO: 6174614 - DNA, 20 bp, Homo sapiens
cttcttccttcttgtcacca

SEQ ID NO: 6174615 - DNA, 15 bp, Homo sapiens
cttcttcctttctct

SEQ ID NO: 6174616 - DNA, 18 bp, Homo sapiens
cttcttcggaggtggcag

SEQ ID NO: 6174617 - DNA, 17 bp, Homo sapiens
cttcttcggggaactcc

SEQ ID NO: 6174618 - DNA, 14 bp, Homo sapiens
cttcttcgttcctg

SEQ ID NO: 6174619 - DNA, 16 bp, Homo sapiens
cttcttctaagaagac

SEQ ID NO: 6174620 - DNA, 21 bp, Homo sapiens
cttcttctacttcagtcttct

SEQ ID NO: 6174621 - DNA, 13 bp, Homo sapiens
cttcttctccccc

SEQ ID NO: 6174622 - DNA, 14 bp, Homo sapiens
cttcttctctccac

SEQ ID NO: 6174623 - DNA, 16 bp, Homo sapiens
cttcttctgaaagaat

SEQ ID NO: 6174624 - DNA, 14 bp, Homo sapiens
cttcttctgccact

SEQ ID NO: 6174625 - DNA, 23 bp, Homo sapiens
cttcttctgccacttctgcgggc

SEQ ID NO: 6174626 - DNA, 20 bp, Homo sapiens
cttcttctgcgtttgtccct

SEQ ID NO: 6174627 - DNA, 15 bp, Homo sapiens
cttcttctgtaatat

SEQ ID NO: 6174628 - DNA, 14 bp, Homo sapiens
cttcttcttcagaa

SEQ ID NO: 6174629 - DNA, 20 bp, Homo sapiens
cttcttgaaacagcctgggt

SEQ ID NO: 6174630 - DNA, 13 bp, Homo sapiens
cttcttgaaatcc

SEQ ID NO: 6174631 - DNA, 19 bp, Homo sapiens
cttcttgaacactcatgct

SEQ ID NO: 6174632 - DNA, 20 bp, Homo sapiens
cttcttgaacactcatgctg

SEQ ID NO: 6174633 - DNA, 21 bp, Homo sapiens
cttcttgaacactcatgctga

SEQ ID NO: 6174634 - DNA, 13 bp, Homo sapiens
cttcttgaatata

SEQ ID NO: 6174635 - DNA, 16 bp, Homo sapiens
cttcttgcactccttc

SEQ ID NO: 6174636 - DNA, 20 bp, Homo sapiens
cttcttgcactccttcccta

SEQ ID NO: 6174637 - DNA, 20 bp, Homo sapiens
cttcttgcatccttcctata

SEQ ID NO: 6174638 - DNA, 21 bp, Homo sapiens
cttcttgccattattaaccca

SEQ ID NO: 6174639 - DNA, 12 bp, Homo sapiens
cttcttgcccct

SEQ ID NO: 6174640 - DNA, 17 bp, Homo sapiens
cttcttgccccttgggc

SEQ ID NO: 6174641 - DNA, 19 bp, Homo sapiens
cttcttgccccttgggcct

SEQ ID NO: 6174642 - DNA, 22 bp, Homo sapiens
cttcttgccccttgggcctccc

SEQ ID NO: 6174643 - DNA, 13 bp, Homo sapiens
cttcttgccctga

SEQ ID NO: 6174644 - DNA, 15 bp, Homo sapiens
cttcttgcctctgtg

SEQ ID NO: 6174645 - DNA, 14 bp, Homo sapiens
cttcttgcggcacc

SEQ ID NO: 6174646 - DNA, 18 bp, Homo sapiens
cttcttgcggcaccgccc

SEQ ID NO: 6174647 - DNA, 22 bp, Homo sapiens
cttcttgcggcaccgcccaccc

SEQ ID NO: 6174648 - DNA, 15 bp, Homo sapiens
cttcttgctgcagcc

SEQ ID NO: 6174649 - DNA, 17 bp, Homo sapiens
cttcttgctgcagcctg

SEQ ID NO: 6174650 - DNA, 14 bp, Homo sapiens
cttcttgctgccca

SEQ ID NO: 6174651 - DNA, 15 bp, Homo sapiens
cttcttgctgcccac

SEQ ID NO: 6174652 - DNA, 23 bp, Homo sapiens
cttcttgctgccctgccccaagt

SEQ ID NO: 6174653 - DNA, 13 bp, Homo sapiens
cttcttgcttctc

SEQ ID NO: 6174654 - DNA, 16 bp, Homo sapiens
cttcttgcttgtaaaa

SEQ ID NO: 6174655 - DNA, 12 bp, Homo sapiens
cttcttggcttc

SEQ ID NO: 6174656 - DNA, 16 bp, Homo sapiens
cttcttggcttcctgg

SEQ ID NO: 6174657 - DNA, 19 bp, Homo sapiens
cttcttggcttctgggacc

SEQ ID NO: 6174658 - DNA, 14 bp, Homo sapiens
cttcttgggactgc

SEQ ID NO: 6174659 - DNA, 17 bp, Homo sapiens
cttcttgggactgctgt

SEQ ID NO: 6174660 - DNA, 20 bp, Homo sapiens
cttcttgggagtatgttgtc

SEQ ID NO: 6174661 - DNA, 21 bp, Homo sapiens
cttcttgggagtatgttgtca

SEQ ID NO: 6174662 - DNA, 23 bp, Homo sapiens
cttcttgggagtatgttgtcata

SEQ ID NO: 6174663 - DNA, 11 bp, Homo sapiens
cttcttgggat

SEQ ID NO: 6174664 - DNA, 13 bp, Homo sapiens
cttcttgggcccc

SEQ ID NO: 6174665 - DNA, 20 bp, Homo sapiens
cttcttgggcccggtccaca

SEQ ID NO: 6174666 - DNA, 21 bp, Homo sapiens
cttcttgggcccggtccacag

SEQ ID NO: 6174667 - DNA, 13 bp, Homo sapiens
cttcttgggctga

SEQ ID NO: 6174668 - DNA, 19 bp, Homo sapiens
cttcttgggggcagaccag

SEQ ID NO: 6174669 - DNA, 17 bp, Homo sapiens
cttcttgggtctgccct

SEQ ID NO: 6174670 - DNA, 20 bp, Homo sapiens
cttcttgggtctgccctgcc

SEQ ID NO: 6174671 - DNA, 23 bp, Homo sapiens
cttcttggtgcttacacatctca

SEQ ID NO: 6174672 - DNA, 17 bp, Homo sapiens
cttcttggttcctggga

SEQ ID NO: 6174673 - DNA, 19 bp, Homo sapiens
cttcttggtttggggagaa

SEQ ID NO: 6174674 - DNA, 20 bp, Homo sapiens
cttcttggtttggggagaaa

SEQ ID NO: 6174675 - DNA, 12 bp, Homo sapiens
cttcttgtaata

SEQ ID NO: 6174676 - DNA, 20 bp, Homo sapiens
cttcttgtaatatttcttca

SEQ ID NO: 6174677 - DNA, 14 bp, Homo sapiens
cttcttgtcagaca

SEQ ID NO: 6174678 - DNA, 19 bp, Homo sapiens
cttcttgtcagacataaag

SEQ ID NO: 6174679 - DNA, 22 bp, Homo sapiens
cttcttgtcagacataaagcca

SEQ ID NO: 6174680 - DNA, 19 bp, Homo sapiens
cttcttgtctttgtccctg

SEQ ID NO: 6174681 - DNA, 15 bp, Homo sapiens
cttcttgtgaaatgt

SEQ ID NO: 6174682 - DNA, 13 bp, Homo sapiens
cttcttgtgaagg

SEQ ID NO: 6174683 - DNA, 22 bp, Homo sapiens
cttcttgtgattgctgccataa

SEQ ID NO: 6174684 - DNA, 17 bp, Homo sapiens
cttcttgtggttgtata

SEQ ID NO: 6174685 - DNA, 15 bp, Homo sapiens
cttcttgtgttttac

SEQ ID NO: 6174686 - DNA, 13 bp, Homo sapiens
cttcttgttcatg

SEQ ID NO: 6174687 - DNA, 13 bp, Homo sapiens
cttcttgttcccc

SEQ ID NO: 6174688 - DNA, 21 bp, Homo sapiens
cttcttgttctgagattcaat

SEQ ID NO: 6174689 - DNA, 22 bp, Homo sapiens
cttcttgttctgagattcaata

SEQ ID NO: 6174690 - DNA, 12 bp, Homo sapiens
cttctttaaaca

SEQ ID NO: 6174691 - DNA, 13 bp, Homo sapiens
cttctttaaatca

SEQ ID NO: 6174692 - DNA, 14 bp, Homo sapiens
cttctttaaatcaa

SEQ ID NO: 6174693 - DNA, 20 bp, Homo sapiens
cttctttaatcacttaacat

SEQ ID NO: 6174694 - DNA, 19 bp, Homo sapiens
cttctttaattttggaatt

SEQ ID NO: 6174695 - DNA, 16 bp, Homo sapiens
cttctttaccttcatt

SEQ ID NO: 6174696 - DNA, 19 bp, Homo sapiens
cttctttaccttcatttca

SEQ ID NO: 6174697 - DNA, 18 bp, Homo sapiens
cttctttactaacactgg

SEQ ID NO: 6174698 - DNA, 14 bp, Homo sapiens
cttctttagaacag

SEQ ID NO: 6174699 - DNA, 20 bp, Homo sapiens
cttctttagcatttttatgc

SEQ ID NO: 6174700 - DNA, 14 bp, Homo sapiens
cttctttattgcac

SEQ ID NO: 6174701 - DNA, 16 bp, Homo sapiens
cttctttcactactca

SEQ ID NO: 6174702 - DNA, 17 bp, Homo sapiens
cttctttcatgtaagta

SEQ ID NO: 6174703 - DNA, 17 bp, Homo sapiens
cttctttccagaaacca

SEQ ID NO: 6174704 - DNA, 12 bp, Homo sapiens
cttctttccatt

SEQ ID NO: 6174705 - DNA, 20 bp, Homo sapiens
cttctttccattcttcttgc

SEQ ID NO: 6174706 - DNA, 17 bp, Homo sapiens
cttctttccctggacag

SEQ ID NO: 6174707 - DNA, 14 bp, Homo sapiens
cttctttcccttcc

SEQ ID NO: 6174708 - DNA, 12 bp, Homo sapiens
cttctttcctct

SEQ ID NO: 6174709 - DNA, 14 bp, Homo sapiens
cttctttcctcttc

SEQ ID NO: 6174710 - DNA, 13 bp, Homo sapiens
cttctttccttcc

SEQ ID NO: 6174711 - DNA, 14 bp, Homo sapiens
cttctttccttcca

SEQ ID NO: 6174712 - DNA, 12 bp, Homo sapiens
cttctttccttt

SEQ ID NO: 6174713 - DNA, 16 bp, Homo sapiens
cttctttctagaaaga

SEQ ID NO: 6174714 - DNA, 19 bp, Homo sapiens
cttctttctccatggagcc

SEQ ID NO: 6174715 - DNA, 17 bp, Homo sapiens
cttctttctcttccctc

SEQ ID NO: 6174716 - DNA, 17 bp, Homo sapiens
cttctttctgactctaa

SEQ ID NO: 6174717 - DNA, 17 bp, Homo sapiens
cttctttctgctggctg

SEQ ID NO: 6174718 - DNA, 21 bp, Homo sapiens
cttctttctttgggaatattt

SEQ ID NO: 6174719 - DNA, 12 bp, Homo sapiens
cttctttgaaga

SEQ ID NO: 6174720 - DNA, 13 bp, Homo sapiens
cttctttgaagaa

SEQ ID NO: 6174721 - DNA, 23 bp, Homo sapiens
cttctttgcaacaataataaatg

SEQ ID NO: 6174722 - DNA, 18 bp, Homo sapiens
cttctttgcagcctgggt

SEQ ID NO: 6174723 - DNA, 15 bp, Homo sapiens
cttctttgcctccct

SEQ ID NO: 6174724 - DNA, 18 bp, Homo sapiens
cttctttgcctccctcag

SEQ ID NO: 6174725 - DNA, 14 bp, Homo sapiens
cttctttgcttctt

SEQ ID NO: 6174726 - DNA, 14 bp, Homo sapiens
cttctttgctttct

SEQ ID NO: 6174727 - DNA, 15 bp, Homo sapiens
cttctttgctttctc

SEQ ID NO: 6174728 - DNA, 16 bp, Homo sapiens
cttctttgctttctcg

SEQ ID NO: 6174729 - DNA, 20 bp, Homo sapiens
cttctttggacttctgaaga

SEQ ID NO: 6174730 - DNA, 18 bp, Homo sapiens
cttctttgggtaaacgtg

SEQ ID NO: 6174731 - DNA, 16 bp, Homo sapiens
cttctttgtgcctttg

SEQ ID NO: 6174732 - DNA, 22 bp, Homo sapiens
cttctttgtgcctttggcctgg

SEQ ID NO: 6174733 - DNA, 23 bp, Homo sapiens
cttctttgttattataacataaa

SEQ ID NO: 6174734 - DNA, 13 bp, Homo sapiens
cttctttgttttt

SEQ ID NO: 6174735 - DNA, 23 bp, Homo sapiens
cttcttttaagatgtgtcttcaa

SEQ ID NO: 6174736 - DNA, 21 bp, Homo sapiens
cttcttttactggactgtctg

SEQ ID NO: 6174737 - DNA, 12 bp, Homo sapiens
cttcttttactt

SEQ ID NO: 6174738 - DNA, 13 bp, Homo sapiens
cttcttttagtca

SEQ ID NO: 6174739 - DNA, 14 bp, Homo sapiens
cttcttttagtcag

SEQ ID NO: 6174740 - DNA, 15 bp, Homo sapiens
cttcttttcaaaata

SEQ ID NO: 6174741 - DNA, 19 bp, Homo sapiens
cttcttttcaatgcaatgc

SEQ ID NO: 6174742 - DNA, 14 bp, Homo sapiens
cttcttttcacatt

SEQ ID NO: 6174743 - DNA, 14 bp, Homo sapiens
cttcttttcacctc

SEQ ID NO: 6174744 - DNA, 13 bp, Homo sapiens
cttcttttcctaa

SEQ ID NO: 6174745 - DNA, 14 bp, Homo sapiens
cttcttttccttta

SEQ ID NO: 6174746 - DNA, 15 bp, Homo sapiens
cttcttttgaacatc

SEQ ID NO: 6174747 - DNA, 23 bp, Homo sapiens
cttcttttgaactgttagatgct

SEQ ID NO: 6174748 - DNA, 20 bp, Homo sapiens
cttcttttgaccccttcctg

SEQ ID NO: 6174749 - DNA, 22 bp, Homo sapiens
cttcttttgaccccttcctgtc

SEQ ID NO: 6174750 - DNA, 14 bp, Homo sapiens
cttcttttgctctt

SEQ ID NO: 6174751 - DNA, 21 bp, Homo sapiens
cttctttttccctttcctttc

SEQ ID NO: 6174752 - DNA, 19 bp, Homo sapiens
cttctttttctggactctg

SEQ ID NO: 6174753 - DNA, 14 bp, Homo sapiens
cttctttttgctgt

SEQ ID NO: 6174754 - DNA, 15 bp, Homo sapiens
cttctttttgctgtt

SEQ ID NO: 6174755 - DNA, 16 bp, Homo sapiens
cttctttttgctgttg

SEQ ID NO: 6174756 - DNA, 14 bp, Homo sapiens
cttcttttttaagt

SEQ ID NO: 6174757 - DNA, 17 bp, Homo sapiens
cttcttttttaagttgt

SEQ ID NO: 6174758 - DNA, 22 bp, Homo sapiens
cttcttttttgtaaaaactttt

SEQ ID NO: 6174759 - DNA, 23 bp, Homo sapiens
cttcttttttgtctcaagattat

SEQ ID NO: 6174760 - DNA, 19 bp, Homo sapiens
cttgaaaaaaaaaaacaca

SEQ ID NO: 6174761 - DNA, 20 bp, Homo sapiens
cttgaaaaaaaatagatgtt

SEQ ID NO: 6174762 - DNA, 17 bp, Homo sapiens
cttgaaaaaatgttcta

SEQ ID NO: 6174763 - DNA, 22 bp, Homo sapiens
cttgaaaaagatccaagctcct

SEQ ID NO: 6174764 - DNA, 19 bp, Homo sapiens
ctgctgtcacctctcccac

SEQ ID NO: 6174765 - DNA, 21 bp, Homo sapiens
ctgctgtcacctctcccacgg

SEQ ID NO: 6174766 - DNA, 14 bp, Homo sapiens
ctgctgtcagccaa

SEQ ID NO: 6174767 - DNA, 15 bp, Homo sapiens
ctgctgtcagtctgc

SEQ ID NO: 6174768 - DNA, 20 bp, Homo sapiens
ctgctgtcattgcttcttct

SEQ ID NO: 6174769 - DNA, 11 bp, Homo sapiens
ctgctgtccag

SEQ ID NO: 6174770 - DNA, 16 bp, Homo sapiens
ctgctgtccagacagc

SEQ ID NO: 6174771 - DNA, 18 bp, Homo sapiens
ctgctgtccagacagcct

SEQ ID NO: 6174772 - DNA, 19 bp, Homo sapiens
ctgctgtccagacagcctg

SEQ ID NO: 6174773 - DNA, 20 bp, Homo sapiens
ctgctgtccagacagcctgt

SEQ ID NO: 6174774 - DNA, 14 bp, Homo sapiens
ctgctgtccagtgc

SEQ ID NO: 6174775 - DNA, 15 bp, Homo sapiens
ctgctgtccagtgcc

SEQ ID NO: 6174776 - DNA, 16 bp, Homo sapiens
ctgctgtccagtgcct

SEQ ID NO: 6174777 - DNA, 23 bp, Homo sapiens
ctgctgtcccctcttgccccaac

SEQ ID NO: 6174778 - DNA, 14 bp, Homo sapiens
ctgctgtccctcct

SEQ ID NO: 6174779 - DNA, 18 bp, Homo sapiens
ctgctgtccctcctgagg

SEQ ID NO: 6174780 - DNA, 13 bp, Homo sapiens
ctgctgtccctgt

SEQ ID NO: 6174781 - DNA, 16 bp, Homo sapiens
ctgctgtccctgtcag

SEQ ID NO: 6174782 - DNA, 23 bp, Homo sapiens
ctgctgtcctctcccccttcagc

SEQ ID NO: 6174783 - DNA, 13 bp, Homo sapiens
ctgctgtcctgca

SEQ ID NO: 6174784 - DNA, 14 bp, Homo sapiens
ctgctgtcctgcag

SEQ ID NO: 6174785 - DNA, 16 bp, Homo sapiens
ctgctgtcctgcagta

SEQ ID NO: 6174786 - DNA, 13 bp, Homo sapiens
ctgctgtcctggt

SEQ ID NO: 6174787 - DNA, 15 bp, Homo sapiens
ctgctgtcctggtgg

SEQ ID NO: 6174788 - DNA, 18 bp, Homo sapiens
ctgctgtcctggtggctg

SEQ ID NO: 6174789 - DNA, 10 bp, Homo sapiens
ctgctgtctc

SEQ ID NO: 6174790 - DNA, 12 bp, Homo sapiens
ctgctgtctccc

SEQ ID NO: 6174791 - DNA, 11 bp, Homo sapiens
ctgctgtctct

SEQ ID NO: 6174792 - DNA, 12 bp, Homo sapiens
ctgctgtctcta

SEQ ID NO: 6174793 - DNA, 15 bp, Homo sapiens
ctgctgtctctctgg

SEQ ID NO: 6174794 - DNA, 21 bp, Homo sapiens
ctgctgtctcttaaatctctt

SEQ ID NO: 6174795 - DNA, 19 bp, Homo sapiens
ctgctgtctgggtggctca

SEQ ID NO: 6174796 - DNA, 21 bp, Homo sapiens
ctgctgtctgggtggctcact

SEQ ID NO: 6174797 - DNA, 14 bp, Homo sapiens
ctgctgtcttccaa

SEQ ID NO: 6174798 - DNA, 15 bp, Homo sapiens
ctgctgtcttcccca

SEQ ID NO: 6174799 - DNA, 17 bp, Homo sapiens
ctgctgtcttccccacc

SEQ ID NO: 6174800 - DNA, 21 bp, Homo sapiens
ctgctgtcttccccaccgcag

SEQ ID NO: 6174801 - DNA, 16 bp, Homo sapiens
ctgctgtcttctccct

SEQ ID NO: 6174802 - DNA, 19 bp, Homo sapiens
ctgctgtcttttctttgcc

SEQ ID NO: 6174803 - DNA, 21 bp, Homo sapiens
ctgctgtgaaaactctggtac

SEQ ID NO: 6174804 - DNA, 18 bp, Homo sapiens
ctgctgtgaacatgcctc

SEQ ID NO: 6174805 - DNA, 22 bp, Homo sapiens
ctgctgtgaaccctggggcctg

SEQ ID NO: 6174806 - DNA, 23 bp, Homo sapiens
ctgctgtgaatttgtgtaaggat

SEQ ID NO: 6174807 - DNA, 14 bp, Homo sapiens
ctgctgtgaatttt

SEQ ID NO: 6174808 - DNA, 15 bp, Homo sapiens
ctgctgtgactgtgt

SEQ ID NO: 6174809 - DNA, 17 bp, Homo sapiens
ctgctgtgactgtgtcc

SEQ ID NO: 6174810 - DNA, 19 bp, Homo sapiens
ctgctgtgatgccgtcctg

SEQ ID NO: 6174811 - DNA, 16 bp, Homo sapiens
ctgctgtgattccact

SEQ ID NO: 6174812 - DNA, 9 bp, Homo sapiens
ctgctgtgc

SEQ ID NO: 6174813 - DNA, 22 bp, Homo sapiens
ctgctgtgcaccttacattcct

SEQ ID NO: 6174814 - DNA, 19 bp, Homo sapiens
ctgctgtgccatgctgggc

SEQ ID NO: 6174815 - DNA, 13 bp, Homo sapiens
ctgctgtgcccca

SEQ ID NO: 6174816 - DNA, 14 bp, Homo sapiens
ctgctgtgcctgcg

SEQ ID NO: 6174817 - DNA, 14 bp, Homo sapiens
ctgctgtgcgtgga

SEQ ID NO: 6174818 - DNA, 21 bp, Homo sapiens
ctgctgtgcgtggaaaaagac

SEQ ID NO: 6174819 - DNA, 16 bp, Homo sapiens
ctgctgtgctgctcaa

SEQ ID NO: 6174820 - DNA, 14 bp, Homo sapiens
ctgctgtggagccc

SEQ ID NO: 6174821 - DNA, 15 bp, Homo sapiens
ctgctgtggagccca

SEQ ID NO: 6174822 - DNA, 14 bp, Homo sapiens
ctgctgtggcatca

SEQ ID NO: 6174823 - DNA, 14 bp, Homo sapiens
ctgctgtggccagg

SEQ ID NO: 6174824 - DNA, 17 bp, Homo sapiens
ctgctgtggccaggagg

SEQ ID NO: 6174825 - DNA, 14 bp, Homo sapiens
ctgctgtggcccag

SEQ ID NO: 6174826 - DNA, 16 bp, Homo sapiens
ctgctgtggcccagtc

SEQ ID NO: 6174827 - DNA, 15 bp, Homo sapiens
ctgctgtggccccct

SEQ ID NO: 6174828 - DNA, 19 bp, Homo sapiens
ctgctgtggccccctgtcc

SEQ ID NO: 6174829 - DNA, 19 bp, Homo sapiens
ctgctgtggcctcacttcc

SEQ ID NO: 6174830 - DNA, 19 bp, Homo sapiens
ctgctgtgggagagcgaag

SEQ ID NO: 6174831 - DNA, 23 bp, Homo sapiens
ctgctgtggggtatacagcattg

SEQ ID NO: 6174832 - DNA, 15 bp, Homo sapiens
ctgctgtggtgttcc

SEQ ID NO: 6174833 - DNA, 18 bp, Homo sapiens
ctgctgtgtagctctgtc

SEQ ID NO: 6174834 - DNA, 17 bp, Homo sapiens
ctgctgtgtccttcctc

SEQ ID NO: 6174835 - DNA, 21 bp, Homo sapiens
ctgctgtgtccttcctccaca

SEQ ID NO: 6174836 - DNA, 20 bp, Homo sapiens
ctgctgtgtgaattcccagg

SEQ ID NO: 6174837 - DNA, 14 bp, Homo sapiens
ctgctgtgtgcctt

SEQ ID NO: 6174838 - DNA, 21 bp, Homo sapiens
ctgctgtgtggacggcgctgc

SEQ ID NO: 6174839 - DNA, 20 bp, Homo sapiens
ctgctgttatatttcatcat

SEQ ID NO: 6174840 - DNA, 15 bp, Homo sapiens
ctgctgttcccctct

SEQ ID NO: 6174841 - DNA, 22 bp, Homo sapiens
ctgctgttctcaggacagcatc

SEQ ID NO: 6174842 - DNA, 14 bp, Homo sapiens
ctgctgttgaactt

SEQ ID NO: 6174843 - DNA, 15 bp, Homo sapiens
ctgctgttgaacttt

SEQ ID NO: 6174844 - DNA, 13 bp, Homo sapiens
ctgctgttgcctc

SEQ ID NO: 6174845 - DNA, 20 bp, Homo sapiens
ctgctgttgctggactgagg

SEQ ID NO: 6174846 - DNA, 16 bp, Homo sapiens
ctgctgtttacaacat

SEQ ID NO: 6174847 - DNA, 21 bp, Homo sapiens
ctgctgtttcaaaaataaaag

SEQ ID NO: 6174848 - DNA, 14 bp, Homo sapiens
ctgctgttttatgt

SEQ ID NO: 6174849 - DNA, 24 bp, Homo sapiens
ctgctgttttatgtcatactctgt

SEQ ID NO: 6174850 - DNA, 16 bp, Homo sapiens
ctgcttaaaaatgtag

SEQ ID NO: 6174851 - DNA, 16 bp, Homo sapiens
ctgcttaaactggaaa

SEQ ID NO: 6174852 - DNA, 18 bp, Homo sapiens
ctgcttaaagttgtaaca

SEQ ID NO: 6174853 - DNA, 15 bp, Homo sapiens
ctgcttaacttcaca

SEQ ID NO: 6174854 - DNA, 18 bp, Homo sapiens
ctgcttaagtggatctgt

SEQ ID NO: 6174855 - DNA, 22 bp, Homo sapiens
ctgcttaatcctaccccctctt

SEQ ID NO: 6174856 - DNA, 23 bp, Homo sapiens
ctgcttaatcttcaaagccttct

SEQ ID NO: 6174857 - DNA, 13 bp, Homo sapiens
ctgcttaattgct

SEQ ID NO: 6174858 - DNA, 19 bp, Homo sapiens
ctgcttacactccaggtgt

SEQ ID NO: 6174859 - DNA, 23 bp, Homo sapiens
ctgcttaccagataatgctactt

SEQ ID NO: 6174860 - DNA, 17 bp, Homo sapiens
ctgcttactagccctgc

SEQ ID NO: 6174861 - DNA, 20 bp, Homo sapiens
ctgcttagaacccttctgct

SEQ ID NO: 6174862 - DNA, 15 bp, Homo sapiens
ctgcttagaattaac

SEQ ID NO: 6174863 - DNA, 15 bp, Homo sapiens
ctgcttatctgaaac

SEQ ID NO: 6174864 - DNA, 14 bp, Homo sapiens
ctgcttatgaaaag

SEQ ID NO: 6174865 - DNA, 19 bp, Homo sapiens
ctgcttatgatgggctccc

SEQ ID NO: 6174866 - DNA, 23 bp, Homo sapiens
ctgcttatgatgggctccccagg

SEQ ID NO: 6174867 - DNA, 20 bp, Homo sapiens
ctgcttatttattgaaaata

SEQ ID NO: 6174868 - DNA, 16 bp, Homo sapiens
ctgcttatttcatctg

SEQ ID NO: 6174869 - DNA, 20 bp, Homo sapiens
ctgcttcaaagattatctga

SEQ ID NO: 6174870 - DNA, 12 bp, Homo sapiens
ctgcttcaagga

SEQ ID NO: 6174871 - DNA, 23 bp, Homo sapiens
ctgcttcaaggatcctgagccag

SEQ ID NO: 6174872 - DNA, 21 bp, Homo sapiens
ctgcttcaatacccaaatcct

SEQ ID NO: 6174873 - DNA, 15 bp, Homo sapiens
ctgcttcacacccct

SEQ ID NO: 6174874 - DNA, 17 bp, Homo sapiens
ctgcttcacacccctca

SEQ ID NO: 6174875 - DNA, 18 bp, Homo sapiens
ctgcttcaccagactttt

SEQ ID NO: 6174876 - DNA, 23 bp, Homo sapiens
ctgcttcacggactctttgctgt

SEQ ID NO: 6174877 - DNA, 15 bp, Homo sapiens
ctgcttcactaggga

SEQ ID NO: 6174878 - DNA, 23 bp, Homo sapiens
ctgcttcagatgtggagccaggc

SEQ ID NO: 6174879 - DNA, 23 bp, Homo sapiens
ctgcttcagcctcccgagtagct

SEQ ID NO: 6174880 - DNA, 17 bp, Homo sapiens
ctgcttcagtgcagtga

SEQ ID NO: 6174881 - DNA, 12 bp, Homo sapiens
ctgcttcagtgg

SEQ ID NO: 6174882 - DNA, 21 bp, Homo sapiens
ctgcttcagtgtatggaaata

SEQ ID NO: 6174883 - DNA, 20 bp, Homo sapiens
ctgcttcatatctctccctt

SEQ ID NO: 6174884 - DNA, 21 bp, Homo sapiens
ctgcttcatatctctcccttc

SEQ ID NO: 6174885 - DNA, 21 bp, Homo sapiens
ctgcttcatccaatgtgaagt

SEQ ID NO: 6174886 - DNA, 14 bp, Homo sapiens
ctgcttcatttttg

SEQ ID NO: 6174887 - DNA, 15 bp, Homo sapiens
ctgcttccaacaggc

SEQ ID NO: 6174888 - DNA, 18 bp, Homo sapiens
ctgcttccacctcacccc

SEQ ID NO: 6174889 - DNA, 19 bp, Homo sapiens
ctgcttccacctcacccca

SEQ ID NO: 6174890 - DNA, 12 bp, Homo sapiens
ctgcttccactc

SEQ ID NO: 6174891 - DNA, 12 bp, Homo sapiens
ctgcttccagga

SEQ ID NO: 6174892 - DNA, 15 bp, Homo sapiens
ctgcttccaggctgg

SEQ ID NO: 6174893 - DNA, 13 bp, Homo sapiens
ctgcttccaggta

SEQ ID NO: 6174894 - DNA, 19 bp, Homo sapiens
ctgcttccagtgaggctct

SEQ ID NO: 6174895 - DNA, 22 bp, Homo sapiens
ctgcttccagttggactgtggc

SEQ ID NO: 6174896 - DNA, 13 bp, Homo sapiens
ctgcttccatggc

SEQ ID NO: 6174897 - DNA, 20 bp, Homo sapiens
ctgcttccatggcttcctga

SEQ ID NO: 6174898 - DNA, 15 bp, Homo sapiens
ctgcttcccaaactc

SEQ ID NO: 6174899 - DNA, 15 bp, Homo sapiens
ctgcttcccacaact

SEQ ID NO: 6174900 - DNA, 12 bp, Homo sapiens
ctgcttcccact

SEQ ID NO: 6174901 - DNA, 14 bp, Homo sapiens
ctgcttcccactgg

SEQ ID NO: 6174902 - DNA, 17 bp, Homo sapiens
ctgcttcccagaggagc

SEQ ID NO: 6174903 - DNA, 12 bp, Homo sapiens
ctgcttcccatc

SEQ ID NO: 6174904 - DNA, 13 bp, Homo sapiens
ctgcttcccatcc

SEQ ID NO: 6174905 - DNA, 14 bp, Homo sapiens
ctgcttcccatcct

SEQ ID NO: 6174906 - DNA, 17 bp, Homo sapiens
ctgcttcccatgcctgc

SEQ ID NO: 6174907 - DNA, 23 bp, Homo sapiens
ctgcttcccattgagtaatcata

SEQ ID NO: 6174908 - DNA, 15 bp, Homo sapiens
ctgcttcccccactt

SEQ ID NO: 6174909 - DNA, 20 bp, Homo sapiens
ctgcttcccccacttcacct

SEQ ID NO: 6174910 - DNA, 23 bp, Homo sapiens
ctgcttccccctccccctcctgc

SEQ ID NO: 6174911 - DNA, 18 bp, Homo sapiens
ctgcttcccctccctacc

SEQ ID NO: 6174912 - DNA, 19 bp, Homo sapiens
ctgcttcccctccctaccc

SEQ ID NO: 6174913 - DNA, 20 bp, Homo sapiens
ctgcttccctctgcctgtcc

SEQ ID NO: 6174914 - DNA, 14 bp, Homo sapiens
ctgcttccctgggg

SEQ ID NO: 6174915 - DNA, 15 bp, Homo sapiens
ctgcttccctggggc

SEQ ID NO: 6174916 - DNA, 16 bp, Homo sapiens
ctgcttccctggggcc

SEQ ID NO: 6174917 - DNA, 15 bp, Homo sapiens
ctgcttcccttactt

SEQ ID NO: 6174918 - DNA, 22 bp, Homo sapiens
ctgcttccggtagggaggcagc

SEQ ID NO: 6174919 - DNA, 23 bp, Homo sapiens
ctgcttccggtagggaggcagcc

SEQ ID NO: 6174920 - DNA, 16 bp, Homo sapiens
ctgcttccgtatttta

SEQ ID NO: 6174921 - DNA, 10 bp, Homo sapiens
ctgcttccta

SEQ ID NO: 6174922 - DNA, 20 bp, Homo sapiens
ctgcttcctataattttgat

SEQ ID NO: 6174923 - DNA, 11 bp, Homo sapiens
ctgcttcctga

SEQ ID NO: 6174924 - DNA, 12 bp, Homo sapiens
ctgcttcctgaa

SEQ ID NO: 6174925 - DNA, 13 bp, Homo sapiens
ctgcttcctgaaa

SEQ ID NO: 6174926 - DNA, 20 bp, Homo sapiens
ctgcttcctgaaagctgttg

SEQ ID NO: 6174927 - DNA, 18 bp, Homo sapiens
ctgcttcctgaaataaac

SEQ ID NO: 6174928 - DNA, 20 bp, Homo sapiens
ctgcttcctgaaataaacac

SEQ ID NO: 6174929 - DNA, 14 bp, Homo sapiens
ctgcttcctgcttg

SEQ ID NO: 6174930 - DNA, 15 bp, Homo sapiens
ctgcttcctgcttgc

SEQ ID NO: 6174931 - DNA, 14 bp, Homo sapiens
ctgcttcctggacc

SEQ ID NO: 6174932 - DNA, 16 bp, Homo sapiens
ctgcttcctggaccgg

SEQ ID NO: 6174933 - DNA, 17 bp, Homo sapiens
ctgcttcctgtgacagt

SEQ ID NO: 6174934 - DNA, 13 bp, Homo sapiens
ctgcttccttcag

SEQ ID NO: 6174935 - DNA, 13 bp, Homo sapiens
ctgcttccttctg

SEQ ID NO: 6174936 - DNA, 16 bp, Homo sapiens
ctgcttcctttcttga

SEQ ID NO: 6174937 - DNA, 24 bp, Homo sapiens
ctgcttctagaaactctggctcag

SEQ ID NO: 6174938 - DNA, 22 bp, Homo sapiens
ctgcttctccaaaaatctgcct

SEQ ID NO: 6174939 - DNA, 19 bp, Homo sapiens
ctgcttctccacctccccc

SEQ ID NO: 6174940 - DNA, 20 bp, Homo sapiens
ctgcttctcccacttggcca

SEQ ID NO: 6174941 - DNA, 20 bp, Homo sapiens
ctgcttctcccaggcaaggc

SEQ ID NO: 6174942 - DNA, 21 bp, Homo sapiens
ctgcttctcccaggcaaggct

SEQ ID NO: 6174943 - DNA, 12 bp, Homo sapiens
ctgcttctcccc

SEQ ID NO: 6174944 - DNA, 15 bp, Homo sapiens
cttgaaaaagatggc

SEQ ID NO: 6174945 - DNA, 19 bp, Homo sapiens
cttgaaaaagtattgtttt

SEQ ID NO: 6174946 - DNA, 12 bp, Homo sapiens
cttgaaaaatac

SEQ ID NO: 6174947 - DNA, 14 bp, Homo sapiens
cttgaaaaatgaca

SEQ ID NO: 6174948 - DNA, 13 bp, Homo sapiens
cttgaaaaatgtg

SEQ ID NO: 6174949 - DNA, 22 bp, Homo sapiens
cttgaaaaatgtgcaaaacagc

SEQ ID NO: 6174950 - DNA, 11 bp, Homo sapiens
cttgaaaacaa

SEQ ID NO: 6174951 - DNA, 19 bp, Homo sapiens
cttgaaaacctcatttacc

SEQ ID NO: 6174952 - DNA, 22 bp, Homo sapiens
cttgaaaacctcatttaccata

SEQ ID NO: 6174953 - DNA, 18 bp, Homo sapiens
cttgaaaacttctcattt

SEQ ID NO: 6174954 - DNA, 19 bp, Homo sapiens
cttgaaaagaaagaaacca

SEQ ID NO: 6174955 - DNA, 16 bp, Homo sapiens
cttgaaaagaaagtgt

SEQ ID NO: 6174956 - DNA, 14 bp, Homo sapiens
cttgaaaagattgc

SEQ ID NO: 6174957 - DNA, 18 bp, Homo sapiens
cttgaaaagattgcaaag

SEQ ID NO: 6174958 - DNA, 13 bp, Homo sapiens
cttgaaaagtgtg

SEQ ID NO: 6174959 - DNA, 14 bp, Homo sapiens
cttgaaaagtgtgt

SEQ ID NO: 6174960 - DNA, 11 bp, Homo sapiens
cttgaaaagtt

SEQ ID NO: 6174961 - DNA, 19 bp, Homo sapiens
cttgaaaagttcagggacc

SEQ ID NO: 6174962 - DNA, 20 bp, Homo sapiens
cttgaaaagttcagggaccg

SEQ ID NO: 6174963 - DNA, 19 bp, Homo sapiens
cttgaaaataaaaagagaa

SEQ ID NO: 6174964 - DNA, 16 bp, Homo sapiens
cttgaaaataagaata

SEQ ID NO: 6174965 - DNA, 16 bp, Homo sapiens
cttgaaaatgccacca

SEQ ID NO: 6174966 - DNA, 18 bp, Homo sapiens
cttgaaaattaacatgaa

SEQ ID NO: 6174967 - DNA, 22 bp, Homo sapiens
cttgaaacagattcaggccagc

SEQ ID NO: 6174968 - DNA, 15 bp, Homo sapiens
cttgaaacagcctgg

SEQ ID NO: 6174969 - DNA, 17 bp, Homo sapiens
cttgaaaccagtattta

SEQ ID NO: 6174970 - DNA, 14 bp, Homo sapiens
cttgaaacctgatg

SEQ ID NO: 6174971 - DNA, 17 bp, Homo sapiens
cttgaaacctgatgtca

SEQ ID NO: 6174972 - DNA, 21 bp, Homo sapiens
cttgaaacctgttaaaacaac

SEQ ID NO: 6174973 - DNA, 13 bp, Homo sapiens
cttgaaagaaatg

SEQ ID NO: 6174974 - DNA, 17 bp, Homo sapiens
cttgaaagaattttcct

SEQ ID NO: 6174975 - DNA, 20 bp, Homo sapiens
cttgaaagattttattgtat

SEQ ID NO: 6174976 - DNA, 16 bp, Homo sapiens
cttgaaagcatccatg

SEQ ID NO: 6174977 - DNA, 17 bp, Homo sapiens
cttgaaagcatccatgt

SEQ ID NO: 6174978 - DNA, 20 bp, Homo sapiens
cttgaaagcatccatgtgtg

SEQ ID NO: 6174979 - DNA, 23 bp, Homo sapiens
cttgaaagcgaaatacttgaaaa

SEQ ID NO: 6174980 - DNA, 13 bp, Homo sapiens
cttgaaagtagga

SEQ ID NO: 6174981 - DNA, 20 bp, Homo sapiens
cttgaaagtcatgaacacat

SEQ ID NO: 6174982 - DNA, 16 bp, Homo sapiens
cttgaaagttttccag

SEQ ID NO: 6174983 - DNA, 15 bp, Homo sapiens
cttgaaataagttgt

SEQ ID NO: 6174984 - DNA, 22 bp, Homo sapiens
cttgaaataccagtgaaccaaa

SEQ ID NO: 6174985 - DNA, 23 bp, Homo sapiens
cttgaaatacgtttgtgtttcta

SEQ ID NO: 6174986 - DNA, 18 bp, Homo sapiens
cttgaaatatcctgcttg

SEQ ID NO: 6174987 - DNA, 15 bp, Homo sapiens
cttgaaatattcaga

SEQ ID NO: 6174988 - DNA, 21 bp, Homo sapiens
cttgaaatctaatatttctag

SEQ ID NO: 6174989 - DNA, 17 bp, Homo sapiens
cttgaaatgaaagggaa

SEQ ID NO: 6174990 - DNA, 21 bp, Homo sapiens
cttgaaatgctcttttgcaca

SEQ ID NO: 6174991 - DNA, 16 bp, Homo sapiens
cttgaaattactgtgt

SEQ ID NO: 6174992 - DNA, 17 bp, Homo sapiens
cttgaaattactgtgta

SEQ ID NO: 6174993 - DNA, 17 bp, Homo sapiens
cttgaaattatatctgt

SEQ ID NO: 6174994 - DNA, 20 bp, Homo sapiens
cttgaaattatatctgtggt

SEQ ID NO: 6174995 - DNA, 13 bp, Homo sapiens
cttgaaattgatt

SEQ ID NO: 6174996 - DNA, 17 bp, Homo sapiens
cttgaaattgattaact

SEQ ID NO: 6174997 - DNA, 13 bp, Homo sapiens
cttgaaatttaga

SEQ ID NO: 6174998 - DNA, 17 bp, Homo sapiens
cttgaaatttctcagcg

SEQ ID NO: 6174999 - DNA, 19 bp, Homo sapiens
cttgaaatttgaattttgt

SEQ ID NO: 6175000 - DNA, 13 bp, Homo sapiens
cttgaaattttaa

SEQ ID NO: 6175001 - DNA, 19 bp, Homo sapiens
cttgaaattttaaactata

SEQ ID NO: 6175002 - DNA, 15 bp, Homo sapiens
cttgaaattttaacc

SEQ ID NO: 6175003 - DNA, 19 bp, Homo sapiens
cttgaacaaaagggtcaga

SEQ ID NO: 6175004 - DNA, 22 bp, Homo sapiens
cttgaacaaaagggtcagagga

SEQ ID NO: 6175005 - DNA, 15 bp, Homo sapiens
cttgaacaaagacat

SEQ ID NO: 6175006 - DNA, 17 bp, Homo sapiens
cttgaacaaagacattt

SEQ ID NO: 6175007 - DNA, 20 bp, Homo sapiens
cttgaacaaagacatttata

SEQ ID NO: 6175008 - DNA, 21 bp, Homo sapiens
cttgaacaacccaatctggct

SEQ ID NO: 6175009 - DNA, 22 bp, Homo sapiens
cttgaacaacccaatctggctg

SEQ ID NO: 6175010 - DNA, 16 bp, Homo sapiens
cttgaacacagtattt

SEQ ID NO: 6175011 - DNA, 20 bp, Homo sapiens
cttgaacacagtattttccc

SEQ ID NO: 6175012 - DNA, 16 bp, Homo sapiens
cttgaacccaacagtc

SEQ ID NO: 6175013 - DNA, 15 bp, Homo sapiens
cttgaacccaggaga

SEQ ID NO: 6175014 - DNA, 14 bp, Homo sapiens
cttgaaccccctcc

SEQ ID NO: 6175015 - DNA, 20 bp, Homo sapiens
cttgaacccgggaggcagag

SEQ ID NO: 6175016 - DNA, 22 bp, Homo sapiens
cttgaaccctaataagacccca

SEQ ID NO: 6175017 - DNA, 18 bp, Homo sapiens
cttgaacctatgaagcaa

SEQ ID NO: 6175018 - DNA, 15 bp, Homo sapiens
cttgaacctgcttcc

SEQ ID NO: 6175019 - DNA, 16 bp, Homo sapiens
cttgaacctgcttcct

SEQ ID NO: 6175020 - DNA, 14 bp, Homo sapiens
cttgaacctgggaa

SEQ ID NO: 6175021 - DNA, 16 bp, Homo sapiens
cttgaacctgggaggt

SEQ ID NO: 6175022 - DNA, 21 bp, Homo sapiens
cttgaacctgtgagtaaatat

SEQ ID NO: 6175023 - DNA, 18 bp, Homo sapiens
cttgaacgagcagcccag

SEQ ID NO: 6175024 - DNA, 19 bp, Homo sapiens
cttgaacgagcagcccagg

SEQ ID NO: 6175025 - DNA, 20 bp, Homo sapiens
cttgaacgagcagcccaggg

SEQ ID NO: 6175026 - DNA, 18 bp, Homo sapiens
cttgaacgttttctaatt

SEQ ID NO: 6175027 - DNA, 22 bp, Homo sapiens
cttgaacgttttctaattgctt

SEQ ID NO: 6175028 - DNA, 15 bp, Homo sapiens
cttgaactcctgacc

SEQ ID NO: 6175029 - DNA, 16 bp, Homo sapiens
cttgaactcctgacct

SEQ ID NO: 6175030 - DNA, 13 bp, Homo sapiens
cttgaactcctgg

SEQ ID NO: 6175031 - DNA, 18 bp, Homo sapiens
cttgaactcctggcctca

SEQ ID NO: 6175032 - DNA, 14 bp, Homo sapiens
cttgaactcttggc

SEQ ID NO: 6175033 - DNA, 17 bp, Homo sapiens
cttgaactcttggcctc

SEQ ID NO: 6175034 - DNA, 15 bp, Homo sapiens
cttgaactgaggccc

SEQ ID NO: 6175035 - DNA, 16 bp, Homo sapiens
cttgaactgaggccct

SEQ ID NO: 6175036 - DNA, 14 bp, Homo sapiens
cttgaactgggctc

SEQ ID NO: 6175037 - DNA, 15 bp, Homo sapiens
cttgaactgggctca

SEQ ID NO: 6175038 - DNA, 13 bp, Homo sapiens
cttgaactgtcag

SEQ ID NO: 6175039 - DNA, 17 bp, Homo sapiens
cttgaactgtggccacc

SEQ ID NO: 6175040 - DNA, 22 bp, Homo sapiens
cttgaactgttctggcctcaga

SEQ ID NO: 6175041 - DNA, 22 bp, Homo sapiens
cttgaacttagatgttaaatgt

SEQ ID NO: 6175042 - DNA, 16 bp, Homo sapiens
cttgaacttgaaaaaa

SEQ ID NO: 6175043 - DNA, 15 bp, Homo sapiens
cttgaacttgcctct

SEQ ID NO: 6175044 - DNA, 18 bp, Homo sapiens
cttgaacttgcctctttt

SEQ ID NO: 6175045 - DNA, 13 bp, Homo sapiens
cttgaactttcca

SEQ ID NO: 6175046 - DNA, 15 bp, Homo sapiens
cttgaactttgacct

SEQ ID NO: 6175047 - DNA, 21 bp, Homo sapiens
cttgaactttgacctctgcag

SEQ ID NO: 6175048 - DNA, 19 bp, Homo sapiens
cttgaagaaaatgacttta

SEQ ID NO: 6175049 - DNA, 22 bp, Homo sapiens
cttgaagaaacagagtggcctc

SEQ ID NO: 6175050 - DNA, 14 bp, Homo sapiens
cttgaagaactgac

SEQ ID NO: 6175051 - DNA, 16 bp, Homo sapiens
cttgaagaaggaaaga

SEQ ID NO: 6175052 - DNA, 21 bp, Homo sapiens
cttgaagaaggggctgttctt

SEQ ID NO: 6175053 - DNA, 16 bp, Homo sapiens
cttgaagaatattccc

SEQ ID NO: 6175054 - DNA, 14 bp, Homo sapiens
cttgaagaatattg

SEQ ID NO: 6175055 - DNA, 18 bp, Homo sapiens
cttgaagaatattgttaa

SEQ ID NO: 6175056 - DNA, 15 bp, Homo sapiens
cttgaagactccctg

SEQ ID NO: 6175057 - DNA, 13 bp, Homo sapiens
cttgaagcaaatg

SEQ ID NO: 6175058 - DNA, 15 bp, Homo sapiens
cttgaagcaaatgtg

SEQ ID NO: 6175059 - DNA, 12 bp, Homo sapiens
cttgaagcaata

SEQ ID NO: 6175060 - DNA, 16 bp, Homo sapiens
cttgaagccactgaag

SEQ ID NO: 6175061 - DNA, 19 bp, Homo sapiens
cttgaagccactgaagctg

SEQ ID NO: 6175062 - DNA, 18 bp, Homo sapiens
cttgaagcctaaatttgt

SEQ ID NO: 6175063 - DNA, 15 bp, Homo sapiens
cttgaagcctgctcc

SEQ ID NO: 6175064 - DNA, 20 bp, Homo sapiens
cttgaagctgggctgtctct

SEQ ID NO: 6175065 - DNA, 11 bp, Homo sapiens
cttgaagctgt

SEQ ID NO: 6175066 - DNA, 15 bp, Homo sapiens
cttgaagcttgtatc

SEQ ID NO: 6175067 - DNA, 19 bp, Homo sapiens
cttgaagcttgtatctgat

SEQ ID NO: 6175068 - DNA, 14 bp, Homo sapiens
cttgaaggaaaaat

SEQ ID NO: 6175069 - DNA, 18 bp, Homo sapiens
cttgaaggactgcagaca

SEQ ID NO: 6175070 - DNA, 20 bp, Homo sapiens
cttgaaggccacatgtgaaa

SEQ ID NO: 6175071 - DNA, 15 bp, Homo sapiens
cttgaaggccctgct

SEQ ID NO: 6175072 - DNA, 21 bp, Homo sapiens
cttgaaggccctgctgagtca

SEQ ID NO: 6175073 - DNA, 15 bp, Homo sapiens
cttgaagggcccagg

SEQ ID NO: 6175074 - DNA, 17 bp, Homo sapiens
cttgaaggtacacccca

SEQ ID NO: 6175075 - DNA, 23 bp, Homo sapiens
cttgaaggtatatctaggtttat

SEQ ID NO: 6175076 - DNA, 14 bp, Homo sapiens
cttgaaggtgctga

SEQ ID NO: 6175077 - DNA, 17 bp, Homo sapiens
cttgaaggtgctgccac

SEQ ID NO: 6175078 - DNA, 18 bp, Homo sapiens
cttgaaggtgctgccacc

SEQ ID NO: 6175079 - DNA, 17 bp, Homo sapiens
cttgaaggtttgatgcc

SEQ ID NO: 6175080 - DNA, 22 bp, Homo sapiens
cttgaagtaactataacaaaaa

SEQ ID NO: 6175081 - DNA, 23 bp, Homo sapiens
cttgaagtccaggactgggtctg

SEQ ID NO: 6175082 - DNA, 13 bp, Homo sapiens
cttgaagtcctgg

SEQ ID NO: 6175083 - DNA, 17 bp, Homo sapiens
cttgaagtcctggcttc

SEQ ID NO: 6175084 - DNA, 18 bp, Homo sapiens
cttgaagtcctggcttca

SEQ ID NO: 6175085 - DNA, 19 bp, Homo sapiens
cttgaagtcctggcttcag

SEQ ID NO: 6175086 - DNA, 22 bp, Homo sapiens
cttgaagtgaacaaatttcaaa

SEQ ID NO: 6175087 - DNA, 17 bp, Homo sapiens
cttgaagtgactgttgt

SEQ ID NO: 6175088 - DNA, 19 bp, Homo sapiens
cttgaagttctgaaattta

SEQ ID NO: 6175089 - DNA, 20 bp, Homo sapiens
cttgaagttctgaaatttaa

SEQ ID NO: 6175090 - DNA, 20 bp, Homo sapiens
cttgaagttgtggaggaggt

SEQ ID NO: 6175091 - DNA, 17 bp, Homo sapiens
cttgaataagagtgatt

SEQ ID NO: 6175092 - DNA, 20 bp, Homo sapiens
cttgaatagattttctctgg

SEQ ID NO: 6175093 - DNA, 21 bp, Homo sapiens
cttgaatagattttctctgga

SEQ ID NO: 6175094 - DNA, 13 bp, Homo sapiens
cttgaatagtatt

SEQ ID NO: 6175095 - DNA, 15 bp, Homo sapiens
cttgaatataaaaaa

SEQ ID NO: 6175096 - DNA, 16 bp, Homo sapiens
cttgaatatgggtggc

SEQ ID NO: 6175097 - DNA, 19 bp, Homo sapiens
cttgaatattcctggactt

SEQ ID NO: 6175098 - DNA, 14 bp, Homo sapiens
cttgaatcagtttt

SEQ ID NO: 6175099 - DNA, 22 bp, Homo sapiens
cttgaatcagtttttaaaatat

SEQ ID NO: 6175100 - DNA, 18 bp, Homo sapiens
cttgaatctgttactgaa

SEQ ID NO: 6175101 - DNA, 19 bp, Homo sapiens
cttgaatctgttactgaaa

SEQ ID NO: 6175102 - DNA, 20 bp, Homo sapiens
cttgaatctttttatcccat

SEQ ID NO: 6175103 - DNA, 13 bp, Homo sapiens
cttgaatgctgcc

SEQ ID NO: 6175104 - DNA, 15 bp, Homo sapiens
cttgaatgctgccag

SEQ ID NO: 6175105 - DNA, 16 bp, Homo sapiens
cttgaatgctgccagt

SEQ ID NO: 6175106 - DNA, 19 bp, Homo sapiens
cttgaatgcttaaatgatc

SEQ ID NO: 6175107 - DNA, 23 bp, Homo sapiens
cttgaatggcaatgttttgcttt

SEQ ID NO: 6175108 - DNA, 23 bp, Homo sapiens
cttgaatggttaataaaactgca

SEQ ID NO: 6175109 - DNA, 16 bp, Homo sapiens
cttgaatgtagcagcc

SEQ ID NO: 6175110 - DNA, 20 bp, Homo sapiens
cttgaatgtagcagccccgg

SEQ ID NO: 6175111 - DNA, 19 bp, Homo sapiens
cttgaatgtccccattcta

SEQ ID NO: 6175112 - DNA, 21 bp, Homo sapiens
cttgaatgtccccattctata

SEQ ID NO: 6175113 - DNA, 13 bp, Homo sapiens
cttgaatgtcttt

SEQ ID NO: 6175114 - DNA, 20 bp, Homo sapiens
cttgaatgtggcttgagaaa

SEQ ID NO: 6175115 - DNA, 22 bp, Homo sapiens
cttgaatgtggcttgagaaata

SEQ ID NO: 6175116 - DNA, 17 bp, Homo sapiens
cttgaatgtggtctcag

SEQ ID NO: 6175117 - DNA, 17 bp, Homo sapiens
cttgaattagtatttca

SEQ ID NO: 6175118 - DNA, 17 bp, Homo sapiens
cttgaattcctctcaaa

SEQ ID NO: 6175119 - DNA, 20 bp, Homo sapiens
cttgaattgcattttttaaa

SEQ ID NO: 6175120 - DNA, 16 bp, Homo sapiens
cttgaattgttatgaa

SEQ ID NO: 6175121 - DNA, 21 bp, Homo sapiens
cttgaatttctagacagtatt

SEQ ID NO: 6175122 - DNA, 13 bp, Homo sapiens
cttgaatttctga

SEQ ID NO: 6175123 - DNA, 14 bp, Homo sapiens
ctgcttctcccccc

SEQ ID NO: 6175124 - DNA, 16 bp, Homo sapiens
ctgcttctccccccat

SEQ ID NO: 6175125 - DNA, 15 bp, Homo sapiens
ctgcttctcccgcca

SEQ ID NO: 6175126 - DNA, 13 bp, Homo sapiens
ctgcttctccctg

SEQ ID NO: 6175127 - DNA, 14 bp, Homo sapiens
ctgcttctccctgg

SEQ ID NO: 6175128 - DNA, 15 bp, Homo sapiens
ctgcttctccctggc

SEQ ID NO: 6175129 - DNA, 16 bp, Homo sapiens
ctgcttctcggccagc

SEQ ID NO: 6175130 - DNA, 17 bp, Homo sapiens
ctgcttctcggccagcc

SEQ ID NO: 6175131 - DNA, 23 bp, Homo sapiens
ctgcttctcggggtccagtgcat

SEQ ID NO: 6175132 - DNA, 22 bp, Homo sapiens
ctgcttctctctctctcacaca

SEQ ID NO: 6175133 - DNA, 13 bp, Homo sapiens
ctgcttctctgac

SEQ ID NO: 6175134 - DNA, 14 bp, Homo sapiens
ctgcttctctgact

SEQ ID NO: 6175135 - DNA, 19 bp, Homo sapiens
ctgcttctctgacttctgc

SEQ ID NO: 6175136 - DNA, 22 bp, Homo sapiens
ctgcttctctgacttctgcctg

SEQ ID NO: 6175137 - DNA, 19 bp, Homo sapiens
ctgcttctctgcccagctt

SEQ ID NO: 6175138 - DNA, 13 bp, Homo sapiens
ctgcttctcttta

SEQ ID NO: 6175139 - DNA, 14 bp, Homo sapiens
ctgcttctctttca

SEQ ID NO: 6175140 - DNA, 14 bp, Homo sapiens
ctgcttctctttgt

SEQ ID NO: 6175141 - DNA, 20 bp, Homo sapiens
ctgcttctgaactcaagctg

SEQ ID NO: 6175142 - DNA, 13 bp, Homo sapiens
ctgcttctgcacc

SEQ ID NO: 6175143 - DNA, 13 bp, Homo sapiens
ctgcttctgccca

SEQ ID NO: 6175144 - DNA, 23 bp, Homo sapiens
ctgcttctgcccaccccgcctct

SEQ ID NO: 6175145 - DNA, 16 bp, Homo sapiens
ctgcttctgctccagc

SEQ ID NO: 6175146 - DNA, 15 bp, Homo sapiens
ctgcttctgctgccc

SEQ ID NO: 6175147 - DNA, 18 bp, Homo sapiens
ctgcttctgctgccctga

SEQ ID NO: 6175148 - DNA, 15 bp, Homo sapiens
ctgcttctgctgcct

SEQ ID NO: 6175149 - DNA, 12 bp, Homo sapiens
ctgcttctggcg

SEQ ID NO: 6175150 - DNA, 13 bp, Homo sapiens
ctgcttctggggc

SEQ ID NO: 6175151 - DNA, 14 bp, Homo sapiens
ctgcttctggggct

SEQ ID NO: 6175152 - DNA, 16 bp, Homo sapiens
ctgcttctgtccagga

SEQ ID NO: 6175153 - DNA, 23 bp, Homo sapiens
ctgcttctgtgcatttgtgtctg

SEQ ID NO: 6175154 - DNA, 14 bp, Homo sapiens
ctgcttcttcatct

SEQ ID NO: 6175155 - DNA, 19 bp, Homo sapiens
ctgcttcttcatcttgaca

SEQ ID NO: 6175156 - DNA, 18 bp, Homo sapiens
ctgcttcttcccctctgc

SEQ ID NO: 6175157 - DNA, 18 bp, Homo sapiens
ctgcttcttctctccaca

SEQ ID NO: 6175158 - DNA, 18 bp, Homo sapiens
ctgcttcttcttccaaat

SEQ ID NO: 6175159 - DNA, 19 bp, Homo sapiens
ctgcttcttgctggtgaaa

SEQ ID NO: 6175160 - DNA, 15 bp, Homo sapiens
ctgcttcttggagct

SEQ ID NO: 6175161 - DNA, 14 bp, Homo sapiens
ctgcttctttccag

SEQ ID NO: 6175162 - DNA, 19 bp, Homo sapiens
ctgcttgaactgctgccaa

SEQ ID NO: 6175163 - DNA, 17 bp, Homo sapiens
ctgcttgaaggaacagt

SEQ ID NO: 6175164 - DNA, 20 bp, Homo sapiens
ctgcttgaaggaacagtgct

SEQ ID NO: 6175165 - DNA, 23 bp, Homo sapiens
ctgcttgaaggaacagtgctgtt

SEQ ID NO: 6175166 - DNA, 15 bp, Homo sapiens
ctgcttgactgtaac

SEQ ID NO: 6175167 - DNA, 16 bp, Homo sapiens
ctgcttgactttccag

SEQ ID NO: 6175168 - DNA, 18 bp, Homo sapiens
ctgcttgactttccagaa

SEQ ID NO: 6175169 - DNA, 20 bp, Homo sapiens
ctgcttgagaatattgaagt

SEQ ID NO: 6175170 - DNA, 20 bp, Homo sapiens
ctgcttgagctttctgtgca

SEQ ID NO: 6175171 - DNA, 22 bp, Homo sapiens
ctgcttgagctttctgtgcatg

SEQ ID NO: 6175172 - DNA, 12 bp, Homo sapiens
ctgcttgaggaa

SEQ ID NO: 6175173 - DNA, 14 bp, Homo sapiens
ctgcttgaggaaaa

SEQ ID NO: 6175174 - DNA, 16 bp, Homo sapiens
ctgcttgaggaggggc

SEQ ID NO: 6175175 - DNA, 21 bp, Homo sapiens
ctgcttgaggaggggcacctg

SEQ ID NO: 6175176 - DNA, 23 bp, Homo sapiens
ctgcttgaggaggggcacctgcc

SEQ ID NO: 6175177 - DNA, 19 bp, Homo sapiens
ctgcttgagggagaatcct

SEQ ID NO: 6175178 - DNA, 18 bp, Homo sapiens
ctgcttgagtggacagca

SEQ ID NO: 6175179 - DNA, 17 bp, Homo sapiens
ctgcttgatgaagcaag

SEQ ID NO: 6175180 - DNA, 18 bp, Homo sapiens
ctgcttgatgaagcaagg

SEQ ID NO: 6175181 - DNA, 21 bp, Homo sapiens
ctgcttgatgggattctggac

SEQ ID NO: 6175182 - DNA, 13 bp, Homo sapiens
ctgcttgattttt

SEQ ID NO: 6175183 - DNA, 20 bp, Homo sapiens
ctgcttgcacacttccccat

SEQ ID NO: 6175184 - DNA, 18 bp, Homo sapiens
ctgcttgcaggaggccaa

SEQ ID NO: 6175185 - DNA, 22 bp, Homo sapiens
ctgcttgcaggaggccaaactg

SEQ ID NO: 6175186 - DNA, 12 bp, Homo sapiens
ctgcttgcattt

SEQ ID NO: 6175187 - DNA, 18 bp, Homo sapiens
ctgcttgccaaggcagag

SEQ ID NO: 6175188 - DNA, 21 bp, Homo sapiens
ctgcttgccaaggcagaggcc

SEQ ID NO: 6175189 - DNA, 13 bp, Homo sapiens
ctgcttgccagcc

SEQ ID NO: 6175190 - DNA, 15 bp, Homo sapiens
ctgcttgccagccag

SEQ ID NO: 6175191 - DNA, 15 bp, Homo sapiens
ctgcttgccatccct

SEQ ID NO: 6175192 - DNA, 20 bp, Homo sapiens
ctgcttgccatccctccctc

SEQ ID NO: 6175193 - DNA, 21 bp, Homo sapiens
ctgcttgcccaagtcacacag

SEQ ID NO: 6175194 - DNA, 19 bp, Homo sapiens
ctgcttgcccgctcccaca

SEQ ID NO: 6175195 - DNA, 20 bp, Homo sapiens
ctgcttgccgaaactggaag

SEQ ID NO: 6175196 - DNA, 19 bp, Homo sapiens
ctgcttgctcccaagcccc

SEQ ID NO: 6175197 - DNA, 15 bp, Homo sapiens
ctgcttgctggaaaa

SEQ ID NO: 6175198 - DNA, 23 bp, Homo sapiens
ctgcttgctggaaaactgccaca

SEQ ID NO: 6175199 - DNA, 22 bp, Homo sapiens
ctgcttggaagaaggaaacgga

SEQ ID NO: 6175200 - DNA, 23 bp, Homo sapiens
ctgcttggacggattccttggca

SEQ ID NO: 6175201 - DNA, 17 bp, Homo sapiens
ctgcttggagctgagca

SEQ ID NO: 6175202 - DNA, 23 bp, Homo sapiens
ctgcttggagtgccccaaggagg

SEQ ID NO: 6175203 - DNA, 13 bp, Homo sapiens
ctgcttggatcca

SEQ ID NO: 6175204 - DNA, 18 bp, Homo sapiens
ctgcttggatccatacaa

SEQ ID NO: 6175205 - DNA, 22 bp, Homo sapiens
ctgcttggatccatacaaaact

SEQ ID NO: 6175206 - DNA, 23 bp, Homo sapiens
ctgcttggcagttgcagtgctgc

SEQ ID NO: 6175207 - DNA, 15 bp, Homo sapiens
ctgcttggccagatg

SEQ ID NO: 6175208 - DNA, 18 bp, Homo sapiens
ctgcttggcccagggggc

SEQ ID NO: 6175209 - DNA, 23 bp, Homo sapiens
ctgcttggcccagggggcttcct

SEQ ID NO: 6175210 - DNA, 22 bp, Homo sapiens
ctgcttggcccggccggcctgg

SEQ ID NO: 6175211 - DNA, 17 bp, Homo sapiens
ctgcttggcccttcaag

SEQ ID NO: 6175212 - DNA, 15 bp, Homo sapiens
ctgcttggctgtccc

SEQ ID NO: 6175213 - DNA, 16 bp, Homo sapiens
ctgcttggctgtcccc

SEQ ID NO: 6175214 - DNA, 22 bp, Homo sapiens
ctgcttgggacgtgtacagcac

SEQ ID NO: 6175215 - DNA, 15 bp, Homo sapiens
ctgcttggggcctgg

SEQ ID NO: 6175216 - DNA, 19 bp, Homo sapiens
ctgcttggggggtgatgag

SEQ ID NO: 6175217 - DNA, 15 bp, Homo sapiens
ctgcttggtcaaatc

SEQ ID NO: 6175218 - DNA, 19 bp, Homo sapiens
ctgcttgtactaagccagg

SEQ ID NO: 6175219 - DNA, 23 bp, Homo sapiens
ctgcttgtactaagccaggaggc

SEQ ID NO: 6175220 - DNA, 12 bp, Homo sapiens
ctgcttgtcaaa

SEQ ID NO: 6175221 - DNA, 18 bp, Homo sapiens
ctgcttgtcattctgcta

SEQ ID NO: 6175222 - DNA, 13 bp, Homo sapiens
ctgcttgtcctgc

SEQ ID NO: 6175223 - DNA, 19 bp, Homo sapiens
ctgcttgtgaaaggaaaga

SEQ ID NO: 6175224 - DNA, 14 bp, Homo sapiens
ctgcttgtgacctt

SEQ ID NO: 6175225 - DNA, 15 bp, Homo sapiens
ctgcttgtgaccttg

SEQ ID NO: 6175226 - DNA, 16 bp, Homo sapiens
ctgcttgtgcctccct

SEQ ID NO: 6175227 - DNA, 22 bp, Homo sapiens
ctgcttgtgcctcccttcccag

SEQ ID NO: 6175228 - DNA, 17 bp, Homo sapiens
ctgcttgtgttgggccc

SEQ ID NO: 6175229 - DNA, 19 bp, Homo sapiens
ctgcttgtgttgggcccca

SEQ ID NO: 6175230 - DNA, 16 bp, Homo sapiens
ctgcttgttgtcaagt

SEQ ID NO: 6175231 - DNA, 20 bp, Homo sapiens
ctgcttgttgtcaagtataa

SEQ ID NO: 6175232 - DNA, 19 bp, Homo sapiens
ctgctttaaaaatgtctta

SEQ ID NO: 6175233 - DNA, 17 bp, Homo sapiens
ctgctttaaattaaaat

SEQ ID NO: 6175234 - DNA, 18 bp, Homo sapiens
ctgctttaaattaaaatt

SEQ ID NO: 6175235 - DNA, 17 bp, Homo sapiens
ctgctttaaccacccca

SEQ ID NO: 6175236 - DNA, 13 bp, Homo sapiens
ctgctttaatcag

SEQ ID NO: 6175237 - DNA, 14 bp, Homo sapiens
ctgctttaattacc

SEQ ID NO: 6175238 - DNA, 21 bp, Homo sapiens
ctgctttaattacctggtgag

SEQ ID NO: 6175239 - DNA, 17 bp, Homo sapiens
ctgctttagacttgaaa

SEQ ID NO: 6175240 - DNA, 19 bp, Homo sapiens
ctgctttagacttgaaaag

SEQ ID NO: 6175241 - DNA, 17 bp, Homo sapiens
ctgctttagtttcacat

SEQ ID NO: 6175242 - DNA, 9 bp, Homo sapiens
ctgctttat

SEQ ID NO: 6175243 - DNA, 22 bp, Homo sapiens
ctgctttattgcctctgtctta

SEQ ID NO: 6175244 - DNA, 13 bp, Homo sapiens
ctgctttcaactt

SEQ ID NO: 6175245 - DNA, 15 bp, Homo sapiens
ctgctttcaacttaa

SEQ ID NO: 6175246 - DNA, 12 bp, Homo sapiens
ctgctttcaagt

SEQ ID NO: 6175247 - DNA, 14 bp, Homo sapiens
ctgctttcactgtg

SEQ ID NO: 6175248 - DNA, 15 bp, Homo sapiens
ctgctttcacttaag

SEQ ID NO: 6175249 - DNA, 14 bp, Homo sapiens
ctgctttcccctgt

SEQ ID NO: 6175250 - DNA, 16 bp, Homo sapiens
ctgctttcccctgtgg

SEQ ID NO: 6175251 - DNA, 17 bp, Homo sapiens
ctgctttcccctgtggg

SEQ ID NO: 6175252 - DNA, 20 bp, Homo sapiens
ctgctttcccctgtggggat

SEQ ID NO: 6175253 - DNA, 24 bp, Homo sapiens
ctgctttcctatctagcatttatt

SEQ ID NO: 6175254 - DNA, 13 bp, Homo sapiens
ctgctttccttcg

SEQ ID NO: 6175255 - DNA, 17 bp, Homo sapiens
ctgctttcgaataaagt

SEQ ID NO: 6175256 - DNA, 13 bp, Homo sapiens
ctgctttctccaa

SEQ ID NO: 6175257 - DNA, 16 bp, Homo sapiens
ctgctttctccattgt

SEQ ID NO: 6175258 - DNA, 22 bp, Homo sapiens
ctgctttctccattgtaaacca

SEQ ID NO: 6175259 - DNA, 14 bp, Homo sapiens
ctgctttctcctgg

SEQ ID NO: 6175260 - DNA, 13 bp, Homo sapiens
ctgctttctcttt

SEQ ID NO: 6175261 - DNA, 19 bp, Homo sapiens
ctgctttctgatacatctg

SEQ ID NO: 6175262 - DNA, 21 bp, Homo sapiens
ctgctttctgttcatctcttt

SEQ ID NO: 6175263 - DNA, 17 bp, Homo sapiens
ctgctttctgttccaaa

SEQ ID NO: 6175264 - DNA, 18 bp, Homo sapiens
ctgctttctgttccaaat

SEQ ID NO: 6175265 - DNA, 22 bp, Homo sapiens
ctgctttcttgccacacagtgg

SEQ ID NO: 6175266 - DNA, 14 bp, Homo sapiens
ctgctttctttgat

SEQ ID NO: 6175267 - DNA, 15 bp, Homo sapiens
ctgctttctttgatt

SEQ ID NO: 6175268 - DNA, 20 bp, Homo sapiens
ctgctttgacgggccaggcc

SEQ ID NO: 6175269 - DNA, 23 bp, Homo sapiens
ctgctttgagctacaggacaaag

SEQ ID NO: 6175270 - DNA, 15 bp, Homo sapiens
ctgctttgcatcttt

SEQ ID NO: 6175271 - DNA, 17 bp, Homo sapiens
ctgctttgcatctttgt

SEQ ID NO: 6175272 - DNA, 22 bp, Homo sapiens
ctgctttgcctcgaaagtgtca

SEQ ID NO: 6175273 - DNA, 18 bp, Homo sapiens
ctgctttgcctctaccag

SEQ ID NO: 6175274 - DNA, 18 bp, Homo sapiens
ctgctttgcgctggtgga

SEQ ID NO: 6175275 - DNA, 14 bp, Homo sapiens
ctgctttgcttctt

SEQ ID NO: 6175276 - DNA, 13 bp, Homo sapiens
ctgctttggaaat

SEQ ID NO: 6175277 - DNA, 21 bp, Homo sapiens
ctgctttggatagtctcctac

SEQ ID NO: 6175278 - DNA, 16 bp, Homo sapiens
ctgctttggcagtgcc

SEQ ID NO: 6175279 - DNA, 16 bp, Homo sapiens
ctgctttggctgaggg

SEQ ID NO: 6175280 - DNA, 20 bp, Homo sapiens
ctgctttggctgaggggctt

SEQ ID NO: 6175281 - DNA, 23 bp, Homo sapiens
ctgctttgggatttaatttccag

SEQ ID NO: 6175282 - DNA, 17 bp, Homo sapiens
ctgctttgggctgccct

SEQ ID NO: 6175283 - DNA, 18 bp, Homo sapiens
ctgctttgggctgccctg

SEQ ID NO: 6175284 - DNA, 19 bp, Homo sapiens
ctgctttgggctgccctgg

SEQ ID NO: 6175285 - DNA, 21 bp, Homo sapiens
ctgctttgggctgccctggtg

SEQ ID NO: 6175286 - DNA, 22 bp, Homo sapiens
ctgctttgggctgccctggtgc

SEQ ID NO: 6175287 - DNA, 17 bp, Homo sapiens
ctgctttggtcttgccc

SEQ ID NO: 6175288 - DNA, 21 bp, Homo sapiens
ctgctttgtagtttgcccaga

SEQ ID NO: 6175289 - DNA, 22 bp, Homo sapiens
ctgctttgtagtttgcccagag

SEQ ID NO: 6175290 - DNA, 13 bp, Homo sapiens
ctgctttgtgcat

SEQ ID NO: 6175291 - DNA, 14 bp, Homo sapiens
ctgctttgtgcata

SEQ ID NO: 6175292 - DNA, 21 bp, Homo sapiens
ctgctttgttgtgtgcctcta

SEQ ID NO: 6175293 - DNA, 23 bp, Homo sapiens
ctgctttgttttggctgctctcc

SEQ ID NO: 6175294 - DNA, 18 bp, Homo sapiens
ctgcttttaaaagtgcac

SEQ ID NO: 6175295 - DNA, 21 bp, Homo sapiens
ctgcttttaaaagtgcacatt

SEQ ID NO: 6175296 - DNA, 19 bp, Homo sapiens
ctgcttttaactctagaat

SEQ ID NO: 6175297 - DNA, 23 bp, Homo sapiens
ctgcttttaactttataaatcca

SEQ ID NO: 6175298 - DNA, 12 bp, Homo sapiens
ctgcttttaagt

SEQ ID NO: 6175299 - DNA, 24 bp, Homo sapiens
ctgcttttaggagaattcacagaa

SEQ ID NO: 6175300 - DNA, 17 bp, Homo sapiens
ctgcttttaggtcatcc

SEQ ID NO: 6175301 - DNA, 18 bp, Homo sapiens
cttgaatttgcatgtcta

SEQ ID NO: 6175302 - DNA, 19 bp, Homo sapiens
cttgaatttgcatgtctaa

SEQ ID NO: 6175303 - DNA, 20 bp, Homo sapiens
cttgaattttcccactgcac

SEQ ID NO: 6175304 - DNA, 15 bp, Homo sapiens
cttgaatttttttct

SEQ ID NO: 6175305 - DNA, 20 bp, Homo sapiens
cttgaatttttttctgcaca

SEQ ID NO: 6175306 - DNA, 20 bp, Homo sapiens
cttgacaaaacctaacttgc

SEQ ID NO: 6175307 - DNA, 18 bp, Homo sapiens
cttgacaaacttctttca

SEQ ID NO: 6175308 - DNA, 19 bp, Homo sapiens
cttgacaaacttctttcac

SEQ ID NO: 6175309 - DNA, 16 bp, Homo sapiens
cttgacaaagtcaagc

SEQ ID NO: 6175310 - DNA, 14 bp, Homo sapiens
cttgacaacagact

SEQ ID NO: 6175311 - DNA, 15 bp, Homo sapiens
cttgacaacagactg

SEQ ID NO: 6175312 - DNA, 14 bp, Homo sapiens
cttgacaacatctg

SEQ ID NO: 6175313 - DNA, 16 bp, Homo sapiens
cttgacaactggcagg

SEQ ID NO: 6175314 - DNA, 18 bp, Homo sapiens
cttgacaagtacatcacc

SEQ ID NO: 6175315 - DNA, 22 bp, Homo sapiens
cttgacaagttgcgacggagag

SEQ ID NO: 6175316 - DNA, 21 bp, Homo sapiens
cttgacacaggaaatgggaaa

SEQ ID NO: 6175317 - DNA, 12 bp, Homo sapiens
cttgacaccact

SEQ ID NO: 6175318 - DNA, 16 bp, Homo sapiens
cttgacacggtgaaat

SEQ ID NO: 6175319 - DNA, 15 bp, Homo sapiens
cttgacagaaagcag

SEQ ID NO: 6175320 - DNA, 20 bp, Homo sapiens
cttgacagaaagcagttctg

SEQ ID NO: 6175321 - DNA, 17 bp, Homo sapiens
cttgacagaacactgtc

SEQ ID NO: 6175322 - DNA, 23 bp, Homo sapiens
cttgacagactgtagcttctctt

SEQ ID NO: 6175323 - DNA, 15 bp, Homo sapiens
cttgacagagcagct

SEQ ID NO: 6175324 - DNA, 13 bp, Homo sapiens
cttgacaggcgcc

SEQ ID NO: 6175325 - DNA, 12 bp, Homo sapiens
cttgacagggca

SEQ ID NO: 6175326 - DNA, 15 bp, Homo sapiens
cttgacagggcacac

SEQ ID NO: 6175327 - DNA, 14 bp, Homo sapiens
cttgacatacctac

SEQ ID NO: 6175328 - DNA, 14 bp, Homo sapiens
cttgacattatgtt

SEQ ID NO: 6175329 - DNA, 14 bp, Homo sapiens
cttgacattcaagg

SEQ ID NO: 6175330 - DNA, 23 bp, Homo sapiens
cttgacattccttgtcaccagca

SEQ ID NO: 6175331 - DNA, 16 bp, Homo sapiens
cttgaccaacagaaac

SEQ ID NO: 6175332 - DNA, 20 bp, Homo sapiens
cttgaccaagcaggaagctc

SEQ ID NO: 6175333 - DNA, 23 bp, Homo sapiens
cttgaccaagcaggaagctcaga

SEQ ID NO: 6175334 - DNA, 17 bp, Homo sapiens
cttgaccactggccctg

SEQ ID NO: 6175335 - DNA, 11 bp, Homo sapiens
cttgaccagac

SEQ ID NO: 6175336 - DNA, 22 bp, Homo sapiens
cttgaccagacctagacctggg

SEQ ID NO: 6175337 - DNA, 20 bp, Homo sapiens
cttgaccagcagatcccagc

SEQ ID NO: 6175338 - DNA, 22 bp, Homo sapiens
cttgaccagcagatcccagctc

SEQ ID NO: 6175339 - DNA, 21 bp, Homo sapiens
cttgaccaggctgcctccctt

SEQ ID NO: 6175340 - DNA, 23 bp, Homo sapiens
cttgaccatactaataaatataa

SEQ ID NO: 6175341 - DNA, 13 bp, Homo sapiens
cttgaccatgttg

SEQ ID NO: 6175342 - DNA, 17 bp, Homo sapiens
cttgaccattctccacc

SEQ ID NO: 6175343 - DNA, 20 bp, Homo sapiens
cttgaccattctccacctgc

SEQ ID NO: 6175344 - DNA, 21 bp, Homo sapiens
cttgaccattctccacctgcc

SEQ ID NO: 6175345 - DNA, 13 bp, Homo sapiens
cttgacccatctc

SEQ ID NO: 6175346 - DNA, 14 bp, Homo sapiens
cttgaccccacacg

SEQ ID NO: 6175347 - DNA, 15 bp, Homo sapiens
cttgaccctgagctg

SEQ ID NO: 6175348 - DNA, 13 bp, Homo sapiens
cttgaccctgcac

SEQ ID NO: 6175349 - DNA, 19 bp, Homo sapiens
cttgaccctttcctccccc

SEQ ID NO: 6175350 - DNA, 23 bp, Homo sapiens
cttgaccgtactctcacatgtgg

SEQ ID NO: 6175351 - DNA, 18 bp, Homo sapiens
cttgaccgtgaggccaga

SEQ ID NO: 6175352 - DNA, 13 bp, Homo sapiens
cttgacctagctc

SEQ ID NO: 6175353 - DNA, 18 bp, Homo sapiens
cttgacctagctctttgg

SEQ ID NO: 6175354 - DNA, 21 bp, Homo sapiens
cttgacctcatctcccgagca

SEQ ID NO: 6175355 - DNA, 15 bp, Homo sapiens
cttgacctctataaa

SEQ ID NO: 6175356 - DNA, 14 bp, Homo sapiens
cttgacctctccag

SEQ ID NO: 6175357 - DNA, 16 bp, Homo sapiens
cttgacctctccagca

SEQ ID NO: 6175358 - DNA, 16 bp, Homo sapiens
cttgacctctgtgacc

SEQ ID NO: 6175359 - DNA, 17 bp, Homo sapiens
cttgacctgaactctgc

SEQ ID NO: 6175360 - DNA, 19 bp, Homo sapiens
cttgacctgaactctgcaa

SEQ ID NO: 6175361 - DNA, 22 bp, Homo sapiens
cttgacctgagatgctgggagg

SEQ ID NO: 6175362 - DNA, 18 bp, Homo sapiens
cttgacctgcattgtaaa

SEQ ID NO: 6175363 - DNA, 19 bp, Homo sapiens
cttgacctgcattgtaaat

SEQ ID NO: 6175364 - DNA, 16 bp, Homo sapiens
cttgacctgctgaagt

SEQ ID NO: 6175365 - DNA, 18 bp, Homo sapiens
cttgaccttcctctgggg

SEQ ID NO: 6175366 - DNA, 22 bp, Homo sapiens
cttgaccttcctctggggctct

SEQ ID NO: 6175367 - DNA, 14 bp, Homo sapiens
cttgacctttgtac

SEQ ID NO: 6175368 - DNA, 17 bp, Homo sapiens
cttgacctttgtacagc

SEQ ID NO: 6175369 - DNA, 22 bp, Homo sapiens
cttgacgcgtggtcacaggacg

SEQ ID NO: 6175370 - DNA, 17 bp, Homo sapiens
cttgacgtgtgtggtcc

SEQ ID NO: 6175371 - DNA, 20 bp, Homo sapiens
cttgacgtttcttctttcta

SEQ ID NO: 6175372 - DNA, 21 bp, Homo sapiens
cttgacgtttcttctttctag

SEQ ID NO: 6175373 - DNA, 20 bp, Homo sapiens
cttgactaaaaaaaaaagaa

SEQ ID NO: 6175374 - DNA, 17 bp, Homo sapiens
cttgactataaaaactg

SEQ ID NO: 6175375 - DNA, 19 bp, Homo sapiens
cttgactatcacatacaat

SEQ ID NO: 6175376 - DNA, 21 bp, Homo sapiens
cttgactatcacatacaattt

SEQ ID NO: 6175377 - DNA, 18 bp, Homo sapiens
cttgactattacactgcc

SEQ ID NO: 6175378 - DNA, 16 bp, Homo sapiens
cttgactattggagga

SEQ ID NO: 6175379 - DNA, 14 bp, Homo sapiens
cttgactatttcac

SEQ ID NO: 6175380 - DNA, 18 bp, Homo sapiens
cttgactcatggcagctg

SEQ ID NO: 6175381 - DNA, 16 bp, Homo sapiens
cttgactctaaatgca

SEQ ID NO: 6175382 - DNA, 12 bp, Homo sapiens
cttgactctaat

SEQ ID NO: 6175383 - DNA, 17 bp, Homo sapiens
cttgactctaatatgat

SEQ ID NO: 6175384 - DNA, 14 bp, Homo sapiens
cttgactcttgaat

SEQ ID NO: 6175385 - DNA, 16 bp, Homo sapiens
cttgactcttgaataa

SEQ ID NO: 6175386 - DNA, 18 bp, Homo sapiens
cttgactgaagcgaacat

SEQ ID NO: 6175387 - DNA, 21 bp, Homo sapiens
cttgactgaagcgaacatctt

SEQ ID NO: 6175388 - DNA, 19 bp, Homo sapiens
cttgactgccccttctatg

SEQ ID NO: 6175389 - DNA, 16 bp, Homo sapiens
cttgactgtacagaga

SEQ ID NO: 6175390 - DNA, 18 bp, Homo sapiens
cttgactgtacagagact

SEQ ID NO: 6175391 - DNA, 20 bp, Homo sapiens
cttgactgtctagccactcc

SEQ ID NO: 6175392 - DNA, 20 bp, Homo sapiens
cttgactgtcttccctctct

SEQ ID NO: 6175393 - DNA, 16 bp, Homo sapiens
cttgactgttatctcg

SEQ ID NO: 6175394 - DNA, 19 bp, Homo sapiens
cttgacttatggctcgctt

SEQ ID NO: 6175395 - DNA, 16 bp, Homo sapiens
cttgacttcacagcag

SEQ ID NO: 6175396 - DNA, 19 bp, Homo sapiens
cttgacttcagttattggt

SEQ ID NO: 6175397 - DNA, 16 bp, Homo sapiens
cttgacttctgcccaa

SEQ ID NO: 6175398 - DNA, 15 bp, Homo sapiens
cttgacttgccatga

SEQ ID NO: 6175399 - DNA, 17 bp, Homo sapiens
cttgacttgtggggcag

SEQ ID NO: 6175400 - DNA, 15 bp, Homo sapiens
cttgactttccagaa

SEQ ID NO: 6175401 - DNA, 14 bp, Homo sapiens
cttgactttctgat

SEQ ID NO: 6175402 - DNA, 13 bp, Homo sapiens
cttgactttgctc

SEQ ID NO: 6175403 - DNA, 19 bp, Homo sapiens
cttgactttgctcctcaca

SEQ ID NO: 6175404 - DNA, 22 bp, Homo sapiens
cttgactttggctgatttaaaa

SEQ ID NO: 6175405 - DNA, 15 bp, Homo sapiens
cttgagaaaaaaaga

SEQ ID NO: 6175406 - DNA, 22 bp, Homo sapiens
cttgagaaaaaaagaatagttg

SEQ ID NO: 6175407 - DNA, 21 bp, Homo sapiens
cttgagaaaatgcaggagagc

SEQ ID NO: 6175408 - DNA, 17 bp, Homo sapiens
cttgagaaatttgtggt

SEQ ID NO: 6175409 - DNA, 20 bp, Homo sapiens
cttgagaaccagtctcctca

SEQ ID NO: 6175410 - DNA, 19 bp, Homo sapiens
cttgagaactttatttcca

SEQ ID NO: 6175411 - DNA, 23 bp, Homo sapiens
cttgagaagacctcacctagaaa

SEQ ID NO: 6175412 - DNA, 19 bp, Homo sapiens
cttgagaatcctctccttt

SEQ ID NO: 6175413 - DNA, 21 bp, Homo sapiens
cttgagaatcctctcctttct

SEQ ID NO: 6175414 - DNA, 13 bp, Homo sapiens
cttgagacagctt

SEQ ID NO: 6175415 - DNA, 21 bp, Homo sapiens
cttgagaccaagccggtgccc

SEQ ID NO: 6175416 - DNA, 14 bp, Homo sapiens
cttgagaccagcct

SEQ ID NO: 6175417 - DNA, 20 bp, Homo sapiens
cttgagacccccaagcttcc

SEQ ID NO: 6175418 - DNA, 17 bp, Homo sapiens
cttgagaccctcttctc

SEQ ID NO: 6175419 - DNA, 17 bp, Homo sapiens
cttgagagacccagctg

SEQ ID NO: 6175420 - DNA, 14 bp, Homo sapiens
cttgagagagaaat

SEQ ID NO: 6175421 - DNA, 14 bp, Homo sapiens
cttgagagcgctgg

SEQ ID NO: 6175422 - DNA, 18 bp, Homo sapiens
cttgagagcgctggcctc

SEQ ID NO: 6175423 - DNA, 19 bp, Homo sapiens
cttgagagctcagcctgcc

SEQ ID NO: 6175424 - DNA, 13 bp, Homo sapiens
cttgagagctgct

SEQ ID NO: 6175425 - DNA, 14 bp, Homo sapiens
cttgagagctgctg

SEQ ID NO: 6175426 - DNA, 16 bp, Homo sapiens
cttgagagctgctgag

SEQ ID NO: 6175427 - DNA, 18 bp, Homo sapiens
cttgagaggagaaatgca

SEQ ID NO: 6175428 - DNA, 20 bp, Homo sapiens
cttgagagtagatggtttga

SEQ ID NO: 6175429 - DNA, 23 bp, Homo sapiens
cttgagagtgttcctgagacaga

SEQ ID NO: 6175430 - DNA, 17 bp, Homo sapiens
cttgagataaggtttta

SEQ ID NO: 6175431 - DNA, 15 bp, Homo sapiens
cttgagatgtcttct

SEQ ID NO: 6175432 - DNA, 18 bp, Homo sapiens
cttgagcaaggcaagaag

SEQ ID NO: 6175433 - DNA, 14 bp, Homo sapiens
cttgagcaataaag

SEQ ID NO: 6175434 - DNA, 20 bp, Homo sapiens
cttgagcaataaagtggaaa

SEQ ID NO: 6175435 - DNA, 23 bp, Homo sapiens
cttgagcactattctaaggagca

SEQ ID NO: 6175436 - DNA, 16 bp, Homo sapiens
cttgagcagctgaatt

SEQ ID NO: 6175437 - DNA, 15 bp, Homo sapiens
cttgagcaggattag

SEQ ID NO: 6175438 - DNA, 13 bp, Homo sapiens
cttgagcagtggc

SEQ ID NO: 6175439 - DNA, 14 bp, Homo sapiens
cttgagcagtggct

SEQ ID NO: 6175440 - DNA, 20 bp, Homo sapiens
cttgagcatcaatcttgtta

SEQ ID NO: 6175441 - DNA, 13 bp, Homo sapiens
cttgagcatctgg

SEQ ID NO: 6175442 - DNA, 20 bp, Homo sapiens
cttgagcatgcccaaatata

SEQ ID NO: 6175443 - DNA, 18 bp, Homo sapiens
cttgagccactccttcct

SEQ ID NO: 6175444 - DNA, 17 bp, Homo sapiens
cttgagccagttacctt

SEQ ID NO: 6175445 - DNA, 13 bp, Homo sapiens
cttgagccatcca

SEQ ID NO: 6175446 - DNA, 14 bp, Homo sapiens
cttgagcccactcc

SEQ ID NO: 6175447 - DNA, 15 bp, Homo sapiens
cttgagcccactcct

SEQ ID NO: 6175448 - DNA, 12 bp, Homo sapiens
cttgagcccagg

SEQ ID NO: 6175449 - DNA, 14 bp, Homo sapiens
cttgagccctggct

SEQ ID NO: 6175450 - DNA, 17 bp, Homo sapiens
cttgagccgggcccctg

SEQ ID NO: 6175451 - DNA, 17 bp, Homo sapiens
cttgagcctggctgtcc

SEQ ID NO: 6175452 - DNA, 15 bp, Homo sapiens
cttgagcctgggagg

SEQ ID NO: 6175453 - DNA, 18 bp, Homo sapiens
cttgagccttgaactttg

SEQ ID NO: 6175454 - DNA, 22 bp, Homo sapiens
cttgagccttgaactttgacct

SEQ ID NO: 6175455 - DNA, 23 bp, Homo sapiens
cttgagctagagataaaacagaa

SEQ ID NO: 6175456 - DNA, 20 bp, Homo sapiens
cttgagctctgtaacttaca

SEQ ID NO: 6175457 - DNA, 23 bp, Homo sapiens
cttgagctcttcatttattttga

SEQ ID NO: 6175458 - DNA, 13 bp, Homo sapiens
cttgagctgagat

SEQ ID NO: 6175459 - DNA, 22 bp, Homo sapiens
cttgagctgcctgctctgcagc

SEQ ID NO: 6175460 - DNA, 13 bp, Homo sapiens
cttgagctggcct

SEQ ID NO: 6175461 - DNA, 14 bp, Homo sapiens
cttgagctggcctc

SEQ ID NO: 6175462 - DNA, 20 bp, Homo sapiens
cttgagctgtctgaagccca

SEQ ID NO: 6175463 - DNA, 18 bp, Homo sapiens
cttgagctgttgtggttt

SEQ ID NO: 6175464 - DNA, 20 bp, Homo sapiens
cttgagcttggcagctgaac

SEQ ID NO: 6175465 - DNA, 22 bp, Homo sapiens
cttgagctttctgtgcatgtgc

SEQ ID NO: 6175466 - DNA, 21 bp, Homo sapiens
cttgaggaataaatgccttta

SEQ ID NO: 6175467 - DNA, 15 bp, Homo sapiens
cttgaggacacatgt

SEQ ID NO: 6175468 - DNA, 16 bp, Homo sapiens
cttgaggacacatgtc

SEQ ID NO: 6175469 - DNA, 24 bp, Homo sapiens
cttgaggacctccacctgggagat

SEQ ID NO: 6175470 - DNA, 21 bp, Homo sapiens
cttgaggaggagctggcctgc

SEQ ID NO: 6175471 - DNA, 15 bp, Homo sapiens
cttgaggaggggcac

SEQ ID NO: 6175472 - DNA, 19 bp, Homo sapiens
cttgaggaggggcacctgc

SEQ ID NO: 6175473 - DNA, 20 bp, Homo sapiens
cttgaggaggggcacctgcc

SEQ ID NO: 6175474 - DNA, 22 bp, Homo sapiens
cttgaggagtgtgagaatcaaa

SEQ ID NO: 6175475 - DNA, 12 bp, Homo sapiens
cttgaggcaggg

SEQ ID NO: 6175476 - DNA, 16 bp, Homo sapiens
cttgaggccaaatgag

SEQ ID NO: 6175477 - DNA, 17 bp, Homo sapiens
cttgaggccaagatggc

SEQ ID NO: 6175478 - DNA, 19 bp, Homo sapiens
cttgaggccaagatggctg

SEQ ID NO: 6175479 - DNA, 20 bp, Homo sapiens
ctgcttttagttcatatata

SEQ ID NO: 6175480 - DNA, 13 bp, Homo sapiens
ctgcttttatatc

SEQ ID NO: 6175481 - DNA, 12 bp, Homo sapiens
ctgcttttcaat

SEQ ID NO: 6175482 - DNA, 15 bp, Homo sapiens
ctgcttttcactgct

SEQ ID NO: 6175483 - DNA, 17 bp, Homo sapiens
ctgcttttcattagcag

SEQ ID NO: 6175484 - DNA, 16 bp, Homo sapiens
ctgcttttccaggatc

SEQ ID NO: 6175485 - DNA, 17 bp, Homo sapiens
ctgcttttccaggatcc

SEQ ID NO: 6175486 - DNA, 16 bp, Homo sapiens
ctgcttttccattctg

SEQ ID NO: 6175487 - DNA, 21 bp, Homo sapiens
ctgcttttccattctgggtgt

SEQ ID NO: 6175488 - DNA, 18 bp, Homo sapiens
ctgcttttcctcaagcaa

SEQ ID NO: 6175489 - DNA, 20 bp, Homo sapiens
ctgcttttcctcaagcaata

SEQ ID NO: 6175490 - DNA, 19 bp, Homo sapiens
ctgcttttcctctgccttc

SEQ ID NO: 6175491 - DNA, 15 bp, Homo sapiens
ctgcttttctcccag

SEQ ID NO: 6175492 - DNA, 16 bp, Homo sapiens
ctgcttttctgccctg

SEQ ID NO: 6175493 - DNA, 17 bp, Homo sapiens
ctgcttttctgccctgg

SEQ ID NO: 6175494 - DNA, 16 bp, Homo sapiens
ctgcttttctgtcctg

SEQ ID NO: 6175495 - DNA, 14 bp, Homo sapiens
ctgcttttcttaag

SEQ ID NO: 6175496 - DNA, 21 bp, Homo sapiens
ctgcttttcttaagtgcccac

SEQ ID NO: 6175497 - DNA, 17 bp, Homo sapiens
ctgcttttgagcctcag

SEQ ID NO: 6175498 - DNA, 18 bp, Homo sapiens
ctgcttttgagcctcaga

SEQ ID NO: 6175499 - DNA, 14 bp, Homo sapiens
ctgcttttgatgat

SEQ ID NO: 6175500 - DNA, 18 bp, Homo sapiens
ctgcttttgcagaaatca

SEQ ID NO: 6175501 - DNA, 12 bp, Homo sapiens
ctgcttttgcat

SEQ ID NO: 6175502 - DNA, 16 bp, Homo sapiens
ctgcttttgctggggt

SEQ ID NO: 6175503 - DNA, 16 bp, Homo sapiens
ctgcttttggggctct

SEQ ID NO: 6175504 - DNA, 19 bp, Homo sapiens
ctgcttttggggctcttga

SEQ ID NO: 6175505 - DNA, 22 bp, Homo sapiens
ctgcttttggggctcttgatca

SEQ ID NO: 6175506 - DNA, 20 bp, Homo sapiens
ctgcttttgggggtcagcat

SEQ ID NO: 6175507 - DNA, 22 bp, Homo sapiens
ctgcttttggtgctctcacctt

SEQ ID NO: 6175508 - DNA, 20 bp, Homo sapiens
ctgcttttgtctatgggact

SEQ ID NO: 6175509 - DNA, 16 bp, Homo sapiens
ctgcttttgtgtccca

SEQ ID NO: 6175510 - DNA, 22 bp, Homo sapiens
ctgcttttgtgtcccattcaca

SEQ ID NO: 6175511 - DNA, 19 bp, Homo sapiens
ctgctttttaaagaatgct

SEQ ID NO: 6175512 - DNA, 17 bp, Homo sapiens
ctgctttttatggcctg

SEQ ID NO: 6175513 - DNA, 22 bp, Homo sapiens
ctgctttttccagattcttcca

SEQ ID NO: 6175514 - DNA, 23 bp, Homo sapiens
ctgctttttctctgcttccagtt

SEQ ID NO: 6175515 - DNA, 14 bp, Homo sapiens
ctgctttttgaaat

SEQ ID NO: 6175516 - DNA, 18 bp, Homo sapiens
ctgctttttgaaatgaaa

SEQ ID NO: 6175517 - DNA, 16 bp, Homo sapiens
ctgctttttggaaagt

SEQ ID NO: 6175518 - DNA, 17 bp, Homo sapiens
ctgctttttttcttaaa

SEQ ID NO: 6175519 - DNA, 21 bp, Homo sapiens
ctgcttttttttttccagcaa

SEQ ID NO: 6175520 - DNA, 20 bp, Homo sapiens
ctggaaaaaaaatatatata

SEQ ID NO: 6175521 - DNA, 21 bp, Homo sapiens
ctggaaaaatgaactgtatta

SEQ ID NO: 6175522 - DNA, 19 bp, Homo sapiens
ctggaaaaattaagttgtt

SEQ ID NO: 6175523 - DNA, 19 bp, Homo sapiens
ctggaaaacatagagtaga

SEQ ID NO: 6175524 - DNA, 18 bp, Homo sapiens
ctggaaaacctgaggcca

SEQ ID NO: 6175525 - DNA, 16 bp, Homo sapiens
ctggaaaactgccaca

SEQ ID NO: 6175526 - DNA, 13 bp, Homo sapiens
ctggaaaagaaga

SEQ ID NO: 6175527 - DNA, 16 bp, Homo sapiens
ctggaaaagcacttta

SEQ ID NO: 6175528 - DNA, 19 bp, Homo sapiens
ctggaaaagggtcttggga

SEQ ID NO: 6175529 - DNA, 14 bp, Homo sapiens
ctggaaaagtgttc

SEQ ID NO: 6175530 - DNA, 19 bp, Homo sapiens
ctggaaaatctgtaaaaaa

SEQ ID NO: 6175531 - DNA, 23 bp, Homo sapiens
ctggaaaatctgtaaaaaagaaa

SEQ ID NO: 6175532 - DNA, 16 bp, Homo sapiens
ctggaaaatgcttctt

SEQ ID NO: 6175533 - DNA, 21 bp, Homo sapiens
ctggaaacaaaacagaagggg

SEQ ID NO: 6175534 - DNA, 16 bp, Homo sapiens
ctggaaacagacaggg

SEQ ID NO: 6175535 - DNA, 23 bp, Homo sapiens
ctggaaacagacagggagaagtt

SEQ ID NO: 6175536 - DNA, 16 bp, Homo sapiens
ctggaaacagcatgaa

SEQ ID NO: 6175537 - DNA, 17 bp, Homo sapiens
ctggaaacatctgattt

SEQ ID NO: 6175538 - DNA, 17 bp, Homo sapiens
ctggaaaccaagtcagg

SEQ ID NO: 6175539 - DNA, 22 bp, Homo sapiens
ctggaaaccaagtcaggccagg

SEQ ID NO: 6175540 - DNA, 20 bp, Homo sapiens
ctggaaacccacctctctgg

SEQ ID NO: 6175541 - DNA, 16 bp, Homo sapiens
ctggaaacctctggag

SEQ ID NO: 6175542 - DNA, 16 bp, Homo sapiens
ctggaaacctgtctga

SEQ ID NO: 6175543 - DNA, 12 bp, Homo sapiens
ctggaaactgct

SEQ ID NO: 6175544 - DNA, 22 bp, Homo sapiens
ctggaaacttagcttttgatgt

SEQ ID NO: 6175545 - DNA, 18 bp, Homo sapiens
ctggaaacttctgtaagg

SEQ ID NO: 6175546 - DNA, 15 bp, Homo sapiens
ctggaaagagctgtt

SEQ ID NO: 6175547 - DNA, 19 bp, Homo sapiens
ctggaaagaggagaaggag

SEQ ID NO: 6175548 - DNA, 18 bp, Homo sapiens
ctggaaagaggctctgga

SEQ ID NO: 6175549 - DNA, 20 bp, Homo sapiens
ctggaaagcacaagactggc

SEQ ID NO: 6175550 - DNA, 20 bp, Homo sapiens
ctggaaagcagagcctcctg

SEQ ID NO: 6175551 - DNA, 13 bp, Homo sapiens
ctggaaagccagg

SEQ ID NO: 6175552 - DNA, 23 bp, Homo sapiens
ctggaaagcttttctattttaat

SEQ ID NO: 6175553 - DNA, 18 bp, Homo sapiens
ctggaaaggaaagatgat

SEQ ID NO: 6175554 - DNA, 17 bp, Homo sapiens
ctggaaaggatctgtga

SEQ ID NO: 6175555 - DNA, 19 bp, Homo sapiens
ctggaaaggatgcttctgc

SEQ ID NO: 6175556 - DNA, 20 bp, Homo sapiens
ctggaaaggatgcttctgct

SEQ ID NO: 6175557 - DNA, 23 bp, Homo sapiens
ctggaaaggatgcttctgctcac

SEQ ID NO: 6175558 - DNA, 14 bp, Homo sapiens
ctggaaaggccagc

SEQ ID NO: 6175559 - DNA, 21 bp, Homo sapiens
ctggaaaggccagcagccttc

SEQ ID NO: 6175560 - DNA, 22 bp, Homo sapiens
ctggaaaggccagcagccttcc

SEQ ID NO: 6175561 - DNA, 23 bp, Homo sapiens
ctggaaaggccagcagccttcca

SEQ ID NO: 6175562 - DNA, 22 bp, Homo sapiens
ctggaaaggctcagtctcagga

SEQ ID NO: 6175563 - DNA, 23 bp, Homo sapiens
ctggaaaggctcagtctcaggag

SEQ ID NO: 6175564 - DNA, 17 bp, Homo sapiens
ctggaaaggggagagcc

SEQ ID NO: 6175565 - DNA, 23 bp, Homo sapiens
ctggaaaggggagagcctgctgg

SEQ ID NO: 6175566 - DNA, 13 bp, Homo sapiens
ctggaaagggggt

SEQ ID NO: 6175567 - DNA, 20 bp, Homo sapiens
ctggaaataaacctggagat

SEQ ID NO: 6175568 - DNA, 17 bp, Homo sapiens
ctggaaataatatcatt

SEQ ID NO: 6175569 - DNA, 20 bp, Homo sapiens
ctggaaatctgttttgtata

SEQ ID NO: 6175570 - DNA, 20 bp, Homo sapiens
ctggaaatgtaaaattgaaa

SEQ ID NO: 6175571 - DNA, 14 bp, Homo sapiens
ctggaaatgtcttt

SEQ ID NO: 6175572 - DNA, 21 bp, Homo sapiens
ctggaaattccaggaaccaaa

SEQ ID NO: 6175573 - DNA, 16 bp, Homo sapiens
ctggaaattctgcctt

SEQ ID NO: 6175574 - DNA, 20 bp, Homo sapiens
ctggaaattcttccctgggg

SEQ ID NO: 6175575 - DNA, 20 bp, Homo sapiens
ctggaaattgaaataaagat

SEQ ID NO: 6175576 - DNA, 14 bp, Homo sapiens
ctggaaattgaggt

SEQ ID NO: 6175577 - DNA, 19 bp, Homo sapiens
ctggaacaaattatttttg

SEQ ID NO: 6175578 - DNA, 18 bp, Homo sapiens
ctggaacaacttgtagca

SEQ ID NO: 6175579 - DNA, 11 bp, Homo sapiens
ctggaacacaa

SEQ ID NO: 6175580 - DNA, 12 bp, Homo sapiens
ctggaacacagg

SEQ ID NO: 6175581 - DNA, 21 bp, Homo sapiens
ctggaacactagacaagccag

SEQ ID NO: 6175582 - DNA, 19 bp, Homo sapiens
ctggaacactatagagaac

SEQ ID NO: 6175583 - DNA, 14 bp, Homo sapiens
ctggaacagattca

SEQ ID NO: 6175584 - DNA, 24 bp, Homo sapiens
ctggaacatcctttgcagggcagc

SEQ ID NO: 6175585 - DNA, 19 bp, Homo sapiens
ctggaacatttgatatttt

SEQ ID NO: 6175586 - DNA, 22 bp, Homo sapiens
ctggaaccaatcccgtgaaaga

SEQ ID NO: 6175587 - DNA, 14 bp, Homo sapiens
ctggaaccagagcc

SEQ ID NO: 6175588 - DNA, 14 bp, Homo sapiens
ctggaaccagaggg

SEQ ID NO: 6175589 - DNA, 20 bp, Homo sapiens
ctggaaccaggcttgcctgg

SEQ ID NO: 6175590 - DNA, 23 bp, Homo sapiens
ctggaaccagggaggagaggaaa

SEQ ID NO: 6175591 - DNA, 13 bp, Homo sapiens
ctggaacccagga

SEQ ID NO: 6175592 - DNA, 16 bp, Homo sapiens
ctggaaccccccaggc

SEQ ID NO: 6175593 - DNA, 17 bp, Homo sapiens
ctggaaccccccaggcc

SEQ ID NO: 6175594 - DNA, 18 bp, Homo sapiens
ctggaaccgggaagggtg

SEQ ID NO: 6175595 - DNA, 22 bp, Homo sapiens
ctggaaccgggaagggtggcct

SEQ ID NO: 6175596 - DNA, 23 bp, Homo sapiens
ctggaacctcagcctggccagac

SEQ ID NO: 6175597 - DNA, 15 bp, Homo sapiens
ctggaacctgcaaaa

SEQ ID NO: 6175598 - DNA, 18 bp, Homo sapiens
ctggaacctggaccccag

SEQ ID NO: 6175599 - DNA, 22 bp, Homo sapiens
ctggaacctggaccccagcctt

SEQ ID NO: 6175600 - DNA, 23 bp, Homo sapiens
ctggaacctggaccccagccttg

SEQ ID NO: 6175601 - DNA, 16 bp, Homo sapiens
ctggaacctggcaggc

SEQ ID NO: 6175602 - DNA, 17 bp, Homo sapiens
ctggaacctggcaggcc

SEQ ID NO: 6175603 - DNA, 15 bp, Homo sapiens
ctggaaccttgctgt

SEQ ID NO: 6175604 - DNA, 17 bp, Homo sapiens
ctggaaccttgctgtcc

SEQ ID NO: 6175605 - DNA, 19 bp, Homo sapiens
ctggaaccttgctgtcctg

SEQ ID NO: 6175606 - DNA, 19 bp, Homo sapiens
ctggaacgtttcactgcaa

SEQ ID NO: 6175607 - DNA, 19 bp, Homo sapiens
ctggaactctatctgggcc

SEQ ID NO: 6175608 - DNA, 22 bp, Homo sapiens
ctggaactctatctgggcctgg

SEQ ID NO: 6175609 - DNA, 22 bp, Homo sapiens
ctggaactgctgctgacccctg

SEQ ID NO: 6175610 - DNA, 19 bp, Homo sapiens
ctggaactggctgtgaaga

SEQ ID NO: 6175611 - DNA, 18 bp, Homo sapiens
ctggaactgtctctcatg

SEQ ID NO: 6175612 - DNA, 19 bp, Homo sapiens
ctggaactgtctctcatga

SEQ ID NO: 6175613 - DNA, 16 bp, Homo sapiens
ctggaacttgaactga

SEQ ID NO: 6175614 - DNA, 20 bp, Homo sapiens
ctggaacttgaactgattca

SEQ ID NO: 6175615 - DNA, 17 bp, Homo sapiens
ctggaactttagtgaaa

SEQ ID NO: 6175616 - DNA, 14 bp, Homo sapiens
ctggaagaaaaaaa

SEQ ID NO: 6175617 - DNA, 18 bp, Homo sapiens
ctggaagaaaaaaaccac

SEQ ID NO: 6175618 - DNA, 20 bp, Homo sapiens
ctggaagaaactaaaaatat

SEQ ID NO: 6175619 - DNA, 11 bp, Homo sapiens
ctggaagaaag

SEQ ID NO: 6175620 - DNA, 16 bp, Homo sapiens
ctggaagaaagccctg

SEQ ID NO: 6175621 - DNA, 21 bp, Homo sapiens
ctggaagaaagccctgtgctt

SEQ ID NO: 6175622 - DNA, 17 bp, Homo sapiens
ctggaagaaaggctgtg

SEQ ID NO: 6175623 - DNA, 17 bp, Homo sapiens
ctggaagaacaggcctc

SEQ ID NO: 6175624 - DNA, 19 bp, Homo sapiens
ctggaagaacatcaagata

SEQ ID NO: 6175625 - DNA, 17 bp, Homo sapiens
ctggaagaaccactgtc

SEQ ID NO: 6175626 - DNA, 22 bp, Homo sapiens
ctggaagaacccttctcagaca

SEQ ID NO: 6175627 - DNA, 12 bp, Homo sapiens
ctggaagaagag

SEQ ID NO: 6175628 - DNA, 13 bp, Homo sapiens
ctggaagaagagg

SEQ ID NO: 6175629 - DNA, 11 bp, Homo sapiens
ctggaagaagc

SEQ ID NO: 6175630 - DNA, 15 bp, Homo sapiens
ctggaagaagcagcg

SEQ ID NO: 6175631 - DNA, 16 bp, Homo sapiens
ctggaagacacttcag

SEQ ID NO: 6175632 - DNA, 17 bp, Homo sapiens
ctggaagacacttcaga

SEQ ID NO: 6175633 - DNA, 17 bp, Homo sapiens
ctggaagacatgataca

SEQ ID NO: 6175634 - DNA, 19 bp, Homo sapiens
ctggaagacgtggctctgg

SEQ ID NO: 6175635 - DNA, 21 bp, Homo sapiens
ctggaagacgtggctctgggt

SEQ ID NO: 6175636 - DNA, 18 bp, Homo sapiens
ctggaagacttagatctg

SEQ ID NO: 6175637 - DNA, 16 bp, Homo sapiens
ctggaagagcagccct

SEQ ID NO: 6175638 - DNA, 17 bp, Homo sapiens
ctggaagagccaaagaa

SEQ ID NO: 6175639 - DNA, 14 bp, Homo sapiens
ctggaagagcccag

SEQ ID NO: 6175640 - DNA, 15 bp, Homo sapiens
ctggaagagcccagt

SEQ ID NO: 6175641 - DNA, 14 bp, Homo sapiens
ctggaagagctggg

SEQ ID NO: 6175642 - DNA, 16 bp, Homo sapiens
ctggaagagctgggta

SEQ ID NO: 6175643 - DNA, 22 bp, Homo sapiens
ctggaagagctgggtaccaggc

SEQ ID NO: 6175644 - DNA, 23 bp, Homo sapiens
ctggaagagctgggtaccaggcc

SEQ ID NO: 6175645 - DNA, 14 bp, Homo sapiens
ctggaagagggagg

SEQ ID NO: 6175646 - DNA, 24 bp, Homo sapiens
ctggaagagggaggggccctgtca

SEQ ID NO: 6175647 - DNA, 15 bp, Homo sapiens
ctggaagatagctgt

SEQ ID NO: 6175648 - DNA, 18 bp, Homo sapiens
ctggaagatataacattc

SEQ ID NO: 6175649 - DNA, 17 bp, Homo sapiens
ctggaagatcatggacc

SEQ ID NO: 6175650 - DNA, 21 bp, Homo sapiens
ctggaagatcccctctcctgc

SEQ ID NO: 6175651 - DNA, 14 bp, Homo sapiens
ctggaagatcctgc

SEQ ID NO: 6175652 - DNA, 17 bp, Homo sapiens
ctggaagattcttactg

SEQ ID NO: 6175653 - DNA, 19 bp, Homo sapiens
ctggaagcacagaaaacta

SEQ ID NO: 6175654 - DNA, 17 bp, Homo sapiens
ctggaagcacagcctcg

SEQ ID NO: 6175655 - DNA, 21 bp, Homo sapiens
cttgaggccccgatggactcc

SEQ ID NO: 6175656 - DNA, 17 bp, Homo sapiens
cttgaggcctgatctgc

SEQ ID NO: 6175657 - DNA, 19 bp, Homo sapiens
cttgaggcttctgcttcca

SEQ ID NO: 6175658 - DNA, 22 bp, Homo sapiens
cttgagggacgactttctttaa

SEQ ID NO: 6175659 - DNA, 18 bp, Homo sapiens
cttgagggcaagagccac

SEQ ID NO: 6175660 - DNA, 17 bp, Homo sapiens
cttgagggcccagagca

SEQ ID NO: 6175661 - DNA, 14 bp, Homo sapiens
cttgaggggaagct

SEQ ID NO: 6175662 - DNA, 21 bp, Homo sapiens
cttgaggggaagctagtcttt

SEQ ID NO: 6175663 - DNA, 19 bp, Homo sapiens
cttgaggggaccaggagtg

SEQ ID NO: 6175664 - DNA, 19 bp, Homo sapiens
cttgaggggccccagcgtc

SEQ ID NO: 6175665 - DNA, 22 bp, Homo sapiens
cttgaggggctaccctgggaag

SEQ ID NO: 6175666 - DNA, 13 bp, Homo sapiens
cttgagggtgggc

SEQ ID NO: 6175667 - DNA, 17 bp, Homo sapiens
cttgagggtgggccagc

SEQ ID NO: 6175668 - DNA, 19 bp, Homo sapiens
cttgagggtttgagagccc

SEQ ID NO: 6175669 - DNA, 15 bp, Homo sapiens
cttgaggtctcagcc

SEQ ID NO: 6175670 - DNA, 18 bp, Homo sapiens
cttgaggtctcagcccct

SEQ ID NO: 6175671 - DNA, 14 bp, Homo sapiens
cttgaggtctcttt

SEQ ID NO: 6175672 - DNA, 18 bp, Homo sapiens
cttgaggtctcttttctc

SEQ ID NO: 6175673 - DNA, 19 bp, Homo sapiens
cttgaggtctcttttctct

SEQ ID NO: 6175674 - DNA, 21 bp, Homo sapiens
cttgaggtctcttttctctac

SEQ ID NO: 6175675 - DNA, 17 bp, Homo sapiens
cttgaggtcttttgaca

SEQ ID NO: 6175676 - DNA, 18 bp, Homo sapiens
cttgaggtcttttgacat

SEQ ID NO: 6175677 - DNA, 22 bp, Homo sapiens
cttgaggtcttttgacatgtgg

SEQ ID NO: 6175678 - DNA, 15 bp, Homo sapiens
cttgaggtggcctcc

SEQ ID NO: 6175679 - DNA, 17 bp, Homo sapiens
cttgagtaatttaaatg

SEQ ID NO: 6175680 - DNA, 19 bp, Homo sapiens
cttgagtagatctgcttct

SEQ ID NO: 6175681 - DNA, 15 bp, Homo sapiens
cttgagtaggccctg

SEQ ID NO: 6175682 - DNA, 16 bp, Homo sapiens
cttgagtaggccctgc

SEQ ID NO: 6175683 - DNA, 14 bp, Homo sapiens
cttgagtatcataa

SEQ ID NO: 6175684 - DNA, 16 bp, Homo sapiens
cttgagtatcataata

SEQ ID NO: 6175685 - DNA, 17 bp, Homo sapiens
cttgagtcagaaaacag

SEQ ID NO: 6175686 - DNA, 17 bp, Homo sapiens
cttgagtgagaagagct

SEQ ID NO: 6175687 - DNA, 21 bp, Homo sapiens
cttgagtgagaagagcttgca

SEQ ID NO: 6175688 - DNA, 17 bp, Homo sapiens
cttgagtgaggcagtga

SEQ ID NO: 6175689 - DNA, 17 bp, Homo sapiens
cttgagtggacagcagc

SEQ ID NO: 6175690 - DNA, 19 bp, Homo sapiens
cttgagtggacagcagctg

SEQ ID NO: 6175691 - DNA, 22 bp, Homo sapiens
cttgagtggacagcagctggac

SEQ ID NO: 6175692 - DNA, 19 bp, Homo sapiens
cttgagtgggccccctctc

SEQ ID NO: 6175693 - DNA, 21 bp, Homo sapiens
cttgagtggggttatctctgt

SEQ ID NO: 6175694 - DNA, 16 bp, Homo sapiens
cttgagtgtaatgttt

SEQ ID NO: 6175695 - DNA, 22 bp, Homo sapiens
cttgagtgtcaagctgaccttg

SEQ ID NO: 6175696 - DNA, 19 bp, Homo sapiens
cttgagtgttcctttttaa

SEQ ID NO: 6175697 - DNA, 15 bp, Homo sapiens
cttgagttcctctgc

SEQ ID NO: 6175698 - DNA, 18 bp, Homo sapiens
cttgagttgattcagctc

SEQ ID NO: 6175699 - DNA, 20 bp, Homo sapiens
cttgagttgattcagctctg

SEQ ID NO: 6175700 - DNA, 21 bp, Homo sapiens
cttgagttggggccattgctt

SEQ ID NO: 6175701 - DNA, 18 bp, Homo sapiens
cttgagttgtttttgtat

SEQ ID NO: 6175702 - DNA, 20 bp, Homo sapiens
cttgagttgtttttgtatat

SEQ ID NO: 6175703 - DNA, 21 bp, Homo sapiens
cttgagttgtttttgtatatt

SEQ ID NO: 6175704 - DNA, 22 bp, Homo sapiens
cttgagttgtttttgtatattg

SEQ ID NO: 6175705 - DNA, 14 bp, Homo sapiens
cttgagtttacatc

SEQ ID NO: 6175706 - DNA, 16 bp, Homo sapiens
cttgagtttgtcgctc

SEQ ID NO: 6175707 - DNA, 12 bp, Homo sapiens
cttgagtttgtt

SEQ ID NO: 6175708 - DNA, 16 bp, Homo sapiens
cttgagttttatttat

SEQ ID NO: 6175709 - DNA, 19 bp, Homo sapiens
cttgagttttgataaagta

SEQ ID NO: 6175710 - DNA, 21 bp, Homo sapiens
cttgagttttgataaagtaat

SEQ ID NO: 6175711 - DNA, 18 bp, Homo sapiens
cttgataaacataattat

SEQ ID NO: 6175712 - DNA, 14 bp, Homo sapiens
cttgataaatatat

SEQ ID NO: 6175713 - DNA, 16 bp, Homo sapiens
cttgataaatatatat

SEQ ID NO: 6175714 - DNA, 18 bp, Homo sapiens
cttgataaatatatatga

SEQ ID NO: 6175715 - DNA, 22 bp, Homo sapiens
cttgataaatatatatgatcat

SEQ ID NO: 6175716 - DNA, 18 bp, Homo sapiens
cttgataatatataaaca

SEQ ID NO: 6175717 - DNA, 17 bp, Homo sapiens
cttgataatattagtga

SEQ ID NO: 6175718 - DNA, 18 bp, Homo sapiens
cttgataatattagtgat

SEQ ID NO: 6175719 - DNA, 23 bp, Homo sapiens
cttgataatattagtgattctga

SEQ ID NO: 6175720 - DNA, 16 bp, Homo sapiens
cttgataattttcctt

SEQ ID NO: 6175721 - DNA, 22 bp, Homo sapiens
cttgataattttcctttaatat

SEQ ID NO: 6175722 - DNA, 18 bp, Homo sapiens
cttgatacattcaaattt

SEQ ID NO: 6175723 - DNA, 23 bp, Homo sapiens
cttgatactaaaagttcttctcc

SEQ ID NO: 6175724 - DNA, 23 bp, Homo sapiens
cttgatactgaatgcataaataa

SEQ ID NO: 6175725 - DNA, 21 bp, Homo sapiens
cttgatacttttattgttata

SEQ ID NO: 6175726 - DNA, 22 bp, Homo sapiens
cttgatagaaatgccaagcact

SEQ ID NO: 6175727 - DNA, 16 bp, Homo sapiens
cttgatagctaaataa

SEQ ID NO: 6175728 - DNA, 22 bp, Homo sapiens
cttgataggacttccttaagca

SEQ ID NO: 6175729 - DNA, 21 bp, Homo sapiens
cttgatataattacttaatgt

SEQ ID NO: 6175730 - DNA, 14 bp, Homo sapiens
cttgatatcccaag

SEQ ID NO: 6175731 - DNA, 17 bp, Homo sapiens
cttgatatcctctttga

SEQ ID NO: 6175732 - DNA, 22 bp, Homo sapiens
cttgatatcctctttgagtgaa

SEQ ID NO: 6175733 - DNA, 18 bp, Homo sapiens
cttgatatgactaattca

SEQ ID NO: 6175734 - DNA, 16 bp, Homo sapiens
cttgatatttgtattt

SEQ ID NO: 6175735 - DNA, 23 bp, Homo sapiens
cttgatatttgtatttattcttt

SEQ ID NO: 6175736 - DNA, 14 bp, Homo sapiens
cttgatattttcta

SEQ ID NO: 6175737 - DNA, 15 bp, Homo sapiens
cttgatcacagctcc

SEQ ID NO: 6175738 - DNA, 21 bp, Homo sapiens
cttgatcagacattcagagat

SEQ ID NO: 6175739 - DNA, 10 bp, Homo sapiens
cttgatcagt

SEQ ID NO: 6175740 - DNA, 18 bp, Homo sapiens
cttgatcagtagtttgca

SEQ ID NO: 6175741 - DNA, 18 bp, Homo sapiens
cttgatcagttaagaaat

SEQ ID NO: 6175742 - DNA, 18 bp, Homo sapiens
cttgatccagaagagccc

SEQ ID NO: 6175743 - DNA, 18 bp, Homo sapiens
cttgatccatttctaatt

SEQ ID NO: 6175744 - DNA, 19 bp, Homo sapiens
cttgatccatttctaatta

SEQ ID NO: 6175745 - DNA, 20 bp, Homo sapiens
cttgatccccttgatagatg

SEQ ID NO: 6175746 - DNA, 13 bp, Homo sapiens
cttgatctatcta

SEQ ID NO: 6175747 - DNA, 15 bp, Homo sapiens
cttgatctatctaca

SEQ ID NO: 6175748 - DNA, 18 bp, Homo sapiens
cttgatctcaaagcacaa

SEQ ID NO: 6175749 - DNA, 15 bp, Homo sapiens
cttgatctcctgagc

SEQ ID NO: 6175750 - DNA, 14 bp, Homo sapiens
cttgatctctcttg

SEQ ID NO: 6175751 - DNA, 20 bp, Homo sapiens
cttgatctctcttgtcctct

SEQ ID NO: 6175752 - DNA, 22 bp, Homo sapiens
cttgatctgctcagccctggag

SEQ ID NO: 6175753 - DNA, 23 bp, Homo sapiens
cttgatctgctcagccctggagg

SEQ ID NO: 6175754 - DNA, 18 bp, Homo sapiens
cttgatctgtgatttctt

SEQ ID NO: 6175755 - DNA, 16 bp, Homo sapiens
cttgatcttaaagatc

SEQ ID NO: 6175756 - DNA, 13 bp, Homo sapiens
cttgatctttgag

SEQ ID NO: 6175757 - DNA, 22 bp, Homo sapiens
cttgatgaaataacacagcagt

SEQ ID NO: 6175758 - DNA, 14 bp, Homo sapiens
cttgatgaagcaag

SEQ ID NO: 6175759 - DNA, 16 bp, Homo sapiens
cttgatgaagcccgtg

SEQ ID NO: 6175760 - DNA, 19 bp, Homo sapiens
cttgatgaagcctgtgcca

SEQ ID NO: 6175761 - DNA, 21 bp, Homo sapiens
cttgatgaagcctgtgccacc

SEQ ID NO: 6175762 - DNA, 22 bp, Homo sapiens
cttgatgaatttggtctgcctc

SEQ ID NO: 6175763 - DNA, 18 bp, Homo sapiens
cttgatgaccaaagtcct

SEQ ID NO: 6175764 - DNA, 12 bp, Homo sapiens
cttgatgactgc

SEQ ID NO: 6175765 - DNA, 16 bp, Homo sapiens
cttgatgactgccttg

SEQ ID NO: 6175766 - DNA, 21 bp, Homo sapiens
cttgatgagctgtgcacaaag

SEQ ID NO: 6175767 - DNA, 13 bp, Homo sapiens
cttgatgagtgta

SEQ ID NO: 6175768 - DNA, 23 bp, Homo sapiens
cttgatgagtgtaacaagaaagg

SEQ ID NO: 6175769 - DNA, 21 bp, Homo sapiens
cttgatgatttttaacttttt

SEQ ID NO: 6175770 - DNA, 23 bp, Homo sapiens
cttgatgcagttttaatacttgt

SEQ ID NO: 6175771 - DNA, 21 bp, Homo sapiens
cttgatgcatgcactgttccc

SEQ ID NO: 6175772 - DNA, 16 bp, Homo sapiens
cttgatgccaaaatga

SEQ ID NO: 6175773 - DNA, 21 bp, Homo sapiens
cttgatgccaaaatgacttta

SEQ ID NO: 6175774 - DNA, 22 bp, Homo sapiens
cttgatgccagagggccagcag

SEQ ID NO: 6175775 - DNA, 23 bp, Homo sapiens
cttgatgccatatgccttgggga

SEQ ID NO: 6175776 - DNA, 23 bp, Homo sapiens
cttgatggaagaaaatggaatta

SEQ ID NO: 6175777 - DNA, 24 bp, Homo sapiens
cttgatggaagtgggccagtcctg

SEQ ID NO: 6175778 - DNA, 17 bp, Homo sapiens
cttgatggagaaggaaa

SEQ ID NO: 6175779 - DNA, 22 bp, Homo sapiens
cttgatggagaaggaaaaggct

SEQ ID NO: 6175780 - DNA, 23 bp, Homo sapiens
cttgatggagaaggaaaaggctg

SEQ ID NO: 6175781 - DNA, 21 bp, Homo sapiens
cttgatggctaacttacaaag

SEQ ID NO: 6175782 - DNA, 14 bp, Homo sapiens
cttgatgggagagg

SEQ ID NO: 6175783 - DNA, 23 bp, Homo sapiens
cttgatggggaatccgtgtgtgt

SEQ ID NO: 6175784 - DNA, 17 bp, Homo sapiens
cttgatggtgacagctg

SEQ ID NO: 6175785 - DNA, 23 bp, Homo sapiens
cttgatggtgacagctgcaagcc

SEQ ID NO: 6175786 - DNA, 16 bp, Homo sapiens
cttgatggtttatgtt

SEQ ID NO: 6175787 - DNA, 13 bp, Homo sapiens
cttgatgtaaaat

SEQ ID NO: 6175788 - DNA, 17 bp, Homo sapiens
cttgatgtaaaatcttg

SEQ ID NO: 6175789 - DNA, 21 bp, Homo sapiens
cttgatgtaaaatcttgtcat

SEQ ID NO: 6175790 - DNA, 22 bp, Homo sapiens
cttgatgtaaaatcttgtcatg

SEQ ID NO: 6175791 - DNA, 23 bp, Homo sapiens
cttgatgtaaaatcttgtcatgt

SEQ ID NO: 6175792 - DNA, 13 bp, Homo sapiens
cttgatgtacata

SEQ ID NO: 6175793 - DNA, 17 bp, Homo sapiens
cttgatgtcatgtactt

SEQ ID NO: 6175794 - DNA, 20 bp, Homo sapiens
cttgatgtctttgttaagac

SEQ ID NO: 6175795 - DNA, 12 bp, Homo sapiens
cttgatgtgaaa

SEQ ID NO: 6175796 - DNA, 15 bp, Homo sapiens
cttgatgtgaagata

SEQ ID NO: 6175797 - DNA, 17 bp, Homo sapiens
cttgatgtgaagataat

SEQ ID NO: 6175798 - DNA, 15 bp, Homo sapiens
cttgatgtgttatct

SEQ ID NO: 6175799 - DNA, 23 bp, Homo sapiens
cttgatgttacaaggtgttgtta

SEQ ID NO: 6175800 - DNA, 16 bp, Homo sapiens
cttgatgttcctggga

SEQ ID NO: 6175801 - DNA, 18 bp, Homo sapiens
cttgatgttccttccaga

SEQ ID NO: 6175802 - DNA, 19 bp, Homo sapiens
cttgatgtttcctggaagc

SEQ ID NO: 6175803 - DNA, 20 bp, Homo sapiens
cttgatgtttctatatgtaa

SEQ ID NO: 6175804 - DNA, 14 bp, Homo sapiens
cttgattaaatcaa

SEQ ID NO: 6175805 - DNA, 15 bp, Homo sapiens
cttgattaaatcaac

SEQ ID NO: 6175806 - DNA, 15 bp, Homo sapiens
cttgattaacatctt

SEQ ID NO: 6175807 - DNA, 18 bp, Homo sapiens
cttgattaagattttaca

SEQ ID NO: 6175808 - DNA, 16 bp, Homo sapiens
cttgattaatgtactt

SEQ ID NO: 6175809 - DNA, 17 bp, Homo sapiens
cttgattaatgtacttt

SEQ ID NO: 6175810 - DNA, 14 bp, Homo sapiens
cttgattacttcca

SEQ ID NO: 6175811 - DNA, 14 bp, Homo sapiens
cttgattataaatg

SEQ ID NO: 6175812 - DNA, 17 bp, Homo sapiens
cttgattataaatgttt

SEQ ID NO: 6175813 - DNA, 19 bp, Homo sapiens
cttgattataccactgcac

SEQ ID NO: 6175814 - DNA, 22 bp, Homo sapiens
cttgattatgccttttaaaaat

SEQ ID NO: 6175815 - DNA, 18 bp, Homo sapiens
cttgattcacaatgaaat

SEQ ID NO: 6175816 - DNA, 16 bp, Homo sapiens
cttgattcagtcacat

SEQ ID NO: 6175817 - DNA, 13 bp, Homo sapiens
cttgattcctggc

SEQ ID NO: 6175818 - DNA, 15 bp, Homo sapiens
cttgattcctggctc

SEQ ID NO: 6175819 - DNA, 13 bp, Homo sapiens
cttgattgagaaa

SEQ ID NO: 6175820 - DNA, 14 bp, Homo sapiens
cttgattgagaaag

SEQ ID NO: 6175821 - DNA, 15 bp, Homo sapiens
cttgattgagaaaga

SEQ ID NO: 6175822 - DNA, 19 bp, Homo sapiens
cttgattgtacttggagta

SEQ ID NO: 6175823 - DNA, 23 bp, Homo sapiens
cttgattgtacttggagtaattg

SEQ ID NO: 6175824 - DNA, 15 bp, Homo sapiens
cttgatttacaagca

SEQ ID NO: 6175825 - DNA, 18 bp, Homo sapiens
cttgatttatttgcttct

SEQ ID NO: 6175826 - DNA, 19 bp, Homo sapiens
cttgatttcaaagttttgt

SEQ ID NO: 6175827 - DNA, 20 bp, Homo sapiens
cttgatttgatgtgactttt

SEQ ID NO: 6175828 - DNA, 19 bp, Homo sapiens
cttgattttcaagctttca

SEQ ID NO: 6175829 - DNA, 13 bp, Homo sapiens
cttgatttttcaa

SEQ ID NO: 6175830 - DNA, 12 bp, Homo sapiens
cttgcaaaaagt

SEQ ID NO: 6175831 - DNA, 21 bp, Homo sapiens
ctggaagcacagcctcgggga

SEQ ID NO: 6175832 - DNA, 15 bp, Homo sapiens
ctggaagcagagcaa

SEQ ID NO: 6175833 - DNA, 18 bp, Homo sapiens
ctggaagcagagcaaaat

SEQ ID NO: 6175834 - DNA, 14 bp, Homo sapiens
ctggaagcaggtgc

SEQ ID NO: 6175835 - DNA, 18 bp, Homo sapiens
ctggaagcaggtgctaca

SEQ ID NO: 6175836 - DNA, 22 bp, Homo sapiens
ctggaagccaaaatgtaggctt

SEQ ID NO: 6175837 - DNA, 14 bp, Homo sapiens
ctggaagcccagcc

SEQ ID NO: 6175838 - DNA, 22 bp, Homo sapiens
ctggaagcccagcccctactgc

SEQ ID NO: 6175839 - DNA, 20 bp, Homo sapiens
ctggaagcccctgggcccag

SEQ ID NO: 6175840 - DNA, 16 bp, Homo sapiens
ctggaagccctggaga

SEQ ID NO: 6175841 - DNA, 14 bp, Homo sapiens
ctggaagcctgctg

SEQ ID NO: 6175842 - DNA, 18 bp, Homo sapiens
ctggaagctaatttgcat

SEQ ID NO: 6175843 - DNA, 23 bp, Homo sapiens
ctggaagctctccgagctctggt

SEQ ID NO: 6175844 - DNA, 14 bp, Homo sapiens
ctggaagctggaag

SEQ ID NO: 6175845 - DNA, 15 bp, Homo sapiens
ctggaagctggaaga

SEQ ID NO: 6175846 - DNA, 22 bp, Homo sapiens
ctggaagctgtgtccttgcacc

SEQ ID NO: 6175847 - DNA, 23 bp, Homo sapiens
ctggaagctttgtagaaattaaa

SEQ ID NO: 6175848 - DNA, 15 bp, Homo sapiens
ctggaagctttgtcc

SEQ ID NO: 6175849 - DNA, 20 bp, Homo sapiens
ctggaagctttgtcccctgc

SEQ ID NO: 6175850 - DNA, 22 bp, Homo sapiens
ctggaagctttgtcccctgctt

SEQ ID NO: 6175851 - DNA, 13 bp, Homo sapiens
ctggaaggaacat

SEQ ID NO: 6175852 - DNA, 19 bp, Homo sapiens
ctggaaggaacatggagct

SEQ ID NO: 6175853 - DNA, 20 bp, Homo sapiens
ctggaaggaacatggagctg

SEQ ID NO: 6175854 - DNA, 22 bp, Homo sapiens
ctggaaggaacatggagctgtc

SEQ ID NO: 6175855 - DNA, 12 bp, Homo sapiens
ctggaaggaatg

SEQ ID NO: 6175856 - DNA, 13 bp, Homo sapiens
ctggaaggaggaa

SEQ ID NO: 6175857 - DNA, 22 bp, Homo sapiens
ctggaaggaggaagaatagggc

SEQ ID NO: 6175858 - DNA, 17 bp, Homo sapiens
ctggaaggagtgagagg

SEQ ID NO: 6175859 - DNA, 14 bp, Homo sapiens
ctggaaggcagggc

SEQ ID NO: 6175860 - DNA, 16 bp, Homo sapiens
ctggaaggcagggcag

SEQ ID NO: 6175861 - DNA, 19 bp, Homo sapiens
ctggaaggccccttccctg

SEQ ID NO: 6175862 - DNA, 20 bp, Homo sapiens
ctggaaggccccttccctgg

SEQ ID NO: 6175863 - DNA, 17 bp, Homo sapiens
ctggaaggctgctttct

SEQ ID NO: 6175864 - DNA, 12 bp, Homo sapiens
ctggaaggctgg

SEQ ID NO: 6175865 - DNA, 15 bp, Homo sapiens
ctggaaggctggctg

SEQ ID NO: 6175866 - DNA, 20 bp, Homo sapiens
ctggaagggaggaaggcctt

SEQ ID NO: 6175867 - DNA, 22 bp, Homo sapiens
ctggaagggaggaaggcctttc

SEQ ID NO: 6175868 - DNA, 16 bp, Homo sapiens
ctggaagggagggctt

SEQ ID NO: 6175869 - DNA, 15 bp, Homo sapiens
ctggaagggaggtgg

SEQ ID NO: 6175870 - DNA, 20 bp, Homo sapiens
ctggaagggccggcttctgc

SEQ ID NO: 6175871 - DNA, 22 bp, Homo sapiens
ctggaagggctagaacctgtag

SEQ ID NO: 6175872 - DNA, 15 bp, Homo sapiens
ctggaaggggcagca

SEQ ID NO: 6175873 - DNA, 19 bp, Homo sapiens
ctggaaggggcagccctga

SEQ ID NO: 6175874 - DNA, 20 bp, Homo sapiens
ctggaaggggcagccctgag

SEQ ID NO: 6175875 - DNA, 21 bp, Homo sapiens
ctggaaggggcagccctgagt

SEQ ID NO: 6175876 - DNA, 13 bp, Homo sapiens
ctggaaggggcca

SEQ ID NO: 6175877 - DNA, 17 bp, Homo sapiens
ctggaaggggcccgtgg

SEQ ID NO: 6175878 - DNA, 19 bp, Homo sapiens
ctggaaggggcccgtggga

SEQ ID NO: 6175879 - DNA, 17 bp, Homo sapiens
ctggaagggtccggctt

SEQ ID NO: 6175880 - DNA, 22 bp, Homo sapiens
ctggaaggtactgaaggcttct

SEQ ID NO: 6175881 - DNA, 20 bp, Homo sapiens
ctggaaggtggggacaggga

SEQ ID NO: 6175882 - DNA, 17 bp, Homo sapiens
ctggaagtctacctgct

SEQ ID NO: 6175883 - DNA, 18 bp, Homo sapiens
ctggaagtggctctgggg

SEQ ID NO: 6175884 - DNA, 16 bp, Homo sapiens
ctggaagttatttatt

SEQ ID NO: 6175885 - DNA, 16 bp, Homo sapiens
ctggaagttgtccttt

SEQ ID NO: 6175886 - DNA, 15 bp, Homo sapiens
ctggaagtttctggt

SEQ ID NO: 6175887 - DNA, 17 bp, Homo sapiens
ctggaagttttgcattt

SEQ ID NO: 6175888 - DNA, 20 bp, Homo sapiens
ctggaagttttgcatttatg

SEQ ID NO: 6175889 - DNA, 20 bp, Homo sapiens
ctggaataaaatataaaact

SEQ ID NO: 6175890 - DNA, 23 bp, Homo sapiens
ctggaataaaatataaaactgaa

SEQ ID NO: 6175891 - DNA, 19 bp, Homo sapiens
ctggaataagaagcaaata

SEQ ID NO: 6175892 - DNA, 21 bp, Homo sapiens
ctggaataagaagcaaataaa

SEQ ID NO: 6175893 - DNA, 13 bp, Homo sapiens
ctggaataagcct

SEQ ID NO: 6175894 - DNA, 15 bp, Homo sapiens
ctggaataagccttc

SEQ ID NO: 6175895 - DNA, 18 bp, Homo sapiens
ctggaataatttgtaaat

SEQ ID NO: 6175896 - DNA, 19 bp, Homo sapiens
ctggaataatttgtaaatg

SEQ ID NO: 6175897 - DNA, 21 bp, Homo sapiens
ctggaatacgatcctgcaggg

SEQ ID NO: 6175898 - DNA, 19 bp, Homo sapiens
ctggaatagttactttaca

SEQ ID NO: 6175899 - DNA, 18 bp, Homo sapiens
ctggaatatataaccagt

SEQ ID NO: 6175900 - DNA, 17 bp, Homo sapiens
ctggaatattgtgattc

SEQ ID NO: 6175901 - DNA, 18 bp, Homo sapiens
ctggaatcaatttcccag

SEQ ID NO: 6175902 - DNA, 19 bp, Homo sapiens
ctggaatcaatttcccaga

SEQ ID NO: 6175903 - DNA, 21 bp, Homo sapiens
ctggaatcaatttcccagaag

SEQ ID NO: 6175904 - DNA, 20 bp, Homo sapiens
ctggaatcagctcaggactg

SEQ ID NO: 6175905 - DNA, 21 bp, Homo sapiens
ctggaatccagaaggaagctc

SEQ ID NO: 6175906 - DNA, 14 bp, Homo sapiens
ctggaatcccagct

SEQ ID NO: 6175907 - DNA, 18 bp, Homo sapiens
ctggaatcccagctccgc

SEQ ID NO: 6175908 - DNA, 22 bp, Homo sapiens
ctggaatcctgaaagggcactt

SEQ ID NO: 6175909 - DNA, 21 bp, Homo sapiens
ctggaatcgaggctgtgtgtc

SEQ ID NO: 6175910 - DNA, 22 bp, Homo sapiens
ctggaatcgatctgtactgtaa

SEQ ID NO: 6175911 - DNA, 15 bp, Homo sapiens
ctggaatctgaggca

SEQ ID NO: 6175912 - DNA, 16 bp, Homo sapiens
ctggaatctgaggcat

SEQ ID NO: 6175913 - DNA, 22 bp, Homo sapiens
ctggaatctgaggcatcctctg

SEQ ID NO: 6175914 - DNA, 23 bp, Homo sapiens
ctggaatctgaggcatcctctga

SEQ ID NO: 6175915 - DNA, 13 bp, Homo sapiens
ctggaatcttccc

SEQ ID NO: 6175916 - DNA, 14 bp, Homo sapiens
ctggaatgaagcat

SEQ ID NO: 6175917 - DNA, 17 bp, Homo sapiens
ctggaatgaagcatgta

SEQ ID NO: 6175918 - DNA, 16 bp, Homo sapiens
ctggaatgagggaggc

SEQ ID NO: 6175919 - DNA, 17 bp, Homo sapiens
ctggaatgagggaggcg

SEQ ID NO: 6175920 - DNA, 16 bp, Homo sapiens
ctggaatgcattcact

SEQ ID NO: 6175921 - DNA, 22 bp, Homo sapiens
ctggaatgccagtttgaccttt

SEQ ID NO: 6175922 - DNA, 14 bp, Homo sapiens
ctggaatgctgggt

SEQ ID NO: 6175923 - DNA, 21 bp, Homo sapiens
ctggaatggaattcagtaaca

SEQ ID NO: 6175924 - DNA, 22 bp, Homo sapiens
ctggaatgggagacctgttggc

SEQ ID NO: 6175925 - DNA, 20 bp, Homo sapiens
ctggaatggggacctggggt

SEQ ID NO: 6175926 - DNA, 22 bp, Homo sapiens
ctggaatggggacctggggtgg

SEQ ID NO: 6175927 - DNA, 16 bp, Homo sapiens
ctggaatgtttttccc

SEQ ID NO: 6175928 - DNA, 18 bp, Homo sapiens
ctggaatgtttttccctc

SEQ ID NO: 6175929 - DNA, 16 bp, Homo sapiens
ctggaattcagcaccc

SEQ ID NO: 6175930 - DNA, 23 bp, Homo sapiens
ctggaattcagcaccctgggtgc

SEQ ID NO: 6175931 - DNA, 14 bp, Homo sapiens
ctggaattcttctg

SEQ ID NO: 6175932 - DNA, 18 bp, Homo sapiens
ctggaattgatgtttaca

SEQ ID NO: 6175933 - DNA, 16 bp, Homo sapiens
ctggaattgggctccg

SEQ ID NO: 6175934 - DNA, 23 bp, Homo sapiens
ctggaattgtggctatcctgatt

SEQ ID NO: 6175935 - DNA, 16 bp, Homo sapiens
ctggaattgttgaatg

SEQ ID NO: 6175936 - DNA, 12 bp, Homo sapiens
ctggaatttatt

SEQ ID NO: 6175937 - DNA, 14 bp, Homo sapiens
ctggaatttctgct

SEQ ID NO: 6175938 - DNA, 19 bp, Homo sapiens
ctggaatttggacaagtgc

SEQ ID NO: 6175939 - DNA, 14 bp, Homo sapiens
ctggaatttgggca

SEQ ID NO: 6175940 - DNA, 17 bp, Homo sapiens
ctggaatttgggcagat

SEQ ID NO: 6175941 - DNA, 13 bp, Homo sapiens
ctggaatttttat

SEQ ID NO: 6175942 - DNA, 18 bp, Homo sapiens
ctggaattttttattctt

SEQ ID NO: 6175943 - DNA, 20 bp, Homo sapiens
ctggaattttttattcttgt

SEQ ID NO: 6175944 - DNA, 14 bp, Homo sapiens
ctggacaacactga

SEQ ID NO: 6175945 - DNA, 16 bp, Homo sapiens
ctggacaacccagaac

SEQ ID NO: 6175946 - DNA, 21 bp, Homo sapiens
ctggacaagccaacttgtaaa

SEQ ID NO: 6175947 - DNA, 23 bp, Homo sapiens
ctggacaagccaacttgtaaata

SEQ ID NO: 6175948 - DNA, 22 bp, Homo sapiens
ctggacaatgtccaaacccact

SEQ ID NO: 6175949 - DNA, 10 bp, Homo sapiens
ctggacacac

SEQ ID NO: 6175950 - DNA, 12 bp, Homo sapiens
ctggacacacac

SEQ ID NO: 6175951 - DNA, 13 bp, Homo sapiens
ctggacacacact

SEQ ID NO: 6175952 - DNA, 22 bp, Homo sapiens
ctggacacacactcaccagtgg

SEQ ID NO: 6175953 - DNA, 20 bp, Homo sapiens
ctggacacactaaactctgg

SEQ ID NO: 6175954 - DNA, 16 bp, Homo sapiens
ctggacacagcccacc

SEQ ID NO: 6175955 - DNA, 17 bp, Homo sapiens
ctggacacagcccaccc

SEQ ID NO: 6175956 - DNA, 15 bp, Homo sapiens
ctggacacagctctt

SEQ ID NO: 6175957 - DNA, 16 bp, Homo sapiens
ctggacacagctcttc

SEQ ID NO: 6175958 - DNA, 18 bp, Homo sapiens
ctggacacagctcttcat

SEQ ID NO: 6175959 - DNA, 15 bp, Homo sapiens
ctggacacagtcagg

SEQ ID NO: 6175960 - DNA, 16 bp, Homo sapiens
ctggacacagtcaggg

SEQ ID NO: 6175961 - DNA, 18 bp, Homo sapiens
ctggacacccccttggtg

SEQ ID NO: 6175962 - DNA, 17 bp, Homo sapiens
ctggacacccctgctct

SEQ ID NO: 6175963 - DNA, 19 bp, Homo sapiens
ctggacaccctctgccgag

SEQ ID NO: 6175964 - DNA, 13 bp, Homo sapiens
ctggacacctccc

SEQ ID NO: 6175965 - DNA, 17 bp, Homo sapiens
ctggacacctcccaggg

SEQ ID NO: 6175966 - DNA, 20 bp, Homo sapiens
ctggacacctcccaggggac

SEQ ID NO: 6175967 - DNA, 16 bp, Homo sapiens
ctggacactcagacct

SEQ ID NO: 6175968 - DNA, 18 bp, Homo sapiens
ctggacactctatatgta

SEQ ID NO: 6175969 - DNA, 19 bp, Homo sapiens
ctggacactgtgaaataca

SEQ ID NO: 6175970 - DNA, 11 bp, Homo sapiens
ctggacagaac

SEQ ID NO: 6175971 - DNA, 13 bp, Homo sapiens
ctggacagacaga

SEQ ID NO: 6175972 - DNA, 11 bp, Homo sapiens
ctggacagacc

SEQ ID NO: 6175973 - DNA, 12 bp, Homo sapiens
ctggacagaccc

SEQ ID NO: 6175974 - DNA, 13 bp, Homo sapiens
ctggacagaccca

SEQ ID NO: 6175975 - DNA, 15 bp, Homo sapiens
ctggacagacccagg

SEQ ID NO: 6175976 - DNA, 18 bp, Homo sapiens
ctggacagacccaggtct

SEQ ID NO: 6175977 - DNA, 23 bp, Homo sapiens
ctggacagacccaggtcttccag

SEQ ID NO: 6175978 - DNA, 13 bp, Homo sapiens
ctggacagagact

SEQ ID NO: 6175979 - DNA, 21 bp, Homo sapiens
ctggacagagactcagcgctc

SEQ ID NO: 6175980 - DNA, 19 bp, Homo sapiens
ctggacagaggcggggcta

SEQ ID NO: 6175981 - DNA, 13 bp, Homo sapiens
ctggacagagggg

SEQ ID NO: 6175982 - DNA, 22 bp, Homo sapiens
ctggacagaggggactctgggc

SEQ ID NO: 6175983 - DNA, 21 bp, Homo sapiens
ctggacagatggacgcaggcc

SEQ ID NO: 6175984 - DNA, 22 bp, Homo sapiens
ctggacagatggacgcaggccc

SEQ ID NO: 6175985 - DNA, 13 bp, Homo sapiens
ctggacagatggc

SEQ ID NO: 6175986 - DNA, 21 bp, Homo sapiens
ctggacagatggcccaaggga

SEQ ID NO: 6175987 - DNA, 21 bp, Homo sapiens
ctggacagatgggtgtcccct

SEQ ID NO: 6175988 - DNA, 18 bp, Homo sapiens
ctggacagcagaagcctc

SEQ ID NO: 6175989 - DNA, 14 bp, Homo sapiens
ctggacagcagcag

SEQ ID NO: 6175990 - DNA, 18 bp, Homo sapiens
ctggacagcatcagaaat

SEQ ID NO: 6175991 - DNA, 12 bp, Homo sapiens
ctggacagccag

SEQ ID NO: 6175992 - DNA, 20 bp, Homo sapiens
ctggacagccagggcagggc

SEQ ID NO: 6175993 - DNA, 21 bp, Homo sapiens
ctggacagccagggcagggct

SEQ ID NO: 6175994 - DNA, 14 bp, Homo sapiens
ctggacagccagtg

SEQ ID NO: 6175995 - DNA, 13 bp, Homo sapiens
ctggacagcccca

SEQ ID NO: 6175996 - DNA, 16 bp, Homo sapiens
ctggacagccccaccc

SEQ ID NO: 6175997 - DNA, 19 bp, Homo sapiens
ctggacagccccaccctgg

SEQ ID NO: 6175998 - DNA, 23 bp, Homo sapiens
ctggacagcctcttctgtcccaa

SEQ ID NO: 6175999 - DNA, 17 bp, Homo sapiens
ctggacagcggcagtgg

SEQ ID NO: 6176000 - DNA, 22 bp, Homo sapiens
ctggacagcggttgtaaataca

SEQ ID NO: 6176001 - DNA, 16 bp, Homo sapiens
ctggacagctgtgcct

SEQ ID NO: 6176002 - DNA, 19 bp, Homo sapiens
ctggacagctgtgcctcgc

SEQ ID NO: 6176003 - DNA, 17 bp, Homo sapiens
ctggacagctttgctcc

SEQ ID NO: 6176004 - DNA, 15 bp, Homo sapiens
ctggacaggcagcct

SEQ ID NO: 6176005 - DNA, 14 bp, Homo sapiens
ctggacaggcatgt

SEQ ID NO: 6176006 - DNA, 15 bp, Homo sapiens
ctggacaggcgggct

SEQ ID NO: 6176007 - DNA, 15 bp, Homo sapiens
ctggacaggctctgc

SEQ ID NO: 6176008 - DNA, 19 bp, Homo sapiens
ctggacaggctctgcttct

SEQ ID NO: 6176009 - DNA, 17 bp, Homo sapiens
cttgcaaaattcctgac

SEQ ID NO: 6176010 - DNA, 23 bp, Homo sapiens
cttgcaaactctataaagaaact

SEQ ID NO: 6176011 - DNA, 20 bp, Homo sapiens
cttgcaaagacctacctcca

SEQ ID NO: 6176012 - DNA, 13 bp, Homo sapiens
cttgcaaagcaac

SEQ ID NO: 6176013 - DNA, 17 bp, Homo sapiens
cttgcaaagcctttaaa

SEQ ID NO: 6176014 - DNA, 22 bp, Homo sapiens
cttgcaaagtatccctactgta

SEQ ID NO: 6176015 - DNA, 17 bp, Homo sapiens
cttgcaaatgaatgcct

SEQ ID NO: 6176016 - DNA, 15 bp, Homo sapiens
cttgcaacccaaggt

SEQ ID NO: 6176017 - DNA, 20 bp, Homo sapiens
cttgcaacccaaggtgaggt

SEQ ID NO: 6176018 - DNA, 15 bp, Homo sapiens
cttgcaactaaggac

SEQ ID NO: 6176019 - DNA, 20 bp, Homo sapiens
cttgcaactaaggacaaatt

SEQ ID NO: 6176020 - DNA, 21 bp, Homo sapiens
cttgcaactaaggacaaatta

SEQ ID NO: 6176021 - DNA, 20 bp, Homo sapiens
cttgcaagcaacaagctatt

SEQ ID NO: 6176022 - DNA, 12 bp, Homo sapiens
cttgcaagccat

SEQ ID NO: 6176023 - DNA, 13 bp, Homo sapiens
cttgcaagctcca

SEQ ID NO: 6176024 - DNA, 14 bp, Homo sapiens
cttgcaagctccag

SEQ ID NO: 6176025 - DNA, 15 bp, Homo sapiens
cttgcaagctccagt

SEQ ID NO: 6176026 - DNA, 19 bp, Homo sapiens
cttgcaagctccagtagct

SEQ ID NO: 6176027 - DNA, 14 bp, Homo sapiens
cttgcaataagata

SEQ ID NO: 6176028 - DNA, 15 bp, Homo sapiens
cttgcaatagtttgc

SEQ ID NO: 6176029 - DNA, 17 bp, Homo sapiens
cttgcaatccaggctgt

SEQ ID NO: 6176030 - DNA, 17 bp, Homo sapiens
cttgcaatctaatctga

SEQ ID NO: 6176031 - DNA, 18 bp, Homo sapiens
cttgcaatctaatctgaa

SEQ ID NO: 6176032 - DNA, 17 bp, Homo sapiens
cttgcaatcttctactt

SEQ ID NO: 6176033 - DNA, 14 bp, Homo sapiens
cttgcaatggcagc

SEQ ID NO: 6176034 - DNA, 17 bp, Homo sapiens
cttgcaatttctaccta

SEQ ID NO: 6176035 - DNA, 13 bp, Homo sapiens
cttgcaatttgaa

SEQ ID NO: 6176036 - DNA, 15 bp, Homo sapiens
cttgcaatttgaagg

SEQ ID NO: 6176037 - DNA, 16 bp, Homo sapiens
cttgcacaagcttgta

SEQ ID NO: 6176038 - DNA, 20 bp, Homo sapiens
cttgcacaagcttgtatata

SEQ ID NO: 6176039 - DNA, 23 bp, Homo sapiens
cttgcacacactttcatgcagtg

SEQ ID NO: 6176040 - DNA, 20 bp, Homo sapiens
cttgcacacagggaggctgt

SEQ ID NO: 6176041 - DNA, 13 bp, Homo sapiens
cttgcacacatca

SEQ ID NO: 6176042 - DNA, 14 bp, Homo sapiens
cttgcacacatcat

SEQ ID NO: 6176043 - DNA, 14 bp, Homo sapiens
cttgcacacccact

SEQ ID NO: 6176044 - DNA, 17 bp, Homo sapiens
cttgcacacccactgcc

SEQ ID NO: 6176045 - DNA, 23 bp, Homo sapiens
cttgcacactcccctgcactgga

SEQ ID NO: 6176046 - DNA, 16 bp, Homo sapiens
cttgcacacttcccca

SEQ ID NO: 6176047 - DNA, 12 bp, Homo sapiens
cttgcacagagg

SEQ ID NO: 6176048 - DNA, 14 bp, Homo sapiens
cttgcacagccaac

SEQ ID NO: 6176049 - DNA, 20 bp, Homo sapiens
cttgcacagccaacgagaca

SEQ ID NO: 6176050 - DNA, 19 bp, Homo sapiens
cttgcacagcccacacatg

SEQ ID NO: 6176051 - DNA, 16 bp, Homo sapiens
cttgcacagctggaga

SEQ ID NO: 6176052 - DNA, 15 bp, Homo sapiens
cttgcacaggccact

SEQ ID NO: 6176053 - DNA, 16 bp, Homo sapiens
cttgcacaggccactt

SEQ ID NO: 6176054 - DNA, 18 bp, Homo sapiens
cttgcacatatttgaatg

SEQ ID NO: 6176055 - DNA, 15 bp, Homo sapiens
cttgcaccaaattat

SEQ ID NO: 6176056 - DNA, 23 bp, Homo sapiens
cttgcaccccaaagctttcctgc

SEQ ID NO: 6176057 - DNA, 18 bp, Homo sapiens
cttgcacccctcactctg

SEQ ID NO: 6176058 - DNA, 16 bp, Homo sapiens
cttgcaccccttcctc

SEQ ID NO: 6176059 - DNA, 16 bp, Homo sapiens
cttgcacccgcctctc

SEQ ID NO: 6176060 - DNA, 19 bp, Homo sapiens
cttgcacctcagcctccca

SEQ ID NO: 6176061 - DNA, 16 bp, Homo sapiens
cttgcacctctgacct

SEQ ID NO: 6176062 - DNA, 14 bp, Homo sapiens
cttgcacctgagcc

SEQ ID NO: 6176063 - DNA, 19 bp, Homo sapiens
cttgcacgaccgccccagt

SEQ ID NO: 6176064 - DNA, 21 bp, Homo sapiens
cttgcacgcgccctttctacc

SEQ ID NO: 6176065 - DNA, 18 bp, Homo sapiens
cttgcactcctcacacag

SEQ ID NO: 6176066 - DNA, 13 bp, Homo sapiens
cttgcactccttc

SEQ ID NO: 6176067 - DNA, 17 bp, Homo sapiens
cttgcactctcttggct

SEQ ID NO: 6176068 - DNA, 12 bp, Homo sapiens
cttgcactgaat

SEQ ID NO: 6176069 - DNA, 13 bp, Homo sapiens
cttgcactgaata

SEQ ID NO: 6176070 - DNA, 13 bp, Homo sapiens
cttgcactggggg

SEQ ID NO: 6176071 - DNA, 14 bp, Homo sapiens
cttgcactgtatcc

SEQ ID NO: 6176072 - DNA, 18 bp, Homo sapiens
cttgcactgtatccaagt

SEQ ID NO: 6176073 - DNA, 15 bp, Homo sapiens
cttgcactgtgcttg

SEQ ID NO: 6176074 - DNA, 17 bp, Homo sapiens
cttgcactgtgggggct

SEQ ID NO: 6176075 - DNA, 13 bp, Homo sapiens
cttgcactgtggt

SEQ ID NO: 6176076 - DNA, 15 bp, Homo sapiens
cttgcacttctgtta

SEQ ID NO: 6176077 - DNA, 17 bp, Homo sapiens
cttgcagaaaatgaatg

SEQ ID NO: 6176078 - DNA, 16 bp, Homo sapiens
cttgcagaactgccat

SEQ ID NO: 6176079 - DNA, 18 bp, Homo sapiens
cttgcagaactgccatta

SEQ ID NO: 6176080 - DNA, 22 bp, Homo sapiens
cttgcagaaggcaaggccctgc

SEQ ID NO: 6176081 - DNA, 21 bp, Homo sapiens
cttgcagactctacagaggcc

SEQ ID NO: 6176082 - DNA, 18 bp, Homo sapiens
cttgcagagaagccttgg

SEQ ID NO: 6176083 - DNA, 16 bp, Homo sapiens
cttgcagaggagccca

SEQ ID NO: 6176084 - DNA, 17 bp, Homo sapiens
cttgcagaggagcccag

SEQ ID NO: 6176085 - DNA, 19 bp, Homo sapiens
cttgcagaggagcccagtg

SEQ ID NO: 6176086 - DNA, 21 bp, Homo sapiens
cttgcagagttcatggaatgt

SEQ ID NO: 6176087 - DNA, 19 bp, Homo sapiens
cttgcagcactcacacagg

SEQ ID NO: 6176088 - DNA, 13 bp, Homo sapiens
cttgcagcaggat

SEQ ID NO: 6176089 - DNA, 23 bp, Homo sapiens
cttgcagcaggatctagaggggg

SEQ ID NO: 6176090 - DNA, 18 bp, Homo sapiens
cttgcagcagggctgggc

SEQ ID NO: 6176091 - DNA, 13 bp, Homo sapiens
cttgcagccagga

SEQ ID NO: 6176092 - DNA, 14 bp, Homo sapiens
cttgcagccaggag

SEQ ID NO: 6176093 - DNA, 16 bp, Homo sapiens
cttgcagcctggtcac

SEQ ID NO: 6176094 - DNA, 20 bp, Homo sapiens
cttgcagcgccaagtggcca

SEQ ID NO: 6176095 - DNA, 13 bp, Homo sapiens
cttgcagctggcc

SEQ ID NO: 6176096 - DNA, 17 bp, Homo sapiens
cttgcagctggcccact

SEQ ID NO: 6176097 - DNA, 23 bp, Homo sapiens
cttgcaggaaggactatgaaaag

SEQ ID NO: 6176098 - DNA, 13 bp, Homo sapiens
cttgcaggcaagc

SEQ ID NO: 6176099 - DNA, 21 bp, Homo sapiens
cttgcaggggtcccccctcaa

SEQ ID NO: 6176100 - DNA, 17 bp, Homo sapiens
cttgcaggggtccctgc

SEQ ID NO: 6176101 - DNA, 13 bp, Homo sapiens
cttgcagggtggg

SEQ ID NO: 6176102 - DNA, 18 bp, Homo sapiens
cttgcagtaattcaactg

SEQ ID NO: 6176103 - DNA, 21 bp, Homo sapiens
cttgcagtagattttctttaa

SEQ ID NO: 6176104 - DNA, 17 bp, Homo sapiens
cttgcagtcatcagaag

SEQ ID NO: 6176105 - DNA, 20 bp, Homo sapiens
cttgcagtcttgtagctaga

SEQ ID NO: 6176106 - DNA, 20 bp, Homo sapiens
cttgcagtgaagtgttctgc

SEQ ID NO: 6176107 - DNA, 16 bp, Homo sapiens
cttgcagttatgttat

SEQ ID NO: 6176108 - DNA, 17 bp, Homo sapiens
cttgcagttatgttatc

SEQ ID NO: 6176109 - DNA, 18 bp, Homo sapiens
cttgcagttcagcaccac

SEQ ID NO: 6176110 - DNA, 14 bp, Homo sapiens
cttgcagttcttga

SEQ ID NO: 6176111 - DNA, 21 bp, Homo sapiens
cttgcagtttaagatgacact

SEQ ID NO: 6176112 - DNA, 15 bp, Homo sapiens
cttgcataagcctca

SEQ ID NO: 6176113 - DNA, 20 bp, Homo sapiens
cttgcataataagctaaaga

SEQ ID NO: 6176114 - DNA, 21 bp, Homo sapiens
cttgcatacaaacaagcatat

SEQ ID NO: 6176115 - DNA, 21 bp, Homo sapiens
cttgcatagtaaatgtagttc

SEQ ID NO: 6176116 - DNA, 21 bp, Homo sapiens
cttgcatattgttggcacaga

SEQ ID NO: 6176117 - DNA, 14 bp, Homo sapiens
cttgcatcaagggg

SEQ ID NO: 6176118 - DNA, 18 bp, Homo sapiens
cttgcatctaaccaaaaa

SEQ ID NO: 6176119 - DNA, 22 bp, Homo sapiens
cttgcatctaatgaaaaacaaa

SEQ ID NO: 6176120 - DNA, 23 bp, Homo sapiens
cttgcatctaatgaaaaacaaaa

SEQ ID NO: 6176121 - DNA, 14 bp, Homo sapiens
cttgcatgaagaga

SEQ ID NO: 6176122 - DNA, 13 bp, Homo sapiens
cttgcatgaggct

SEQ ID NO: 6176123 - DNA, 15 bp, Homo sapiens
cttgcatggagaatg

SEQ ID NO: 6176124 - DNA, 21 bp, Homo sapiens
cttgcatggtttagaaagctt

SEQ ID NO: 6176125 - DNA, 19 bp, Homo sapiens
cttgcatggtttggagctg

SEQ ID NO: 6176126 - DNA, 13 bp, Homo sapiens
cttgcatgtaacg

SEQ ID NO: 6176127 - DNA, 17 bp, Homo sapiens
cttgcattaaaagactg

SEQ ID NO: 6176128 - DNA, 23 bp, Homo sapiens
cttgcattccagagttaaaatgt

SEQ ID NO: 6176129 - DNA, 12 bp, Homo sapiens
cttgcattccca

SEQ ID NO: 6176130 - DNA, 14 bp, Homo sapiens
cttgcattgacatt

SEQ ID NO: 6176131 - DNA, 14 bp, Homo sapiens
cttgcattgcagag

SEQ ID NO: 6176132 - DNA, 22 bp, Homo sapiens
cttgcatttcacttgagtggag

SEQ ID NO: 6176133 - DNA, 17 bp, Homo sapiens
cttgcatttctttattt

SEQ ID NO: 6176134 - DNA, 21 bp, Homo sapiens
cttgcatttctttatttctgt

SEQ ID NO: 6176135 - DNA, 21 bp, Homo sapiens
cttgcatttgtggtaatctac

SEQ ID NO: 6176136 - DNA, 10 bp, Homo sapiens
cttgcatttt

SEQ ID NO: 6176137 - DNA, 16 bp, Homo sapiens
cttgcattttagctaa

SEQ ID NO: 6176138 - DNA, 20 bp, Homo sapiens
cttgcattttggaaggctga

SEQ ID NO: 6176139 - DNA, 11 bp, Homo sapiens
cttgcattttt

SEQ ID NO: 6176140 - DNA, 12 bp, Homo sapiens
cttgcatttttg

SEQ ID NO: 6176141 - DNA, 14 bp, Homo sapiens
cttgcatttttgca

SEQ ID NO: 6176142 - DNA, 21 bp, Homo sapiens
cttgcatttttgcaggagcag

SEQ ID NO: 6176143 - DNA, 16 bp, Homo sapiens
cttgccaaaatgttgg

SEQ ID NO: 6176144 - DNA, 22 bp, Homo sapiens
cttgccaaagcagattttccta

SEQ ID NO: 6176145 - DNA, 20 bp, Homo sapiens
cttgccaaagtacagaattt

SEQ ID NO: 6176146 - DNA, 17 bp, Homo sapiens
cttgccaaatataaata

SEQ ID NO: 6176147 - DNA, 22 bp, Homo sapiens
cttgccaaattccatgtccctg

SEQ ID NO: 6176148 - DNA, 22 bp, Homo sapiens
cttgccaagactcattgctgga

SEQ ID NO: 6176149 - DNA, 21 bp, Homo sapiens
cttgccaagggtccctgtgtg

SEQ ID NO: 6176150 - DNA, 22 bp, Homo sapiens
cttgccaatgaggtctgaaatg

SEQ ID NO: 6176151 - DNA, 15 bp, Homo sapiens
cttgccaatggtgta

SEQ ID NO: 6176152 - DNA, 13 bp, Homo sapiens
cttgccacaatca

SEQ ID NO: 6176153 - DNA, 21 bp, Homo sapiens
cttgccacatctgtgtctctg

SEQ ID NO: 6176154 - DNA, 23 bp, Homo sapiens
cttgccacatcttgaaaatgcca

SEQ ID NO: 6176155 - DNA, 23 bp, Homo sapiens
cttgccacatggtgtctcccaac

SEQ ID NO: 6176156 - DNA, 19 bp, Homo sapiens
cttgccacccattcttccc

SEQ ID NO: 6176157 - DNA, 20 bp, Homo sapiens
cttgccacccattcttcccg

SEQ ID NO: 6176158 - DNA, 22 bp, Homo sapiens
cttgccaccccaccctccctgg

SEQ ID NO: 6176159 - DNA, 23 bp, Homo sapiens
cttgccaccccaccctccctgga

SEQ ID NO: 6176160 - DNA, 16 bp, Homo sapiens
cttgccacccccagtt

SEQ ID NO: 6176161 - DNA, 20 bp, Homo sapiens
cttgccaccccccgccggca

SEQ ID NO: 6176162 - DNA, 17 bp, Homo sapiens
cttgccactgcactcca

SEQ ID NO: 6176163 - DNA, 12 bp, Homo sapiens
cttgccactgcc

SEQ ID NO: 6176164 - DNA, 13 bp, Homo sapiens
cttgccactgcca

SEQ ID NO: 6176165 - DNA, 14 bp, Homo sapiens
cttgccactgccat

SEQ ID NO: 6176166 - DNA, 17 bp, Homo sapiens
cttgccactgccataac

SEQ ID NO: 6176167 - DNA, 12 bp, Homo sapiens
cttgccagagat

SEQ ID NO: 6176168 - DNA, 16 bp, Homo sapiens
cttgccagagatccaa

SEQ ID NO: 6176169 - DNA, 23 bp, Homo sapiens
cttgccagagatccaaaagaagc

SEQ ID NO: 6176170 - DNA, 13 bp, Homo sapiens
cttgccagagccg

SEQ ID NO: 6176171 - DNA, 20 bp, Homo sapiens
cttgccagagccgggcacat

SEQ ID NO: 6176172 - DNA, 18 bp, Homo sapiens
cttgccagaggccctcgg

SEQ ID NO: 6176173 - DNA, 13 bp, Homo sapiens
cttgccagccaga

SEQ ID NO: 6176174 - DNA, 11 bp, Homo sapiens
cttgccagcct

SEQ ID NO: 6176175 - DNA, 23 bp, Homo sapiens
cttgccagcctcaggcttgaggg

SEQ ID NO: 6176176 - DNA, 13 bp, Homo sapiens
cttgccagcctcc

SEQ ID NO: 6176177 - DNA, 13 bp, Homo sapiens
cttgccagctcag

SEQ ID NO: 6176178 - DNA, 12 bp, Homo sapiens
cttgccagctgc

SEQ ID NO: 6176179 - DNA, 19 bp, Homo sapiens
cttgccagctgctgagccg

SEQ ID NO: 6176180 - DNA, 21 bp, Homo sapiens
cttgccagctgctgagccgca

SEQ ID NO: 6176181 - DNA, 22 bp, Homo sapiens
cttgccagctgctgagccgcag

SEQ ID NO: 6176182 - DNA, 20 bp, Homo sapiens
cttgccaggaggctggcagt

SEQ ID NO: 6176183 - DNA, 19 bp, Homo sapiens
cttgccagggcagggtctg

SEQ ID NO: 6176184 - DNA, 23 bp, Homo sapiens
cttgccagggtttcgagaagctg

SEQ ID NO: 6176185 - DNA, 13 bp, Homo sapiens
cttgccatcactg

SEQ ID NO: 6176186 - DNA, 16 bp, Homo sapiens
cttgccatcccaagcc

SEQ ID NO: 6176187 - DNA, 21 bp, Homo sapiens
cttgccatccctccctccacc

SEQ ID NO: 6176188 - DNA, 21 bp, Homo sapiens
ctggacaggcttcgtctcaga

SEQ ID NO: 6176189 - DNA, 22 bp, Homo sapiens
ctggacaggcttcgtctcagaa

SEQ ID NO: 6176190 - DNA, 13 bp, Homo sapiens
ctggacaggtctg

SEQ ID NO: 6176191 - DNA, 18 bp, Homo sapiens
ctggacagtacctgattg

SEQ ID NO: 6176192 - DNA, 20 bp, Homo sapiens
ctggacagtatcactgtctt

SEQ ID NO: 6176193 - DNA, 19 bp, Homo sapiens
ctggacagtcagctcttca

SEQ ID NO: 6176194 - DNA, 18 bp, Homo sapiens
ctggacataacattttca

SEQ ID NO: 6176195 - DNA, 17 bp, Homo sapiens
ctggacatactgctgga

SEQ ID NO: 6176196 - DNA, 22 bp, Homo sapiens
ctggacatcacagcagaatgaa

SEQ ID NO: 6176197 - DNA, 17 bp, Homo sapiens
ctggacatcaccagtcc

SEQ ID NO: 6176198 - DNA, 18 bp, Homo sapiens
ctggacatcaccagtcct

SEQ ID NO: 6176199 - DNA, 23 bp, Homo sapiens
ctggacatgaagattctttccca

SEQ ID NO: 6176200 - DNA, 16 bp, Homo sapiens
ctggacatgagatgga

SEQ ID NO: 6176201 - DNA, 17 bp, Homo sapiens
ctggacatgcctgtcct

SEQ ID NO: 6176202 - DNA, 15 bp, Homo sapiens
ctggacattctcttt

SEQ ID NO: 6176203 - DNA, 17 bp, Homo sapiens
ctggacattctctttga

SEQ ID NO: 6176204 - DNA, 22 bp, Homo sapiens
ctggacatttcatataaatgga

SEQ ID NO: 6176205 - DNA, 18 bp, Homo sapiens
ctggacatttgccttgct

SEQ ID NO: 6176206 - DNA, 22 bp, Homo sapiens
ctggacatttgtggcagtgctg

SEQ ID NO: 6176207 - DNA, 23 bp, Homo sapiens
ctggaccaaccctgtttcctgag

SEQ ID NO: 6176208 - DNA, 19 bp, Homo sapiens
ctggaccaaggtgaagcaa

SEQ ID NO: 6176209 - DNA, 20 bp, Homo sapiens
ctggaccaaggtgaagcaaa

SEQ ID NO: 6176210 - DNA, 16 bp, Homo sapiens
ctggaccacacctccg

SEQ ID NO: 6176211 - DNA, 20 bp, Homo sapiens
ctggaccaccagccccagca

SEQ ID NO: 6176212 - DNA, 16 bp, Homo sapiens
ctggaccacgaggctg

SEQ ID NO: 6176213 - DNA, 21 bp, Homo sapiens
ctggaccacgtctccctggcc

SEQ ID NO: 6176214 - DNA, 13 bp, Homo sapiens
ctggaccagatgc

SEQ ID NO: 6176215 - DNA, 13 bp, Homo sapiens
ctggaccagcctc

SEQ ID NO: 6176216 - DNA, 14 bp, Homo sapiens
ctggaccagcctcc

SEQ ID NO: 6176217 - DNA, 14 bp, Homo sapiens
ctggaccagcctct

SEQ ID NO: 6176218 - DNA, 16 bp, Homo sapiens
ctggaccagctggcct

SEQ ID NO: 6176219 - DNA, 12 bp, Homo sapiens
ctggaccaggtc

SEQ ID NO: 6176220 - DNA, 14 bp, Homo sapiens
ctggaccaggtcct

SEQ ID NO: 6176221 - DNA, 19 bp, Homo sapiens
ctggaccatacgcggagga

SEQ ID NO: 6176222 - DNA, 16 bp, Homo sapiens
ctggaccatctctgta

SEQ ID NO: 6176223 - DNA, 13 bp, Homo sapiens
ctggaccatgctg

SEQ ID NO: 6176224 - DNA, 16 bp, Homo sapiens
ctggaccattcctgtc

SEQ ID NO: 6176225 - DNA, 17 bp, Homo sapiens
ctggacccagccaggcc

SEQ ID NO: 6176226 - DNA, 18 bp, Homo sapiens
ctggacccagccaggccc

SEQ ID NO: 6176227 - DNA, 21 bp, Homo sapiens
ctggacccagccaggcccagc

SEQ ID NO: 6176228 - DNA, 19 bp, Homo sapiens
ctggacccatttgccagga

SEQ ID NO: 6176229 - DNA, 17 bp, Homo sapiens
ctggaccccactggctg

SEQ ID NO: 6176230 - DNA, 21 bp, Homo sapiens
ctggaccccactggctgagaa

SEQ ID NO: 6176231 - DNA, 15 bp, Homo sapiens
ctggaccccagcctc

SEQ ID NO: 6176232 - DNA, 16 bp, Homo sapiens
ctggaccccagccttg

SEQ ID NO: 6176233 - DNA, 17 bp, Homo sapiens
ctggaccccagccttgg

SEQ ID NO: 6176234 - DNA, 12 bp, Homo sapiens
ctggaccccagg

SEQ ID NO: 6176235 - DNA, 16 bp, Homo sapiens
ctggaccccaggctct

SEQ ID NO: 6176236 - DNA, 17 bp, Homo sapiens
ctggaccccaggctctt

SEQ ID NO: 6176237 - DNA, 17 bp, Homo sapiens
ctggaccccatctgtga

SEQ ID NO: 6176238 - DNA, 19 bp, Homo sapiens
ctggaccccatctgtgaat

SEQ ID NO: 6176239 - DNA, 22 bp, Homo sapiens
ctggaccccatctgtgaataag

SEQ ID NO: 6176240 - DNA, 23 bp, Homo sapiens
ctggacccccagcccccagggcc

SEQ ID NO: 6176241 - DNA, 23 bp, Homo sapiens
ctggacccccctttcacaggcag

SEQ ID NO: 6176242 - DNA, 13 bp, Homo sapiens
ctggaccccgcct

SEQ ID NO: 6176243 - DNA, 20 bp, Homo sapiens
ctggaccccgtttcattttt

SEQ ID NO: 6176244 - DNA, 14 bp, Homo sapiens
ctggacccctgcat

SEQ ID NO: 6176245 - DNA, 18 bp, Homo sapiens
ctggacccctgcattgga

SEQ ID NO: 6176246 - DNA, 23 bp, Homo sapiens
ctggacccctgcattggaactgg

SEQ ID NO: 6176247 - DNA, 21 bp, Homo sapiens
ctggacccctgggcctcatca

SEQ ID NO: 6176248 - DNA, 14 bp, Homo sapiens
ctggacccctgggg

SEQ ID NO: 6176249 - DNA, 13 bp, Homo sapiens
ctggaccctgacc

SEQ ID NO: 6176250 - DNA, 21 bp, Homo sapiens
ctggaccctgaccagctcccc

SEQ ID NO: 6176251 - DNA, 14 bp, Homo sapiens
ctggaccctggcct

SEQ ID NO: 6176252 - DNA, 17 bp, Homo sapiens
ctggaccctgttgctaa

SEQ ID NO: 6176253 - DNA, 18 bp, Homo sapiens
ctggacccttataaaatc

SEQ ID NO: 6176254 - DNA, 15 bp, Homo sapiens
ctggaccgagatgtg

SEQ ID NO: 6176255 - DNA, 16 bp, Homo sapiens
ctggaccgagatgtga

SEQ ID NO: 6176256 - DNA, 16 bp, Homo sapiens
ctggaccgagtggacc

SEQ ID NO: 6176257 - DNA, 18 bp, Homo sapiens
ctggaccgcttcccagag

SEQ ID NO: 6176258 - DNA, 21 bp, Homo sapiens
ctggaccgcttcccagaggcc

SEQ ID NO: 6176259 - DNA, 13 bp, Homo sapiens
ctggaccggggcc

SEQ ID NO: 6176260 - DNA, 18 bp, Homo sapiens
ctggaccggggccttggt

SEQ ID NO: 6176261 - DNA, 19 bp, Homo sapiens
ctggaccgtttccaagctg

SEQ ID NO: 6176262 - DNA, 22 bp, Homo sapiens
ctggacctatgcagggaggcca

SEQ ID NO: 6176263 - DNA, 20 bp, Homo sapiens
ctggacctcaggagggcagg

SEQ ID NO: 6176264 - DNA, 22 bp, Homo sapiens
ctggacctcaggagggcaggct

SEQ ID NO: 6176265 - DNA, 14 bp, Homo sapiens
ctggacctcagttt

SEQ ID NO: 6176266 - DNA, 12 bp, Homo sapiens
ctggacctccat

SEQ ID NO: 6176267 - DNA, 19 bp, Homo sapiens
ctggacctccccctcttgg

SEQ ID NO: 6176268 - DNA, 19 bp, Homo sapiens
ctggacctcggtgatgcct

SEQ ID NO: 6176269 - DNA, 14 bp, Homo sapiens
ctggacctgaaggc

SEQ ID NO: 6176270 - DNA, 23 bp, Homo sapiens
ctggacctgaccagactgtgggt

SEQ ID NO: 6176271 - DNA, 22 bp, Homo sapiens
ctggacctgcctgctgcagtca

SEQ ID NO: 6176272 - DNA, 21 bp, Homo sapiens
ctggacctgctgacatagtgg

SEQ ID NO: 6176273 - DNA, 13 bp, Homo sapiens
ctggacctggaac

SEQ ID NO: 6176274 - DNA, 13 bp, Homo sapiens
ctggacctgggaa

SEQ ID NO: 6176275 - DNA, 13 bp, Homo sapiens
ctggacctgggat

SEQ ID NO: 6176276 - DNA, 12 bp, Homo sapiens
ctggacctgggg

SEQ ID NO: 6176277 - DNA, 13 bp, Homo sapiens
ctggacctgggga

SEQ ID NO: 6176278 - DNA, 15 bp, Homo sapiens
ctggacctgggggta

SEQ ID NO: 6176279 - DNA, 17 bp, Homo sapiens
ctggaccttgacagagc

SEQ ID NO: 6176280 - DNA, 20 bp, Homo sapiens
ctggaccttgacagagcagc

SEQ ID NO: 6176281 - DNA, 21 bp, Homo sapiens
ctggaccttgacagagcagct

SEQ ID NO: 6176282 - DNA, 22 bp, Homo sapiens
ctggaccttggccctacagccc

SEQ ID NO: 6176283 - DNA, 23 bp, Homo sapiens
ctggaccttttcccttgctgtac

SEQ ID NO: 6176284 - DNA, 19 bp, Homo sapiens
ctggacgaagagcaggcca

SEQ ID NO: 6176285 - DNA, 20 bp, Homo sapiens
ctggacgaagagcaggccag

SEQ ID NO: 6176286 - DNA, 21 bp, Homo sapiens
ctggacgaagagcaggccagc

SEQ ID NO: 6176287 - DNA, 21 bp, Homo sapiens
ctggacgatagcttggaggga

SEQ ID NO: 6176288 - DNA, 17 bp, Homo sapiens
ctggacgcagccacaca

SEQ ID NO: 6176289 - DNA, 19 bp, Homo sapiens
ctggacgcagccacacagt

SEQ ID NO: 6176290 - DNA, 14 bp, Homo sapiens
ctggacggcaggct

SEQ ID NO: 6176291 - DNA, 20 bp, Homo sapiens
ctggacggcaggctcactgc

SEQ ID NO: 6176292 - DNA, 21 bp, Homo sapiens
ctggacggcaggctcactgcc

SEQ ID NO: 6176293 - DNA, 17 bp, Homo sapiens
ctggacggcattcctgc

SEQ ID NO: 6176294 - DNA, 13 bp, Homo sapiens
ctggacgggccct

SEQ ID NO: 6176295 - DNA, 22 bp, Homo sapiens
ctggacggggatggttccccag

SEQ ID NO: 6176296 - DNA, 23 bp, Homo sapiens
ctggacggggcgggccctgcctg

SEQ ID NO: 6176297 - DNA, 16 bp, Homo sapiens
ctggacgtctttcttt

SEQ ID NO: 6176298 - DNA, 22 bp, Homo sapiens
ctggactaaaggcatccttgtc

SEQ ID NO: 6176299 - DNA, 20 bp, Homo sapiens
ctggactacacccaagcctg

SEQ ID NO: 6176300 - DNA, 14 bp, Homo sapiens
ctggactagggcct

SEQ ID NO: 6176301 - DNA, 15 bp, Homo sapiens
ctggactagggcctc

SEQ ID NO: 6176302 - DNA, 22 bp, Homo sapiens
ctggactagggcctcggaggct

SEQ ID NO: 6176303 - DNA, 17 bp, Homo sapiens
ctggactagtgaaaaat

SEQ ID NO: 6176304 - DNA, 15 bp, Homo sapiens
ctggactagtgtcct

SEQ ID NO: 6176305 - DNA, 14 bp, Homo sapiens
ctggactattgtgc

SEQ ID NO: 6176306 - DNA, 12 bp, Homo sapiens
ctggactcagga

SEQ ID NO: 6176307 - DNA, 19 bp, Homo sapiens
ctggactcaggatgcccag

SEQ ID NO: 6176308 - DNA, 17 bp, Homo sapiens
ctggactccacgatgcc

SEQ ID NO: 6176309 - DNA, 16 bp, Homo sapiens
ctggactccagatctg

SEQ ID NO: 6176310 - DNA, 19 bp, Homo sapiens
ctggactccagatctgcac

SEQ ID NO: 6176311 - DNA, 23 bp, Homo sapiens
ctggactccagatctgcaccgcc

SEQ ID NO: 6176312 - DNA, 15 bp, Homo sapiens
ctggactccctcaag

SEQ ID NO: 6176313 - DNA, 18 bp, Homo sapiens
ctggactccggaggactg

SEQ ID NO: 6176314 - DNA, 21 bp, Homo sapiens
ctggactccggaggactgagc

SEQ ID NO: 6176315 - DNA, 24 bp, Homo sapiens
ctggactcctgccaccagcatcca

SEQ ID NO: 6176316 - DNA, 19 bp, Homo sapiens
ctggactctaaagaccaaa

SEQ ID NO: 6176317 - DNA, 22 bp, Homo sapiens
ctggactctaagctggagctct

SEQ ID NO: 6176318 - DNA, 17 bp, Homo sapiens
ctggactctcagtctct

SEQ ID NO: 6176319 - DNA, 19 bp, Homo sapiens
ctggactctcagtctctga

SEQ ID NO: 6176320 - DNA, 20 bp, Homo sapiens
ctggactctcagtctctgag

SEQ ID NO: 6176321 - DNA, 24 bp, Homo sapiens
ctggactctgcatcccagcacctg

SEQ ID NO: 6176322 - DNA, 17 bp, Homo sapiens
ctggactctgccccaat

SEQ ID NO: 6176323 - DNA, 18 bp, Homo sapiens
ctggactctgccccaatc

SEQ ID NO: 6176324 - DNA, 16 bp, Homo sapiens
ctggactctggacttt

SEQ ID NO: 6176325 - DNA, 18 bp, Homo sapiens
ctggactctggcacccag

SEQ ID NO: 6176326 - DNA, 21 bp, Homo sapiens
ctggactctgtggggccacac

SEQ ID NO: 6176327 - DNA, 13 bp, Homo sapiens
ctggactctgtgt

SEQ ID NO: 6176328 - DNA, 16 bp, Homo sapiens
ctggactgaagcctgc

SEQ ID NO: 6176329 - DNA, 19 bp, Homo sapiens
ctggactgaagcctgcagg

SEQ ID NO: 6176330 - DNA, 22 bp, Homo sapiens
ctggactgaagcctgcaggagt

SEQ ID NO: 6176331 - DNA, 12 bp, Homo sapiens
ctggactgacag

SEQ ID NO: 6176332 - DNA, 16 bp, Homo sapiens
ctggactgacagcatg

SEQ ID NO: 6176333 - DNA, 12 bp, Homo sapiens
ctggactgacca

SEQ ID NO: 6176334 - DNA, 14 bp, Homo sapiens
ctggactgaccaaa

SEQ ID NO: 6176335 - DNA, 21 bp, Homo sapiens
ctggactgaccctgcaggttg

SEQ ID NO: 6176336 - DNA, 21 bp, Homo sapiens
ctggactgacctggtccacag

SEQ ID NO: 6176337 - DNA, 17 bp, Homo sapiens
ctggactgactgcagcc

SEQ ID NO: 6176338 - DNA, 13 bp, Homo sapiens
ctggactgaggac

SEQ ID NO: 6176339 - DNA, 15 bp, Homo sapiens
ctggactgaggcctg

SEQ ID NO: 6176340 - DNA, 21 bp, Homo sapiens
ctggactgagggggcctggat

SEQ ID NO: 6176341 - DNA, 22 bp, Homo sapiens
ctggactgagggggcctggatg

SEQ ID NO: 6176342 - DNA, 23 bp, Homo sapiens
ctggactgagggggcctggatgc

SEQ ID NO: 6176343 - DNA, 19 bp, Homo sapiens
ctggactgatggttgcttt

SEQ ID NO: 6176344 - DNA, 14 bp, Homo sapiens
ctggactgcacagg

SEQ ID NO: 6176345 - DNA, 20 bp, Homo sapiens
ctggactgcatggggaggca

SEQ ID NO: 6176346 - DNA, 21 bp, Homo sapiens
ctggactgcatggggaggcag

SEQ ID NO: 6176347 - DNA, 22 bp, Homo sapiens
ctggactgcatggggaggcagc

SEQ ID NO: 6176348 - DNA, 15 bp, Homo sapiens
ctggactgctgctgt

SEQ ID NO: 6176349 - DNA, 13 bp, Homo sapiens
ctggactgcttgg

SEQ ID NO: 6176350 - DNA, 21 bp, Homo sapiens
ctggactggaaagcacaagac

SEQ ID NO: 6176351 - DNA, 13 bp, Homo sapiens
ctggactggaggc

SEQ ID NO: 6176352 - DNA, 20 bp, Homo sapiens
ctggactggaggctgggtgg

SEQ ID NO: 6176353 - DNA, 19 bp, Homo sapiens
ctggactggaggtgggcat

SEQ ID NO: 6176354 - DNA, 15 bp, Homo sapiens
ctggactggcccttg

SEQ ID NO: 6176355 - DNA, 22 bp, Homo sapiens
ctggactggcccttgcccaact

SEQ ID NO: 6176356 - DNA, 20 bp, Homo sapiens
ctggactggcctgtctggcc

SEQ ID NO: 6176357 - DNA, 21 bp, Homo sapiens
ctggactggctagagtcctca

SEQ ID NO: 6176358 - DNA, 17 bp, Homo sapiens
ctggactgggaaggggg

SEQ ID NO: 6176359 - DNA, 22 bp, Homo sapiens
ctggactgggaagggggcaggc

SEQ ID NO: 6176360 - DNA, 13 bp, Homo sapiens
ctggactgggtgg

SEQ ID NO: 6176361 - DNA, 19 bp, Homo sapiens
ctggactgggtgggcccca

SEQ ID NO: 6176362 - DNA, 21 bp, Homo sapiens
ctggactgggtgggccccaca

SEQ ID NO: 6176363 - DNA, 17 bp, Homo sapiens
ctggactggttatcttg

SEQ ID NO: 6176364 - DNA, 12 bp, Homo sapiens
cttgccatcctg

SEQ ID NO: 6176365 - DNA, 15 bp, Homo sapiens
cttgccatcctgatg

SEQ ID NO: 6176366 - DNA, 16 bp, Homo sapiens
cttgccatctgttcat

SEQ ID NO: 6176367 - DNA, 20 bp, Homo sapiens
cttgccatgaaggcacctgc

SEQ ID NO: 6176368 - DNA, 14 bp, Homo sapiens
cttgccatgcagga

SEQ ID NO: 6176369 - DNA, 16 bp, Homo sapiens
cttgccatgcaggaag

SEQ ID NO: 6176370 - DNA, 21 bp, Homo sapiens
cttgccatgcaggaagaggcc

SEQ ID NO: 6176371 - DNA, 21 bp, Homo sapiens
cttgccatgcttcagtgaaca

SEQ ID NO: 6176372 - DNA, 15 bp, Homo sapiens
cttgccatgtgactc

SEQ ID NO: 6176373 - DNA, 15 bp, Homo sapiens
cttgccatgtgctgg

SEQ ID NO: 6176374 - DNA, 14 bp, Homo sapiens
cttgccatttcttt

SEQ ID NO: 6176375 - DNA, 16 bp, Homo sapiens
cttgccattttaaggt

SEQ ID NO: 6176376 - DNA, 16 bp, Homo sapiens
cttgcccaactcccag

SEQ ID NO: 6176377 - DNA, 15 bp, Homo sapiens
cttgcccaagtccca

SEQ ID NO: 6176378 - DNA, 15 bp, Homo sapiens
cttgcccaccccacc

SEQ ID NO: 6176379 - DNA, 22 bp, Homo sapiens
cttgcccaccccacccccaccc

SEQ ID NO: 6176380 - DNA, 15 bp, Homo sapiens
cttgcccactcctgc

SEQ ID NO: 6176381 - DNA, 22 bp, Homo sapiens
cttgcccactcctgctctgctc

SEQ ID NO: 6176382 - DNA, 21 bp, Homo sapiens
cttgcccactgcctgcctccc

SEQ ID NO: 6176383 - DNA, 22 bp, Homo sapiens
cttgcccactgcctgcctcccc

SEQ ID NO: 6176384 - DNA, 16 bp, Homo sapiens
cttgcccacttctcct

SEQ ID NO: 6176385 - DNA, 19 bp, Homo sapiens
cttgcccagactacagggc

SEQ ID NO: 6176386 - DNA, 16 bp, Homo sapiens
cttgcccagcagctca

SEQ ID NO: 6176387 - DNA, 13 bp, Homo sapiens
cttgcccagcctg

SEQ ID NO: 6176388 - DNA, 15 bp, Homo sapiens
cttgcccagcctgga

SEQ ID NO: 6176389 - DNA, 16 bp, Homo sapiens
cttgcccagcctggat

SEQ ID NO: 6176390 - DNA, 17 bp, Homo sapiens
cttgcccagcctggatg

SEQ ID NO: 6176391 - DNA, 18 bp, Homo sapiens
cttgcccagcctggatgc

SEQ ID NO: 6176392 - DNA, 22 bp, Homo sapiens
cttgcccaggagcaagtgaggc

SEQ ID NO: 6176393 - DNA, 12 bp, Homo sapiens
cttgcccaggcc

SEQ ID NO: 6176394 - DNA, 18 bp, Homo sapiens
cttgcccaggcctcccca

SEQ ID NO: 6176395 - DNA, 16 bp, Homo sapiens
cttgcccagggctcag

SEQ ID NO: 6176396 - DNA, 19 bp, Homo sapiens
cttgcccagggctcagcct

SEQ ID NO: 6176397 - DNA, 18 bp, Homo sapiens
cttgcccaggtgagggaa

SEQ ID NO: 6176398 - DNA, 21 bp, Homo sapiens
cttgcccaggtgagggaagga

SEQ ID NO: 6176399 - DNA, 14 bp, Homo sapiens
cttgcccatcagcc

SEQ ID NO: 6176400 - DNA, 13 bp, Homo sapiens
cttgcccatcctg

SEQ ID NO: 6176401 - DNA, 18 bp, Homo sapiens
cttgcccatcctgactga

SEQ ID NO: 6176402 - DNA, 14 bp, Homo sapiens
cttgccccaacccc

SEQ ID NO: 6176403 - DNA, 21 bp, Homo sapiens
cttgccccaacccccagcacc

SEQ ID NO: 6176404 - DNA, 12 bp, Homo sapiens
cttgccccacag

SEQ ID NO: 6176405 - DNA, 14 bp, Homo sapiens
cttgccccacagtt

SEQ ID NO: 6176406 - DNA, 15 bp, Homo sapiens
cttgccccacagttg

SEQ ID NO: 6176407 - DNA, 22 bp, Homo sapiens
cttgccccacctcccccttccc

SEQ ID NO: 6176408 - DNA, 21 bp, Homo sapiens
cttgccccactctgcctgcct

SEQ ID NO: 6176409 - DNA, 22 bp, Homo sapiens
cttgccccactctgcctgcctg

SEQ ID NO: 6176410 - DNA, 12 bp, Homo sapiens
cttgccccagga

SEQ ID NO: 6176411 - DNA, 22 bp, Homo sapiens
cttgccccaggactctggcact

SEQ ID NO: 6176412 - DNA, 14 bp, Homo sapiens
cttgccccaggcca

SEQ ID NO: 6176413 - DNA, 14 bp, Homo sapiens
cttgccccatcact

SEQ ID NO: 6176414 - DNA, 14 bp, Homo sapiens
cttgcccccagtgc

SEQ ID NO: 6176415 - DNA, 20 bp, Homo sapiens
cttgcccccagtgcctcacc

SEQ ID NO: 6176416 - DNA, 19 bp, Homo sapiens
cttgccccccgccctcatg

SEQ ID NO: 6176417 - DNA, 18 bp, Homo sapiens
cttgccccggccccggcc

SEQ ID NO: 6176418 - DNA, 23 bp, Homo sapiens
cttgcccctccagagacaggaaa

SEQ ID NO: 6176419 - DNA, 13 bp, Homo sapiens
cttgcccctgctc

SEQ ID NO: 6176420 - DNA, 14 bp, Homo sapiens
cttgcccctgtggc

SEQ ID NO: 6176421 - DNA, 19 bp, Homo sapiens
cttgccccttgggcctccc

SEQ ID NO: 6176422 - DNA, 15 bp, Homo sapiens
cttgcccgccagcca

SEQ ID NO: 6176423 - DNA, 16 bp, Homo sapiens
cttgcccgccagccag

SEQ ID NO: 6176424 - DNA, 17 bp, Homo sapiens
cttgcccgccagccagt

SEQ ID NO: 6176425 - DNA, 21 bp, Homo sapiens
cttgcccgccagccagtggcc

SEQ ID NO: 6176426 - DNA, 17 bp, Homo sapiens
cttgcccgccagcctca

SEQ ID NO: 6176427 - DNA, 23 bp, Homo sapiens
cttgcccgccagcctcagtgcca

SEQ ID NO: 6176428 - DNA, 15 bp, Homo sapiens
cttgcccgctcccac

SEQ ID NO: 6176429 - DNA, 18 bp, Homo sapiens
cttgcccggattctggga

SEQ ID NO: 6176430 - DNA, 20 bp, Homo sapiens
cttgcccggattctgggagg

SEQ ID NO: 6176431 - DNA, 16 bp, Homo sapiens
cttgcccgtcggccct

SEQ ID NO: 6176432 - DNA, 18 bp, Homo sapiens
cttgcccgtcgtgtgctg

SEQ ID NO: 6176433 - DNA, 15 bp, Homo sapiens
cttgccctaagcaga

SEQ ID NO: 6176434 - DNA, 19 bp, Homo sapiens
cttgccctagatagtttat

SEQ ID NO: 6176435 - DNA, 20 bp, Homo sapiens
cttgccctcctgggccctgg

SEQ ID NO: 6176436 - DNA, 21 bp, Homo sapiens
cttgccctcctgggccctggg

SEQ ID NO: 6176437 - DNA, 15 bp, Homo sapiens
cttgccctctctttt

SEQ ID NO: 6176438 - DNA, 13 bp, Homo sapiens
cttgccctgacct

SEQ ID NO: 6176439 - DNA, 14 bp, Homo sapiens
cttgccctgacctc

SEQ ID NO: 6176440 - DNA, 15 bp, Homo sapiens
cttgccctgacctcc

SEQ ID NO: 6176441 - DNA, 12 bp, Homo sapiens
cttgccctgagc

SEQ ID NO: 6176442 - DNA, 22 bp, Homo sapiens
cttgccctgagcactcctggtg

SEQ ID NO: 6176443 - DNA, 24 bp, Homo sapiens
cttgccctgagcactcctggtgca

SEQ ID NO: 6176444 - DNA, 18 bp, Homo sapiens
cttgccctgggctgcctc

SEQ ID NO: 6176445 - DNA, 12 bp, Homo sapiens
cttgcccttccc

SEQ ID NO: 6176446 - DNA, 14 bp, Homo sapiens
cttgcccttccctg

SEQ ID NO: 6176447 - DNA, 17 bp, Homo sapiens
cttgcccttccctgtcc

SEQ ID NO: 6176448 - DNA, 23 bp, Homo sapiens
cttgcccttccctgtccctctaa

SEQ ID NO: 6176449 - DNA, 15 bp, Homo sapiens
cttgcccttcctact

SEQ ID NO: 6176450 - DNA, 13 bp, Homo sapiens
cttgcccttcctg

SEQ ID NO: 6176451 - DNA, 16 bp, Homo sapiens
cttgcccttgccctga

SEQ ID NO: 6176452 - DNA, 17 bp, Homo sapiens
cttgccctttcccccca

SEQ ID NO: 6176453 - DNA, 17 bp, Homo sapiens
cttgccgaaactggaag

SEQ ID NO: 6176454 - DNA, 18 bp, Homo sapiens
cttgccgaaactggaagt

SEQ ID NO: 6176455 - DNA, 23 bp, Homo sapiens
cttgccgaaccaggagctgctca

SEQ ID NO: 6176456 - DNA, 13 bp, Homo sapiens
cttgccgagagag

SEQ ID NO: 6176457 - DNA, 23 bp, Homo sapiens
cttgccgagagaggcgcgtctgc

SEQ ID NO: 6176458 - DNA, 19 bp, Homo sapiens
cttgccgagcctaatgaaa

SEQ ID NO: 6176459 - DNA, 15 bp, Homo sapiens
cttgccgaggagcca

SEQ ID NO: 6176460 - DNA, 17 bp, Homo sapiens
cttgccgaggagccagg

SEQ ID NO: 6176461 - DNA, 20 bp, Homo sapiens
cttgccgaggagccaggcaa

SEQ ID NO: 6176462 - DNA, 18 bp, Homo sapiens
cttgccgcgtcgccctcc

SEQ ID NO: 6176463 - DNA, 17 bp, Homo sapiens
cttgccgctccccttgg

SEQ ID NO: 6176464 - DNA, 18 bp, Homo sapiens
cttgccgctccccttgga

SEQ ID NO: 6176465 - DNA, 19 bp, Homo sapiens
cttgccgtctacctgaggg

SEQ ID NO: 6176466 - DNA, 20 bp, Homo sapiens
cttgccgtctacctgagggg

SEQ ID NO: 6176467 - DNA, 17 bp, Homo sapiens
cttgcctaaatttaatg

SEQ ID NO: 6176468 - DNA, 23 bp, Homo sapiens
cttgcctaaatttaatgctgcct

SEQ ID NO: 6176469 - DNA, 16 bp, Homo sapiens
cttgcctacttttctt

SEQ ID NO: 6176470 - DNA, 18 bp, Homo sapiens
cttgcctaggccaaatgc

SEQ ID NO: 6176471 - DNA, 21 bp, Homo sapiens
cttgcctatctgacttcatac

SEQ ID NO: 6176472 - DNA, 18 bp, Homo sapiens
cttgcctcaatgccagta

SEQ ID NO: 6176473 - DNA, 20 bp, Homo sapiens
cttgcctcagcttccccagt

SEQ ID NO: 6176474 - DNA, 17 bp, Homo sapiens
cttgcctcatttcccta

SEQ ID NO: 6176475 - DNA, 13 bp, Homo sapiens
cttgcctcatttt

SEQ ID NO: 6176476 - DNA, 12 bp, Homo sapiens
cttgcctccagg

SEQ ID NO: 6176477 - DNA, 14 bp, Homo sapiens
cttgcctccaggac

SEQ ID NO: 6176478 - DNA, 13 bp, Homo sapiens
cttgcctccaggt

SEQ ID NO: 6176479 - DNA, 15 bp, Homo sapiens
cttgcctccaggtgc

SEQ ID NO: 6176480 - DNA, 16 bp, Homo sapiens
cttgcctccaggtgca

SEQ ID NO: 6176481 - DNA, 23 bp, Homo sapiens
cttgcctccaggtgcagaggtac

SEQ ID NO: 6176482 - DNA, 23 bp, Homo sapiens
cttgcctccatctttttcttggg

SEQ ID NO: 6176483 - DNA, 17 bp, Homo sapiens
cttgcctccatggtgcc

SEQ ID NO: 6176484 - DNA, 20 bp, Homo sapiens
cttgcctcccctcctctcct

SEQ ID NO: 6176485 - DNA, 11 bp, Homo sapiens
cttgcctcctg

SEQ ID NO: 6176486 - DNA, 12 bp, Homo sapiens
cttgcctcctgg

SEQ ID NO: 6176487 - DNA, 13 bp, Homo sapiens
cttgcctcctgga

SEQ ID NO: 6176488 - DNA, 16 bp, Homo sapiens
cttgcctcctggaaga

SEQ ID NO: 6176489 - DNA, 16 bp, Homo sapiens
cttgcctccttttttc

SEQ ID NO: 6176490 - DNA, 15 bp, Homo sapiens
cttgcctcggctcct

SEQ ID NO: 6176491 - DNA, 19 bp, Homo sapiens
cttgcctcggctcctgctg

SEQ ID NO: 6176492 - DNA, 21 bp, Homo sapiens
cttgcctcggctcctgctgca

SEQ ID NO: 6176493 - DNA, 13 bp, Homo sapiens
cttgcctctctgt

SEQ ID NO: 6176494 - DNA, 14 bp, Homo sapiens
cttgcctctgcaca

SEQ ID NO: 6176495 - DNA, 24 bp, Homo sapiens
cttgcctctgcacaccctccagag

SEQ ID NO: 6176496 - DNA, 19 bp, Homo sapiens
cttgcctctgtccccttct

SEQ ID NO: 6176497 - DNA, 13 bp, Homo sapiens
cttgcctctgtgc

SEQ ID NO: 6176498 - DNA, 20 bp, Homo sapiens
cttgcctctgtgctgtgtgt

SEQ ID NO: 6176499 - DNA, 22 bp, Homo sapiens
cttgcctcttttacctgctgct

SEQ ID NO: 6176500 - DNA, 18 bp, Homo sapiens
cttgcctgaacatccttc

SEQ ID NO: 6176501 - DNA, 22 bp, Homo sapiens
cttgcctgaacatccttccttc

SEQ ID NO: 6176502 - DNA, 18 bp, Homo sapiens
cttgcctgaactccagag

SEQ ID NO: 6176503 - DNA, 20 bp, Homo sapiens
cttgcctgaactccagaggt

SEQ ID NO: 6176504 - DNA, 12 bp, Homo sapiens
cttgcctgaagc

SEQ ID NO: 6176505 - DNA, 17 bp, Homo sapiens
cttgcctgaggctcaag

SEQ ID NO: 6176506 - DNA, 15 bp, Homo sapiens
cttgcctgaggggaa

SEQ ID NO: 6176507 - DNA, 22 bp, Homo sapiens
cttgcctgaggggaaagagaga

SEQ ID NO: 6176508 - DNA, 21 bp, Homo sapiens
cttgcctgcacccttcctcct

SEQ ID NO: 6176509 - DNA, 15 bp, Homo sapiens
cttgcctgccactgt

SEQ ID NO: 6176510 - DNA, 16 bp, Homo sapiens
cttgcctgccagggcc

SEQ ID NO: 6176511 - DNA, 13 bp, Homo sapiens
cttgcctgcctcc

SEQ ID NO: 6176512 - DNA, 17 bp, Homo sapiens
cttgcctgcctcctagg

SEQ ID NO: 6176513 - DNA, 13 bp, Homo sapiens
cttgcctgcctgc

SEQ ID NO: 6176514 - DNA, 16 bp, Homo sapiens
cttgcctgcctttcca

SEQ ID NO: 6176515 - DNA, 13 bp, Homo sapiens
cttgcctgctggg

SEQ ID NO: 6176516 - DNA, 15 bp, Homo sapiens
cttgcctgcttttct

SEQ ID NO: 6176517 - DNA, 20 bp, Homo sapiens
cttgcctggagacgtggaac

SEQ ID NO: 6176518 - DNA, 12 bp, Homo sapiens
cttgcctgggct

SEQ ID NO: 6176519 - DNA, 15 bp, Homo sapiens
cttgcctgggctggg

SEQ ID NO: 6176520 - DNA, 16 bp, Homo sapiens
cttgcctgggctgggc

SEQ ID NO: 6176521 - DNA, 22 bp, Homo sapiens
cttgcctgggctgggcagcctt

SEQ ID NO: 6176522 - DNA, 15 bp, Homo sapiens
cttgcctggtacagt

SEQ ID NO: 6176523 - DNA, 14 bp, Homo sapiens
cttgcctgtcaccc

SEQ ID NO: 6176524 - DNA, 16 bp, Homo sapiens
cttgcctgtcacccca

SEQ ID NO: 6176525 - DNA, 17 bp, Homo sapiens
cttgcctgtcaccccag

SEQ ID NO: 6176526 - DNA, 11 bp, Homo sapiens
cttgcctgtgc

SEQ ID NO: 6176527 - DNA, 18 bp, Homo sapiens
cttgcctgtgccaggtga

SEQ ID NO: 6176528 - DNA, 17 bp, Homo sapiens
cttgcctgttggctgct

SEQ ID NO: 6176529 - DNA, 20 bp, Homo sapiens
cttgccttaataaatatgta

SEQ ID NO: 6176530 - DNA, 18 bp, Homo sapiens
cttgccttattagagtgt

SEQ ID NO: 6176531 - DNA, 13 bp, Homo sapiens
cttgccttcccct

SEQ ID NO: 6176532 - DNA, 17 bp, Homo sapiens
cttgccttcccctgtct

SEQ ID NO: 6176533 - DNA, 21 bp, Homo sapiens
cttgccttcccctgtcttcac

SEQ ID NO: 6176534 - DNA, 21 bp, Homo sapiens
cttgccttccccttgaacctc

SEQ ID NO: 6176535 - DNA, 18 bp, Homo sapiens
cttgccttcctcagctgc

SEQ ID NO: 6176536 - DNA, 23 bp, Homo sapiens
cttgccttcctcagctgcctcct

SEQ ID NO: 6176537 - DNA, 15 bp, Homo sapiens
cttgccttctggtgt

SEQ ID NO: 6176538 - DNA, 19 bp, Homo sapiens
cttgccttgaaatttacac

SEQ ID NO: 6176539 - DNA, 20 bp, Homo sapiens
cttgccttgcttctcccatt

SEQ ID NO: 6176540 - DNA, 23 bp, Homo sapiens
cttgcctttagcccctcccaagc

SEQ ID NO: 6176541 - DNA, 14 bp, Homo sapiens
cttgcctttccacc

SEQ ID NO: 6176542 - DNA, 22 bp, Homo sapiens
cttgcctttccacctgctttct

SEQ ID NO: 6176543 - DNA, 18 bp, Homo sapiens
cttgcctttcgaggcctg

SEQ ID NO: 6176544 - DNA, 23 bp, Homo sapiens
ctggactgtaggactatataaag

SEQ ID NO: 6176545 - DNA, 20 bp, Homo sapiens
ctggactgtcatagaaatta

SEQ ID NO: 6176546 - DNA, 13 bp, Homo sapiens
ctggactgtccta

SEQ ID NO: 6176547 - DNA, 16 bp, Homo sapiens
ctggactgtgtgctca

SEQ ID NO: 6176548 - DNA, 19 bp, Homo sapiens
ctggactgtgtgctcagga

SEQ ID NO: 6176549 - DNA, 22 bp, Homo sapiens
ctggactgtgtgctcaggagcc

SEQ ID NO: 6176550 - DNA, 20 bp, Homo sapiens
ctggactgttccaggccctc

SEQ ID NO: 6176551 - DNA, 13 bp, Homo sapiens
ctggactgtttca

SEQ ID NO: 6176552 - DNA, 19 bp, Homo sapiens
ctggactgtttcaaggtcc

SEQ ID NO: 6176553 - DNA, 21 bp, Homo sapiens
ctggactgtttcatagttttc

SEQ ID NO: 6176554 - DNA, 13 bp, Homo sapiens
ctggacttacaaa

SEQ ID NO: 6176555 - DNA, 19 bp, Homo sapiens
ctggacttacaaaatgcca

SEQ ID NO: 6176556 - DNA, 20 bp, Homo sapiens
ctggacttacaaaatgccaa

SEQ ID NO: 6176557 - DNA, 18 bp, Homo sapiens
ctggacttcctataatac

SEQ ID NO: 6176558 - DNA, 16 bp, Homo sapiens
ctggacttcctgtcat

SEQ ID NO: 6176559 - DNA, 18 bp, Homo sapiens
ctggacttctacctgccc

SEQ ID NO: 6176560 - DNA, 23 bp, Homo sapiens
ctggacttctacctgccctcaag

SEQ ID NO: 6176561 - DNA, 16 bp, Homo sapiens
ctggacttctgtgggc

SEQ ID NO: 6176562 - DNA, 19 bp, Homo sapiens
ctggacttctgtgggcccc

SEQ ID NO: 6176563 - DNA, 15 bp, Homo sapiens
ctggacttgaaggtt

SEQ ID NO: 6176564 - DNA, 15 bp, Homo sapiens
ctggacttgagcttg

SEQ ID NO: 6176565 - DNA, 16 bp, Homo sapiens
ctggacttgcctctgc

SEQ ID NO: 6176566 - DNA, 13 bp, Homo sapiens
ctggacttggagg

SEQ ID NO: 6176567 - DNA, 19 bp, Homo sapiens
ctggacttggcccctgcca

SEQ ID NO: 6176568 - DNA, 14 bp, Homo sapiens
ctggacttggtaca

SEQ ID NO: 6176569 - DNA, 23 bp, Homo sapiens
ctggacttggtacagttgcagga

SEQ ID NO: 6176570 - DNA, 18 bp, Homo sapiens
ctggactttaaaaaaaca

SEQ ID NO: 6176571 - DNA, 19 bp, Homo sapiens
ctggactttaaaaaaacaa

SEQ ID NO: 6176572 - DNA, 15 bp, Homo sapiens
ctggactttcctgca

SEQ ID NO: 6176573 - DNA, 22 bp, Homo sapiens
ctggactttctctaataataaa

SEQ ID NO: 6176574 - DNA, 22 bp, Homo sapiens
ctggactttggttctctccagg

SEQ ID NO: 6176575 - DNA, 19 bp, Homo sapiens
ctggacttttgcagcttcc

SEQ ID NO: 6176576 - DNA, 22 bp, Homo sapiens
ctggacttttgcagcttccttc

SEQ ID NO: 6176577 - DNA, 18 bp, Homo sapiens
ctggagaaaaaggtgcca

SEQ ID NO: 6176578 - DNA, 17 bp, Homo sapiens
ctggagaaaccttcact

SEQ ID NO: 6176579 - DNA, 18 bp, Homo sapiens
ctggagaaaccttcactc

SEQ ID NO: 6176580 - DNA, 22 bp, Homo sapiens
ctggagaaaccttcactccaga

SEQ ID NO: 6176581 - DNA, 20 bp, Homo sapiens
ctggagaaagagctgcctgg

SEQ ID NO: 6176582 - DNA, 21 bp, Homo sapiens
ctggagaaagagctgcctgga

SEQ ID NO: 6176583 - DNA, 22 bp, Homo sapiens
ctggagaaagagctgcctggat

SEQ ID NO: 6176584 - DNA, 24 bp, Homo sapiens
ctggagaaagagctgcctggatga

SEQ ID NO: 6176585 - DNA, 16 bp, Homo sapiens
ctggagaaagccacgc

SEQ ID NO: 6176586 - DNA, 22 bp, Homo sapiens
ctggagaaagccacgccctccc

SEQ ID NO: 6176587 - DNA, 21 bp, Homo sapiens
ctggagaacagtggttgcctg

SEQ ID NO: 6176588 - DNA, 19 bp, Homo sapiens
ctggagaactagaacctgg

SEQ ID NO: 6176589 - DNA, 13 bp, Homo sapiens
ctggagaactagg

SEQ ID NO: 6176590 - DNA, 19 bp, Homo sapiens
ctggagaactatacctgct

SEQ ID NO: 6176591 - DNA, 12 bp, Homo sapiens
ctggagaagaga

SEQ ID NO: 6176592 - DNA, 18 bp, Homo sapiens
ctggagaagagaggagag

SEQ ID NO: 6176593 - DNA, 19 bp, Homo sapiens
ctggagaagagaggagagg

SEQ ID NO: 6176594 - DNA, 14 bp, Homo sapiens
ctggagaagcacca

SEQ ID NO: 6176595 - DNA, 15 bp, Homo sapiens
ctggagaagcaccag

SEQ ID NO: 6176596 - DNA, 18 bp, Homo sapiens
ctggagaagctcacccaa

SEQ ID NO: 6176597 - DNA, 14 bp, Homo sapiens
ctggagaaggcctg

SEQ ID NO: 6176598 - DNA, 15 bp, Homo sapiens
ctggagaaggcctgg

SEQ ID NO: 6176599 - DNA, 18 bp, Homo sapiens
ctggagaaggcctggaag

SEQ ID NO: 6176600 - DNA, 18 bp, Homo sapiens
ctggagaattgactgaag

SEQ ID NO: 6176601 - DNA, 20 bp, Homo sapiens
ctggagaattgactgaagca

SEQ ID NO: 6176602 - DNA, 16 bp, Homo sapiens
ctggagacaaggtgct

SEQ ID NO: 6176603 - DNA, 17 bp, Homo sapiens
ctggagacaaggtgcta

SEQ ID NO: 6176604 - DNA, 20 bp, Homo sapiens
ctggagacaatgcagatgcc

SEQ ID NO: 6176605 - DNA, 21 bp, Homo sapiens
ctggagacaatgcagatgcca

SEQ ID NO: 6176606 - DNA, 19 bp, Homo sapiens
ctggagacagaaccagcag

SEQ ID NO: 6176607 - DNA, 20 bp, Homo sapiens
ctggagacagaagtcaggtg

SEQ ID NO: 6176608 - DNA, 11 bp, Homo sapiens
ctggagacagc

SEQ ID NO: 6176609 - DNA, 19 bp, Homo sapiens
ctggagacagccccagagc

SEQ ID NO: 6176610 - DNA, 20 bp, Homo sapiens
ctggagacagccccagagca

SEQ ID NO: 6176611 - DNA, 21 bp, Homo sapiens
ctggagacagccccagagcag

SEQ ID NO: 6176612 - DNA, 22 bp, Homo sapiens
ctggagacagccccagagcagg

SEQ ID NO: 6176613 - DNA, 15 bp, Homo sapiens
ctggagaccaccagg

SEQ ID NO: 6176614 - DNA, 15 bp, Homo sapiens
ctggagaccaggact

SEQ ID NO: 6176615 - DNA, 17 bp, Homo sapiens
ctggagaccaggactct

SEQ ID NO: 6176616 - DNA, 20 bp, Homo sapiens
ctggagaccaggactctgcc

SEQ ID NO: 6176617 - DNA, 18 bp, Homo sapiens
ctggagaccatgcagagc

SEQ ID NO: 6176618 - DNA, 23 bp, Homo sapiens
ctggagacccaccccacctgcag

SEQ ID NO: 6176619 - DNA, 20 bp, Homo sapiens
ctggagaccccaccagcctc

SEQ ID NO: 6176620 - DNA, 21 bp, Homo sapiens
ctggagaccccaccagcctca

SEQ ID NO: 6176621 - DNA, 22 bp, Homo sapiens
ctggagacccccccccaactcc

SEQ ID NO: 6176622 - DNA, 13 bp, Homo sapiens
ctggagaccctgc

SEQ ID NO: 6176623 - DNA, 15 bp, Homo sapiens
ctggagaccgaggcc

SEQ ID NO: 6176624 - DNA, 22 bp, Homo sapiens
ctggagaccgcttcacccctgc

SEQ ID NO: 6176625 - DNA, 18 bp, Homo sapiens
ctggagacgggtgggcgg

SEQ ID NO: 6176626 - DNA, 21 bp, Homo sapiens
ctggagacgggtgggcggctg

SEQ ID NO: 6176627 - DNA, 21 bp, Homo sapiens
ctggagacgtggaacctctgt

SEQ ID NO: 6176628 - DNA, 14 bp, Homo sapiens
ctggagactattta

SEQ ID NO: 6176629 - DNA, 18 bp, Homo sapiens
ctggagactcctaggcag

SEQ ID NO: 6176630 - DNA, 12 bp, Homo sapiens
ctggagactgtc

SEQ ID NO: 6176631 - DNA, 22 bp, Homo sapiens
ctggagactgtgtgtgccctct

SEQ ID NO: 6176632 - DNA, 14 bp, Homo sapiens
ctggagacttcctc

SEQ ID NO: 6176633 - DNA, 17 bp, Homo sapiens
ctggagacttcctctgg

SEQ ID NO: 6176634 - DNA, 17 bp, Homo sapiens
ctggagagaagtttctg

SEQ ID NO: 6176635 - DNA, 13 bp, Homo sapiens
ctggagagcaaca

SEQ ID NO: 6176636 - DNA, 14 bp, Homo sapiens
ctggagagcactgc

SEQ ID NO: 6176637 - DNA, 16 bp, Homo sapiens
ctggagagcccagagt

SEQ ID NO: 6176638 - DNA, 14 bp, Homo sapiens
ctggagagccccat

SEQ ID NO: 6176639 - DNA, 23 bp, Homo sapiens
ctggagaggagccctgcctctcc

SEQ ID NO: 6176640 - DNA, 22 bp, Homo sapiens
ctggagaggccctctggagtgg

SEQ ID NO: 6176641 - DNA, 15 bp, Homo sapiens
ctggagaggcctggg

SEQ ID NO: 6176642 - DNA, 18 bp, Homo sapiens
ctggagaggggcctggga

SEQ ID NO: 6176643 - DNA, 12 bp, Homo sapiens
ctggagaggtta

SEQ ID NO: 6176644 - DNA, 12 bp, Homo sapiens
ctggagagtaga

SEQ ID NO: 6176645 - DNA, 18 bp, Homo sapiens
ctggagagtgcacatgcc

SEQ ID NO: 6176646 - DNA, 23 bp, Homo sapiens
ctggagagttcaatggctgctga

SEQ ID NO: 6176647 - DNA, 18 bp, Homo sapiens
ctggagataacagcctct

SEQ ID NO: 6176648 - DNA, 16 bp, Homo sapiens
ctggagatactggtgg

SEQ ID NO: 6176649 - DNA, 15 bp, Homo sapiens
ctggagatagctggg

SEQ ID NO: 6176650 - DNA, 19 bp, Homo sapiens
ctggagatagctggggctt

SEQ ID NO: 6176651 - DNA, 14 bp, Homo sapiens
ctggagatcctcct

SEQ ID NO: 6176652 - DNA, 20 bp, Homo sapiens
ctggagatctgaacccagct

SEQ ID NO: 6176653 - DNA, 19 bp, Homo sapiens
ctggagatgaggccagacc

SEQ ID NO: 6176654 - DNA, 14 bp, Homo sapiens
ctggagatgcagct

SEQ ID NO: 6176655 - DNA, 23 bp, Homo sapiens
ctggagatgcagctactggaatg

SEQ ID NO: 6176656 - DNA, 15 bp, Homo sapiens
ctggagatggaagct

SEQ ID NO: 6176657 - DNA, 15 bp, Homo sapiens
ctggagatggatcct

SEQ ID NO: 6176658 - DNA, 15 bp, Homo sapiens
ctggagatggctgct

SEQ ID NO: 6176659 - DNA, 12 bp, Homo sapiens
ctggagcaaagc

SEQ ID NO: 6176660 - DNA, 18 bp, Homo sapiens
ctggagcaacctactgtc

SEQ ID NO: 6176661 - DNA, 14 bp, Homo sapiens
ctggagcaagaagg

SEQ ID NO: 6176662 - DNA, 12 bp, Homo sapiens
ctggagcaagag

SEQ ID NO: 6176663 - DNA, 14 bp, Homo sapiens
ctggagcaagccct

SEQ ID NO: 6176664 - DNA, 19 bp, Homo sapiens
ctggagcaagccctgaccc

SEQ ID NO: 6176665 - DNA, 20 bp, Homo sapiens
ctggagcaagccctgaccca

SEQ ID NO: 6176666 - DNA, 21 bp, Homo sapiens
ctggagcaagccctgacccaa

SEQ ID NO: 6176667 - DNA, 16 bp, Homo sapiens
ctggagcaagctctgc

SEQ ID NO: 6176668 - DNA, 13 bp, Homo sapiens
ctggagcacaaag

SEQ ID NO: 6176669 - DNA, 23 bp, Homo sapiens
ctggagcacaaagaccctggctt

SEQ ID NO: 6176670 - DNA, 23 bp, Homo sapiens
ctggagcacaataaatggctgta

SEQ ID NO: 6176671 - DNA, 21 bp, Homo sapiens
ctggagcacttgttttaaaat

SEQ ID NO: 6176672 - DNA, 20 bp, Homo sapiens
ctggagcagaactttccagg

SEQ ID NO: 6176673 - DNA, 16 bp, Homo sapiens
ctggagcagaagcagc

SEQ ID NO: 6176674 - DNA, 22 bp, Homo sapiens
ctggagcagaggaggggaaagt

SEQ ID NO: 6176675 - DNA, 16 bp, Homo sapiens
ctggagcagcagctga

SEQ ID NO: 6176676 - DNA, 19 bp, Homo sapiens
ctggagcagcagctgaggc

SEQ ID NO: 6176677 - DNA, 20 bp, Homo sapiens
ctggagcagcagctgaggcc

SEQ ID NO: 6176678 - DNA, 12 bp, Homo sapiens
ctggagcagcca

SEQ ID NO: 6176679 - DNA, 23 bp, Homo sapiens
ctggagcagcggattgctctgga

SEQ ID NO: 6176680 - DNA, 16 bp, Homo sapiens
ctggagcaggagcccc

SEQ ID NO: 6176681 - DNA, 14 bp, Homo sapiens
ctggagcaggccca

SEQ ID NO: 6176682 - DNA, 24 bp, Homo sapiens
ctggagcaggcccaatgctgcttt

SEQ ID NO: 6176683 - DNA, 21 bp, Homo sapiens
ctggagcaggccttgcgctgt

SEQ ID NO: 6176684 - DNA, 21 bp, Homo sapiens
ctggagcagtttggggcaggg

SEQ ID NO: 6176685 - DNA, 22 bp, Homo sapiens
ctggagcagtttggggcagggg

SEQ ID NO: 6176686 - DNA, 16 bp, Homo sapiens
ctggagcatctgactc

SEQ ID NO: 6176687 - DNA, 19 bp, Homo sapiens
ctggagcatgagctctgtg

SEQ ID NO: 6176688 - DNA, 22 bp, Homo sapiens
ctggagcatgcagaggaggtga

SEQ ID NO: 6176689 - DNA, 22 bp, Homo sapiens
ctggagcattgtgtatagaact

SEQ ID NO: 6176690 - DNA, 14 bp, Homo sapiens
ctggagccaaggca

SEQ ID NO: 6176691 - DNA, 15 bp, Homo sapiens
ctggagccaaggcag

SEQ ID NO: 6176692 - DNA, 23 bp, Homo sapiens
ctggagccaatggtgagggctga

SEQ ID NO: 6176693 - DNA, 14 bp, Homo sapiens
ctggagccacaggc

SEQ ID NO: 6176694 - DNA, 18 bp, Homo sapiens
ctggagccacaggcaggg

SEQ ID NO: 6176695 - DNA, 14 bp, Homo sapiens
ctggagccacctgt

SEQ ID NO: 6176696 - DNA, 21 bp, Homo sapiens
ctggagccacctgtcccacct

SEQ ID NO: 6176697 - DNA, 23 bp, Homo sapiens
ctggagccacctgtcccacctca

SEQ ID NO: 6176698 - DNA, 14 bp, Homo sapiens
ctggagccagccga

SEQ ID NO: 6176699 - DNA, 22 bp, Homo sapiens
ctggagccagggcagaggaatg

SEQ ID NO: 6176700 - DNA, 22 bp, Homo sapiens
ctggagcccacagcgagcctgt

SEQ ID NO: 6176701 - DNA, 23 bp, Homo sapiens
ctggagcccacagcgagcctgtg

SEQ ID NO: 6176702 - DNA, 15 bp, Homo sapiens
ctggagcccactgta

SEQ ID NO: 6176703 - DNA, 21 bp, Homo sapiens
ctggagcccactgtacttgct

SEQ ID NO: 6176704 - DNA, 21 bp, Homo sapiens
ctggagcccagaggagggcag

SEQ ID NO: 6176705 - DNA, 23 bp, Homo sapiens
ctggagccccactgcccttctca

SEQ ID NO: 6176706 - DNA, 19 bp, Homo sapiens
ctggagccccatcgcctgg

SEQ ID NO: 6176707 - DNA, 19 bp, Homo sapiens
ctggagccccgcagggagg

SEQ ID NO: 6176708 - DNA, 19 bp, Homo sapiens
ctggagcccctatcctgca

SEQ ID NO: 6176709 - DNA, 18 bp, Homo sapiens
ctggagcccctcctcccc

SEQ ID NO: 6176710 - DNA, 12 bp, Homo sapiens
ctggagcccctg

SEQ ID NO: 6176711 - DNA, 18 bp, Homo sapiens
ctggagcccctgggtggg

SEQ ID NO: 6176712 - DNA, 16 bp, Homo sapiens
ctggagcccctgtgtg

SEQ ID NO: 6176713 - DNA, 20 bp, Homo sapiens
ctggagcccctgtgtgggag

SEQ ID NO: 6176714 - DNA, 17 bp, Homo sapiens
ctggagcccgaggcacc

SEQ ID NO: 6176715 - DNA, 17 bp, Homo sapiens
ctggagcccgagggcct

SEQ ID NO: 6176716 - DNA, 23 bp, Homo sapiens
ctggagcccgcctgcgcccccca

SEQ ID NO: 6176717 - DNA, 18 bp, Homo sapiens
ctggagcccgcttcaagc

SEQ ID NO: 6176718 - DNA, 18 bp, Homo sapiens
ctggagcccggcagtgca

SEQ ID NO: 6176719 - DNA, 22 bp, Homo sapiens
ctggagccctaaccccttccag

SEQ ID NO: 6176720 - DNA, 20 bp, Homo sapiens
cttgcctttcgaggcctgaa

SEQ ID NO: 6176721 - DNA, 21 bp, Homo sapiens
cttgcctttcttatttgcaat

SEQ ID NO: 6176722 - DNA, 13 bp, Homo sapiens
cttgcctttgtgg

SEQ ID NO: 6176723 - DNA, 15 bp, Homo sapiens
cttgcctttgtggcc

SEQ ID NO: 6176724 - DNA, 16 bp, Homo sapiens
cttgcctttgtggcct

SEQ ID NO: 6176725 - DNA, 18 bp, Homo sapiens
cttgcctttgtggccttc

SEQ ID NO: 6176726 - DNA, 15 bp, Homo sapiens
cttgcctttttcatt

SEQ ID NO: 6176727 - DNA, 23 bp, Homo sapiens
cttgcgaactagagatgtgcaat

SEQ ID NO: 6176728 - DNA, 14 bp, Homo sapiens
cttgcgaatccaag

SEQ ID NO: 6176729 - DNA, 16 bp, Homo sapiens
cttgcgaatccaagct

SEQ ID NO: 6176730 - DNA, 19 bp, Homo sapiens
cttgcgaatccaagctccc

SEQ ID NO: 6176731 - DNA, 14 bp, Homo sapiens
cttgcgaccatgtg

SEQ ID NO: 6176732 - DNA, 16 bp, Homo sapiens
cttgcgaccatgtgta

SEQ ID NO: 6176733 - DNA, 17 bp, Homo sapiens
cttgcgagctgttgtag

SEQ ID NO: 6176734 - DNA, 13 bp, Homo sapiens
cttgcgagtccaa

SEQ ID NO: 6176735 - DNA, 14 bp, Homo sapiens
cttgcggaagccat

SEQ ID NO: 6176736 - DNA, 20 bp, Homo sapiens
cttgcggaatcactctgtcc

SEQ ID NO: 6176737 - DNA, 18 bp, Homo sapiens
cttgcggccacagcacta

SEQ ID NO: 6176738 - DNA, 22 bp, Homo sapiens
cttgcggtatccgcccccaata

SEQ ID NO: 6176739 - DNA, 15 bp, Homo sapiens
cttgcgtatgtctgt

SEQ ID NO: 6176740 - DNA, 13 bp, Homo sapiens
cttgcgtcctgca

SEQ ID NO: 6176741 - DNA, 24 bp, Homo sapiens
cttgcgtcctgcagaggaccacag

SEQ ID NO: 6176742 - DNA, 22 bp, Homo sapiens
cttgctaaactgttgggaaagc

SEQ ID NO: 6176743 - DNA, 14 bp, Homo sapiens
cttgctaaagcact

SEQ ID NO: 6176744 - DNA, 19 bp, Homo sapiens
cttgctaaagcactttgca

SEQ ID NO: 6176745 - DNA, 12 bp, Homo sapiens
cttgctaagctc

SEQ ID NO: 6176746 - DNA, 22 bp, Homo sapiens
cttgctaataaacactggctct

SEQ ID NO: 6176747 - DNA, 19 bp, Homo sapiens
cttgctaatcagtgtctca

SEQ ID NO: 6176748 - DNA, 20 bp, Homo sapiens
cttgctaatcagtgtctcac

SEQ ID NO: 6176749 - DNA, 17 bp, Homo sapiens
cttgctaattttctcaa

SEQ ID NO: 6176750 - DNA, 15 bp, Homo sapiens
cttgctaccaatctg

SEQ ID NO: 6176751 - DNA, 20 bp, Homo sapiens
cttgctaccaatctgtgaga

SEQ ID NO: 6176752 - DNA, 13 bp, Homo sapiens
cttgctaccagta

SEQ ID NO: 6176753 - DNA, 14 bp, Homo sapiens
cttgctacctcagt

SEQ ID NO: 6176754 - DNA, 16 bp, Homo sapiens
cttgctacctgtgagc

SEQ ID NO: 6176755 - DNA, 17 bp, Homo sapiens
cttgctacctgtgagca

SEQ ID NO: 6176756 - DNA, 17 bp, Homo sapiens
cttgctactgaaaaaaa

SEQ ID NO: 6176757 - DNA, 21 bp, Homo sapiens
cttgctacttatcatttttgt

SEQ ID NO: 6176758 - DNA, 12 bp, Homo sapiens
cttgctagctag

SEQ ID NO: 6176759 - DNA, 22 bp, Homo sapiens
cttgctatattgcccaggctgg

SEQ ID NO: 6176760 - DNA, 23 bp, Homo sapiens
cttgctatattgcccaggctggt

SEQ ID NO: 6176761 - DNA, 21 bp, Homo sapiens
cttgctatcggggaagccaga

SEQ ID NO: 6176762 - DNA, 22 bp, Homo sapiens
cttgctatctctcaagagtgct

SEQ ID NO: 6176763 - DNA, 21 bp, Homo sapiens
cttgctatgttattttcagtg

SEQ ID NO: 6176764 - DNA, 13 bp, Homo sapiens
cttgctatttcaa

SEQ ID NO: 6176765 - DNA, 19 bp, Homo sapiens
cttgctcaagttcaccagc

SEQ ID NO: 6176766 - DNA, 23 bp, Homo sapiens
cttgctcactcactcactccaag

SEQ ID NO: 6176767 - DNA, 14 bp, Homo sapiens
cttgctcactccct

SEQ ID NO: 6176768 - DNA, 19 bp, Homo sapiens
cttgctcagacgagacacc

SEQ ID NO: 6176769 - DNA, 21 bp, Homo sapiens
cttgctcagacgagacaccct

SEQ ID NO: 6176770 - DNA, 16 bp, Homo sapiens
cttgctcagagctagg

SEQ ID NO: 6176771 - DNA, 21 bp, Homo sapiens
cttgctcagatagatctgtgt

SEQ ID NO: 6176772 - DNA, 14 bp, Homo sapiens
cttgctcagtgcct

SEQ ID NO: 6176773 - DNA, 16 bp, Homo sapiens
cttgctcagtgcctcc

SEQ ID NO: 6176774 - DNA, 20 bp, Homo sapiens
cttgctcagtgcctcctggc

SEQ ID NO: 6176775 - DNA, 23 bp, Homo sapiens
cttgctcatgagctcctgatcag

SEQ ID NO: 6176776 - DNA, 19 bp, Homo sapiens
cttgctcattcttcagttc

SEQ ID NO: 6176777 - DNA, 15 bp, Homo sapiens
cttgctcattcttga

SEQ ID NO: 6176778 - DNA, 16 bp, Homo sapiens
cttgctcattcttgag

SEQ ID NO: 6176779 - DNA, 17 bp, Homo sapiens
cttgctcatttgaaaat

SEQ ID NO: 6176780 - DNA, 16 bp, Homo sapiens
cttgctccagattctg

SEQ ID NO: 6176781 - DNA, 20 bp, Homo sapiens
cttgctccagattctgatgc

SEQ ID NO: 6176782 - DNA, 15 bp, Homo sapiens
cttgctcccaagccc

SEQ ID NO: 6176783 - DNA, 19 bp, Homo sapiens
cttgctcccaatggtgctt

SEQ ID NO: 6176784 - DNA, 21 bp, Homo sapiens
cttgctcccaatggtgcttgg

SEQ ID NO: 6176785 - DNA, 22 bp, Homo sapiens
cttgctcccaatggtgcttgga

SEQ ID NO: 6176786 - DNA, 22 bp, Homo sapiens
cttgctcccgccccagggtctg

SEQ ID NO: 6176787 - DNA, 12 bp, Homo sapiens
cttgctccctct

SEQ ID NO: 6176788 - DNA, 15 bp, Homo sapiens
cttgctccctgactg

SEQ ID NO: 6176789 - DNA, 13 bp, Homo sapiens
cttgctcccttca

SEQ ID NO: 6176790 - DNA, 20 bp, Homo sapiens
cttgctcctagcagacagaa

SEQ ID NO: 6176791 - DNA, 20 bp, Homo sapiens
cttgctcctgcttctcctga

SEQ ID NO: 6176792 - DNA, 14 bp, Homo sapiens
cttgctcctgggga

SEQ ID NO: 6176793 - DNA, 20 bp, Homo sapiens
cttgctcctggggagaaaga

SEQ ID NO: 6176794 - DNA, 23 bp, Homo sapiens
cttgctcctgtttaactccctag

SEQ ID NO: 6176795 - DNA, 17 bp, Homo sapiens
cttgctccttgaataag

SEQ ID NO: 6176796 - DNA, 12 bp, Homo sapiens
cttgctcctttc

SEQ ID NO: 6176797 - DNA, 19 bp, Homo sapiens
cttgctcctttccatcagc

SEQ ID NO: 6176798 - DNA, 16 bp, Homo sapiens
cttgctctacctggcc

SEQ ID NO: 6176799 - DNA, 14 bp, Homo sapiens
cttgctctatctca

SEQ ID NO: 6176800 - DNA, 18 bp, Homo sapiens
cttgctctatctcacagc

SEQ ID NO: 6176801 - DNA, 22 bp, Homo sapiens
cttgctctatctcacagcacac

SEQ ID NO: 6176802 - DNA, 23 bp, Homo sapiens
cttgctctatctcacagcacact

SEQ ID NO: 6176803 - DNA, 15 bp, Homo sapiens
cttgctctccctctt

SEQ ID NO: 6176804 - DNA, 14 bp, Homo sapiens
cttgctctcctcat

SEQ ID NO: 6176805 - DNA, 14 bp, Homo sapiens
cttgctctcctgga

SEQ ID NO: 6176806 - DNA, 16 bp, Homo sapiens
cttgctctcctggagc

SEQ ID NO: 6176807 - DNA, 22 bp, Homo sapiens
cttgctctctctccctgccttt

SEQ ID NO: 6176808 - DNA, 14 bp, Homo sapiens
cttgctctctgaga

SEQ ID NO: 6176809 - DNA, 15 bp, Homo sapiens
cttgctctctggcct

SEQ ID NO: 6176810 - DNA, 22 bp, Homo sapiens
cttgctctctggccttttccta

SEQ ID NO: 6176811 - DNA, 14 bp, Homo sapiens
cttgctctctgttc

SEQ ID NO: 6176812 - DNA, 20 bp, Homo sapiens
cttgctctctgttctcttgc

SEQ ID NO: 6176813 - DNA, 16 bp, Homo sapiens
cttgctctcttcaata

SEQ ID NO: 6176814 - DNA, 12 bp, Homo sapiens
cttgctctgctg

SEQ ID NO: 6176815 - DNA, 13 bp, Homo sapiens
cttgctctggacc

SEQ ID NO: 6176816 - DNA, 14 bp, Homo sapiens
cttgctctgtaatc

SEQ ID NO: 6176817 - DNA, 15 bp, Homo sapiens
cttgctctgtaatct

SEQ ID NO: 6176818 - DNA, 13 bp, Homo sapiens
cttgctctgtccc

SEQ ID NO: 6176819 - DNA, 22 bp, Homo sapiens
cttgctctgtcccccaggctgg

SEQ ID NO: 6176820 - DNA, 12 bp, Homo sapiens
cttgctctgtct

SEQ ID NO: 6176821 - DNA, 22 bp, Homo sapiens
cttgctctgtctcccaggctgg

SEQ ID NO: 6176822 - DNA, 19 bp, Homo sapiens
cttgctctgttacccaggc

SEQ ID NO: 6176823 - DNA, 19 bp, Homo sapiens
cttgctcttcagtgggaga

SEQ ID NO: 6176824 - DNA, 19 bp, Homo sapiens
cttgctcttgatgcctggc

SEQ ID NO: 6176825 - DNA, 20 bp, Homo sapiens
cttgctgaaggagaaaaaga

SEQ ID NO: 6176826 - DNA, 18 bp, Homo sapiens
cttgctgaatttcaggca

SEQ ID NO: 6176827 - DNA, 16 bp, Homo sapiens
cttgctgaccccaggt

SEQ ID NO: 6176828 - DNA, 17 bp, Homo sapiens
cttgctgaccccaggtc

SEQ ID NO: 6176829 - DNA, 16 bp, Homo sapiens
cttgctgactctctga

SEQ ID NO: 6176830 - DNA, 16 bp, Homo sapiens
cttgctgacttagcct

SEQ ID NO: 6176831 - DNA, 17 bp, Homo sapiens
cttgctgacttagcctc

SEQ ID NO: 6176832 - DNA, 18 bp, Homo sapiens
cttgctgagacttacgcc

SEQ ID NO: 6176833 - DNA, 17 bp, Homo sapiens
cttgctgaggggcaggg

SEQ ID NO: 6176834 - DNA, 18 bp, Homo sapiens
cttgctgaggggcaggga

SEQ ID NO: 6176835 - DNA, 23 bp, Homo sapiens
cttgctgaggggcagggagagcg

SEQ ID NO: 6176836 - DNA, 22 bp, Homo sapiens
cttgctgagtggcgcaaggccg

SEQ ID NO: 6176837 - DNA, 16 bp, Homo sapiens
cttgctgatggctgct

SEQ ID NO: 6176838 - DNA, 15 bp, Homo sapiens
cttgctgatggcttg

SEQ ID NO: 6176839 - DNA, 20 bp, Homo sapiens
cttgctgcaagcacagccct

SEQ ID NO: 6176840 - DNA, 21 bp, Homo sapiens
cttgctgccaagtcctgcctt

SEQ ID NO: 6176841 - DNA, 12 bp, Homo sapiens
cttgctgcccac

SEQ ID NO: 6176842 - DNA, 16 bp, Homo sapiens
cttgctgccctaggct

SEQ ID NO: 6176843 - DNA, 13 bp, Homo sapiens
cttgctgccctgc

SEQ ID NO: 6176844 - DNA, 16 bp, Homo sapiens
cttgctgccctgcccc

SEQ ID NO: 6176845 - DNA, 18 bp, Homo sapiens
cttgctgccttcaccctg

SEQ ID NO: 6176846 - DNA, 15 bp, Homo sapiens
cttgctgccttctgg

SEQ ID NO: 6176847 - DNA, 20 bp, Homo sapiens
cttgctgccttctggattct

SEQ ID NO: 6176848 - DNA, 14 bp, Homo sapiens
cttgctgctagaac

SEQ ID NO: 6176849 - DNA, 17 bp, Homo sapiens
cttgctgctagaacttt

SEQ ID NO: 6176850 - DNA, 18 bp, Homo sapiens
cttgctgctagaactttt

SEQ ID NO: 6176851 - DNA, 13 bp, Homo sapiens
cttgctgctctgc

SEQ ID NO: 6176852 - DNA, 13 bp, Homo sapiens
cttgctgctgcct

SEQ ID NO: 6176853 - DNA, 18 bp, Homo sapiens
cttgctgctgctgcaccc

SEQ ID NO: 6176854 - DNA, 15 bp, Homo sapiens
cttgctgctggctcc

SEQ ID NO: 6176855 - DNA, 13 bp, Homo sapiens
cttgctgcttcta

SEQ ID NO: 6176856 - DNA, 11 bp, Homo sapiens
cttgctgcttt

SEQ ID NO: 6176857 - DNA, 12 bp, Homo sapiens
cttgctgcttta

SEQ ID NO: 6176858 - DNA, 14 bp, Homo sapiens
cttgctggaaaact

SEQ ID NO: 6176859 - DNA, 20 bp, Homo sapiens
cttgctggaaaactgccaca

SEQ ID NO: 6176860 - DNA, 18 bp, Homo sapiens
cttgctggaacacagggg

SEQ ID NO: 6176861 - DNA, 21 bp, Homo sapiens
cttgctggaacacaggggcct

SEQ ID NO: 6176862 - DNA, 13 bp, Homo sapiens
cttgctggaagac

SEQ ID NO: 6176863 - DNA, 21 bp, Homo sapiens
cttgctggacggggactgggg

SEQ ID NO: 6176864 - DNA, 18 bp, Homo sapiens
cttgctggagagtggcat

SEQ ID NO: 6176865 - DNA, 19 bp, Homo sapiens
cttgctggatctgtagtga

SEQ ID NO: 6176866 - DNA, 15 bp, Homo sapiens
cttgctggctctgag

SEQ ID NO: 6176867 - DNA, 13 bp, Homo sapiens
cttgctgggccag

SEQ ID NO: 6176868 - DNA, 22 bp, Homo sapiens
cttgctgggccagggaaacaaa

SEQ ID NO: 6176869 - DNA, 21 bp, Homo sapiens
cttgctggggtccagggctgt

SEQ ID NO: 6176870 - DNA, 23 bp, Homo sapiens
cttgctggggtccagggctgttg

SEQ ID NO: 6176871 - DNA, 16 bp, Homo sapiens
cttgctggtctagtca

SEQ ID NO: 6176872 - DNA, 12 bp, Homo sapiens
cttgctggtgcc

SEQ ID NO: 6176873 - DNA, 13 bp, Homo sapiens
cttgctgtagaga

SEQ ID NO: 6176874 - DNA, 16 bp, Homo sapiens
cttgctgtagagactt

SEQ ID NO: 6176875 - DNA, 19 bp, Homo sapiens
cttgctgtatgctgatcat

SEQ ID NO: 6176876 - DNA, 12 bp, Homo sapiens
cttgctgtccaa

SEQ ID NO: 6176877 - DNA, 19 bp, Homo sapiens
cttgctgtcccttggaact

SEQ ID NO: 6176878 - DNA, 16 bp, Homo sapiens
cttgctgtcctaggcc

SEQ ID NO: 6176879 - DNA, 20 bp, Homo sapiens
cttgctgtcctaggccacac

SEQ ID NO: 6176880 - DNA, 13 bp, Homo sapiens
cttgctgtcctga

SEQ ID NO: 6176881 - DNA, 16 bp, Homo sapiens
cttgctgtcctgatct

SEQ ID NO: 6176882 - DNA, 17 bp, Homo sapiens
cttgctgtcctgatctg

SEQ ID NO: 6176883 - DNA, 22 bp, Homo sapiens
cttgctgtctacagtagctgct

SEQ ID NO: 6176884 - DNA, 13 bp, Homo sapiens
cttgctgtctctg

SEQ ID NO: 6176885 - DNA, 22 bp, Homo sapiens
cttgctgtgtgaccctgggcaa

SEQ ID NO: 6176886 - DNA, 21 bp, Homo sapiens
cttgctgtgtgacctgaggcc

SEQ ID NO: 6176887 - DNA, 16 bp, Homo sapiens
cttgctgtgtgacctt

SEQ ID NO: 6176888 - DNA, 14 bp, Homo sapiens
cttgctgttcagtg

SEQ ID NO: 6176889 - DNA, 18 bp, Homo sapiens
cttgctgttcagtgcttt

SEQ ID NO: 6176890 - DNA, 15 bp, Homo sapiens
cttgctgttcttgaa

SEQ ID NO: 6176891 - DNA, 16 bp, Homo sapiens
cttgctgttcttgaag

SEQ ID NO: 6176892 - DNA, 21 bp, Homo sapiens
cttgctgttcttgaagctggg

SEQ ID NO: 6176893 - DNA, 20 bp, Homo sapiens
cttgctgttggtcatgtggg

SEQ ID NO: 6176894 - DNA, 20 bp, Homo sapiens
cttgctgtttactcccttct

SEQ ID NO: 6176895 - DNA, 13 bp, Homo sapiens
cttgctgtttctt

SEQ ID NO: 6176896 - DNA, 15 bp, Homo sapiens
cttgcttaaatgtga

SEQ ID NO: 6176897 - DNA, 16 bp, Homo sapiens
cttgcttaaatttctt

SEQ ID NO: 6176898 - DNA, 17 bp, Homo sapiens
cttgcttaaatttctta

SEQ ID NO: 6176899 - DNA, 15 bp, Homo sapiens
ctggagccctgggcg

SEQ ID NO: 6176900 - DNA, 15 bp, Homo sapiens
ctggagcccttgggt

SEQ ID NO: 6176901 - DNA, 20 bp, Homo sapiens
ctggagccgcttccccagct

SEQ ID NO: 6176902 - DNA, 21 bp, Homo sapiens
ctggagccgcttccccagctc

SEQ ID NO: 6176903 - DNA, 16 bp, Homo sapiens
ctggagcctcagcagc

SEQ ID NO: 6176904 - DNA, 18 bp, Homo sapiens
ctggagcctcagcagcaa

SEQ ID NO: 6176905 - DNA, 22 bp, Homo sapiens
ctggagcctcagcagcaaatgc

SEQ ID NO: 6176906 - DNA, 23 bp, Homo sapiens
ctggagcctccactgcctctgga

SEQ ID NO: 6176907 - DNA, 23 bp, Homo sapiens
ctggagcctccgacgctgcctct

SEQ ID NO: 6176908 - DNA, 20 bp, Homo sapiens
ctggagcctcggtggccatg

SEQ ID NO: 6176909 - DNA, 22 bp, Homo sapiens
ctggagcctcggtggccatgct

SEQ ID NO: 6176910 - DNA, 23 bp, Homo sapiens
ctggagcctgagtcagggcccag

SEQ ID NO: 6176911 - DNA, 19 bp, Homo sapiens
ctggagcctgcagatgaga

SEQ ID NO: 6176912 - DNA, 21 bp, Homo sapiens
ctggagcctgcggggcagcag

SEQ ID NO: 6176913 - DNA, 15 bp, Homo sapiens
ctggagcctgggcag

SEQ ID NO: 6176914 - DNA, 16 bp, Homo sapiens
ctggagcctgggcagc

SEQ ID NO: 6176915 - DNA, 13 bp, Homo sapiens
ctggagcctgggg

SEQ ID NO: 6176916 - DNA, 14 bp, Homo sapiens
ctggagcctggggt

SEQ ID NO: 6176917 - DNA, 15 bp, Homo sapiens
ctggagcctggtgcc

SEQ ID NO: 6176918 - DNA, 21 bp, Homo sapiens
ctggagcgaagccttctgcag

SEQ ID NO: 6176919 - DNA, 23 bp, Homo sapiens
ctggagcgaagccttctgcagca

SEQ ID NO: 6176920 - DNA, 16 bp, Homo sapiens
ctggagcggagaggaa

SEQ ID NO: 6176921 - DNA, 17 bp, Homo sapiens
ctggagcggagcttgcc

SEQ ID NO: 6176922 - DNA, 16 bp, Homo sapiens
ctggagcggctctcct

SEQ ID NO: 6176923 - DNA, 18 bp, Homo sapiens
ctggagcggctctcctga

SEQ ID NO: 6176924 - DNA, 20 bp, Homo sapiens
ctggagcggctctcctgaga

SEQ ID NO: 6176925 - DNA, 23 bp, Homo sapiens
ctggagcggctgctcgcccagga

SEQ ID NO: 6176926 - DNA, 16 bp, Homo sapiens
ctggagcggggatctg

SEQ ID NO: 6176927 - DNA, 21 bp, Homo sapiens
ctggagcgtgtactaccccag

SEQ ID NO: 6176928 - DNA, 16 bp, Homo sapiens
ctggagctaaggccag

SEQ ID NO: 6176929 - DNA, 22 bp, Homo sapiens
ctggagctaaggccagctagag

SEQ ID NO: 6176930 - DNA, 18 bp, Homo sapiens
ctggagctcaagccgtgg

SEQ ID NO: 6176931 - DNA, 21 bp, Homo sapiens
ctggagctcatctgcaaaagg

SEQ ID NO: 6176932 - DNA, 23 bp, Homo sapiens
ctggagctccgatttaactggga

SEQ ID NO: 6176933 - DNA, 19 bp, Homo sapiens
ctggagctcctccctccag

SEQ ID NO: 6176934 - DNA, 21 bp, Homo sapiens
ctggagctcctccctccagct

SEQ ID NO: 6176935 - DNA, 22 bp, Homo sapiens
ctggagctcctccctccagctg

SEQ ID NO: 6176936 - DNA, 18 bp, Homo sapiens
ctggagctcctgggaagg

SEQ ID NO: 6176937 - DNA, 14 bp, Homo sapiens
ctggagctcttgga

SEQ ID NO: 6176938 - DNA, 22 bp, Homo sapiens
ctggagctgctaagctaaagaa

SEQ ID NO: 6176939 - DNA, 13 bp, Homo sapiens
ctggagctggctt

SEQ ID NO: 6176940 - DNA, 17 bp, Homo sapiens
ctggagctgggagacaa

SEQ ID NO: 6176941 - DNA, 14 bp, Homo sapiens
ctggagctgggagg

SEQ ID NO: 6176942 - DNA, 17 bp, Homo sapiens
ctggagctgtgtaccaa

SEQ ID NO: 6176943 - DNA, 13 bp, Homo sapiens
ctggagcttcagc

SEQ ID NO: 6176944 - DNA, 17 bp, Homo sapiens
ctggagcttcagccagg

SEQ ID NO: 6176945 - DNA, 20 bp, Homo sapiens
ctggagcttcagccaggtct

SEQ ID NO: 6176946 - DNA, 18 bp, Homo sapiens
ctggagcttcattttggt

SEQ ID NO: 6176947 - DNA, 17 bp, Homo sapiens
ctggagctttgcagcca

SEQ ID NO: 6176948 - DNA, 15 bp, Homo sapiens
ctggagcttttaaaa

SEQ ID NO: 6176949 - DNA, 22 bp, Homo sapiens
ctggagcttttaaaaatgtttg

SEQ ID NO: 6176950 - DNA, 14 bp, Homo sapiens
ctggaggaaaactg

SEQ ID NO: 6176951 - DNA, 19 bp, Homo sapiens
ctggaggaaaactgagact

SEQ ID NO: 6176952 - DNA, 18 bp, Homo sapiens
ctggaggaaagggaggag

SEQ ID NO: 6176953 - DNA, 18 bp, Homo sapiens
ctggaggaacacagagaa

SEQ ID NO: 6176954 - DNA, 18 bp, Homo sapiens
ctggaggaacacttgatg

SEQ ID NO: 6176955 - DNA, 19 bp, Homo sapiens
ctggaggaagccagtgggg

SEQ ID NO: 6176956 - DNA, 13 bp, Homo sapiens
ctggaggaaggaa

SEQ ID NO: 6176957 - DNA, 16 bp, Homo sapiens
ctggaggaaggaaaca

SEQ ID NO: 6176958 - DNA, 16 bp, Homo sapiens
ctggaggaagtggggt

SEQ ID NO: 6176959 - DNA, 19 bp, Homo sapiens
ctggaggaagtggggtctg

SEQ ID NO: 6176960 - DNA, 20 bp, Homo sapiens
ctggaggaagtggggtctgg

SEQ ID NO: 6176961 - DNA, 23 bp, Homo sapiens
ctggaggaagttctccagcttca

SEQ ID NO: 6176962 - DNA, 19 bp, Homo sapiens
ctggaggaattcagctcag

SEQ ID NO: 6176963 - DNA, 13 bp, Homo sapiens
ctggaggaccaga

SEQ ID NO: 6176964 - DNA, 23 bp, Homo sapiens
ctggaggaccagattgctctgcc

SEQ ID NO: 6176965 - DNA, 14 bp, Homo sapiens
ctggaggacctgag

SEQ ID NO: 6176966 - DNA, 15 bp, Homo sapiens
ctggaggacctgagc

SEQ ID NO: 6176967 - DNA, 19 bp, Homo sapiens
ctggaggactagaacctgg

SEQ ID NO: 6176968 - DNA, 22 bp, Homo sapiens
ctggaggactctagaagctcag

SEQ ID NO: 6176969 - DNA, 23 bp, Homo sapiens
ctggaggactctagaagctcagg

SEQ ID NO: 6176970 - DNA, 14 bp, Homo sapiens
ctggaggagaagga

SEQ ID NO: 6176971 - DNA, 17 bp, Homo sapiens
ctggaggagagaagaat

SEQ ID NO: 6176972 - DNA, 15 bp, Homo sapiens
ctggaggagcccagg

SEQ ID NO: 6176973 - DNA, 16 bp, Homo sapiens
ctggaggagcccaggc

SEQ ID NO: 6176974 - DNA, 21 bp, Homo sapiens
ctggaggagcccaggccagga

SEQ ID NO: 6176975 - DNA, 21 bp, Homo sapiens
ctggaggagctggcctgtggc

SEQ ID NO: 6176976 - DNA, 17 bp, Homo sapiens
ctggaggagctgggccc

SEQ ID NO: 6176977 - DNA, 14 bp, Homo sapiens
ctggaggaggaggt

SEQ ID NO: 6176978 - DNA, 14 bp, Homo sapiens
ctggaggaggcctg

SEQ ID NO: 6176979 - DNA, 20 bp, Homo sapiens
ctggaggaggcctgtcccaa

SEQ ID NO: 6176980 - DNA, 18 bp, Homo sapiens
ctggaggaggggaagctg

SEQ ID NO: 6176981 - DNA, 21 bp, Homo sapiens
ctggaggaggggaagctgggc

SEQ ID NO: 6176982 - DNA, 23 bp, Homo sapiens
ctggaggagggtttgggcagagc

SEQ ID NO: 6176983 - DNA, 22 bp, Homo sapiens
ctggaggatcccctccaagcct

SEQ ID NO: 6176984 - DNA, 18 bp, Homo sapiens
ctggaggatgtgggcagc

SEQ ID NO: 6176985 - DNA, 18 bp, Homo sapiens
ctggaggatgttagactt

SEQ ID NO: 6176986 - DNA, 17 bp, Homo sapiens
ctggaggattttccagt

SEQ ID NO: 6176987 - DNA, 17 bp, Homo sapiens
ctggaggcaaaggcctg

SEQ ID NO: 6176988 - DNA, 14 bp, Homo sapiens
ctggaggcaagagg

SEQ ID NO: 6176989 - DNA, 18 bp, Homo sapiens
ctggaggcacgcaccact

SEQ ID NO: 6176990 - DNA, 14 bp, Homo sapiens
ctggaggcagactc

SEQ ID NO: 6176991 - DNA, 15 bp, Homo sapiens
ctggaggcagactcg

SEQ ID NO: 6176992 - DNA, 16 bp, Homo sapiens
ctggaggcagagggca

SEQ ID NO: 6176993 - DNA, 16 bp, Homo sapiens
ctggaggcaggactcc

SEQ ID NO: 6176994 - DNA, 12 bp, Homo sapiens
ctggaggcaggg

SEQ ID NO: 6176995 - DNA, 14 bp, Homo sapiens
ctggaggcagggcc

SEQ ID NO: 6176996 - DNA, 23 bp, Homo sapiens
ctggaggcaggggctgctgcctt

SEQ ID NO: 6176997 - DNA, 18 bp, Homo sapiens
ctggaggcaggggcttcc

SEQ ID NO: 6176998 - DNA, 22 bp, Homo sapiens
ctggaggcagtccatctaggga

SEQ ID NO: 6176999 - DNA, 23 bp, Homo sapiens
ctggaggcattcccagaggtggg

SEQ ID NO: 6177000 - DNA, 23 bp, Homo sapiens
ctggaggcatttctttttaggct

SEQ ID NO: 6177001 - DNA, 20 bp, Homo sapiens
ctggaggccaccaagctgct

SEQ ID NO: 6177002 - DNA, 13 bp, Homo sapiens
ctggaggcccagt

SEQ ID NO: 6177003 - DNA, 12 bp, Homo sapiens
ctggaggccgag

SEQ ID NO: 6177004 - DNA, 21 bp, Homo sapiens
ctggaggccgggtgctcaggg

SEQ ID NO: 6177005 - DNA, 16 bp, Homo sapiens
ctggaggcctcaggtg

SEQ ID NO: 6177006 - DNA, 12 bp, Homo sapiens
ctggaggcctct

SEQ ID NO: 6177007 - DNA, 15 bp, Homo sapiens
ctggaggcctctggc

SEQ ID NO: 6177008 - DNA, 19 bp, Homo sapiens
ctggaggcctctggccctc

SEQ ID NO: 6177009 - DNA, 15 bp, Homo sapiens
ctggaggcctctggg

SEQ ID NO: 6177010 - DNA, 22 bp, Homo sapiens
ctggaggcctctgggcctcctc

SEQ ID NO: 6177011 - DNA, 17 bp, Homo sapiens
ctggaggcggtgcggca

SEQ ID NO: 6177012 - DNA, 18 bp, Homo sapiens
ctggaggcggtgcggcag

SEQ ID NO: 6177013 - DNA, 14 bp, Homo sapiens
ctggaggctccagg

SEQ ID NO: 6177014 - DNA, 16 bp, Homo sapiens
ctggaggctccaggac

SEQ ID NO: 6177015 - DNA, 17 bp, Homo sapiens
ctggaggctccaggact

SEQ ID NO: 6177016 - DNA, 21 bp, Homo sapiens
ctggaggctccaggactccac

SEQ ID NO: 6177017 - DNA, 23 bp, Homo sapiens
ctggaggctccaggactccactg

SEQ ID NO: 6177018 - DNA, 22 bp, Homo sapiens
ctggaggctcctctaggccctg

SEQ ID NO: 6177019 - DNA, 11 bp, Homo sapiens
ctggaggctgc

SEQ ID NO: 6177020 - DNA, 23 bp, Homo sapiens
ctggaggctgcagagctgaccca

SEQ ID NO: 6177021 - DNA, 16 bp, Homo sapiens
ctggaggctggatggc

SEQ ID NO: 6177022 - DNA, 18 bp, Homo sapiens
ctggaggctggggatggt

SEQ ID NO: 6177023 - DNA, 23 bp, Homo sapiens
ctggaggctgggtggccggccct

SEQ ID NO: 6177024 - DNA, 17 bp, Homo sapiens
ctggagggaaggacagt

SEQ ID NO: 6177025 - DNA, 23 bp, Homo sapiens
ctggagggaaggacagtccctgc

SEQ ID NO: 6177026 - DNA, 19 bp, Homo sapiens
ctggagggaatgaacctgg

SEQ ID NO: 6177027 - DNA, 21 bp, Homo sapiens
ctggagggaatgaacctggag

SEQ ID NO: 6177028 - DNA, 22 bp, Homo sapiens
ctggagggaatgaacctggagg

SEQ ID NO: 6177029 - DNA, 23 bp, Homo sapiens
ctggagggaatgaacctggaggg

SEQ ID NO: 6177030 - DNA, 15 bp, Homo sapiens
ctggagggaggtggg

SEQ ID NO: 6177031 - DNA, 23 bp, Homo sapiens
ctggagggatgcccccaggcagc

SEQ ID NO: 6177032 - DNA, 21 bp, Homo sapiens
ctggagggcaagccctgccca

SEQ ID NO: 6177033 - DNA, 17 bp, Homo sapiens
ctggagggcacttcctc

SEQ ID NO: 6177034 - DNA, 13 bp, Homo sapiens
ctggagggcagag

SEQ ID NO: 6177035 - DNA, 14 bp, Homo sapiens
ctggagggcagaga

SEQ ID NO: 6177036 - DNA, 16 bp, Homo sapiens
ctggagggcagagaca

SEQ ID NO: 6177037 - DNA, 17 bp, Homo sapiens
ctggagggcgcccagca

SEQ ID NO: 6177038 - DNA, 20 bp, Homo sapiens
ctggagggctagaacctgga

SEQ ID NO: 6177039 - DNA, 22 bp, Homo sapiens
ctggagggctagaacctggcag

SEQ ID NO: 6177040 - DNA, 19 bp, Homo sapiens
ctggagggctggaatctgg

SEQ ID NO: 6177041 - DNA, 16 bp, Homo sapiens
ctggaggggacgctgg

SEQ ID NO: 6177042 - DNA, 16 bp, Homo sapiens
ctggaggggagagctt

SEQ ID NO: 6177043 - DNA, 17 bp, Homo sapiens
ctggaggggagagcttt

SEQ ID NO: 6177044 - DNA, 14 bp, Homo sapiens
ctggaggggagagg

SEQ ID NO: 6177045 - DNA, 16 bp, Homo sapiens
ctggaggggagctctg

SEQ ID NO: 6177046 - DNA, 15 bp, Homo sapiens
ctggaggggcccacc

SEQ ID NO: 6177047 - DNA, 17 bp, Homo sapiens
ctggaggggcccatgtg

SEQ ID NO: 6177048 - DNA, 21 bp, Homo sapiens
ctggaggggcccatgtgggct

SEQ ID NO: 6177049 - DNA, 15 bp, Homo sapiens
ctggaggggcccctg

SEQ ID NO: 6177050 - DNA, 17 bp, Homo sapiens
ctggaggggcccctgct

SEQ ID NO: 6177051 - DNA, 15 bp, Homo sapiens
ctggagggggagcac

SEQ ID NO: 6177052 - DNA, 17 bp, Homo sapiens
ctggagggggcagagtg

SEQ ID NO: 6177053 - DNA, 21 bp, Homo sapiens
ctggaggggtcatccttgccc

SEQ ID NO: 6177054 - DNA, 15 bp, Homo sapiens
ctggaggggtgggga

SEQ ID NO: 6177055 - DNA, 20 bp, Homo sapiens
ctggaggggtgtggctcctt

SEQ ID NO: 6177056 - DNA, 16 bp, Homo sapiens
ctggagggtaactggg

SEQ ID NO: 6177057 - DNA, 20 bp, Homo sapiens
ctggagggtgagaggaaggg

SEQ ID NO: 6177058 - DNA, 23 bp, Homo sapiens
ctggagggtgggttggggagggg

SEQ ID NO: 6177059 - DNA, 18 bp, Homo sapiens
ctggagggttgagaccca

SEQ ID NO: 6177060 - DNA, 22 bp, Homo sapiens
ctggaggtacgaaaagagggga

SEQ ID NO: 6177061 - DNA, 21 bp, Homo sapiens
ctggaggtactgagacagggt

SEQ ID NO: 6177062 - DNA, 19 bp, Homo sapiens
ctggaggtcacattcagga

SEQ ID NO: 6177063 - DNA, 17 bp, Homo sapiens
ctggaggtcgaagcaat

SEQ ID NO: 6177064 - DNA, 18 bp, Homo sapiens
ctggaggtctccaggggc

SEQ ID NO: 6177065 - DNA, 14 bp, Homo sapiens
ctggaggtctggct

SEQ ID NO: 6177066 - DNA, 16 bp, Homo sapiens
ctggaggtctggctga

SEQ ID NO: 6177067 - DNA, 13 bp, Homo sapiens
ctggaggtgccag

SEQ ID NO: 6177068 - DNA, 16 bp, Homo sapiens
ctggaggtgccagcaa

SEQ ID NO: 6177069 - DNA, 19 bp, Homo sapiens
ctggaggtgccagcaaagc

SEQ ID NO: 6177070 - DNA, 22 bp, Homo sapiens
ctggaggtgccagcaaagcccc

SEQ ID NO: 6177071 - DNA, 23 bp, Homo sapiens
ctggaggtgccagcaaagcccca

SEQ ID NO: 6177072 - DNA, 15 bp, Homo sapiens
ctggaggtgctgctc

SEQ ID NO: 6177073 - DNA, 11 bp, Homo sapiens
ctggaggtggc

SEQ ID NO: 6177074 - DNA, 16 bp, Homo sapiens
ctggaggtgggagcag

SEQ ID NO: 6177075 - DNA, 15 bp, Homo sapiens
cttgcttacctctca

SEQ ID NO: 6177076 - DNA, 24 bp, Homo sapiens
cttgcttaccttgactgttgatgt

SEQ ID NO: 6177077 - DNA, 15 bp, Homo sapiens
cttgcttagcctgtg

SEQ ID NO: 6177078 - DNA, 17 bp, Homo sapiens
cttgcttagcctgtgct

SEQ ID NO: 6177079 - DNA, 18 bp, Homo sapiens
cttgcttagcctgtgctg

SEQ ID NO: 6177080 - DNA, 20 bp, Homo sapiens
cttgcttcaaccccatgaga

SEQ ID NO: 6177081 - DNA, 14 bp, Homo sapiens
cttgcttcagtgga

SEQ ID NO: 6177082 - DNA, 15 bp, Homo sapiens
cttgcttctaaggga

SEQ ID NO: 6177083 - DNA, 22 bp, Homo sapiens
cttgcttctcccatttcctgat

SEQ ID NO: 6177084 - DNA, 17 bp, Homo sapiens
cttgcttctcttctttc

SEQ ID NO: 6177085 - DNA, 11 bp, Homo sapiens
cttgcttctgc

SEQ ID NO: 6177086 - DNA, 15 bp, Homo sapiens
cttgcttctgcagca

SEQ ID NO: 6177087 - DNA, 21 bp, Homo sapiens
cttgcttctgcagcaactccc

SEQ ID NO: 6177088 - DNA, 14 bp, Homo sapiens
cttgcttcttactg

SEQ ID NO: 6177089 - DNA, 15 bp, Homo sapiens
cttgcttcttactga

SEQ ID NO: 6177090 - DNA, 14 bp, Homo sapiens
cttgcttcttgtgt

SEQ ID NO: 6177091 - DNA, 13 bp, Homo sapiens
cttgcttgaggga

SEQ ID NO: 6177092 - DNA, 14 bp, Homo sapiens
cttgcttgccaact

SEQ ID NO: 6177093 - DNA, 23 bp, Homo sapiens
cttgcttgccctccaaatgtcct

SEQ ID NO: 6177094 - DNA, 19 bp, Homo sapiens
cttgcttgcctgcagggcc

SEQ ID NO: 6177095 - DNA, 14 bp, Homo sapiens
cttgcttgtcattg

SEQ ID NO: 6177096 - DNA, 21 bp, Homo sapiens
cttgctttaaagagtcctcct

SEQ ID NO: 6177097 - DNA, 22 bp, Homo sapiens
cttgctttacaaaccaaccatt

SEQ ID NO: 6177098 - DNA, 18 bp, Homo sapiens
cttgctttagagtagatg

SEQ ID NO: 6177099 - DNA, 20 bp, Homo sapiens
cttgctttatttttcattac

SEQ ID NO: 6177100 - DNA, 17 bp, Homo sapiens
cttgctttcacaaatat

SEQ ID NO: 6177101 - DNA, 18 bp, Homo sapiens
cttgctttcacaaatata

SEQ ID NO: 6177102 - DNA, 23 bp, Homo sapiens
cttgctttcacaaatatagttga

SEQ ID NO: 6177103 - DNA, 19 bp, Homo sapiens
cttgctttcatcactacct

SEQ ID NO: 6177104 - DNA, 21 bp, Homo sapiens
cttgctttctatgctgtttgt

SEQ ID NO: 6177105 - DNA, 17 bp, Homo sapiens
cttgctttcttctttcc

SEQ ID NO: 6177106 - DNA, 18 bp, Homo sapiens
cttgctttcttctttcct

SEQ ID NO: 6177107 - DNA, 13 bp, Homo sapiens
cttgctttcttta

SEQ ID NO: 6177108 - DNA, 17 bp, Homo sapiens
cttgctttgaatgcatg

SEQ ID NO: 6177109 - DNA, 20 bp, Homo sapiens
cttgctttgatttacagcaa

SEQ ID NO: 6177110 - DNA, 12 bp, Homo sapiens
cttgctttgctg

SEQ ID NO: 6177111 - DNA, 13 bp, Homo sapiens
cttgctttgctgt

SEQ ID NO: 6177112 - DNA, 15 bp, Homo sapiens
cttgctttgggcttt

SEQ ID NO: 6177113 - DNA, 17 bp, Homo sapiens
cttgctttgggctttgc

SEQ ID NO: 6177114 - DNA, 21 bp, Homo sapiens
cttgctttgggctttgcaggc

SEQ ID NO: 6177115 - DNA, 18 bp, Homo sapiens
cttgctttgtctggcctc

SEQ ID NO: 6177116 - DNA, 20 bp, Homo sapiens
cttgctttgtctggcctcac

SEQ ID NO: 6177117 - DNA, 15 bp, Homo sapiens
cttgcttttaaaatc

SEQ ID NO: 6177118 - DNA, 14 bp, Homo sapiens
cttgcttttatagt

SEQ ID NO: 6177119 - DNA, 18 bp, Homo sapiens
cttgcttttcatgcaaac

SEQ ID NO: 6177120 - DNA, 16 bp, Homo sapiens
cttgcttttccctctt

SEQ ID NO: 6177121 - DNA, 17 bp, Homo sapiens
cttgcttttccctcttt

SEQ ID NO: 6177122 - DNA, 20 bp, Homo sapiens
cttgcttttccctcttttct

SEQ ID NO: 6177123 - DNA, 21 bp, Homo sapiens
cttgcttttccctcttttctt

SEQ ID NO: 6177124 - DNA, 18 bp, Homo sapiens
cttgcttttcttttttaa

SEQ ID NO: 6177125 - DNA, 19 bp, Homo sapiens
cttgcttttgcctctgccc

SEQ ID NO: 6177126 - DNA, 14 bp, Homo sapiens
cttggaaaaacagc

SEQ ID NO: 6177127 - DNA, 17 bp, Homo sapiens
cttggaaaaagaaagaa

SEQ ID NO: 6177128 - DNA, 14 bp, Homo sapiens
cttggaaaaagtga

SEQ ID NO: 6177129 - DNA, 16 bp, Homo sapiens
cttggaaaaagtgatg

SEQ ID NO: 6177130 - DNA, 22 bp, Homo sapiens
cttggaaaaatccagaaagaaa

SEQ ID NO: 6177131 - DNA, 17 bp, Homo sapiens
cttggaaaacaaaagtt

SEQ ID NO: 6177132 - DNA, 23 bp, Homo sapiens
cttggaaaacaaaagttttaatt

SEQ ID NO: 6177133 - DNA, 20 bp, Homo sapiens
cttggaaacagttggcactg

SEQ ID NO: 6177134 - DNA, 22 bp, Homo sapiens
cttggaaacctgccctgcctga

SEQ ID NO: 6177135 - DNA, 20 bp, Homo sapiens
cttggaaagcatcacctcag

SEQ ID NO: 6177136 - DNA, 22 bp, Homo sapiens
cttggaaagcatcacctcaggc

SEQ ID NO: 6177137 - DNA, 23 bp, Homo sapiens
cttggaaagcatcacctcaggcc

SEQ ID NO: 6177138 - DNA, 24 bp, Homo sapiens
cttggaaagctgatgatgtctctt

SEQ ID NO: 6177139 - DNA, 20 bp, Homo sapiens
cttggaaatagaaagaagcc

SEQ ID NO: 6177140 - DNA, 21 bp, Homo sapiens
cttggaaatagaaagaagcca

SEQ ID NO: 6177141 - DNA, 18 bp, Homo sapiens
cttggaaatattaaaaga

SEQ ID NO: 6177142 - DNA, 20 bp, Homo sapiens
cttggaaatcaaatgtaaag

SEQ ID NO: 6177143 - DNA, 14 bp, Homo sapiens
cttggaaatcaggt

SEQ ID NO: 6177144 - DNA, 19 bp, Homo sapiens
cttggaaatcagtagaaag

SEQ ID NO: 6177145 - DNA, 19 bp, Homo sapiens
cttggaaatgttaagaaag

SEQ ID NO: 6177146 - DNA, 16 bp, Homo sapiens
cttggaacattggaat

SEQ ID NO: 6177147 - DNA, 18 bp, Homo sapiens
cttggaaccaccagtcta

SEQ ID NO: 6177148 - DNA, 19 bp, Homo sapiens
cttggaaccagtccgccgc

SEQ ID NO: 6177149 - DNA, 17 bp, Homo sapiens
cttggaactgtcccagc

SEQ ID NO: 6177150 - DNA, 19 bp, Homo sapiens
cttggaacttgcctgcctt

SEQ ID NO: 6177151 - DNA, 15 bp, Homo sapiens
cttggaagaggagga

SEQ ID NO: 6177152 - DNA, 16 bp, Homo sapiens
cttggaagcattcaca

SEQ ID NO: 6177153 - DNA, 13 bp, Homo sapiens
cttggaagccagg

SEQ ID NO: 6177154 - DNA, 14 bp, Homo sapiens
cttggaaggtcttt

SEQ ID NO: 6177155 - DNA, 18 bp, Homo sapiens
cttggaaggtcttttgag

SEQ ID NO: 6177156 - DNA, 22 bp, Homo sapiens
cttggaaggtcttttgagggct

SEQ ID NO: 6177157 - DNA, 17 bp, Homo sapiens
cttggaagtgtgtggaa

SEQ ID NO: 6177158 - DNA, 17 bp, Homo sapiens
cttggaatctatagtat

SEQ ID NO: 6177159 - DNA, 12 bp, Homo sapiens
cttggaatgaat

SEQ ID NO: 6177160 - DNA, 22 bp, Homo sapiens
cttggaatgaattctctctaaa

SEQ ID NO: 6177161 - DNA, 15 bp, Homo sapiens
cttggaatgggagag

SEQ ID NO: 6177162 - DNA, 20 bp, Homo sapiens
cttggaattacaagccctgg

SEQ ID NO: 6177163 - DNA, 17 bp, Homo sapiens
cttggaattactgaaag

SEQ ID NO: 6177164 - DNA, 22 bp, Homo sapiens
cttggaatttgtaacctcagct

SEQ ID NO: 6177165 - DNA, 16 bp, Homo sapiens
cttggaattttgtaaa

SEQ ID NO: 6177166 - DNA, 21 bp, Homo sapiens
cttggaattttgtaaaaagaa

SEQ ID NO: 6177167 - DNA, 17 bp, Homo sapiens
cttggacaacagctctc

SEQ ID NO: 6177168 - DNA, 17 bp, Homo sapiens
cttggacaccatcccct

SEQ ID NO: 6177169 - DNA, 15 bp, Homo sapiens
cttggacacgctcag

SEQ ID NO: 6177170 - DNA, 13 bp, Homo sapiens
cttggacactgta

SEQ ID NO: 6177171 - DNA, 23 bp, Homo sapiens
cttggacaggagtcagtgtctgg

SEQ ID NO: 6177172 - DNA, 17 bp, Homo sapiens
cttggacatcagtgttt

SEQ ID NO: 6177173 - DNA, 16 bp, Homo sapiens
cttggacatcctcctc

SEQ ID NO: 6177174 - DNA, 20 bp, Homo sapiens
cttggacatcctcctcccac

SEQ ID NO: 6177175 - DNA, 16 bp, Homo sapiens
cttggacatctctctg

SEQ ID NO: 6177176 - DNA, 21 bp, Homo sapiens
cttggacatctctctggcttc

SEQ ID NO: 6177177 - DNA, 22 bp, Homo sapiens
cttggacatctctctggcttct

SEQ ID NO: 6177178 - DNA, 23 bp, Homo sapiens
cttggacatctctctggcttctg

SEQ ID NO: 6177179 - DNA, 21 bp, Homo sapiens
cttggacatgggccccagata

SEQ ID NO: 6177180 - DNA, 18 bp, Homo sapiens
cttggacatttatgtaca

SEQ ID NO: 6177181 - DNA, 17 bp, Homo sapiens
cttggacattttatgtc

SEQ ID NO: 6177182 - DNA, 14 bp, Homo sapiens
cttggaccactcct

SEQ ID NO: 6177183 - DNA, 16 bp, Homo sapiens
cttggaccactcctgt

SEQ ID NO: 6177184 - DNA, 20 bp, Homo sapiens
cttggaccactcctgtccct

SEQ ID NO: 6177185 - DNA, 22 bp, Homo sapiens
cttggaccactcctgtccctgt

SEQ ID NO: 6177186 - DNA, 20 bp, Homo sapiens
cttggacccacctgaaatgc

SEQ ID NO: 6177187 - DNA, 19 bp, Homo sapiens
cttggacccacctgtgggg

SEQ ID NO: 6177188 - DNA, 14 bp, Homo sapiens
cttggaccctggtg

SEQ ID NO: 6177189 - DNA, 16 bp, Homo sapiens
cttggaccctggtgac

SEQ ID NO: 6177190 - DNA, 23 bp, Homo sapiens
cttggaccctggtgacctcctgt

SEQ ID NO: 6177191 - DNA, 16 bp, Homo sapiens
cttggacctccagggg

SEQ ID NO: 6177192 - DNA, 18 bp, Homo sapiens
cttggacctccaggggct

SEQ ID NO: 6177193 - DNA, 23 bp, Homo sapiens
cttggacctccaggggctcctgg

SEQ ID NO: 6177194 - DNA, 16 bp, Homo sapiens
cttggacctctgctct

SEQ ID NO: 6177195 - DNA, 17 bp, Homo sapiens
cttggacctctgctctg

SEQ ID NO: 6177196 - DNA, 16 bp, Homo sapiens
cttggacgcactgttt

SEQ ID NO: 6177197 - DNA, 14 bp, Homo sapiens
cttggacggggaca

SEQ ID NO: 6177198 - DNA, 23 bp, Homo sapiens
cttggacggggacacggcctctg

SEQ ID NO: 6177199 - DNA, 22 bp, Homo sapiens
cttggactccctccccacccca

SEQ ID NO: 6177200 - DNA, 14 bp, Homo sapiens
cttggactcctccc

SEQ ID NO: 6177201 - DNA, 18 bp, Homo sapiens
cttggactctagtccttg

SEQ ID NO: 6177202 - DNA, 14 bp, Homo sapiens
cttggacttcctgg

SEQ ID NO: 6177203 - DNA, 18 bp, Homo sapiens
cttggacttcctggggcc

SEQ ID NO: 6177204 - DNA, 21 bp, Homo sapiens
cttggacttcctggggccccg

SEQ ID NO: 6177205 - DNA, 22 bp, Homo sapiens
cttggacttctaaaggcggagg

SEQ ID NO: 6177206 - DNA, 22 bp, Homo sapiens
cttggacttttttttttctttt

SEQ ID NO: 6177207 - DNA, 15 bp, Homo sapiens
cttggagaaatgaaa

SEQ ID NO: 6177208 - DNA, 19 bp, Homo sapiens
cttggagactcctggtctg

SEQ ID NO: 6177209 - DNA, 17 bp, Homo sapiens
cttggagagagaggctg

SEQ ID NO: 6177210 - DNA, 20 bp, Homo sapiens
cttggagagagaggctgcct

SEQ ID NO: 6177211 - DNA, 21 bp, Homo sapiens
cttggagagagaggctgcctc

SEQ ID NO: 6177212 - DNA, 13 bp, Homo sapiens
cttggagagcaaa

SEQ ID NO: 6177213 - DNA, 17 bp, Homo sapiens
cttggagagcaaaggcc

SEQ ID NO: 6177214 - DNA, 15 bp, Homo sapiens
cttggagagcagctg

SEQ ID NO: 6177215 - DNA, 23 bp, Homo sapiens
cttggagagctcaggatggctca

SEQ ID NO: 6177216 - DNA, 11 bp, Homo sapiens
cttggagagga

SEQ ID NO: 6177217 - DNA, 18 bp, Homo sapiens
cttggagaggagagtggc

SEQ ID NO: 6177218 - DNA, 18 bp, Homo sapiens
cttggagagggcccaggt

SEQ ID NO: 6177219 - DNA, 20 bp, Homo sapiens
cttggagagtcttgggcctg

SEQ ID NO: 6177220 - DNA, 18 bp, Homo sapiens
cttggagatctttgcttc

SEQ ID NO: 6177221 - DNA, 16 bp, Homo sapiens
cttggagcagagacgg

SEQ ID NO: 6177222 - DNA, 14 bp, Homo sapiens
cttggagcatttat

SEQ ID NO: 6177223 - DNA, 22 bp, Homo sapiens
cttggagcatttatgtagacat

SEQ ID NO: 6177224 - DNA, 18 bp, Homo sapiens
cttggagccccagtgcca

SEQ ID NO: 6177225 - DNA, 13 bp, Homo sapiens
cttggagccccct

SEQ ID NO: 6177226 - DNA, 13 bp, Homo sapiens
cttggagcctgca

SEQ ID NO: 6177227 - DNA, 19 bp, Homo sapiens
cttggagcctgcagagctg

SEQ ID NO: 6177228 - DNA, 13 bp, Homo sapiens
cttggagccttcc

SEQ ID NO: 6177229 - DNA, 18 bp, Homo sapiens
cttggagcgtggactggt

SEQ ID NO: 6177230 - DNA, 22 bp, Homo sapiens
cttggagcgtttttgctggctt

SEQ ID NO: 6177231 - DNA, 13 bp, Homo sapiens
cttggagctgaga

SEQ ID NO: 6177232 - DNA, 21 bp, Homo sapiens
cttggagctgagcctctcacc

SEQ ID NO: 6177233 - DNA, 15 bp, Homo sapiens
cttggagctgcttgg

SEQ ID NO: 6177234 - DNA, 18 bp, Homo sapiens
cttggagctgtcctccag

SEQ ID NO: 6177235 - DNA, 15 bp, Homo sapiens
cttggaggacagtgg

SEQ ID NO: 6177236 - DNA, 10 bp, Homo sapiens
cttggaggag

SEQ ID NO: 6177237 - DNA, 14 bp, Homo sapiens
cttggaggagagag

SEQ ID NO: 6177238 - DNA, 19 bp, Homo sapiens
cttggaggatcgtggccaa

SEQ ID NO: 6177239 - DNA, 21 bp, Homo sapiens
cttggaggcaacctcccattt

SEQ ID NO: 6177240 - DNA, 17 bp, Homo sapiens
cttggaggccaccggga

SEQ ID NO: 6177241 - DNA, 13 bp, Homo sapiens
cttggaggcctca

SEQ ID NO: 6177242 - DNA, 14 bp, Homo sapiens
cttggaggcctcag

SEQ ID NO: 6177243 - DNA, 14 bp, Homo sapiens
cttggagggagagg

SEQ ID NO: 6177244 - DNA, 13 bp, Homo sapiens
cttggagggatgg

SEQ ID NO: 6177245 - DNA, 23 bp, Homo sapiens
cttggagggcatgaagacagata

SEQ ID NO: 6177246 - DNA, 14 bp, Homo sapiens
cttggagggcccag

SEQ ID NO: 6177247 - DNA, 16 bp, Homo sapiens
cttggagggggaagag

SEQ ID NO: 6177248 - DNA, 18 bp, Homo sapiens
cttggagggtcccaagct

SEQ ID NO: 6177249 - DNA, 18 bp, Homo sapiens
cttggagggtctgggggc

SEQ ID NO: 6177250 - DNA, 24 bp, Homo sapiens
cttggagggttggtcctcttgcct

SEQ ID NO: 6177251 - DNA, 17 bp, Homo sapiens
cttggaggtagctttga

SEQ ID NO: 6177252 - DNA, 21 bp, Homo sapiens
ctggaggtgggagcaggagat

SEQ ID NO: 6177253 - DNA, 17 bp, Homo sapiens
ctggaggtggggagggc

SEQ ID NO: 6177254 - DNA, 18 bp, Homo sapiens
ctggaggtggggagggcc

SEQ ID NO: 6177255 - DNA, 16 bp, Homo sapiens
ctggaggtggggcgag

SEQ ID NO: 6177256 - DNA, 15 bp, Homo sapiens
ctggaggtggggttg

SEQ ID NO: 6177257 - DNA, 19 bp, Homo sapiens
ctggaggttgaagccaagt

SEQ ID NO: 6177258 - DNA, 17 bp, Homo sapiens
ctggaggttgataactt

SEQ ID NO: 6177259 - DNA, 18 bp, Homo sapiens
ctggaggttgataacttt

SEQ ID NO: 6177260 - DNA, 12 bp, Homo sapiens
ctggaggtttgt

SEQ ID NO: 6177261 - DNA, 17 bp, Homo sapiens
ctggagtacccagccta

SEQ ID NO: 6177262 - DNA, 19 bp, Homo sapiens
ctggagtatttggaagcaa

SEQ ID NO: 6177263 - DNA, 14 bp, Homo sapiens
ctggagtcacatca

SEQ ID NO: 6177264 - DNA, 15 bp, Homo sapiens
ctggagtcagatgag

SEQ ID NO: 6177265 - DNA, 18 bp, Homo sapiens
ctggagtcagatgagcaa

SEQ ID NO: 6177266 - DNA, 22 bp, Homo sapiens
ctggagtcaggtgtcgaggcca

SEQ ID NO: 6177267 - DNA, 16 bp, Homo sapiens
ctggagtcagtagcca

SEQ ID NO: 6177268 - DNA, 18 bp, Homo sapiens
ctggagtcagtagccaga

SEQ ID NO: 6177269 - DNA, 20 bp, Homo sapiens
ctggagtcagtagccagagt

SEQ ID NO: 6177270 - DNA, 18 bp, Homo sapiens
ctggagtcatcattccct

SEQ ID NO: 6177271 - DNA, 18 bp, Homo sapiens
ctggagtcccaaatgtca

SEQ ID NO: 6177272 - DNA, 20 bp, Homo sapiens
ctggagtcccacccggacag

SEQ ID NO: 6177273 - DNA, 14 bp, Homo sapiens
ctggagtccctcct

SEQ ID NO: 6177274 - DNA, 23 bp, Homo sapiens
ctggagtccctcctcccccacgc

SEQ ID NO: 6177275 - DNA, 15 bp, Homo sapiens
ctggagtcctgttct

SEQ ID NO: 6177276 - DNA, 19 bp, Homo sapiens
ctggagtcctgttctcaga

SEQ ID NO: 6177277 - DNA, 21 bp, Homo sapiens
ctggagtcctgttctcagagc

SEQ ID NO: 6177278 - DNA, 23 bp, Homo sapiens
ctggagtcggatctagccatggc

SEQ ID NO: 6177279 - DNA, 18 bp, Homo sapiens
ctggagtcgtgggaagga

SEQ ID NO: 6177280 - DNA, 20 bp, Homo sapiens
ctggagtcgtgggaaggagg

SEQ ID NO: 6177281 - DNA, 16 bp, Homo sapiens
ctggagtctcactgtc

SEQ ID NO: 6177282 - DNA, 16 bp, Homo sapiens
ctggagtctcagagca

SEQ ID NO: 6177283 - DNA, 18 bp, Homo sapiens
ctggagtctcagagcaca

SEQ ID NO: 6177284 - DNA, 21 bp, Homo sapiens
ctggagtctccagatgttaat

SEQ ID NO: 6177285 - DNA, 15 bp, Homo sapiens
ctggagtctcctgag

SEQ ID NO: 6177286 - DNA, 14 bp, Homo sapiens
ctggagtctctctc

SEQ ID NO: 6177287 - DNA, 20 bp, Homo sapiens
ctggagtctctctctctcca

SEQ ID NO: 6177288 - DNA, 16 bp, Homo sapiens
ctggagtctgaaggag

SEQ ID NO: 6177289 - DNA, 17 bp, Homo sapiens
ctggagtctgaaggaga

SEQ ID NO: 6177290 - DNA, 20 bp, Homo sapiens
ctggagtctgaaggagagga

SEQ ID NO: 6177291 - DNA, 12 bp, Homo sapiens
ctggagtctgga

SEQ ID NO: 6177292 - DNA, 16 bp, Homo sapiens
ctggagtctggcttta

SEQ ID NO: 6177293 - DNA, 15 bp, Homo sapiens
ctggagtgaaccaga

SEQ ID NO: 6177294 - DNA, 13 bp, Homo sapiens
ctggagtgaggct

SEQ ID NO: 6177295 - DNA, 19 bp, Homo sapiens
ctggagtgaggcttccagg

SEQ ID NO: 6177296 - DNA, 21 bp, Homo sapiens
ctggagtgaggcttccaggct

SEQ ID NO: 6177297 - DNA, 23 bp, Homo sapiens
ctggagtgatggtgtccttccct

SEQ ID NO: 6177298 - DNA, 12 bp, Homo sapiens
ctggagtgcagg

SEQ ID NO: 6177299 - DNA, 16 bp, Homo sapiens
ctggagtgcagtgagc

SEQ ID NO: 6177300 - DNA, 20 bp, Homo sapiens
ctggagtgcagtgagccgag

SEQ ID NO: 6177301 - DNA, 15 bp, Homo sapiens
ctggagtgcagtggc

SEQ ID NO: 6177302 - DNA, 19 bp, Homo sapiens
ctggagtgcccaccctggg

SEQ ID NO: 6177303 - DNA, 22 bp, Homo sapiens
ctggagtgcccaccctgggaga

SEQ ID NO: 6177304 - DNA, 14 bp, Homo sapiens
ctggagtgctgctt

SEQ ID NO: 6177305 - DNA, 15 bp, Homo sapiens
ctggagtgctgcttg

SEQ ID NO: 6177306 - DNA, 15 bp, Homo sapiens
ctggagtggcatggt

SEQ ID NO: 6177307 - DNA, 19 bp, Homo sapiens
ctggagtggcatggtcctg

SEQ ID NO: 6177308 - DNA, 22 bp, Homo sapiens
ctggagtggcatggtcctgtgc

SEQ ID NO: 6177309 - DNA, 23 bp, Homo sapiens
ctggagtggcatggtcctgtgcc

SEQ ID NO: 6177310 - DNA, 16 bp, Homo sapiens
ctggagtgggcagagc

SEQ ID NO: 6177311 - DNA, 16 bp, Homo sapiens
ctggagtgggctctct

SEQ ID NO: 6177312 - DNA, 23 bp, Homo sapiens
ctggagtgggctctctggacctg

SEQ ID NO: 6177313 - DNA, 19 bp, Homo sapiens
ctggagtgggtagaagcct

SEQ ID NO: 6177314 - DNA, 15 bp, Homo sapiens
ctggagtggtaacag

SEQ ID NO: 6177315 - DNA, 21 bp, Homo sapiens
ctggagtggtaacagctctct

SEQ ID NO: 6177316 - DNA, 13 bp, Homo sapiens
ctggagtgtagtg

SEQ ID NO: 6177317 - DNA, 20 bp, Homo sapiens
ctggagtgtcggatcctgtg

SEQ ID NO: 6177318 - DNA, 21 bp, Homo sapiens
ctggagtgtcggatcctgtga

SEQ ID NO: 6177319 - DNA, 19 bp, Homo sapiens
ctggagtgtggctgaggag

SEQ ID NO: 6177320 - DNA, 20 bp, Homo sapiens
ctggagtgtggctgaggagg

SEQ ID NO: 6177321 - DNA, 23 bp, Homo sapiens
ctggagtgtgtcagagcccaggg

SEQ ID NO: 6177322 - DNA, 17 bp, Homo sapiens
ctggagttagggactga

SEQ ID NO: 6177323 - DNA, 21 bp, Homo sapiens
ctggagttattgaagcagagt

SEQ ID NO: 6177324 - DNA, 20 bp, Homo sapiens
ctggagttccggcctgggca

SEQ ID NO: 6177325 - DNA, 13 bp, Homo sapiens
ctggagttcctca

SEQ ID NO: 6177326 - DNA, 24 bp, Homo sapiens
ctggagttccttatccctctcttc

SEQ ID NO: 6177327 - DNA, 22 bp, Homo sapiens
ctggagttgactgactgagcag

SEQ ID NO: 6177328 - DNA, 15 bp, Homo sapiens
ctggagttgcattga

SEQ ID NO: 6177329 - DNA, 13 bp, Homo sapiens
ctggagttgggct

SEQ ID NO: 6177330 - DNA, 14 bp, Homo sapiens
ctggagttgggctg

SEQ ID NO: 6177331 - DNA, 23 bp, Homo sapiens
ctggagttggggctcttggcttt

SEQ ID NO: 6177332 - DNA, 23 bp, Homo sapiens
ctggagtttcatgttatgcctgt

SEQ ID NO: 6177333 - DNA, 20 bp, Homo sapiens
ctggagtttgggatccctgt

SEQ ID NO: 6177334 - DNA, 16 bp, Homo sapiens
ctggagttttgatttg

SEQ ID NO: 6177335 - DNA, 22 bp, Homo sapiens
ctggagtttttgtttggagagc

SEQ ID NO: 6177336 - DNA, 23 bp, Homo sapiens
ctggagtttttgtttggagagca

SEQ ID NO: 6177337 - DNA, 13 bp, Homo sapiens
ctggataaaatga

SEQ ID NO: 6177338 - DNA, 20 bp, Homo sapiens
ctggataaaccaccctctgg

SEQ ID NO: 6177339 - DNA, 22 bp, Homo sapiens
ctggataaaccaccctctgggg

SEQ ID NO: 6177340 - DNA, 14 bp, Homo sapiens
ctggataaatttaa

SEQ ID NO: 6177341 - DNA, 16 bp, Homo sapiens
ctggataaatttaaaa

SEQ ID NO: 6177342 - DNA, 22 bp, Homo sapiens
ctggataaatttaaaacacagt

SEQ ID NO: 6177343 - DNA, 22 bp, Homo sapiens
ctggataacttccacagggtcc

SEQ ID NO: 6177344 - DNA, 14 bp, Homo sapiens
ctggataatttgta

SEQ ID NO: 6177345 - DNA, 15 bp, Homo sapiens
ctggatacctgtgtg

SEQ ID NO: 6177346 - DNA, 23 bp, Homo sapiens
ctggatactatatgataaagagg

SEQ ID NO: 6177347 - DNA, 23 bp, Homo sapiens
ctggatactgcaaaggcttgtgg

SEQ ID NO: 6177348 - DNA, 15 bp, Homo sapiens
ctggatactgtactg

SEQ ID NO: 6177349 - DNA, 14 bp, Homo sapiens
ctggatagaaaaat

SEQ ID NO: 6177350 - DNA, 14 bp, Homo sapiens
ctggatagacgagt

SEQ ID NO: 6177351 - DNA, 13 bp, Homo sapiens
ctggatagacttg

SEQ ID NO: 6177352 - DNA, 14 bp, Homo sapiens
ctggatagacttgg

SEQ ID NO: 6177353 - DNA, 13 bp, Homo sapiens
ctggatagccttg

SEQ ID NO: 6177354 - DNA, 20 bp, Homo sapiens
ctggatagccttgaaaacaa

SEQ ID NO: 6177355 - DNA, 23 bp, Homo sapiens
ctggatagccttgaaaacaaaca

SEQ ID NO: 6177356 - DNA, 19 bp, Homo sapiens
ctggataggagcctgctgg

SEQ ID NO: 6177357 - DNA, 20 bp, Homo sapiens
ctggataggagcctgctggt

SEQ ID NO: 6177358 - DNA, 18 bp, Homo sapiens
ctggatagtccgtctctg

SEQ ID NO: 6177359 - DNA, 16 bp, Homo sapiens
ctggatagttaagggc

SEQ ID NO: 6177360 - DNA, 21 bp, Homo sapiens
ctggatataatgtattttcag

SEQ ID NO: 6177361 - DNA, 15 bp, Homo sapiens
ctggatatatttaaa

SEQ ID NO: 6177362 - DNA, 20 bp, Homo sapiens
ctggatatcaaggtggaaat

SEQ ID NO: 6177363 - DNA, 21 bp, Homo sapiens
ctggatatcgtcattttgcag

SEQ ID NO: 6177364 - DNA, 13 bp, Homo sapiens
ctggatatttcaa

SEQ ID NO: 6177365 - DNA, 15 bp, Homo sapiens
ctggatatttcaatc

SEQ ID NO: 6177366 - DNA, 23 bp, Homo sapiens
ctggatatttcaatcttttaaat

SEQ ID NO: 6177367 - DNA, 21 bp, Homo sapiens
ctggatatttgcacttatgta

SEQ ID NO: 6177368 - DNA, 21 bp, Homo sapiens
ctggatattttcaaattgtat

SEQ ID NO: 6177369 - DNA, 16 bp, Homo sapiens
ctggatcacagctgct

SEQ ID NO: 6177370 - DNA, 14 bp, Homo sapiens
ctggatcagcgtgg

SEQ ID NO: 6177371 - DNA, 22 bp, Homo sapiens
ctggatcagggttgttctggga

SEQ ID NO: 6177372 - DNA, 14 bp, Homo sapiens
ctggatcagtaaaa

SEQ ID NO: 6177373 - DNA, 21 bp, Homo sapiens
ctggatcagtcctttgatcag

SEQ ID NO: 6177374 - DNA, 17 bp, Homo sapiens
ctggatccagcactggt

SEQ ID NO: 6177375 - DNA, 20 bp, Homo sapiens
ctggatccagctctgggagc

SEQ ID NO: 6177376 - DNA, 14 bp, Homo sapiens
ctggatccatcctg

SEQ ID NO: 6177377 - DNA, 21 bp, Homo sapiens
ctggatccatcttgagccaca

SEQ ID NO: 6177378 - DNA, 18 bp, Homo sapiens
ctggatccatggggggag

SEQ ID NO: 6177379 - DNA, 23 bp, Homo sapiens
ctggatcccctctgtctacaaat

SEQ ID NO: 6177380 - DNA, 22 bp, Homo sapiens
ctggatcccgaggtatggcaga

SEQ ID NO: 6177381 - DNA, 14 bp, Homo sapiens
ctggatccctttca

SEQ ID NO: 6177382 - DNA, 15 bp, Homo sapiens
ctggatcctgctgct

SEQ ID NO: 6177383 - DNA, 17 bp, Homo sapiens
ctggatcctgctgcttt

SEQ ID NO: 6177384 - DNA, 17 bp, Homo sapiens
ctggatccttcccaagg

SEQ ID NO: 6177385 - DNA, 18 bp, Homo sapiens
ctggatccttcccaaggt

SEQ ID NO: 6177386 - DNA, 22 bp, Homo sapiens
ctggatcgctgcacatggcctg

SEQ ID NO: 6177387 - DNA, 16 bp, Homo sapiens
ctggatctacctggag

SEQ ID NO: 6177388 - DNA, 20 bp, Homo sapiens
ctggatctccattctctcag

SEQ ID NO: 6177389 - DNA, 13 bp, Homo sapiens
ctggatctcccag

SEQ ID NO: 6177390 - DNA, 16 bp, Homo sapiens
ctggatctcccagggc

SEQ ID NO: 6177391 - DNA, 13 bp, Homo sapiens
ctggatctccctg

SEQ ID NO: 6177392 - DNA, 22 bp, Homo sapiens
ctggatctcctgctgccttttc

SEQ ID NO: 6177393 - DNA, 15 bp, Homo sapiens
ctggatctgaccctc

SEQ ID NO: 6177394 - DNA, 16 bp, Homo sapiens
ctggatctgaccctcc

SEQ ID NO: 6177395 - DNA, 14 bp, Homo sapiens
ctggatctggctta

SEQ ID NO: 6177396 - DNA, 20 bp, Homo sapiens
ctggatctgggaccctttcc

SEQ ID NO: 6177397 - DNA, 14 bp, Homo sapiens
ctggatctgtgagg

SEQ ID NO: 6177398 - DNA, 15 bp, Homo sapiens
ctggatctgttcctt

SEQ ID NO: 6177399 - DNA, 17 bp, Homo sapiens
ctggatcttctatcatt

SEQ ID NO: 6177400 - DNA, 18 bp, Homo sapiens
ctggatcttttggtggag

SEQ ID NO: 6177401 - DNA, 12 bp, Homo sapiens
ctggatgaaaga

SEQ ID NO: 6177402 - DNA, 17 bp, Homo sapiens
ctggatgaaagagccag

SEQ ID NO: 6177403 - DNA, 23 bp, Homo sapiens
ctggatgaagattctcctgtgct

SEQ ID NO: 6177404 - DNA, 13 bp, Homo sapiens
ctggatgaaggca

SEQ ID NO: 6177405 - DNA, 20 bp, Homo sapiens
ctggatgaagttatctggct

SEQ ID NO: 6177406 - DNA, 13 bp, Homo sapiens
ctggatgacccca

SEQ ID NO: 6177407 - DNA, 15 bp, Homo sapiens
ctggatgacttgctc

SEQ ID NO: 6177408 - DNA, 15 bp, Homo sapiens
ctggatgagaaacag

SEQ ID NO: 6177409 - DNA, 21 bp, Homo sapiens
ctggatgagaaacagctcagc

SEQ ID NO: 6177410 - DNA, 22 bp, Homo sapiens
ctggatgagaaacagctcagcc

SEQ ID NO: 6177411 - DNA, 13 bp, Homo sapiens
ctggatgagactt

SEQ ID NO: 6177412 - DNA, 19 bp, Homo sapiens
ctggatgagcaactcctgt

SEQ ID NO: 6177413 - DNA, 20 bp, Homo sapiens
ctggatgagctcccacaagc

SEQ ID NO: 6177414 - DNA, 22 bp, Homo sapiens
ctggatgagtagcgctatagtt

SEQ ID NO: 6177415 - DNA, 16 bp, Homo sapiens
ctggatgatactaata

SEQ ID NO: 6177416 - DNA, 22 bp, Homo sapiens
ctggatgatactaataaactaa

SEQ ID NO: 6177417 - DNA, 21 bp, Homo sapiens
ctggatgatttcatcttctgg

SEQ ID NO: 6177418 - DNA, 20 bp, Homo sapiens
ctggatgcacagatgccatg

SEQ ID NO: 6177419 - DNA, 17 bp, Homo sapiens
ctggatgcacagtgcct

SEQ ID NO: 6177420 - DNA, 22 bp, Homo sapiens
ctggatgcagcctcacagtcct

SEQ ID NO: 6177421 - DNA, 19 bp, Homo sapiens
ctggatgccaaggagcccc

SEQ ID NO: 6177422 - DNA, 12 bp, Homo sapiens
ctggatgccatc

SEQ ID NO: 6177423 - DNA, 14 bp, Homo sapiens
ctggatgcccagga

SEQ ID NO: 6177424 - DNA, 15 bp, Homo sapiens
ctggatgcccaggaa

SEQ ID NO: 6177425 - DNA, 18 bp, Homo sapiens
ctggatgccccctgtgga

SEQ ID NO: 6177426 - DNA, 22 bp, Homo sapiens
ctggatgcctcattatgtcaac

SEQ ID NO: 6177427 - DNA, 16 bp, Homo sapiens
ctggatgccttccccc

SEQ ID NO: 6177428 - DNA, 12 bp, Homo sapiens
ctggatgctcgc

SEQ ID NO: 6177429 - DNA, 13 bp, Homo sapiens
cttggaggtcaca

SEQ ID NO: 6177430 - DNA, 15 bp, Homo sapiens
cttggaggtcacagc

SEQ ID NO: 6177431 - DNA, 22 bp, Homo sapiens
cttggaggtcacagctggatct

SEQ ID NO: 6177432 - DNA, 15 bp, Homo sapiens
cttggaggtgtctgt

SEQ ID NO: 6177433 - DNA, 15 bp, Homo sapiens
cttggagtaattgca

SEQ ID NO: 6177434 - DNA, 16 bp, Homo sapiens
cttggagtagacaaaa

SEQ ID NO: 6177435 - DNA, 19 bp, Homo sapiens
cttggagtgccccaaggag

SEQ ID NO: 6177436 - DNA, 17 bp, Homo sapiens
cttggagtgctgcagct

SEQ ID NO: 6177437 - DNA, 14 bp, Homo sapiens
cttggagtggccaa

SEQ ID NO: 6177438 - DNA, 22 bp, Homo sapiens
cttggagtttttcattgtcgct

SEQ ID NO: 6177439 - DNA, 17 bp, Homo sapiens
cttggataccagctcag

SEQ ID NO: 6177440 - DNA, 20 bp, Homo sapiens
cttggataggagcttccaga

SEQ ID NO: 6177441 - DNA, 14 bp, Homo sapiens
cttggatcagaggt

SEQ ID NO: 6177442 - DNA, 15 bp, Homo sapiens
cttggatcagaggtc

SEQ ID NO: 6177443 - DNA, 20 bp, Homo sapiens
cttggatccatacaaaacta

SEQ ID NO: 6177444 - DNA, 14 bp, Homo sapiens
cttggatcccaaag

SEQ ID NO: 6177445 - DNA, 16 bp, Homo sapiens
cttggatcccaaagca

SEQ ID NO: 6177446 - DNA, 17 bp, Homo sapiens
cttggatcctgggctgg

SEQ ID NO: 6177447 - DNA, 14 bp, Homo sapiens
cttggatcgtggaa

SEQ ID NO: 6177448 - DNA, 14 bp, Homo sapiens
cttggatctggggt

SEQ ID NO: 6177449 - DNA, 16 bp, Homo sapiens
cttggatctttttgca

SEQ ID NO: 6177450 - DNA, 21 bp, Homo sapiens
cttggatgagttttgggaagt

SEQ ID NO: 6177451 - DNA, 18 bp, Homo sapiens
cttggatgattgcagtta

SEQ ID NO: 6177452 - DNA, 16 bp, Homo sapiens
cttggatggacttgta

SEQ ID NO: 6177453 - DNA, 18 bp, Homo sapiens
cttggatgggacattttt

SEQ ID NO: 6177454 - DNA, 15 bp, Homo sapiens
cttggattaaataca

SEQ ID NO: 6177455 - DNA, 16 bp, Homo sapiens
cttggattcaatttta

SEQ ID NO: 6177456 - DNA, 18 bp, Homo sapiens
cttggattctctgagaaa

SEQ ID NO: 6177457 - DNA, 14 bp, Homo sapiens
cttggattgtcccc

SEQ ID NO: 6177458 - DNA, 16 bp, Homo sapiens
cttggatttagtttca

SEQ ID NO: 6177459 - DNA, 21 bp, Homo sapiens
cttggatttcgtgtgccgctg

SEQ ID NO: 6177460 - DNA, 15 bp, Homo sapiens
cttggatttctgaat

SEQ ID NO: 6177461 - DNA, 23 bp, Homo sapiens
cttggatttgaacttgctctttt

SEQ ID NO: 6177462 - DNA, 15 bp, Homo sapiens
cttggattttcctga

SEQ ID NO: 6177463 - DNA, 18 bp, Homo sapiens
cttggcaaaagccttgtg

SEQ ID NO: 6177464 - DNA, 16 bp, Homo sapiens
cttggcaaattttaaa

SEQ ID NO: 6177465 - DNA, 20 bp, Homo sapiens
cttggcaacagaagcagttg

SEQ ID NO: 6177466 - DNA, 16 bp, Homo sapiens
cttggcaactttcttc

SEQ ID NO: 6177467 - DNA, 21 bp, Homo sapiens
cttggcaataaattttgaaaa

SEQ ID NO: 6177468 - DNA, 12 bp, Homo sapiens
cttggcaccaaa

SEQ ID NO: 6177469 - DNA, 19 bp, Homo sapiens
cttggcaccaaagatgcag

SEQ ID NO: 6177470 - DNA, 14 bp, Homo sapiens
cttggcaccaataa

SEQ ID NO: 6177471 - DNA, 19 bp, Homo sapiens
cttggcaccaataaaggag

SEQ ID NO: 6177472 - DNA, 21 bp, Homo sapiens
cttggcaccaataaaggagga

SEQ ID NO: 6177473 - DNA, 17 bp, Homo sapiens
cttggcaccaccagggt

SEQ ID NO: 6177474 - DNA, 18 bp, Homo sapiens
cttggcaccaccagggtg

SEQ ID NO: 6177475 - DNA, 16 bp, Homo sapiens
cttggcaccagacacc

SEQ ID NO: 6177476 - DNA, 21 bp, Homo sapiens
cttggcacccaagacctcagg

SEQ ID NO: 6177477 - DNA, 14 bp, Homo sapiens
cttggcacccccat

SEQ ID NO: 6177478 - DNA, 22 bp, Homo sapiens
cttggcacccccatgctgcctt

SEQ ID NO: 6177479 - DNA, 13 bp, Homo sapiens
cttggcactgtgg

SEQ ID NO: 6177480 - DNA, 14 bp, Homo sapiens
cttggcactgtgga

SEQ ID NO: 6177481 - DNA, 22 bp, Homo sapiens
cttggcactgtggaactgccac

SEQ ID NO: 6177482 - DNA, 23 bp, Homo sapiens
cttggcactgtggaactgccacc

SEQ ID NO: 6177483 - DNA, 21 bp, Homo sapiens
cttggcacttaagtgcacttt

SEQ ID NO: 6177484 - DNA, 14 bp, Homo sapiens
cttggcactttttc

SEQ ID NO: 6177485 - DNA, 13 bp, Homo sapiens
cttggcagccttg

SEQ ID NO: 6177486 - DNA, 23 bp, Homo sapiens
cttggcagcttaacattgacttc

SEQ ID NO: 6177487 - DNA, 21 bp, Homo sapiens
cttggcagctttttctgtgga

SEQ ID NO: 6177488 - DNA, 16 bp, Homo sapiens
cttggcaggctgaggt

SEQ ID NO: 6177489 - DNA, 18 bp, Homo sapiens
cttggcagtattccatgg

SEQ ID NO: 6177490 - DNA, 14 bp, Homo sapiens
cttggcataagaca

SEQ ID NO: 6177491 - DNA, 17 bp, Homo sapiens
cttggcatacaaaatat

SEQ ID NO: 6177492 - DNA, 20 bp, Homo sapiens
cttggcatcacagggcagag

SEQ ID NO: 6177493 - DNA, 13 bp, Homo sapiens
cttggcatctact

SEQ ID NO: 6177494 - DNA, 16 bp, Homo sapiens
cttggcatctgtgtgc

SEQ ID NO: 6177495 - DNA, 16 bp, Homo sapiens
cttggcatgcatcttt

SEQ ID NO: 6177496 - DNA, 17 bp, Homo sapiens
cttggcatgcatcttta

SEQ ID NO: 6177497 - DNA, 14 bp, Homo sapiens
cttggcattccgca

SEQ ID NO: 6177498 - DNA, 14 bp, Homo sapiens
cttggcattgacct

SEQ ID NO: 6177499 - DNA, 15 bp, Homo sapiens
cttggcattggaatt

SEQ ID NO: 6177500 - DNA, 22 bp, Homo sapiens
cttggccaaaacaggctcaggc

SEQ ID NO: 6177501 - DNA, 23 bp, Homo sapiens
cttggccaaaacaggctcaggcc

SEQ ID NO: 6177502 - DNA, 17 bp, Homo sapiens
cttggccaagagaaggg

SEQ ID NO: 6177503 - DNA, 15 bp, Homo sapiens
cttggccaagcaggg

SEQ ID NO: 6177504 - DNA, 14 bp, Homo sapiens
cttggccacagact

SEQ ID NO: 6177505 - DNA, 17 bp, Homo sapiens
cttggccagaagggggc

SEQ ID NO: 6177506 - DNA, 17 bp, Homo sapiens
cttggccagagctgagt

SEQ ID NO: 6177507 - DNA, 21 bp, Homo sapiens
cttggccagcaagttagagaa

SEQ ID NO: 6177508 - DNA, 14 bp, Homo sapiens
cttggccagcgctg

SEQ ID NO: 6177509 - DNA, 21 bp, Homo sapiens
cttggccatgatgtccttgga

SEQ ID NO: 6177510 - DNA, 18 bp, Homo sapiens
cttggccatgcagaaagc

SEQ ID NO: 6177511 - DNA, 13 bp, Homo sapiens
cttggcccagcag

SEQ ID NO: 6177512 - DNA, 13 bp, Homo sapiens
cttggcccaggaa

SEQ ID NO: 6177513 - DNA, 14 bp, Homo sapiens
cttggcccaggagc

SEQ ID NO: 6177514 - DNA, 16 bp, Homo sapiens
cttggcccaggagctc

SEQ ID NO: 6177515 - DNA, 17 bp, Homo sapiens
cttggcccaggagctct

SEQ ID NO: 6177516 - DNA, 19 bp, Homo sapiens
cttggcccaggagctctgc

SEQ ID NO: 6177517 - DNA, 23 bp, Homo sapiens
cttggcccaggagctctgcgcca

SEQ ID NO: 6177518 - DNA, 18 bp, Homo sapiens
cttggcccagggggcttc

SEQ ID NO: 6177519 - DNA, 16 bp, Homo sapiens
cttggccccagacgca

SEQ ID NO: 6177520 - DNA, 21 bp, Homo sapiens
cttggccccagaggaccgaga

SEQ ID NO: 6177521 - DNA, 21 bp, Homo sapiens
cttggccccccaaagtgctgg

SEQ ID NO: 6177522 - DNA, 19 bp, Homo sapiens
cttggcccctcacatcctc

SEQ ID NO: 6177523 - DNA, 18 bp, Homo sapiens
cttggcccgcggcctgca

SEQ ID NO: 6177524 - DNA, 18 bp, Homo sapiens
cttggccctcctcagctc

SEQ ID NO: 6177525 - DNA, 14 bp, Homo sapiens
cttggccctctcct

SEQ ID NO: 6177526 - DNA, 11 bp, Homo sapiens
cttggccctgc

SEQ ID NO: 6177527 - DNA, 22 bp, Homo sapiens
cttggccgcacctaaagcagcc

SEQ ID NO: 6177528 - DNA, 21 bp, Homo sapiens
cttggccgccatccgggacgc

SEQ ID NO: 6177529 - DNA, 24 bp, Homo sapiens
cttggccgccatccgggacgcttc

SEQ ID NO: 6177530 - DNA, 20 bp, Homo sapiens
cttggccggctgtgctcaga

SEQ ID NO: 6177531 - DNA, 19 bp, Homo sapiens
cttggcctaaacctcagtt

SEQ ID NO: 6177532 - DNA, 16 bp, Homo sapiens
cttggcctcactacca

SEQ ID NO: 6177533 - DNA, 13 bp, Homo sapiens
cttggcctcagag

SEQ ID NO: 6177534 - DNA, 13 bp, Homo sapiens
cttggcctcagct

SEQ ID NO: 6177535 - DNA, 18 bp, Homo sapiens
cttggcctccatttctgt

SEQ ID NO: 6177536 - DNA, 21 bp, Homo sapiens
cttggcctcccaaagtgttgg

SEQ ID NO: 6177537 - DNA, 17 bp, Homo sapiens
cttggcctcggcgggct

SEQ ID NO: 6177538 - DNA, 13 bp, Homo sapiens
cttggcctctctg

SEQ ID NO: 6177539 - DNA, 23 bp, Homo sapiens
cttggcctctctgtacactgccc

SEQ ID NO: 6177540 - DNA, 12 bp, Homo sapiens
cttggcctcttc

SEQ ID NO: 6177541 - DNA, 14 bp, Homo sapiens
cttggcctgacctg

SEQ ID NO: 6177542 - DNA, 17 bp, Homo sapiens
cttggcctgatcagacc

SEQ ID NO: 6177543 - DNA, 13 bp, Homo sapiens
cttggcctggaga

SEQ ID NO: 6177544 - DNA, 13 bp, Homo sapiens
cttggcctgggcc

SEQ ID NO: 6177545 - DNA, 20 bp, Homo sapiens
cttggcctggtgggaccagg

SEQ ID NO: 6177546 - DNA, 15 bp, Homo sapiens
cttggcctgtccacc

SEQ ID NO: 6177547 - DNA, 11 bp, Homo sapiens
cttggccttct

SEQ ID NO: 6177548 - DNA, 12 bp, Homo sapiens
cttggccttctc

SEQ ID NO: 6177549 - DNA, 21 bp, Homo sapiens
cttggccttctcccctcttct

SEQ ID NO: 6177550 - DNA, 23 bp, Homo sapiens
cttggccttctcccctcttctga

SEQ ID NO: 6177551 - DNA, 16 bp, Homo sapiens
cttggccttggcatgg

SEQ ID NO: 6177552 - DNA, 17 bp, Homo sapiens
cttggccttgggccggt

SEQ ID NO: 6177553 - DNA, 22 bp, Homo sapiens
cttggccttggggccagactgg

SEQ ID NO: 6177554 - DNA, 11 bp, Homo sapiens
cttggccttgt

SEQ ID NO: 6177555 - DNA, 14 bp, Homo sapiens
cttggcctttcctg

SEQ ID NO: 6177556 - DNA, 17 bp, Homo sapiens
cttggcctttcctggaa

SEQ ID NO: 6177557 - DNA, 19 bp, Homo sapiens
cttggcctttcctggaagc

SEQ ID NO: 6177558 - DNA, 20 bp, Homo sapiens
cttggcctttcctggaagcc

SEQ ID NO: 6177559 - DNA, 13 bp, Homo sapiens
cttggcgagggca

SEQ ID NO: 6177560 - DNA, 15 bp, Homo sapiens
cttggcgagggcagc

SEQ ID NO: 6177561 - DNA, 17 bp, Homo sapiens
cttggcgatgccagcca

SEQ ID NO: 6177562 - DNA, 23 bp, Homo sapiens
cttggcgctctcagctttccctg

SEQ ID NO: 6177563 - DNA, 14 bp, Homo sapiens
cttggcgctgcccc

SEQ ID NO: 6177564 - DNA, 22 bp, Homo sapiens
cttggcgctgcccctggcagcc

SEQ ID NO: 6177565 - DNA, 19 bp, Homo sapiens
cttggcggcaaaagcccat

SEQ ID NO: 6177566 - DNA, 15 bp, Homo sapiens
cttggcggcagcagc

SEQ ID NO: 6177567 - DNA, 15 bp, Homo sapiens
cttggcggctctagc

SEQ ID NO: 6177568 - DNA, 18 bp, Homo sapiens
cttggcgtggagcaggcg

SEQ ID NO: 6177569 - DNA, 21 bp, Homo sapiens
cttggcgtggagccagggagc

SEQ ID NO: 6177570 - DNA, 21 bp, Homo sapiens
cttggcgtgtgtccctgtggt

SEQ ID NO: 6177571 - DNA, 15 bp, Homo sapiens
cttggctagtcacat

SEQ ID NO: 6177572 - DNA, 22 bp, Homo sapiens
cttggctattgaagatgctgcc

SEQ ID NO: 6177573 - DNA, 23 bp, Homo sapiens
cttggctattgaagatgctgcct

SEQ ID NO: 6177574 - DNA, 18 bp, Homo sapiens
cttggctatttctgtgtc

SEQ ID NO: 6177575 - DNA, 19 bp, Homo sapiens
cttggctcacaaggcccag

SEQ ID NO: 6177576 - DNA, 19 bp, Homo sapiens
cttggctcagacacctaga

SEQ ID NO: 6177577 - DNA, 20 bp, Homo sapiens
cttggctcagacacctagac

SEQ ID NO: 6177578 - DNA, 22 bp, Homo sapiens
cttggctcgaatctctgtgcct

SEQ ID NO: 6177579 - DNA, 18 bp, Homo sapiens
cttggctcgcacccccac

SEQ ID NO: 6177580 - DNA, 16 bp, Homo sapiens
cttggctcttggcttc

SEQ ID NO: 6177581 - DNA, 20 bp, Homo sapiens
cttggctcttggcttccaga

SEQ ID NO: 6177582 - DNA, 19 bp, Homo sapiens
cttggctcttggtacctgt

SEQ ID NO: 6177583 - DNA, 16 bp, Homo sapiens
cttggctgacccctct

SEQ ID NO: 6177584 - DNA, 17 bp, Homo sapiens
cttggctgactggggct

SEQ ID NO: 6177585 - DNA, 13 bp, Homo sapiens
cttggctgagccc

SEQ ID NO: 6177586 - DNA, 14 bp, Homo sapiens
cttggctgcaggga

SEQ ID NO: 6177587 - DNA, 17 bp, Homo sapiens
cttggctgcagggagtc

SEQ ID NO: 6177588 - DNA, 12 bp, Homo sapiens
cttggctgcccc

SEQ ID NO: 6177589 - DNA, 13 bp, Homo sapiens
cttggctgcccca

SEQ ID NO: 6177590 - DNA, 13 bp, Homo sapiens
cttggctgctcac

SEQ ID NO: 6177591 - DNA, 20 bp, Homo sapiens
cttggctgctcactgtccac

SEQ ID NO: 6177592 - DNA, 19 bp, Homo sapiens
cttggctgctcttccagcg

SEQ ID NO: 6177593 - DNA, 17 bp, Homo sapiens
cttggctgcttcctgtg

SEQ ID NO: 6177594 - DNA, 15 bp, Homo sapiens
cttggctggacccag

SEQ ID NO: 6177595 - DNA, 13 bp, Homo sapiens
cttggctggggag

SEQ ID NO: 6177596 - DNA, 14 bp, Homo sapiens
cttggctggggagg

SEQ ID NO: 6177597 - DNA, 21 bp, Homo sapiens
cttggctggtgtatgcacagg

SEQ ID NO: 6177598 - DNA, 14 bp, Homo sapiens
cttggctggtgtgg

SEQ ID NO: 6177599 - DNA, 21 bp, Homo sapiens
cttggctggtgtggtacagag

SEQ ID NO: 6177600 - DNA, 17 bp, Homo sapiens
cttggctgtaatcagtt

SEQ ID NO: 6177601 - DNA, 22 bp, Homo sapiens
cttggctgtagaaggagacaga

SEQ ID NO: 6177602 - DNA, 21 bp, Homo sapiens
cttggctgtatgtcaaattgt

SEQ ID NO: 6177603 - DNA, 17 bp, Homo sapiens
cttggctgtccttcccc

SEQ ID NO: 6177604 - DNA, 18 bp, Homo sapiens
cttggctgtccttcccct

SEQ ID NO: 6177605 - DNA, 19 bp, Homo sapiens
cttggctgtccttcccctt

SEQ ID NO: 6177606 - DNA, 21 bp, Homo sapiens
cttggctgtctgaccagagaa

SEQ ID NO: 6177607 - DNA, 22 bp, Homo sapiens
cttggctgtctgaccagagaat

SEQ ID NO: 6177608 - DNA, 20 bp, Homo sapiens
ctggatgctgggttctgggg

SEQ ID NO: 6177609 - DNA, 22 bp, Homo sapiens
ctggatgctgggttctggggct

SEQ ID NO: 6177610 - DNA, 23 bp, Homo sapiens
ctggatgctgttgagggccaaga

SEQ ID NO: 6177611 - DNA, 16 bp, Homo sapiens
ctggatggaaacttcc

SEQ ID NO: 6177612 - DNA, 17 bp, Homo sapiens
ctggatggaaagacaaa

SEQ ID NO: 6177613 - DNA, 15 bp, Homo sapiens
ctggatggaacgggc

SEQ ID NO: 6177614 - DNA, 13 bp, Homo sapiens
ctggatggacaga

SEQ ID NO: 6177615 - DNA, 14 bp, Homo sapiens
ctggatggacagac

SEQ ID NO: 6177616 - DNA, 15 bp, Homo sapiens
ctggatggacagaca

SEQ ID NO: 6177617 - DNA, 16 bp, Homo sapiens
ctggatggacagacac

SEQ ID NO: 6177618 - DNA, 18 bp, Homo sapiens
ctggatggacagacacct

SEQ ID NO: 6177619 - DNA, 21 bp, Homo sapiens
ctggatggacagacacctccc

SEQ ID NO: 6177620 - DNA, 21 bp, Homo sapiens
ctggatggaggaaaaccaagc

SEQ ID NO: 6177621 - DNA, 22 bp, Homo sapiens
ctggatggatctgctccatgca

SEQ ID NO: 6177622 - DNA, 15 bp, Homo sapiens
ctggatggcaccaga

SEQ ID NO: 6177623 - DNA, 23 bp, Homo sapiens
ctggatggcaccagaggctgcag

SEQ ID NO: 6177624 - DNA, 20 bp, Homo sapiens
ctggatggcacctcaggctg

SEQ ID NO: 6177625 - DNA, 16 bp, Homo sapiens
ctggatggcccctcct

SEQ ID NO: 6177626 - DNA, 21 bp, Homo sapiens
ctggatggccgggctgctgct

SEQ ID NO: 6177627 - DNA, 13 bp, Homo sapiens
ctggatggcctct

SEQ ID NO: 6177628 - DNA, 15 bp, Homo sapiens
ctggatggcctctgg

SEQ ID NO: 6177629 - DNA, 20 bp, Homo sapiens
ctggatggcctctggggcag

SEQ ID NO: 6177630 - DNA, 21 bp, Homo sapiens
ctggatgggaggagagccact

SEQ ID NO: 6177631 - DNA, 22 bp, Homo sapiens
ctggatgggaggagagccactg

SEQ ID NO: 6177632 - DNA, 17 bp, Homo sapiens
ctggatgggcattgggc

SEQ ID NO: 6177633 - DNA, 22 bp, Homo sapiens
ctggatgggcctttgagcctga

SEQ ID NO: 6177634 - DNA, 18 bp, Homo sapiens
ctggatgggctgcagcag

SEQ ID NO: 6177635 - DNA, 17 bp, Homo sapiens
ctggatggggagtctca

SEQ ID NO: 6177636 - DNA, 21 bp, Homo sapiens
ctggatggggcagagcttctc

SEQ ID NO: 6177637 - DNA, 23 bp, Homo sapiens
ctggatggggcagagcttctcct

SEQ ID NO: 6177638 - DNA, 24 bp, Homo sapiens
ctggatggggcaggccacctggct

SEQ ID NO: 6177639 - DNA, 12 bp, Homo sapiens
ctggatgggggc

SEQ ID NO: 6177640 - DNA, 15 bp, Homo sapiens
ctggatgggggctct

SEQ ID NO: 6177641 - DNA, 16 bp, Homo sapiens
ctggatgggggctctg

SEQ ID NO: 6177642 - DNA, 23 bp, Homo sapiens
ctggatggtattaatcttgtgta

SEQ ID NO: 6177643 - DNA, 22 bp, Homo sapiens
ctggatggtcctcttaccaaca

SEQ ID NO: 6177644 - DNA, 16 bp, Homo sapiens
ctggatggtggtgcat

SEQ ID NO: 6177645 - DNA, 19 bp, Homo sapiens
ctggatgtcatattggcag

SEQ ID NO: 6177646 - DNA, 13 bp, Homo sapiens
ctggatgtctggc

SEQ ID NO: 6177647 - DNA, 23 bp, Homo sapiens
ctggatgtgaagctcacactgat

SEQ ID NO: 6177648 - DNA, 16 bp, Homo sapiens
ctggatgtgcatctgg

SEQ ID NO: 6177649 - DNA, 18 bp, Homo sapiens
ctggatgtgcatctggcc

SEQ ID NO: 6177650 - DNA, 21 bp, Homo sapiens
ctggatgtgcatctggcctat

SEQ ID NO: 6177651 - DNA, 22 bp, Homo sapiens
ctggatgtgcatctggcctatg

SEQ ID NO: 6177652 - DNA, 14 bp, Homo sapiens
ctggatgtgcccac

SEQ ID NO: 6177653 - DNA, 19 bp, Homo sapiens
ctggatgtgcccacaggga

SEQ ID NO: 6177654 - DNA, 15 bp, Homo sapiens
ctggatgtgctttca

SEQ ID NO: 6177655 - DNA, 15 bp, Homo sapiens
ctggatgtttggaaa

SEQ ID NO: 6177656 - DNA, 13 bp, Homo sapiens
ctggattaaactt

SEQ ID NO: 6177657 - DNA, 23 bp, Homo sapiens
ctggattaaacttaatctaaatg

SEQ ID NO: 6177658 - DNA, 21 bp, Homo sapiens
ctggattataagttctatttt

SEQ ID NO: 6177659 - DNA, 17 bp, Homo sapiens
ctggattcaaatttatt

SEQ ID NO: 6177660 - DNA, 21 bp, Homo sapiens
ctggattcaattcctgtcctt

SEQ ID NO: 6177661 - DNA, 17 bp, Homo sapiens
ctggattcacgccctct

SEQ ID NO: 6177662 - DNA, 23 bp, Homo sapiens
ctggattcacgccctcttgtttc

SEQ ID NO: 6177663 - DNA, 17 bp, Homo sapiens
ctggattcagccttctt

SEQ ID NO: 6177664 - DNA, 16 bp, Homo sapiens
ctggattcattgtctc

SEQ ID NO: 6177665 - DNA, 18 bp, Homo sapiens
ctggattcatttcctgcc

SEQ ID NO: 6177666 - DNA, 22 bp, Homo sapiens
ctggattccagcagtgaatgct

SEQ ID NO: 6177667 - DNA, 14 bp, Homo sapiens
ctggattcccagga

SEQ ID NO: 6177668 - DNA, 20 bp, Homo sapiens
ctggattcccgtggctttgt

SEQ ID NO: 6177669 - DNA, 23 bp, Homo sapiens
ctggattctacaaaaaaccagga

SEQ ID NO: 6177670 - DNA, 19 bp, Homo sapiens
ctggattgcagactgttct

SEQ ID NO: 6177671 - DNA, 19 bp, Homo sapiens
ctggattgcgcctaatgtg

SEQ ID NO: 6177672 - DNA, 20 bp, Homo sapiens
ctggattgcgcctaatgtgt

SEQ ID NO: 6177673 - DNA, 14 bp, Homo sapiens
ctggattggcaggt

SEQ ID NO: 6177674 - DNA, 22 bp, Homo sapiens
ctggattgggacgcacagtgca

SEQ ID NO: 6177675 - DNA, 20 bp, Homo sapiens
ctggattgtactttgtgctg

SEQ ID NO: 6177676 - DNA, 18 bp, Homo sapiens
ctggattgtagaacttgt

SEQ ID NO: 6177677 - DNA, 21 bp, Homo sapiens
ctggattgtagaacttgttgc

SEQ ID NO: 6177678 - DNA, 20 bp, Homo sapiens
ctggattgtccttggaggaa

SEQ ID NO: 6177679 - DNA, 19 bp, Homo sapiens
ctggattgttgacatgagt

SEQ ID NO: 6177680 - DNA, 21 bp, Homo sapiens
ctggatttatagtatgtgact

SEQ ID NO: 6177681 - DNA, 15 bp, Homo sapiens
ctggatttgcagaag

SEQ ID NO: 6177682 - DNA, 18 bp, Homo sapiens
ctggatttgggagctctg

SEQ ID NO: 6177683 - DNA, 12 bp, Homo sapiens
ctggattttgaa

SEQ ID NO: 6177684 - DNA, 23 bp, Homo sapiens
ctggatttttacaaataaagatg

SEQ ID NO: 6177685 - DNA, 20 bp, Homo sapiens
ctggattttttatgtacaac

SEQ ID NO: 6177686 - DNA, 21 bp, Homo sapiens
ctggattttttatgtacaacc

SEQ ID NO: 6177687 - DNA, 23 bp, Homo sapiens
ctggattttttatgtacaaccct

SEQ ID NO: 6177688 - DNA, 21 bp, Homo sapiens
ctggcaaaaggatctttgtgg

SEQ ID NO: 6177689 - DNA, 23 bp, Homo sapiens
ctggcaaaaggatctttgtggcc

SEQ ID NO: 6177690 - DNA, 19 bp, Homo sapiens
ctggcaaacaccattattc

SEQ ID NO: 6177691 - DNA, 17 bp, Homo sapiens
ctggcaaacagggcctc

SEQ ID NO: 6177692 - DNA, 20 bp, Homo sapiens
ctggcaaacagggcctctgc

SEQ ID NO: 6177693 - DNA, 21 bp, Homo sapiens
ctggcaaacagggcctctgcg

SEQ ID NO: 6177694 - DNA, 17 bp, Homo sapiens
ctggcaaaccctcccag

SEQ ID NO: 6177695 - DNA, 20 bp, Homo sapiens
ctggcaaaccctcccagaaa

SEQ ID NO: 6177696 - DNA, 20 bp, Homo sapiens
ctggcaaacttttctttctt

SEQ ID NO: 6177697 - DNA, 18 bp, Homo sapiens
ctggcaaagacagaagcc

SEQ ID NO: 6177698 - DNA, 22 bp, Homo sapiens
ctggcaaaggtggctctccagt

SEQ ID NO: 6177699 - DNA, 14 bp, Homo sapiens
ctggcaaatccagg

SEQ ID NO: 6177700 - DNA, 20 bp, Homo sapiens
ctggcaaatgcacacacctc

SEQ ID NO: 6177701 - DNA, 17 bp, Homo sapiens
ctggcaacaacagcttc

SEQ ID NO: 6177702 - DNA, 17 bp, Homo sapiens
ctggcaacatctttatc

SEQ ID NO: 6177703 - DNA, 23 bp, Homo sapiens
ctggcaagaaaagagttaaggca

SEQ ID NO: 6177704 - DNA, 14 bp, Homo sapiens
ctggcaagaaccag

SEQ ID NO: 6177705 - DNA, 21 bp, Homo sapiens
ctggcaagaaccagttgtttt

SEQ ID NO: 6177706 - DNA, 14 bp, Homo sapiens
ctggcaagaatgtg

SEQ ID NO: 6177707 - DNA, 23 bp, Homo sapiens
ctggcaagagcagatactgtctt

SEQ ID NO: 6177708 - DNA, 21 bp, Homo sapiens
ctggcaagagctctttgtctc

SEQ ID NO: 6177709 - DNA, 17 bp, Homo sapiens
ctggcaagaggcctcat

SEQ ID NO: 6177710 - DNA, 21 bp, Homo sapiens
ctggcaagaggcctcatgcct

SEQ ID NO: 6177711 - DNA, 16 bp, Homo sapiens
ctggcaagcagggaaa

SEQ ID NO: 6177712 - DNA, 17 bp, Homo sapiens
ctggcaaggacacagat

SEQ ID NO: 6177713 - DNA, 19 bp, Homo sapiens
ctggcaaggactttgtaca

SEQ ID NO: 6177714 - DNA, 17 bp, Homo sapiens
ctggcaaggcattcctc

SEQ ID NO: 6177715 - DNA, 18 bp, Homo sapiens
ctggcaaggcattcctca

SEQ ID NO: 6177716 - DNA, 15 bp, Homo sapiens
ctggcaatagtgtgt

SEQ ID NO: 6177717 - DNA, 15 bp, Homo sapiens
ctggcaatcccacca

SEQ ID NO: 6177718 - DNA, 22 bp, Homo sapiens
ctggcaatgaaaaattctcagt

SEQ ID NO: 6177719 - DNA, 15 bp, Homo sapiens
ctggcaatgccacag

SEQ ID NO: 6177720 - DNA, 21 bp, Homo sapiens
ctggcaatgccacagccctgt

SEQ ID NO: 6177721 - DNA, 16 bp, Homo sapiens
ctggcaatggtagttt

SEQ ID NO: 6177722 - DNA, 22 bp, Homo sapiens
ctggcaatttagcaaactgatg

SEQ ID NO: 6177723 - DNA, 12 bp, Homo sapiens
ctggcacaaaag

SEQ ID NO: 6177724 - DNA, 14 bp, Homo sapiens
ctggcacaaaagac

SEQ ID NO: 6177725 - DNA, 17 bp, Homo sapiens
ctggcacaaaagacagc

SEQ ID NO: 6177726 - DNA, 19 bp, Homo sapiens
ctggcacaaaagacagctg

SEQ ID NO: 6177727 - DNA, 18 bp, Homo sapiens
ctggcacaatgttggagc

SEQ ID NO: 6177728 - DNA, 19 bp, Homo sapiens
ctggcacaatgttggagca

SEQ ID NO: 6177729 - DNA, 21 bp, Homo sapiens
ctggcacaatgttggagcagc

SEQ ID NO: 6177730 - DNA, 22 bp, Homo sapiens
ctggcacaatgttggagcagca

SEQ ID NO: 6177731 - DNA, 21 bp, Homo sapiens
ctggcacacagtaggtgctca

SEQ ID NO: 6177732 - DNA, 15 bp, Homo sapiens
ctggcacagaagagg

SEQ ID NO: 6177733 - DNA, 17 bp, Homo sapiens
ctggcacagaagaggag

SEQ ID NO: 6177734 - DNA, 19 bp, Homo sapiens
ctggcacagaagaggagtc

SEQ ID NO: 6177735 - DNA, 16 bp, Homo sapiens
ctggcacagaccaggc

SEQ ID NO: 6177736 - DNA, 22 bp, Homo sapiens
ctggcacagacttcacacagca

SEQ ID NO: 6177737 - DNA, 12 bp, Homo sapiens
ctggcacagagg

SEQ ID NO: 6177738 - DNA, 14 bp, Homo sapiens
ctggcacagcccct

SEQ ID NO: 6177739 - DNA, 15 bp, Homo sapiens
ctggcacagcccctg

SEQ ID NO: 6177740 - DNA, 18 bp, Homo sapiens
ctggcacagcccctggag

SEQ ID NO: 6177741 - DNA, 19 bp, Homo sapiens
ctggcacagcccctggagc

SEQ ID NO: 6177742 - DNA, 23 bp, Homo sapiens
ctggcacagccgcgggccaggag

SEQ ID NO: 6177743 - DNA, 15 bp, Homo sapiens
ctggcacagcctgca

SEQ ID NO: 6177744 - DNA, 21 bp, Homo sapiens
ctggcacagcctggctgtggc

SEQ ID NO: 6177745 - DNA, 16 bp, Homo sapiens
ctggcacagggcagtg

SEQ ID NO: 6177746 - DNA, 12 bp, Homo sapiens
ctggcacagtct

SEQ ID NO: 6177747 - DNA, 16 bp, Homo sapiens
ctggcacagtgatgcc

SEQ ID NO: 6177748 - DNA, 21 bp, Homo sapiens
ctggcacagtgatgccgggcg

SEQ ID NO: 6177749 - DNA, 12 bp, Homo sapiens
ctggcacagtgt

SEQ ID NO: 6177750 - DNA, 21 bp, Homo sapiens
ctggcacagttttctgagaaa

SEQ ID NO: 6177751 - DNA, 19 bp, Homo sapiens
ctggcacatttcagggaga

SEQ ID NO: 6177752 - DNA, 17 bp, Homo sapiens
ctggcacatttccccag

SEQ ID NO: 6177753 - DNA, 23 bp, Homo sapiens
ctggcacatttccccagacctga

SEQ ID NO: 6177754 - DNA, 12 bp, Homo sapiens
ctggcaccaaca

SEQ ID NO: 6177755 - DNA, 14 bp, Homo sapiens
ctggcaccacacta

SEQ ID NO: 6177756 - DNA, 12 bp, Homo sapiens
ctggcaccagca

SEQ ID NO: 6177757 - DNA, 14 bp, Homo sapiens
ctggcaccagcagg

SEQ ID NO: 6177758 - DNA, 15 bp, Homo sapiens
ctggcaccagcaggc

SEQ ID NO: 6177759 - DNA, 16 bp, Homo sapiens
ctggcaccagcaggca

SEQ ID NO: 6177760 - DNA, 22 bp, Homo sapiens
ctggcaccatggtgactgccac

SEQ ID NO: 6177761 - DNA, 23 bp, Homo sapiens
ctggcaccatggtgactgccaca

SEQ ID NO: 6177762 - DNA, 14 bp, Homo sapiens
ctggcacccactcc

SEQ ID NO: 6177763 - DNA, 17 bp, Homo sapiens
ctggcacccccacaagc

SEQ ID NO: 6177764 - DNA, 16 bp, Homo sapiens
ctggcacccggcccct

SEQ ID NO: 6177765 - DNA, 20 bp, Homo sapiens
ctggcaccctgtcatcacca

SEQ ID NO: 6177766 - DNA, 17 bp, Homo sapiens
ctggcaccgttatccct

SEQ ID NO: 6177767 - DNA, 15 bp, Homo sapiens
ctggcacctgagtgt

SEQ ID NO: 6177768 - DNA, 21 bp, Homo sapiens
ctggcacctgtgttccagccc

SEQ ID NO: 6177769 - DNA, 15 bp, Homo sapiens
ctggcacgaaggccc

SEQ ID NO: 6177770 - DNA, 15 bp, Homo sapiens
ctggcacgccctact

SEQ ID NO: 6177771 - DNA, 16 bp, Homo sapiens
ctggcacgccctactc

SEQ ID NO: 6177772 - DNA, 22 bp, Homo sapiens
ctggcacgggtgtcgaggcagg

SEQ ID NO: 6177773 - DNA, 21 bp, Homo sapiens
ctggcacggtggctcaggcct

SEQ ID NO: 6177774 - DNA, 16 bp, Homo sapiens
ctggcacgtgacaggc

SEQ ID NO: 6177775 - DNA, 18 bp, Homo sapiens
ctggcacgtgacaggctc

SEQ ID NO: 6177776 - DNA, 18 bp, Homo sapiens
ctggcacgtggccaggag

SEQ ID NO: 6177777 - DNA, 19 bp, Homo sapiens
ctggcacgtggccaggagc

SEQ ID NO: 6177778 - DNA, 22 bp, Homo sapiens
ctggcacgtggccaggagccat

SEQ ID NO: 6177779 - DNA, 15 bp, Homo sapiens
ctggcactcccctga

SEQ ID NO: 6177780 - DNA, 19 bp, Homo sapiens
ctggcactcttgttcccac

SEQ ID NO: 6177781 - DNA, 19 bp, Homo sapiens
ctggcactgaattaatcat

SEQ ID NO: 6177782 - DNA, 17 bp, Homo sapiens
ctggcactgacagcctg

SEQ ID NO: 6177783 - DNA, 21 bp, Homo sapiens
cttggctgtgaggcccctgga

SEQ ID NO: 6177784 - DNA, 16 bp, Homo sapiens
cttggctgtggggcta

SEQ ID NO: 6177785 - DNA, 22 bp, Homo sapiens
cttggcttacctgacctcttgc

SEQ ID NO: 6177786 - DNA, 20 bp, Homo sapiens
cttggcttcaggggagtccc

SEQ ID NO: 6177787 - DNA, 18 bp, Homo sapiens
cttggcttccactcagca

SEQ ID NO: 6177788 - DNA, 13 bp, Homo sapiens
cttggcttccaga

SEQ ID NO: 6177789 - DNA, 15 bp, Homo sapiens
cttggcttctcagcc

SEQ ID NO: 6177790 - DNA, 16 bp, Homo sapiens
cttggcttctcagccc

SEQ ID NO: 6177791 - DNA, 15 bp, Homo sapiens
cttggcttctgggac

SEQ ID NO: 6177792 - DNA, 17 bp, Homo sapiens
cttggcttcttaaaaac

SEQ ID NO: 6177793 - DNA, 14 bp, Homo sapiens
cttggcttcttctt

SEQ ID NO: 6177794 - DNA, 21 bp, Homo sapiens
cttggcttgatggaagtgggc

SEQ ID NO: 6177795 - DNA, 17 bp, Homo sapiens
cttggcttgccattttt

SEQ ID NO: 6177796 - DNA, 22 bp, Homo sapiens
cttggctttaaccgtttttcaa

SEQ ID NO: 6177797 - DNA, 15 bp, Homo sapiens
cttggctttcatgtt

SEQ ID NO: 6177798 - DNA, 17 bp, Homo sapiens
cttggctttgaggccga

SEQ ID NO: 6177799 - DNA, 22 bp, Homo sapiens
cttggctttgtcacttttcctt

SEQ ID NO: 6177800 - DNA, 12 bp, Homo sapiens
cttggctttgtt

SEQ ID NO: 6177801 - DNA, 22 bp, Homo sapiens
cttggctttgttgatgctccgc

SEQ ID NO: 6177802 - DNA, 13 bp, Homo sapiens
cttggctttgttt

SEQ ID NO: 6177803 - DNA, 17 bp, Homo sapiens
cttggcttttgcttggc

SEQ ID NO: 6177804 - DNA, 12 bp, Homo sapiens
cttggctttttc

SEQ ID NO: 6177805 - DNA, 21 bp, Homo sapiens
cttgggaaaaaaacttggcac

SEQ ID NO: 6177806 - DNA, 13 bp, Homo sapiens
cttgggaaaatat

SEQ ID NO: 6177807 - DNA, 19 bp, Homo sapiens
cttgggaaaatatcacttt

SEQ ID NO: 6177808 - DNA, 20 bp, Homo sapiens
cttgggaaaatatcactttg

SEQ ID NO: 6177809 - DNA, 15 bp, Homo sapiens
cttgggaaagagaca

SEQ ID NO: 6177810 - DNA, 19 bp, Homo sapiens
cttgggaaggaaggcagtg

SEQ ID NO: 6177811 - DNA, 19 bp, Homo sapiens
cttgggaaggacacagcag

SEQ ID NO: 6177812 - DNA, 23 bp, Homo sapiens
cttgggaaggacacagcagtatt

SEQ ID NO: 6177813 - DNA, 19 bp, Homo sapiens
cttgggaatcattctggct

SEQ ID NO: 6177814 - DNA, 13 bp, Homo sapiens
cttgggaatttta

SEQ ID NO: 6177815 - DNA, 11 bp, Homo sapiens
cttgggacagc

SEQ ID NO: 6177816 - DNA, 18 bp, Homo sapiens
cttgggacagccagagct

SEQ ID NO: 6177817 - DNA, 14 bp, Homo sapiens
cttgggaccccaga

SEQ ID NO: 6177818 - DNA, 23 bp, Homo sapiens
cttgggaccgccagatggggcct

SEQ ID NO: 6177819 - DNA, 22 bp, Homo sapiens
cttgggacctttaaagagcccc

SEQ ID NO: 6177820 - DNA, 21 bp, Homo sapiens
cttgggacgtgtacagcacag

SEQ ID NO: 6177821 - DNA, 15 bp, Homo sapiens
cttgggactgggttt

SEQ ID NO: 6177822 - DNA, 17 bp, Homo sapiens
cttgggactgggtttgg

SEQ ID NO: 6177823 - DNA, 16 bp, Homo sapiens
cttgggagagcccctg

SEQ ID NO: 6177824 - DNA, 17 bp, Homo sapiens
cttgggagagcccctgg

SEQ ID NO: 6177825 - DNA, 22 bp, Homo sapiens
cttgggagagcccctggggcct

SEQ ID NO: 6177826 - DNA, 21 bp, Homo sapiens
cttgggagagggagcaagcct

SEQ ID NO: 6177827 - DNA, 19 bp, Homo sapiens
cttgggagagtcaggcagg

SEQ ID NO: 6177828 - DNA, 14 bp, Homo sapiens
cttgggagccactg

SEQ ID NO: 6177829 - DNA, 17 bp, Homo sapiens
cttgggagccactgcca

SEQ ID NO: 6177830 - DNA, 13 bp, Homo sapiens
cttgggagcctga

SEQ ID NO: 6177831 - DNA, 15 bp, Homo sapiens
cttgggagcctgagg

SEQ ID NO: 6177832 - DNA, 16 bp, Homo sapiens
cttgggagctcatccc

SEQ ID NO: 6177833 - DNA, 20 bp, Homo sapiens
cttgggagctcatccctctc

SEQ ID NO: 6177834 - DNA, 16 bp, Homo sapiens
cttgggaggaaacctg

SEQ ID NO: 6177835 - DNA, 21 bp, Homo sapiens
cttgggaggaaacctgagatc

SEQ ID NO: 6177836 - DNA, 18 bp, Homo sapiens
cttgggaggaagcagaat

SEQ ID NO: 6177837 - DNA, 21 bp, Homo sapiens
cttgggaggaagcagaataaa

SEQ ID NO: 6177838 - DNA, 22 bp, Homo sapiens
cttgggaggaagcagaataaag

SEQ ID NO: 6177839 - DNA, 21 bp, Homo sapiens
cttgggaggccccactgggga

SEQ ID NO: 6177840 - DNA, 20 bp, Homo sapiens
cttgggaggctgaggcagga

SEQ ID NO: 6177841 - DNA, 19 bp, Homo sapiens
cttgggagggtcaggctgt

SEQ ID NO: 6177842 - DNA, 19 bp, Homo sapiens
cttgggagtatgttgtcat

SEQ ID NO: 6177843 - DNA, 20 bp, Homo sapiens
cttgggagtgtggtttcttt

SEQ ID NO: 6177844 - DNA, 18 bp, Homo sapiens
cttgggatagcaaactcc

SEQ ID NO: 6177845 - DNA, 17 bp, Homo sapiens
cttgggatagtgttctg

SEQ ID NO: 6177846 - DNA, 20 bp, Homo sapiens
cttgggatagtgttctgctc

SEQ ID NO: 6177847 - DNA, 21 bp, Homo sapiens
cttgggattcctcccctggaa

SEQ ID NO: 6177848 - DNA, 14 bp, Homo sapiens
cttgggcaaggaca

SEQ ID NO: 6177849 - DNA, 22 bp, Homo sapiens
cttgggcaatattctctgtaca

SEQ ID NO: 6177850 - DNA, 17 bp, Homo sapiens
cttgggcaccagcttct

SEQ ID NO: 6177851 - DNA, 17 bp, Homo sapiens
cttgggcacccccagcc

SEQ ID NO: 6177852 - DNA, 21 bp, Homo sapiens
cttgggcacgggagagcgcca

SEQ ID NO: 6177853 - DNA, 11 bp, Homo sapiens
cttgggcagaa

SEQ ID NO: 6177854 - DNA, 13 bp, Homo sapiens
cttgggcagagct

SEQ ID NO: 6177855 - DNA, 23 bp, Homo sapiens
cttgggcagagctggctctgagc

SEQ ID NO: 6177856 - DNA, 21 bp, Homo sapiens
cttgggcagagtcctgccttc

SEQ ID NO: 6177857 - DNA, 11 bp, Homo sapiens
cttgggcaggg

SEQ ID NO: 6177858 - DNA, 18 bp, Homo sapiens
cttgggcagggtctctgc

SEQ ID NO: 6177859 - DNA, 19 bp, Homo sapiens
cttgggcatccacccagtg

SEQ ID NO: 6177860 - DNA, 14 bp, Homo sapiens
cttgggcatgctca

SEQ ID NO: 6177861 - DNA, 20 bp, Homo sapiens
cttgggccaagccagctgcc

SEQ ID NO: 6177862 - DNA, 16 bp, Homo sapiens
cttgggccactgccct

SEQ ID NO: 6177863 - DNA, 23 bp, Homo sapiens
cttgggccagaagtaccagacta

SEQ ID NO: 6177864 - DNA, 17 bp, Homo sapiens
cttgggccatagctcct

SEQ ID NO: 6177865 - DNA, 18 bp, Homo sapiens
cttgggcccacacctcct

SEQ ID NO: 6177866 - DNA, 16 bp, Homo sapiens
cttgggcccagctggg

SEQ ID NO: 6177867 - DNA, 18 bp, Homo sapiens
cttgggcccagctgggct

SEQ ID NO: 6177868 - DNA, 20 bp, Homo sapiens
cttgggcccagctgggctct

SEQ ID NO: 6177869 - DNA, 21 bp, Homo sapiens
cttgggcccagctgggctctg

SEQ ID NO: 6177870 - DNA, 21 bp, Homo sapiens
cttgggcccggtccacaggtc

SEQ ID NO: 6177871 - DNA, 13 bp, Homo sapiens
cttgggccctcct

SEQ ID NO: 6177872 - DNA, 14 bp, Homo sapiens
cttgggccctctgg

SEQ ID NO: 6177873 - DNA, 14 bp, Homo sapiens
cttgggccctgcac

SEQ ID NO: 6177874 - DNA, 19 bp, Homo sapiens
cttgggccctgcacagata

SEQ ID NO: 6177875 - DNA, 20 bp, Homo sapiens
cttgggccctgcattggcct

SEQ ID NO: 6177876 - DNA, 19 bp, Homo sapiens
cttgggccctttgagtgca

SEQ ID NO: 6177877 - DNA, 18 bp, Homo sapiens
cttgggccgagcctgcct

SEQ ID NO: 6177878 - DNA, 15 bp, Homo sapiens
cttgggccggtgctg

SEQ ID NO: 6177879 - DNA, 21 bp, Homo sapiens
cttgggccgtccccatttgca

SEQ ID NO: 6177880 - DNA, 17 bp, Homo sapiens
cttgggcctcaggctct

SEQ ID NO: 6177881 - DNA, 18 bp, Homo sapiens
cttgggcctcaggctctg

SEQ ID NO: 6177882 - DNA, 19 bp, Homo sapiens
cttgggcctcaggctctgc

SEQ ID NO: 6177883 - DNA, 22 bp, Homo sapiens
cttgggcctcatctgctcctag

SEQ ID NO: 6177884 - DNA, 13 bp, Homo sapiens
cttgggcctccca

SEQ ID NO: 6177885 - DNA, 17 bp, Homo sapiens
cttgggcctcccactcc

SEQ ID NO: 6177886 - DNA, 21 bp, Homo sapiens
cttgggcctccccccagcccc

SEQ ID NO: 6177887 - DNA, 18 bp, Homo sapiens
cttgggcctgacctccag

SEQ ID NO: 6177888 - DNA, 23 bp, Homo sapiens
cttgggcctgacctccagtcctg

SEQ ID NO: 6177889 - DNA, 16 bp, Homo sapiens
cttgggcctggccagt

SEQ ID NO: 6177890 - DNA, 21 bp, Homo sapiens
cttgggcctggccagtcttcc

SEQ ID NO: 6177891 - DNA, 13 bp, Homo sapiens
cttgggcctggga

SEQ ID NO: 6177892 - DNA, 12 bp, Homo sapiens
cttgggcctttc

SEQ ID NO: 6177893 - DNA, 16 bp, Homo sapiens
cttgggcctttcagtc

SEQ ID NO: 6177894 - DNA, 20 bp, Homo sapiens
cttgggcgccgtgctgggca

SEQ ID NO: 6177895 - DNA, 23 bp, Homo sapiens
cttgggcgccgtgctgggcagcc

SEQ ID NO: 6177896 - DNA, 12 bp, Homo sapiens
cttgggcggctg

SEQ ID NO: 6177897 - DNA, 18 bp, Homo sapiens
cttgggcggctgagagcc

SEQ ID NO: 6177898 - DNA, 19 bp, Homo sapiens
cttgggcgtctcccccaga

SEQ ID NO: 6177899 - DNA, 24 bp, Homo sapiens
cttgggcgtctcccccagagtgct

SEQ ID NO: 6177900 - DNA, 17 bp, Homo sapiens
cttgggctactggcagc

SEQ ID NO: 6177901 - DNA, 21 bp, Homo sapiens
cttgggctactggcagctcct

SEQ ID NO: 6177902 - DNA, 22 bp, Homo sapiens
cttgggctccattcccatcact

SEQ ID NO: 6177903 - DNA, 17 bp, Homo sapiens
cttgggctccgctgtgc

SEQ ID NO: 6177904 - DNA, 17 bp, Homo sapiens
cttgggctcctggctgc

SEQ ID NO: 6177905 - DNA, 22 bp, Homo sapiens
cttgggctcctggctgccaggc

SEQ ID NO: 6177906 - DNA, 22 bp, Homo sapiens
cttgggctctctctagctcccc

SEQ ID NO: 6177907 - DNA, 23 bp, Homo sapiens
cttgggctctctctagctcccca

SEQ ID NO: 6177908 - DNA, 17 bp, Homo sapiens
cttgggctctgatgaaa

SEQ ID NO: 6177909 - DNA, 15 bp, Homo sapiens
cttgggctgagtgca

SEQ ID NO: 6177910 - DNA, 18 bp, Homo sapiens
cttgggctgagtgcagcc

SEQ ID NO: 6177911 - DNA, 16 bp, Homo sapiens
cttgggctggcaccca

SEQ ID NO: 6177912 - DNA, 13 bp, Homo sapiens
cttgggctggcgg

SEQ ID NO: 6177913 - DNA, 12 bp, Homo sapiens
cttgggctggga

SEQ ID NO: 6177914 - DNA, 20 bp, Homo sapiens
cttgggcttcaacagccaag

SEQ ID NO: 6177915 - DNA, 14 bp, Homo sapiens
cttgggcttcttcc

SEQ ID NO: 6177916 - DNA, 15 bp, Homo sapiens
cttgggcttcttcct

SEQ ID NO: 6177917 - DNA, 17 bp, Homo sapiens
cttggggaacccatgag

SEQ ID NO: 6177918 - DNA, 15 bp, Homo sapiens
cttggggaaggggcc

SEQ ID NO: 6177919 - DNA, 23 bp, Homo sapiens
cttggggaaggggcctgggctgt

SEQ ID NO: 6177920 - DNA, 19 bp, Homo sapiens
cttggggaatgttgttttc

SEQ ID NO: 6177921 - DNA, 17 bp, Homo sapiens
cttggggaatttcctct

SEQ ID NO: 6177922 - DNA, 19 bp, Homo sapiens
cttggggacataatttcag

SEQ ID NO: 6177923 - DNA, 15 bp, Homo sapiens
cttggggacatctct

SEQ ID NO: 6177924 - DNA, 18 bp, Homo sapiens
cttggggaccagagctgc

SEQ ID NO: 6177925 - DNA, 19 bp, Homo sapiens
cttggggaccagagctgcc

SEQ ID NO: 6177926 - DNA, 17 bp, Homo sapiens
cttggggaccctgccta

SEQ ID NO: 6177927 - DNA, 14 bp, Homo sapiens
cttggggagaaggc

SEQ ID NO: 6177928 - DNA, 22 bp, Homo sapiens
cttggggagacctctactgcct

SEQ ID NO: 6177929 - DNA, 14 bp, Homo sapiens
cttggggagcagag

SEQ ID NO: 6177930 - DNA, 17 bp, Homo sapiens
cttggggagcaggtctc

SEQ ID NO: 6177931 - DNA, 20 bp, Homo sapiens
cttggggagttaagacctgg

SEQ ID NO: 6177932 - DNA, 22 bp, Homo sapiens
cttggggagttaagacctggca

SEQ ID NO: 6177933 - DNA, 17 bp, Homo sapiens
cttggggattgtacacg

SEQ ID NO: 6177934 - DNA, 13 bp, Homo sapiens
cttggggcacagt

SEQ ID NO: 6177935 - DNA, 22 bp, Homo sapiens
cttggggcagccattggcctct

SEQ ID NO: 6177936 - DNA, 15 bp, Homo sapiens
cttggggcagggcct

SEQ ID NO: 6177937 - DNA, 16 bp, Homo sapiens
cttggggcagggcctg

SEQ ID NO: 6177938 - DNA, 16 bp, Homo sapiens
cttggggccagactgg

SEQ ID NO: 6177939 - DNA, 20 bp, Homo sapiens
cttggggccagactggctgc

SEQ ID NO: 6177940 - DNA, 23 bp, Homo sapiens
cttggggccagactggctgcaca

SEQ ID NO: 6177941 - DNA, 14 bp, Homo sapiens
cttggggccagcgc

SEQ ID NO: 6177942 - DNA, 13 bp, Homo sapiens
cttggggccatcg

SEQ ID NO: 6177943 - DNA, 15 bp, Homo sapiens
cttggggcccagtgc

SEQ ID NO: 6177944 - DNA, 19 bp, Homo sapiens
cttggggcccagtgcatgg

SEQ ID NO: 6177945 - DNA, 15 bp, Homo sapiens
cttggggcctggctt

SEQ ID NO: 6177946 - DNA, 17 bp, Homo sapiens
cttggggcctggcttgc

SEQ ID NO: 6177947 - DNA, 22 bp, Homo sapiens
cttggggccttgatgactgcct

SEQ ID NO: 6177948 - DNA, 14 bp, Homo sapiens
cttggggctcagcc

SEQ ID NO: 6177949 - DNA, 23 bp, Homo sapiens
cttggggctcagccacagcctga

SEQ ID NO: 6177950 - DNA, 19 bp, Homo sapiens
cttggggctcgccccaccc

SEQ ID NO: 6177951 - DNA, 20 bp, Homo sapiens
cttggggctcgccccaccca

SEQ ID NO: 6177952 - DNA, 16 bp, Homo sapiens
cttggggctggggaag

SEQ ID NO: 6177953 - DNA, 21 bp, Homo sapiens
cttggggcttgacttttgtat

SEQ ID NO: 6177954 - DNA, 18 bp, Homo sapiens
cttgggggaggccacccc

SEQ ID NO: 6177955 - DNA, 16 bp, Homo sapiens
cttgggggcagaccag

SEQ ID NO: 6177956 - DNA, 20 bp, Homo sapiens
cttgggggctcagcaaggcc

SEQ ID NO: 6177957 - DNA, 19 bp, Homo sapiens
cttgggggggctgcctttg

SEQ ID NO: 6177958 - DNA, 16 bp, Homo sapiens
cttgggggggtggccg

SEQ ID NO: 6177959 - DNA, 22 bp, Homo sapiens
cttgggggggtggccgctgagt

SEQ ID NO: 6177960 - DNA, 17 bp, Homo sapiens
ctggcactgagcctgct

SEQ ID NO: 6177961 - DNA, 13 bp, Homo sapiens
ctggcactgcttc

SEQ ID NO: 6177962 - DNA, 15 bp, Homo sapiens
ctggcactgcttcca

SEQ ID NO: 6177963 - DNA, 18 bp, Homo sapiens
ctggcactgcttccagtg

SEQ ID NO: 6177964 - DNA, 23 bp, Homo sapiens
ctggcactgcttccagtgaggct

SEQ ID NO: 6177965 - DNA, 17 bp, Homo sapiens
ctggcactggaccccag

SEQ ID NO: 6177966 - DNA, 21 bp, Homo sapiens
ctggcactggatgcagaaaca

SEQ ID NO: 6177967 - DNA, 21 bp, Homo sapiens
ctggcactgtggcactgccac

SEQ ID NO: 6177968 - DNA, 22 bp, Homo sapiens
ctggcactgtggcactgccacc

SEQ ID NO: 6177969 - DNA, 23 bp, Homo sapiens
ctggcacttagcccaagaggtct

SEQ ID NO: 6177970 - DNA, 21 bp, Homo sapiens
ctggcacttagtaggtcctca

SEQ ID NO: 6177971 - DNA, 17 bp, Homo sapiens
ctggcacttgcctgctg

SEQ ID NO: 6177972 - DNA, 18 bp, Homo sapiens
ctggcacttgcctgctgc

SEQ ID NO: 6177973 - DNA, 13 bp, Homo sapiens
ctggcactttaat

SEQ ID NO: 6177974 - DNA, 20 bp, Homo sapiens
ctggcacttttttaaatata

SEQ ID NO: 6177975 - DNA, 18 bp, Homo sapiens
ctggcagaactgagctcc

SEQ ID NO: 6177976 - DNA, 19 bp, Homo sapiens
ctggcagaactgagctcct

SEQ ID NO: 6177977 - DNA, 20 bp, Homo sapiens
ctggcagaactgagctcctc

SEQ ID NO: 6177978 - DNA, 18 bp, Homo sapiens
ctggcagaagcattgcct

SEQ ID NO: 6177979 - DNA, 20 bp, Homo sapiens
ctggcagacacaacccaata

SEQ ID NO: 6177980 - DNA, 20 bp, Homo sapiens
ctggcagactcaaggggctg

SEQ ID NO: 6177981 - DNA, 22 bp, Homo sapiens
ctggcagacttgcccaggtcac

SEQ ID NO: 6177982 - DNA, 14 bp, Homo sapiens
ctggcagagagcac

SEQ ID NO: 6177983 - DNA, 21 bp, Homo sapiens
ctggcagagaggtaaagggtg

SEQ ID NO: 6177984 - DNA, 17 bp, Homo sapiens
ctggcagagatgcctcc

SEQ ID NO: 6177985 - DNA, 18 bp, Homo sapiens
ctggcagagatgcctccc

SEQ ID NO: 6177986 - DNA, 20 bp, Homo sapiens
ctggcagagatgcctccctg

SEQ ID NO: 6177987 - DNA, 11 bp, Homo sapiens
ctggcagagca

SEQ ID NO: 6177988 - DNA, 14 bp, Homo sapiens
ctggcagagcacag

SEQ ID NO: 6177989 - DNA, 18 bp, Homo sapiens
ctggcagagcccccaagg

SEQ ID NO: 6177990 - DNA, 12 bp, Homo sapiens
ctggcagagcct

SEQ ID NO: 6177991 - DNA, 15 bp, Homo sapiens
ctggcagagcctctg

SEQ ID NO: 6177992 - DNA, 21 bp, Homo sapiens
ctggcagatgggggcctctct

SEQ ID NO: 6177993 - DNA, 14 bp, Homo sapiens
ctggcagcacagcc

SEQ ID NO: 6177994 - DNA, 20 bp, Homo sapiens
ctggcagcacagcccagggc

SEQ ID NO: 6177995 - DNA, 15 bp, Homo sapiens
ctggcagcaccgcct

SEQ ID NO: 6177996 - DNA, 19 bp, Homo sapiens
ctggcagcaccgcctcttc

SEQ ID NO: 6177997 - DNA, 13 bp, Homo sapiens
ctggcagcagcag

SEQ ID NO: 6177998 - DNA, 16 bp, Homo sapiens
ctggcagcagcaggtg

SEQ ID NO: 6177999 - DNA, 12 bp, Homo sapiens
ctggcagccagg

SEQ ID NO: 6178000 - DNA, 14 bp, Homo sapiens
ctggcagccaggga

SEQ ID NO: 6178001 - DNA, 11 bp, Homo sapiens
ctggcagccca

SEQ ID NO: 6178002 - DNA, 15 bp, Homo sapiens
ctggcagccccagca

SEQ ID NO: 6178003 - DNA, 23 bp, Homo sapiens
ctggcagcccctgttctggcaga

SEQ ID NO: 6178004 - DNA, 13 bp, Homo sapiens
ctggcagcccgca

SEQ ID NO: 6178005 - DNA, 17 bp, Homo sapiens
ctggcagcctcagaggc

SEQ ID NO: 6178006 - DNA, 12 bp, Homo sapiens
ctggcagcctcc

SEQ ID NO: 6178007 - DNA, 13 bp, Homo sapiens
ctggcagcctcca

SEQ ID NO: 6178008 - DNA, 14 bp, Homo sapiens
ctggcagcctccag

SEQ ID NO: 6178009 - DNA, 22 bp, Homo sapiens
ctggcagcctcccatccagggc

SEQ ID NO: 6178010 - DNA, 23 bp, Homo sapiens
ctggcagcctcccatccagggcc

SEQ ID NO: 6178011 - DNA, 17 bp, Homo sapiens
ctggcagcctgcacctg

SEQ ID NO: 6178012 - DNA, 14 bp, Homo sapiens
ctggcagcctgctg

SEQ ID NO: 6178013 - DNA, 15 bp, Homo sapiens
ctggcagcgcctccc

SEQ ID NO: 6178014 - DNA, 12 bp, Homo sapiens
ctggcagctcag

SEQ ID NO: 6178015 - DNA, 17 bp, Homo sapiens
ctggcagctcagagagg

SEQ ID NO: 6178016 - DNA, 19 bp, Homo sapiens
ctggcagctcagagagggt

SEQ ID NO: 6178017 - DNA, 16 bp, Homo sapiens
ctggcagctcctctcc

SEQ ID NO: 6178018 - DNA, 18 bp, Homo sapiens
ctggcagctcctctcctt

SEQ ID NO: 6178019 - DNA, 21 bp, Homo sapiens
ctggcagctcctctccttggg

SEQ ID NO: 6178020 - DNA, 12 bp, Homo sapiens
ctggcagctctc

SEQ ID NO: 6178021 - DNA, 21 bp, Homo sapiens
ctggcaggaagtctctcccga

SEQ ID NO: 6178022 - DNA, 21 bp, Homo sapiens
ctggcaggacctgcctagcat

SEQ ID NO: 6178023 - DNA, 13 bp, Homo sapiens
ctggcaggagaca

SEQ ID NO: 6178024 - DNA, 23 bp, Homo sapiens
ctggcaggagacactggtctcag

SEQ ID NO: 6178025 - DNA, 22 bp, Homo sapiens
ctggcaggagagagccttggcc

SEQ ID NO: 6178026 - DNA, 21 bp, Homo sapiens
ctggcaggagcctcgtgtcct

SEQ ID NO: 6178027 - DNA, 14 bp, Homo sapiens
ctggcaggagggtg

SEQ ID NO: 6178028 - DNA, 18 bp, Homo sapiens
ctggcaggatgaccctgc

SEQ ID NO: 6178029 - DNA, 20 bp, Homo sapiens
ctggcaggatgaccctgcga

SEQ ID NO: 6178030 - DNA, 17 bp, Homo sapiens
ctggcaggattcttccc

SEQ ID NO: 6178031 - DNA, 20 bp, Homo sapiens
ctggcaggattcttcccgct

SEQ ID NO: 6178032 - DNA, 23 bp, Homo sapiens
ctggcaggattcttcccgctccc

SEQ ID NO: 6178033 - DNA, 13 bp, Homo sapiens
ctggcaggcaggg

SEQ ID NO: 6178034 - DNA, 18 bp, Homo sapiens
ctggcaggcagttctaga

SEQ ID NO: 6178035 - DNA, 14 bp, Homo sapiens
ctggcaggccagtg

SEQ ID NO: 6178036 - DNA, 16 bp, Homo sapiens
ctggcaggccagtgtc

SEQ ID NO: 6178037 - DNA, 20 bp, Homo sapiens
ctggcaggccagtgtctggg

SEQ ID NO: 6178038 - DNA, 14 bp, Homo sapiens
ctggcaggccctgc

SEQ ID NO: 6178039 - DNA, 22 bp, Homo sapiens
ctggcaggccctgcccagccag

SEQ ID NO: 6178040 - DNA, 20 bp, Homo sapiens
ctggcaggctactctgccca

SEQ ID NO: 6178041 - DNA, 21 bp, Homo sapiens
ctggcaggctactctgcccac

SEQ ID NO: 6178042 - DNA, 17 bp, Homo sapiens
ctggcaggcttccccct

SEQ ID NO: 6178043 - DNA, 23 bp, Homo sapiens
ctggcagggaggtcaggccctgg

SEQ ID NO: 6178044 - DNA, 14 bp, Homo sapiens
ctggcagggcagca

SEQ ID NO: 6178045 - DNA, 18 bp, Homo sapiens
ctggcagggcagcaggag

SEQ ID NO: 6178046 - DNA, 16 bp, Homo sapiens
ctggcagggcaggcag

SEQ ID NO: 6178047 - DNA, 12 bp, Homo sapiens
ctggcagggcca

SEQ ID NO: 6178048 - DNA, 14 bp, Homo sapiens
ctggcagggccacc

SEQ ID NO: 6178049 - DNA, 17 bp, Homo sapiens
ctggcagggccacctgc

SEQ ID NO: 6178050 - DNA, 15 bp, Homo sapiens
ctggcagggccaggg

SEQ ID NO: 6178051 - DNA, 23 bp, Homo sapiens
ctggcagggcgccaagtctggca

SEQ ID NO: 6178052 - DNA, 22 bp, Homo sapiens
ctggcaggggaaactctggtgc

SEQ ID NO: 6178053 - DNA, 23 bp, Homo sapiens
ctggcaggggagacaggagccta

SEQ ID NO: 6178054 - DNA, 21 bp, Homo sapiens
ctggcagggggtgaaggcagg

SEQ ID NO: 6178055 - DNA, 20 bp, Homo sapiens
ctggcaggtcatggagcagc

SEQ ID NO: 6178056 - DNA, 23 bp, Homo sapiens
ctggcaggtcatggagcagcccc

SEQ ID NO: 6178057 - DNA, 12 bp, Homo sapiens
ctggcaggtcct

SEQ ID NO: 6178058 - DNA, 12 bp, Homo sapiens
ctggcaggtgca

SEQ ID NO: 6178059 - DNA, 16 bp, Homo sapiens
ctggcaggtgcagatg

SEQ ID NO: 6178060 - DNA, 22 bp, Homo sapiens
ctggcaggtgcagatgggctgt

SEQ ID NO: 6178061 - DNA, 16 bp, Homo sapiens
ctggcaggtgccccgt

SEQ ID NO: 6178062 - DNA, 15 bp, Homo sapiens
ctggcaggtggccag

SEQ ID NO: 6178063 - DNA, 16 bp, Homo sapiens
ctggcaggtggccagg

SEQ ID NO: 6178064 - DNA, 20 bp, Homo sapiens
ctggcaggtggccaggcagg

SEQ ID NO: 6178065 - DNA, 20 bp, Homo sapiens
ctggcaggtggccagggctc

SEQ ID NO: 6178066 - DNA, 22 bp, Homo sapiens
ctggcaggtgttgggacctgct

SEQ ID NO: 6178067 - DNA, 17 bp, Homo sapiens
ctggcagtacagagtgc

SEQ ID NO: 6178068 - DNA, 20 bp, Homo sapiens
ctggcagtacagagtgcagc

SEQ ID NO: 6178069 - DNA, 22 bp, Homo sapiens
ctggcagtcctggaagccagct

SEQ ID NO: 6178070 - DNA, 19 bp, Homo sapiens
ctggcagtgcaatgcttgt

SEQ ID NO: 6178071 - DNA, 19 bp, Homo sapiens
ctggcagtgctgagggacc

SEQ ID NO: 6178072 - DNA, 19 bp, Homo sapiens
ctggcagtggaactaagaa

SEQ ID NO: 6178073 - DNA, 22 bp, Homo sapiens
ctggcagtggcctccttttggt

SEQ ID NO: 6178074 - DNA, 16 bp, Homo sapiens
ctggcagttgaacaga

SEQ ID NO: 6178075 - DNA, 20 bp, Homo sapiens
ctggcagtttatatttaact

SEQ ID NO: 6178076 - DNA, 22 bp, Homo sapiens
ctggcagttttgacatcagcca

SEQ ID NO: 6178077 - DNA, 19 bp, Homo sapiens
ctggcatactatgtggatg

SEQ ID NO: 6178078 - DNA, 14 bp, Homo sapiens
ctggcatagagtag

SEQ ID NO: 6178079 - DNA, 21 bp, Homo sapiens
ctggcatagccctcctgagca

SEQ ID NO: 6178080 - DNA, 23 bp, Homo sapiens
ctggcatagccctcctgagcacc

SEQ ID NO: 6178081 - DNA, 18 bp, Homo sapiens
ctggcatcaagggagaca

SEQ ID NO: 6178082 - DNA, 15 bp, Homo sapiens
ctggcatcaggtctg

SEQ ID NO: 6178083 - DNA, 21 bp, Homo sapiens
ctggcatcaggtctgggcaag

SEQ ID NO: 6178084 - DNA, 18 bp, Homo sapiens
ctggcatcatggtggata

SEQ ID NO: 6178085 - DNA, 19 bp, Homo sapiens
ctggcatccaaatggctgc

SEQ ID NO: 6178086 - DNA, 15 bp, Homo sapiens
ctggcatcctggctg

SEQ ID NO: 6178087 - DNA, 17 bp, Homo sapiens
ctggcatcctggctggc

SEQ ID NO: 6178088 - DNA, 21 bp, Homo sapiens
ctggcatcctggctggctgtg

SEQ ID NO: 6178089 - DNA, 22 bp, Homo sapiens
ctggcatcgcaccattctgact

SEQ ID NO: 6178090 - DNA, 16 bp, Homo sapiens
ctggcatcgcagcttc

SEQ ID NO: 6178091 - DNA, 20 bp, Homo sapiens
ctggcatcgtgtattccata

SEQ ID NO: 6178092 - DNA, 14 bp, Homo sapiens
ctggcatctccccc

SEQ ID NO: 6178093 - DNA, 14 bp, Homo sapiens
ctggcatctgctct

SEQ ID NO: 6178094 - DNA, 18 bp, Homo sapiens
ctggcatcttagacctcc

SEQ ID NO: 6178095 - DNA, 19 bp, Homo sapiens
ctggcatcttctggagaag

SEQ ID NO: 6178096 - DNA, 23 bp, Homo sapiens
ctggcatctttgctatggggaca

SEQ ID NO: 6178097 - DNA, 17 bp, Homo sapiens
ctggcatgacactctag

SEQ ID NO: 6178098 - DNA, 19 bp, Homo sapiens
ctggcatgaccatcctgtc

SEQ ID NO: 6178099 - DNA, 18 bp, Homo sapiens
ctggcatgatccaagcaa

SEQ ID NO: 6178100 - DNA, 22 bp, Homo sapiens
ctggcatggattaatagagttg

SEQ ID NO: 6178101 - DNA, 17 bp, Homo sapiens
ctggcatgggacagggg

SEQ ID NO: 6178102 - DNA, 19 bp, Homo sapiens
ctggcatggggaggggaga

SEQ ID NO: 6178103 - DNA, 20 bp, Homo sapiens
ctggcatggggaggggagag

SEQ ID NO: 6178104 - DNA, 21 bp, Homo sapiens
ctggcatggggaggggagaga

SEQ ID NO: 6178105 - DNA, 23 bp, Homo sapiens
ctggcatggggaggggagagaag

SEQ ID NO: 6178106 - DNA, 17 bp, Homo sapiens
ctggcatggtggctccc

SEQ ID NO: 6178107 - DNA, 16 bp, Homo sapiens
ctggcatgtcagagcc

SEQ ID NO: 6178108 - DNA, 18 bp, Homo sapiens
ctggcatgtcatttgcac

SEQ ID NO: 6178109 - DNA, 13 bp, Homo sapiens
ctggcatgtctgg

SEQ ID NO: 6178110 - DNA, 16 bp, Homo sapiens
ctggcatgtctgggtc

SEQ ID NO: 6178111 - DNA, 20 bp, Homo sapiens
ctggcatgttcaaagccaca

SEQ ID NO: 6178112 - DNA, 19 bp, Homo sapiens
ctggcatgtttcactcctg

SEQ ID NO: 6178113 - DNA, 18 bp, Homo sapiens
ctggcatgttttctttgt

SEQ ID NO: 6178114 - DNA, 17 bp, Homo sapiens
ctggcattaagggcatt

SEQ ID NO: 6178115 - DNA, 18 bp, Homo sapiens
ctggcattaattattaat

SEQ ID NO: 6178116 - DNA, 15 bp, Homo sapiens
ctggcattacagctg

SEQ ID NO: 6178117 - DNA, 16 bp, Homo sapiens
ctggcattacagctgg

SEQ ID NO: 6178118 - DNA, 22 bp, Homo sapiens
ctggcattaccctctgcagaac

SEQ ID NO: 6178119 - DNA, 22 bp, Homo sapiens
ctggcattactcagcaggagcc

SEQ ID NO: 6178120 - DNA, 19 bp, Homo sapiens
ctggcattatgtccactgt

SEQ ID NO: 6178121 - DNA, 14 bp, Homo sapiens
ctggcattctcaaa

SEQ ID NO: 6178122 - DNA, 17 bp, Homo sapiens
ctggcattcttgtacag

SEQ ID NO: 6178123 - DNA, 13 bp, Homo sapiens
ctggcattgaaat

SEQ ID NO: 6178124 - DNA, 17 bp, Homo sapiens
ctggcattgtccctgtg

SEQ ID NO: 6178125 - DNA, 19 bp, Homo sapiens
ctggcattgtccctgtgcc

SEQ ID NO: 6178126 - DNA, 21 bp, Homo sapiens
ctggcatttgctgatttctag

SEQ ID NO: 6178127 - DNA, 16 bp, Homo sapiens
ctggcatttggcctct

SEQ ID NO: 6178128 - DNA, 16 bp, Homo sapiens
ctggcatttgtttcct

SEQ ID NO: 6178129 - DNA, 17 bp, Homo sapiens
ctggcattttatagaca

SEQ ID NO: 6178130 - DNA, 17 bp, Homo sapiens
ctggcattttctgttcc

SEQ ID NO: 6178131 - DNA, 18 bp, Homo sapiens
ctggcattttctgttcca

SEQ ID NO: 6178132 - DNA, 19 bp, Homo sapiens
ctggcattttctgttccag

SEQ ID NO: 6178133 - DNA, 18 bp, Homo sapiens
ctggccaaacccttgctt

SEQ ID NO: 6178134 - DNA, 12 bp, Homo sapiens
ctggccaaagtc

SEQ ID NO: 6178135 - DNA, 15 bp, Homo sapiens
ctggccaaagtcact

SEQ ID NO: 6178136 - DNA, 19 bp, Homo sapiens
ctggccaaagtcacttccc

SEQ ID NO: 6178137 - DNA, 13 bp, Homo sapiens
cttggggggtgat

SEQ ID NO: 6178138 - DNA, 22 bp, Homo sapiens
cttggggggtgatgagggcagc

SEQ ID NO: 6178139 - DNA, 22 bp, Homo sapiens
cttggggggtttttactccagt

SEQ ID NO: 6178140 - DNA, 23 bp, Homo sapiens
cttggggggtttttactccagtg

SEQ ID NO: 6178141 - DNA, 17 bp, Homo sapiens
cttgggggtcacccatg

SEQ ID NO: 6178142 - DNA, 13 bp, Homo sapiens
cttgggggtcagg

SEQ ID NO: 6178143 - DNA, 22 bp, Homo sapiens
cttgggggtcctcctccaggga

SEQ ID NO: 6178144 - DNA, 19 bp, Homo sapiens
cttgggggtggggctgcat

SEQ ID NO: 6178145 - DNA, 17 bp, Homo sapiens
cttgggggtttttgaag

SEQ ID NO: 6178146 - DNA, 17 bp, Homo sapiens
cttggggtaagccagag

SEQ ID NO: 6178147 - DNA, 14 bp, Homo sapiens
cttggggtactctt

SEQ ID NO: 6178148 - DNA, 15 bp, Homo sapiens
cttggggtcaagaaa

SEQ ID NO: 6178149 - DNA, 22 bp, Homo sapiens
cttggggtcaggttgacaggag

SEQ ID NO: 6178150 - DNA, 12 bp, Homo sapiens
cttggggtggcg

SEQ ID NO: 6178151 - DNA, 22 bp, Homo sapiens
cttggggtggcgcgcctgcctt

SEQ ID NO: 6178152 - DNA, 20 bp, Homo sapiens
cttggggtgggggccaggcc

SEQ ID NO: 6178153 - DNA, 18 bp, Homo sapiens
cttggggtgtggggtggg

SEQ ID NO: 6178154 - DNA, 19 bp, Homo sapiens
cttggggttcataggggca

SEQ ID NO: 6178155 - DNA, 19 bp, Homo sapiens
cttgggtagagtttacagc

SEQ ID NO: 6178156 - DNA, 13 bp, Homo sapiens
cttgggtagggca

SEQ ID NO: 6178157 - DNA, 17 bp, Homo sapiens
cttgggtagggcagaca

SEQ ID NO: 6178158 - DNA, 20 bp, Homo sapiens
cttgggtcaggttcttgcct

SEQ ID NO: 6178159 - DNA, 20 bp, Homo sapiens
cttgggtccaccatgcagaa

SEQ ID NO: 6178160 - DNA, 17 bp, Homo sapiens
cttgggtcccagggaag

SEQ ID NO: 6178161 - DNA, 16 bp, Homo sapiens
cttgggtcgccctacc

SEQ ID NO: 6178162 - DNA, 23 bp, Homo sapiens
cttgggtctctctcggcccctgt

SEQ ID NO: 6178163 - DNA, 15 bp, Homo sapiens
cttgggtctctggat

SEQ ID NO: 6178164 - DNA, 17 bp, Homo sapiens
cttgggtctgccctgcc

SEQ ID NO: 6178165 - DNA, 14 bp, Homo sapiens
cttgggtgaatttc

SEQ ID NO: 6178166 - DNA, 18 bp, Homo sapiens
cttgggtggagaagccat

SEQ ID NO: 6178167 - DNA, 17 bp, Homo sapiens
cttgggtgggacagggc

SEQ ID NO: 6178168 - DNA, 18 bp, Homo sapiens
cttgggtgggacagggct

SEQ ID NO: 6178169 - DNA, 21 bp, Homo sapiens
cttgggtgggtgaaggcctgg

SEQ ID NO: 6178170 - DNA, 17 bp, Homo sapiens
cttgggtggttcctaag

SEQ ID NO: 6178171 - DNA, 19 bp, Homo sapiens
cttgggtgtattctctgta

SEQ ID NO: 6178172 - DNA, 20 bp, Homo sapiens
cttgggtgtggctcctctgt

SEQ ID NO: 6178173 - DNA, 23 bp, Homo sapiens
cttgggttcaagtgattctcctg

SEQ ID NO: 6178174 - DNA, 14 bp, Homo sapiens
cttgggttcctttt

SEQ ID NO: 6178175 - DNA, 16 bp, Homo sapiens
cttgggtttaacaagc

SEQ ID NO: 6178176 - DNA, 17 bp, Homo sapiens
cttgggtttttgttacc

SEQ ID NO: 6178177 - DNA, 20 bp, Homo sapiens
cttggtaaaaactgcagtgt

SEQ ID NO: 6178178 - DNA, 16 bp, Homo sapiens
cttggtaaattgtaaa

SEQ ID NO: 6178179 - DNA, 19 bp, Homo sapiens
cttggtaagtgaatttatg

SEQ ID NO: 6178180 - DNA, 19 bp, Homo sapiens
cttggtacagttgcaggag

SEQ ID NO: 6178181 - DNA, 20 bp, Homo sapiens
cttggtacagttgcaggagc

SEQ ID NO: 6178182 - DNA, 23 bp, Homo sapiens
cttggtactactagatgtcttta

SEQ ID NO: 6178183 - DNA, 22 bp, Homo sapiens
cttggtagaagcccttctacct

SEQ ID NO: 6178184 - DNA, 18 bp, Homo sapiens
cttggtagagttcctttc

SEQ ID NO: 6178185 - DNA, 14 bp, Homo sapiens
cttggtagcacttt

SEQ ID NO: 6178186 - DNA, 14 bp, Homo sapiens
cttggtagttctgt

SEQ ID NO: 6178187 - DNA, 17 bp, Homo sapiens
cttggtagtttggaaag

SEQ ID NO: 6178188 - DNA, 22 bp, Homo sapiens
cttggtatatctggccacactg

SEQ ID NO: 6178189 - DNA, 23 bp, Homo sapiens
cttggtatatctggccacactgg

SEQ ID NO: 6178190 - DNA, 19 bp, Homo sapiens
cttggtatgggctgttctg

SEQ ID NO: 6178191 - DNA, 15 bp, Homo sapiens
cttggtatgtgccag

SEQ ID NO: 6178192 - DNA, 22 bp, Homo sapiens
cttggtatgtgccaggcttgcc

SEQ ID NO: 6178193 - DNA, 22 bp, Homo sapiens
cttggtatttgtttaataccct

SEQ ID NO: 6178194 - DNA, 23 bp, Homo sapiens
cttggtatttttcagagatttat

SEQ ID NO: 6178195 - DNA, 14 bp, Homo sapiens
cttggtcaaacttt

SEQ ID NO: 6178196 - DNA, 15 bp, Homo sapiens
cttggtcaaactttt

SEQ ID NO: 6178197 - DNA, 22 bp, Homo sapiens
cttggtcacaaagctatttaag

SEQ ID NO: 6178198 - DNA, 23 bp, Homo sapiens
cttggtcacaaagctatttaagt

SEQ ID NO: 6178199 - DNA, 16 bp, Homo sapiens
cttggtcacagccagg

SEQ ID NO: 6178200 - DNA, 21 bp, Homo sapiens
cttggtccagattgaaaagtg

SEQ ID NO: 6178201 - DNA, 16 bp, Homo sapiens
cttggtccaggaaatg

SEQ ID NO: 6178202 - DNA, 23 bp, Homo sapiens
cttggtcccagacagctggaccc

SEQ ID NO: 6178203 - DNA, 23 bp, Homo sapiens
cttggtcccattagctgaggttt

SEQ ID NO: 6178204 - DNA, 23 bp, Homo sapiens
cttggtccctatgggcttccgca

SEQ ID NO: 6178205 - DNA, 15 bp, Homo sapiens
cttggtccctctcag

SEQ ID NO: 6178206 - DNA, 16 bp, Homo sapiens
cttggtccctctcaga

SEQ ID NO: 6178207 - DNA, 13 bp, Homo sapiens
cttggtccctggt

SEQ ID NO: 6178208 - DNA, 19 bp, Homo sapiens
cttggtcctagggtgggaa

SEQ ID NO: 6178209 - DNA, 13 bp, Homo sapiens
cttggtcctgcct

SEQ ID NO: 6178210 - DNA, 16 bp, Homo sapiens
cttggtcctgctgcag

SEQ ID NO: 6178211 - DNA, 22 bp, Homo sapiens
cttggtcctgctgcagttgcca

SEQ ID NO: 6178212 - DNA, 18 bp, Homo sapiens
cttggtcctgtcaccctg

SEQ ID NO: 6178213 - DNA, 23 bp, Homo sapiens
cttggtcctgtcaccctggcccc

SEQ ID NO: 6178214 - DNA, 13 bp, Homo sapiens
cttggtccttaaa

SEQ ID NO: 6178215 - DNA, 24 bp, Homo sapiens
cttggtctaccaatctgggaagat

SEQ ID NO: 6178216 - DNA, 13 bp, Homo sapiens
cttggtctcagct

SEQ ID NO: 6178217 - DNA, 17 bp, Homo sapiens
cttggtctcagcttcat

SEQ ID NO: 6178218 - DNA, 23 bp, Homo sapiens
cttggtctcagtgtcaatgcagc

SEQ ID NO: 6178219 - DNA, 13 bp, Homo sapiens
cttggtctctcct

SEQ ID NO: 6178220 - DNA, 18 bp, Homo sapiens
cttggtctctttctttcc

SEQ ID NO: 6178221 - DNA, 21 bp, Homo sapiens
cttggtctctttctttccaaa

SEQ ID NO: 6178222 - DNA, 22 bp, Homo sapiens
cttggtctctttctttccaaag

SEQ ID NO: 6178223 - DNA, 17 bp, Homo sapiens
cttggtctgccaggccc

SEQ ID NO: 6178224 - DNA, 16 bp, Homo sapiens
cttggtctgtgagatg

SEQ ID NO: 6178225 - DNA, 15 bp, Homo sapiens
cttggtctgtgttct

SEQ ID NO: 6178226 - DNA, 15 bp, Homo sapiens
cttggtcttatttat

SEQ ID NO: 6178227 - DNA, 12 bp, Homo sapiens
cttggtcttgaa

SEQ ID NO: 6178228 - DNA, 19 bp, Homo sapiens
cttggtgaaataataaaat

SEQ ID NO: 6178229 - DNA, 22 bp, Homo sapiens
cttggtgaatttttttttccta

SEQ ID NO: 6178230 - DNA, 15 bp, Homo sapiens
cttggtgactgtccc

SEQ ID NO: 6178231 - DNA, 14 bp, Homo sapiens
cttggtgaggagga

SEQ ID NO: 6178232 - DNA, 14 bp, Homo sapiens
cttggtgagtcttg

SEQ ID NO: 6178233 - DNA, 19 bp, Homo sapiens
cttggtgattccgcagtga

SEQ ID NO: 6178234 - DNA, 21 bp, Homo sapiens
cttggtgcacagattgctgaa

SEQ ID NO: 6178235 - DNA, 22 bp, Homo sapiens
cttggtgcacagattgctgaaa

SEQ ID NO: 6178236 - DNA, 13 bp, Homo sapiens
cttggtgccacca

SEQ ID NO: 6178237 - DNA, 16 bp, Homo sapiens
cttggtgccctcgcct

SEQ ID NO: 6178238 - DNA, 17 bp, Homo sapiens
cttggtgcctctgcagt

SEQ ID NO: 6178239 - DNA, 17 bp, Homo sapiens
cttggtgccttttgtgt

SEQ ID NO: 6178240 - DNA, 23 bp, Homo sapiens
cttggtgcggtaggtgctggcct

SEQ ID NO: 6178241 - DNA, 17 bp, Homo sapiens
cttggtgctaaagattg

SEQ ID NO: 6178242 - DNA, 13 bp, Homo sapiens
cttggtgctatga

SEQ ID NO: 6178243 - DNA, 21 bp, Homo sapiens
cttggtgctatgacagtgtga

SEQ ID NO: 6178244 - DNA, 18 bp, Homo sapiens
cttggtgctgctttggct

SEQ ID NO: 6178245 - DNA, 15 bp, Homo sapiens
cttggtgctgggaac

SEQ ID NO: 6178246 - DNA, 14 bp, Homo sapiens
cttggtgctggttt

SEQ ID NO: 6178247 - DNA, 13 bp, Homo sapiens
cttggtgctgtgt

SEQ ID NO: 6178248 - DNA, 19 bp, Homo sapiens
cttggtgctgtgtgcccca

SEQ ID NO: 6178249 - DNA, 18 bp, Homo sapiens
cttggtgcttattgatat

SEQ ID NO: 6178250 - DNA, 16 bp, Homo sapiens
cttggtgctttgtcta

SEQ ID NO: 6178251 - DNA, 17 bp, Homo sapiens
cttggtggcagaatgaa

SEQ ID NO: 6178252 - DNA, 21 bp, Homo sapiens
cttggtggccccgacaggtct

SEQ ID NO: 6178253 - DNA, 19 bp, Homo sapiens
cttggtggctcacgcctgt

SEQ ID NO: 6178254 - DNA, 21 bp, Homo sapiens
cttggtggctgagcttggccc

SEQ ID NO: 6178255 - DNA, 16 bp, Homo sapiens
cttggtggcttttcct

SEQ ID NO: 6178256 - DNA, 19 bp, Homo sapiens
cttggtggcttttccttga

SEQ ID NO: 6178257 - DNA, 18 bp, Homo sapiens
cttggtgggcccagggac

SEQ ID NO: 6178258 - DNA, 21 bp, Homo sapiens
cttggtggggctcgtggcctt

SEQ ID NO: 6178259 - DNA, 16 bp, Homo sapiens
cttggtgtaatttgaa

SEQ ID NO: 6178260 - DNA, 18 bp, Homo sapiens
cttggtgtaatttgaaga

SEQ ID NO: 6178261 - DNA, 15 bp, Homo sapiens
cttggtgtccacctg

SEQ ID NO: 6178262 - DNA, 17 bp, Homo sapiens
cttggtgtccacctggc

SEQ ID NO: 6178263 - DNA, 21 bp, Homo sapiens
cttggtgtcctttccctccac

SEQ ID NO: 6178264 - DNA, 18 bp, Homo sapiens
cttggtgtgattgcacag

SEQ ID NO: 6178265 - DNA, 17 bp, Homo sapiens
cttggtgtgtaggttcc

SEQ ID NO: 6178266 - DNA, 16 bp, Homo sapiens
cttggtgttaaaacac

SEQ ID NO: 6178267 - DNA, 17 bp, Homo sapiens
cttggtgttaaaacact

SEQ ID NO: 6178268 - DNA, 22 bp, Homo sapiens
cttggtgtttcccttcctcggt

SEQ ID NO: 6178269 - DNA, 18 bp, Homo sapiens
cttggtgtttgactgtaa

SEQ ID NO: 6178270 - DNA, 17 bp, Homo sapiens
cttggtgttttgggact

SEQ ID NO: 6178271 - DNA, 22 bp, Homo sapiens
cttggttcaataaagcactgag

SEQ ID NO: 6178272 - DNA, 16 bp, Homo sapiens
cttggttcataaatga

SEQ ID NO: 6178273 - DNA, 19 bp, Homo sapiens
cttggttccagcctgccac

SEQ ID NO: 6178274 - DNA, 14 bp, Homo sapiens
cttggttcccagaa

SEQ ID NO: 6178275 - DNA, 20 bp, Homo sapiens
cttggttcccatttgctcct

SEQ ID NO: 6178276 - DNA, 19 bp, Homo sapiens
cttggttcccccactgatc

SEQ ID NO: 6178277 - DNA, 17 bp, Homo sapiens
cttggttcccttgtgtg

SEQ ID NO: 6178278 - DNA, 22 bp, Homo sapiens
cttggttcctccagcaatgcct

SEQ ID NO: 6178279 - DNA, 19 bp, Homo sapiens
cttggttcctggggcatcc

SEQ ID NO: 6178280 - DNA, 12 bp, Homo sapiens
cttggttcctgt

SEQ ID NO: 6178281 - DNA, 17 bp, Homo sapiens
cttggttcctgtttgaa

SEQ ID NO: 6178282 - DNA, 12 bp, Homo sapiens
cttggttctaaa

SEQ ID NO: 6178283 - DNA, 14 bp, Homo sapiens
cttggttctggcca

SEQ ID NO: 6178284 - DNA, 17 bp, Homo sapiens
cttggttctggccaccc

SEQ ID NO: 6178285 - DNA, 13 bp, Homo sapiens
cttggttcttatt

SEQ ID NO: 6178286 - DNA, 23 bp, Homo sapiens
cttggttcttgaggggaccagga

SEQ ID NO: 6178287 - DNA, 22 bp, Homo sapiens
cttggttgaagttgtgttaaca

SEQ ID NO: 6178288 - DNA, 13 bp, Homo sapiens
cttggttggctgg

SEQ ID NO: 6178289 - DNA, 20 bp, Homo sapiens
cttggttgggtcaaggacag

SEQ ID NO: 6178290 - DNA, 17 bp, Homo sapiens
cttggttgggtcctcac

SEQ ID NO: 6178291 - DNA, 19 bp, Homo sapiens
cttggttggtagggtggga

SEQ ID NO: 6178292 - DNA, 17 bp, Homo sapiens
cttggttgttaatttag

SEQ ID NO: 6178293 - DNA, 19 bp, Homo sapiens
cttggtttagaggaaccca

SEQ ID NO: 6178294 - DNA, 14 bp, Homo sapiens
cttggtttcagcca

SEQ ID NO: 6178295 - DNA, 21 bp, Homo sapiens
cttggtttccatcaaagccct

SEQ ID NO: 6178296 - DNA, 23 bp, Homo sapiens
cttggtttccatcaaagccctcc

SEQ ID NO: 6178297 - DNA, 16 bp, Homo sapiens
cttggtttcctgagcc

SEQ ID NO: 6178298 - DNA, 19 bp, Homo sapiens
cttggtttctctctacagt

SEQ ID NO: 6178299 - DNA, 12 bp, Homo sapiens
cttggtttctgg

SEQ ID NO: 6178300 - DNA, 15 bp, Homo sapiens
cttggtttctggata

SEQ ID NO: 6178301 - DNA, 15 bp, Homo sapiens
cttggtttctggggg

SEQ ID NO: 6178302 - DNA, 16 bp, Homo sapiens
cttggtttctgggggc

SEQ ID NO: 6178303 - DNA, 14 bp, Homo sapiens
cttggtttctgtga

SEQ ID NO: 6178304 - DNA, 18 bp, Homo sapiens
cttggtttgcacataaaa

SEQ ID NO: 6178305 - DNA, 15 bp, Homo sapiens
cttggtttggggaga

SEQ ID NO: 6178306 - DNA, 21 bp, Homo sapiens
cttggtttggtcatgcccgtc

SEQ ID NO: 6178307 - DNA, 20 bp, Homo sapiens
cttggtttgtaaattaactt

SEQ ID NO: 6178308 - DNA, 21 bp, Homo sapiens
cttggtttgttatatcaggga

SEQ ID NO: 6178309 - DNA, 14 bp, Homo sapiens
cttggttttatggt

SEQ ID NO: 6178310 - DNA, 14 bp, Homo sapiens
cttggttttctctc

SEQ ID NO: 6178311 - DNA, 18 bp, Homo sapiens
cttggttttctctctgga

SEQ ID NO: 6178312 - DNA, 19 bp, Homo sapiens
cttggttttgcctctttaa

SEQ ID NO: 6178313 - DNA, 20 bp, Homo sapiens
cttggttttgcctctttaaa

SEQ ID NO: 6178314 - DNA, 22 bp, Homo sapiens
ctggccaaagtcagtaggagag

SEQ ID NO: 6178315 - DNA, 18 bp, Homo sapiens
ctggccaaatagcaaaga

SEQ ID NO: 6178316 - DNA, 17 bp, Homo sapiens
ctggccaaatatgcact

SEQ ID NO: 6178317 - DNA, 21 bp, Homo sapiens
ctggccaaatatgcactttcc

SEQ ID NO: 6178318 - DNA, 15 bp, Homo sapiens
ctggccaagctgagg

SEQ ID NO: 6178319 - DNA, 23 bp, Homo sapiens
ctggccaagctgaggtgcccagg

SEQ ID NO: 6178320 - DNA, 18 bp, Homo sapiens
ctggccaagggccagaca

SEQ ID NO: 6178321 - DNA, 23 bp, Homo sapiens
ctggccaagggccagacagacct

SEQ ID NO: 6178322 - DNA, 19 bp, Homo sapiens
ctggccaaggtgtccaggg

SEQ ID NO: 6178323 - DNA, 23 bp, Homo sapiens
ctggccaaggtgtccagggtcct

SEQ ID NO: 6178324 - DNA, 19 bp, Homo sapiens
ctggccaatgcggcccact

SEQ ID NO: 6178325 - DNA, 20 bp, Homo sapiens
ctggccaatttttgtacttt

SEQ ID NO: 6178326 - DNA, 13 bp, Homo sapiens
ctggccacaagga

SEQ ID NO: 6178327 - DNA, 21 bp, Homo sapiens
ctggccacaatcctccccacc

SEQ ID NO: 6178328 - DNA, 17 bp, Homo sapiens
ctggccacacaggatct

SEQ ID NO: 6178329 - DNA, 16 bp, Homo sapiens
ctggccacagccttcc

SEQ ID NO: 6178330 - DNA, 16 bp, Homo sapiens
ctggccacatcagccc

SEQ ID NO: 6178331 - DNA, 16 bp, Homo sapiens
ctggccaccacccccc

SEQ ID NO: 6178332 - DNA, 21 bp, Homo sapiens
ctggccaccaccccccactct

SEQ ID NO: 6178333 - DNA, 16 bp, Homo sapiens
ctggccaccagccatc

SEQ ID NO: 6178334 - DNA, 20 bp, Homo sapiens
ctggccaccagccatcctcc

SEQ ID NO: 6178335 - DNA, 15 bp, Homo sapiens
ctggccaccaggctg

SEQ ID NO: 6178336 - DNA, 17 bp, Homo sapiens
ctggccaccaggctggc

SEQ ID NO: 6178337 - DNA, 20 bp, Homo sapiens
ctggccaccaggctggcgca

SEQ ID NO: 6178338 - DNA, 21 bp, Homo sapiens
ctggccaccaggctggcgcag

SEQ ID NO: 6178339 - DNA, 19 bp, Homo sapiens
ctggccaccccagagtggg

SEQ ID NO: 6178340 - DNA, 12 bp, Homo sapiens
ctggccaccctg

SEQ ID NO: 6178341 - DNA, 15 bp, Homo sapiens
ctggccaccctggcc

SEQ ID NO: 6178342 - DNA, 16 bp, Homo sapiens
ctggccaccctggccc

SEQ ID NO: 6178343 - DNA, 21 bp, Homo sapiens
ctggccacctagaagtctccc

SEQ ID NO: 6178344 - DNA, 16 bp, Homo sapiens
ctggccacctgaggtg

SEQ ID NO: 6178345 - DNA, 18 bp, Homo sapiens
ctggccacctgaggtggg

SEQ ID NO: 6178346 - DNA, 21 bp, Homo sapiens
ctggccacctgaggtgggccc

SEQ ID NO: 6178347 - DNA, 13 bp, Homo sapiens
ctggccacctgcc

SEQ ID NO: 6178348 - DNA, 14 bp, Homo sapiens
ctggccacgcagcc

SEQ ID NO: 6178349 - DNA, 20 bp, Homo sapiens
ctggccacgcagccaggaca

SEQ ID NO: 6178350 - DNA, 15 bp, Homo sapiens
ctggccactaaagct

SEQ ID NO: 6178351 - DNA, 13 bp, Homo sapiens
ctggccactctgc

SEQ ID NO: 6178352 - DNA, 18 bp, Homo sapiens
ctggccactgcacagagc

SEQ ID NO: 6178353 - DNA, 13 bp, Homo sapiens
ctggccagaatgc

SEQ ID NO: 6178354 - DNA, 17 bp, Homo sapiens
ctggccagacacaggcc

SEQ ID NO: 6178355 - DNA, 18 bp, Homo sapiens
ctggccagacacaggccc

SEQ ID NO: 6178356 - DNA, 14 bp, Homo sapiens
ctggccagacggcc

SEQ ID NO: 6178357 - DNA, 14 bp, Homo sapiens
ctggccagagaggg

SEQ ID NO: 6178358 - DNA, 15 bp, Homo sapiens
ctggccagagagggc

SEQ ID NO: 6178359 - DNA, 17 bp, Homo sapiens
ctggccagagagggccc

SEQ ID NO: 6178360 - DNA, 18 bp, Homo sapiens
ctggccagagagggccca

SEQ ID NO: 6178361 - DNA, 22 bp, Homo sapiens
ctggccagagagggcccagctg

SEQ ID NO: 6178362 - DNA, 12 bp, Homo sapiens
ctggccagaggc

SEQ ID NO: 6178363 - DNA, 13 bp, Homo sapiens
ctggccagaggca

SEQ ID NO: 6178364 - DNA, 13 bp, Homo sapiens
ctggccagaggct

SEQ ID NO: 6178365 - DNA, 19 bp, Homo sapiens
ctggccagatgcaccagcc

SEQ ID NO: 6178366 - DNA, 22 bp, Homo sapiens
ctggccagatgcaccagccctt

SEQ ID NO: 6178367 - DNA, 18 bp, Homo sapiens
ctggccagatggcccgga

SEQ ID NO: 6178368 - DNA, 22 bp, Homo sapiens
ctggccagatgtcgctgggtcc

SEQ ID NO: 6178369 - DNA, 13 bp, Homo sapiens
ctggccagcaccc

SEQ ID NO: 6178370 - DNA, 14 bp, Homo sapiens
ctggccagcaccct

SEQ ID NO: 6178371 - DNA, 20 bp, Homo sapiens
ctggccagcaccctctcctg

SEQ ID NO: 6178372 - DNA, 22 bp, Homo sapiens
ctggccagcaccctctcctggg

SEQ ID NO: 6178373 - DNA, 13 bp, Homo sapiens
ctggccagcccca

SEQ ID NO: 6178374 - DNA, 17 bp, Homo sapiens
ctggccagccccacagc

SEQ ID NO: 6178375 - DNA, 19 bp, Homo sapiens
ctggccagccgctctcctg

SEQ ID NO: 6178376 - DNA, 14 bp, Homo sapiens
ctggccagcctggg

SEQ ID NO: 6178377 - DNA, 17 bp, Homo sapiens
ctggccagcctggggcc

SEQ ID NO: 6178378 - DNA, 20 bp, Homo sapiens
ctggccagcctggggcctgg

SEQ ID NO: 6178379 - DNA, 22 bp, Homo sapiens
ctggccagcctggggcctggca

SEQ ID NO: 6178380 - DNA, 12 bp, Homo sapiens
ctggccagcgag

SEQ ID NO: 6178381 - DNA, 13 bp, Homo sapiens
ctggccagctctg

SEQ ID NO: 6178382 - DNA, 23 bp, Homo sapiens
ctggccagctctgaggggaggca

SEQ ID NO: 6178383 - DNA, 13 bp, Homo sapiens
ctggccaggagca

SEQ ID NO: 6178384 - DNA, 15 bp, Homo sapiens
ctggccaggagcagg

SEQ ID NO: 6178385 - DNA, 13 bp, Homo sapiens
ctggccaggagct

SEQ ID NO: 6178386 - DNA, 16 bp, Homo sapiens
ctggccaggagctgga

SEQ ID NO: 6178387 - DNA, 12 bp, Homo sapiens
ctggccaggatg

SEQ ID NO: 6178388 - DNA, 12 bp, Homo sapiens
ctggccaggcag

SEQ ID NO: 6178389 - DNA, 14 bp, Homo sapiens
ctggccaggcagat

SEQ ID NO: 6178390 - DNA, 18 bp, Homo sapiens
ctggccaggcagggagag

SEQ ID NO: 6178391 - DNA, 22 bp, Homo sapiens
ctggccaggccctgagagtctg

SEQ ID NO: 6178392 - DNA, 23 bp, Homo sapiens
ctggccaggccctgagagtctgg

SEQ ID NO: 6178393 - DNA, 15 bp, Homo sapiens
ctggccaggccctgg

SEQ ID NO: 6178394 - DNA, 17 bp, Homo sapiens
ctggccaggccctgggt

SEQ ID NO: 6178395 - DNA, 10 bp, Homo sapiens
ctggccaggg

SEQ ID NO: 6178396 - DNA, 14 bp, Homo sapiens
ctggccagggcagg

SEQ ID NO: 6178397 - DNA, 17 bp, Homo sapiens
ctggccagggcagggcc

SEQ ID NO: 6178398 - DNA, 19 bp, Homo sapiens
ctggccagggcagggccac

SEQ ID NO: 6178399 - DNA, 12 bp, Homo sapiens
ctggccagggcc

SEQ ID NO: 6178400 - DNA, 14 bp, Homo sapiens
ctggccagggcctg

SEQ ID NO: 6178401 - DNA, 15 bp, Homo sapiens
ctggccaggggtcct

SEQ ID NO: 6178402 - DNA, 20 bp, Homo sapiens
ctggccagtccaccctgcct

SEQ ID NO: 6178403 - DNA, 18 bp, Homo sapiens
ctggccagtccaggctgc

SEQ ID NO: 6178404 - DNA, 19 bp, Homo sapiens
ctggccagtccaggctgcc

SEQ ID NO: 6178405 - DNA, 22 bp, Homo sapiens
ctggccagtccaggctgccgtg

SEQ ID NO: 6178406 - DNA, 17 bp, Homo sapiens
ctggccagtcctagagc

SEQ ID NO: 6178407 - DNA, 22 bp, Homo sapiens
ctggccagtcctggtcctggct

SEQ ID NO: 6178408 - DNA, 23 bp, Homo sapiens
ctggccagtcctggtcctggctg

SEQ ID NO: 6178409 - DNA, 17 bp, Homo sapiens
ctggccagtgctgccca

SEQ ID NO: 6178410 - DNA, 15 bp, Homo sapiens
ctggccagtgtcatt

SEQ ID NO: 6178411 - DNA, 13 bp, Homo sapiens
ctggccagtgttt

SEQ ID NO: 6178412 - DNA, 15 bp, Homo sapiens
ctggccagtgtttaa

SEQ ID NO: 6178413 - DNA, 20 bp, Homo sapiens
ctggccagtgtttaaaactt

SEQ ID NO: 6178414 - DNA, 17 bp, Homo sapiens
ctggccagttggaacca

SEQ ID NO: 6178415 - DNA, 17 bp, Homo sapiens
ctggccatccctcgtgg

SEQ ID NO: 6178416 - DNA, 23 bp, Homo sapiens
ctggccatctcaacgcctctcct

SEQ ID NO: 6178417 - DNA, 19 bp, Homo sapiens
ctggccatctccctcccca

SEQ ID NO: 6178418 - DNA, 12 bp, Homo sapiens
ctggccatctct

SEQ ID NO: 6178419 - DNA, 22 bp, Homo sapiens
ctggccatctctgaacttcagc

SEQ ID NO: 6178420 - DNA, 22 bp, Homo sapiens
ctggccatctggttaggatggc

SEQ ID NO: 6178421 - DNA, 14 bp, Homo sapiens
ctggccatgcaagt

SEQ ID NO: 6178422 - DNA, 15 bp, Homo sapiens
ctggccatgctgtcc

SEQ ID NO: 6178423 - DNA, 18 bp, Homo sapiens
ctggccatgctgtccctg

SEQ ID NO: 6178424 - DNA, 23 bp, Homo sapiens
ctggccatggacgaatatgaatg

SEQ ID NO: 6178425 - DNA, 19 bp, Homo sapiens
ctggccatggagaaagctg

SEQ ID NO: 6178426 - DNA, 20 bp, Homo sapiens
ctggccatggagaaagctga

SEQ ID NO: 6178427 - DNA, 15 bp, Homo sapiens
ctggccatggggccc

SEQ ID NO: 6178428 - DNA, 16 bp, Homo sapiens
ctggccatggggccct

SEQ ID NO: 6178429 - DNA, 22 bp, Homo sapiens
ctggccatggggccctcccaga

SEQ ID NO: 6178430 - DNA, 22 bp, Homo sapiens
ctggccatgtggccctccagtg

SEQ ID NO: 6178431 - DNA, 22 bp, Homo sapiens
ctggccatttggccccagggga

SEQ ID NO: 6178432 - DNA, 23 bp, Homo sapiens
ctggccattttcttgcctgaggc

SEQ ID NO: 6178433 - DNA, 15 bp, Homo sapiens
ctggccattttggaa

SEQ ID NO: 6178434 - DNA, 13 bp, Homo sapiens
ctggcccaaagca

SEQ ID NO: 6178435 - DNA, 17 bp, Homo sapiens
ctggcccaagctgggct

SEQ ID NO: 6178436 - DNA, 13 bp, Homo sapiens
ctggcccacagct

SEQ ID NO: 6178437 - DNA, 18 bp, Homo sapiens
ctggcccacagctctgct

SEQ ID NO: 6178438 - DNA, 22 bp, Homo sapiens
ctggcccacagctctgctggaa

SEQ ID NO: 6178439 - DNA, 16 bp, Homo sapiens
ctggcccacccctctt

SEQ ID NO: 6178440 - DNA, 22 bp, Homo sapiens
ctggcccacccctcttccccct

SEQ ID NO: 6178441 - DNA, 14 bp, Homo sapiens
ctggcccacgccct

SEQ ID NO: 6178442 - DNA, 22 bp, Homo sapiens
ctggcccacgccctccctctcc

SEQ ID NO: 6178443 - DNA, 13 bp, Homo sapiens
ctggcccactgca

SEQ ID NO: 6178444 - DNA, 15 bp, Homo sapiens
ctggcccagaaagcc

SEQ ID NO: 6178445 - DNA, 18 bp, Homo sapiens
ctggcccagaaagcctct

SEQ ID NO: 6178446 - DNA, 13 bp, Homo sapiens
ctggcccagaagc

SEQ ID NO: 6178447 - DNA, 17 bp, Homo sapiens
ctggcccagcatggaat

SEQ ID NO: 6178448 - DNA, 18 bp, Homo sapiens
ctggcccagcatggaatc

SEQ ID NO: 6178449 - DNA, 13 bp, Homo sapiens
ctggcccagccaa

SEQ ID NO: 6178450 - DNA, 23 bp, Homo sapiens
ctggcccagccaaaccctgtctg

SEQ ID NO: 6178451 - DNA, 22 bp, Homo sapiens
ctggcccagccaactgccccgg

SEQ ID NO: 6178452 - DNA, 14 bp, Homo sapiens
ctggcccagccagc

SEQ ID NO: 6178453 - DNA, 15 bp, Homo sapiens
ctggcccagccagca

SEQ ID NO: 6178454 - DNA, 15 bp, Homo sapiens
ctggcccagccagcc

SEQ ID NO: 6178455 - DNA, 16 bp, Homo sapiens
ctggcccagccagcca

SEQ ID NO: 6178456 - DNA, 15 bp, Homo sapiens
ctggcccagccatgg

SEQ ID NO: 6178457 - DNA, 13 bp, Homo sapiens
ctggcccagccct

SEQ ID NO: 6178458 - DNA, 18 bp, Homo sapiens
ctggcccagccctgctgg

SEQ ID NO: 6178459 - DNA, 21 bp, Homo sapiens
ctggcccagcctgtggcctca

SEQ ID NO: 6178460 - DNA, 22 bp, Homo sapiens
ctggcccagcctgtggcctcag

SEQ ID NO: 6178461 - DNA, 23 bp, Homo sapiens
ctggcccagcctgtggcctcagc

SEQ ID NO: 6178462 - DNA, 13 bp, Homo sapiens
ctggcccagcctt

SEQ ID NO: 6178463 - DNA, 15 bp, Homo sapiens
ctggcccagcctttg

SEQ ID NO: 6178464 - DNA, 12 bp, Homo sapiens
ctggcccagcgg

SEQ ID NO: 6178465 - DNA, 13 bp, Homo sapiens
ctggcccagcggc

SEQ ID NO: 6178466 - DNA, 18 bp, Homo sapiens
ctggcccagcggcccctc

SEQ ID NO: 6178467 - DNA, 21 bp, Homo sapiens
ctggcccaggccttgctgact

SEQ ID NO: 6178468 - DNA, 21 bp, Homo sapiens
ctggcccaggctggcccccac

SEQ ID NO: 6178469 - DNA, 13 bp, Homo sapiens
ctggcccagggca

SEQ ID NO: 6178470 - DNA, 20 bp, Homo sapiens
ctggcccagggcatctggga

SEQ ID NO: 6178471 - DNA, 16 bp, Homo sapiens
ctggcccagggcccag

SEQ ID NO: 6178472 - DNA, 17 bp, Homo sapiens
ctggcccagggcccaga

SEQ ID NO: 6178473 - DNA, 19 bp, Homo sapiens
ctggcccagggcccagagc

SEQ ID NO: 6178474 - DNA, 21 bp, Homo sapiens
ctggcccagggggcctggagc

SEQ ID NO: 6178475 - DNA, 16 bp, Homo sapiens
ctggcccagggtaggg

SEQ ID NO: 6178476 - DNA, 19 bp, Homo sapiens
ctggcccagggtaggggag

SEQ ID NO: 6178477 - DNA, 13 bp, Homo sapiens
ctggcccaggtgc

SEQ ID NO: 6178478 - DNA, 14 bp, Homo sapiens
ctggcccaggtgcc

SEQ ID NO: 6178479 - DNA, 12 bp, Homo sapiens
ctggcccagtga

SEQ ID NO: 6178480 - DNA, 13 bp, Homo sapiens
ctggcccagtgag

SEQ ID NO: 6178481 - DNA, 14 bp, Homo sapiens
ctggcccagtgcca

SEQ ID NO: 6178482 - DNA, 16 bp, Homo sapiens
ctggcccagtgccagc

SEQ ID NO: 6178483 - DNA, 21 bp, Homo sapiens
ctggcccatagaaacatgaca

SEQ ID NO: 6178484 - DNA, 23 bp, Homo sapiens
ctggcccatagaaacatgacact

SEQ ID NO: 6178485 - DNA, 19 bp, Homo sapiens
ctggcccatctcagcctcc

SEQ ID NO: 6178486 - DNA, 15 bp, Homo sapiens
ctggccccaaatgtt

SEQ ID NO: 6178487 - DNA, 21 bp, Homo sapiens
ctggccccaaatgttctttcc

SEQ ID NO: 6178488 - DNA, 17 bp, Homo sapiens
ctggccccacaccagcc

SEQ ID NO: 6178489 - DNA, 13 bp, Homo sapiens
ctggccccacagg

SEQ ID NO: 6178490 - DNA, 12 bp, Homo sapiens
ctggccccagcc

SEQ ID NO: 6178491 - DNA, 15 bp, Homo sapiens
ctggccccagccccc

SEQ ID NO: 6178492 - DNA, 15 bp, Homo sapiens
ctggccccagccctg

SEQ ID NO: 6178493 - DNA, 18 bp, Homo sapiens
ctggccccagccctgctg

SEQ ID NO: 6178494 - DNA, 23 bp, Homo sapiens
cttggtttttttttttcttaaat

SEQ ID NO: 6178495 - DNA, 21 bp, Homo sapiens
cttgtaaaaatagcaaaatat

SEQ ID NO: 6178496 - DNA, 13 bp, Homo sapiens
cttgtaaaaatat

SEQ ID NO: 6178497 - DNA, 20 bp, Homo sapiens
cttgtaaaactgtgacattc

SEQ ID NO: 6178498 - DNA, 18 bp, Homo sapiens
cttgtaaaagacagtgta

SEQ ID NO: 6178499 - DNA, 17 bp, Homo sapiens
cttgtaaacagaagcaa

SEQ ID NO: 6178500 - DNA, 15 bp, Homo sapiens
cttgtaaacctggag

SEQ ID NO: 6178501 - DNA, 18 bp, Homo sapiens
cttgtaaagactgtagaa

SEQ ID NO: 6178502 - DNA, 19 bp, Homo sapiens
cttgtaaaggaatttaaaa

SEQ ID NO: 6178503 - DNA, 22 bp, Homo sapiens
cttgtaaataaagtctattttt

SEQ ID NO: 6178504 - DNA, 13 bp, Homo sapiens
cttgtaaataaat

SEQ ID NO: 6178505 - DNA, 14 bp, Homo sapiens
cttgtaaataccag

SEQ ID NO: 6178506 - DNA, 13 bp, Homo sapiens
cttgtaaatactc

SEQ ID NO: 6178507 - DNA, 13 bp, Homo sapiens
cttgtaaatatgg

SEQ ID NO: 6178508 - DNA, 12 bp, Homo sapiens
cttgtaaatatt

SEQ ID NO: 6178509 - DNA, 18 bp, Homo sapiens
cttgtaaatctttttgct

SEQ ID NO: 6178510 - DNA, 23 bp, Homo sapiens
cttgtaaatgtgttggacaaatg

SEQ ID NO: 6178511 - DNA, 14 bp, Homo sapiens
cttgtaaatgtttc

SEQ ID NO: 6178512 - DNA, 23 bp, Homo sapiens
cttgtaaattattaatttatgca

SEQ ID NO: 6178513 - DNA, 22 bp, Homo sapiens
cttgtaaattgatgggagaaat

SEQ ID NO: 6178514 - DNA, 14 bp, Homo sapiens
cttgtaaccagtgc

SEQ ID NO: 6178515 - DNA, 14 bp, Homo sapiens
cttgtaactaaaat

SEQ ID NO: 6178516 - DNA, 17 bp, Homo sapiens
cttgtaactaaaataat

SEQ ID NO: 6178517 - DNA, 20 bp, Homo sapiens
cttgtaagagctatacagtt

SEQ ID NO: 6178518 - DNA, 17 bp, Homo sapiens
cttgtaagatggataat

SEQ ID NO: 6178519 - DNA, 13 bp, Homo sapiens
cttgtaataaata

SEQ ID NO: 6178520 - DNA, 18 bp, Homo sapiens
cttgtaataaatttctaa

SEQ ID NO: 6178521 - DNA, 22 bp, Homo sapiens
cttgtaatacctgattgatcac

SEQ ID NO: 6178522 - DNA, 14 bp, Homo sapiens
cttgtaatatttct

SEQ ID NO: 6178523 - DNA, 15 bp, Homo sapiens
cttgtaatatttctt

SEQ ID NO: 6178524 - DNA, 17 bp, Homo sapiens
cttgtaatattttgtat

SEQ ID NO: 6178525 - DNA, 20 bp, Homo sapiens
cttgtaatgatatagccaga

SEQ ID NO: 6178526 - DNA, 21 bp, Homo sapiens
cttgtaatgatatagccagaa

SEQ ID NO: 6178527 - DNA, 14 bp, Homo sapiens
cttgtaattatgga

SEQ ID NO: 6178528 - DNA, 18 bp, Homo sapiens
cttgtaattatggagtca

SEQ ID NO: 6178529 - DNA, 13 bp, Homo sapiens
cttgtaattctaa

SEQ ID NO: 6178530 - DNA, 23 bp, Homo sapiens
cttgtaattctaaatgaatgttt

SEQ ID NO: 6178531 - DNA, 18 bp, Homo sapiens
cttgtaattgtggattaa

SEQ ID NO: 6178532 - DNA, 23 bp, Homo sapiens
cttgtaatttaaacaggcccagc

SEQ ID NO: 6178533 - DNA, 13 bp, Homo sapiens
cttgtaatttcta

SEQ ID NO: 6178534 - DNA, 16 bp, Homo sapiens
cttgtaatttttattt

SEQ ID NO: 6178535 - DNA, 12 bp, Homo sapiens
cttgtacaaaat

SEQ ID NO: 6178536 - DNA, 14 bp, Homo sapiens
cttgtacaaacttt

SEQ ID NO: 6178537 - DNA, 14 bp, Homo sapiens
cttgtacagtctgc

SEQ ID NO: 6178538 - DNA, 20 bp, Homo sapiens
cttgtacagtctgctcctct

SEQ ID NO: 6178539 - DNA, 12 bp, Homo sapiens
cttgtacagtgt

SEQ ID NO: 6178540 - DNA, 19 bp, Homo sapiens
cttgtacataatgcgtgca

SEQ ID NO: 6178541 - DNA, 21 bp, Homo sapiens
cttgtacatggaattttttga

SEQ ID NO: 6178542 - DNA, 20 bp, Homo sapiens
cttgtacatgtgtagcctgt

SEQ ID NO: 6178543 - DNA, 20 bp, Homo sapiens
cttgtacatttttaaattct

SEQ ID NO: 6178544 - DNA, 15 bp, Homo sapiens
cttgtaccagcccag

SEQ ID NO: 6178545 - DNA, 23 bp, Homo sapiens
cttgtaccgatgcagctctcttt

SEQ ID NO: 6178546 - DNA, 23 bp, Homo sapiens
cttgtacctctggctgactaaat

SEQ ID NO: 6178547 - DNA, 20 bp, Homo sapiens
cttgtaccttgagttgagta

SEQ ID NO: 6178548 - DNA, 24 bp, Homo sapiens
cttgtactaagccaggaggcttta

SEQ ID NO: 6178549 - DNA, 16 bp, Homo sapiens
cttgtactatgttaat

SEQ ID NO: 6178550 - DNA, 17 bp, Homo sapiens
cttgtactatgttaata

SEQ ID NO: 6178551 - DNA, 17 bp, Homo sapiens
cttgtactcttaggata

SEQ ID NO: 6178552 - DNA, 21 bp, Homo sapiens
cttgtacttacactgaaatcc

SEQ ID NO: 6178553 - DNA, 13 bp, Homo sapiens
cttgtacttctgt

SEQ ID NO: 6178554 - DNA, 21 bp, Homo sapiens
cttgtacttctgtgttcattt

SEQ ID NO: 6178555 - DNA, 13 bp, Homo sapiens
cttgtacttgctt

SEQ ID NO: 6178556 - DNA, 18 bp, Homo sapiens
cttgtacttgtttcatct

SEQ ID NO: 6178557 - DNA, 16 bp, Homo sapiens
cttgtactttacaatc

SEQ ID NO: 6178558 - DNA, 17 bp, Homo sapiens
cttgtactttattttct

SEQ ID NO: 6178559 - DNA, 20 bp, Homo sapiens
cttgtagaaaaatccctcca

SEQ ID NO: 6178560 - DNA, 17 bp, Homo sapiens
cttgtagaaatctgtaa

SEQ ID NO: 6178561 - DNA, 19 bp, Homo sapiens
cttgtagaactcactctgg

SEQ ID NO: 6178562 - DNA, 23 bp, Homo sapiens
cttgtagaactcactctgggctg

SEQ ID NO: 6178563 - DNA, 14 bp, Homo sapiens
cttgtagatttgat

SEQ ID NO: 6178564 - DNA, 13 bp, Homo sapiens
cttgtagccagaa

SEQ ID NO: 6178565 - DNA, 15 bp, Homo sapiens
cttgtagccagaatg

SEQ ID NO: 6178566 - DNA, 16 bp, Homo sapiens
cttgtagccagccggg

SEQ ID NO: 6178567 - DNA, 21 bp, Homo sapiens
cttgtagccagccggggcgag

SEQ ID NO: 6178568 - DNA, 20 bp, Homo sapiens
cttgtagccctggatggcct

SEQ ID NO: 6178569 - DNA, 19 bp, Homo sapiens
cttgtagctcctcccctgg

SEQ ID NO: 6178570 - DNA, 19 bp, Homo sapiens
cttgtagctggactgcaat

SEQ ID NO: 6178571 - DNA, 13 bp, Homo sapiens
cttgtagctgtaa

SEQ ID NO: 6178572 - DNA, 15 bp, Homo sapiens
cttgtagctgtaaaa

SEQ ID NO: 6178573 - DNA, 16 bp, Homo sapiens
cttgtagctgtaaaac

SEQ ID NO: 6178574 - DNA, 22 bp, Homo sapiens
cttgtaggggaggggctccttt

SEQ ID NO: 6178575 - DNA, 13 bp, Homo sapiens
cttgtagggtgag

SEQ ID NO: 6178576 - DNA, 22 bp, Homo sapiens
cttgtaggtaagttggctcaca

SEQ ID NO: 6178577 - DNA, 15 bp, Homo sapiens
cttgtaggtatgtct

SEQ ID NO: 6178578 - DNA, 18 bp, Homo sapiens
cttgtaggtatgtctgtg

SEQ ID NO: 6178579 - DNA, 20 bp, Homo sapiens
cttgtaggtatgtctgtgcc

SEQ ID NO: 6178580 - DNA, 20 bp, Homo sapiens
cttgtaggtttctctgcctc

SEQ ID NO: 6178581 - DNA, 13 bp, Homo sapiens
cttgtagttcttt

SEQ ID NO: 6178582 - DNA, 15 bp, Homo sapiens
cttgtataaatgtat

SEQ ID NO: 6178583 - DNA, 19 bp, Homo sapiens
cttgtataaatgtatatac

SEQ ID NO: 6178584 - DNA, 23 bp, Homo sapiens
cttgtataaatgtatatacacat

SEQ ID NO: 6178585 - DNA, 14 bp, Homo sapiens
cttgtataacatca

SEQ ID NO: 6178586 - DNA, 18 bp, Homo sapiens
cttgtataacatcactgt

SEQ ID NO: 6178587 - DNA, 21 bp, Homo sapiens
cttgtataacatcactgtcaa

SEQ ID NO: 6178588 - DNA, 15 bp, Homo sapiens
cttgtataaggagct

SEQ ID NO: 6178589 - DNA, 20 bp, Homo sapiens
cttgtataaggagctttgct

SEQ ID NO: 6178590 - DNA, 12 bp, Homo sapiens
cttgtataatat

SEQ ID NO: 6178591 - DNA, 22 bp, Homo sapiens
cttgtatagctgaaattccagt

SEQ ID NO: 6178592 - DNA, 20 bp, Homo sapiens
cttgtatatacatattataa

SEQ ID NO: 6178593 - DNA, 16 bp, Homo sapiens
cttgtatattccacca

SEQ ID NO: 6178594 - DNA, 15 bp, Homo sapiens
cttgtatcaaatgtt

SEQ ID NO: 6178595 - DNA, 16 bp, Homo sapiens
cttgtatcaaatgtta

SEQ ID NO: 6178596 - DNA, 19 bp, Homo sapiens
cttgtatcaacactgttac

SEQ ID NO: 6178597 - DNA, 20 bp, Homo sapiens
cttgtatctgatatcagcac

SEQ ID NO: 6178598 - DNA, 23 bp, Homo sapiens
cttgtatgcaaatgagttcagga

SEQ ID NO: 6178599 - DNA, 22 bp, Homo sapiens
cttgtatgcttttataggcctg

SEQ ID NO: 6178600 - DNA, 23 bp, Homo sapiens
cttgtatgtaaggaggtttgtat

SEQ ID NO: 6178601 - DNA, 14 bp, Homo sapiens
cttgtattaagaat

SEQ ID NO: 6178602 - DNA, 17 bp, Homo sapiens
cttgtattaagttgtta

SEQ ID NO: 6178603 - DNA, 22 bp, Homo sapiens
cttgtattatctcctttgaaga

SEQ ID NO: 6178604 - DNA, 13 bp, Homo sapiens
cttgtattatgtg

SEQ ID NO: 6178605 - DNA, 18 bp, Homo sapiens
cttgtattatgtgtgttt

SEQ ID NO: 6178606 - DNA, 16 bp, Homo sapiens
cttgtattcctaactg

SEQ ID NO: 6178607 - DNA, 20 bp, Homo sapiens
cttgtattctctttaccttc

SEQ ID NO: 6178608 - DNA, 18 bp, Homo sapiens
cttgtattctgaggatgt

SEQ ID NO: 6178609 - DNA, 14 bp, Homo sapiens
cttgtattgacttt

SEQ ID NO: 6178610 - DNA, 14 bp, Homo sapiens
cttgtattgctcca

SEQ ID NO: 6178611 - DNA, 17 bp, Homo sapiens
cttgtattgtaaatgtg

SEQ ID NO: 6178612 - DNA, 15 bp, Homo sapiens
cttgtatttaaaaac

SEQ ID NO: 6178613 - DNA, 20 bp, Homo sapiens
cttgtatttaaaaacatttt

SEQ ID NO: 6178614 - DNA, 18 bp, Homo sapiens
cttgtatttaaatattaa

SEQ ID NO: 6178615 - DNA, 13 bp, Homo sapiens
cttgtatttaatt

SEQ ID NO: 6178616 - DNA, 16 bp, Homo sapiens
cttgtatttaattctt

SEQ ID NO: 6178617 - DNA, 14 bp, Homo sapiens
cttgtattttctta

SEQ ID NO: 6178618 - DNA, 19 bp, Homo sapiens
cttgtattttgttaaagct

SEQ ID NO: 6178619 - DNA, 23 bp, Homo sapiens
cttgtcaaagaaggtgctgatcc

SEQ ID NO: 6178620 - DNA, 19 bp, Homo sapiens
cttgtcaagcctgtgcaaa

SEQ ID NO: 6178621 - DNA, 18 bp, Homo sapiens
cttgtcaaggaatgttat

SEQ ID NO: 6178622 - DNA, 15 bp, Homo sapiens
cttgtcaataaaaat

SEQ ID NO: 6178623 - DNA, 23 bp, Homo sapiens
cttgtcaataaaatccatacatt

SEQ ID NO: 6178624 - DNA, 15 bp, Homo sapiens
cttgtcaatatttaa

SEQ ID NO: 6178625 - DNA, 22 bp, Homo sapiens
cttgtcaatatttaaacatggt

SEQ ID NO: 6178626 - DNA, 22 bp, Homo sapiens
cttgtcacaaagtgagaaatta

SEQ ID NO: 6178627 - DNA, 17 bp, Homo sapiens
cttgtcacaataaatgt

SEQ ID NO: 6178628 - DNA, 13 bp, Homo sapiens
cttgtcacatgga

SEQ ID NO: 6178629 - DNA, 22 bp, Homo sapiens
cttgtcaccagttaaaagcatt

SEQ ID NO: 6178630 - DNA, 22 bp, Homo sapiens
cttgtcacccaaagcctgtccc

SEQ ID NO: 6178631 - DNA, 13 bp, Homo sapiens
cttgtcaccccag

SEQ ID NO: 6178632 - DNA, 18 bp, Homo sapiens
cttgtcacgccagacttc

SEQ ID NO: 6178633 - DNA, 23 bp, Homo sapiens
cttgtcacgccagacttcccacg

SEQ ID NO: 6178634 - DNA, 20 bp, Homo sapiens
cttgtcactagcagctgcag

SEQ ID NO: 6178635 - DNA, 20 bp, Homo sapiens
cttgtcactatgctatttct

SEQ ID NO: 6178636 - DNA, 18 bp, Homo sapiens
cttgtcactgacacaaag

SEQ ID NO: 6178637 - DNA, 23 bp, Homo sapiens
cttgtcactgacacaaaggaagt

SEQ ID NO: 6178638 - DNA, 22 bp, Homo sapiens
cttgtcactggtagaccaaaat

SEQ ID NO: 6178639 - DNA, 13 bp, Homo sapiens
cttgtcacttgca

SEQ ID NO: 6178640 - DNA, 18 bp, Homo sapiens
cttgtcagacataaagcc

SEQ ID NO: 6178641 - DNA, 15 bp, Homo sapiens
cttgtcagagctggg

SEQ ID NO: 6178642 - DNA, 21 bp, Homo sapiens
cttgtcagagctgggaggggt

SEQ ID NO: 6178643 - DNA, 21 bp, Homo sapiens
cttgtcaggagtgtgtgtgag

SEQ ID NO: 6178644 - DNA, 23 bp, Homo sapiens
cttgtcagtgtgtcagtttttcc

SEQ ID NO: 6178645 - DNA, 16 bp, Homo sapiens
cttgtcataaaatgca

SEQ ID NO: 6178646 - DNA, 15 bp, Homo sapiens
cttgtcatatgtgtt

SEQ ID NO: 6178647 - DNA, 18 bp, Homo sapiens
cttgtcatatgtgttgat

SEQ ID NO: 6178648 - DNA, 12 bp, Homo sapiens
cttgtcatcttt

SEQ ID NO: 6178649 - DNA, 22 bp, Homo sapiens
cttgtcatcttttagagtaaac

SEQ ID NO: 6178650 - DNA, 17 bp, Homo sapiens
cttgtcatgtaccatca

SEQ ID NO: 6178651 - DNA, 12 bp, Homo sapiens
cttgtcatgtgt

SEQ ID NO: 6178652 - DNA, 16 bp, Homo sapiens
cttgtcattctgctaa

SEQ ID NO: 6178653 - DNA, 16 bp, Homo sapiens
cttgtcattgccttcg

SEQ ID NO: 6178654 - DNA, 18 bp, Homo sapiens
cttgtcattttttttctt

SEQ ID NO: 6178655 - DNA, 20 bp, Homo sapiens
cttgtccaacccgaggcccg

SEQ ID NO: 6178656 - DNA, 18 bp, Homo sapiens
cttgtccaagttgtttca

SEQ ID NO: 6178657 - DNA, 14 bp, Homo sapiens
cttgtccacattct

SEQ ID NO: 6178658 - DNA, 12 bp, Homo sapiens
cttgtccagctg

SEQ ID NO: 6178659 - DNA, 20 bp, Homo sapiens
cttgtccaggtctcactgct

SEQ ID NO: 6178660 - DNA, 22 bp, Homo sapiens
cttgtccattgcgttattttct

SEQ ID NO: 6178661 - DNA, 19 bp, Homo sapiens
cttgtcccaattaaaatac

SEQ ID NO: 6178662 - DNA, 16 bp, Homo sapiens
cttgtcccactcaagc

SEQ ID NO: 6178663 - DNA, 19 bp, Homo sapiens
cttgtcccatgtggcttgt

SEQ ID NO: 6178664 - DNA, 16 bp, Homo sapiens
cttgtccccacactcc

SEQ ID NO: 6178665 - DNA, 18 bp, Homo sapiens
cttgtccccacactccta

SEQ ID NO: 6178666 - DNA, 13 bp, Homo sapiens
cttgtccccaccc

SEQ ID NO: 6178667 - DNA, 15 bp, Homo sapiens
cttgtccccacccat

SEQ ID NO: 6178668 - DNA, 16 bp, Homo sapiens
cttgtccccagctcca

SEQ ID NO: 6178669 - DNA, 14 bp, Homo sapiens
cttgtccctccaac

SEQ ID NO: 6178670 - DNA, 14 bp, Homo sapiens
cttgtccctctcac

SEQ ID NO: 6178671 - DNA, 23 bp, Homo sapiens
cttgtccctggggcactccccca

SEQ ID NO: 6178672 - DNA, 19 bp, Homo sapiens
ctggccccagccctgctgg

SEQ ID NO: 6178673 - DNA, 13 bp, Homo sapiens
ctggccccagcct

SEQ ID NO: 6178674 - DNA, 13 bp, Homo sapiens
ctggccccagctc

SEQ ID NO: 6178675 - DNA, 14 bp, Homo sapiens
ctggccccagctcc

SEQ ID NO: 6178676 - DNA, 13 bp, Homo sapiens
ctggccccaggac

SEQ ID NO: 6178677 - DNA, 20 bp, Homo sapiens
ctggccccaggacctggctg

SEQ ID NO: 6178678 - DNA, 18 bp, Homo sapiens
ctggccccaggccccaga

SEQ ID NO: 6178679 - DNA, 18 bp, Homo sapiens
ctggccccaggcggaggg

SEQ ID NO: 6178680 - DNA, 23 bp, Homo sapiens
ctggccccagtgcggttcctcat

SEQ ID NO: 6178681 - DNA, 16 bp, Homo sapiens
ctggccccatgtctct

SEQ ID NO: 6178682 - DNA, 19 bp, Homo sapiens
ctggccccatgtctctcag

SEQ ID NO: 6178683 - DNA, 22 bp, Homo sapiens
ctggcccccaacctcagggctc

SEQ ID NO: 6178684 - DNA, 13 bp, Homo sapiens
ctggcccccacag

SEQ ID NO: 6178685 - DNA, 23 bp, Homo sapiens
ctggcccccactggctgtgggct

SEQ ID NO: 6178686 - DNA, 16 bp, Homo sapiens
ctggcccccagccctg

SEQ ID NO: 6178687 - DNA, 17 bp, Homo sapiens
ctggcccccagccctgg

SEQ ID NO: 6178688 - DNA, 15 bp, Homo sapiens
ctggcccccagctgt

SEQ ID NO: 6178689 - DNA, 23 bp, Homo sapiens
ctggcccccagcttcacctctgg

SEQ ID NO: 6178690 - DNA, 22 bp, Homo sapiens
ctggcccccaggattcccccag

SEQ ID NO: 6178691 - DNA, 19 bp, Homo sapiens
ctggcccccatcagccctg

SEQ ID NO: 6178692 - DNA, 15 bp, Homo sapiens
ctggcccccctccag

SEQ ID NO: 6178693 - DNA, 16 bp, Homo sapiens
ctggcccccctccagg

SEQ ID NO: 6178694 - DNA, 17 bp, Homo sapiens
ctggcccccgacccagc

SEQ ID NO: 6178695 - DNA, 18 bp, Homo sapiens
ctggccccctcagctctg

SEQ ID NO: 6178696 - DNA, 14 bp, Homo sapiens
ctggccccctcatt

SEQ ID NO: 6178697 - DNA, 18 bp, Homo sapiens
ctggccccctcattcaga

SEQ ID NO: 6178698 - DNA, 16 bp, Homo sapiens
ctggccccctccctgg

SEQ ID NO: 6178699 - DNA, 15 bp, Homo sapiens
ctggccccctcgcgc

SEQ ID NO: 6178700 - DNA, 18 bp, Homo sapiens
ctggccccgcccctgccc

SEQ ID NO: 6178701 - DNA, 17 bp, Homo sapiens
ctggccccgcctgcctg

SEQ ID NO: 6178702 - DNA, 21 bp, Homo sapiens
ctggccccgctagcggggcca

SEQ ID NO: 6178703 - DNA, 19 bp, Homo sapiens
ctggccccggatcagagca

SEQ ID NO: 6178704 - DNA, 21 bp, Homo sapiens
ctggccccggatcagagcagg

SEQ ID NO: 6178705 - DNA, 18 bp, Homo sapiens
ctggcccctcaacctcct

SEQ ID NO: 6178706 - DNA, 12 bp, Homo sapiens
ctggcccctcac

SEQ ID NO: 6178707 - DNA, 15 bp, Homo sapiens
ctggcccctcacctg

SEQ ID NO: 6178708 - DNA, 12 bp, Homo sapiens
ctggcccctcca

SEQ ID NO: 6178709 - DNA, 20 bp, Homo sapiens
ctggcccctccagaccctgc

SEQ ID NO: 6178710 - DNA, 15 bp, Homo sapiens
ctggcccctcccaca

SEQ ID NO: 6178711 - DNA, 15 bp, Homo sapiens
ctggcccctctccct

SEQ ID NO: 6178712 - DNA, 22 bp, Homo sapiens
ctggcccctgagatctctgcag

SEQ ID NO: 6178713 - DNA, 17 bp, Homo sapiens
ctggcccctggcctgcc

SEQ ID NO: 6178714 - DNA, 13 bp, Homo sapiens
ctggcccctgggt

SEQ ID NO: 6178715 - DNA, 19 bp, Homo sapiens
ctggcccctgtggggaaca

SEQ ID NO: 6178716 - DNA, 19 bp, Homo sapiens
ctggcccgcccctcgctgc

SEQ ID NO: 6178717 - DNA, 22 bp, Homo sapiens
ctggcccgccctcacctctgat

SEQ ID NO: 6178718 - DNA, 14 bp, Homo sapiens
ctggcccggtccca

SEQ ID NO: 6178719 - DNA, 16 bp, Homo sapiens
ctggcccggtcccagt

SEQ ID NO: 6178720 - DNA, 18 bp, Homo sapiens
ctggcccggtcccagtcc

SEQ ID NO: 6178721 - DNA, 22 bp, Homo sapiens
ctggcccgtcatgttcctcaaa

SEQ ID NO: 6178722 - DNA, 16 bp, Homo sapiens
ctggcccgtgacagac

SEQ ID NO: 6178723 - DNA, 13 bp, Homo sapiens
ctggccctagact

SEQ ID NO: 6178724 - DNA, 19 bp, Homo sapiens
ctggccctagactcggggt

SEQ ID NO: 6178725 - DNA, 12 bp, Homo sapiens
ctggccctaggc

SEQ ID NO: 6178726 - DNA, 13 bp, Homo sapiens
ctggccctaggca

SEQ ID NO: 6178727 - DNA, 18 bp, Homo sapiens
ctggccctcaaggcctcc

SEQ ID NO: 6178728 - DNA, 19 bp, Homo sapiens
ctggccctcaaggcctccc

SEQ ID NO: 6178729 - DNA, 24 bp, Homo sapiens
ctggccctcaaggcctcccacagt

SEQ ID NO: 6178730 - DNA, 19 bp, Homo sapiens
ctggccctcacccctgccc

SEQ ID NO: 6178731 - DNA, 22 bp, Homo sapiens
ctggccctcacccctgccctgg

SEQ ID NO: 6178732 - DNA, 13 bp, Homo sapiens
ctggccctcactc

SEQ ID NO: 6178733 - DNA, 16 bp, Homo sapiens
ctggccctcagctccc

SEQ ID NO: 6178734 - DNA, 19 bp, Homo sapiens
ctggccctcagctccctga

SEQ ID NO: 6178735 - DNA, 21 bp, Homo sapiens
ctggccctccactcctcatcc

SEQ ID NO: 6178736 - DNA, 14 bp, Homo sapiens
ctggccctccccac

SEQ ID NO: 6178737 - DNA, 19 bp, Homo sapiens
ctggccctccctccctagc

SEQ ID NO: 6178738 - DNA, 20 bp, Homo sapiens
ctggccctccctccctagcc

SEQ ID NO: 6178739 - DNA, 14 bp, Homo sapiens
ctggccctcctctg

SEQ ID NO: 6178740 - DNA, 17 bp, Homo sapiens
ctggccctcctctggtc

SEQ ID NO: 6178741 - DNA, 16 bp, Homo sapiens
ctggccctcgggccct

SEQ ID NO: 6178742 - DNA, 16 bp, Homo sapiens
ctggccctctctgaag

SEQ ID NO: 6178743 - DNA, 21 bp, Homo sapiens
ctggccctctctgaaggaggc

SEQ ID NO: 6178744 - DNA, 13 bp, Homo sapiens
ctggccctctgtg

SEQ ID NO: 6178745 - DNA, 16 bp, Homo sapiens
ctggccctctgtgttg

SEQ ID NO: 6178746 - DNA, 16 bp, Homo sapiens
ctggccctcttcttac

SEQ ID NO: 6178747 - DNA, 14 bp, Homo sapiens
ctggccctgcccag

SEQ ID NO: 6178748 - DNA, 15 bp, Homo sapiens
ctggccctgcccagc

SEQ ID NO: 6178749 - DNA, 16 bp, Homo sapiens
ctggccctgcccagcc

SEQ ID NO: 6178750 - DNA, 14 bp, Homo sapiens
ctggccctgccctg

SEQ ID NO: 6178751 - DNA, 16 bp, Homo sapiens
ctggccctgcctcctg

SEQ ID NO: 6178752 - DNA, 16 bp, Homo sapiens
ctggccctgctgcccc

SEQ ID NO: 6178753 - DNA, 17 bp, Homo sapiens
ctggccctgcttcctgc

SEQ ID NO: 6178754 - DNA, 23 bp, Homo sapiens
ctggccctgcttcctgcttgcca

SEQ ID NO: 6178755 - DNA, 11 bp, Homo sapiens
ctggccctggg

SEQ ID NO: 6178756 - DNA, 18 bp, Homo sapiens
ctggccctgggccccgcc

SEQ ID NO: 6178757 - DNA, 13 bp, Homo sapiens
ctggccctggggc

SEQ ID NO: 6178758 - DNA, 16 bp, Homo sapiens
ctggccctggggccat

SEQ ID NO: 6178759 - DNA, 19 bp, Homo sapiens
ctggccctggggcctgtac

SEQ ID NO: 6178760 - DNA, 20 bp, Homo sapiens
ctggccctggggtgtgtctc

SEQ ID NO: 6178761 - DNA, 15 bp, Homo sapiens
ctggccctgtgcaga

SEQ ID NO: 6178762 - DNA, 21 bp, Homo sapiens
ctggccctgtgcagaccttac

SEQ ID NO: 6178763 - DNA, 15 bp, Homo sapiens
ctggccctgttctcc

SEQ ID NO: 6178764 - DNA, 21 bp, Homo sapiens
ctggcccttacacactcaggc

SEQ ID NO: 6178765 - DNA, 13 bp, Homo sapiens
ctggcccttcagt

SEQ ID NO: 6178766 - DNA, 18 bp, Homo sapiens
ctggcccttcagtctgct

SEQ ID NO: 6178767 - DNA, 19 bp, Homo sapiens
ctggcccttcagtctgctc

SEQ ID NO: 6178768 - DNA, 12 bp, Homo sapiens
ctggcccttcct

SEQ ID NO: 6178769 - DNA, 14 bp, Homo sapiens
ctggcccttgccca

SEQ ID NO: 6178770 - DNA, 18 bp, Homo sapiens
ctggcccttgcccaactc

SEQ ID NO: 6178771 - DNA, 18 bp, Homo sapiens
ctggcccttgcctttgtg

SEQ ID NO: 6178772 - DNA, 21 bp, Homo sapiens
ctggcccttgcctttgtggcc

SEQ ID NO: 6178773 - DNA, 12 bp, Homo sapiens
ctggcccttgga

SEQ ID NO: 6178774 - DNA, 13 bp, Homo sapiens
ctggcccttggaa

SEQ ID NO: 6178775 - DNA, 14 bp, Homo sapiens
ctggccctttcacc

SEQ ID NO: 6178776 - DNA, 12 bp, Homo sapiens
ctggccctttcc

SEQ ID NO: 6178777 - DNA, 14 bp, Homo sapiens
ctggccctttcccc

SEQ ID NO: 6178778 - DNA, 16 bp, Homo sapiens
ctggccctttcccctt

SEQ ID NO: 6178779 - DNA, 17 bp, Homo sapiens
ctggccgacccactgac

SEQ ID NO: 6178780 - DNA, 21 bp, Homo sapiens
ctggccgacggacccctttca

SEQ ID NO: 6178781 - DNA, 19 bp, Homo sapiens
ctggccgagggtcctggct

SEQ ID NO: 6178782 - DNA, 22 bp, Homo sapiens
ctggccgatgtgggtccctctc

SEQ ID NO: 6178783 - DNA, 19 bp, Homo sapiens
ctggccgcaagtccccagc

SEQ ID NO: 6178784 - DNA, 15 bp, Homo sapiens
ctggccgcagaggtg

SEQ ID NO: 6178785 - DNA, 13 bp, Homo sapiens
ctggccgccaccc

SEQ ID NO: 6178786 - DNA, 16 bp, Homo sapiens
ctggccgccaccccca

SEQ ID NO: 6178787 - DNA, 21 bp, Homo sapiens
ctggccgcccccagccccctc

SEQ ID NO: 6178788 - DNA, 13 bp, Homo sapiens
ctggccgccccct

SEQ ID NO: 6178789 - DNA, 18 bp, Homo sapiens
ctggccgcctcaccccct

SEQ ID NO: 6178790 - DNA, 15 bp, Homo sapiens
ctggccgcctccagg

SEQ ID NO: 6178791 - DNA, 18 bp, Homo sapiens
ctggccgcctccaggagc

SEQ ID NO: 6178792 - DNA, 20 bp, Homo sapiens
ctggccgcgctccgggcttt

SEQ ID NO: 6178793 - DNA, 22 bp, Homo sapiens
ctggccgcgtttagaccaagga

SEQ ID NO: 6178794 - DNA, 16 bp, Homo sapiens
ctggccgctaagttgc

SEQ ID NO: 6178795 - DNA, 15 bp, Homo sapiens
ctggccgctgtgcca

SEQ ID NO: 6178796 - DNA, 18 bp, Homo sapiens
ctggccgcttctccccag

SEQ ID NO: 6178797 - DNA, 21 bp, Homo sapiens
ctggccgcttctccccagagc

SEQ ID NO: 6178798 - DNA, 22 bp, Homo sapiens
ctggccggagcaaactctgctg

SEQ ID NO: 6178799 - DNA, 18 bp, Homo sapiens
ctggccggcaaccccagt

SEQ ID NO: 6178800 - DNA, 23 bp, Homo sapiens
ctggccggccagccagccactct

SEQ ID NO: 6178801 - DNA, 20 bp, Homo sapiens
ctggccggcccacgtcctgg

SEQ ID NO: 6178802 - DNA, 23 bp, Homo sapiens
ctggccggcccacgtcctgggtg

SEQ ID NO: 6178803 - DNA, 19 bp, Homo sapiens
ctggccggcccaggcctcc

SEQ ID NO: 6178804 - DNA, 18 bp, Homo sapiens
ctggccggccgcccacat

SEQ ID NO: 6178805 - DNA, 23 bp, Homo sapiens
ctggccggctccagtttccccat

SEQ ID NO: 6178806 - DNA, 23 bp, Homo sapiens
ctggccgggactgctgctctccc

SEQ ID NO: 6178807 - DNA, 16 bp, Homo sapiens
ctggccgggagcctga

SEQ ID NO: 6178808 - DNA, 12 bp, Homo sapiens
ctggccgggcag

SEQ ID NO: 6178809 - DNA, 14 bp, Homo sapiens
ctggccgggcaggc

SEQ ID NO: 6178810 - DNA, 15 bp, Homo sapiens
ctggccgggcaggcg

SEQ ID NO: 6178811 - DNA, 18 bp, Homo sapiens
ctggccgggggaggtggg

SEQ ID NO: 6178812 - DNA, 20 bp, Homo sapiens
ctggccgggtcaccctgtga

SEQ ID NO: 6178813 - DNA, 16 bp, Homo sapiens
ctggccggtaggctgc

SEQ ID NO: 6178814 - DNA, 17 bp, Homo sapiens
ctggccggtaggctgct

SEQ ID NO: 6178815 - DNA, 19 bp, Homo sapiens
ctggccggtaggctgctgg

SEQ ID NO: 6178816 - DNA, 15 bp, Homo sapiens
ctggccggtccaccc

SEQ ID NO: 6178817 - DNA, 17 bp, Homo sapiens
ctggccggtccaccccg

SEQ ID NO: 6178818 - DNA, 21 bp, Homo sapiens
ctggccggtctgcaagtcaga

SEQ ID NO: 6178819 - DNA, 16 bp, Homo sapiens
ctggccggtgctgggt

SEQ ID NO: 6178820 - DNA, 20 bp, Homo sapiens
ctggccggtgctgggttccc

SEQ ID NO: 6178821 - DNA, 23 bp, Homo sapiens
ctggccgtatctgagggctgctc

SEQ ID NO: 6178822 - DNA, 15 bp, Homo sapiens
ctggccgtcacacgt

SEQ ID NO: 6178823 - DNA, 15 bp, Homo sapiens
ctggccgttcagcct

SEQ ID NO: 6178824 - DNA, 17 bp, Homo sapiens
ctggccgttcagcctgt

SEQ ID NO: 6178825 - DNA, 13 bp, Homo sapiens
ctggcctaaagaa

SEQ ID NO: 6178826 - DNA, 14 bp, Homo sapiens
ctggcctaatcctt

SEQ ID NO: 6178827 - DNA, 16 bp, Homo sapiens
ctggcctaccacagct

SEQ ID NO: 6178828 - DNA, 21 bp, Homo sapiens
ctggcctaccacagctgcctc

SEQ ID NO: 6178829 - DNA, 21 bp, Homo sapiens
ctggcctacccctttctccag

SEQ ID NO: 6178830 - DNA, 14 bp, Homo sapiens
ctggcctaggggcc

SEQ ID NO: 6178831 - DNA, 19 bp, Homo sapiens
ctggcctaggggccagggc

SEQ ID NO: 6178832 - DNA, 18 bp, Homo sapiens
ctggcctaggtgggagcc

SEQ ID NO: 6178833 - DNA, 12 bp, Homo sapiens
ctggcctagtcc

SEQ ID NO: 6178834 - DNA, 23 bp, Homo sapiens
ctggcctagtcccttccacaccc

SEQ ID NO: 6178835 - DNA, 21 bp, Homo sapiens
ctggcctagtggggaggggcc

SEQ ID NO: 6178836 - DNA, 19 bp, Homo sapiens
ctggcctatccgctgccag

SEQ ID NO: 6178837 - DNA, 18 bp, Homo sapiens
ctggcctatgaccctgtg

SEQ ID NO: 6178838 - DNA, 21 bp, Homo sapiens
ctggcctatgaccctgtgcct

SEQ ID NO: 6178839 - DNA, 23 bp, Homo sapiens
ctggcctatgaccctgtgcctgt

SEQ ID NO: 6178840 - DNA, 16 bp, Homo sapiens
ctggcctcaaagcaag

SEQ ID NO: 6178841 - DNA, 18 bp, Homo sapiens
ctggcctcaagccatctt

SEQ ID NO: 6178842 - DNA, 14 bp, Homo sapiens
ctggcctcacctgg

SEQ ID NO: 6178843 - DNA, 18 bp, Homo sapiens
ctggcctcacctgggttc

SEQ ID NO: 6178844 - DNA, 18 bp, Homo sapiens
ctggcctcacgcccagcc

SEQ ID NO: 6178845 - DNA, 22 bp, Homo sapiens
ctggcctcacgcccagcctcct

SEQ ID NO: 6178846 - DNA, 21 bp, Homo sapiens
ctggcctcactggctggggca

SEQ ID NO: 6178847 - DNA, 11 bp, Homo sapiens
ctggcctcaga

SEQ ID NO: 6178848 - DNA, 21 bp, Homo sapiens
ctggcctcagactcatacaga

SEQ ID NO: 6178849 - DNA, 23 bp, Homo sapiens
ctggcctcagactgcacccagga

SEQ ID NO: 6178850 - DNA, 17 bp, Homo sapiens
ctggcctcagagcttcc

SEQ ID NO: 6178851 - DNA, 20 bp, Homo sapiens
cttgtcctagcacagatggc

SEQ ID NO: 6178852 - DNA, 16 bp, Homo sapiens
cttgtcctcagtccat

SEQ ID NO: 6178853 - DNA, 22 bp, Homo sapiens
cttgtcctcagtccatttatat

SEQ ID NO: 6178854 - DNA, 14 bp, Homo sapiens
cttgtcctctcaga

SEQ ID NO: 6178855 - DNA, 21 bp, Homo sapiens
cttgtcctctcagagcctcag

SEQ ID NO: 6178856 - DNA, 22 bp, Homo sapiens
cttgtcctctcagagcctcagc

SEQ ID NO: 6178857 - DNA, 13 bp, Homo sapiens
cttgtcctctccc

SEQ ID NO: 6178858 - DNA, 13 bp, Homo sapiens
cttgtcctcttct

SEQ ID NO: 6178859 - DNA, 17 bp, Homo sapiens
cttgtcctgccagctgc

SEQ ID NO: 6178860 - DNA, 18 bp, Homo sapiens
cttgtcctgccagctgcc

SEQ ID NO: 6178861 - DNA, 18 bp, Homo sapiens
cttgtcctgctctcttca

SEQ ID NO: 6178862 - DNA, 22 bp, Homo sapiens
cttgtcctgctctcttcaggag

SEQ ID NO: 6178863 - DNA, 14 bp, Homo sapiens
cttgtcctggaata

SEQ ID NO: 6178864 - DNA, 13 bp, Homo sapiens
cttgtcctggccc

SEQ ID NO: 6178865 - DNA, 18 bp, Homo sapiens
cttgtcctggcccttcag

SEQ ID NO: 6178866 - DNA, 20 bp, Homo sapiens
cttgtcctggcccttcagtc

SEQ ID NO: 6178867 - DNA, 22 bp, Homo sapiens
cttgtcctggcccttcagtctg

SEQ ID NO: 6178868 - DNA, 19 bp, Homo sapiens
cttgtcctgtatagcaacc

SEQ ID NO: 6178869 - DNA, 14 bp, Homo sapiens
cttgtcctgtgctt

SEQ ID NO: 6178870 - DNA, 19 bp, Homo sapiens
cttgtccttagcctggacc

SEQ ID NO: 6178871 - DNA, 17 bp, Homo sapiens
cttgtccttgctcctgg

SEQ ID NO: 6178872 - DNA, 18 bp, Homo sapiens
cttgtcctttaatatttg

SEQ ID NO: 6178873 - DNA, 15 bp, Homo sapiens
cttgtcctttccctt

SEQ ID NO: 6178874 - DNA, 18 bp, Homo sapiens
cttgtcctttgaggcccc

SEQ ID NO: 6178875 - DNA, 19 bp, Homo sapiens
cttgtcctttgaggcccca

SEQ ID NO: 6178876 - DNA, 22 bp, Homo sapiens
cttgtcgcccctccctcccaga

SEQ ID NO: 6178877 - DNA, 19 bp, Homo sapiens
cttgtcgctttctcagtgt

SEQ ID NO: 6178878 - DNA, 21 bp, Homo sapiens
cttgtcgctttctcagtgtgt

SEQ ID NO: 6178879 - DNA, 14 bp, Homo sapiens
cttgtctaaagatc

SEQ ID NO: 6178880 - DNA, 14 bp, Homo sapiens
cttgtctcaatgct

SEQ ID NO: 6178881 - DNA, 21 bp, Homo sapiens
cttgtctcagattttattatg

SEQ ID NO: 6178882 - DNA, 14 bp, Homo sapiens
cttgtctcaggact

SEQ ID NO: 6178883 - DNA, 18 bp, Homo sapiens
cttgtctcattttaatgt

SEQ ID NO: 6178884 - DNA, 20 bp, Homo sapiens
cttgtctcccagctcagggc

SEQ ID NO: 6178885 - DNA, 22 bp, Homo sapiens
cttgtctccctggttgcctctc

SEQ ID NO: 6178886 - DNA, 18 bp, Homo sapiens
cttgtctcctactcctga

SEQ ID NO: 6178887 - DNA, 19 bp, Homo sapiens
cttgtctcctactcctgac

SEQ ID NO: 6178888 - DNA, 19 bp, Homo sapiens
cttgtctcctcctccagga

SEQ ID NO: 6178889 - DNA, 17 bp, Homo sapiens
cttgtctctctggcaat

SEQ ID NO: 6178890 - DNA, 13 bp, Homo sapiens
cttgtctctgggc

SEQ ID NO: 6178891 - DNA, 22 bp, Homo sapiens
cttgtctcttgcctgccactgt

SEQ ID NO: 6178892 - DNA, 23 bp, Homo sapiens
cttgtctcttgcctgccactgtg

SEQ ID NO: 6178893 - DNA, 17 bp, Homo sapiens
cttgtctgaatgtattt

SEQ ID NO: 6178894 - DNA, 20 bp, Homo sapiens
cttgtctgaggcctcatccc

SEQ ID NO: 6178895 - DNA, 14 bp, Homo sapiens
cttgtctgatttct

SEQ ID NO: 6178896 - DNA, 15 bp, Homo sapiens
cttgtctgcctcctg

SEQ ID NO: 6178897 - DNA, 16 bp, Homo sapiens
cttgtctgcctcctgc

SEQ ID NO: 6178898 - DNA, 14 bp, Homo sapiens
cttgtctgctgctc

SEQ ID NO: 6178899 - DNA, 20 bp, Homo sapiens
cttgtctggcaaaagaaaaa

SEQ ID NO: 6178900 - DNA, 13 bp, Homo sapiens
cttgtctggctgc

SEQ ID NO: 6178901 - DNA, 23 bp, Homo sapiens
cttgtctgggtgcagctgggctt

SEQ ID NO: 6178902 - DNA, 19 bp, Homo sapiens
cttgtctgtgatctctgct

SEQ ID NO: 6178903 - DNA, 12 bp, Homo sapiens
cttgtcttcccc

SEQ ID NO: 6178904 - DNA, 13 bp, Homo sapiens
cttgtcttccccc

SEQ ID NO: 6178905 - DNA, 23 bp, Homo sapiens
cttgtcttcccccctctcctccc

SEQ ID NO: 6178906 - DNA, 19 bp, Homo sapiens
cttgtcttcctatttcaga

SEQ ID NO: 6178907 - DNA, 21 bp, Homo sapiens
cttgtcttcctatttcagaag

SEQ ID NO: 6178908 - DNA, 13 bp, Homo sapiens
cttgtcttcgctg

SEQ ID NO: 6178909 - DNA, 18 bp, Homo sapiens
cttgtcttctagtttaga

SEQ ID NO: 6178910 - DNA, 18 bp, Homo sapiens
cttgtcttctggtacttt

SEQ ID NO: 6178911 - DNA, 15 bp, Homo sapiens
cttgtctttaaatct

SEQ ID NO: 6178912 - DNA, 14 bp, Homo sapiens
cttgtctttcaaaa

SEQ ID NO: 6178913 - DNA, 16 bp, Homo sapiens
cttgtctttctggggt

SEQ ID NO: 6178914 - DNA, 12 bp, Homo sapiens
cttgtctttgat

SEQ ID NO: 6178915 - DNA, 23 bp, Homo sapiens
cttgtctttgatatcagcccctg

SEQ ID NO: 6178916 - DNA, 13 bp, Homo sapiens
cttgtctttggac

SEQ ID NO: 6178917 - DNA, 20 bp, Homo sapiens
cttgtctttggaccctgagg

SEQ ID NO: 6178918 - DNA, 16 bp, Homo sapiens
cttgtctttgtccctg

SEQ ID NO: 6178919 - DNA, 15 bp, Homo sapiens
cttgtcttttcccct

SEQ ID NO: 6178920 - DNA, 17 bp, Homo sapiens
cttgtcttttcccctca

SEQ ID NO: 6178921 - DNA, 19 bp, Homo sapiens
cttgtcttttcccctcatt

SEQ ID NO: 6178922 - DNA, 14 bp, Homo sapiens
cttgtcttttctgc

SEQ ID NO: 6178923 - DNA, 15 bp, Homo sapiens
cttgtgaaaataatt

SEQ ID NO: 6178924 - DNA, 16 bp, Homo sapiens
cttgtgaaaataattg

SEQ ID NO: 6178925 - DNA, 21 bp, Homo sapiens
cttgtgaaaataattgacagg

SEQ ID NO: 6178926 - DNA, 14 bp, Homo sapiens
cttgtgaaaatgtg

SEQ ID NO: 6178927 - DNA, 17 bp, Homo sapiens
cttgtgaaacacagctg

SEQ ID NO: 6178928 - DNA, 19 bp, Homo sapiens
cttgtgaaacacagctgtt

SEQ ID NO: 6178929 - DNA, 19 bp, Homo sapiens
cttgtgaaacgtctggact

SEQ ID NO: 6178930 - DNA, 14 bp, Homo sapiens
cttgtgaaatgtct

SEQ ID NO: 6178931 - DNA, 17 bp, Homo sapiens
cttgtgaaattgtgtag

SEQ ID NO: 6178932 - DNA, 12 bp, Homo sapiens
cttgtgaacaga

SEQ ID NO: 6178933 - DNA, 13 bp, Homo sapiens
cttgtgaactgct

SEQ ID NO: 6178934 - DNA, 23 bp, Homo sapiens
cttgtgaactttgaatgaaattc

SEQ ID NO: 6178935 - DNA, 21 bp, Homo sapiens
cttgtgaaggccatgatattt

SEQ ID NO: 6178936 - DNA, 12 bp, Homo sapiens
cttgtgaagttg

SEQ ID NO: 6178937 - DNA, 19 bp, Homo sapiens
cttgtgaatcttaacattt

SEQ ID NO: 6178938 - DNA, 21 bp, Homo sapiens
cttgtgaatcttaacattttg

SEQ ID NO: 6178939 - DNA, 16 bp, Homo sapiens
cttgtgaatgcttctc

SEQ ID NO: 6178940 - DNA, 23 bp, Homo sapiens
cttgtgaatgtttagtgtgctgc

SEQ ID NO: 6178941 - DNA, 20 bp, Homo sapiens
cttgtgacagattatacaga

SEQ ID NO: 6178942 - DNA, 15 bp, Homo sapiens
cttgtgacagtgcct

SEQ ID NO: 6178943 - DNA, 18 bp, Homo sapiens
cttgtgacagtgcctctt

SEQ ID NO: 6178944 - DNA, 22 bp, Homo sapiens
cttgtgacagtgcctcttccag

SEQ ID NO: 6178945 - DNA, 12 bp, Homo sapiens
cttgtgacatat

SEQ ID NO: 6178946 - DNA, 15 bp, Homo sapiens
cttgtgacattaaaa

SEQ ID NO: 6178947 - DNA, 13 bp, Homo sapiens
cttgtgacccagc

SEQ ID NO: 6178948 - DNA, 17 bp, Homo sapiens
cttgtgacgtgcactgt

SEQ ID NO: 6178949 - DNA, 17 bp, Homo sapiens
cttgtgactagtgctga

SEQ ID NO: 6178950 - DNA, 19 bp, Homo sapiens
cttgtgactcagcagaggc

SEQ ID NO: 6178951 - DNA, 19 bp, Homo sapiens
cttgtgacttttgctttaa

SEQ ID NO: 6178952 - DNA, 21 bp, Homo sapiens
cttgtgacttttgctttaatt

SEQ ID NO: 6178953 - DNA, 23 bp, Homo sapiens
cttgtgagagcccattcccacca

SEQ ID NO: 6178954 - DNA, 15 bp, Homo sapiens
cttgtgagctatcta

SEQ ID NO: 6178955 - DNA, 17 bp, Homo sapiens
cttgtgaggaaagtcat

SEQ ID NO: 6178956 - DNA, 23 bp, Homo sapiens
cttgtgaggaaagtcattggctt

SEQ ID NO: 6178957 - DNA, 23 bp, Homo sapiens
cttgtgaggcccgaggcagaagg

SEQ ID NO: 6178958 - DNA, 13 bp, Homo sapiens
cttgtgaggcttc

SEQ ID NO: 6178959 - DNA, 14 bp, Homo sapiens
cttgtgagggagag

SEQ ID NO: 6178960 - DNA, 15 bp, Homo sapiens
cttgtgagggagaga

SEQ ID NO: 6178961 - DNA, 17 bp, Homo sapiens
cttgtgagtggataatc

SEQ ID NO: 6178962 - DNA, 22 bp, Homo sapiens
cttgtgatgtcatacagagaag

SEQ ID NO: 6178963 - DNA, 24 bp, Homo sapiens
cttgtgatgtcatacagagaagtc

SEQ ID NO: 6178964 - DNA, 18 bp, Homo sapiens
cttgtgatgtttgctcag

SEQ ID NO: 6178965 - DNA, 19 bp, Homo sapiens
cttgtgatgtttgctcaga

SEQ ID NO: 6178966 - DNA, 15 bp, Homo sapiens
cttgtgattatttat

SEQ ID NO: 6178967 - DNA, 17 bp, Homo sapiens
cttgtgattatttatta

SEQ ID NO: 6178968 - DNA, 17 bp, Homo sapiens
cttgtgattcctacccc

SEQ ID NO: 6178969 - DNA, 16 bp, Homo sapiens
cttgtgattctgggat

SEQ ID NO: 6178970 - DNA, 16 bp, Homo sapiens
cttgtgattgctgcca

SEQ ID NO: 6178971 - DNA, 12 bp, Homo sapiens
cttgtgattggc

SEQ ID NO: 6178972 - DNA, 16 bp, Homo sapiens
cttgtgattggctgca

SEQ ID NO: 6178973 - DNA, 20 bp, Homo sapiens
cttgtgatttccatttctga

SEQ ID NO: 6178974 - DNA, 21 bp, Homo sapiens
cttgtgatttccatttctgat

SEQ ID NO: 6178975 - DNA, 16 bp, Homo sapiens
cttgtgcaattgtctt

SEQ ID NO: 6178976 - DNA, 16 bp, Homo sapiens
cttgtgcacaggcaga

SEQ ID NO: 6178977 - DNA, 18 bp, Homo sapiens
cttgtgcacaggcagagc

SEQ ID NO: 6178978 - DNA, 22 bp, Homo sapiens
cttgtgcacaggcagagcccag

SEQ ID NO: 6178979 - DNA, 20 bp, Homo sapiens
cttgtgcaccctctatccca

SEQ ID NO: 6178980 - DNA, 20 bp, Homo sapiens
cttgtgcagaaaacattgtt

SEQ ID NO: 6178981 - DNA, 20 bp, Homo sapiens
cttgtgcatgcaaaaatgaa

SEQ ID NO: 6178982 - DNA, 23 bp, Homo sapiens
cttgtgcatgcaaaaatgaattc

SEQ ID NO: 6178983 - DNA, 17 bp, Homo sapiens
cttgtgcattgtgtgtc

SEQ ID NO: 6178984 - DNA, 19 bp, Homo sapiens
cttgtgcattgtgtgtcac

SEQ ID NO: 6178985 - DNA, 18 bp, Homo sapiens
cttgtgccaacactcaag

SEQ ID NO: 6178986 - DNA, 17 bp, Homo sapiens
cttgtgccacaccctcc

SEQ ID NO: 6178987 - DNA, 13 bp, Homo sapiens
cttgtgccagccc

SEQ ID NO: 6178988 - DNA, 15 bp, Homo sapiens
cttgtgccagcccgg

SEQ ID NO: 6178989 - DNA, 13 bp, Homo sapiens
cttgtgccctgcc

SEQ ID NO: 6178990 - DNA, 14 bp, Homo sapiens
cttgtgccctgccc

SEQ ID NO: 6178991 - DNA, 17 bp, Homo sapiens
cttgtgccctgccccca

SEQ ID NO: 6178992 - DNA, 23 bp, Homo sapiens
cttgtgccctgcccccatctccc

SEQ ID NO: 6178993 - DNA, 19 bp, Homo sapiens
cttgtgccctgcctccacc

SEQ ID NO: 6178994 - DNA, 11 bp, Homo sapiens
cttgtgcctcc

SEQ ID NO: 6178995 - DNA, 14 bp, Homo sapiens
cttgtgcctccctt

SEQ ID NO: 6178996 - DNA, 16 bp, Homo sapiens
cttgtgcctcttggga

SEQ ID NO: 6178997 - DNA, 16 bp, Homo sapiens
cttgtgcctgctcctg

SEQ ID NO: 6178998 - DNA, 19 bp, Homo sapiens
cttgtgcctgctcctgtac

SEQ ID NO: 6178999 - DNA, 15 bp, Homo sapiens
cttgtgcctgggagt

SEQ ID NO: 6179000 - DNA, 17 bp, Homo sapiens
cttgtgctcacgctccc

SEQ ID NO: 6179001 - DNA, 12 bp, Homo sapiens
cttgtgctcagt

SEQ ID NO: 6179002 - DNA, 22 bp, Homo sapiens
cttgtgctcctcttgattcctg

SEQ ID NO: 6179003 - DNA, 13 bp, Homo sapiens
cttgtgctcggga

SEQ ID NO: 6179004 - DNA, 15 bp, Homo sapiens
cttgtgctgagcctg

SEQ ID NO: 6179005 - DNA, 19 bp, Homo sapiens
cttgtgctgagcctgccca

SEQ ID NO: 6179006 - DNA, 12 bp, Homo sapiens
cttgtgcttctt

SEQ ID NO: 6179007 - DNA, 22 bp, Homo sapiens
cttgtgcttggtggggctcgtg

SEQ ID NO: 6179008 - DNA, 23 bp, Homo sapiens
cttgtgcttggtggggctcgtgg

SEQ ID NO: 6179009 - DNA, 24 bp, Homo sapiens
cttgtgcttggtggggctcgtggc

SEQ ID NO: 6179010 - DNA, 23 bp, Homo sapiens
cttgtggaagacaagtctgtggc

SEQ ID NO: 6179011 - DNA, 21 bp, Homo sapiens
cttgtggaagacacttgctga

SEQ ID NO: 6179012 - DNA, 18 bp, Homo sapiens
cttgtggaatgctgcctt

SEQ ID NO: 6179013 - DNA, 13 bp, Homo sapiens
cttgtggacacag

SEQ ID NO: 6179014 - DNA, 17 bp, Homo sapiens
cttgtggacacagctct

SEQ ID NO: 6179015 - DNA, 21 bp, Homo sapiens
cttgtggacacagctcttctc

SEQ ID NO: 6179016 - DNA, 15 bp, Homo sapiens
cttgtggactaaaag

SEQ ID NO: 6179017 - DNA, 16 bp, Homo sapiens
cttgtggactaaaaga

SEQ ID NO: 6179018 - DNA, 16 bp, Homo sapiens
cttgtggactctctgc

SEQ ID NO: 6179019 - DNA, 21 bp, Homo sapiens
cttgtggactctctgcctgct

SEQ ID NO: 6179020 - DNA, 13 bp, Homo sapiens
cttgtggactggc

SEQ ID NO: 6179021 - DNA, 17 bp, Homo sapiens
cttgtggactggctgtg

SEQ ID NO: 6179022 - DNA, 16 bp, Homo sapiens
cttgtggagccccaca

SEQ ID NO: 6179023 - DNA, 22 bp, Homo sapiens
cttgtggaggatgaatagatgt

SEQ ID NO: 6179024 - DNA, 17 bp, Homo sapiens
cttgtggatggaaatgt

SEQ ID NO: 6179025 - DNA, 15 bp, Homo sapiens
cttgtggatgtttta

SEQ ID NO: 6179026 - DNA, 16 bp, Homo sapiens
cttgtggatgttttaa

SEQ ID NO: 6179027 - DNA, 14 bp, Homo sapiens
cttgtggcagcctg

SEQ ID NO: 6179028 - DNA, 22 bp, Homo sapiens
cttgtggccctctcccttaccc

SEQ ID NO: 6179029 - DNA, 21 bp, Homo sapiens
ctggcctcagagcttcctggg

SEQ ID NO: 6179030 - DNA, 13 bp, Homo sapiens
ctggcctcagcag

SEQ ID NO: 6179031 - DNA, 23 bp, Homo sapiens
ctggcctcagccagctgcccaca

SEQ ID NO: 6179032 - DNA, 17 bp, Homo sapiens
ctggcctcagttcccag

SEQ ID NO: 6179033 - DNA, 21 bp, Homo sapiens
ctggcctcatctcagaccctg

SEQ ID NO: 6179034 - DNA, 13 bp, Homo sapiens
ctggcctccagcc

SEQ ID NO: 6179035 - DNA, 16 bp, Homo sapiens
ctggcctccagctccc

SEQ ID NO: 6179036 - DNA, 22 bp, Homo sapiens
ctggcctccagctcccactccc

SEQ ID NO: 6179037 - DNA, 12 bp, Homo sapiens
ctggcctccagg

SEQ ID NO: 6179038 - DNA, 20 bp, Homo sapiens
ctggcctccaggcccgtctg

SEQ ID NO: 6179039 - DNA, 18 bp, Homo sapiens
ctggcctcccaataaagc

SEQ ID NO: 6179040 - DNA, 23 bp, Homo sapiens
ctggcctcccaataaagctggac

SEQ ID NO: 6179041 - DNA, 12 bp, Homo sapiens
ctggcctcccac

SEQ ID NO: 6179042 - DNA, 13 bp, Homo sapiens
ctggcctcccaca

SEQ ID NO: 6179043 - DNA, 19 bp, Homo sapiens
ctggcctcccccaacacct

SEQ ID NO: 6179044 - DNA, 22 bp, Homo sapiens
ctggcctcccccaacacctgct

SEQ ID NO: 6179045 - DNA, 14 bp, Homo sapiens
ctggcctcccctgc

SEQ ID NO: 6179046 - DNA, 16 bp, Homo sapiens
ctggcctcccctgcca

SEQ ID NO: 6179047 - DNA, 16 bp, Homo sapiens
ctggcctcccctgcgg

SEQ ID NO: 6179048 - DNA, 18 bp, Homo sapiens
ctggcctcccgccactcg

SEQ ID NO: 6179049 - DNA, 20 bp, Homo sapiens
ctggcctccgatgcctggcc

SEQ ID NO: 6179050 - DNA, 20 bp, Homo sapiens
ctggcctccggcgtcagcct

SEQ ID NO: 6179051 - DNA, 22 bp, Homo sapiens
ctggcctccggcgtcagcctcc

SEQ ID NO: 6179052 - DNA, 15 bp, Homo sapiens
ctggcctcgcctgcc

SEQ ID NO: 6179053 - DNA, 17 bp, Homo sapiens
ctggcctcgcctgcctt

SEQ ID NO: 6179054 - DNA, 20 bp, Homo sapiens
ctggcctcgcctggcctgag

SEQ ID NO: 6179055 - DNA, 20 bp, Homo sapiens
ctggcctcgtgatctgccct

SEQ ID NO: 6179056 - DNA, 13 bp, Homo sapiens
ctggcctctcact

SEQ ID NO: 6179057 - DNA, 17 bp, Homo sapiens
ctggcctctctagcaca

SEQ ID NO: 6179058 - DNA, 18 bp, Homo sapiens
ctggcctctctagcacaa

SEQ ID NO: 6179059 - DNA, 16 bp, Homo sapiens
ctggcctctctgacat

SEQ ID NO: 6179060 - DNA, 20 bp, Homo sapiens
ctggcctctgcactcccctg

SEQ ID NO: 6179061 - DNA, 21 bp, Homo sapiens
ctggcctctgcactcccctgc

SEQ ID NO: 6179062 - DNA, 12 bp, Homo sapiens
ctggcctctgcc

SEQ ID NO: 6179063 - DNA, 18 bp, Homo sapiens
ctggcctctgcttacttt

SEQ ID NO: 6179064 - DNA, 21 bp, Homo sapiens
ctggcctctgcttacttttta

SEQ ID NO: 6179065 - DNA, 15 bp, Homo sapiens
ctggcctctgctttc

SEQ ID NO: 6179066 - DNA, 11 bp, Homo sapiens
ctggcctctgg

SEQ ID NO: 6179067 - DNA, 18 bp, Homo sapiens
ctggcctctgggcagtgt

SEQ ID NO: 6179068 - DNA, 19 bp, Homo sapiens
ctggcctctgggcagtgtg

SEQ ID NO: 6179069 - DNA, 11 bp, Homo sapiens
ctggcctctgt

SEQ ID NO: 6179070 - DNA, 14 bp, Homo sapiens
ctggcctctgtcat

SEQ ID NO: 6179071 - DNA, 12 bp, Homo sapiens
ctggcctctgtg

SEQ ID NO: 6179072 - DNA, 17 bp, Homo sapiens
ctggcctctgtgattac

SEQ ID NO: 6179073 - DNA, 19 bp, Homo sapiens
ctggcctctgtgattacat

SEQ ID NO: 6179074 - DNA, 14 bp, Homo sapiens
ctggcctctgtgcc

SEQ ID NO: 6179075 - DNA, 20 bp, Homo sapiens
ctggcctctgtgccttcttt

SEQ ID NO: 6179076 - DNA, 15 bp, Homo sapiens
ctggcctcttggcac

SEQ ID NO: 6179077 - DNA, 18 bp, Homo sapiens
ctggcctcttggcacctg

SEQ ID NO: 6179078 - DNA, 20 bp, Homo sapiens
ctggcctcttggcacctgcc

SEQ ID NO: 6179079 - DNA, 21 bp, Homo sapiens
ctggcctcttggcacctgcct

SEQ ID NO: 6179080 - DNA, 21 bp, Homo sapiens
ctggcctgaaccacaggagag

SEQ ID NO: 6179081 - DNA, 14 bp, Homo sapiens
ctggcctgacacaa

SEQ ID NO: 6179082 - DNA, 21 bp, Homo sapiens
ctggcctgactggttgtcaga

SEQ ID NO: 6179083 - DNA, 10 bp, Homo sapiens
ctggcctgag

SEQ ID NO: 6179084 - DNA, 23 bp, Homo sapiens
ctggcctgagagtcagctctctg

SEQ ID NO: 6179085 - DNA, 12 bp, Homo sapiens
ctggcctgagca

SEQ ID NO: 6179086 - DNA, 16 bp, Homo sapiens
ctggcctgagctggga

SEQ ID NO: 6179087 - DNA, 18 bp, Homo sapiens
ctggcctgagctgggatg

SEQ ID NO: 6179088 - DNA, 17 bp, Homo sapiens
ctggcctgagctggggc

SEQ ID NO: 6179089 - DNA, 21 bp, Homo sapiens
ctggcctgagctggggccaca

SEQ ID NO: 6179090 - DNA, 13 bp, Homo sapiens
ctggcctgaggtc

SEQ ID NO: 6179091 - DNA, 20 bp, Homo sapiens
ctggcctgaggtctcgctga

SEQ ID NO: 6179092 - DNA, 24 bp, Homo sapiens
ctggcctgaggtctcgctgatgct

SEQ ID NO: 6179093 - DNA, 19 bp, Homo sapiens
ctggcctgcacggtgggcc

SEQ ID NO: 6179094 - DNA, 13 bp, Homo sapiens
ctggcctgcccgt

SEQ ID NO: 6179095 - DNA, 18 bp, Homo sapiens
ctggcctgcgcctgcacc

SEQ ID NO: 6179096 - DNA, 22 bp, Homo sapiens
ctggcctgcggtggagggatca

SEQ ID NO: 6179097 - DNA, 21 bp, Homo sapiens
ctggcctgctcttacttcccc

SEQ ID NO: 6179098 - DNA, 15 bp, Homo sapiens
ctggcctgctgggct

SEQ ID NO: 6179099 - DNA, 21 bp, Homo sapiens
ctggcctggaatttgggcaga

SEQ ID NO: 6179100 - DNA, 22 bp, Homo sapiens
ctggcctggaatttgggcagat

SEQ ID NO: 6179101 - DNA, 14 bp, Homo sapiens
ctggcctggactgt

SEQ ID NO: 6179102 - DNA, 18 bp, Homo sapiens
ctggcctggactgttttc

SEQ ID NO: 6179103 - DNA, 12 bp, Homo sapiens
ctggcctggatc

SEQ ID NO: 6179104 - DNA, 15 bp, Homo sapiens
ctggcctggatctcc

SEQ ID NO: 6179105 - DNA, 17 bp, Homo sapiens
ctggcctggcacacatc

SEQ ID NO: 6179106 - DNA, 11 bp, Homo sapiens
ctggcctggcc

SEQ ID NO: 6179107 - DNA, 14 bp, Homo sapiens
ctggcctggccagt

SEQ ID NO: 6179108 - DNA, 18 bp, Homo sapiens
ctggcctggcccccagct

SEQ ID NO: 6179109 - DNA, 17 bp, Homo sapiens
ctggcctggcccctcag

SEQ ID NO: 6179110 - DNA, 23 bp, Homo sapiens
ctggcctggccctgccctgagga

SEQ ID NO: 6179111 - DNA, 14 bp, Homo sapiens
ctggcctggcctgg

SEQ ID NO: 6179112 - DNA, 17 bp, Homo sapiens
ctggcctggcctggccc

SEQ ID NO: 6179113 - DNA, 13 bp, Homo sapiens
ctggcctggctcc

SEQ ID NO: 6179114 - DNA, 16 bp, Homo sapiens
ctggcctggctctcct

SEQ ID NO: 6179115 - DNA, 14 bp, Homo sapiens
ctggcctggcttct

SEQ ID NO: 6179116 - DNA, 16 bp, Homo sapiens
ctggcctgggaaaagg

SEQ ID NO: 6179117 - DNA, 19 bp, Homo sapiens
ctggcctgggccacacctg

SEQ ID NO: 6179118 - DNA, 15 bp, Homo sapiens
ctggcctggtccctg

SEQ ID NO: 6179119 - DNA, 16 bp, Homo sapiens
ctggcctggtccctgg

SEQ ID NO: 6179120 - DNA, 19 bp, Homo sapiens
ctggcctggtccctggtcc

SEQ ID NO: 6179121 - DNA, 21 bp, Homo sapiens
ctggcctggtccctggtcctt

SEQ ID NO: 6179122 - DNA, 21 bp, Homo sapiens
ctggcctgtctccctagggaa

SEQ ID NO: 6179123 - DNA, 13 bp, Homo sapiens
ctggcctgtggca

SEQ ID NO: 6179124 - DNA, 22 bp, Homo sapiens
ctggcctgtggcacagccctga

SEQ ID NO: 6179125 - DNA, 18 bp, Homo sapiens
ctggcctgtggcaggcct

SEQ ID NO: 6179126 - DNA, 14 bp, Homo sapiens
ctggcctgtgtcta

SEQ ID NO: 6179127 - DNA, 18 bp, Homo sapiens
ctggcctgttctgtagga

SEQ ID NO: 6179128 - DNA, 21 bp, Homo sapiens
ctggccttaaaaggggcccaa

SEQ ID NO: 6179129 - DNA, 19 bp, Homo sapiens
ctggccttaaagagggaca

SEQ ID NO: 6179130 - DNA, 13 bp, Homo sapiens
ctggccttacacc

SEQ ID NO: 6179131 - DNA, 17 bp, Homo sapiens
ctggccttcggcctcca

SEQ ID NO: 6179132 - DNA, 21 bp, Homo sapiens
ctggccttcgtctccatctct

SEQ ID NO: 6179133 - DNA, 13 bp, Homo sapiens
ctggccttctcct

SEQ ID NO: 6179134 - DNA, 14 bp, Homo sapiens
ctggccttctccta

SEQ ID NO: 6179135 - DNA, 19 bp, Homo sapiens
ctggccttgaaaccacctt

SEQ ID NO: 6179136 - DNA, 18 bp, Homo sapiens
ctggccttggttcctcca

SEQ ID NO: 6179137 - DNA, 20 bp, Homo sapiens
ctggccttggttcctccagc

SEQ ID NO: 6179138 - DNA, 22 bp, Homo sapiens
ctggccttggttcctccagcaa

SEQ ID NO: 6179139 - DNA, 18 bp, Homo sapiens
ctggccttgtcaggaccc

SEQ ID NO: 6179140 - DNA, 19 bp, Homo sapiens
ctggccttgtcaggaccca

SEQ ID NO: 6179141 - DNA, 21 bp, Homo sapiens
ctggcctttcaggtccaggcc

SEQ ID NO: 6179142 - DNA, 22 bp, Homo sapiens
ctggcctttcaggtccaggcca

SEQ ID NO: 6179143 - DNA, 14 bp, Homo sapiens
ctggcctttcatat

SEQ ID NO: 6179144 - DNA, 13 bp, Homo sapiens
ctggcctttccta

SEQ ID NO: 6179145 - DNA, 15 bp, Homo sapiens
ctggcctttcctctc

SEQ ID NO: 6179146 - DNA, 15 bp, Homo sapiens
ctggcgaagcctgag

SEQ ID NO: 6179147 - DNA, 22 bp, Homo sapiens
ctggcgaagcctgagcaggcag

SEQ ID NO: 6179148 - DNA, 18 bp, Homo sapiens
ctggcgacacactccgtc

SEQ ID NO: 6179149 - DNA, 23 bp, Homo sapiens
ctggcgacacactccgtccatcc

SEQ ID NO: 6179150 - DNA, 15 bp, Homo sapiens
ctggcgacactcagg

SEQ ID NO: 6179151 - DNA, 16 bp, Homo sapiens
ctggcgacactcaggg

SEQ ID NO: 6179152 - DNA, 19 bp, Homo sapiens
ctggcgacagttttccttc

SEQ ID NO: 6179153 - DNA, 20 bp, Homo sapiens
ctggcgacagttttccttct

SEQ ID NO: 6179154 - DNA, 18 bp, Homo sapiens
ctggcgactgcagctgca

SEQ ID NO: 6179155 - DNA, 19 bp, Homo sapiens
ctggcgagagtctggccct

SEQ ID NO: 6179156 - DNA, 13 bp, Homo sapiens
ctggcgagccctt

SEQ ID NO: 6179157 - DNA, 22 bp, Homo sapiens
ctggcgaggtgcggccaccacc

SEQ ID NO: 6179158 - DNA, 23 bp, Homo sapiens
ctggcgagtgaatgccagtgtgc

SEQ ID NO: 6179159 - DNA, 24 bp, Homo sapiens
ctggcgatctcccagggctctctg

SEQ ID NO: 6179160 - DNA, 23 bp, Homo sapiens
ctggcgcagaacgaaccttggcc

SEQ ID NO: 6179161 - DNA, 22 bp, Homo sapiens
ctggcgccaacaacttctccat

SEQ ID NO: 6179162 - DNA, 14 bp, Homo sapiens
ctggcgccaggggc

SEQ ID NO: 6179163 - DNA, 21 bp, Homo sapiens
ctggcgccaggggcaggcagc

SEQ ID NO: 6179164 - DNA, 13 bp, Homo sapiens
ctggcgcccatcc

SEQ ID NO: 6179165 - DNA, 20 bp, Homo sapiens
ctggcgcccctgcctgtgcc

SEQ ID NO: 6179166 - DNA, 15 bp, Homo sapiens
ctggcgcctccgagg

SEQ ID NO: 6179167 - DNA, 20 bp, Homo sapiens
ctggcgcctctgcaagggca

SEQ ID NO: 6179168 - DNA, 14 bp, Homo sapiens
ctggcgccttctcg

SEQ ID NO: 6179169 - DNA, 20 bp, Homo sapiens
ctggcgccttctcggagctg

SEQ ID NO: 6179170 - DNA, 17 bp, Homo sapiens
ctggcgcgtgtgtggcc

SEQ ID NO: 6179171 - DNA, 13 bp, Homo sapiens
ctggcgctcagca

SEQ ID NO: 6179172 - DNA, 17 bp, Homo sapiens
ctggcgctcagcagccc

SEQ ID NO: 6179173 - DNA, 18 bp, Homo sapiens
ctggcgctcagcagccct

SEQ ID NO: 6179174 - DNA, 17 bp, Homo sapiens
ctggcgctgtgctagct

SEQ ID NO: 6179175 - DNA, 15 bp, Homo sapiens
ctggcgcttggatct

SEQ ID NO: 6179176 - DNA, 17 bp, Homo sapiens
ctggcgcttggatctgg

SEQ ID NO: 6179177 - DNA, 21 bp, Homo sapiens
ctggcgcttggatctggggtg

SEQ ID NO: 6179178 - DNA, 14 bp, Homo sapiens
ctggcggaacctgg

SEQ ID NO: 6179179 - DNA, 19 bp, Homo sapiens
ctggcggaacctggctgcg

SEQ ID NO: 6179180 - DNA, 15 bp, Homo sapiens
ctggcggaggctgct

SEQ ID NO: 6179181 - DNA, 22 bp, Homo sapiens
ctggcggaggtctctgggagcc

SEQ ID NO: 6179182 - DNA, 15 bp, Homo sapiens
ctggcggcaggaagc

SEQ ID NO: 6179183 - DNA, 20 bp, Homo sapiens
ctggcggcaggggttggcag

SEQ ID NO: 6179184 - DNA, 22 bp, Homo sapiens
ctggcggcaggggttggcagcg

SEQ ID NO: 6179185 - DNA, 17 bp, Homo sapiens
ctggcggccatccccgt

SEQ ID NO: 6179186 - DNA, 15 bp, Homo sapiens
ctggcggccccaact

SEQ ID NO: 6179187 - DNA, 23 bp, Homo sapiens
ctggcggcccttctgactgttta

SEQ ID NO: 6179188 - DNA, 16 bp, Homo sapiens
ctggcggcgcagaggg

SEQ ID NO: 6179189 - DNA, 22 bp, Homo sapiens
ctggcggctactcagcagccct

SEQ ID NO: 6179190 - DNA, 19 bp, Homo sapiens
ctggcggcttcctgtccac

SEQ ID NO: 6179191 - DNA, 19 bp, Homo sapiens
ctggcgggatgggccaccg

SEQ ID NO: 6179192 - DNA, 20 bp, Homo sapiens
ctggcgggatgggccaccgc

SEQ ID NO: 6179193 - DNA, 15 bp, Homo sapiens
ctggcgggcagcccc

SEQ ID NO: 6179194 - DNA, 16 bp, Homo sapiens
ctggcgggcagcccct

SEQ ID NO: 6179195 - DNA, 22 bp, Homo sapiens
ctggcgggcagcccctgctgga

SEQ ID NO: 6179196 - DNA, 13 bp, Homo sapiens
ctggcgggccctg

SEQ ID NO: 6179197 - DNA, 14 bp, Homo sapiens
ctggcgggccctgg

SEQ ID NO: 6179198 - DNA, 22 bp, Homo sapiens
ctggcgggccctggagctcaag

SEQ ID NO: 6179199 - DNA, 20 bp, Homo sapiens
ctggcgggcctttttcctgc

SEQ ID NO: 6179200 - DNA, 17 bp, Homo sapiens
ctggcggggcaggaggc

SEQ ID NO: 6179201 - DNA, 20 bp, Homo sapiens
ctggcggggcaggaggcctg

SEQ ID NO: 6179202 - DNA, 20 bp, Homo sapiens
ctggcgggggtgggccgtgg

SEQ ID NO: 6179203 - DNA, 14 bp, Homo sapiens
ctggcggggtctgc

SEQ ID NO: 6179204 - DNA, 22 bp, Homo sapiens
ctggcggggttggcccttgtct

SEQ ID NO: 6179205 - DNA, 15 bp, Homo sapiens
ctggcggtggccaca

SEQ ID NO: 6179206 - DNA, 20 bp, Homo sapiens
ctggcggtggccacagcgtg

SEQ ID NO: 6179207 - DNA, 22 bp, Homo sapiens
cttgtggccttttttataacta

SEQ ID NO: 6179208 - DNA, 15 bp, Homo sapiens
cttgtggctttgcaa

SEQ ID NO: 6179209 - DNA, 14 bp, Homo sapiens
cttgtgggaataaa

SEQ ID NO: 6179210 - DNA, 18 bp, Homo sapiens
cttgtgggaccagtccca

SEQ ID NO: 6179211 - DNA, 20 bp, Homo sapiens
cttgtgggaccagtcccaca

SEQ ID NO: 6179212 - DNA, 14 bp, Homo sapiens
cttgtgggagacag

SEQ ID NO: 6179213 - DNA, 15 bp, Homo sapiens
cttgtgggagacagc

SEQ ID NO: 6179214 - DNA, 16 bp, Homo sapiens
cttgtgggagacagca

SEQ ID NO: 6179215 - DNA, 17 bp, Homo sapiens
cttgtgggagacagcag

SEQ ID NO: 6179216 - DNA, 19 bp, Homo sapiens
cttgtgggagacagcagcc

SEQ ID NO: 6179217 - DNA, 19 bp, Homo sapiens
cttgtgggcaaaggcaggg

SEQ ID NO: 6179218 - DNA, 20 bp, Homo sapiens
cttgtgggcaaaggcagggc

SEQ ID NO: 6179219 - DNA, 18 bp, Homo sapiens
cttgtgggcactgtgcca

SEQ ID NO: 6179220 - DNA, 14 bp, Homo sapiens
cttgtgggcctggg

SEQ ID NO: 6179221 - DNA, 21 bp, Homo sapiens
cttgtgggcctgggctcctgg

SEQ ID NO: 6179222 - DNA, 12 bp, Homo sapiens
cttgtgggctgg

SEQ ID NO: 6179223 - DNA, 14 bp, Homo sapiens
cttgtgggctggtg

SEQ ID NO: 6179224 - DNA, 14 bp, Homo sapiens
cttgtggggccagg

SEQ ID NO: 6179225 - DNA, 12 bp, Homo sapiens
cttgtggggcct

SEQ ID NO: 6179226 - DNA, 14 bp, Homo sapiens
cttgtggggcctgg

SEQ ID NO: 6179227 - DNA, 18 bp, Homo sapiens
cttgtggggcctgggagg

SEQ ID NO: 6179228 - DNA, 19 bp, Homo sapiens
cttgtggggctaaggcagg

SEQ ID NO: 6179229 - DNA, 16 bp, Homo sapiens
cttgtgggtccatgct

SEQ ID NO: 6179230 - DNA, 16 bp, Homo sapiens
cttgtggtcccacccc

SEQ ID NO: 6179231 - DNA, 19 bp, Homo sapiens
cttgtggtcccaccccaca

SEQ ID NO: 6179232 - DNA, 15 bp, Homo sapiens
cttgtggtggggcag

SEQ ID NO: 6179233 - DNA, 12 bp, Homo sapiens
cttgtggtgtaa

SEQ ID NO: 6179234 - DNA, 19 bp, Homo sapiens
cttgtggtgtaaagctggc

SEQ ID NO: 6179235 - DNA, 22 bp, Homo sapiens
cttgtggtgtaaagctggccct

SEQ ID NO: 6179236 - DNA, 23 bp, Homo sapiens
cttgtggtgtaaagctggccctg

SEQ ID NO: 6179237 - DNA, 23 bp, Homo sapiens
cttgtggtgtgaccatgttcatt

SEQ ID NO: 6179238 - DNA, 24 bp, Homo sapiens
cttgtggtgtgaccatgttcatta

SEQ ID NO: 6179239 - DNA, 17 bp, Homo sapiens
cttgtggtgttcctgaa

SEQ ID NO: 6179240 - DNA, 14 bp, Homo sapiens
cttgtggttaaaaa

SEQ ID NO: 6179241 - DNA, 14 bp, Homo sapiens
cttgtggtttatgt

SEQ ID NO: 6179242 - DNA, 12 bp, Homo sapiens
cttgtggtttgt

SEQ ID NO: 6179243 - DNA, 20 bp, Homo sapiens
cttgtggttttcaaattgga

SEQ ID NO: 6179244 - DNA, 14 bp, Homo sapiens
cttgtgtaaataca

SEQ ID NO: 6179245 - DNA, 21 bp, Homo sapiens
cttgtgtaaatacaattttgt

SEQ ID NO: 6179246 - DNA, 15 bp, Homo sapiens
cttgtgtaactaatt

SEQ ID NO: 6179247 - DNA, 18 bp, Homo sapiens
cttgtgtaactaatttgt

SEQ ID NO: 6179248 - DNA, 18 bp, Homo sapiens
cttgtgtaatttatgtga

SEQ ID NO: 6179249 - DNA, 13 bp, Homo sapiens
cttgtgtagattt

SEQ ID NO: 6179250 - DNA, 18 bp, Homo sapiens
cttgtgtagatttgaaaa

SEQ ID NO: 6179251 - DNA, 20 bp, Homo sapiens
cttgtgtagatttgaaaatt

SEQ ID NO: 6179252 - DNA, 23 bp, Homo sapiens
cttgtgtatatgtataaattaat

SEQ ID NO: 6179253 - DNA, 23 bp, Homo sapiens
cttgtgtatccattatcatgtgt

SEQ ID NO: 6179254 - DNA, 18 bp, Homo sapiens
cttgtgtatcctgacagc

SEQ ID NO: 6179255 - DNA, 21 bp, Homo sapiens
cttgtgtatcttgattaatgt

SEQ ID NO: 6179256 - DNA, 17 bp, Homo sapiens
cttgtgtatttctctgt

SEQ ID NO: 6179257 - DNA, 13 bp, Homo sapiens
cttgtgtcagggc

SEQ ID NO: 6179258 - DNA, 15 bp, Homo sapiens
cttgtgtcagggcag

SEQ ID NO: 6179259 - DNA, 12 bp, Homo sapiens
cttgtgtcctgg

SEQ ID NO: 6179260 - DNA, 17 bp, Homo sapiens
cttgtgtctctgtgctt

SEQ ID NO: 6179261 - DNA, 10 bp, Homo sapiens
cttgtgtctg

SEQ ID NO: 6179262 - DNA, 22 bp, Homo sapiens
cttgtgtctttggaggtgctgc

SEQ ID NO: 6179263 - DNA, 12 bp, Homo sapiens
cttgtgtgaggg

SEQ ID NO: 6179264 - DNA, 20 bp, Homo sapiens
cttgtgtggcgcacttcaga

SEQ ID NO: 6179265 - DNA, 18 bp, Homo sapiens
cttgtgtgtaccacaccc

SEQ ID NO: 6179266 - DNA, 16 bp, Homo sapiens
cttgtgtgtatgtcta

SEQ ID NO: 6179267 - DNA, 22 bp, Homo sapiens
cttgtgtgtatgtctatgtgta

SEQ ID NO: 6179268 - DNA, 22 bp, Homo sapiens
cttgtgtgtcaggccctctgcc

SEQ ID NO: 6179269 - DNA, 17 bp, Homo sapiens
cttgtgtgtctgtgtgt

SEQ ID NO: 6179270 - DNA, 15 bp, Homo sapiens
cttgtgtgtgccctg

SEQ ID NO: 6179271 - DNA, 20 bp, Homo sapiens
cttgtgtgtgggctgtgagt

SEQ ID NO: 6179272 - DNA, 15 bp, Homo sapiens
cttgtgtgtgtacct

SEQ ID NO: 6179273 - DNA, 23 bp, Homo sapiens
cttgtgtgtgtacctgtggctgt

SEQ ID NO: 6179274 - DNA, 13 bp, Homo sapiens
cttgtgtgtttca

SEQ ID NO: 6179275 - DNA, 21 bp, Homo sapiens
cttgtgttaacttgcctccat

SEQ ID NO: 6179276 - DNA, 15 bp, Homo sapiens
cttgtgttcaatctg

SEQ ID NO: 6179277 - DNA, 19 bp, Homo sapiens
cttgtgttcaatctgtgaa

SEQ ID NO: 6179278 - DNA, 13 bp, Homo sapiens
cttgtgttccttc

SEQ ID NO: 6179279 - DNA, 20 bp, Homo sapiens
cttgtgttccttctgtgaag

SEQ ID NO: 6179280 - DNA, 17 bp, Homo sapiens
cttgtgttctgtagact

SEQ ID NO: 6179281 - DNA, 20 bp, Homo sapiens
cttgtgttgtccttttgtct

SEQ ID NO: 6179282 - DNA, 12 bp, Homo sapiens
cttgtgttgttt

SEQ ID NO: 6179283 - DNA, 15 bp, Homo sapiens
cttgtgttgttttct

SEQ ID NO: 6179284 - DNA, 16 bp, Homo sapiens
cttgtgttgttttctc

SEQ ID NO: 6179285 - DNA, 17 bp, Homo sapiens
cttgtgttgttttctct

SEQ ID NO: 6179286 - DNA, 21 bp, Homo sapiens
cttgtgtttctttagtttttg

SEQ ID NO: 6179287 - DNA, 16 bp, Homo sapiens
cttgtgtttgctgcag

SEQ ID NO: 6179288 - DNA, 17 bp, Homo sapiens
cttgtgtttgcttaaac

SEQ ID NO: 6179289 - DNA, 18 bp, Homo sapiens
cttgtgtttgcttaaaca

SEQ ID NO: 6179290 - DNA, 19 bp, Homo sapiens
cttgtgtttgtatataaat

SEQ ID NO: 6179291 - DNA, 19 bp, Homo sapiens
cttgtgttttactgtcaga

SEQ ID NO: 6179292 - DNA, 22 bp, Homo sapiens
cttgtgtttttaactcaatatt

SEQ ID NO: 6179293 - DNA, 13 bp, Homo sapiens
cttgttaaatgta

SEQ ID NO: 6179294 - DNA, 13 bp, Homo sapiens
cttgttaatattc

SEQ ID NO: 6179295 - DNA, 17 bp, Homo sapiens
cttgttaatgctttctg

SEQ ID NO: 6179296 - DNA, 20 bp, Homo sapiens
cttgttaatttcattccaaa

SEQ ID NO: 6179297 - DNA, 21 bp, Homo sapiens
cttgttacaaattttttaatt

SEQ ID NO: 6179298 - DNA, 17 bp, Homo sapiens
cttgttacccatgaaaa

SEQ ID NO: 6179299 - DNA, 18 bp, Homo sapiens
cttgttacccatgaaaaa

SEQ ID NO: 6179300 - DNA, 19 bp, Homo sapiens
cttgttacccatgaaaaac

SEQ ID NO: 6179301 - DNA, 18 bp, Homo sapiens
cttgttacggcagtcaca

SEQ ID NO: 6179302 - DNA, 16 bp, Homo sapiens
cttgttagaaaacaaa

SEQ ID NO: 6179303 - DNA, 16 bp, Homo sapiens
cttgttagatctagtt

SEQ ID NO: 6179304 - DNA, 17 bp, Homo sapiens
cttgttagcccttcaga

SEQ ID NO: 6179305 - DNA, 19 bp, Homo sapiens
cttgttatatgcagacatg

SEQ ID NO: 6179306 - DNA, 22 bp, Homo sapiens
cttgttatatgcagacatgtat

SEQ ID NO: 6179307 - DNA, 19 bp, Homo sapiens
cttgttatggtagaaaaat

SEQ ID NO: 6179308 - DNA, 23 bp, Homo sapiens
cttgttatgttgtaatattttgc

SEQ ID NO: 6179309 - DNA, 12 bp, Homo sapiens
cttgttattaat

SEQ ID NO: 6179310 - DNA, 15 bp, Homo sapiens
cttgttattaccaaa

SEQ ID NO: 6179311 - DNA, 21 bp, Homo sapiens
cttgttattatctactagtaa

SEQ ID NO: 6179312 - DNA, 22 bp, Homo sapiens
cttgttattattgttaataata

SEQ ID NO: 6179313 - DNA, 16 bp, Homo sapiens
cttgttattgaagtgt

SEQ ID NO: 6179314 - DNA, 15 bp, Homo sapiens
cttgttatttataac

SEQ ID NO: 6179315 - DNA, 14 bp, Homo sapiens
cttgttcaacagtt

SEQ ID NO: 6179316 - DNA, 19 bp, Homo sapiens
cttgttcaggaaaaggttg

SEQ ID NO: 6179317 - DNA, 14 bp, Homo sapiens
cttgttcagtcact

SEQ ID NO: 6179318 - DNA, 16 bp, Homo sapiens
cttgttcatcatccag

SEQ ID NO: 6179319 - DNA, 17 bp, Homo sapiens
cttgttcatggagagct

SEQ ID NO: 6179320 - DNA, 19 bp, Homo sapiens
cttgttcatgttttgctaa

SEQ ID NO: 6179321 - DNA, 17 bp, Homo sapiens
cttgttcattctgtgac

SEQ ID NO: 6179322 - DNA, 19 bp, Homo sapiens
cttgttcatttctgtctcc

SEQ ID NO: 6179323 - DNA, 15 bp, Homo sapiens
cttgttccagctttg

SEQ ID NO: 6179324 - DNA, 15 bp, Homo sapiens
cttgttcctgaaatg

SEQ ID NO: 6179325 - DNA, 21 bp, Homo sapiens
cttgttcgcacaatctacact

SEQ ID NO: 6179326 - DNA, 13 bp, Homo sapiens
cttgttctatttt

SEQ ID NO: 6179327 - DNA, 16 bp, Homo sapiens
cttgttctgagattca

SEQ ID NO: 6179328 - DNA, 15 bp, Homo sapiens
cttgttctgggctca

SEQ ID NO: 6179329 - DNA, 13 bp, Homo sapiens
cttgttctgtcac

SEQ ID NO: 6179330 - DNA, 20 bp, Homo sapiens
cttgttctgtgatgagggga

SEQ ID NO: 6179331 - DNA, 14 bp, Homo sapiens
cttgttctgttcct

SEQ ID NO: 6179332 - DNA, 12 bp, Homo sapiens
cttgttcttcca

SEQ ID NO: 6179333 - DNA, 13 bp, Homo sapiens
cttgttcttccaa

SEQ ID NO: 6179334 - DNA, 20 bp, Homo sapiens
cttgttcttccaaagcagag

SEQ ID NO: 6179335 - DNA, 13 bp, Homo sapiens
cttgttcttcctc

SEQ ID NO: 6179336 - DNA, 17 bp, Homo sapiens
cttgttcttgcagcatt

SEQ ID NO: 6179337 - DNA, 19 bp, Homo sapiens
cttgttcttggttcctgtt

SEQ ID NO: 6179338 - DNA, 14 bp, Homo sapiens
cttgttctttgctg

SEQ ID NO: 6179339 - DNA, 21 bp, Homo sapiens
cttgttgaaaacccagactgt

SEQ ID NO: 6179340 - DNA, 20 bp, Homo sapiens
cttgttgaatgtcaatcata

SEQ ID NO: 6179341 - DNA, 12 bp, Homo sapiens
cttgttgacaga

SEQ ID NO: 6179342 - DNA, 22 bp, Homo sapiens
cttgttgatgggccttcagatt

SEQ ID NO: 6179343 - DNA, 18 bp, Homo sapiens
cttgttgcactgccccct

SEQ ID NO: 6179344 - DNA, 23 bp, Homo sapiens
cttgttgcactgccccctgcttg

SEQ ID NO: 6179345 - DNA, 13 bp, Homo sapiens
cttgttgcagact

SEQ ID NO: 6179346 - DNA, 22 bp, Homo sapiens
cttgttgcagactggtgttaat

SEQ ID NO: 6179347 - DNA, 22 bp, Homo sapiens
cttgttgcagagatttcctcca

SEQ ID NO: 6179348 - DNA, 21 bp, Homo sapiens
cttgttgctgattcaagaaac

SEQ ID NO: 6179349 - DNA, 18 bp, Homo sapiens
cttgttgctttgttgcac

SEQ ID NO: 6179350 - DNA, 19 bp, Homo sapiens
cttgttggagcctgcaggg

SEQ ID NO: 6179351 - DNA, 23 bp, Homo sapiens
cttgttggcgtaggctacagaga

SEQ ID NO: 6179352 - DNA, 14 bp, Homo sapiens
cttgttggtcagag

SEQ ID NO: 6179353 - DNA, 15 bp, Homo sapiens
cttgttggtcagagg

SEQ ID NO: 6179354 - DNA, 23 bp, Homo sapiens
cttgttggtggagagtggaagga

SEQ ID NO: 6179355 - DNA, 19 bp, Homo sapiens
cttgttgtcccaatgaaat

SEQ ID NO: 6179356 - DNA, 22 bp, Homo sapiens
cttgttgtctccacttgtatat

SEQ ID NO: 6179357 - DNA, 17 bp, Homo sapiens
cttgttgtgcttttagt

SEQ ID NO: 6179358 - DNA, 13 bp, Homo sapiens
cttgttgtggagg

SEQ ID NO: 6179359 - DNA, 22 bp, Homo sapiens
cttgttgtggctcttatttctg

SEQ ID NO: 6179360 - DNA, 20 bp, Homo sapiens
cttgttgtttatatgaaaac

SEQ ID NO: 6179361 - DNA, 23 bp, Homo sapiens
cttgttgtttatatgaaaacact

SEQ ID NO: 6179362 - DNA, 15 bp, Homo sapiens
cttgttgtttcttgc

SEQ ID NO: 6179363 - DNA, 16 bp, Homo sapiens
cttgttgtttgctttg

SEQ ID NO: 6179364 - DNA, 21 bp, Homo sapiens
cttgttgtttgttgacagctt

SEQ ID NO: 6179365 - DNA, 16 bp, Homo sapiens
cttgttgttttactaa

SEQ ID NO: 6179366 - DNA, 21 bp, Homo sapiens
cttgttgttttactaaagaaa

SEQ ID NO: 6179367 - DNA, 21 bp, Homo sapiens
cttgttgtttttaagtcctgt

SEQ ID NO: 6179368 - DNA, 22 bp, Homo sapiens
cttgttgtttttaagtcctgta

SEQ ID NO: 6179369 - DNA, 17 bp, Homo sapiens
cttgtttaaaaaaagaa

SEQ ID NO: 6179370 - DNA, 21 bp, Homo sapiens
cttgtttaattctaaaagaga

SEQ ID NO: 6179371 - DNA, 22 bp, Homo sapiens
cttgtttaattctaaaagagaa

SEQ ID NO: 6179372 - DNA, 22 bp, Homo sapiens
cttgtttacagcactactctgt

SEQ ID NO: 6179373 - DNA, 17 bp, Homo sapiens
cttgtttacatgcttat

SEQ ID NO: 6179374 - DNA, 15 bp, Homo sapiens
cttgtttacctttct

SEQ ID NO: 6179375 - DNA, 23 bp, Homo sapiens
cttgtttagagagcctgtcacca

SEQ ID NO: 6179376 - DNA, 12 bp, Homo sapiens
cttgtttatagc

SEQ ID NO: 6179377 - DNA, 16 bp, Homo sapiens
cttgtttatagccact

SEQ ID NO: 6179378 - DNA, 18 bp, Homo sapiens
cttgtttatcagatacat

SEQ ID NO: 6179379 - DNA, 21 bp, Homo sapiens
cttgtttatcagatacatcac

SEQ ID NO: 6179380 - DNA, 13 bp, Homo sapiens
cttgtttatgata

SEQ ID NO: 6179381 - DNA, 16 bp, Homo sapiens
cttgtttatgatattt

SEQ ID NO: 6179382 - DNA, 12 bp, Homo sapiens
cttgtttattga

SEQ ID NO: 6179383 - DNA, 23 bp, Homo sapiens
cttgtttattgagtttgtaggta

SEQ ID NO: 6179384 - DNA, 13 bp, Homo sapiens
cttgtttcatatt

SEQ ID NO: 6179385 - DNA, 16 bp, Homo sapiens
ctggcgtcacctgtgc

SEQ ID NO: 6179386 - DNA, 12 bp, Homo sapiens
ctggcgtcctct

SEQ ID NO: 6179387 - DNA, 14 bp, Homo sapiens
ctggcgtgcagtgg

SEQ ID NO: 6179388 - DNA, 18 bp, Homo sapiens
ctggcgtgctcagaccca

SEQ ID NO: 6179389 - DNA, 22 bp, Homo sapiens
ctggcgtggggggagctctggt

SEQ ID NO: 6179390 - DNA, 19 bp, Homo sapiens
ctggcgttcacctccctgc

SEQ ID NO: 6179391 - DNA, 16 bp, Homo sapiens
ctggctaacacggtga

SEQ ID NO: 6179392 - DNA, 16 bp, Homo sapiens
ctggctaacagtctag

SEQ ID NO: 6179393 - DNA, 21 bp, Homo sapiens
ctggctacagtaccatgcctc

SEQ ID NO: 6179394 - DNA, 12 bp, Homo sapiens
ctggctacatcc

SEQ ID NO: 6179395 - DNA, 17 bp, Homo sapiens
ctggctaccttgtggga

SEQ ID NO: 6179396 - DNA, 18 bp, Homo sapiens
ctggctaccttgtgggaa

SEQ ID NO: 6179397 - DNA, 20 bp, Homo sapiens
ctggctaccttgtgggaata

SEQ ID NO: 6179398 - DNA, 15 bp, Homo sapiens
ctggctactccctgg

SEQ ID NO: 6179399 - DNA, 16 bp, Homo sapiens
ctggctactccctgga

SEQ ID NO: 6179400 - DNA, 18 bp, Homo sapiens
ctggctactccctggacc

SEQ ID NO: 6179401 - DNA, 21 bp, Homo sapiens
ctggctactccctggaccacg

SEQ ID NO: 6179402 - DNA, 21 bp, Homo sapiens
ctggctactgtctattaaaat

SEQ ID NO: 6179403 - DNA, 20 bp, Homo sapiens
ctggctacttcccttcctcc

SEQ ID NO: 6179404 - DNA, 22 bp, Homo sapiens
ctggctacttcccttcctcccg

SEQ ID NO: 6179405 - DNA, 21 bp, Homo sapiens
ctggctagaggccagccccac

SEQ ID NO: 6179406 - DNA, 22 bp, Homo sapiens
ctggctagaggccagccccacc

SEQ ID NO: 6179407 - DNA, 15 bp, Homo sapiens
ctggctagagggccc

SEQ ID NO: 6179408 - DNA, 17 bp, Homo sapiens
ctggctagagggcccaa

SEQ ID NO: 6179409 - DNA, 18 bp, Homo sapiens
ctggctagagggcccaaa

SEQ ID NO: 6179410 - DNA, 14 bp, Homo sapiens
ctggctaggactgt

SEQ ID NO: 6179411 - DNA, 15 bp, Homo sapiens
ctggctagtgtggaa

SEQ ID NO: 6179412 - DNA, 23 bp, Homo sapiens
ctggctatagatgtcttttccca

SEQ ID NO: 6179413 - DNA, 22 bp, Homo sapiens
ctggctatgcatttgaaaattt

SEQ ID NO: 6179414 - DNA, 17 bp, Homo sapiens
ctggctatttaaaaagc

SEQ ID NO: 6179415 - DNA, 16 bp, Homo sapiens
ctggctatttttgtgt

SEQ ID NO: 6179416 - DNA, 23 bp, Homo sapiens
ctggctcacacttggctctgagg

SEQ ID NO: 6179417 - DNA, 12 bp, Homo sapiens
ctggctcacaga

SEQ ID NO: 6179418 - DNA, 18 bp, Homo sapiens
ctggctcacagccaccac

SEQ ID NO: 6179419 - DNA, 15 bp, Homo sapiens
ctggctcacagtaca

SEQ ID NO: 6179420 - DNA, 19 bp, Homo sapiens
ctggctcacagtacagcat

SEQ ID NO: 6179421 - DNA, 19 bp, Homo sapiens
ctggctcacgccccgctgt

SEQ ID NO: 6179422 - DNA, 20 bp, Homo sapiens
ctggctcacgccccgctgtg

SEQ ID NO: 6179423 - DNA, 22 bp, Homo sapiens
ctggctcacgccccgctgtgtc

SEQ ID NO: 6179424 - DNA, 23 bp, Homo sapiens
ctggctcacgccccgctgtgtcc

SEQ ID NO: 6179425 - DNA, 18 bp, Homo sapiens
ctggctcacgcgttctgg

SEQ ID NO: 6179426 - DNA, 22 bp, Homo sapiens
ctggctcacgcgttctgggagc

SEQ ID NO: 6179427 - DNA, 14 bp, Homo sapiens
ctggctcactggca

SEQ ID NO: 6179428 - DNA, 15 bp, Homo sapiens
ctggctcactggcag

SEQ ID NO: 6179429 - DNA, 14 bp, Homo sapiens
ctggctcagcccgg

SEQ ID NO: 6179430 - DNA, 17 bp, Homo sapiens
ctggctcagcctgtctc

SEQ ID NO: 6179431 - DNA, 13 bp, Homo sapiens
ctggctcagctgt

SEQ ID NO: 6179432 - DNA, 15 bp, Homo sapiens
ctggctcagctgtgg

SEQ ID NO: 6179433 - DNA, 17 bp, Homo sapiens
ctggctcagctgtggtc

SEQ ID NO: 6179434 - DNA, 19 bp, Homo sapiens
ctggctcagctgtggtccc

SEQ ID NO: 6179435 - DNA, 14 bp, Homo sapiens
ctggctcagggatc

SEQ ID NO: 6179436 - DNA, 23 bp, Homo sapiens
ctggctcagggatcttctccctc

SEQ ID NO: 6179437 - DNA, 21 bp, Homo sapiens
ctggctcatattcctgcagcc

SEQ ID NO: 6179438 - DNA, 23 bp, Homo sapiens
ctggctcatattcctgcagcctg

SEQ ID NO: 6179439 - DNA, 24 bp, Homo sapiens
ctggctcatattcctgcagcctgg

SEQ ID NO: 6179440 - DNA, 11 bp, Homo sapiens
ctggctcatgc

SEQ ID NO: 6179441 - DNA, 15 bp, Homo sapiens
ctggctcatgcccct

SEQ ID NO: 6179442 - DNA, 18 bp, Homo sapiens
ctggctcatgccccttgg

SEQ ID NO: 6179443 - DNA, 19 bp, Homo sapiens
ctggctccaaaccctcgag

SEQ ID NO: 6179444 - DNA, 20 bp, Homo sapiens
ctggctccaaaccctcgagg

SEQ ID NO: 6179445 - DNA, 13 bp, Homo sapiens
ctggctccacacc

SEQ ID NO: 6179446 - DNA, 11 bp, Homo sapiens
ctggctccacc

SEQ ID NO: 6179447 - DNA, 21 bp, Homo sapiens
ctggctccacgccctggggag

SEQ ID NO: 6179448 - DNA, 24 bp, Homo sapiens
ctggctccagaggacctgagactc

SEQ ID NO: 6179449 - DNA, 15 bp, Homo sapiens
ctggctccagcctgg

SEQ ID NO: 6179450 - DNA, 14 bp, Homo sapiens
ctggctccagctgg

SEQ ID NO: 6179451 - DNA, 20 bp, Homo sapiens
ctggctccagctggccggga

SEQ ID NO: 6179452 - DNA, 14 bp, Homo sapiens
ctggctccaggctc

SEQ ID NO: 6179453 - DNA, 16 bp, Homo sapiens
ctggctccaggctcca

SEQ ID NO: 6179454 - DNA, 18 bp, Homo sapiens
ctggctccaggctccagg

SEQ ID NO: 6179455 - DNA, 19 bp, Homo sapiens
ctggctccaggctccaggc

SEQ ID NO: 6179456 - DNA, 17 bp, Homo sapiens
ctggctccagtgaaact

SEQ ID NO: 6179457 - DNA, 15 bp, Homo sapiens
ctggctcccaaggga

SEQ ID NO: 6179458 - DNA, 20 bp, Homo sapiens
ctggctcccacaggcagctt

SEQ ID NO: 6179459 - DNA, 13 bp, Homo sapiens
ctggctcccacct

SEQ ID NO: 6179460 - DNA, 15 bp, Homo sapiens
ctggctcccacctgt

SEQ ID NO: 6179461 - DNA, 13 bp, Homo sapiens
ctggctcccaggg

SEQ ID NO: 6179462 - DNA, 16 bp, Homo sapiens
ctggctcccagggcca

SEQ ID NO: 6179463 - DNA, 18 bp, Homo sapiens
ctggctcccagggccatg

SEQ ID NO: 6179464 - DNA, 15 bp, Homo sapiens
ctggctcccagggtg

SEQ ID NO: 6179465 - DNA, 17 bp, Homo sapiens
ctggctcccagggtgga

SEQ ID NO: 6179466 - DNA, 15 bp, Homo sapiens
ctggctcccatctcc

SEQ ID NO: 6179467 - DNA, 22 bp, Homo sapiens
ctggctcccatctccctcccat

SEQ ID NO: 6179468 - DNA, 15 bp, Homo sapiens
ctggctccccaaagg

SEQ ID NO: 6179469 - DNA, 22 bp, Homo sapiens
ctggctccccaaggctgcaaag

SEQ ID NO: 6179470 - DNA, 21 bp, Homo sapiens
ctggctccccacgagtcacct

SEQ ID NO: 6179471 - DNA, 23 bp, Homo sapiens
ctggctccccacgagtcacctgc

SEQ ID NO: 6179472 - DNA, 20 bp, Homo sapiens
ctggctccccctccccaggc

SEQ ID NO: 6179473 - DNA, 20 bp, Homo sapiens
ctggctccccgagggctcag

SEQ ID NO: 6179474 - DNA, 15 bp, Homo sapiens
ctggctcccctgcag

SEQ ID NO: 6179475 - DNA, 21 bp, Homo sapiens
ctggctcccctgcagccctgg

SEQ ID NO: 6179476 - DNA, 13 bp, Homo sapiens
ctggctcccctgg

SEQ ID NO: 6179477 - DNA, 15 bp, Homo sapiens
ctggctcccctgggg

SEQ ID NO: 6179478 - DNA, 13 bp, Homo sapiens
ctggctccctcac

SEQ ID NO: 6179479 - DNA, 20 bp, Homo sapiens
ctggctccctcactctcagg

SEQ ID NO: 6179480 - DNA, 21 bp, Homo sapiens
ctggctccctcactctcagga

SEQ ID NO: 6179481 - DNA, 13 bp, Homo sapiens
ctggctccctccc

SEQ ID NO: 6179482 - DNA, 18 bp, Homo sapiens
ctggctccctcctccagg

SEQ ID NO: 6179483 - DNA, 21 bp, Homo sapiens
ctggctccctcctccaggcct

SEQ ID NO: 6179484 - DNA, 22 bp, Homo sapiens
ctggctccctcctccaggcctg

SEQ ID NO: 6179485 - DNA, 24 bp, Homo sapiens
ctggctccctcttggtcttcccag

SEQ ID NO: 6179486 - DNA, 12 bp, Homo sapiens
ctggctccctga

SEQ ID NO: 6179487 - DNA, 14 bp, Homo sapiens
ctggctccctgatg

SEQ ID NO: 6179488 - DNA, 14 bp, Homo sapiens
ctggctccctgccc

SEQ ID NO: 6179489 - DNA, 13 bp, Homo sapiens
ctggctccgcagg

SEQ ID NO: 6179490 - DNA, 17 bp, Homo sapiens
ctggctccgctgtgtgg

SEQ ID NO: 6179491 - DNA, 15 bp, Homo sapiens
ctggctcctagggga

SEQ ID NO: 6179492 - DNA, 16 bp, Homo sapiens
ctggctcctaggggaa

SEQ ID NO: 6179493 - DNA, 18 bp, Homo sapiens
ctggctcctccagcaaga

SEQ ID NO: 6179494 - DNA, 14 bp, Homo sapiens
ctggctcctccagg

SEQ ID NO: 6179495 - DNA, 12 bp, Homo sapiens
ctggctcctccc

SEQ ID NO: 6179496 - DNA, 16 bp, Homo sapiens
ctggctcctcccagca

SEQ ID NO: 6179497 - DNA, 15 bp, Homo sapiens
ctggctcctccgtct

SEQ ID NO: 6179498 - DNA, 16 bp, Homo sapiens
ctggctcctcctggaa

SEQ ID NO: 6179499 - DNA, 17 bp, Homo sapiens
ctggctcctcctggaaa

SEQ ID NO: 6179500 - DNA, 17 bp, Homo sapiens
ctggctcctctgtggtg

SEQ ID NO: 6179501 - DNA, 18 bp, Homo sapiens
ctggctcctctgtggtgt

SEQ ID NO: 6179502 - DNA, 22 bp, Homo sapiens
ctggctcctctgtggtgtctgc

SEQ ID NO: 6179503 - DNA, 11 bp, Homo sapiens
ctggctcctga

SEQ ID NO: 6179504 - DNA, 17 bp, Homo sapiens
ctggctcctgaggggca

SEQ ID NO: 6179505 - DNA, 13 bp, Homo sapiens
ctggctcctgatc

SEQ ID NO: 6179506 - DNA, 14 bp, Homo sapiens
ctggctcctggacc

SEQ ID NO: 6179507 - DNA, 13 bp, Homo sapiens
ctggctcctgtgt

SEQ ID NO: 6179508 - DNA, 15 bp, Homo sapiens
ctggctccttcacca

SEQ ID NO: 6179509 - DNA, 13 bp, Homo sapiens
ctggctccttgca

SEQ ID NO: 6179510 - DNA, 19 bp, Homo sapiens
ctggctccttgcagcaggg

SEQ ID NO: 6179511 - DNA, 21 bp, Homo sapiens
ctggctccttgcagcagggct

SEQ ID NO: 6179512 - DNA, 18 bp, Homo sapiens
ctggctccttgtgccaga

SEQ ID NO: 6179513 - DNA, 15 bp, Homo sapiens
ctggctcctttacaa

SEQ ID NO: 6179514 - DNA, 19 bp, Homo sapiens
ctggctcctttgcctctgc

SEQ ID NO: 6179515 - DNA, 18 bp, Homo sapiens
ctggctcggacccacccc

SEQ ID NO: 6179516 - DNA, 16 bp, Homo sapiens
ctggctcgtaggcctg

SEQ ID NO: 6179517 - DNA, 19 bp, Homo sapiens
ctggctctaccctgtctgt

SEQ ID NO: 6179518 - DNA, 17 bp, Homo sapiens
ctggctctaccttcctg

SEQ ID NO: 6179519 - DNA, 21 bp, Homo sapiens
ctggctctaccttcctgtccc

SEQ ID NO: 6179520 - DNA, 22 bp, Homo sapiens
ctggctctaccttcctgtccct

SEQ ID NO: 6179521 - DNA, 16 bp, Homo sapiens
ctggctctcacctcta

SEQ ID NO: 6179522 - DNA, 22 bp, Homo sapiens
ctggctctcacctctaggtccc

SEQ ID NO: 6179523 - DNA, 17 bp, Homo sapiens
ctggctctcagaggaaa

SEQ ID NO: 6179524 - DNA, 15 bp, Homo sapiens
ctggctctccaagtg

SEQ ID NO: 6179525 - DNA, 16 bp, Homo sapiens
ctggctctccaagtgc

SEQ ID NO: 6179526 - DNA, 22 bp, Homo sapiens
ctggctctccaagtgccagagg

SEQ ID NO: 6179527 - DNA, 18 bp, Homo sapiens
ctggctctcctgtagctc

SEQ ID NO: 6179528 - DNA, 23 bp, Homo sapiens
ctggctctcctgtagctctcctg

SEQ ID NO: 6179529 - DNA, 13 bp, Homo sapiens
ctggctctctcca

SEQ ID NO: 6179530 - DNA, 16 bp, Homo sapiens
ctggctctctccagga

SEQ ID NO: 6179531 - DNA, 13 bp, Homo sapiens
ctggctctgagcg

SEQ ID NO: 6179532 - DNA, 20 bp, Homo sapiens
ctggctctgagcgcctccat

SEQ ID NO: 6179533 - DNA, 15 bp, Homo sapiens
ctggctctgcactaa

SEQ ID NO: 6179534 - DNA, 12 bp, Homo sapiens
ctggctctgcag

SEQ ID NO: 6179535 - DNA, 13 bp, Homo sapiens
ctggctctgcagc

SEQ ID NO: 6179536 - DNA, 16 bp, Homo sapiens
ctggctctgcagcaca

SEQ ID NO: 6179537 - DNA, 17 bp, Homo sapiens
ctggctctgcagcacat

SEQ ID NO: 6179538 - DNA, 22 bp, Homo sapiens
ctggctctgccagcgtccccgg

SEQ ID NO: 6179539 - DNA, 13 bp, Homo sapiens
ctggctctgcccc

SEQ ID NO: 6179540 - DNA, 18 bp, Homo sapiens
ctggctctgccccctccc

SEQ ID NO: 6179541 - DNA, 20 bp, Homo sapiens
ctggctctgccccctccccc

SEQ ID NO: 6179542 - DNA, 21 bp, Homo sapiens
ctggctctgccccctccccca

SEQ ID NO: 6179543 - DNA, 14 bp, Homo sapiens
ctggctctgcccct

SEQ ID NO: 6179544 - DNA, 16 bp, Homo sapiens
ctggctctgcccctca

SEQ ID NO: 6179545 - DNA, 15 bp, Homo sapiens
ctggctctgcctcag

SEQ ID NO: 6179546 - DNA, 14 bp, Homo sapiens
ctggctctgctgtc

SEQ ID NO: 6179547 - DNA, 11 bp, Homo sapiens
ctggctctggg

SEQ ID NO: 6179548 - DNA, 14 bp, Homo sapiens
ctggctctgggact

SEQ ID NO: 6179549 - DNA, 12 bp, Homo sapiens
ctggctctgggg

SEQ ID NO: 6179550 - DNA, 21 bp, Homo sapiens
ctggctctgggggacccaggt

SEQ ID NO: 6179551 - DNA, 15 bp, Homo sapiens
ctggctctgtggagg

SEQ ID NO: 6179552 - DNA, 21 bp, Homo sapiens
ctggctctgttcggcctttgg

SEQ ID NO: 6179553 - DNA, 17 bp, Homo sapiens
ctggctcttccaggctg

SEQ ID NO: 6179554 - DNA, 19 bp, Homo sapiens
ctggctcttccaggctggg

SEQ ID NO: 6179555 - DNA, 20 bp, Homo sapiens
ctggctcttccaggctggga

SEQ ID NO: 6179556 - DNA, 22 bp, Homo sapiens
ctggctcttccaggctgggaga

SEQ ID NO: 6179557 - DNA, 15 bp, Homo sapiens
ctggctcttctgccc

SEQ ID NO: 6179558 - DNA, 21 bp, Homo sapiens
ctggctcttgatacccccctc

SEQ ID NO: 6179559 - DNA, 20 bp, Homo sapiens
ctggctctttgtgtgtctcc

SEQ ID NO: 6179560 - DNA, 21 bp, Homo sapiens
ctggctctttgtgtgtctcca

SEQ ID NO: 6179561 - DNA, 14 bp, Homo sapiens
ctggctgaaaatca

SEQ ID NO: 6179562 - DNA, 13 bp, Homo sapiens
ctggctgaaccct

SEQ ID NO: 6179563 - DNA, 20 bp, Homo sapiens
ctggctgaaccctgtgctgg

SEQ ID NO: 6179564 - DNA, 15 bp, Homo sapiens
cttgtttccaatgtt

SEQ ID NO: 6179565 - DNA, 15 bp, Homo sapiens
cttgtttccctgctg

SEQ ID NO: 6179566 - DNA, 16 bp, Homo sapiens
cttgtttcctgtgccc

SEQ ID NO: 6179567 - DNA, 12 bp, Homo sapiens
cttgtttctgaa

SEQ ID NO: 6179568 - DNA, 18 bp, Homo sapiens
cttgtttctgcatctttt

SEQ ID NO: 6179569 - DNA, 21 bp, Homo sapiens
cttgtttctgggtccctgctc

SEQ ID NO: 6179570 - DNA, 14 bp, Homo sapiens
cttgtttctgttgt

SEQ ID NO: 6179571 - DNA, 14 bp, Homo sapiens
cttgtttctgttta

SEQ ID NO: 6179572 - DNA, 18 bp, Homo sapiens
cttgtttctttctgtctc

SEQ ID NO: 6179573 - DNA, 14 bp, Homo sapiens
cttgtttgaatatt

SEQ ID NO: 6179574 - DNA, 23 bp, Homo sapiens
cttgtttgagagagaatgaggaa

SEQ ID NO: 6179575 - DNA, 21 bp, Homo sapiens
cttgtttgagtttttcctccc

SEQ ID NO: 6179576 - DNA, 13 bp, Homo sapiens
cttgtttgatttc

SEQ ID NO: 6179577 - DNA, 18 bp, Homo sapiens
cttgtttgatttcaacat

SEQ ID NO: 6179578 - DNA, 20 bp, Homo sapiens
cttgtttgattttagctgca

SEQ ID NO: 6179579 - DNA, 23 bp, Homo sapiens
cttgtttgattttagctgcagaa

SEQ ID NO: 6179580 - DNA, 14 bp, Homo sapiens
cttgtttggggcag

SEQ ID NO: 6179581 - DNA, 17 bp, Homo sapiens
cttgtttggggcaggag

SEQ ID NO: 6179582 - DNA, 19 bp, Homo sapiens
cttgtttggtagttagcca

SEQ ID NO: 6179583 - DNA, 22 bp, Homo sapiens
cttgtttggtttggtttgcttt

SEQ ID NO: 6179584 - DNA, 20 bp, Homo sapiens
cttgtttgtaaaagagctgt

SEQ ID NO: 6179585 - DNA, 22 bp, Homo sapiens
cttgtttgtcagcatctgacca

SEQ ID NO: 6179586 - DNA, 17 bp, Homo sapiens
cttgtttgttactgtca

SEQ ID NO: 6179587 - DNA, 14 bp, Homo sapiens
cttgtttgttctag

SEQ ID NO: 6179588 - DNA, 13 bp, Homo sapiens
cttgtttgtttta

SEQ ID NO: 6179589 - DNA, 21 bp, Homo sapiens
cttgttttaagcaaatgcatt

SEQ ID NO: 6179590 - DNA, 15 bp, Homo sapiens
cttgttttaatttta

SEQ ID NO: 6179591 - DNA, 14 bp, Homo sapiens
cttgttttctggga

SEQ ID NO: 6179592 - DNA, 14 bp, Homo sapiens
cttgttttcttgcc

SEQ ID NO: 6179593 - DNA, 19 bp, Homo sapiens
cttgttttgaaactagaaa

SEQ ID NO: 6179594 - DNA, 17 bp, Homo sapiens
cttgttttgatttatgg

SEQ ID NO: 6179595 - DNA, 17 bp, Homo sapiens
cttgttttgcttcccct

SEQ ID NO: 6179596 - DNA, 17 bp, Homo sapiens
cttgttttggatggctt

SEQ ID NO: 6179597 - DNA, 13 bp, Homo sapiens
cttgttttgttat

SEQ ID NO: 6179598 - DNA, 20 bp, Homo sapiens
cttgttttgttatataaaaa

SEQ ID NO: 6179599 - DNA, 22 bp, Homo sapiens
cttgttttgtttgcttccatta

SEQ ID NO: 6179600 - DNA, 15 bp, Homo sapiens
cttgtttttataata

SEQ ID NO: 6179601 - DNA, 18 bp, Homo sapiens
cttgtttttattaattta

SEQ ID NO: 6179602 - DNA, 18 bp, Homo sapiens
cttgtttttccactactg

SEQ ID NO: 6179603 - DNA, 19 bp, Homo sapiens
cttgtttttcttcagcatt

SEQ ID NO: 6179604 - DNA, 21 bp, Homo sapiens
cttgtttttcttcagcattta

SEQ ID NO: 6179605 - DNA, 16 bp, Homo sapiens
cttgtttttgcacatg

SEQ ID NO: 6179606 - DNA, 21 bp, Homo sapiens
cttgtttttgctactaattat

SEQ ID NO: 6179607 - DNA, 18 bp, Homo sapiens
cttgtttttggaaagaaa

SEQ ID NO: 6179608 - DNA, 15 bp, Homo sapiens
cttgtttttgtaaag

SEQ ID NO: 6179609 - DNA, 19 bp, Homo sapiens
ctttaaaaaaaaaatgctt

SEQ ID NO: 6179610 - DNA, 15 bp, Homo sapiens
ctttaaaaaaataat

SEQ ID NO: 6179611 - DNA, 16 bp, Homo sapiens
ctttaaaaaaatccca

SEQ ID NO: 6179612 - DNA, 16 bp, Homo sapiens
ctttaaaaaagactga

SEQ ID NO: 6179613 - DNA, 21 bp, Homo sapiens
ctttaaaaaagactgaacatg

SEQ ID NO: 6179614 - DNA, 13 bp, Homo sapiens
ctttaaaaaataa

SEQ ID NO: 6179615 - DNA, 17 bp, Homo sapiens
ctttaaaaaatatttat

SEQ ID NO: 6179616 - DNA, 17 bp, Homo sapiens
ctttaaaaacaggccag

SEQ ID NO: 6179617 - DNA, 14 bp, Homo sapiens
ctttaaaaactatt

SEQ ID NO: 6179618 - DNA, 19 bp, Homo sapiens
ctttaaaaactatttaact

SEQ ID NO: 6179619 - DNA, 14 bp, Homo sapiens
ctttaaaaagaaaa

SEQ ID NO: 6179620 - DNA, 15 bp, Homo sapiens
ctttaaaaagaaatt

SEQ ID NO: 6179621 - DNA, 18 bp, Homo sapiens
ctttaaaaagcagtcctc

SEQ ID NO: 6179622 - DNA, 21 bp, Homo sapiens
ctttaaaaagctccaaatgca

SEQ ID NO: 6179623 - DNA, 20 bp, Homo sapiens
ctttaaaaagggaagaaact

SEQ ID NO: 6179624 - DNA, 18 bp, Homo sapiens
ctttaaaaataaaagcta

SEQ ID NO: 6179625 - DNA, 22 bp, Homo sapiens
ctttaaaaatacatagcattaa

SEQ ID NO: 6179626 - DNA, 16 bp, Homo sapiens
ctttaaaaatgtctta

SEQ ID NO: 6179627 - DNA, 12 bp, Homo sapiens
ctttaaaaatta

SEQ ID NO: 6179628 - DNA, 13 bp, Homo sapiens
ctttaaaaattat

SEQ ID NO: 6179629 - DNA, 17 bp, Homo sapiens
ctttaaaaattattata

SEQ ID NO: 6179630 - DNA, 15 bp, Homo sapiens
ctttaaaacaaaaca

SEQ ID NO: 6179631 - DNA, 17 bp, Homo sapiens
ctttaaaacaaagggaa

SEQ ID NO: 6179632 - DNA, 19 bp, Homo sapiens
ctttaaaactcgaaaataa

SEQ ID NO: 6179633 - DNA, 15 bp, Homo sapiens
ctttaaaagaatgac

SEQ ID NO: 6179634 - DNA, 20 bp, Homo sapiens
ctttaaaagacaaatcaaag

SEQ ID NO: 6179635 - DNA, 15 bp, Homo sapiens
ctttaaaagatgaaa

SEQ ID NO: 6179636 - DNA, 15 bp, Homo sapiens
ctttaaaagcatttt

SEQ ID NO: 6179637 - DNA, 19 bp, Homo sapiens
ctttaaaaggattaatctg

SEQ ID NO: 6179638 - DNA, 12 bp, Homo sapiens
ctttaaaaggca

SEQ ID NO: 6179639 - DNA, 14 bp, Homo sapiens
ctttaaaagtgatc

SEQ ID NO: 6179640 - DNA, 18 bp, Homo sapiens
ctttaaaataaaaaagca

SEQ ID NO: 6179641 - DNA, 23 bp, Homo sapiens
ctttaaaataaggataataatca

SEQ ID NO: 6179642 - DNA, 19 bp, Homo sapiens
ctttaaaatatatgtctat

SEQ ID NO: 6179643 - DNA, 22 bp, Homo sapiens
ctttaaaatatttgtctttaaa

SEQ ID NO: 6179644 - DNA, 16 bp, Homo sapiens
ctttaaaatgcgaaat

SEQ ID NO: 6179645 - DNA, 17 bp, Homo sapiens
ctttaaaatgcgaaatt

SEQ ID NO: 6179646 - DNA, 23 bp, Homo sapiens
ctttaaaatgcgaaattattggt

SEQ ID NO: 6179647 - DNA, 14 bp, Homo sapiens
ctttaaaattcaag

SEQ ID NO: 6179648 - DNA, 18 bp, Homo sapiens
ctttaaaatttttttaga

SEQ ID NO: 6179649 - DNA, 18 bp, Homo sapiens
ctttaaacaaatatgaaa

SEQ ID NO: 6179650 - DNA, 14 bp, Homo sapiens
ctttaaacatgatt

SEQ ID NO: 6179651 - DNA, 20 bp, Homo sapiens
ctttaaacatgattatcttg

SEQ ID NO: 6179652 - DNA, 17 bp, Homo sapiens
ctttaaactaccctcca

SEQ ID NO: 6179653 - DNA, 13 bp, Homo sapiens
ctttaaactcagg

SEQ ID NO: 6179654 - DNA, 22 bp, Homo sapiens
ctttaaactcagggacagagcc

SEQ ID NO: 6179655 - DNA, 10 bp, Homo sapiens
ctttaaagaa

SEQ ID NO: 6179656 - DNA, 13 bp, Homo sapiens
ctttaaagactta

SEQ ID NO: 6179657 - DNA, 17 bp, Homo sapiens
ctttaaagacttaagat

SEQ ID NO: 6179658 - DNA, 15 bp, Homo sapiens
ctttaaagagagttt

SEQ ID NO: 6179659 - DNA, 17 bp, Homo sapiens
ctttaaagagtcctcct

SEQ ID NO: 6179660 - DNA, 22 bp, Homo sapiens
ctttaaagagtcctccttccca

SEQ ID NO: 6179661 - DNA, 14 bp, Homo sapiens
ctttaaagataagt

SEQ ID NO: 6179662 - DNA, 20 bp, Homo sapiens
ctttaaagatgaactctgaa

SEQ ID NO: 6179663 - DNA, 19 bp, Homo sapiens
ctttaaagccgtgctcttt

SEQ ID NO: 6179664 - DNA, 15 bp, Homo sapiens
ctttaaagctcagga

SEQ ID NO: 6179665 - DNA, 18 bp, Homo sapiens
ctttaaagctcaggaggg

SEQ ID NO: 6179666 - DNA, 14 bp, Homo sapiens
ctttaaaggaaaaa

SEQ ID NO: 6179667 - DNA, 19 bp, Homo sapiens
ctttaaaggaaaaaatgtt

SEQ ID NO: 6179668 - DNA, 14 bp, Homo sapiens
ctttaaaggcccag

SEQ ID NO: 6179669 - DNA, 15 bp, Homo sapiens
ctttaaaggcccagc

SEQ ID NO: 6179670 - DNA, 16 bp, Homo sapiens
ctttaaaggcccagcc

SEQ ID NO: 6179671 - DNA, 18 bp, Homo sapiens
ctttaaaggcccagcccc

SEQ ID NO: 6179672 - DNA, 20 bp, Homo sapiens
ctttaaagggatggcaagat

SEQ ID NO: 6179673 - DNA, 21 bp, Homo sapiens
ctttaaaggtttttaaattgt

SEQ ID NO: 6179674 - DNA, 17 bp, Homo sapiens
ctttaaagtacctgtag

SEQ ID NO: 6179675 - DNA, 23 bp, Homo sapiens
ctttaaagtacctgtagtgagaa

SEQ ID NO: 6179676 - DNA, 16 bp, Homo sapiens
ctttaaagtatgaatc

SEQ ID NO: 6179677 - DNA, 15 bp, Homo sapiens
ctttaaagtatttct

SEQ ID NO: 6179678 - DNA, 12 bp, Homo sapiens
ctttaaagtctt

SEQ ID NO: 6179679 - DNA, 23 bp, Homo sapiens
ctttaaagtgactaatggcatga

SEQ ID NO: 6179680 - DNA, 20 bp, Homo sapiens
ctttaaataaaaataagtca

SEQ ID NO: 6179681 - DNA, 23 bp, Homo sapiens
ctttaaataaatgtgagaactgt

SEQ ID NO: 6179682 - DNA, 14 bp, Homo sapiens
ctttaaataattta

SEQ ID NO: 6179683 - DNA, 13 bp, Homo sapiens
ctttaaatataat

SEQ ID NO: 6179684 - DNA, 15 bp, Homo sapiens
ctttaaatatatatt

SEQ ID NO: 6179685 - DNA, 18 bp, Homo sapiens
ctttaaatatatattatt

SEQ ID NO: 6179686 - DNA, 12 bp, Homo sapiens
ctttaaatatca

SEQ ID NO: 6179687 - DNA, 14 bp, Homo sapiens
ctttaaatatcatt

SEQ ID NO: 6179688 - DNA, 16 bp, Homo sapiens
ctttaaatatcattct

SEQ ID NO: 6179689 - DNA, 12 bp, Homo sapiens
ctttaaatcaaa

SEQ ID NO: 6179690 - DNA, 16 bp, Homo sapiens
ctttaaatcaaaagct

SEQ ID NO: 6179691 - DNA, 19 bp, Homo sapiens
ctttaaatcaaaagctgct

SEQ ID NO: 6179692 - DNA, 21 bp, Homo sapiens
ctttaaatcaaaagctgcttg

SEQ ID NO: 6179693 - DNA, 15 bp, Homo sapiens
ctttaaatcattaga

SEQ ID NO: 6179694 - DNA, 21 bp, Homo sapiens
ctttaaatcatttatctggat

SEQ ID NO: 6179695 - DNA, 15 bp, Homo sapiens
ctttaaatctgtgat

SEQ ID NO: 6179696 - DNA, 21 bp, Homo sapiens
ctttaaatgcaacagttttta

SEQ ID NO: 6179697 - DNA, 17 bp, Homo sapiens
ctttaaatggaataatt

SEQ ID NO: 6179698 - DNA, 15 bp, Homo sapiens
ctttaaatggggacg

SEQ ID NO: 6179699 - DNA, 12 bp, Homo sapiens
ctttaaattatg

SEQ ID NO: 6179700 - DNA, 14 bp, Homo sapiens
ctttaaattatgac

SEQ ID NO: 6179701 - DNA, 13 bp, Homo sapiens
ctttaaattgtgt

SEQ ID NO: 6179702 - DNA, 15 bp, Homo sapiens
ctttaaattgttcct

SEQ ID NO: 6179703 - DNA, 17 bp, Homo sapiens
ctttaaattgttcctct

SEQ ID NO: 6179704 - DNA, 19 bp, Homo sapiens
ctttaaattgttcctcttt

SEQ ID NO: 6179705 - DNA, 22 bp, Homo sapiens
ctttaaattgttcctctttgtt

SEQ ID NO: 6179706 - DNA, 23 bp, Homo sapiens
ctttaaatttaggtaaataaagc

SEQ ID NO: 6179707 - DNA, 17 bp, Homo sapiens
ctttaacaaaacaagaa

SEQ ID NO: 6179708 - DNA, 23 bp, Homo sapiens
ctttaacaaaacaagaaagaaac

SEQ ID NO: 6179709 - DNA, 15 bp, Homo sapiens
ctttaacaacatgtt

SEQ ID NO: 6179710 - DNA, 16 bp, Homo sapiens
ctttaacaacatgttt

SEQ ID NO: 6179711 - DNA, 19 bp, Homo sapiens
ctttaacaacatgtttcca

SEQ ID NO: 6179712 - DNA, 17 bp, Homo sapiens
ctttaacaattgtctta

SEQ ID NO: 6179713 - DNA, 18 bp, Homo sapiens
ctttaacaattgtcttaa

SEQ ID NO: 6179714 - DNA, 16 bp, Homo sapiens
ctttaacacagtgtct

SEQ ID NO: 6179715 - DNA, 23 bp, Homo sapiens
ctttaacacattctttataaaat

SEQ ID NO: 6179716 - DNA, 18 bp, Homo sapiens
ctttaacagaaactttca

SEQ ID NO: 6179717 - DNA, 20 bp, Homo sapiens
ctttaacagctttctccaga

SEQ ID NO: 6179718 - DNA, 14 bp, Homo sapiens
ctttaacagtggag

SEQ ID NO: 6179719 - DNA, 17 bp, Homo sapiens
ctttaacatagtcctgt

SEQ ID NO: 6179720 - DNA, 21 bp, Homo sapiens
ctttaacatatcattcagaat

SEQ ID NO: 6179721 - DNA, 12 bp, Homo sapiens
ctttaacatgcc

SEQ ID NO: 6179722 - DNA, 18 bp, Homo sapiens
ctttaacattttggaaat

SEQ ID NO: 6179723 - DNA, 17 bp, Homo sapiens
ctttaaccagtctgaag

SEQ ID NO: 6179724 - DNA, 18 bp, Homo sapiens
ctttaacccaatggagac

SEQ ID NO: 6179725 - DNA, 15 bp, Homo sapiens
ctttaaccctcactg

SEQ ID NO: 6179726 - DNA, 17 bp, Homo sapiens
ctttaaccgtttttcaa

SEQ ID NO: 6179727 - DNA, 17 bp, Homo sapiens
ctttaacctatgataat

SEQ ID NO: 6179728 - DNA, 17 bp, Homo sapiens
ctttaactcccattacc

SEQ ID NO: 6179729 - DNA, 21 bp, Homo sapiens
ctttaactcccattaccatgt

SEQ ID NO: 6179730 - DNA, 22 bp, Homo sapiens
ctttaactcgttgcagtctgta

SEQ ID NO: 6179731 - DNA, 14 bp, Homo sapiens
ctttaactctgcgg

SEQ ID NO: 6179732 - DNA, 18 bp, Homo sapiens
ctttaactgacaagccat

SEQ ID NO: 6179733 - DNA, 23 bp, Homo sapiens
ctttaactgccgtaatttaactt

SEQ ID NO: 6179734 - DNA, 20 bp, Homo sapiens
ctttaactgtatccttaacc

SEQ ID NO: 6179735 - DNA, 15 bp, Homo sapiens
ctttaacttaaatag

SEQ ID NO: 6179736 - DNA, 13 bp, Homo sapiens
ctttaacttagta

SEQ ID NO: 6179737 - DNA, 20 bp, Homo sapiens
ctttaacttttttttctctc

SEQ ID NO: 6179738 - DNA, 21 bp, Homo sapiens
ctttaagaaaaacatctggat

SEQ ID NO: 6179739 - DNA, 23 bp, Homo sapiens
ctttaagaaaaacatctggatat

SEQ ID NO: 6179740 - DNA, 20 bp, Homo sapiens
ctttaagaaccttaatgaca

SEQ ID NO: 6179741 - DNA, 15 bp, Homo sapiens
ctttaagaactaaaa

SEQ ID NO: 6179742 - DNA, 22 bp, Homo sapiens
ctttaagaactaaaatgttcta

SEQ ID NO: 6179743 - DNA, 19 bp, Homo sapiens
ctggctgaacttggagagg

SEQ ID NO: 6179744 - DNA, 23 bp, Homo sapiens
ctggctgaacttggagagggggc

SEQ ID NO: 6179745 - DNA, 12 bp, Homo sapiens
ctggctgaagaa

SEQ ID NO: 6179746 - DNA, 20 bp, Homo sapiens
ctggctgaagaatgaagacc

SEQ ID NO: 6179747 - DNA, 20 bp, Homo sapiens
ctggctgaagaggaccagag

SEQ ID NO: 6179748 - DNA, 19 bp, Homo sapiens
ctggctgaccccaaagagc

SEQ ID NO: 6179749 - DNA, 22 bp, Homo sapiens
ctggctgaccccaaagagcctg

SEQ ID NO: 6179750 - DNA, 23 bp, Homo sapiens
ctggctgaccccaaagagcctgg

SEQ ID NO: 6179751 - DNA, 17 bp, Homo sapiens
ctggctgacctgctgtg

SEQ ID NO: 6179752 - DNA, 18 bp, Homo sapiens
ctggctgacctgggccca

SEQ ID NO: 6179753 - DNA, 19 bp, Homo sapiens
ctggctgagaatctggggg

SEQ ID NO: 6179754 - DNA, 22 bp, Homo sapiens
ctggctgagcagttcccctgga

SEQ ID NO: 6179755 - DNA, 12 bp, Homo sapiens
ctggctgagccc

SEQ ID NO: 6179756 - DNA, 15 bp, Homo sapiens
ctggctgagcccctg

SEQ ID NO: 6179757 - DNA, 17 bp, Homo sapiens
ctggctgagcccctggg

SEQ ID NO: 6179758 - DNA, 20 bp, Homo sapiens
ctggctgagcccctggggaa

SEQ ID NO: 6179759 - DNA, 12 bp, Homo sapiens
ctggctgatgat

SEQ ID NO: 6179760 - DNA, 18 bp, Homo sapiens
ctggctgatgatccagaa

SEQ ID NO: 6179761 - DNA, 19 bp, Homo sapiens
ctggctgatgatccagaac

SEQ ID NO: 6179762 - DNA, 17 bp, Homo sapiens
ctggctgattcagcatt

SEQ ID NO: 6179763 - DNA, 20 bp, Homo sapiens
ctggctgcaagggccagagt

SEQ ID NO: 6179764 - DNA, 22 bp, Homo sapiens
ctggctgcaagggccagagttc

SEQ ID NO: 6179765 - DNA, 15 bp, Homo sapiens
ctggctgcagcctcc

SEQ ID NO: 6179766 - DNA, 16 bp, Homo sapiens
ctggctgcagcggcag

SEQ ID NO: 6179767 - DNA, 12 bp, Homo sapiens
ctggctgcagct

SEQ ID NO: 6179768 - DNA, 13 bp, Homo sapiens
ctggctgccaggc

SEQ ID NO: 6179769 - DNA, 14 bp, Homo sapiens
ctggctgccaggcg

SEQ ID NO: 6179770 - DNA, 18 bp, Homo sapiens
ctggctgccaggcgttgg

SEQ ID NO: 6179771 - DNA, 13 bp, Homo sapiens
ctggctgcccaga

SEQ ID NO: 6179772 - DNA, 16 bp, Homo sapiens
ctggctgccccaacct

SEQ ID NO: 6179773 - DNA, 20 bp, Homo sapiens
ctggctgccccaacctgctg

SEQ ID NO: 6179774 - DNA, 15 bp, Homo sapiens
ctggctgcccctcac

SEQ ID NO: 6179775 - DNA, 17 bp, Homo sapiens
ctggctgccctggccct

SEQ ID NO: 6179776 - DNA, 18 bp, Homo sapiens
ctggctgccctggccctg

SEQ ID NO: 6179777 - DNA, 20 bp, Homo sapiens
ctggctgccctggccctgag

SEQ ID NO: 6179778 - DNA, 22 bp, Homo sapiens
ctggctgcctccactcccactt

SEQ ID NO: 6179779 - DNA, 13 bp, Homo sapiens
ctggctgcctggc

SEQ ID NO: 6179780 - DNA, 17 bp, Homo sapiens
ctggctgcctggcccag

SEQ ID NO: 6179781 - DNA, 12 bp, Homo sapiens
ctggctgcgggg

SEQ ID NO: 6179782 - DNA, 20 bp, Homo sapiens
ctggctgctccctgctccca

SEQ ID NO: 6179783 - DNA, 22 bp, Homo sapiens
ctggctgctccctgctcccagg

SEQ ID NO: 6179784 - DNA, 13 bp, Homo sapiens
ctggctgctccta

SEQ ID NO: 6179785 - DNA, 12 bp, Homo sapiens
ctggctgctctc

SEQ ID NO: 6179786 - DNA, 20 bp, Homo sapiens
ctggctgctctcatgcctgc

SEQ ID NO: 6179787 - DNA, 20 bp, Homo sapiens
ctggctgctgatcgccttcc

SEQ ID NO: 6179788 - DNA, 12 bp, Homo sapiens
ctggctgctgcc

SEQ ID NO: 6179789 - DNA, 12 bp, Homo sapiens
ctggctgctggc

SEQ ID NO: 6179790 - DNA, 18 bp, Homo sapiens
ctggctgctggcccacag

SEQ ID NO: 6179791 - DNA, 20 bp, Homo sapiens
ctggctgctggcccacagct

SEQ ID NO: 6179792 - DNA, 17 bp, Homo sapiens
ctggctgcttgcagcca

SEQ ID NO: 6179793 - DNA, 23 bp, Homo sapiens
ctggctggaaagcagagcctcct

SEQ ID NO: 6179794 - DNA, 19 bp, Homo sapiens
ctggctggaacactttcag

SEQ ID NO: 6179795 - DNA, 15 bp, Homo sapiens
ctggctggagaggaa

SEQ ID NO: 6179796 - DNA, 18 bp, Homo sapiens
ctggctggagtctcagag

SEQ ID NO: 6179797 - DNA, 19 bp, Homo sapiens
ctggctggagtctcagagc

SEQ ID NO: 6179798 - DNA, 20 bp, Homo sapiens
ctggctggagtctcagagca

SEQ ID NO: 6179799 - DNA, 22 bp, Homo sapiens
ctggctggagtctcagagcaca

SEQ ID NO: 6179800 - DNA, 14 bp, Homo sapiens
ctggctggccagga

SEQ ID NO: 6179801 - DNA, 15 bp, Homo sapiens
ctggctggccaggac

SEQ ID NO: 6179802 - DNA, 17 bp, Homo sapiens
ctggctggcccagagtt

SEQ ID NO: 6179803 - DNA, 13 bp, Homo sapiens
ctggctggcctca

SEQ ID NO: 6179804 - DNA, 17 bp, Homo sapiens
ctggctggcctgagcaa

SEQ ID NO: 6179805 - DNA, 15 bp, Homo sapiens
ctggctggctgaggg

SEQ ID NO: 6179806 - DNA, 15 bp, Homo sapiens
ctggctggctgtgtc

SEQ ID NO: 6179807 - DNA, 16 bp, Homo sapiens
ctggctggctgtgtcc

SEQ ID NO: 6179808 - DNA, 17 bp, Homo sapiens
ctggctggctgtgtcct

SEQ ID NO: 6179809 - DNA, 18 bp, Homo sapiens
ctggctggctgtgtcctc

SEQ ID NO: 6179810 - DNA, 15 bp, Homo sapiens
ctggctgggactggg

SEQ ID NO: 6179811 - DNA, 22 bp, Homo sapiens
ctggctgggagtccttacctcg

SEQ ID NO: 6179812 - DNA, 16 bp, Homo sapiens
ctggctgggatcagag

SEQ ID NO: 6179813 - DNA, 11 bp, Homo sapiens
ctggctgggcc

SEQ ID NO: 6179814 - DNA, 16 bp, Homo sapiens
ctggctgggcccctgg

SEQ ID NO: 6179815 - DNA, 23 bp, Homo sapiens
ctggctgggcccctggggacaga

SEQ ID NO: 6179816 - DNA, 21 bp, Homo sapiens
ctggctgggccttcaccaagc

SEQ ID NO: 6179817 - DNA, 23 bp, Homo sapiens
ctggctgggccttcaccaagcaa

SEQ ID NO: 6179818 - DNA, 17 bp, Homo sapiens
ctggctgggctctggtg

SEQ ID NO: 6179819 - DNA, 14 bp, Homo sapiens
ctggctggggatgg

SEQ ID NO: 6179820 - DNA, 13 bp, Homo sapiens
ctggctggggcag

SEQ ID NO: 6179821 - DNA, 16 bp, Homo sapiens
ctggctggggcagagg

SEQ ID NO: 6179822 - DNA, 22 bp, Homo sapiens
ctggctggggcagaggggcagc

SEQ ID NO: 6179823 - DNA, 13 bp, Homo sapiens
ctggctggggccg

SEQ ID NO: 6179824 - DNA, 18 bp, Homo sapiens
ctggctggggccggggct

SEQ ID NO: 6179825 - DNA, 22 bp, Homo sapiens
ctggctggggccggggctgccg

SEQ ID NO: 6179826 - DNA, 24 bp, Homo sapiens
ctggctggggcctatcagtgtgcc

SEQ ID NO: 6179827 - DNA, 16 bp, Homo sapiens
ctggctgggggcctca

SEQ ID NO: 6179828 - DNA, 19 bp, Homo sapiens
ctggctgggggcctcactc

SEQ ID NO: 6179829 - DNA, 21 bp, Homo sapiens
ctggctgggtggcaccagcag

SEQ ID NO: 6179830 - DNA, 19 bp, Homo sapiens
ctggctgggttcaggtccc

SEQ ID NO: 6179831 - DNA, 20 bp, Homo sapiens
ctggctggtaaatgacatct

SEQ ID NO: 6179832 - DNA, 18 bp, Homo sapiens
ctggctggtaagggccaa

SEQ ID NO: 6179833 - DNA, 18 bp, Homo sapiens
ctggctggtgggccccca

SEQ ID NO: 6179834 - DNA, 16 bp, Homo sapiens
ctggctggtgttaaca

SEQ ID NO: 6179835 - DNA, 18 bp, Homo sapiens
ctggctggtgttaacaga

SEQ ID NO: 6179836 - DNA, 16 bp, Homo sapiens
ctggctgtaaggctct

SEQ ID NO: 6179837 - DNA, 17 bp, Homo sapiens
ctggctgtaaggctcta

SEQ ID NO: 6179838 - DNA, 20 bp, Homo sapiens
ctggctgtaaggctctagat

SEQ ID NO: 6179839 - DNA, 18 bp, Homo sapiens
ctggctgtacctgttcct

SEQ ID NO: 6179840 - DNA, 21 bp, Homo sapiens
ctggctgtactgctcaggctg

SEQ ID NO: 6179841 - DNA, 20 bp, Homo sapiens
ctggctgtccaaccagactt

SEQ ID NO: 6179842 - DNA, 17 bp, Homo sapiens
ctggctgtctagaatgt

SEQ ID NO: 6179843 - DNA, 18 bp, Homo sapiens
ctggctgtctagaatgtg

SEQ ID NO: 6179844 - DNA, 22 bp, Homo sapiens
ctggctgtgaagacccaggaga

SEQ ID NO: 6179845 - DNA, 18 bp, Homo sapiens
ctggctgtgaatgccaaa

SEQ ID NO: 6179846 - DNA, 14 bp, Homo sapiens
ctggctgtgacaat

SEQ ID NO: 6179847 - DNA, 19 bp, Homo sapiens
ctggctgtgacacctggtg

SEQ ID NO: 6179848 - DNA, 14 bp, Homo sapiens
ctggctgtgagcag

SEQ ID NO: 6179849 - DNA, 15 bp, Homo sapiens
ctggctgtgagcagc

SEQ ID NO: 6179850 - DNA, 14 bp, Homo sapiens
ctggctgtgcccag

SEQ ID NO: 6179851 - DNA, 15 bp, Homo sapiens
ctggctgtgcccagc

SEQ ID NO: 6179852 - DNA, 17 bp, Homo sapiens
ctggctgtgcccagcag

SEQ ID NO: 6179853 - DNA, 18 bp, Homo sapiens
ctggctgtgcccagcagg

SEQ ID NO: 6179854 - DNA, 21 bp, Homo sapiens
ctggctgtgcccagcaggccc

SEQ ID NO: 6179855 - DNA, 16 bp, Homo sapiens
ctggctgtgcccctga

SEQ ID NO: 6179856 - DNA, 18 bp, Homo sapiens
ctggctgtgcccctgatg

SEQ ID NO: 6179857 - DNA, 19 bp, Homo sapiens
ctggctgtgcccctgatgc

SEQ ID NO: 6179858 - DNA, 15 bp, Homo sapiens
ctggctgtgcctccc

SEQ ID NO: 6179859 - DNA, 19 bp, Homo sapiens
ctggctgtgcctcccccgc

SEQ ID NO: 6179860 - DNA, 16 bp, Homo sapiens
ctggctgtgcctgctt

SEQ ID NO: 6179861 - DNA, 16 bp, Homo sapiens
ctggctgtggaggcct

SEQ ID NO: 6179862 - DNA, 20 bp, Homo sapiens
ctggctgtggatagcccata

SEQ ID NO: 6179863 - DNA, 17 bp, Homo sapiens
ctggctgtgggctccct

SEQ ID NO: 6179864 - DNA, 13 bp, Homo sapiens
ctggctgtgtcct

SEQ ID NO: 6179865 - DNA, 19 bp, Homo sapiens
ctggctgtgtcctctccag

SEQ ID NO: 6179866 - DNA, 16 bp, Homo sapiens
ctggctgtgtgacttt

SEQ ID NO: 6179867 - DNA, 15 bp, Homo sapiens
ctggctgtgtggcca

SEQ ID NO: 6179868 - DNA, 16 bp, Homo sapiens
ctggctgttcccctgc

SEQ ID NO: 6179869 - DNA, 16 bp, Homo sapiens
ctggctgttggctggg

SEQ ID NO: 6179870 - DNA, 17 bp, Homo sapiens
ctggctgttggctgggg

SEQ ID NO: 6179871 - DNA, 18 bp, Homo sapiens
ctggctgttggctggggg

SEQ ID NO: 6179872 - DNA, 19 bp, Homo sapiens
ctggctgttggctgggggc

SEQ ID NO: 6179873 - DNA, 19 bp, Homo sapiens
ctggctgtttagcagaact

SEQ ID NO: 6179874 - DNA, 20 bp, Homo sapiens
ctggctgtttagcagaactc

SEQ ID NO: 6179875 - DNA, 19 bp, Homo sapiens
ctggcttaaacaacacctc

SEQ ID NO: 6179876 - DNA, 21 bp, Homo sapiens
ctggcttaaacaacacctcct

SEQ ID NO: 6179877 - DNA, 22 bp, Homo sapiens
ctggcttaaacaacacctcctc

SEQ ID NO: 6179878 - DNA, 20 bp, Homo sapiens
ctggcttacctatctgtgga

SEQ ID NO: 6179879 - DNA, 21 bp, Homo sapiens
ctggcttatgctcagaagcca

SEQ ID NO: 6179880 - DNA, 22 bp, Homo sapiens
ctggcttattcccaactgctct

SEQ ID NO: 6179881 - DNA, 14 bp, Homo sapiens
ctggcttattttaa

SEQ ID NO: 6179882 - DNA, 22 bp, Homo sapiens
ctggcttattttaatgtgatga

SEQ ID NO: 6179883 - DNA, 21 bp, Homo sapiens
ctggcttcaggcaattctcct

SEQ ID NO: 6179884 - DNA, 20 bp, Homo sapiens
ctggcttcagggagggttag

SEQ ID NO: 6179885 - DNA, 24 bp, Homo sapiens
ctggcttccagcttcaggcaccag

SEQ ID NO: 6179886 - DNA, 12 bp, Homo sapiens
ctggcttccagg

SEQ ID NO: 6179887 - DNA, 15 bp, Homo sapiens
ctggcttccaggtat

SEQ ID NO: 6179888 - DNA, 22 bp, Homo sapiens
ctggcttccaggtatctccagg

SEQ ID NO: 6179889 - DNA, 17 bp, Homo sapiens
ctggcttccccttcaga

SEQ ID NO: 6179890 - DNA, 21 bp, Homo sapiens
ctggcttccctaaactgcagc

SEQ ID NO: 6179891 - DNA, 17 bp, Homo sapiens
ctggcttccctgcccaa

SEQ ID NO: 6179892 - DNA, 13 bp, Homo sapiens
ctggcttccctgg

SEQ ID NO: 6179893 - DNA, 15 bp, Homo sapiens
ctggcttccctggaa

SEQ ID NO: 6179894 - DNA, 16 bp, Homo sapiens
ctggcttccctggaag

SEQ ID NO: 6179895 - DNA, 17 bp, Homo sapiens
ctggcttccctggaagc

SEQ ID NO: 6179896 - DNA, 21 bp, Homo sapiens
ctggcttccgctgtcacccag

SEQ ID NO: 6179897 - DNA, 18 bp, Homo sapiens
ctggcttccttctctcaa

SEQ ID NO: 6179898 - DNA, 20 bp, Homo sapiens
ctggcttctagtctggtgtt

SEQ ID NO: 6179899 - DNA, 16 bp, Homo sapiens
ctggcttctccctgga

SEQ ID NO: 6179900 - DNA, 20 bp, Homo sapiens
ctggcttctccctggactct

SEQ ID NO: 6179901 - DNA, 12 bp, Homo sapiens
ctggcttctctc

SEQ ID NO: 6179902 - DNA, 20 bp, Homo sapiens
ctggcttctctcttttcctc

SEQ ID NO: 6179903 - DNA, 21 bp, Homo sapiens
ctggcttctctcttttcctcc

SEQ ID NO: 6179904 - DNA, 23 bp, Homo sapiens
ctggcttctctcttttcctcctc

SEQ ID NO: 6179905 - DNA, 23 bp, Homo sapiens
ctggcttctctgtgcccctgtaa

SEQ ID NO: 6179906 - DNA, 18 bp, Homo sapiens
ctggcttctgaagagcct

SEQ ID NO: 6179907 - DNA, 14 bp, Homo sapiens
ctggcttctgggac

SEQ ID NO: 6179908 - DNA, 12 bp, Homo sapiens
ctggcttctgtg

SEQ ID NO: 6179909 - DNA, 14 bp, Homo sapiens
ctggcttctgtggg

SEQ ID NO: 6179910 - DNA, 17 bp, Homo sapiens
ctggcttctgtggggcc

SEQ ID NO: 6179911 - DNA, 19 bp, Homo sapiens
ctggcttctgtggggcccc

SEQ ID NO: 6179912 - DNA, 23 bp, Homo sapiens
ctggcttctgtggggcccctcac

SEQ ID NO: 6179913 - DNA, 16 bp, Homo sapiens
ctggcttgaaggactg

SEQ ID NO: 6179914 - DNA, 16 bp, Homo sapiens
ctggcttgacagcatg

SEQ ID NO: 6179915 - DNA, 15 bp, Homo sapiens
ctggcttgccccagg

SEQ ID NO: 6179916 - DNA, 18 bp, Homo sapiens
ctggcttgccccaggact

SEQ ID NO: 6179917 - DNA, 14 bp, Homo sapiens
ctggcttgctccag

SEQ ID NO: 6179918 - DNA, 15 bp, Homo sapiens
ctggcttgctccagg

SEQ ID NO: 6179919 - DNA, 19 bp, Homo sapiens
ctggcttgctccagggtct

SEQ ID NO: 6179920 - DNA, 12 bp, Homo sapiens
ctggcttggagg

SEQ ID NO: 6179921 - DNA, 13 bp, Homo sapiens
ctttaagaatgaa

SEQ ID NO: 6179922 - DNA, 13 bp, Homo sapiens
ctttaagacagaa

SEQ ID NO: 6179923 - DNA, 13 bp, Homo sapiens
ctttaagagactc

SEQ ID NO: 6179924 - DNA, 14 bp, Homo sapiens
ctttaagagactca

SEQ ID NO: 6179925 - DNA, 17 bp, Homo sapiens
ctttaagagagaaatct

SEQ ID NO: 6179926 - DNA, 14 bp, Homo sapiens
ctttaagaggacat

SEQ ID NO: 6179927 - DNA, 19 bp, Homo sapiens
ctttaagagtttaaaatca

SEQ ID NO: 6179928 - DNA, 20 bp, Homo sapiens
ctttaagcaaggtgtccctg

SEQ ID NO: 6179929 - DNA, 20 bp, Homo sapiens
ctttaagcactacataaact

SEQ ID NO: 6179930 - DNA, 14 bp, Homo sapiens
ctttaagcagctct

SEQ ID NO: 6179931 - DNA, 16 bp, Homo sapiens
ctttaagcagctcttg

SEQ ID NO: 6179932 - DNA, 17 bp, Homo sapiens
ctttaagcagctcttgc

SEQ ID NO: 6179933 - DNA, 19 bp, Homo sapiens
ctttaagcagctcttgcta

SEQ ID NO: 6179934 - DNA, 21 bp, Homo sapiens
ctttaagcagctcttgctaat

SEQ ID NO: 6179935 - DNA, 19 bp, Homo sapiens
ctttaagccatagaccctg

SEQ ID NO: 6179936 - DNA, 17 bp, Homo sapiens
ctttaagctccagcttt

SEQ ID NO: 6179937 - DNA, 12 bp, Homo sapiens
ctttaaggaaaa

SEQ ID NO: 6179938 - DNA, 15 bp, Homo sapiens
ctttaaggaagaata

SEQ ID NO: 6179939 - DNA, 15 bp, Homo sapiens
ctttaaggagataga

SEQ ID NO: 6179940 - DNA, 19 bp, Homo sapiens
ctttaagggcatgccttgt

SEQ ID NO: 6179941 - DNA, 20 bp, Homo sapiens
ctttaaggtactgaagcttt

SEQ ID NO: 6179942 - DNA, 14 bp, Homo sapiens
ctttaaggttcaga

SEQ ID NO: 6179943 - DNA, 17 bp, Homo sapiens
ctttaagtgcacaacat

SEQ ID NO: 6179944 - DNA, 21 bp, Homo sapiens
ctttaagttcttctatttcaa

SEQ ID NO: 6179945 - DNA, 15 bp, Homo sapiens
ctttaataaaacaac

SEQ ID NO: 6179946 - DNA, 22 bp, Homo sapiens
ctttaataaaggccacaggaga

SEQ ID NO: 6179947 - DNA, 17 bp, Homo sapiens
ctttaataaattgctta

SEQ ID NO: 6179948 - DNA, 21 bp, Homo sapiens
ctttaataaattgcttactga

SEQ ID NO: 6179949 - DNA, 17 bp, Homo sapiens
ctttaataaatttaata

SEQ ID NO: 6179950 - DNA, 22 bp, Homo sapiens
ctttaataaatttaataaatat

SEQ ID NO: 6179951 - DNA, 18 bp, Homo sapiens
ctttaataacaatatata

SEQ ID NO: 6179952 - DNA, 22 bp, Homo sapiens
ctttaataacaatatatagaat

SEQ ID NO: 6179953 - DNA, 15 bp, Homo sapiens
ctttaatacaaaaag

SEQ ID NO: 6179954 - DNA, 18 bp, Homo sapiens
ctttaatactcacctcct

SEQ ID NO: 6179955 - DNA, 12 bp, Homo sapiens
ctttaatataaa

SEQ ID NO: 6179956 - DNA, 14 bp, Homo sapiens
ctttaatataaatg

SEQ ID NO: 6179957 - DNA, 19 bp, Homo sapiens
ctttaatataaatgcaaat

SEQ ID NO: 6179958 - DNA, 20 bp, Homo sapiens
ctttaatataaatgcaaata

SEQ ID NO: 6179959 - DNA, 23 bp, Homo sapiens
ctttaatatagctatcatttctt

SEQ ID NO: 6179960 - DNA, 18 bp, Homo sapiens
ctttaatatcatcagtat

SEQ ID NO: 6179961 - DNA, 13 bp, Homo sapiens
ctttaatatgagc

SEQ ID NO: 6179962 - DNA, 16 bp, Homo sapiens
ctttaatattttgtaa

SEQ ID NO: 6179963 - DNA, 21 bp, Homo sapiens
ctttaatcttcagttttatct

SEQ ID NO: 6179964 - DNA, 18 bp, Homo sapiens
ctttaatgattataatca

SEQ ID NO: 6179965 - DNA, 21 bp, Homo sapiens
ctttaatgctgtctttgtgga

SEQ ID NO: 6179966 - DNA, 12 bp, Homo sapiens
ctttaatgcttt

SEQ ID NO: 6179967 - DNA, 17 bp, Homo sapiens
ctttaatggcctggagg

SEQ ID NO: 6179968 - DNA, 19 bp, Homo sapiens
ctttaatgtcacaggcagg

SEQ ID NO: 6179969 - DNA, 17 bp, Homo sapiens
ctttaatgttggaagag

SEQ ID NO: 6179970 - DNA, 18 bp, Homo sapiens
ctttaatgttttaactct

SEQ ID NO: 6179971 - DNA, 18 bp, Homo sapiens
ctttaattaccaacctgt

SEQ ID NO: 6179972 - DNA, 12 bp, Homo sapiens
ctttaattatat

SEQ ID NO: 6179973 - DNA, 24 bp, Homo sapiens
ctttaattccttatcctagccttt

SEQ ID NO: 6179974 - DNA, 14 bp, Homo sapiens
ctttaattgaagaa

SEQ ID NO: 6179975 - DNA, 16 bp, Homo sapiens
ctttaattgaagaact

SEQ ID NO: 6179976 - DNA, 13 bp, Homo sapiens
ctttaattgtgtg

SEQ ID NO: 6179977 - DNA, 13 bp, Homo sapiens
ctttaatttagaa

SEQ ID NO: 6179978 - DNA, 21 bp, Homo sapiens
ctttaatttatttttgcatgg

SEQ ID NO: 6179979 - DNA, 23 bp, Homo sapiens
ctttaatttcaggaatcagaaat

SEQ ID NO: 6179980 - DNA, 21 bp, Homo sapiens
ctttaatttctgtcagaatgc

SEQ ID NO: 6179981 - DNA, 17 bp, Homo sapiens
ctttaattttaactgat

SEQ ID NO: 6179982 - DNA, 16 bp, Homo sapiens
ctttaattttggaatt

SEQ ID NO: 6179983 - DNA, 23 bp, Homo sapiens
ctttaatttttataaatatgtga

SEQ ID NO: 6179984 - DNA, 18 bp, Homo sapiens
ctttacaaaacaaactca

SEQ ID NO: 6179985 - DNA, 13 bp, Homo sapiens
ctttacaaaatga

SEQ ID NO: 6179986 - DNA, 14 bp, Homo sapiens
ctttacaaaccttt

SEQ ID NO: 6179987 - DNA, 21 bp, Homo sapiens
ctttacaaactgaagataatg

SEQ ID NO: 6179988 - DNA, 15 bp, Homo sapiens
ctttacaaataattt

SEQ ID NO: 6179989 - DNA, 20 bp, Homo sapiens
ctttacaaccatactttata

SEQ ID NO: 6179990 - DNA, 15 bp, Homo sapiens
ctttacaactaaata

SEQ ID NO: 6179991 - DNA, 21 bp, Homo sapiens
ctttacaagggagaagacaac

SEQ ID NO: 6179992 - DNA, 13 bp, Homo sapiens
ctttacaatgtga

SEQ ID NO: 6179993 - DNA, 14 bp, Homo sapiens
ctttacaatgtgaa

SEQ ID NO: 6179994 - DNA, 23 bp, Homo sapiens
ctttacacattcggctccctgga

SEQ ID NO: 6179995 - DNA, 18 bp, Homo sapiens
ctttacagctgtttacag

SEQ ID NO: 6179996 - DNA, 22 bp, Homo sapiens
ctttacagttctggaggaggag

SEQ ID NO: 6179997 - DNA, 18 bp, Homo sapiens
ctttacataagaaatgta

SEQ ID NO: 6179998 - DNA, 16 bp, Homo sapiens
ctttacataattcaga

SEQ ID NO: 6179999 - DNA, 17 bp, Homo sapiens
ctttacatatatatgta

SEQ ID NO: 6180000 - DNA, 17 bp, Homo sapiens
ctttacatattcctttg

SEQ ID NO: 6180001 - DNA, 18 bp, Homo sapiens
ctttacatattcctttga

SEQ ID NO: 6180002 - DNA, 20 bp, Homo sapiens
ctttacatctatgtgtatgt

SEQ ID NO: 6180003 - DNA, 22 bp, Homo sapiens
ctttacatctgtgttctatgca

SEQ ID NO: 6180004 - DNA, 20 bp, Homo sapiens
ctttacatgctgtgctcttt

SEQ ID NO: 6180005 - DNA, 22 bp, Homo sapiens
ctttacatgctgtgctctttga

SEQ ID NO: 6180006 - DNA, 18 bp, Homo sapiens
ctttacattttgtgcagt

SEQ ID NO: 6180007 - DNA, 19 bp, Homo sapiens
ctttacattttgtgcagtg

SEQ ID NO: 6180008 - DNA, 16 bp, Homo sapiens
ctttaccaaacagcaa

SEQ ID NO: 6180009 - DNA, 16 bp, Homo sapiens
ctttaccaaagatgaa

SEQ ID NO: 6180010 - DNA, 19 bp, Homo sapiens
ctttaccaaagatgaatga

SEQ ID NO: 6180011 - DNA, 17 bp, Homo sapiens
ctttaccaaatgaaatg

SEQ ID NO: 6180012 - DNA, 14 bp, Homo sapiens
ctttaccaccccca

SEQ ID NO: 6180013 - DNA, 16 bp, Homo sapiens
ctttaccacccccaca

SEQ ID NO: 6180014 - DNA, 13 bp, Homo sapiens
ctttaccactatg

SEQ ID NO: 6180015 - DNA, 12 bp, Homo sapiens
ctttaccactgt

SEQ ID NO: 6180016 - DNA, 13 bp, Homo sapiens
ctttaccactgtg

SEQ ID NO: 6180017 - DNA, 19 bp, Homo sapiens
ctttaccatagcttaagaa

SEQ ID NO: 6180018 - DNA, 17 bp, Homo sapiens
ctttacccacctagaac

SEQ ID NO: 6180019 - DNA, 14 bp, Homo sapiens
ctttaccctcatct

SEQ ID NO: 6180020 - DNA, 14 bp, Homo sapiens
ctttaccctctttg

SEQ ID NO: 6180021 - DNA, 17 bp, Homo sapiens
ctttaccctctttgctg

SEQ ID NO: 6180022 - DNA, 22 bp, Homo sapiens
ctttacccttgagccctcccca

SEQ ID NO: 6180023 - DNA, 15 bp, Homo sapiens
ctttaccgaggacag

SEQ ID NO: 6180024 - DNA, 14 bp, Homo sapiens
ctttacctaagtgt

SEQ ID NO: 6180025 - DNA, 15 bp, Homo sapiens
ctttacctaccacct

SEQ ID NO: 6180026 - DNA, 20 bp, Homo sapiens
ctttacctaccaccttccct

SEQ ID NO: 6180027 - DNA, 22 bp, Homo sapiens
ctttacctatggaagtggttct

SEQ ID NO: 6180028 - DNA, 11 bp, Homo sapiens
ctttacctctt

SEQ ID NO: 6180029 - DNA, 13 bp, Homo sapiens
ctttacctgagac

SEQ ID NO: 6180030 - DNA, 16 bp, Homo sapiens
ctttacctgcaggctc

SEQ ID NO: 6180031 - DNA, 17 bp, Homo sapiens
ctttacctgtgaagtgt

SEQ ID NO: 6180032 - DNA, 15 bp, Homo sapiens
ctttaccttcctgat

SEQ ID NO: 6180033 - DNA, 14 bp, Homo sapiens
ctttaccttttcta

SEQ ID NO: 6180034 - DNA, 17 bp, Homo sapiens
ctttaccttttctataa

SEQ ID NO: 6180035 - DNA, 14 bp, Homo sapiens
ctttacctttttgt

SEQ ID NO: 6180036 - DNA, 22 bp, Homo sapiens
ctttacctttttgtatgtgaac

SEQ ID NO: 6180037 - DNA, 17 bp, Homo sapiens
ctttaccttttttatac

SEQ ID NO: 6180038 - DNA, 22 bp, Homo sapiens
ctttaccttttttatacataaa

SEQ ID NO: 6180039 - DNA, 18 bp, Homo sapiens
ctttacgctgtctgtaat

SEQ ID NO: 6180040 - DNA, 18 bp, Homo sapiens
ctttacggacaccccctc

SEQ ID NO: 6180041 - DNA, 14 bp, Homo sapiens
ctttacgtactgta

SEQ ID NO: 6180042 - DNA, 20 bp, Homo sapiens
ctttacgtactgtaactgct

SEQ ID NO: 6180043 - DNA, 21 bp, Homo sapiens
ctttacgtactgtaactgctc

SEQ ID NO: 6180044 - DNA, 13 bp, Homo sapiens
ctttacgtatttt

SEQ ID NO: 6180045 - DNA, 21 bp, Homo sapiens
ctttacgtgtttaaaaaaaag

SEQ ID NO: 6180046 - DNA, 19 bp, Homo sapiens
ctttactacacagtttggt

SEQ ID NO: 6180047 - DNA, 20 bp, Homo sapiens
ctttactactgcaagttcaa

SEQ ID NO: 6180048 - DNA, 23 bp, Homo sapiens
ctttactactgcaagttcaagac

SEQ ID NO: 6180049 - DNA, 16 bp, Homo sapiens
ctttactactgtggaa

SEQ ID NO: 6180050 - DNA, 16 bp, Homo sapiens
ctttactattaaaata

SEQ ID NO: 6180051 - DNA, 16 bp, Homo sapiens
ctttactcagcccagc

SEQ ID NO: 6180052 - DNA, 20 bp, Homo sapiens
ctttactcagcccagctggc

SEQ ID NO: 6180053 - DNA, 21 bp, Homo sapiens
ctttactcagcccagctggcc

SEQ ID NO: 6180054 - DNA, 14 bp, Homo sapiens
ctttactccatcat

SEQ ID NO: 6180055 - DNA, 19 bp, Homo sapiens
ctttactcccttcctggcc

SEQ ID NO: 6180056 - DNA, 19 bp, Homo sapiens
ctttactcggcgtgctcct

SEQ ID NO: 6180057 - DNA, 14 bp, Homo sapiens
ctttactctttcat

SEQ ID NO: 6180058 - DNA, 19 bp, Homo sapiens
ctttactgcctgaataaag

SEQ ID NO: 6180059 - DNA, 13 bp, Homo sapiens
ctttactggacct

SEQ ID NO: 6180060 - DNA, 14 bp, Homo sapiens
ctttactgggaagc

SEQ ID NO: 6180061 - DNA, 23 bp, Homo sapiens
ctttactgggttggaagaaatat

SEQ ID NO: 6180062 - DNA, 20 bp, Homo sapiens
ctttactggtgatttctgag

SEQ ID NO: 6180063 - DNA, 19 bp, Homo sapiens
ctttactgtcaaaataatt

SEQ ID NO: 6180064 - DNA, 23 bp, Homo sapiens
ctttactgtggctgtctggatcc

SEQ ID NO: 6180065 - DNA, 13 bp, Homo sapiens
ctttactgtgtat

SEQ ID NO: 6180066 - DNA, 16 bp, Homo sapiens
ctttacttaaaaatat

SEQ ID NO: 6180067 - DNA, 16 bp, Homo sapiens
ctttacttatctctca

SEQ ID NO: 6180068 - DNA, 21 bp, Homo sapiens
ctttacttgtggtgtgaccat

SEQ ID NO: 6180069 - DNA, 14 bp, Homo sapiens
ctttactttccctt

SEQ ID NO: 6180070 - DNA, 16 bp, Homo sapiens
ctttactttcccttgc

SEQ ID NO: 6180071 - DNA, 22 bp, Homo sapiens
ctttactttcccttgcttttcc

SEQ ID NO: 6180072 - DNA, 15 bp, Homo sapiens
ctttacttttgctgt

SEQ ID NO: 6180073 - DNA, 23 bp, Homo sapiens
ctttacttttgctgtttatactt

SEQ ID NO: 6180074 - DNA, 22 bp, Homo sapiens
ctttagaaaacccaagttttta

SEQ ID NO: 6180075 - DNA, 18 bp, Homo sapiens
ctttagaaaatataagta

SEQ ID NO: 6180076 - DNA, 20 bp, Homo sapiens
ctttagaaactgagtcctgt

SEQ ID NO: 6180077 - DNA, 21 bp, Homo sapiens
ctttagaaactgagtcctgtt

SEQ ID NO: 6180078 - DNA, 19 bp, Homo sapiens
ctttagaaagctgacattg

SEQ ID NO: 6180079 - DNA, 22 bp, Homo sapiens
ctttagaaataaaccttaatat

SEQ ID NO: 6180080 - DNA, 13 bp, Homo sapiens
ctttagaacaaca

SEQ ID NO: 6180081 - DNA, 17 bp, Homo sapiens
ctttagaagtgcatttc

SEQ ID NO: 6180082 - DNA, 16 bp, Homo sapiens
ctttagaatatgcctt

SEQ ID NO: 6180083 - DNA, 18 bp, Homo sapiens
ctttagaatattaaaaat

SEQ ID NO: 6180084 - DNA, 20 bp, Homo sapiens
ctttagaatcccagccccct

SEQ ID NO: 6180085 - DNA, 18 bp, Homo sapiens
ctttagaatgagagtgtg

SEQ ID NO: 6180086 - DNA, 22 bp, Homo sapiens
ctttagaatgagagtgtgaaat

SEQ ID NO: 6180087 - DNA, 21 bp, Homo sapiens
ctttagaatgttttccttcta

SEQ ID NO: 6180088 - DNA, 20 bp, Homo sapiens
ctttagaattctaattgtca

SEQ ID NO: 6180089 - DNA, 14 bp, Homo sapiens
ctttagacttgaaa

SEQ ID NO: 6180090 - DNA, 15 bp, Homo sapiens
ctttagacttgaaaa

SEQ ID NO: 6180091 - DNA, 19 bp, Homo sapiens
ctttagagaactgaaaaga

SEQ ID NO: 6180092 - DNA, 19 bp, Homo sapiens
ctttagagaagtatacata

SEQ ID NO: 6180093 - DNA, 22 bp, Homo sapiens
ctttagagaagtatacataagt

SEQ ID NO: 6180094 - DNA, 13 bp, Homo sapiens
ctttagagatgct

SEQ ID NO: 6180095 - DNA, 13 bp, Homo sapiens
ctttagagattat

SEQ ID NO: 6180096 - DNA, 19 bp, Homo sapiens
ctttagagattataacaaa

SEQ ID NO: 6180097 - DNA, 21 bp, Homo sapiens
ctttagaggctttcaaatgta

SEQ ID NO: 6180098 - DNA, 22 bp, Homo sapiens
ctttagagtgactaaaaggaaa

SEQ ID NO: 6180099 - DNA, 14 bp, Homo sapiens
ctggcttggaggct

SEQ ID NO: 6180100 - DNA, 13 bp, Homo sapiens
ctggcttggccta

SEQ ID NO: 6180101 - DNA, 16 bp, Homo sapiens
ctggcttgggcagcat

SEQ ID NO: 6180102 - DNA, 20 bp, Homo sapiens
ctggcttggggtcaagaaac

SEQ ID NO: 6180103 - DNA, 20 bp, Homo sapiens
ctggcttgtaactccaccaa

SEQ ID NO: 6180104 - DNA, 16 bp, Homo sapiens
ctggcttgtcggagca

SEQ ID NO: 6180105 - DNA, 23 bp, Homo sapiens
ctggctttcattttctctcaggt

SEQ ID NO: 6180106 - DNA, 15 bp, Homo sapiens
ctggctttccaggag

SEQ ID NO: 6180107 - DNA, 15 bp, Homo sapiens
ctggctttcccagga

SEQ ID NO: 6180108 - DNA, 16 bp, Homo sapiens
ctggctttcccaggag

SEQ ID NO: 6180109 - DNA, 13 bp, Homo sapiens
ctggctttctctc

SEQ ID NO: 6180110 - DNA, 14 bp, Homo sapiens
ctggctttctctct

SEQ ID NO: 6180111 - DNA, 19 bp, Homo sapiens
ctggctttctctctggctt

SEQ ID NO: 6180112 - DNA, 21 bp, Homo sapiens
ctggctttctctctggcttct

SEQ ID NO: 6180113 - DNA, 23 bp, Homo sapiens
ctggctttctctctggcttctct

SEQ ID NO: 6180114 - DNA, 14 bp, Homo sapiens
ctggctttgacatg

SEQ ID NO: 6180115 - DNA, 16 bp, Homo sapiens
ctggctttgccaagct

SEQ ID NO: 6180116 - DNA, 23 bp, Homo sapiens
ctggctttgccaagcttgtgaga

SEQ ID NO: 6180117 - DNA, 15 bp, Homo sapiens
ctggctttgcccaac

SEQ ID NO: 6180118 - DNA, 17 bp, Homo sapiens
ctggctttgcccaacct

SEQ ID NO: 6180119 - DNA, 15 bp, Homo sapiens
ctggctttgcctctt

SEQ ID NO: 6180120 - DNA, 22 bp, Homo sapiens
ctggctttgcctcttctttgtg

SEQ ID NO: 6180121 - DNA, 23 bp, Homo sapiens
ctggctttggaaagacctgtgag

SEQ ID NO: 6180122 - DNA, 16 bp, Homo sapiens
ctggctttggaatgct

SEQ ID NO: 6180123 - DNA, 15 bp, Homo sapiens
ctggctttggcactc

SEQ ID NO: 6180124 - DNA, 14 bp, Homo sapiens
ctggctttggcgcc

SEQ ID NO: 6180125 - DNA, 19 bp, Homo sapiens
ctggctttgggaaagccca

SEQ ID NO: 6180126 - DNA, 19 bp, Homo sapiens
ctggctttgtcccacagct

SEQ ID NO: 6180127 - DNA, 18 bp, Homo sapiens
ctggctttgttcttgtca

SEQ ID NO: 6180128 - DNA, 20 bp, Homo sapiens
ctggcttttaaacctgttcc

SEQ ID NO: 6180129 - DNA, 21 bp, Homo sapiens
ctggcttttaaacctgttcct

SEQ ID NO: 6180130 - DNA, 14 bp, Homo sapiens
ctggcttttattaa

SEQ ID NO: 6180131 - DNA, 23 bp, Homo sapiens
ctggcttttattaatgcactttc

SEQ ID NO: 6180132 - DNA, 15 bp, Homo sapiens
ctggcttttcacccc

SEQ ID NO: 6180133 - DNA, 17 bp, Homo sapiens
ctggcttttcaccccag

SEQ ID NO: 6180134 - DNA, 21 bp, Homo sapiens
ctggcttttcaccccagagga

SEQ ID NO: 6180135 - DNA, 16 bp, Homo sapiens
ctggcttttcactgct

SEQ ID NO: 6180136 - DNA, 23 bp, Homo sapiens
ctggcttttcactgctggctgcc

SEQ ID NO: 6180137 - DNA, 20 bp, Homo sapiens
ctggcttttctgtttcctgt

SEQ ID NO: 6180138 - DNA, 19 bp, Homo sapiens
ctggcttttgcctgtaaga

SEQ ID NO: 6180139 - DNA, 15 bp, Homo sapiens
ctggctttttaaaat

SEQ ID NO: 6180140 - DNA, 17 bp, Homo sapiens
ctggctttttaaaatat

SEQ ID NO: 6180141 - DNA, 16 bp, Homo sapiens
ctggctttttcccagc

SEQ ID NO: 6180142 - DNA, 21 bp, Homo sapiens
ctggctttttcctctgagccc

SEQ ID NO: 6180143 - DNA, 15 bp, Homo sapiens
ctggctttttctgcc

SEQ ID NO: 6180144 - DNA, 13 bp, Homo sapiens
ctggctttttgaa

SEQ ID NO: 6180145 - DNA, 21 bp, Homo sapiens
ctgggaaaagggcaggagcct

SEQ ID NO: 6180146 - DNA, 14 bp, Homo sapiens
ctgggaaaataccc

SEQ ID NO: 6180147 - DNA, 12 bp, Homo sapiens
ctgggaaacact

SEQ ID NO: 6180148 - DNA, 17 bp, Homo sapiens
ctgggaaacactccttg

SEQ ID NO: 6180149 - DNA, 22 bp, Homo sapiens
ctgggaaacactccttgcatca

SEQ ID NO: 6180150 - DNA, 11 bp, Homo sapiens
ctgggaaacag

SEQ ID NO: 6180151 - DNA, 15 bp, Homo sapiens
ctgggaaacagggag

SEQ ID NO: 6180152 - DNA, 16 bp, Homo sapiens
ctgggaaacagggagc

SEQ ID NO: 6180153 - DNA, 15 bp, Homo sapiens
ctgggaaacctgcct

SEQ ID NO: 6180154 - DNA, 13 bp, Homo sapiens
ctgggaaagaact

SEQ ID NO: 6180155 - DNA, 17 bp, Homo sapiens
ctgggaaagaacttgga

SEQ ID NO: 6180156 - DNA, 18 bp, Homo sapiens
ctgggaaagaacttggac

SEQ ID NO: 6180157 - DNA, 19 bp, Homo sapiens
ctgggaaagaacttggact

SEQ ID NO: 6180158 - DNA, 19 bp, Homo sapiens
ctgggaaagacatccataa

SEQ ID NO: 6180159 - DNA, 21 bp, Homo sapiens
ctgggaaaggaaaaccaggga

SEQ ID NO: 6180160 - DNA, 24 bp, Homo sapiens
ctgggaaaggaaaaccagggatag

SEQ ID NO: 6180161 - DNA, 14 bp, Homo sapiens
ctgggaaaggtgct

SEQ ID NO: 6180162 - DNA, 20 bp, Homo sapiens
ctgggaaaggtgctcaaaga

SEQ ID NO: 6180163 - DNA, 12 bp, Homo sapiens
ctgggaaagtta

SEQ ID NO: 6180164 - DNA, 23 bp, Homo sapiens
ctgggaaatgagaaggcagccac

SEQ ID NO: 6180165 - DNA, 14 bp, Homo sapiens
ctgggaaatgagat

SEQ ID NO: 6180166 - DNA, 23 bp, Homo sapiens
ctgggaaatgagatcccagagtt

SEQ ID NO: 6180167 - DNA, 16 bp, Homo sapiens
ctgggaaatgagcagg

SEQ ID NO: 6180168 - DNA, 15 bp, Homo sapiens
ctgggaaatgcagaa

SEQ ID NO: 6180169 - DNA, 16 bp, Homo sapiens
ctgggaaatgcagaaa

SEQ ID NO: 6180170 - DNA, 23 bp, Homo sapiens
ctgggaaatggcttgaagccaag

SEQ ID NO: 6180171 - DNA, 16 bp, Homo sapiens
ctgggaacacagccag

SEQ ID NO: 6180172 - DNA, 13 bp, Homo sapiens
ctgggaacacagt

SEQ ID NO: 6180173 - DNA, 17 bp, Homo sapiens
ctgggaacacagtgccc

SEQ ID NO: 6180174 - DNA, 19 bp, Homo sapiens
ctgggaacaccataggtca

SEQ ID NO: 6180175 - DNA, 20 bp, Homo sapiens
ctgggaacaccccataacta

SEQ ID NO: 6180176 - DNA, 13 bp, Homo sapiens
ctgggaacaggcc

SEQ ID NO: 6180177 - DNA, 16 bp, Homo sapiens
ctgggaacaggcccca

SEQ ID NO: 6180178 - DNA, 22 bp, Homo sapiens
ctgggaacatgacccagcctga

SEQ ID NO: 6180179 - DNA, 20 bp, Homo sapiens
ctgggaaccaagggccctca

SEQ ID NO: 6180180 - DNA, 14 bp, Homo sapiens
ctgggaaccactcc

SEQ ID NO: 6180181 - DNA, 20 bp, Homo sapiens
ctgggaaccactcccaccac

SEQ ID NO: 6180182 - DNA, 22 bp, Homo sapiens
ctgggaacccaagtccaagcat

SEQ ID NO: 6180183 - DNA, 19 bp, Homo sapiens
ctgggaaccccgcagcccg

SEQ ID NO: 6180184 - DNA, 13 bp, Homo sapiens
ctgggaacccctt

SEQ ID NO: 6180185 - DNA, 17 bp, Homo sapiens
ctgggaacccctttccc

SEQ ID NO: 6180186 - DNA, 19 bp, Homo sapiens
ctgggaaccgccctcctga

SEQ ID NO: 6180187 - DNA, 20 bp, Homo sapiens
ctgggaaccgccctcctgat

SEQ ID NO: 6180188 - DNA, 17 bp, Homo sapiens
ctgggaacctcccagag

SEQ ID NO: 6180189 - DNA, 21 bp, Homo sapiens
ctgggaacctcccagaggtcc

SEQ ID NO: 6180190 - DNA, 16 bp, Homo sapiens
ctgggaactcatcctg

SEQ ID NO: 6180191 - DNA, 18 bp, Homo sapiens
ctgggaactcccaagaac

SEQ ID NO: 6180192 - DNA, 23 bp, Homo sapiens
ctgggaactcccaagaacagcag

SEQ ID NO: 6180193 - DNA, 15 bp, Homo sapiens
ctgggaactgcagac

SEQ ID NO: 6180194 - DNA, 18 bp, Homo sapiens
ctgggaactgggccagca

SEQ ID NO: 6180195 - DNA, 21 bp, Homo sapiens
ctgggaactgggccagcagag

SEQ ID NO: 6180196 - DNA, 13 bp, Homo sapiens
ctgggaacttcta

SEQ ID NO: 6180197 - DNA, 19 bp, Homo sapiens
ctgggaacttgcgagtcca

SEQ ID NO: 6180198 - DNA, 15 bp, Homo sapiens
ctgggaagaacaagg

SEQ ID NO: 6180199 - DNA, 17 bp, Homo sapiens
ctgggaagaagcaaggg

SEQ ID NO: 6180200 - DNA, 19 bp, Homo sapiens
ctgggaagacgcctgagct

SEQ ID NO: 6180201 - DNA, 18 bp, Homo sapiens
ctgggaagataggctctg

SEQ ID NO: 6180202 - DNA, 21 bp, Homo sapiens
ctgggaagataggctctgcac

SEQ ID NO: 6180203 - DNA, 15 bp, Homo sapiens
ctgggaagatgctgg

SEQ ID NO: 6180204 - DNA, 21 bp, Homo sapiens
ctgggaagatttgaaaacaaa

SEQ ID NO: 6180205 - DNA, 18 bp, Homo sapiens
ctgggaagcccacccaga

SEQ ID NO: 6180206 - DNA, 20 bp, Homo sapiens
ctgggaagctcccaccccac

SEQ ID NO: 6180207 - DNA, 15 bp, Homo sapiens
ctgggaagctggagt

SEQ ID NO: 6180208 - DNA, 19 bp, Homo sapiens
ctgggaagctggagtgctg

SEQ ID NO: 6180209 - DNA, 23 bp, Homo sapiens
ctgggaagctgtactcagagcag

SEQ ID NO: 6180210 - DNA, 20 bp, Homo sapiens
ctgggaagcttgagcctccc

SEQ ID NO: 6180211 - DNA, 23 bp, Homo sapiens
ctgggaagcttgagcctccccca

SEQ ID NO: 6180212 - DNA, 13 bp, Homo sapiens
ctgggaaggaaac

SEQ ID NO: 6180213 - DNA, 15 bp, Homo sapiens
ctgggaaggaaacaa

SEQ ID NO: 6180214 - DNA, 14 bp, Homo sapiens
ctgggaaggaggga

SEQ ID NO: 6180215 - DNA, 18 bp, Homo sapiens
ctgggaaggagggagctg

SEQ ID NO: 6180216 - DNA, 22 bp, Homo sapiens
ctgggaaggagggagctgctca

SEQ ID NO: 6180217 - DNA, 13 bp, Homo sapiens
ctgggaaggccag

SEQ ID NO: 6180218 - DNA, 13 bp, Homo sapiens
ctgggaaggcctc

SEQ ID NO: 6180219 - DNA, 16 bp, Homo sapiens
ctgggaaggctacttc

SEQ ID NO: 6180220 - DNA, 23 bp, Homo sapiens
ctgggaaggctacttcggggctg

SEQ ID NO: 6180221 - DNA, 19 bp, Homo sapiens
ctgggaagggggcaggccc

SEQ ID NO: 6180222 - DNA, 19 bp, Homo sapiens
ctgggaagttggagcaaga

SEQ ID NO: 6180223 - DNA, 19 bp, Homo sapiens
ctgggaatcaggattcctt

SEQ ID NO: 6180224 - DNA, 18 bp, Homo sapiens
ctgggaatcctgctgcca

SEQ ID NO: 6180225 - DNA, 18 bp, Homo sapiens
ctgggaatcctggacagc

SEQ ID NO: 6180226 - DNA, 21 bp, Homo sapiens
ctgggaatggaaggctttgcc

SEQ ID NO: 6180227 - DNA, 18 bp, Homo sapiens
ctgggaatggaataacta

SEQ ID NO: 6180228 - DNA, 13 bp, Homo sapiens
ctgggaatggagg

SEQ ID NO: 6180229 - DNA, 15 bp, Homo sapiens
ctgggaatgggagag

SEQ ID NO: 6180230 - DNA, 22 bp, Homo sapiens
ctgggaatggggtgggagccac

SEQ ID NO: 6180231 - DNA, 19 bp, Homo sapiens
ctgggaatgtatagtattt

SEQ ID NO: 6180232 - DNA, 21 bp, Homo sapiens
ctgggaatgtatagtatttga

SEQ ID NO: 6180233 - DNA, 19 bp, Homo sapiens
ctgggaatgtattattctg

SEQ ID NO: 6180234 - DNA, 17 bp, Homo sapiens
ctgggacaagcaggccg

SEQ ID NO: 6180235 - DNA, 21 bp, Homo sapiens
ctgggacaagcaggccgccct

SEQ ID NO: 6180236 - DNA, 20 bp, Homo sapiens
ctgggacacaaccactaatt

SEQ ID NO: 6180237 - DNA, 13 bp, Homo sapiens
ctgggacacacac

SEQ ID NO: 6180238 - DNA, 11 bp, Homo sapiens
ctgggacacag

SEQ ID NO: 6180239 - DNA, 16 bp, Homo sapiens
ctgggacacagaccca

SEQ ID NO: 6180240 - DNA, 18 bp, Homo sapiens
ctgggacacagacccagg

SEQ ID NO: 6180241 - DNA, 19 bp, Homo sapiens
ctgggacacagacccagga

SEQ ID NO: 6180242 - DNA, 22 bp, Homo sapiens
ctgggacaccattaccaaaata

SEQ ID NO: 6180243 - DNA, 21 bp, Homo sapiens
ctgggacactgtgtggccctg

SEQ ID NO: 6180244 - DNA, 19 bp, Homo sapiens
ctgggacacttaacagatg

SEQ ID NO: 6180245 - DNA, 22 bp, Homo sapiens
ctgggacacttccctgggcctc

SEQ ID NO: 6180246 - DNA, 23 bp, Homo sapiens
ctgggacacttccctgggcctca

SEQ ID NO: 6180247 - DNA, 13 bp, Homo sapiens
ctgggacagctgg

SEQ ID NO: 6180248 - DNA, 15 bp, Homo sapiens
ctgggacagctggct

SEQ ID NO: 6180249 - DNA, 20 bp, Homo sapiens
ctgggacagctggctgggcc

SEQ ID NO: 6180250 - DNA, 13 bp, Homo sapiens
ctgggacaggctt

SEQ ID NO: 6180251 - DNA, 14 bp, Homo sapiens
ctgggacatgggaa

SEQ ID NO: 6180252 - DNA, 18 bp, Homo sapiens
ctgggacatgggaaaggg

SEQ ID NO: 6180253 - DNA, 22 bp, Homo sapiens
ctgggaccacaggtgcacgcca

SEQ ID NO: 6180254 - DNA, 12 bp, Homo sapiens
ctgggaccagag

SEQ ID NO: 6180255 - DNA, 14 bp, Homo sapiens
ctgggaccagagcc

SEQ ID NO: 6180256 - DNA, 16 bp, Homo sapiens
ctgggaccagagccag

SEQ ID NO: 6180257 - DNA, 20 bp, Homo sapiens
ctgggaccagagccagatgc

SEQ ID NO: 6180258 - DNA, 22 bp, Homo sapiens
ctgggaccaggcacccccagaa

SEQ ID NO: 6180259 - DNA, 20 bp, Homo sapiens
ctgggaccaggctccaatgg

SEQ ID NO: 6180260 - DNA, 13 bp, Homo sapiens
ctgggacccacag

SEQ ID NO: 6180261 - DNA, 15 bp, Homo sapiens
ctgggacccacagaa

SEQ ID NO: 6180262 - DNA, 13 bp, Homo sapiens
ctgggacccagct

SEQ ID NO: 6180263 - DNA, 14 bp, Homo sapiens
ctgggacccagcta

SEQ ID NO: 6180264 - DNA, 21 bp, Homo sapiens
ctgggacccagctactctgtc

SEQ ID NO: 6180265 - DNA, 15 bp, Homo sapiens
ctgggaccccagctg

SEQ ID NO: 6180266 - DNA, 16 bp, Homo sapiens
ctgggaccccagctgc

SEQ ID NO: 6180267 - DNA, 22 bp, Homo sapiens
ctgggaccccccccccccccgc

SEQ ID NO: 6180268 - DNA, 15 bp, Homo sapiens
ctgggaccccctcgc

SEQ ID NO: 6180269 - DNA, 19 bp, Homo sapiens
ctgggaccccctcgccagc

SEQ ID NO: 6180270 - DNA, 20 bp, Homo sapiens
ctgggaccccctcgccagct

SEQ ID NO: 6180271 - DNA, 18 bp, Homo sapiens
ctgggacccctcccaacc

SEQ ID NO: 6180272 - DNA, 22 bp, Homo sapiens
ctgggaccctcggggcaggaag

SEQ ID NO: 6180273 - DNA, 23 bp, Homo sapiens
ctgggaccctcggggcaggaagt

SEQ ID NO: 6180274 - DNA, 13 bp, Homo sapiens
ctgggacccttgt

SEQ ID NO: 6180275 - DNA, 21 bp, Homo sapiens
ctgggacccttgttggggagt

SEQ ID NO: 6180276 - DNA, 20 bp, Homo sapiens
ctttagatagcagcctggct

SEQ ID NO: 6180277 - DNA, 23 bp, Homo sapiens
ctttagatagcagcctggctccc

SEQ ID NO: 6180278 - DNA, 20 bp, Homo sapiens
ctttagatagccctgtcctg

SEQ ID NO: 6180279 - DNA, 16 bp, Homo sapiens
ctttagatctctgaag

SEQ ID NO: 6180280 - DNA, 12 bp, Homo sapiens
ctttagatgcca

SEQ ID NO: 6180281 - DNA, 12 bp, Homo sapiens
ctttagatgctg

SEQ ID NO: 6180282 - DNA, 19 bp, Homo sapiens
ctttagatggtggcacatt

SEQ ID NO: 6180283 - DNA, 19 bp, Homo sapiens
ctttagatttttaaattgg

SEQ ID NO: 6180284 - DNA, 18 bp, Homo sapiens
ctttagcaaaactggaca

SEQ ID NO: 6180285 - DNA, 21 bp, Homo sapiens
ctttagcacgtttaaagttct

SEQ ID NO: 6180286 - DNA, 18 bp, Homo sapiens
ctttagcagaatcaaaat

SEQ ID NO: 6180287 - DNA, 23 bp, Homo sapiens
ctttagcagggaagtcacttcac

SEQ ID NO: 6180288 - DNA, 13 bp, Homo sapiens
ctttagcagtttc

SEQ ID NO: 6180289 - DNA, 18 bp, Homo sapiens
ctttagcagtttcctcag

SEQ ID NO: 6180290 - DNA, 22 bp, Homo sapiens
ctttagcatactagaatcagat

SEQ ID NO: 6180291 - DNA, 22 bp, Homo sapiens
ctttagccagaatctcattact

SEQ ID NO: 6180292 - DNA, 16 bp, Homo sapiens
ctttagccatcataac

SEQ ID NO: 6180293 - DNA, 22 bp, Homo sapiens
ctttagcccctcccaagctggc

SEQ ID NO: 6180294 - DNA, 22 bp, Homo sapiens
ctttagcgctcaataggaccag

SEQ ID NO: 6180295 - DNA, 15 bp, Homo sapiens
ctttagctatgtgga

SEQ ID NO: 6180296 - DNA, 12 bp, Homo sapiens
ctttagctgtga

SEQ ID NO: 6180297 - DNA, 14 bp, Homo sapiens
ctttagctgtgtta

SEQ ID NO: 6180298 - DNA, 20 bp, Homo sapiens
ctttagcttacctgggcaca

SEQ ID NO: 6180299 - DNA, 15 bp, Homo sapiens
ctttagcttttcctt

SEQ ID NO: 6180300 - DNA, 14 bp, Homo sapiens
ctttaggaataata

SEQ ID NO: 6180301 - DNA, 15 bp, Homo sapiens
ctttaggagcagtgg

SEQ ID NO: 6180302 - DNA, 16 bp, Homo sapiens
ctttaggatgagcaaa

SEQ ID NO: 6180303 - DNA, 14 bp, Homo sapiens
ctttaggatgtaaa

SEQ ID NO: 6180304 - DNA, 15 bp, Homo sapiens
ctttaggatgtaaag

SEQ ID NO: 6180305 - DNA, 15 bp, Homo sapiens
ctttaggattgaagt

SEQ ID NO: 6180306 - DNA, 18 bp, Homo sapiens
ctttaggcagcagctttt

SEQ ID NO: 6180307 - DNA, 14 bp, Homo sapiens
ctttaggcaggaag

SEQ ID NO: 6180308 - DNA, 15 bp, Homo sapiens
ctttaggcaggaagt

SEQ ID NO: 6180309 - DNA, 21 bp, Homo sapiens
ctttaggcatatgcttcttta

SEQ ID NO: 6180310 - DNA, 13 bp, Homo sapiens
ctttaggctttca

SEQ ID NO: 6180311 - DNA, 23 bp, Homo sapiens
ctttagggactcaatttctcccc

SEQ ID NO: 6180312 - DNA, 21 bp, Homo sapiens
ctttagggatctggggaagga

SEQ ID NO: 6180313 - DNA, 22 bp, Homo sapiens
ctttagggatctggggaaggac

SEQ ID NO: 6180314 - DNA, 14 bp, Homo sapiens
ctttagggcagctt

SEQ ID NO: 6180315 - DNA, 16 bp, Homo sapiens
ctttagggcagcttgc

SEQ ID NO: 6180316 - DNA, 19 bp, Homo sapiens
ctttagggctgttgctagg

SEQ ID NO: 6180317 - DNA, 22 bp, Homo sapiens
ctttaggggaagtaaaacagtc

SEQ ID NO: 6180318 - DNA, 23 bp, Homo sapiens
ctttaggggaagtaaaacagtca

SEQ ID NO: 6180319 - DNA, 18 bp, Homo sapiens
ctttagggttctgcctct

SEQ ID NO: 6180320 - DNA, 19 bp, Homo sapiens
ctttaggtaaaaagcttaa

SEQ ID NO: 6180321 - DNA, 19 bp, Homo sapiens
ctttaggtcaaactcccta

SEQ ID NO: 6180322 - DNA, 15 bp, Homo sapiens
ctttaggtgcctcct

SEQ ID NO: 6180323 - DNA, 14 bp, Homo sapiens
ctttaggtttgaaa

SEQ ID NO: 6180324 - DNA, 17 bp, Homo sapiens
ctttagtaaatgaaact

SEQ ID NO: 6180325 - DNA, 17 bp, Homo sapiens
ctttagtacatggagct

SEQ ID NO: 6180326 - DNA, 18 bp, Homo sapiens
ctttagtacatggagctc

SEQ ID NO: 6180327 - DNA, 19 bp, Homo sapiens
ctttagtacctgaaaagta

SEQ ID NO: 6180328 - DNA, 22 bp, Homo sapiens
ctttagtacctgaaaagtaact

SEQ ID NO: 6180329 - DNA, 15 bp, Homo sapiens
ctttagtactcaatg

SEQ ID NO: 6180330 - DNA, 13 bp, Homo sapiens
ctttagtataatt

SEQ ID NO: 6180331 - DNA, 22 bp, Homo sapiens
ctttagtatgacgctgatacat

SEQ ID NO: 6180332 - DNA, 16 bp, Homo sapiens
ctttagtattcctgta

SEQ ID NO: 6180333 - DNA, 15 bp, Homo sapiens
ctttagtgccctgcc

SEQ ID NO: 6180334 - DNA, 18 bp, Homo sapiens
ctttagtgccctgccccc

SEQ ID NO: 6180335 - DNA, 18 bp, Homo sapiens
ctttagtgccggctgtgg

SEQ ID NO: 6180336 - DNA, 16 bp, Homo sapiens
ctttagtggagccagg

SEQ ID NO: 6180337 - DNA, 21 bp, Homo sapiens
ctttagtgtattttctgtcac

SEQ ID NO: 6180338 - DNA, 14 bp, Homo sapiens
ctttagttgaattc

SEQ ID NO: 6180339 - DNA, 23 bp, Homo sapiens
ctttagttttgattttggaaaga

SEQ ID NO: 6180340 - DNA, 14 bp, Homo sapiens
ctttagtttttggt

SEQ ID NO: 6180341 - DNA, 13 bp, Homo sapiens
ctttagtttttgt

SEQ ID NO: 6180342 - DNA, 15 bp, Homo sapiens
ctttagtttttgtga

SEQ ID NO: 6180343 - DNA, 16 bp, Homo sapiens
ctttataaaaaaaagt

SEQ ID NO: 6180344 - DNA, 17 bp, Homo sapiens
ctttataaaaaaaagtt

SEQ ID NO: 6180345 - DNA, 19 bp, Homo sapiens
ctttataaaaagtgaaata

SEQ ID NO: 6180346 - DNA, 18 bp, Homo sapiens
ctttataaaccataaaat

SEQ ID NO: 6180347 - DNA, 21 bp, Homo sapiens
ctttataaagctgttcttgaa

SEQ ID NO: 6180348 - DNA, 17 bp, Homo sapiens
ctttataaatccagtga

SEQ ID NO: 6180349 - DNA, 12 bp, Homo sapiens
ctttataagaaa

SEQ ID NO: 6180350 - DNA, 15 bp, Homo sapiens
ctttataagaaagcc

SEQ ID NO: 6180351 - DNA, 18 bp, Homo sapiens
ctttataagaaagcctga

SEQ ID NO: 6180352 - DNA, 22 bp, Homo sapiens
ctttataagccaatgaagcaaa

SEQ ID NO: 6180353 - DNA, 24 bp, Homo sapiens
ctttataagccaatgaagcaaaca

SEQ ID NO: 6180354 - DNA, 17 bp, Homo sapiens
ctttataataaactgtt

SEQ ID NO: 6180355 - DNA, 19 bp, Homo sapiens
ctttataataaactgttta

SEQ ID NO: 6180356 - DNA, 16 bp, Homo sapiens
ctttataatatttcag

SEQ ID NO: 6180357 - DNA, 18 bp, Homo sapiens
ctttataatggctctggg

SEQ ID NO: 6180358 - DNA, 17 bp, Homo sapiens
ctttataattgaattgg

SEQ ID NO: 6180359 - DNA, 19 bp, Homo sapiens
ctttataatttctacccat

SEQ ID NO: 6180360 - DNA, 23 bp, Homo sapiens
ctttatacaacagtgctaaaaat

SEQ ID NO: 6180361 - DNA, 23 bp, Homo sapiens
ctttatacacttctggctcacag

SEQ ID NO: 6180362 - DNA, 14 bp, Homo sapiens
ctttatacagattt

SEQ ID NO: 6180363 - DNA, 20 bp, Homo sapiens
ctttatacattagtaaatgt

SEQ ID NO: 6180364 - DNA, 20 bp, Homo sapiens
ctttataccccatttgattt

SEQ ID NO: 6180365 - DNA, 18 bp, Homo sapiens
ctttatacgtgtagctat

SEQ ID NO: 6180366 - DNA, 13 bp, Homo sapiens
ctttatactctct

SEQ ID NO: 6180367 - DNA, 15 bp, Homo sapiens
ctttatactctcttc

SEQ ID NO: 6180368 - DNA, 17 bp, Homo sapiens
ctttatactctcttccc

SEQ ID NO: 6180369 - DNA, 15 bp, Homo sapiens
ctttatactgtgaag

SEQ ID NO: 6180370 - DNA, 23 bp, Homo sapiens
ctttatacttaaacagctttttt

SEQ ID NO: 6180371 - DNA, 13 bp, Homo sapiens
ctttatactttgc

SEQ ID NO: 6180372 - DNA, 23 bp, Homo sapiens
ctttatactttgctgttgaagaa

SEQ ID NO: 6180373 - DNA, 20 bp, Homo sapiens
ctttatagaacatattttcc

SEQ ID NO: 6180374 - DNA, 20 bp, Homo sapiens
ctttatagaaggaatttgta

SEQ ID NO: 6180375 - DNA, 23 bp, Homo sapiens
ctttatagaaggaatttgtactt

SEQ ID NO: 6180376 - DNA, 16 bp, Homo sapiens
ctttatagtgaagtgt

SEQ ID NO: 6180377 - DNA, 15 bp, Homo sapiens
ctttatagttgtaga

SEQ ID NO: 6180378 - DNA, 19 bp, Homo sapiens
ctttatatacaataatgga

SEQ ID NO: 6180379 - DNA, 21 bp, Homo sapiens
ctttatatacaataatggaaa

SEQ ID NO: 6180380 - DNA, 19 bp, Homo sapiens
ctttatatatggacagctt

SEQ ID NO: 6180381 - DNA, 13 bp, Homo sapiens
ctttatatatgta

SEQ ID NO: 6180382 - DNA, 21 bp, Homo sapiens
ctttatatcttgtttacaata

SEQ ID NO: 6180383 - DNA, 13 bp, Homo sapiens
ctttatatgaaga

SEQ ID NO: 6180384 - DNA, 22 bp, Homo sapiens
ctttatatgaagaaaatcactt

SEQ ID NO: 6180385 - DNA, 22 bp, Homo sapiens
ctttatatgaagtattaaaatg

SEQ ID NO: 6180386 - DNA, 20 bp, Homo sapiens
ctttatatggaacgcatttt

SEQ ID NO: 6180387 - DNA, 12 bp, Homo sapiens
ctttatatgtaa

SEQ ID NO: 6180388 - DNA, 19 bp, Homo sapiens
ctttatatttcaataaatg

SEQ ID NO: 6180389 - DNA, 21 bp, Homo sapiens
ctttatatttcacaggctgta

SEQ ID NO: 6180390 - DNA, 13 bp, Homo sapiens
ctttatatttccc

SEQ ID NO: 6180391 - DNA, 18 bp, Homo sapiens
ctttatcaagcttagtga

SEQ ID NO: 6180392 - DNA, 23 bp, Homo sapiens
ctttatcaaggagatatatcagt

SEQ ID NO: 6180393 - DNA, 20 bp, Homo sapiens
ctttatcaatgtgtctttct

SEQ ID NO: 6180394 - DNA, 20 bp, Homo sapiens
ctttatcaccaggatgtcac

SEQ ID NO: 6180395 - DNA, 17 bp, Homo sapiens
ctttatcacctcattct

SEQ ID NO: 6180396 - DNA, 13 bp, Homo sapiens
ctttatcagaagc

SEQ ID NO: 6180397 - DNA, 17 bp, Homo sapiens
ctttatcagaagcaagg

SEQ ID NO: 6180398 - DNA, 21 bp, Homo sapiens
ctttatcagaagcaaggaagt

SEQ ID NO: 6180399 - DNA, 22 bp, Homo sapiens
ctttatcagggaaactaagatt

SEQ ID NO: 6180400 - DNA, 14 bp, Homo sapiens
ctttatcagtgatg

SEQ ID NO: 6180401 - DNA, 22 bp, Homo sapiens
ctttatcatcggagttgacagt

SEQ ID NO: 6180402 - DNA, 10 bp, Homo sapiens
ctttatcatg

SEQ ID NO: 6180403 - DNA, 18 bp, Homo sapiens
ctttatcatgtgtttctg

SEQ ID NO: 6180404 - DNA, 16 bp, Homo sapiens
ctttatccaatcctca

SEQ ID NO: 6180405 - DNA, 12 bp, Homo sapiens
ctttatccacat

SEQ ID NO: 6180406 - DNA, 15 bp, Homo sapiens
ctttatccacattgt

SEQ ID NO: 6180407 - DNA, 18 bp, Homo sapiens
ctttatccacattgtagc

SEQ ID NO: 6180408 - DNA, 22 bp, Homo sapiens
ctttatccacttttcttcttcc

SEQ ID NO: 6180409 - DNA, 12 bp, Homo sapiens
ctttatccagca

SEQ ID NO: 6180410 - DNA, 15 bp, Homo sapiens
ctttatccagcagtc

SEQ ID NO: 6180411 - DNA, 16 bp, Homo sapiens
ctttatccagcagtca

SEQ ID NO: 6180412 - DNA, 14 bp, Homo sapiens
ctttatccctgctt

SEQ ID NO: 6180413 - DNA, 14 bp, Homo sapiens
ctttatcctcttta

SEQ ID NO: 6180414 - DNA, 21 bp, Homo sapiens
ctttatctaatacctctgtgt

SEQ ID NO: 6180415 - DNA, 16 bp, Homo sapiens
ctttatctcaacggaa

SEQ ID NO: 6180416 - DNA, 17 bp, Homo sapiens
ctttatctgaaaatgat

SEQ ID NO: 6180417 - DNA, 16 bp, Homo sapiens
ctttatctgtcacaca

SEQ ID NO: 6180418 - DNA, 13 bp, Homo sapiens
ctttatctgtgac

SEQ ID NO: 6180419 - DNA, 15 bp, Homo sapiens
ctttatcttgaagtc

SEQ ID NO: 6180420 - DNA, 14 bp, Homo sapiens
ctttatctttgtgt

SEQ ID NO: 6180421 - DNA, 19 bp, Homo sapiens
ctttatgaaaaaaatatat

SEQ ID NO: 6180422 - DNA, 20 bp, Homo sapiens
ctttatgaaaaaaatatatt

SEQ ID NO: 6180423 - DNA, 22 bp, Homo sapiens
ctttatgaaaaaaatatatttt

SEQ ID NO: 6180424 - DNA, 19 bp, Homo sapiens
ctttatgataatagattct

SEQ ID NO: 6180425 - DNA, 20 bp, Homo sapiens
ctttatgattcttactgttc

SEQ ID NO: 6180426 - DNA, 21 bp, Homo sapiens
ctttatgattcttactgttct

SEQ ID NO: 6180427 - DNA, 14 bp, Homo sapiens
ctttatgatttcat

SEQ ID NO: 6180428 - DNA, 21 bp, Homo sapiens
ctttatgattttcataactta

SEQ ID NO: 6180429 - DNA, 13 bp, Homo sapiens
ctttatgcaaaaa

SEQ ID NO: 6180430 - DNA, 17 bp, Homo sapiens
ctttatgcaaaaacata

SEQ ID NO: 6180431 - DNA, 14 bp, Homo sapiens
ctttatgcaaatac

SEQ ID NO: 6180432 - DNA, 22 bp, Homo sapiens
ctttatgcaaatacaatcagcc

SEQ ID NO: 6180433 - DNA, 20 bp, Homo sapiens
ctttatgccggatgtgcttt

SEQ ID NO: 6180434 - DNA, 23 bp, Homo sapiens
ctttatggcagacattgtgctag

SEQ ID NO: 6180435 - DNA, 19 bp, Homo sapiens
ctttatggctctaacatta

SEQ ID NO: 6180436 - DNA, 20 bp, Homo sapiens
ctttatgggggggagggagg

SEQ ID NO: 6180437 - DNA, 22 bp, Homo sapiens
ctttatggtcctaaaagcaaaa

SEQ ID NO: 6180438 - DNA, 20 bp, Homo sapiens
ctttatggttctacttcctg

SEQ ID NO: 6180439 - DNA, 21 bp, Homo sapiens
ctttatgtacaggatgctttg

SEQ ID NO: 6180440 - DNA, 16 bp, Homo sapiens
ctttatgtagagaaaa

SEQ ID NO: 6180441 - DNA, 20 bp, Homo sapiens
ctttatgtagtttttatatg

SEQ ID NO: 6180442 - DNA, 23 bp, Homo sapiens
ctttatgtatctaatttcattca

SEQ ID NO: 6180443 - DNA, 21 bp, Homo sapiens
ctttatgtctgtggatttttt

SEQ ID NO: 6180444 - DNA, 20 bp, Homo sapiens
ctttatgtgatataaggatt

SEQ ID NO: 6180445 - DNA, 17 bp, Homo sapiens
ctttatgttttaatatc

SEQ ID NO: 6180446 - DNA, 20 bp, Homo sapiens
ctttatgtttttgaggcttt

SEQ ID NO: 6180447 - DNA, 14 bp, Homo sapiens
ctttattaaaacag

SEQ ID NO: 6180448 - DNA, 21 bp, Homo sapiens
ctttattaaatacaaaacttc

SEQ ID NO: 6180449 - DNA, 17 bp, Homo sapiens
ctttattaaatgtagaa

SEQ ID NO: 6180450 - DNA, 21 bp, Homo sapiens
ctttattaaccctctgagttt

SEQ ID NO: 6180451 - DNA, 15 bp, Homo sapiens
ctttattaacctcag

SEQ ID NO: 6180452 - DNA, 14 bp, Homo sapiens
ctttattaagtaaa

SEQ ID NO: 6180453 - DNA, 23 bp, Homo sapiens
ctgggacccttgttggggagtgg

SEQ ID NO: 6180454 - DNA, 17 bp, Homo sapiens
ctgggaccgatgcagta

SEQ ID NO: 6180455 - DNA, 16 bp, Homo sapiens
ctgggaccgctacacc

SEQ ID NO: 6180456 - DNA, 17 bp, Homo sapiens
ctgggaccgctacacca

SEQ ID NO: 6180457 - DNA, 20 bp, Homo sapiens
ctgggaccgctacaccactc

SEQ ID NO: 6180458 - DNA, 19 bp, Homo sapiens
ctgggaccgtgcgagctgc

SEQ ID NO: 6180459 - DNA, 22 bp, Homo sapiens
ctgggacctccccagcccagga

SEQ ID NO: 6180460 - DNA, 16 bp, Homo sapiens
ctgggacctcccctga

SEQ ID NO: 6180461 - DNA, 18 bp, Homo sapiens
ctgggacctgccaggcag

SEQ ID NO: 6180462 - DNA, 16 bp, Homo sapiens
ctgggacctgtggtca

SEQ ID NO: 6180463 - DNA, 22 bp, Homo sapiens
ctgggacgatcgcccaggctgg

SEQ ID NO: 6180464 - DNA, 13 bp, Homo sapiens
ctgggacgcccct

SEQ ID NO: 6180465 - DNA, 14 bp, Homo sapiens
ctgggacgctctgc

SEQ ID NO: 6180466 - DNA, 14 bp, Homo sapiens
ctgggacggctcct

SEQ ID NO: 6180467 - DNA, 15 bp, Homo sapiens
ctgggacggctcctg

SEQ ID NO: 6180468 - DNA, 16 bp, Homo sapiens
ctgggacggctcctgc

SEQ ID NO: 6180469 - DNA, 17 bp, Homo sapiens
ctgggacgtggctcagc

SEQ ID NO: 6180470 - DNA, 21 bp, Homo sapiens
ctgggacgtggctcagccagc

SEQ ID NO: 6180471 - DNA, 23 bp, Homo sapiens
ctgggacgtggctcagccagcac

SEQ ID NO: 6180472 - DNA, 21 bp, Homo sapiens
ctgggactacaggcgcccgcc

SEQ ID NO: 6180473 - DNA, 15 bp, Homo sapiens
ctgggactcagcctt

SEQ ID NO: 6180474 - DNA, 16 bp, Homo sapiens
ctgggactcagccttc

SEQ ID NO: 6180475 - DNA, 17 bp, Homo sapiens
ctgggactcagccttca

SEQ ID NO: 6180476 - DNA, 21 bp, Homo sapiens
ctgggactcagccttcagaca

SEQ ID NO: 6180477 - DNA, 19 bp, Homo sapiens
ctgggactcagttcttggc

SEQ ID NO: 6180478 - DNA, 14 bp, Homo sapiens
ctgggactccaggt

SEQ ID NO: 6180479 - DNA, 16 bp, Homo sapiens
ctgggactccaggtct

SEQ ID NO: 6180480 - DNA, 16 bp, Homo sapiens
ctgggactcccagcag

SEQ ID NO: 6180481 - DNA, 17 bp, Homo sapiens
ctgggactcccagcaga

SEQ ID NO: 6180482 - DNA, 14 bp, Homo sapiens
ctgggactcccagt

SEQ ID NO: 6180483 - DNA, 18 bp, Homo sapiens
ctgggactcctggtgccc

SEQ ID NO: 6180484 - DNA, 20 bp, Homo sapiens
ctgggactcctggtgcccct

SEQ ID NO: 6180485 - DNA, 23 bp, Homo sapiens
ctgggactctcctcctcccctcc

SEQ ID NO: 6180486 - DNA, 13 bp, Homo sapiens
ctgggactgagcc

SEQ ID NO: 6180487 - DNA, 16 bp, Homo sapiens
ctgggactgagccagt

SEQ ID NO: 6180488 - DNA, 14 bp, Homo sapiens
ctgggactgctcag

SEQ ID NO: 6180489 - DNA, 19 bp, Homo sapiens
ctgggactgctcaggctcc

SEQ ID NO: 6180490 - DNA, 14 bp, Homo sapiens
ctgggactggccag

SEQ ID NO: 6180491 - DNA, 13 bp, Homo sapiens
ctgggactgggaa

SEQ ID NO: 6180492 - DNA, 19 bp, Homo sapiens
ctgggactgtgcctggctc

SEQ ID NO: 6180493 - DNA, 17 bp, Homo sapiens
ctgggacttccatgcct

SEQ ID NO: 6180494 - DNA, 19 bp, Homo sapiens
ctgggacttccatgcctta

SEQ ID NO: 6180495 - DNA, 14 bp, Homo sapiens
ctgggacttccttg

SEQ ID NO: 6180496 - DNA, 16 bp, Homo sapiens
ctgggacttccttgct

SEQ ID NO: 6180497 - DNA, 17 bp, Homo sapiens
ctgggacttccttgctc

SEQ ID NO: 6180498 - DNA, 18 bp, Homo sapiens
ctgggacttctgggtctc

SEQ ID NO: 6180499 - DNA, 16 bp, Homo sapiens
ctgggacttcttaccc

SEQ ID NO: 6180500 - DNA, 21 bp, Homo sapiens
ctgggacttcttacccaaagc

SEQ ID NO: 6180501 - DNA, 17 bp, Homo sapiens
ctgggactttcccaccc

SEQ ID NO: 6180502 - DNA, 17 bp, Homo sapiens
ctgggagaaaagccaga

SEQ ID NO: 6180503 - DNA, 18 bp, Homo sapiens
ctgggagaaaagccagat

SEQ ID NO: 6180504 - DNA, 12 bp, Homo sapiens
ctgggagaaaat

SEQ ID NO: 6180505 - DNA, 20 bp, Homo sapiens
ctgggagaaatctggcttct

SEQ ID NO: 6180506 - DNA, 14 bp, Homo sapiens
ctgggagaacctca

SEQ ID NO: 6180507 - DNA, 15 bp, Homo sapiens
ctgggagaacctcag

SEQ ID NO: 6180508 - DNA, 23 bp, Homo sapiens
ctgggagaactaacagaggagaa

SEQ ID NO: 6180509 - DNA, 16 bp, Homo sapiens
ctgggagaagagaacc

SEQ ID NO: 6180510 - DNA, 21 bp, Homo sapiens
ctgggagaaggtgcttgggct

SEQ ID NO: 6180511 - DNA, 18 bp, Homo sapiens
ctgggagacaactggaca

SEQ ID NO: 6180512 - DNA, 12 bp, Homo sapiens
ctgggagacaga

SEQ ID NO: 6180513 - DNA, 12 bp, Homo sapiens
ctgggagaccct

SEQ ID NO: 6180514 - DNA, 16 bp, Homo sapiens
ctgggagactgggaca

SEQ ID NO: 6180515 - DNA, 17 bp, Homo sapiens
ctgggagactgggacac

SEQ ID NO: 6180516 - DNA, 18 bp, Homo sapiens
ctgggagactgggacacc

SEQ ID NO: 6180517 - DNA, 18 bp, Homo sapiens
ctgggagacttactgcat

SEQ ID NO: 6180518 - DNA, 12 bp, Homo sapiens
ctgggagagaag

SEQ ID NO: 6180519 - DNA, 18 bp, Homo sapiens
ctgggagagaagaggact

SEQ ID NO: 6180520 - DNA, 14 bp, Homo sapiens
ctgggagagccaag

SEQ ID NO: 6180521 - DNA, 19 bp, Homo sapiens
ctgggagagccaaggccta

SEQ ID NO: 6180522 - DNA, 20 bp, Homo sapiens
ctgggagagccaaggcctat

SEQ ID NO: 6180523 - DNA, 20 bp, Homo sapiens
ctgggagagccagctttgct

SEQ ID NO: 6180524 - DNA, 16 bp, Homo sapiens
ctgggagagcctggca

SEQ ID NO: 6180525 - DNA, 21 bp, Homo sapiens
ctgggagagcctggcaaggca

SEQ ID NO: 6180526 - DNA, 20 bp, Homo sapiens
ctgggagagccttccagggg

SEQ ID NO: 6180527 - DNA, 23 bp, Homo sapiens
ctgggagagctggtggtgcagcc

SEQ ID NO: 6180528 - DNA, 17 bp, Homo sapiens
ctgggagaggacaggga

SEQ ID NO: 6180529 - DNA, 12 bp, Homo sapiens
ctgggagaggat

SEQ ID NO: 6180530 - DNA, 13 bp, Homo sapiens
ctgggagaggcag

SEQ ID NO: 6180531 - DNA, 18 bp, Homo sapiens
ctgggagaggcagcccag

SEQ ID NO: 6180532 - DNA, 23 bp, Homo sapiens
ctgggagaggtgccagcaactga

SEQ ID NO: 6180533 - DNA, 22 bp, Homo sapiens
ctgggagagtccttagcctggg

SEQ ID NO: 6180534 - DNA, 23 bp, Homo sapiens
ctgggagagtccttagcctgggc

SEQ ID NO: 6180535 - DNA, 15 bp, Homo sapiens
ctgggagatgctctc

SEQ ID NO: 6180536 - DNA, 16 bp, Homo sapiens
ctgggagatgctctct

SEQ ID NO: 6180537 - DNA, 18 bp, Homo sapiens
ctgggagatgctctctga

SEQ ID NO: 6180538 - DNA, 22 bp, Homo sapiens
ctgggagatgctctctgaggca

SEQ ID NO: 6180539 - DNA, 19 bp, Homo sapiens
ctgggagattcaagggacc

SEQ ID NO: 6180540 - DNA, 15 bp, Homo sapiens
ctgggagcaagttgc

SEQ ID NO: 6180541 - DNA, 16 bp, Homo sapiens
ctgggagcagaaacag

SEQ ID NO: 6180542 - DNA, 22 bp, Homo sapiens
ctgggagcatagcagaggggcc

SEQ ID NO: 6180543 - DNA, 23 bp, Homo sapiens
ctgggagcatagcagaggggcca

SEQ ID NO: 6180544 - DNA, 17 bp, Homo sapiens
ctgggagccacttctcc

SEQ ID NO: 6180545 - DNA, 20 bp, Homo sapiens
ctgggagccacttctcccca

SEQ ID NO: 6180546 - DNA, 18 bp, Homo sapiens
ctgggagccagagcctct

SEQ ID NO: 6180547 - DNA, 13 bp, Homo sapiens
ctgggagccagtc

SEQ ID NO: 6180548 - DNA, 13 bp, Homo sapiens
ctgggagccagtg

SEQ ID NO: 6180549 - DNA, 12 bp, Homo sapiens
ctgggagcccag

SEQ ID NO: 6180550 - DNA, 13 bp, Homo sapiens
ctgggagcccaga

SEQ ID NO: 6180551 - DNA, 17 bp, Homo sapiens
ctgggagcccccagcct

SEQ ID NO: 6180552 - DNA, 19 bp, Homo sapiens
ctgggagccgggccgcaga

SEQ ID NO: 6180553 - DNA, 17 bp, Homo sapiens
ctgggagcctctcctgt

SEQ ID NO: 6180554 - DNA, 22 bp, Homo sapiens
ctgggagcctggttcagacaca

SEQ ID NO: 6180555 - DNA, 21 bp, Homo sapiens
ctgggagcgtgggctcagcag

SEQ ID NO: 6180556 - DNA, 22 bp, Homo sapiens
ctgggagctgcgccggacagag

SEQ ID NO: 6180557 - DNA, 12 bp, Homo sapiens
ctgggaggaacc

SEQ ID NO: 6180558 - DNA, 15 bp, Homo sapiens
ctgggaggaagcagg

SEQ ID NO: 6180559 - DNA, 22 bp, Homo sapiens
ctgggaggaaggacttccctgt

SEQ ID NO: 6180560 - DNA, 19 bp, Homo sapiens
ctgggaggaatggacagac

SEQ ID NO: 6180561 - DNA, 14 bp, Homo sapiens
ctgggaggacaggc

SEQ ID NO: 6180562 - DNA, 15 bp, Homo sapiens
ctgggaggactggac

SEQ ID NO: 6180563 - DNA, 16 bp, Homo sapiens
ctgggaggactggacc

SEQ ID NO: 6180564 - DNA, 14 bp, Homo sapiens
ctgggaggaggaag

SEQ ID NO: 6180565 - DNA, 15 bp, Homo sapiens
ctgggaggagggaga

SEQ ID NO: 6180566 - DNA, 20 bp, Homo sapiens
ctgggaggagggggagggtg

SEQ ID NO: 6180567 - DNA, 13 bp, Homo sapiens
ctgggaggagtgg

SEQ ID NO: 6180568 - DNA, 14 bp, Homo sapiens
ctgggaggagtggc

SEQ ID NO: 6180569 - DNA, 19 bp, Homo sapiens
ctgggaggagtggccctga

SEQ ID NO: 6180570 - DNA, 23 bp, Homo sapiens
ctgggaggagtggccctgatcca

SEQ ID NO: 6180571 - DNA, 20 bp, Homo sapiens
ctgggaggatcctgagctgc

SEQ ID NO: 6180572 - DNA, 24 bp, Homo sapiens
ctgggaggatcctgagctgctgtt

SEQ ID NO: 6180573 - DNA, 17 bp, Homo sapiens
ctgggaggcaagaaaag

SEQ ID NO: 6180574 - DNA, 18 bp, Homo sapiens
ctgggaggcaagaaaagg

SEQ ID NO: 6180575 - DNA, 18 bp, Homo sapiens
ctgggaggcaagaggggt

SEQ ID NO: 6180576 - DNA, 22 bp, Homo sapiens
ctgggaggcaagaggggtggag

SEQ ID NO: 6180577 - DNA, 23 bp, Homo sapiens
ctgggaggcaagaggggtggaga

SEQ ID NO: 6180578 - DNA, 15 bp, Homo sapiens
ctgggaggcagaggt

SEQ ID NO: 6180579 - DNA, 23 bp, Homo sapiens
ctgggaggcagaggttgcagtga

SEQ ID NO: 6180580 - DNA, 13 bp, Homo sapiens
ctgggaggcaggt

SEQ ID NO: 6180581 - DNA, 14 bp, Homo sapiens
ctgggaggcaggtc

SEQ ID NO: 6180582 - DNA, 22 bp, Homo sapiens
ctgggaggcaggtcccgagccc

SEQ ID NO: 6180583 - DNA, 14 bp, Homo sapiens
ctgggaggcagtga

SEQ ID NO: 6180584 - DNA, 13 bp, Homo sapiens
ctgggaggcatgg

SEQ ID NO: 6180585 - DNA, 14 bp, Homo sapiens
ctgggaggccagtg

SEQ ID NO: 6180586 - DNA, 20 bp, Homo sapiens
ctgggaggccctgagacagg

SEQ ID NO: 6180587 - DNA, 19 bp, Homo sapiens
ctgggaggccctggcagaa

SEQ ID NO: 6180588 - DNA, 23 bp, Homo sapiens
ctgggaggctcggggctccccac

SEQ ID NO: 6180589 - DNA, 17 bp, Homo sapiens
ctgggaggctctggagc

SEQ ID NO: 6180590 - DNA, 18 bp, Homo sapiens
ctgggaggctctggagcc

SEQ ID NO: 6180591 - DNA, 12 bp, Homo sapiens
ctgggaggctgc

SEQ ID NO: 6180592 - DNA, 13 bp, Homo sapiens
ctgggaggctgca

SEQ ID NO: 6180593 - DNA, 14 bp, Homo sapiens
ctgggaggctgcag

SEQ ID NO: 6180594 - DNA, 21 bp, Homo sapiens
ctgggaggctgcagccaggcc

SEQ ID NO: 6180595 - DNA, 15 bp, Homo sapiens
ctgggaggcttcagt

SEQ ID NO: 6180596 - DNA, 12 bp, Homo sapiens
ctgggagggagg

SEQ ID NO: 6180597 - DNA, 21 bp, Homo sapiens
ctgggagggagggggaggtga

SEQ ID NO: 6180598 - DNA, 15 bp, Homo sapiens
ctgggagggaggtgg

SEQ ID NO: 6180599 - DNA, 19 bp, Homo sapiens
ctgggagggaggtggtcct

SEQ ID NO: 6180600 - DNA, 23 bp, Homo sapiens
ctgggagggatagaggggggctg

SEQ ID NO: 6180601 - DNA, 14 bp, Homo sapiens
ctgggagggcaagg

SEQ ID NO: 6180602 - DNA, 15 bp, Homo sapiens
ctgggagggcagcag

SEQ ID NO: 6180603 - DNA, 22 bp, Homo sapiens
ctgggagggcagcagggctacc

SEQ ID NO: 6180604 - DNA, 21 bp, Homo sapiens
ctgggagggcggagaattctt

SEQ ID NO: 6180605 - DNA, 11 bp, Homo sapiens
ctgggaggggg

SEQ ID NO: 6180606 - DNA, 16 bp, Homo sapiens
ctgggagggggacccg

SEQ ID NO: 6180607 - DNA, 21 bp, Homo sapiens
ctgggagggggacccgtggag

SEQ ID NO: 6180608 - DNA, 18 bp, Homo sapiens
ctgggagggggcccttcc

SEQ ID NO: 6180609 - DNA, 12 bp, Homo sapiens
ctgggagggggt

SEQ ID NO: 6180610 - DNA, 14 bp, Homo sapiens
ctgggagggggtga

SEQ ID NO: 6180611 - DNA, 16 bp, Homo sapiens
ctgggagggggtgaga

SEQ ID NO: 6180612 - DNA, 21 bp, Homo sapiens
ctgggagggggtgagaggcag

SEQ ID NO: 6180613 - DNA, 22 bp, Homo sapiens
ctgggaggggtgctgccttgta

SEQ ID NO: 6180614 - DNA, 20 bp, Homo sapiens
ctgggagggttcccctggcc

SEQ ID NO: 6180615 - DNA, 14 bp, Homo sapiens
ctgggaggtcccag

SEQ ID NO: 6180616 - DNA, 18 bp, Homo sapiens
ctgggaggtcccagggcc

SEQ ID NO: 6180617 - DNA, 19 bp, Homo sapiens
ctgggaggtcccagggccc

SEQ ID NO: 6180618 - DNA, 16 bp, Homo sapiens
ctgggaggttgggagg

SEQ ID NO: 6180619 - DNA, 18 bp, Homo sapiens
ctgggaggttgggaggct

SEQ ID NO: 6180620 - DNA, 21 bp, Homo sapiens
ctgggagtatacggaaacaaa

SEQ ID NO: 6180621 - DNA, 16 bp, Homo sapiens
ctgggagtcacacagt

SEQ ID NO: 6180622 - DNA, 22 bp, Homo sapiens
ctgggagtcacacagtgttgga

SEQ ID NO: 6180623 - DNA, 16 bp, Homo sapiens
ctgggagtcaggcccg

SEQ ID NO: 6180624 - DNA, 13 bp, Homo sapiens
ctgggagtcccct

SEQ ID NO: 6180625 - DNA, 14 bp, Homo sapiens
ctgggagtcccctt

SEQ ID NO: 6180626 - DNA, 13 bp, Homo sapiens
ctgggagtgagct

SEQ ID NO: 6180627 - DNA, 19 bp, Homo sapiens
ctgggagtgggtggaggca

SEQ ID NO: 6180628 - DNA, 18 bp, Homo sapiens
ctgggagtgtgggctgcc

SEQ ID NO: 6180629 - DNA, 20 bp, Homo sapiens
ctgggagtgtgggctgccct

SEQ ID NO: 6180630 - DNA, 23 bp, Homo sapiens
ctgggagtgttcccgtgcctggg

SEQ ID NO: 6180631 - DNA, 14 bp, Homo sapiens
ctgggagtgttctg

SEQ ID NO: 6180632 - DNA, 22 bp, Homo sapiens
ctttattaagtagatgaaacat

SEQ ID NO: 6180633 - DNA, 15 bp, Homo sapiens
ctttattaatcacta

SEQ ID NO: 6180634 - DNA, 18 bp, Homo sapiens
ctttattacaatttgtat

SEQ ID NO: 6180635 - DNA, 14 bp, Homo sapiens
ctttattacacaaa

SEQ ID NO: 6180636 - DNA, 21 bp, Homo sapiens
ctttattacacctcagaaatt

SEQ ID NO: 6180637 - DNA, 13 bp, Homo sapiens
ctttattaccagt

SEQ ID NO: 6180638 - DNA, 23 bp, Homo sapiens
ctttattagtgaagtatgcacta

SEQ ID NO: 6180639 - DNA, 16 bp, Homo sapiens
ctttattatagtccta

SEQ ID NO: 6180640 - DNA, 16 bp, Homo sapiens
ctttattatggcttgt

SEQ ID NO: 6180641 - DNA, 18 bp, Homo sapiens
ctttattatggcttgtga

SEQ ID NO: 6180642 - DNA, 11 bp, Homo sapiens
ctttattcaaa

SEQ ID NO: 6180643 - DNA, 19 bp, Homo sapiens
ctttattcacccctgcccc

SEQ ID NO: 6180644 - DNA, 21 bp, Homo sapiens
ctttattcaccttttcttcaa

SEQ ID NO: 6180645 - DNA, 17 bp, Homo sapiens
ctttattcagaacttta

SEQ ID NO: 6180646 - DNA, 12 bp, Homo sapiens
ctttattcctag

SEQ ID NO: 6180647 - DNA, 21 bp, Homo sapiens
ctttattcctccctcatgagc

SEQ ID NO: 6180648 - DNA, 13 bp, Homo sapiens
ctttattctcctc

SEQ ID NO: 6180649 - DNA, 11 bp, Homo sapiens
ctttattcttt

SEQ ID NO: 6180650 - DNA, 13 bp, Homo sapiens
ctttattcttttc

SEQ ID NO: 6180651 - DNA, 14 bp, Homo sapiens
ctttattgaaattc

SEQ ID NO: 6180652 - DNA, 16 bp, Homo sapiens
ctttattgaattagaa

SEQ ID NO: 6180653 - DNA, 17 bp, Homo sapiens
ctttattgaattagaaa

SEQ ID NO: 6180654 - DNA, 20 bp, Homo sapiens
ctttattgaattagaaaatt

SEQ ID NO: 6180655 - DNA, 15 bp, Homo sapiens
ctttattgagaaaga

SEQ ID NO: 6180656 - DNA, 14 bp, Homo sapiens
ctttattgcaatgc

SEQ ID NO: 6180657 - DNA, 16 bp, Homo sapiens
ctttattgcaatgcag

SEQ ID NO: 6180658 - DNA, 19 bp, Homo sapiens
ctttattgcactaggaatt

SEQ ID NO: 6180659 - DNA, 14 bp, Homo sapiens
ctttattgcatata

SEQ ID NO: 6180660 - DNA, 19 bp, Homo sapiens
ctttattgccaaaacccag

SEQ ID NO: 6180661 - DNA, 17 bp, Homo sapiens
ctttattgctgcatttt

SEQ ID NO: 6180662 - DNA, 18 bp, Homo sapiens
ctttattgctgcatttta

SEQ ID NO: 6180663 - DNA, 22 bp, Homo sapiens
ctttattgcttactgtgttaaa

SEQ ID NO: 6180664 - DNA, 14 bp, Homo sapiens
ctttattgcttttt

SEQ ID NO: 6180665 - DNA, 19 bp, Homo sapiens
ctttattgcttttttgtat

SEQ ID NO: 6180666 - DNA, 12 bp, Homo sapiens
ctttattggaaa

SEQ ID NO: 6180667 - DNA, 16 bp, Homo sapiens
ctttattggctgagat

SEQ ID NO: 6180668 - DNA, 18 bp, Homo sapiens
ctttattggctgagatat

SEQ ID NO: 6180669 - DNA, 18 bp, Homo sapiens
ctttattgtacagactgt

SEQ ID NO: 6180670 - DNA, 15 bp, Homo sapiens
ctttattgtctgtaa

SEQ ID NO: 6180671 - DNA, 15 bp, Homo sapiens
ctttattgtcttggt

SEQ ID NO: 6180672 - DNA, 14 bp, Homo sapiens
ctttattgtgatct

SEQ ID NO: 6180673 - DNA, 16 bp, Homo sapiens
ctttattgtgattacg

SEQ ID NO: 6180674 - DNA, 23 bp, Homo sapiens
ctttattgtgggccatgaaccaa

SEQ ID NO: 6180675 - DNA, 19 bp, Homo sapiens
ctttattgtgtttgtcatt

SEQ ID NO: 6180676 - DNA, 20 bp, Homo sapiens
ctttattgtgtttgtcatta

SEQ ID NO: 6180677 - DNA, 13 bp, Homo sapiens
ctttatttaaaat

SEQ ID NO: 6180678 - DNA, 12 bp, Homo sapiens
ctttatttaaat

SEQ ID NO: 6180679 - DNA, 18 bp, Homo sapiens
ctttatttaaatgcatgt

SEQ ID NO: 6180680 - DNA, 24 bp, Homo sapiens
ctttatttaaatgcatgtcttaaa

SEQ ID NO: 6180681 - DNA, 10 bp, Homo sapiens
ctttatttat

SEQ ID NO: 6180682 - DNA, 17 bp, Homo sapiens
ctttatttataaaataa

SEQ ID NO: 6180683 - DNA, 17 bp, Homo sapiens
ctttatttatggcttat

SEQ ID NO: 6180684 - DNA, 21 bp, Homo sapiens
ctttatttattaaacttcagc

SEQ ID NO: 6180685 - DNA, 24 bp, Homo sapiens
ctttatttattgcttagtgaaaat

SEQ ID NO: 6180686 - DNA, 14 bp, Homo sapiens
ctttatttatttct

SEQ ID NO: 6180687 - DNA, 12 bp, Homo sapiens
ctttatttcaca

SEQ ID NO: 6180688 - DNA, 12 bp, Homo sapiens
ctttatttccaa

SEQ ID NO: 6180689 - DNA, 15 bp, Homo sapiens
ctttatttctcttct

SEQ ID NO: 6180690 - DNA, 21 bp, Homo sapiens
ctttatttctgagcaaagcat

SEQ ID NO: 6180691 - DNA, 13 bp, Homo sapiens
ctttatttgtaaa

SEQ ID NO: 6180692 - DNA, 15 bp, Homo sapiens
ctttatttgtaaatt

SEQ ID NO: 6180693 - DNA, 20 bp, Homo sapiens
ctttatttgtactttttcct

SEQ ID NO: 6180694 - DNA, 23 bp, Homo sapiens
ctttatttgtgttcttttttccc

SEQ ID NO: 6180695 - DNA, 23 bp, Homo sapiens
ctttattttaaaaaacactgata

SEQ ID NO: 6180696 - DNA, 16 bp, Homo sapiens
ctttattttaaatgtg

SEQ ID NO: 6180697 - DNA, 22 bp, Homo sapiens
ctttattttaacctttgataga

SEQ ID NO: 6180698 - DNA, 19 bp, Homo sapiens
ctttattttactagaaatg

SEQ ID NO: 6180699 - DNA, 14 bp, Homo sapiens
ctttattttattat

SEQ ID NO: 6180700 - DNA, 18 bp, Homo sapiens
ctttattttattgaaatg

SEQ ID NO: 6180701 - DNA, 18 bp, Homo sapiens
ctttattttctggtagat

SEQ ID NO: 6180702 - DNA, 13 bp, Homo sapiens
ctttattttgtgt

SEQ ID NO: 6180703 - DNA, 19 bp, Homo sapiens
ctttattttgttaataata

SEQ ID NO: 6180704 - DNA, 18 bp, Homo sapiens
ctttatttttataaaact

SEQ ID NO: 6180705 - DNA, 20 bp, Homo sapiens
ctttatttttcattacctgt

SEQ ID NO: 6180706 - DNA, 16 bp, Homo sapiens
ctttattttttaactt

SEQ ID NO: 6180707 - DNA, 22 bp, Homo sapiens
ctttattttttaagtatttata

SEQ ID NO: 6180708 - DNA, 15 bp, Homo sapiens
ctttatttttttccc

SEQ ID NO: 6180709 - DNA, 17 bp, Homo sapiens
ctttatttttttcccat

SEQ ID NO: 6180710 - DNA, 21 bp, Homo sapiens
ctttcaaaagaagagttttag

SEQ ID NO: 6180711 - DNA, 14 bp, Homo sapiens
ctttcaaaatatat

SEQ ID NO: 6180712 - DNA, 23 bp, Homo sapiens
ctttcaaaatatattttcagtac

SEQ ID NO: 6180713 - DNA, 12 bp, Homo sapiens
ctttcaaaatga

SEQ ID NO: 6180714 - DNA, 22 bp, Homo sapiens
ctttcaaaatggaaaattaatt

SEQ ID NO: 6180715 - DNA, 23 bp, Homo sapiens
ctttcaaacattgagactgctag

SEQ ID NO: 6180716 - DNA, 14 bp, Homo sapiens
ctttcaaagaaatc

SEQ ID NO: 6180717 - DNA, 18 bp, Homo sapiens
ctttcaaagaaggaattc

SEQ ID NO: 6180718 - DNA, 15 bp, Homo sapiens
ctttcaaagccattt

SEQ ID NO: 6180719 - DNA, 16 bp, Homo sapiens
ctttcaaagctaaaat

SEQ ID NO: 6180720 - DNA, 18 bp, Homo sapiens
ctttcaaagctaaaatat

SEQ ID NO: 6180721 - DNA, 20 bp, Homo sapiens
ctttcaaagctaaaatatat

SEQ ID NO: 6180722 - DNA, 13 bp, Homo sapiens
ctttcaaatcggt

SEQ ID NO: 6180723 - DNA, 13 bp, Homo sapiens
ctttcaaatgtac

SEQ ID NO: 6180724 - DNA, 13 bp, Homo sapiens
ctttcaaattata

SEQ ID NO: 6180725 - DNA, 19 bp, Homo sapiens
ctttcaaattatatgctaa

SEQ ID NO: 6180726 - DNA, 14 bp, Homo sapiens
ctttcaaatttaga

SEQ ID NO: 6180727 - DNA, 21 bp, Homo sapiens
ctttcaaatttagaaactaat

SEQ ID NO: 6180728 - DNA, 22 bp, Homo sapiens
ctttcaacttaaatcactgagg

SEQ ID NO: 6180729 - DNA, 19 bp, Homo sapiens
ctttcaagaatcagacagc

SEQ ID NO: 6180730 - DNA, 15 bp, Homo sapiens
ctttcaagacagatg

SEQ ID NO: 6180731 - DNA, 14 bp, Homo sapiens
ctttcaaggaaagt

SEQ ID NO: 6180732 - DNA, 16 bp, Homo sapiens
ctttcaagtaatattg

SEQ ID NO: 6180733 - DNA, 20 bp, Homo sapiens
ctttcaagtcagttctgtga

SEQ ID NO: 6180734 - DNA, 20 bp, Homo sapiens
ctttcaagtctgactctcca

SEQ ID NO: 6180735 - DNA, 11 bp, Homo sapiens
ctttcaagtga

SEQ ID NO: 6180736 - DNA, 12 bp, Homo sapiens
ctttcaataaag

SEQ ID NO: 6180737 - DNA, 17 bp, Homo sapiens
ctttcaataaagttgtt

SEQ ID NO: 6180738 - DNA, 13 bp, Homo sapiens
ctttcaatatcat

SEQ ID NO: 6180739 - DNA, 14 bp, Homo sapiens
ctttcaatatcatt

SEQ ID NO: 6180740 - DNA, 21 bp, Homo sapiens
ctttcaatatttatttccaga

SEQ ID NO: 6180741 - DNA, 20 bp, Homo sapiens
ctttcaatggtttgcaagga

SEQ ID NO: 6180742 - DNA, 20 bp, Homo sapiens
ctttcaattccaccagggcc

SEQ ID NO: 6180743 - DNA, 24 bp, Homo sapiens
ctttcaattgcttctgtgcaataa

SEQ ID NO: 6180744 - DNA, 19 bp, Homo sapiens
ctttcaattgtcacttttt

SEQ ID NO: 6180745 - DNA, 14 bp, Homo sapiens
ctttcacaaaaaag

SEQ ID NO: 6180746 - DNA, 14 bp, Homo sapiens
ctttcacaagcaac

SEQ ID NO: 6180747 - DNA, 20 bp, Homo sapiens
ctttcacaaggtataataag

SEQ ID NO: 6180748 - DNA, 14 bp, Homo sapiens
ctttcacacatctg

SEQ ID NO: 6180749 - DNA, 14 bp, Homo sapiens
ctttcacacttcca

SEQ ID NO: 6180750 - DNA, 19 bp, Homo sapiens
ctttcacacttccaccagc

SEQ ID NO: 6180751 - DNA, 21 bp, Homo sapiens
ctttcacacttccaccagcct

SEQ ID NO: 6180752 - DNA, 23 bp, Homo sapiens
ctttcacacttccaccagcctgc

SEQ ID NO: 6180753 - DNA, 13 bp, Homo sapiens
ctttcacagctcc

SEQ ID NO: 6180754 - DNA, 15 bp, Homo sapiens
ctttcacagctcctc

SEQ ID NO: 6180755 - DNA, 14 bp, Homo sapiens
ctttcacagcttct

SEQ ID NO: 6180756 - DNA, 13 bp, Homo sapiens
ctttcacaggcag

SEQ ID NO: 6180757 - DNA, 15 bp, Homo sapiens
ctttcacaggcagcc

SEQ ID NO: 6180758 - DNA, 17 bp, Homo sapiens
ctttcacagtaccatct

SEQ ID NO: 6180759 - DNA, 15 bp, Homo sapiens
ctttcacatctctgt

SEQ ID NO: 6180760 - DNA, 17 bp, Homo sapiens
ctttcacatctctgtag

SEQ ID NO: 6180761 - DNA, 15 bp, Homo sapiens
ctttcaccaccccct

SEQ ID NO: 6180762 - DNA, 17 bp, Homo sapiens
ctttcaccaccccctcc

SEQ ID NO: 6180763 - DNA, 17 bp, Homo sapiens
ctttcacccacagaaag

SEQ ID NO: 6180764 - DNA, 14 bp, Homo sapiens
ctttcacccatcct

SEQ ID NO: 6180765 - DNA, 17 bp, Homo sapiens
ctttcacccatcctagg

SEQ ID NO: 6180766 - DNA, 21 bp, Homo sapiens
ctttcacccctcttcccacca

SEQ ID NO: 6180767 - DNA, 14 bp, Homo sapiens
ctttcaccctgcca

SEQ ID NO: 6180768 - DNA, 14 bp, Homo sapiens
ctttcacccttttc

SEQ ID NO: 6180769 - DNA, 15 bp, Homo sapiens
ctttcacccttttct

SEQ ID NO: 6180770 - DNA, 22 bp, Homo sapiens
ctttcacctcttcccacaagaa

SEQ ID NO: 6180771 - DNA, 13 bp, Homo sapiens
ctttcacctggga

SEQ ID NO: 6180772 - DNA, 22 bp, Homo sapiens
ctttcacctggttatgagccga

SEQ ID NO: 6180773 - DNA, 19 bp, Homo sapiens
ctttcacggaaactcccga

SEQ ID NO: 6180774 - DNA, 17 bp, Homo sapiens
ctttcacgggccccatt

SEQ ID NO: 6180775 - DNA, 15 bp, Homo sapiens
ctttcactatttcct

SEQ ID NO: 6180776 - DNA, 16 bp, Homo sapiens
ctttcactgaagtgaa

SEQ ID NO: 6180777 - DNA, 13 bp, Homo sapiens
ctttcactgggga

SEQ ID NO: 6180778 - DNA, 15 bp, Homo sapiens
ctttcactggggatc

SEQ ID NO: 6180779 - DNA, 12 bp, Homo sapiens
ctttcacttctt

SEQ ID NO: 6180780 - DNA, 14 bp, Homo sapiens
ctttcacttcttcc

SEQ ID NO: 6180781 - DNA, 14 bp, Homo sapiens
ctttcacttctttc

SEQ ID NO: 6180782 - DNA, 10 bp, Homo sapiens
ctttcagaaa

SEQ ID NO: 6180783 - DNA, 13 bp, Homo sapiens
ctttcagaaaaca

SEQ ID NO: 6180784 - DNA, 23 bp, Homo sapiens
ctttcagaaaacagaaaaaaaac

SEQ ID NO: 6180785 - DNA, 15 bp, Homo sapiens
ctttcagaaataaaa

SEQ ID NO: 6180786 - DNA, 23 bp, Homo sapiens
ctttcagaaatataacacatttt

SEQ ID NO: 6180787 - DNA, 20 bp, Homo sapiens
ctttcagaaggaaaccgaaa

SEQ ID NO: 6180788 - DNA, 16 bp, Homo sapiens
ctttcagaatacaatt

SEQ ID NO: 6180789 - DNA, 14 bp, Homo sapiens
ctttcagaatatgt

SEQ ID NO: 6180790 - DNA, 19 bp, Homo sapiens
ctttcagacttgccatgtg

SEQ ID NO: 6180791 - DNA, 20 bp, Homo sapiens
ctttcagagccagtgaagga

SEQ ID NO: 6180792 - DNA, 18 bp, Homo sapiens
ctttcagagcccccagcc

SEQ ID NO: 6180793 - DNA, 20 bp, Homo sapiens
ctttcagataactgttattt

SEQ ID NO: 6180794 - DNA, 14 bp, Homo sapiens
ctttcagatactgg

SEQ ID NO: 6180795 - DNA, 17 bp, Homo sapiens
ctttcagatactggatt

SEQ ID NO: 6180796 - DNA, 15 bp, Homo sapiens
ctttcagatgtcttc

SEQ ID NO: 6180797 - DNA, 20 bp, Homo sapiens
ctttcagatgtcttctgcct

SEQ ID NO: 6180798 - DNA, 13 bp, Homo sapiens
ctttcagatgttt

SEQ ID NO: 6180799 - DNA, 19 bp, Homo sapiens
ctttcagcaagataaacat

SEQ ID NO: 6180800 - DNA, 21 bp, Homo sapiens
ctttcagcaagataaacatta

SEQ ID NO: 6180801 - DNA, 19 bp, Homo sapiens
ctttcagcactcagaaaag

SEQ ID NO: 6180802 - DNA, 17 bp, Homo sapiens
ctttcagcagactgatc

SEQ ID NO: 6180803 - DNA, 18 bp, Homo sapiens
ctttcagcagtctaaatt

SEQ ID NO: 6180804 - DNA, 17 bp, Homo sapiens
ctttcagcctgcttctt

SEQ ID NO: 6180805 - DNA, 19 bp, Homo sapiens
ctttcagcgcccccaggcc

SEQ ID NO: 6180806 - DNA, 15 bp, Homo sapiens
ctttcagctcctgac

SEQ ID NO: 6180807 - DNA, 13 bp, Homo sapiens
ctttcagctgtct

SEQ ID NO: 6180808 - DNA, 17 bp, Homo sapiens
ctttcagctgtcttttg

SEQ ID NO: 6180809 - DNA, 13 bp, Homo sapiens
ctttcagctgtga

SEQ ID NO: 6180810 - DNA, 19 bp, Homo sapiens
ctttcagctgtgtctgaca

SEQ ID NO: 6180811 - DNA, 22 bp, Homo sapiens
ctttcaggaaagtatctctact

SEQ ID NO: 6180812 - DNA, 14 bp, Homo sapiens
ctttcaggaaattt

SEQ ID NO: 6180813 - DNA, 23 bp, Homo sapiens
ctgggagttgatcgcctttccca

SEQ ID NO: 6180814 - DNA, 18 bp, Homo sapiens
ctgggagttgctgttaat

SEQ ID NO: 6180815 - DNA, 12 bp, Homo sapiens
ctgggataactg

SEQ ID NO: 6180816 - DNA, 13 bp, Homo sapiens
ctgggataactga

SEQ ID NO: 6180817 - DNA, 18 bp, Homo sapiens
ctgggataatgcccatgg

SEQ ID NO: 6180818 - DNA, 21 bp, Homo sapiens
ctgggatatatggaggattct

SEQ ID NO: 6180819 - DNA, 20 bp, Homo sapiens
ctgggatatcacttcatcct

SEQ ID NO: 6180820 - DNA, 19 bp, Homo sapiens
ctgggatatggctgcccag

SEQ ID NO: 6180821 - DNA, 14 bp, Homo sapiens
ctgggatatttaac

SEQ ID NO: 6180822 - DNA, 18 bp, Homo sapiens
ctgggatcagctggtgtc

SEQ ID NO: 6180823 - DNA, 15 bp, Homo sapiens
ctgggatccagtgta

SEQ ID NO: 6180824 - DNA, 14 bp, Homo sapiens
ctgggatcccacag

SEQ ID NO: 6180825 - DNA, 15 bp, Homo sapiens
ctgggatcccacagc

SEQ ID NO: 6180826 - DNA, 17 bp, Homo sapiens
ctgggatcccacagccc

SEQ ID NO: 6180827 - DNA, 17 bp, Homo sapiens
ctgggatcctaagggct

SEQ ID NO: 6180828 - DNA, 16 bp, Homo sapiens
ctgggatctgactgca

SEQ ID NO: 6180829 - DNA, 16 bp, Homo sapiens
ctgggatctggtggtc

SEQ ID NO: 6180830 - DNA, 21 bp, Homo sapiens
ctgggatgaaactaaagcaat

SEQ ID NO: 6180831 - DNA, 14 bp, Homo sapiens
ctgggatgacaggc

SEQ ID NO: 6180832 - DNA, 22 bp, Homo sapiens
ctgggatgacaggcgcctgcca

SEQ ID NO: 6180833 - DNA, 24 bp, Homo sapiens
ctgggatgacaggtgtgagccact

SEQ ID NO: 6180834 - DNA, 15 bp, Homo sapiens
ctgggatgcaggcat

SEQ ID NO: 6180835 - DNA, 22 bp, Homo sapiens
ctgggatgcagtgatgtgatca

SEQ ID NO: 6180836 - DNA, 18 bp, Homo sapiens
ctgggatgcccttccccc

SEQ ID NO: 6180837 - DNA, 13 bp, Homo sapiens
ctgggatgcctca

SEQ ID NO: 6180838 - DNA, 14 bp, Homo sapiens
ctgggatgctgacc

SEQ ID NO: 6180839 - DNA, 17 bp, Homo sapiens
ctgggatgctgacccag

SEQ ID NO: 6180840 - DNA, 20 bp, Homo sapiens
ctgggatgctgacccaggaa

SEQ ID NO: 6180841 - DNA, 16 bp, Homo sapiens
ctgggatgcttttgaa

SEQ ID NO: 6180842 - DNA, 14 bp, Homo sapiens
ctgggatggaacct

SEQ ID NO: 6180843 - DNA, 20 bp, Homo sapiens
ctgggatggaacctcaggat

SEQ ID NO: 6180844 - DNA, 14 bp, Homo sapiens
ctgggatggacagg

SEQ ID NO: 6180845 - DNA, 14 bp, Homo sapiens
ctgggatggaccct

SEQ ID NO: 6180846 - DNA, 17 bp, Homo sapiens
ctgggatggaggggagt

SEQ ID NO: 6180847 - DNA, 19 bp, Homo sapiens
ctgggatgggaacactggt

SEQ ID NO: 6180848 - DNA, 15 bp, Homo sapiens
ctgggatgggaccag

SEQ ID NO: 6180849 - DNA, 16 bp, Homo sapiens
ctgggatgggaccagg

SEQ ID NO: 6180850 - DNA, 17 bp, Homo sapiens
ctgggatgggaccaggg

SEQ ID NO: 6180851 - DNA, 16 bp, Homo sapiens
ctgggatgggcctgct

SEQ ID NO: 6180852 - DNA, 22 bp, Homo sapiens
ctgggatgggcctgcttcctgt

SEQ ID NO: 6180853 - DNA, 16 bp, Homo sapiens
ctgggatggtgggctt

SEQ ID NO: 6180854 - DNA, 18 bp, Homo sapiens
ctgggatggtgggcttca

SEQ ID NO: 6180855 - DNA, 20 bp, Homo sapiens
ctgggatggtgggcttcagg

SEQ ID NO: 6180856 - DNA, 21 bp, Homo sapiens
ctgggatggtgggcttcaggg

SEQ ID NO: 6180857 - DNA, 22 bp, Homo sapiens
ctgggatggtgggcttcagggc

SEQ ID NO: 6180858 - DNA, 16 bp, Homo sapiens
ctgggatgtagaactt

SEQ ID NO: 6180859 - DNA, 17 bp, Homo sapiens
ctgggatgtagaacttc

SEQ ID NO: 6180860 - DNA, 18 bp, Homo sapiens
ctgggatgtcacagtcca

SEQ ID NO: 6180861 - DNA, 15 bp, Homo sapiens
ctgggatgtggctgc

SEQ ID NO: 6180862 - DNA, 23 bp, Homo sapiens
ctgggatgtggtattggtgcttt

SEQ ID NO: 6180863 - DNA, 20 bp, Homo sapiens
ctgggattaagaaaccttgc

SEQ ID NO: 6180864 - DNA, 15 bp, Homo sapiens
ctgggattaagggca

SEQ ID NO: 6180865 - DNA, 21 bp, Homo sapiens
ctgggattacaagcgtgagcc

SEQ ID NO: 6180866 - DNA, 15 bp, Homo sapiens
ctgggattacaggca

SEQ ID NO: 6180867 - DNA, 24 bp, Homo sapiens
ctgggattacaggcatgagccact

SEQ ID NO: 6180868 - DNA, 20 bp, Homo sapiens
ctgggattacaggcgcctgc

SEQ ID NO: 6180869 - DNA, 22 bp, Homo sapiens
ctgggattacaggcgcctgcca

SEQ ID NO: 6180870 - DNA, 18 bp, Homo sapiens
ctgggattacaggcgtga

SEQ ID NO: 6180871 - DNA, 21 bp, Homo sapiens
ctgggattacaggcgtgagcc

SEQ ID NO: 6180872 - DNA, 19 bp, Homo sapiens
ctgggattacaggctcctg

SEQ ID NO: 6180873 - DNA, 15 bp, Homo sapiens
ctgggattacaggtg

SEQ ID NO: 6180874 - DNA, 19 bp, Homo sapiens
ctgggattacaggtgtgca

SEQ ID NO: 6180875 - DNA, 20 bp, Homo sapiens
ctgggattactggcatgagc

SEQ ID NO: 6180876 - DNA, 17 bp, Homo sapiens
ctgggattcccaccaag

SEQ ID NO: 6180877 - DNA, 20 bp, Homo sapiens
ctgggattcccaccaaggtc

SEQ ID NO: 6180878 - DNA, 14 bp, Homo sapiens
ctgggattcctccc

SEQ ID NO: 6180879 - DNA, 17 bp, Homo sapiens
ctgggattctactttaa

SEQ ID NO: 6180880 - DNA, 22 bp, Homo sapiens
ctgggattctactttaagcact

SEQ ID NO: 6180881 - DNA, 23 bp, Homo sapiens
ctgggattctactttaagcacta

SEQ ID NO: 6180882 - DNA, 19 bp, Homo sapiens
ctgggattggggggtgggc

SEQ ID NO: 6180883 - DNA, 21 bp, Homo sapiens
ctgggattggggggtgggctt

SEQ ID NO: 6180884 - DNA, 19 bp, Homo sapiens
ctgggatttcttcgctgct

SEQ ID NO: 6180885 - DNA, 22 bp, Homo sapiens
ctgggatttcttcgctgctcta

SEQ ID NO: 6180886 - DNA, 23 bp, Homo sapiens
ctgggatttcttcgctgctctag

SEQ ID NO: 6180887 - DNA, 17 bp, Homo sapiens
ctgggattttaaactag

SEQ ID NO: 6180888 - DNA, 21 bp, Homo sapiens
ctgggattttaaactagatga

SEQ ID NO: 6180889 - DNA, 23 bp, Homo sapiens
ctgggattttaaactagatgacc

SEQ ID NO: 6180890 - DNA, 18 bp, Homo sapiens
ctgggcaaaagaatgttt

SEQ ID NO: 6180891 - DNA, 20 bp, Homo sapiens
ctgggcaaacagagctactg

SEQ ID NO: 6180892 - DNA, 23 bp, Homo sapiens
ctgggcaaacagagctactgaga

SEQ ID NO: 6180893 - DNA, 20 bp, Homo sapiens
ctgggcaaacccttctcttc

SEQ ID NO: 6180894 - DNA, 21 bp, Homo sapiens
ctgggcaaacccttctcttct

SEQ ID NO: 6180895 - DNA, 13 bp, Homo sapiens
ctgggcaaagcca

SEQ ID NO: 6180896 - DNA, 22 bp, Homo sapiens
ctgggcaaagccacaaggctgg

SEQ ID NO: 6180897 - DNA, 19 bp, Homo sapiens
ctgggcaacagagcaagac

SEQ ID NO: 6180898 - DNA, 14 bp, Homo sapiens
ctgggcaagaggaa

SEQ ID NO: 6180899 - DNA, 14 bp, Homo sapiens
ctgggcaaggaaaa

SEQ ID NO: 6180900 - DNA, 15 bp, Homo sapiens
ctgggcaaggaggcc

SEQ ID NO: 6180901 - DNA, 12 bp, Homo sapiens
ctgggcaagggc

SEQ ID NO: 6180902 - DNA, 16 bp, Homo sapiens
ctgggcaagggctcct

SEQ ID NO: 6180903 - DNA, 18 bp, Homo sapiens
ctgggcaagtagcaggac

SEQ ID NO: 6180904 - DNA, 22 bp, Homo sapiens
ctgggcaagtagcaggactagg

SEQ ID NO: 6180905 - DNA, 19 bp, Homo sapiens
ctgggcaatgatggcaatt

SEQ ID NO: 6180906 - DNA, 16 bp, Homo sapiens
ctgggcaatggccagg

SEQ ID NO: 6180907 - DNA, 20 bp, Homo sapiens
ctgggcaatgtgataaaacc

SEQ ID NO: 6180908 - DNA, 12 bp, Homo sapiens
ctgggcacaaac

SEQ ID NO: 6180909 - DNA, 17 bp, Homo sapiens
ctgggcacacgcctccc

SEQ ID NO: 6180910 - DNA, 23 bp, Homo sapiens
ctgggcacacgcctcccactggg

SEQ ID NO: 6180911 - DNA, 14 bp, Homo sapiens
ctgggcacacgctg

SEQ ID NO: 6180912 - DNA, 16 bp, Homo sapiens
ctgggcacacgctgct

SEQ ID NO: 6180913 - DNA, 22 bp, Homo sapiens
ctgggcacacgctgctctgccc

SEQ ID NO: 6180914 - DNA, 18 bp, Homo sapiens
ctgggcacagattgaaga

SEQ ID NO: 6180915 - DNA, 15 bp, Homo sapiens
ctgggcacagctctt

SEQ ID NO: 6180916 - DNA, 15 bp, Homo sapiens
ctgggcacagtgctg

SEQ ID NO: 6180917 - DNA, 22 bp, Homo sapiens
ctgggcacagtggactcagcag

SEQ ID NO: 6180918 - DNA, 18 bp, Homo sapiens
ctgggcaccacaaaatat

SEQ ID NO: 6180919 - DNA, 20 bp, Homo sapiens
ctgggcaccacaaaatatac

SEQ ID NO: 6180920 - DNA, 18 bp, Homo sapiens
ctgggcaccacaggctgc

SEQ ID NO: 6180921 - DNA, 18 bp, Homo sapiens
ctgggcacccacctccac

SEQ ID NO: 6180922 - DNA, 20 bp, Homo sapiens
ctgggcacccacctccaccc

SEQ ID NO: 6180923 - DNA, 21 bp, Homo sapiens
ctgggcaccccaggcagctcc

SEQ ID NO: 6180924 - DNA, 23 bp, Homo sapiens
ctgggcaccccaggcagctcctg

SEQ ID NO: 6180925 - DNA, 18 bp, Homo sapiens
ctgggcacccctgcctcc

SEQ ID NO: 6180926 - DNA, 19 bp, Homo sapiens
ctgggcacccctgcctcct

SEQ ID NO: 6180927 - DNA, 17 bp, Homo sapiens
ctgggcaccctcccacc

SEQ ID NO: 6180928 - DNA, 12 bp, Homo sapiens
ctgggcaccctg

SEQ ID NO: 6180929 - DNA, 19 bp, Homo sapiens
ctgggcaccctgcaggcag

SEQ ID NO: 6180930 - DNA, 21 bp, Homo sapiens
ctgggcaccctgcaggcaggc

SEQ ID NO: 6180931 - DNA, 20 bp, Homo sapiens
ctgggcaccggggcctcgga

SEQ ID NO: 6180932 - DNA, 14 bp, Homo sapiens
ctgggcaccgtgtc

SEQ ID NO: 6180933 - DNA, 16 bp, Homo sapiens
ctgggcacctctagtg

SEQ ID NO: 6180934 - DNA, 19 bp, Homo sapiens
ctgggcacctgcgcacagg

SEQ ID NO: 6180935 - DNA, 17 bp, Homo sapiens
ctgggcacctggggagt

SEQ ID NO: 6180936 - DNA, 16 bp, Homo sapiens
ctgggcactagctaga

SEQ ID NO: 6180937 - DNA, 15 bp, Homo sapiens
ctgggcactcctccc

SEQ ID NO: 6180938 - DNA, 13 bp, Homo sapiens
ctgggcactgctc

SEQ ID NO: 6180939 - DNA, 17 bp, Homo sapiens
ctgggcactgctccaag

SEQ ID NO: 6180940 - DNA, 20 bp, Homo sapiens
ctgggcactgctccaaggga

SEQ ID NO: 6180941 - DNA, 14 bp, Homo sapiens
ctgggcactgggca

SEQ ID NO: 6180942 - DNA, 14 bp, Homo sapiens
ctgggcactgggcc

SEQ ID NO: 6180943 - DNA, 18 bp, Homo sapiens
ctgggcacttccctgctg

SEQ ID NO: 6180944 - DNA, 16 bp, Homo sapiens
ctgggcactttggcca

SEQ ID NO: 6180945 - DNA, 15 bp, Homo sapiens
ctgggcagaaggaag

SEQ ID NO: 6180946 - DNA, 18 bp, Homo sapiens
ctgggcagaaggaagact

SEQ ID NO: 6180947 - DNA, 13 bp, Homo sapiens
ctgggcagaaggc

SEQ ID NO: 6180948 - DNA, 14 bp, Homo sapiens
ctgggcagaaggcc

SEQ ID NO: 6180949 - DNA, 21 bp, Homo sapiens
ctgggcagaagtgagcccccc

SEQ ID NO: 6180950 - DNA, 13 bp, Homo sapiens
ctgggcagacagg

SEQ ID NO: 6180951 - DNA, 20 bp, Homo sapiens
ctgggcagacaggtgggaga

SEQ ID NO: 6180952 - DNA, 21 bp, Homo sapiens
ctgggcagacaggtgggagat

SEQ ID NO: 6180953 - DNA, 22 bp, Homo sapiens
ctgggcagacaggtgggagatg

SEQ ID NO: 6180954 - DNA, 13 bp, Homo sapiens
ctgggcagacctt

SEQ ID NO: 6180955 - DNA, 14 bp, Homo sapiens
ctgggcagagcctg

SEQ ID NO: 6180956 - DNA, 11 bp, Homo sapiens
ctgggcagagg

SEQ ID NO: 6180957 - DNA, 16 bp, Homo sapiens
ctgggcagaggaaagc

SEQ ID NO: 6180958 - DNA, 13 bp, Homo sapiens
ctgggcagaggga

SEQ ID NO: 6180959 - DNA, 15 bp, Homo sapiens
ctgggcagagggagg

SEQ ID NO: 6180960 - DNA, 22 bp, Homo sapiens
ctgggcagaggggagaggaagc

SEQ ID NO: 6180961 - DNA, 14 bp, Homo sapiens
ctgggcagcaaggc

SEQ ID NO: 6180962 - DNA, 15 bp, Homo sapiens
ctgggcagcaaggct

SEQ ID NO: 6180963 - DNA, 17 bp, Homo sapiens
ctgggcagcaaggctgc

SEQ ID NO: 6180964 - DNA, 21 bp, Homo sapiens
ctgggcagcacctccgggact

SEQ ID NO: 6180965 - DNA, 23 bp, Homo sapiens
ctgggcagcacctccgggactga

SEQ ID NO: 6180966 - DNA, 17 bp, Homo sapiens
ctgggcagcacctctgg

SEQ ID NO: 6180967 - DNA, 16 bp, Homo sapiens
ctgggcagccaggctg

SEQ ID NO: 6180968 - DNA, 13 bp, Homo sapiens
ctgggcagcccag

SEQ ID NO: 6180969 - DNA, 15 bp, Homo sapiens
ctgggcagcccagag

SEQ ID NO: 6180970 - DNA, 15 bp, Homo sapiens
ctgggcagccccaca

SEQ ID NO: 6180971 - DNA, 14 bp, Homo sapiens
ctgggcagccccag

SEQ ID NO: 6180972 - DNA, 15 bp, Homo sapiens
ctgggcagcctgctt

SEQ ID NO: 6180973 - DNA, 17 bp, Homo sapiens
ctgggcagcctgctttg

SEQ ID NO: 6180974 - DNA, 22 bp, Homo sapiens
ctgggcagcctgctttggcctt

SEQ ID NO: 6180975 - DNA, 21 bp, Homo sapiens
ctgggcagctcctccctgtgc

SEQ ID NO: 6180976 - DNA, 16 bp, Homo sapiens
ctgggcagctgcctcc

SEQ ID NO: 6180977 - DNA, 21 bp, Homo sapiens
ctgggcagctgcctcccctcc

SEQ ID NO: 6180978 - DNA, 12 bp, Homo sapiens
ctgggcagctgt

SEQ ID NO: 6180979 - DNA, 16 bp, Homo sapiens
ctgggcagctgtcatg

SEQ ID NO: 6180980 - DNA, 16 bp, Homo sapiens
ctgggcagctgtccct

SEQ ID NO: 6180981 - DNA, 17 bp, Homo sapiens
ctgggcagctgtccctt

SEQ ID NO: 6180982 - DNA, 19 bp, Homo sapiens
ctgggcagctgtcccttgc

SEQ ID NO: 6180983 - DNA, 21 bp, Homo sapiens
ctgggcagctgttagagtcca

SEQ ID NO: 6180984 - DNA, 23 bp, Homo sapiens
ctgggcagcttctgttggcagag

SEQ ID NO: 6180985 - DNA, 16 bp, Homo sapiens
ctgggcagcttgggct

SEQ ID NO: 6180986 - DNA, 22 bp, Homo sapiens
ctgggcagcttgggctggcggg

SEQ ID NO: 6180987 - DNA, 17 bp, Homo sapiens
ctgggcaggactcagct

SEQ ID NO: 6180988 - DNA, 17 bp, Homo sapiens
ctgggcagggccctgtg

SEQ ID NO: 6180989 - DNA, 19 bp, Homo sapiens
ctgggcagggccctgtggc

SEQ ID NO: 6180990 - DNA, 22 bp, Homo sapiens
ctttcaggaagggagaggaggg

SEQ ID NO: 6180991 - DNA, 22 bp, Homo sapiens
ctttcaggaagttgctgagaaa

SEQ ID NO: 6180992 - DNA, 18 bp, Homo sapiens
ctttcaggagggaaaacc

SEQ ID NO: 6180993 - DNA, 20 bp, Homo sapiens
ctttcaggagggtccccagc

SEQ ID NO: 6180994 - DNA, 15 bp, Homo sapiens
ctttcaggatctatt

SEQ ID NO: 6180995 - DNA, 17 bp, Homo sapiens
ctttcaggatctatttt

SEQ ID NO: 6180996 - DNA, 18 bp, Homo sapiens
ctttcaggctactgttct

SEQ ID NO: 6180997 - DNA, 21 bp, Homo sapiens
ctttcagggagggctgttcaa

SEQ ID NO: 6180998 - DNA, 13 bp, Homo sapiens
ctttcagggcagc

SEQ ID NO: 6180999 - DNA, 16 bp, Homo sapiens
ctttcagggccatggt

SEQ ID NO: 6181000 - DNA, 12 bp, Homo sapiens
ctttcaggtact

SEQ ID NO: 6181001 - DNA, 15 bp, Homo sapiens
ctttcagtacttttt

SEQ ID NO: 6181002 - DNA, 22 bp, Homo sapiens
ctttcagtatgtccccataaga

SEQ ID NO: 6181003 - DNA, 23 bp, Homo sapiens
ctttcagtattaaactctccttt

SEQ ID NO: 6181004 - DNA, 14 bp, Homo sapiens
ctttcagtgcctgc

SEQ ID NO: 6181005 - DNA, 17 bp, Homo sapiens
ctttcagttattaaatg

SEQ ID NO: 6181006 - DNA, 20 bp, Homo sapiens
ctttcagtttgtccacacaa

SEQ ID NO: 6181007 - DNA, 21 bp, Homo sapiens
ctttcataaagcaccagcagt

SEQ ID NO: 6181008 - DNA, 22 bp, Homo sapiens
ctttcataaagcaccagcagtg

SEQ ID NO: 6181009 - DNA, 13 bp, Homo sapiens
ctttcatacatat

SEQ ID NO: 6181010 - DNA, 14 bp, Homo sapiens
ctttcatacattat

SEQ ID NO: 6181011 - DNA, 15 bp, Homo sapiens
ctttcatacattata

SEQ ID NO: 6181012 - DNA, 17 bp, Homo sapiens
ctttcatactgaagatg

SEQ ID NO: 6181013 - DNA, 14 bp, Homo sapiens
ctttcatagagagg

SEQ ID NO: 6181014 - DNA, 23 bp, Homo sapiens
ctttcatatgaggggacccagcg

SEQ ID NO: 6181015 - DNA, 16 bp, Homo sapiens
ctttcatatggtagga

SEQ ID NO: 6181016 - DNA, 23 bp, Homo sapiens
ctttcatattttaaacagaggat

SEQ ID NO: 6181017 - DNA, 20 bp, Homo sapiens
ctttcatcaatcattgtaca

SEQ ID NO: 6181018 - DNA, 22 bp, Homo sapiens
ctttcatcaatcattgtacagt

SEQ ID NO: 6181019 - DNA, 20 bp, Homo sapiens
ctttcatcaatgggattttc

SEQ ID NO: 6181020 - DNA, 16 bp, Homo sapiens
ctttcatcacactggg

SEQ ID NO: 6181021 - DNA, 22 bp, Homo sapiens
ctttcatcattcataaaagttt

SEQ ID NO: 6181022 - DNA, 16 bp, Homo sapiens
ctttcatccaactcta

SEQ ID NO: 6181023 - DNA, 17 bp, Homo sapiens
ctttcatccactagtgc

SEQ ID NO: 6181024 - DNA, 16 bp, Homo sapiens
ctttcatccccacctt

SEQ ID NO: 6181025 - DNA, 22 bp, Homo sapiens
ctttcatcctgactctgccccc

SEQ ID NO: 6181026 - DNA, 13 bp, Homo sapiens
ctttcatcctgtg

SEQ ID NO: 6181027 - DNA, 15 bp, Homo sapiens
ctttcatcctgtgtc

SEQ ID NO: 6181028 - DNA, 19 bp, Homo sapiens
ctttcatctaaattactga

SEQ ID NO: 6181029 - DNA, 16 bp, Homo sapiens
ctttcatctacctttt

SEQ ID NO: 6181030 - DNA, 18 bp, Homo sapiens
ctttcatctcccagatcc

SEQ ID NO: 6181031 - DNA, 19 bp, Homo sapiens
ctttcatctcccagatcct

SEQ ID NO: 6181032 - DNA, 19 bp, Homo sapiens
ctttcatctctctacctcc

SEQ ID NO: 6181033 - DNA, 18 bp, Homo sapiens
ctttcatctggggtgggg

SEQ ID NO: 6181034 - DNA, 19 bp, Homo sapiens
ctttcatgaccactgggcc

SEQ ID NO: 6181035 - DNA, 21 bp, Homo sapiens
ctttcatgaccactgggcctg

SEQ ID NO: 6181036 - DNA, 16 bp, Homo sapiens
ctttcatgagcttgcc

SEQ ID NO: 6181037 - DNA, 17 bp, Homo sapiens
ctttcatgatttgcaac

SEQ ID NO: 6181038 - DNA, 20 bp, Homo sapiens
ctttcatgcagtgctctttg

SEQ ID NO: 6181039 - DNA, 14 bp, Homo sapiens
ctttcatgccattt

SEQ ID NO: 6181040 - DNA, 16 bp, Homo sapiens
ctttcatgccatttta

SEQ ID NO: 6181041 - DNA, 16 bp, Homo sapiens
ctttcatgctacagaa

SEQ ID NO: 6181042 - DNA, 19 bp, Homo sapiens
ctttcatggggtgatgctg

SEQ ID NO: 6181043 - DNA, 20 bp, Homo sapiens
ctttcatgtttaagaaatga

SEQ ID NO: 6181044 - DNA, 21 bp, Homo sapiens
ctttcattaaaggcttctctc

SEQ ID NO: 6181045 - DNA, 22 bp, Homo sapiens
ctttcattaccctacagacagc

SEQ ID NO: 6181046 - DNA, 15 bp, Homo sapiens
ctttcattaggcaaa

SEQ ID NO: 6181047 - DNA, 18 bp, Homo sapiens
ctttcattccttcagatt

SEQ ID NO: 6181048 - DNA, 21 bp, Homo sapiens
ctttcattcggtgtgaacttt

SEQ ID NO: 6181049 - DNA, 23 bp, Homo sapiens
ctttcattctagtattctttatt

SEQ ID NO: 6181050 - DNA, 15 bp, Homo sapiens
ctttcattgctaaga

SEQ ID NO: 6181051 - DNA, 17 bp, Homo sapiens
ctttcatttactgtggc

SEQ ID NO: 6181052 - DNA, 15 bp, Homo sapiens
ctttcatttcttcta

SEQ ID NO: 6181053 - DNA, 13 bp, Homo sapiens
ctttcatttgaaa

SEQ ID NO: 6181054 - DNA, 18 bp, Homo sapiens
ctttcatttgctttggaa

SEQ ID NO: 6181055 - DNA, 21 bp, Homo sapiens
ctttcatttggggcatttgta

SEQ ID NO: 6181056 - DNA, 23 bp, Homo sapiens
ctttcatttggggcatttgtaaa

SEQ ID NO: 6181057 - DNA, 19 bp, Homo sapiens
ctttcattttaaatattgt

SEQ ID NO: 6181058 - DNA, 17 bp, Homo sapiens
ctttcattttctctcag

SEQ ID NO: 6181059 - DNA, 19 bp, Homo sapiens
ctttcattttctctcaggt

SEQ ID NO: 6181060 - DNA, 16 bp, Homo sapiens
ctttcattttctttcc

SEQ ID NO: 6181061 - DNA, 18 bp, Homo sapiens
ctttcattttctttcctt

SEQ ID NO: 6181062 - DNA, 20 bp, Homo sapiens
ctttcattttctttcctttc

SEQ ID NO: 6181063 - DNA, 19 bp, Homo sapiens
ctttcatttttttccaggc

SEQ ID NO: 6181064 - DNA, 20 bp, Homo sapiens
ctttcatttttttccaggct

SEQ ID NO: 6181065 - DNA, 22 bp, Homo sapiens
ctttccaaaacctaaagaggaa

SEQ ID NO: 6181066 - DNA, 18 bp, Homo sapiens
ctttccaaaccttatctc

SEQ ID NO: 6181067 - DNA, 20 bp, Homo sapiens
ctttccaaagccaatgtgaa

SEQ ID NO: 6181068 - DNA, 23 bp, Homo sapiens
ctttccaaagccaatgtgaacag

SEQ ID NO: 6181069 - DNA, 21 bp, Homo sapiens
ctttccaaaggccatggagag

SEQ ID NO: 6181070 - DNA, 16 bp, Homo sapiens
ctttccaaagtacact

SEQ ID NO: 6181071 - DNA, 17 bp, Homo sapiens
ctttccaaatccaggag

SEQ ID NO: 6181072 - DNA, 19 bp, Homo sapiens
ctttccaaatgcccagctt

SEQ ID NO: 6181073 - DNA, 22 bp, Homo sapiens
ctttccaaatgcccagcttaaa

SEQ ID NO: 6181074 - DNA, 18 bp, Homo sapiens
ctttccaaattaaaacaa

SEQ ID NO: 6181075 - DNA, 22 bp, Homo sapiens
ctttccaaattaaaacaaatat

SEQ ID NO: 6181076 - DNA, 14 bp, Homo sapiens
ctttccaacacaca

SEQ ID NO: 6181077 - DNA, 15 bp, Homo sapiens
ctttccaacacacaa

SEQ ID NO: 6181078 - DNA, 16 bp, Homo sapiens
ctttccaaggaagcag

SEQ ID NO: 6181079 - DNA, 18 bp, Homo sapiens
ctttccaaggaagcagaa

SEQ ID NO: 6181080 - DNA, 19 bp, Homo sapiens
ctttccaaggccccacctt

SEQ ID NO: 6181081 - DNA, 15 bp, Homo sapiens
ctttccaatagaaag

SEQ ID NO: 6181082 - DNA, 18 bp, Homo sapiens
ctttccaatgccacagac

SEQ ID NO: 6181083 - DNA, 21 bp, Homo sapiens
ctttccacacctggcactgct

SEQ ID NO: 6181084 - DNA, 19 bp, Homo sapiens
ctttccacatttgtcacag

SEQ ID NO: 6181085 - DNA, 22 bp, Homo sapiens
ctttccacatttgtcacagaaa

SEQ ID NO: 6181086 - DNA, 17 bp, Homo sapiens
ctttccaccacagccag

SEQ ID NO: 6181087 - DNA, 15 bp, Homo sapiens
ctttccaccatacct

SEQ ID NO: 6181088 - DNA, 17 bp, Homo sapiens
ctttccacccagaccct

SEQ ID NO: 6181089 - DNA, 22 bp, Homo sapiens
ctttccacccagaccctccttc

SEQ ID NO: 6181090 - DNA, 14 bp, Homo sapiens
ctttccaccccctc

SEQ ID NO: 6181091 - DNA, 17 bp, Homo sapiens
ctttccaccccctccct

SEQ ID NO: 6181092 - DNA, 20 bp, Homo sapiens
ctttccaccccctccctggc

SEQ ID NO: 6181093 - DNA, 13 bp, Homo sapiens
ctttccacctgct

SEQ ID NO: 6181094 - DNA, 16 bp, Homo sapiens
ctttccacctgctttc

SEQ ID NO: 6181095 - DNA, 19 bp, Homo sapiens
ctttccactcccactgcca

SEQ ID NO: 6181096 - DNA, 14 bp, Homo sapiens
ctttccactctgga

SEQ ID NO: 6181097 - DNA, 15 bp, Homo sapiens
ctttccactctggat

SEQ ID NO: 6181098 - DNA, 14 bp, Homo sapiens
ctttccacttcttc

SEQ ID NO: 6181099 - DNA, 20 bp, Homo sapiens
ctttccacttcttcctttct

SEQ ID NO: 6181100 - DNA, 13 bp, Homo sapiens
ctttccactttca

SEQ ID NO: 6181101 - DNA, 13 bp, Homo sapiens
ctttccagaacta

SEQ ID NO: 6181102 - DNA, 19 bp, Homo sapiens
ctttccagaatgaccttga

SEQ ID NO: 6181103 - DNA, 15 bp, Homo sapiens
ctttccagaatgcaa

SEQ ID NO: 6181104 - DNA, 13 bp, Homo sapiens
ctttccagacaga

SEQ ID NO: 6181105 - DNA, 19 bp, Homo sapiens
ctttccagagaactgcaga

SEQ ID NO: 6181106 - DNA, 23 bp, Homo sapiens
ctttccagagcaaccagaaggag

SEQ ID NO: 6181107 - DNA, 17 bp, Homo sapiens
ctttccagcagtcagtc

SEQ ID NO: 6181108 - DNA, 12 bp, Homo sapiens
ctttccagccaa

SEQ ID NO: 6181109 - DNA, 14 bp, Homo sapiens
ctttccagccgtgt

SEQ ID NO: 6181110 - DNA, 15 bp, Homo sapiens
ctttccagcctcctg

SEQ ID NO: 6181111 - DNA, 21 bp, Homo sapiens
ctttccagctcaccccccaca

SEQ ID NO: 6181112 - DNA, 19 bp, Homo sapiens
ctttccaggagacatatat

SEQ ID NO: 6181113 - DNA, 21 bp, Homo sapiens
ctttccaggagacatatatag

SEQ ID NO: 6181114 - DNA, 11 bp, Homo sapiens
ctttccaggca

SEQ ID NO: 6181115 - DNA, 22 bp, Homo sapiens
ctttccaggctatgtataaaat

SEQ ID NO: 6181116 - DNA, 13 bp, Homo sapiens
ctttccagggcat

SEQ ID NO: 6181117 - DNA, 18 bp, Homo sapiens
ctttccatatttaaccta

SEQ ID NO: 6181118 - DNA, 18 bp, Homo sapiens
ctttccatcagctttata

SEQ ID NO: 6181119 - DNA, 20 bp, Homo sapiens
ctttccatcagctttataat

SEQ ID NO: 6181120 - DNA, 15 bp, Homo sapiens
ctttccatccatggc

SEQ ID NO: 6181121 - DNA, 18 bp, Homo sapiens
ctttccatccatggccag

SEQ ID NO: 6181122 - DNA, 14 bp, Homo sapiens
ctttccatctctgc

SEQ ID NO: 6181123 - DNA, 15 bp, Homo sapiens
ctttccatctctgcc

SEQ ID NO: 6181124 - DNA, 16 bp, Homo sapiens
ctttccatctctgcct

SEQ ID NO: 6181125 - DNA, 16 bp, Homo sapiens
ctttccatctgtccac

SEQ ID NO: 6181126 - DNA, 23 bp, Homo sapiens
ctttccatctgtccacatcccca

SEQ ID NO: 6181127 - DNA, 12 bp, Homo sapiens
ctttccatgaca

SEQ ID NO: 6181128 - DNA, 16 bp, Homo sapiens
ctttccatgggaaact

SEQ ID NO: 6181129 - DNA, 14 bp, Homo sapiens
ctttccatgggccc

SEQ ID NO: 6181130 - DNA, 15 bp, Homo sapiens
ctttccatgggcccg

SEQ ID NO: 6181131 - DNA, 23 bp, Homo sapiens
ctttccatgggcccgctgcctct

SEQ ID NO: 6181132 - DNA, 12 bp, Homo sapiens
ctttccattaca

SEQ ID NO: 6181133 - DNA, 18 bp, Homo sapiens
ctttccattcttcttgct

SEQ ID NO: 6181134 - DNA, 19 bp, Homo sapiens
ctttccatttacagtctct

SEQ ID NO: 6181135 - DNA, 14 bp, Homo sapiens
ctttccatttctct

SEQ ID NO: 6181136 - DNA, 22 bp, Homo sapiens
ctttccatttggtttagaacat

SEQ ID NO: 6181137 - DNA, 23 bp, Homo sapiens
ctttccattttctataagaaaaa

SEQ ID NO: 6181138 - DNA, 19 bp, Homo sapiens
ctttcccaaaattagggag

SEQ ID NO: 6181139 - DNA, 14 bp, Homo sapiens
ctttcccaaaccct

SEQ ID NO: 6181140 - DNA, 19 bp, Homo sapiens
ctttcccacactgaaattc

SEQ ID NO: 6181141 - DNA, 12 bp, Homo sapiens
ctttcccacagt

SEQ ID NO: 6181142 - DNA, 13 bp, Homo sapiens
ctttcccacagtc

SEQ ID NO: 6181143 - DNA, 23 bp, Homo sapiens
ctttcccaccagcatgtcactcc

SEQ ID NO: 6181144 - DNA, 24 bp, Homo sapiens
ctttcccaccagcatgtcactccc

SEQ ID NO: 6181145 - DNA, 13 bp, Homo sapiens
ctttcccaccatt

SEQ ID NO: 6181146 - DNA, 19 bp, Homo sapiens
ctttcccacccagcctggg

SEQ ID NO: 6181147 - DNA, 15 bp, Homo sapiens
ctttcccacccagga

SEQ ID NO: 6181148 - DNA, 21 bp, Homo sapiens
ctttcccaccccaacctgctc

SEQ ID NO: 6181149 - DNA, 22 bp, Homo sapiens
ctttcccaccctcctgccccac

SEQ ID NO: 6181150 - DNA, 16 bp, Homo sapiens
ctttcccaccctgttc

SEQ ID NO: 6181151 - DNA, 17 bp, Homo sapiens
ctttcccacctctctcc

SEQ ID NO: 6181152 - DNA, 15 bp, Homo sapiens
ctttcccagagaccc

SEQ ID NO: 6181153 - DNA, 12 bp, Homo sapiens
ctttcccaggac

SEQ ID NO: 6181154 - DNA, 19 bp, Homo sapiens
ctttcccaggtaatttaaa

SEQ ID NO: 6181155 - DNA, 22 bp, Homo sapiens
ctttcccaggtaatttaaattg

SEQ ID NO: 6181156 - DNA, 16 bp, Homo sapiens
ctttcccatcacccct

SEQ ID NO: 6181157 - DNA, 22 bp, Homo sapiens
ctttcccatcaccccttcccca

SEQ ID NO: 6181158 - DNA, 18 bp, Homo sapiens
ctttcccatgctgaatta

SEQ ID NO: 6181159 - DNA, 15 bp, Homo sapiens
ctttcccatgtattt

SEQ ID NO: 6181160 - DNA, 18 bp, Homo sapiens
ctttcccatgtatttgtt

SEQ ID NO: 6181161 - DNA, 14 bp, Homo sapiens
ctttccccaaggac

SEQ ID NO: 6181162 - DNA, 17 bp, Homo sapiens
ctttccccaaggaccca

SEQ ID NO: 6181163 - DNA, 14 bp, Homo sapiens
ctttccccacacct

SEQ ID NO: 6181164 - DNA, 20 bp, Homo sapiens
ctttccccacctcttacagt

SEQ ID NO: 6181165 - DNA, 19 bp, Homo sapiens
ctttccccacctcttcctt

SEQ ID NO: 6181166 - DNA, 22 bp, Homo sapiens
ctttccccacgcccacccccag

SEQ ID NO: 6181167 - DNA, 13 bp, Homo sapiens
ctgggcagggccg

SEQ ID NO: 6181168 - DNA, 22 bp, Homo sapiens
ctgggcagggccgcagggcgct

SEQ ID NO: 6181169 - DNA, 14 bp, Homo sapiens
ctgggcagggcctg

SEQ ID NO: 6181170 - DNA, 13 bp, Homo sapiens
ctgggcagggtga

SEQ ID NO: 6181171 - DNA, 23 bp, Homo sapiens
ctgggcaggtcctggggaggctg

SEQ ID NO: 6181172 - DNA, 18 bp, Homo sapiens
ctgggcaggtgggagctg

SEQ ID NO: 6181173 - DNA, 17 bp, Homo sapiens
ctgggcaggttcctggg

SEQ ID NO: 6181174 - DNA, 18 bp, Homo sapiens
ctgggcaggttcctgggg

SEQ ID NO: 6181175 - DNA, 14 bp, Homo sapiens
ctgggcagtgagtg

SEQ ID NO: 6181176 - DNA, 21 bp, Homo sapiens
ctgggcagtgagtgccatgct

SEQ ID NO: 6181177 - DNA, 12 bp, Homo sapiens
ctgggcagtgcc

SEQ ID NO: 6181178 - DNA, 13 bp, Homo sapiens
ctgggcagtgcca

SEQ ID NO: 6181179 - DNA, 14 bp, Homo sapiens
ctgggcagtgccac

SEQ ID NO: 6181180 - DNA, 22 bp, Homo sapiens
ctgggcagtgccacagcctgct

SEQ ID NO: 6181181 - DNA, 19 bp, Homo sapiens
ctgggcagtgccagccaat

SEQ ID NO: 6181182 - DNA, 19 bp, Homo sapiens
ctgggcagtgcccaccatg

SEQ ID NO: 6181183 - DNA, 22 bp, Homo sapiens
ctgggcagtgcccaccatgcac

SEQ ID NO: 6181184 - DNA, 12 bp, Homo sapiens
ctgggcagtgtg

SEQ ID NO: 6181185 - DNA, 13 bp, Homo sapiens
ctgggcagtgtgg

SEQ ID NO: 6181186 - DNA, 22 bp, Homo sapiens
ctgggcagtgtggcctcttggc

SEQ ID NO: 6181187 - DNA, 20 bp, Homo sapiens
ctgggcatactttctctcta

SEQ ID NO: 6181188 - DNA, 16 bp, Homo sapiens
ctgggcatagatgcag

SEQ ID NO: 6181189 - DNA, 20 bp, Homo sapiens
ctgggcatcagggcctttct

SEQ ID NO: 6181190 - DNA, 15 bp, Homo sapiens
ctgggcatcccagct

SEQ ID NO: 6181191 - DNA, 17 bp, Homo sapiens
ctgggcatccccagccc

SEQ ID NO: 6181192 - DNA, 17 bp, Homo sapiens
ctgggcatctggccctg

SEQ ID NO: 6181193 - DNA, 22 bp, Homo sapiens
ctgggcatctggccctgctgcc

SEQ ID NO: 6181194 - DNA, 14 bp, Homo sapiens
ctgggcatctgttc

SEQ ID NO: 6181195 - DNA, 18 bp, Homo sapiens
ctgggcatctgttctggt

SEQ ID NO: 6181196 - DNA, 21 bp, Homo sapiens
ctgggcatgatgggccgagcc

SEQ ID NO: 6181197 - DNA, 16 bp, Homo sapiens
ctgggcatgggtccag

SEQ ID NO: 6181198 - DNA, 17 bp, Homo sapiens
ctgggcatgggtccagg

SEQ ID NO: 6181199 - DNA, 21 bp, Homo sapiens
ctgggcatgggtccagggcct

SEQ ID NO: 6181200 - DNA, 22 bp, Homo sapiens
ctgggcatgggtccagggcctg

SEQ ID NO: 6181201 - DNA, 14 bp, Homo sapiens
ctgggcattgcttt

SEQ ID NO: 6181202 - DNA, 15 bp, Homo sapiens
ctgggcatttcaatc

SEQ ID NO: 6181203 - DNA, 18 bp, Homo sapiens
ctgggcatttggtgagag

SEQ ID NO: 6181204 - DNA, 17 bp, Homo sapiens
ctgggcattttcctcct

SEQ ID NO: 6181205 - DNA, 23 bp, Homo sapiens
ctgggcattttcctcctctgcct

SEQ ID NO: 6181206 - DNA, 18 bp, Homo sapiens
ctgggccaaaagggcagc

SEQ ID NO: 6181207 - DNA, 21 bp, Homo sapiens
ctgggccaaaagggcagccag

SEQ ID NO: 6181208 - DNA, 18 bp, Homo sapiens
ctgggccaagttcctcta

SEQ ID NO: 6181209 - DNA, 22 bp, Homo sapiens
ctgggccaattcaatacaaaca

SEQ ID NO: 6181210 - DNA, 15 bp, Homo sapiens
ctgggccacacctga

SEQ ID NO: 6181211 - DNA, 22 bp, Homo sapiens
ctgggccacacctgagcgctgt

SEQ ID NO: 6181212 - DNA, 16 bp, Homo sapiens
ctgggccaccagggat

SEQ ID NO: 6181213 - DNA, 21 bp, Homo sapiens
ctgggccaccagggatcacag

SEQ ID NO: 6181214 - DNA, 16 bp, Homo sapiens
ctgggccacccttcac

SEQ ID NO: 6181215 - DNA, 23 bp, Homo sapiens
ctgggccacccttcacgctggct

SEQ ID NO: 6181216 - DNA, 14 bp, Homo sapiens
ctgggccacggagg

SEQ ID NO: 6181217 - DNA, 14 bp, Homo sapiens
ctgggccactggca

SEQ ID NO: 6181218 - DNA, 17 bp, Homo sapiens
ctgggccactggcatct

SEQ ID NO: 6181219 - DNA, 23 bp, Homo sapiens
ctgggccactggcatctctggag

SEQ ID NO: 6181220 - DNA, 16 bp, Homo sapiens
ctgggccactggggac

SEQ ID NO: 6181221 - DNA, 18 bp, Homo sapiens
ctgggccacttctgggtg

SEQ ID NO: 6181222 - DNA, 18 bp, Homo sapiens
ctgggccagaagtcctcc

SEQ ID NO: 6181223 - DNA, 12 bp, Homo sapiens
ctgggccagaat

SEQ ID NO: 6181224 - DNA, 23 bp, Homo sapiens
ctgggccagccgcccacccccac

SEQ ID NO: 6181225 - DNA, 12 bp, Homo sapiens
ctgggccagcct

SEQ ID NO: 6181226 - DNA, 14 bp, Homo sapiens
ctgggccaggcagg

SEQ ID NO: 6181227 - DNA, 12 bp, Homo sapiens
ctgggccaggga

SEQ ID NO: 6181228 - DNA, 16 bp, Homo sapiens
ctgggccagggtctcg

SEQ ID NO: 6181229 - DNA, 19 bp, Homo sapiens
ctgggccagggtctgtgtg

SEQ ID NO: 6181230 - DNA, 20 bp, Homo sapiens
ctgggccagggtctgtgtga

SEQ ID NO: 6181231 - DNA, 22 bp, Homo sapiens
ctgggccagggtctgtgtgaat

SEQ ID NO: 6181232 - DNA, 13 bp, Homo sapiens
ctgggccaggtct

SEQ ID NO: 6181233 - DNA, 14 bp, Homo sapiens
ctgggccaggtctc

SEQ ID NO: 6181234 - DNA, 16 bp, Homo sapiens
ctgggccaggtctccg

SEQ ID NO: 6181235 - DNA, 11 bp, Homo sapiens
ctgggccagtc

SEQ ID NO: 6181236 - DNA, 12 bp, Homo sapiens
ctgggccagtca

SEQ ID NO: 6181237 - DNA, 22 bp, Homo sapiens
ctgggccagtgagccagaaatt

SEQ ID NO: 6181238 - DNA, 13 bp, Homo sapiens
ctgggccagtggc

SEQ ID NO: 6181239 - DNA, 17 bp, Homo sapiens
ctgggccagtggcactc

SEQ ID NO: 6181240 - DNA, 21 bp, Homo sapiens
ctgggccatatgtgctatgga

SEQ ID NO: 6181241 - DNA, 19 bp, Homo sapiens
ctgggccatgcgaggggcc

SEQ ID NO: 6181242 - DNA, 17 bp, Homo sapiens
ctgggccatgggtcctc

SEQ ID NO: 6181243 - DNA, 18 bp, Homo sapiens
ctgggccatgggtcctcg

SEQ ID NO: 6181244 - DNA, 18 bp, Homo sapiens
ctgggccatgtccaaaga

SEQ ID NO: 6181245 - DNA, 15 bp, Homo sapiens
ctgggcccaaaggcc

SEQ ID NO: 6181246 - DNA, 17 bp, Homo sapiens
ctgggcccaaaggccca

SEQ ID NO: 6181247 - DNA, 18 bp, Homo sapiens
ctgggcccaaaggcccag

SEQ ID NO: 6181248 - DNA, 19 bp, Homo sapiens
ctgggcccaaaggcccagg

SEQ ID NO: 6181249 - DNA, 22 bp, Homo sapiens
ctgggcccaaaggcccagggag

SEQ ID NO: 6181250 - DNA, 14 bp, Homo sapiens
ctgggcccaaccct

SEQ ID NO: 6181251 - DNA, 18 bp, Homo sapiens
ctgggcccaaccctgtct

SEQ ID NO: 6181252 - DNA, 14 bp, Homo sapiens
ctgggcccacagag

SEQ ID NO: 6181253 - DNA, 18 bp, Homo sapiens
ctgggcccacagagcctg

SEQ ID NO: 6181254 - DNA, 17 bp, Homo sapiens
ctgggcccacagccccc

SEQ ID NO: 6181255 - DNA, 20 bp, Homo sapiens
ctgggcccacagcccccacc

SEQ ID NO: 6181256 - DNA, 21 bp, Homo sapiens
ctgggcccacccaagcaggag

SEQ ID NO: 6181257 - DNA, 17 bp, Homo sapiens
ctgggcccacccaggga

SEQ ID NO: 6181258 - DNA, 14 bp, Homo sapiens
ctgggcccagaagg

SEQ ID NO: 6181259 - DNA, 18 bp, Homo sapiens
ctgggcccagaggagagg

SEQ ID NO: 6181260 - DNA, 18 bp, Homo sapiens
ctgggcccagaggcacag

SEQ ID NO: 6181261 - DNA, 16 bp, Homo sapiens
ctgggcccagcagggg

SEQ ID NO: 6181262 - DNA, 18 bp, Homo sapiens
ctgggcccagcaggggcc

SEQ ID NO: 6181263 - DNA, 15 bp, Homo sapiens
ctgggcccagcccct

SEQ ID NO: 6181264 - DNA, 20 bp, Homo sapiens
ctgggcccagcccctccacg

SEQ ID NO: 6181265 - DNA, 18 bp, Homo sapiens
ctgggcccagccggggtg

SEQ ID NO: 6181266 - DNA, 16 bp, Homo sapiens
ctgggcccaggcagca

SEQ ID NO: 6181267 - DNA, 19 bp, Homo sapiens
ctgggcccaggcaggtctg

SEQ ID NO: 6181268 - DNA, 14 bp, Homo sapiens
ctgggcccaggccc

SEQ ID NO: 6181269 - DNA, 16 bp, Homo sapiens
ctgggcccaggcccag

SEQ ID NO: 6181270 - DNA, 17 bp, Homo sapiens
ctgggcccaggcccagc

SEQ ID NO: 6181271 - DNA, 14 bp, Homo sapiens
ctgggcccaggctc

SEQ ID NO: 6181272 - DNA, 15 bp, Homo sapiens
ctgggcccaggctct

SEQ ID NO: 6181273 - DNA, 18 bp, Homo sapiens
ctgggcccaggctctggg

SEQ ID NO: 6181274 - DNA, 20 bp, Homo sapiens
ctgggcccaggctctgggaa

SEQ ID NO: 6181275 - DNA, 13 bp, Homo sapiens
ctgggcccagggg

SEQ ID NO: 6181276 - DNA, 15 bp, Homo sapiens
ctgggcccaggggct

SEQ ID NO: 6181277 - DNA, 14 bp, Homo sapiens
ctgggcccatctct

SEQ ID NO: 6181278 - DNA, 24 bp, Homo sapiens
ctgggccccaaacgggctgccctg

SEQ ID NO: 6181279 - DNA, 19 bp, Homo sapiens
ctgggccccacatggctta

SEQ ID NO: 6181280 - DNA, 22 bp, Homo sapiens
ctgggccccactggacaacact

SEQ ID NO: 6181281 - DNA, 23 bp, Homo sapiens
ctgggccccactggacaacactg

SEQ ID NO: 6181282 - DNA, 23 bp, Homo sapiens
ctgggccccagaaagcctcagag

SEQ ID NO: 6181283 - DNA, 14 bp, Homo sapiens
ctgggccccagccc

SEQ ID NO: 6181284 - DNA, 15 bp, Homo sapiens
ctgggccccatgctc

SEQ ID NO: 6181285 - DNA, 16 bp, Homo sapiens
ctgggccccatgctct

SEQ ID NO: 6181286 - DNA, 17 bp, Homo sapiens
ctgggccccatgctctg

SEQ ID NO: 6181287 - DNA, 20 bp, Homo sapiens
ctgggccccatgctctgccc

SEQ ID NO: 6181288 - DNA, 21 bp, Homo sapiens
ctgggccccatgctctgcccc

SEQ ID NO: 6181289 - DNA, 18 bp, Homo sapiens
ctgggccccattctccct

SEQ ID NO: 6181290 - DNA, 17 bp, Homo sapiens
ctgggcccccagcctgg

SEQ ID NO: 6181291 - DNA, 19 bp, Homo sapiens
ctgggcccccagcctggcc

SEQ ID NO: 6181292 - DNA, 18 bp, Homo sapiens
ctgggccccccagctcag

SEQ ID NO: 6181293 - DNA, 20 bp, Homo sapiens
ctgggccccccagctcaggg

SEQ ID NO: 6181294 - DNA, 10 bp, Homo sapiens
ctgggcccct

SEQ ID NO: 6181295 - DNA, 23 bp, Homo sapiens
ctgggcccctcaggggaagctgc

SEQ ID NO: 6181296 - DNA, 12 bp, Homo sapiens
ctgggcccctcc

SEQ ID NO: 6181297 - DNA, 15 bp, Homo sapiens
ctgggcccctccacg

SEQ ID NO: 6181298 - DNA, 15 bp, Homo sapiens
ctgggcccctccagg

SEQ ID NO: 6181299 - DNA, 23 bp, Homo sapiens
ctgggcccctcccctcagagccc

SEQ ID NO: 6181300 - DNA, 21 bp, Homo sapiens
ctgggcccctcttattcctct

SEQ ID NO: 6181301 - DNA, 14 bp, Homo sapiens
ctgggcccctgcac

SEQ ID NO: 6181302 - DNA, 20 bp, Homo sapiens
ctgggcccctgcacaggcac

SEQ ID NO: 6181303 - DNA, 17 bp, Homo sapiens
ctgggcccctgcctctc

SEQ ID NO: 6181304 - DNA, 12 bp, Homo sapiens
ctgggcccctgg

SEQ ID NO: 6181305 - DNA, 14 bp, Homo sapiens
ctgggcccctgggg

SEQ ID NO: 6181306 - DNA, 16 bp, Homo sapiens
ctgggcccctggggac

SEQ ID NO: 6181307 - DNA, 12 bp, Homo sapiens
ctgggcccctgt

SEQ ID NO: 6181308 - DNA, 18 bp, Homo sapiens
ctgggcccctgtccccag

SEQ ID NO: 6181309 - DNA, 22 bp, Homo sapiens
ctgggcccctgtccccagtccc

SEQ ID NO: 6181310 - DNA, 20 bp, Homo sapiens
ctgggcccgacatggctccg

SEQ ID NO: 6181311 - DNA, 18 bp, Homo sapiens
ctgggcccgagcctgaac

SEQ ID NO: 6181312 - DNA, 16 bp, Homo sapiens
ctgggcccgagggtgg

SEQ ID NO: 6181313 - DNA, 17 bp, Homo sapiens
ctgggcccgatttggta

SEQ ID NO: 6181314 - DNA, 20 bp, Homo sapiens
ctgggcccgctttgcctgct

SEQ ID NO: 6181315 - DNA, 22 bp, Homo sapiens
ctgggcccggaagggctttggt

SEQ ID NO: 6181316 - DNA, 19 bp, Homo sapiens
ctgggcccgggcaggccag

SEQ ID NO: 6181317 - DNA, 20 bp, Homo sapiens
ctgggcccgggcaggccagc

SEQ ID NO: 6181318 - DNA, 15 bp, Homo sapiens
ctgggccctaggcat

SEQ ID NO: 6181319 - DNA, 23 bp, Homo sapiens
ctgggccctaggcatactctcca

SEQ ID NO: 6181320 - DNA, 15 bp, Homo sapiens
ctgggccctctctgc

SEQ ID NO: 6181321 - DNA, 18 bp, Homo sapiens
ctgggccctctctgctct

SEQ ID NO: 6181322 - DNA, 16 bp, Homo sapiens
ctgggccctctttccc

SEQ ID NO: 6181323 - DNA, 19 bp, Homo sapiens
ctgggccctctttccctgc

SEQ ID NO: 6181324 - DNA, 23 bp, Homo sapiens
ctgggccctctttccctgcgaga

SEQ ID NO: 6181325 - DNA, 11 bp, Homo sapiens
ctgggccctga

SEQ ID NO: 6181326 - DNA, 22 bp, Homo sapiens
ctgggccctgagtctgggcagc

SEQ ID NO: 6181327 - DNA, 19 bp, Homo sapiens
ctgggccctgcaggaggcc

SEQ ID NO: 6181328 - DNA, 21 bp, Homo sapiens
ctgggccctgcaggaggcctg

SEQ ID NO: 6181329 - DNA, 12 bp, Homo sapiens
ctgggccctgcc

SEQ ID NO: 6181330 - DNA, 15 bp, Homo sapiens
ctgggccctgcctgc

SEQ ID NO: 6181331 - DNA, 16 bp, Homo sapiens
ctgggccctgcctgca

SEQ ID NO: 6181332 - DNA, 17 bp, Homo sapiens
ctgggccctgcctgcag

SEQ ID NO: 6181333 - DNA, 19 bp, Homo sapiens
ctgggccctgcctgcagcc

SEQ ID NO: 6181334 - DNA, 13 bp, Homo sapiens
ctgggccctggag

SEQ ID NO: 6181335 - DNA, 12 bp, Homo sapiens
ctgggccctggg

SEQ ID NO: 6181336 - DNA, 18 bp, Homo sapiens
ctgggccctgggctggaa

SEQ ID NO: 6181337 - DNA, 14 bp, Homo sapiens
ctgggccctggggc

SEQ ID NO: 6181338 - DNA, 17 bp, Homo sapiens
ctgggccctggggcctg

SEQ ID NO: 6181339 - DNA, 20 bp, Homo sapiens
ctgggccctggggctgccct

SEQ ID NO: 6181340 - DNA, 21 bp, Homo sapiens
ctgggccctggggctgccctc

SEQ ID NO: 6181341 - DNA, 12 bp, Homo sapiens
ctgggccctggt

SEQ ID NO: 6181342 - DNA, 14 bp, Homo sapiens
ctgggccctggttc

SEQ ID NO: 6181343 - DNA, 20 bp, Homo sapiens
ctgggccctggttcccccag

SEQ ID NO: 6181344 - DNA, 13 bp, Homo sapiens
ctgggccctgtcc

SEQ ID NO: 6181345 - DNA, 16 bp, Homo sapiens
ctgggccctgtccagg

SEQ ID NO: 6181346 - DNA, 16 bp, Homo sapiens
ctttccccagacacat

SEQ ID NO: 6181347 - DNA, 17 bp, Homo sapiens
ctttccccagacacatt

SEQ ID NO: 6181348 - DNA, 20 bp, Homo sapiens
ctttccccagaggctcccaa

SEQ ID NO: 6181349 - DNA, 16 bp, Homo sapiens
ctttccccagatcaaa

SEQ ID NO: 6181350 - DNA, 13 bp, Homo sapiens
ctttccccagccc

SEQ ID NO: 6181351 - DNA, 14 bp, Homo sapiens
ctttccccagccca

SEQ ID NO: 6181352 - DNA, 15 bp, Homo sapiens
ctttccccagcctct

SEQ ID NO: 6181353 - DNA, 16 bp, Homo sapiens
ctttccccaggggcat

SEQ ID NO: 6181354 - DNA, 23 bp, Homo sapiens
ctttccccagtgtggccccagcc

SEQ ID NO: 6181355 - DNA, 17 bp, Homo sapiens
ctttccccatactctgt

SEQ ID NO: 6181356 - DNA, 18 bp, Homo sapiens
ctttccccatactctgtc

SEQ ID NO: 6181357 - DNA, 18 bp, Homo sapiens
ctttcccccaactcagga

SEQ ID NO: 6181358 - DNA, 11 bp, Homo sapiens
ctttcccccac

SEQ ID NO: 6181359 - DNA, 15 bp, Homo sapiens
ctttcccccaggaaa

SEQ ID NO: 6181360 - DNA, 16 bp, Homo sapiens
ctttccccccaacccg

SEQ ID NO: 6181361 - DNA, 22 bp, Homo sapiens
ctttccccgggggaggaagggg

SEQ ID NO: 6181362 - DNA, 16 bp, Homo sapiens
ctttcccctcagagct

SEQ ID NO: 6181363 - DNA, 12 bp, Homo sapiens
ctttcccctcct

SEQ ID NO: 6181364 - DNA, 13 bp, Homo sapiens
ctttcccctctca

SEQ ID NO: 6181365 - DNA, 22 bp, Homo sapiens
ctttcccctctcatacataaaa

SEQ ID NO: 6181366 - DNA, 16 bp, Homo sapiens
ctttcccctctctgcc

SEQ ID NO: 6181367 - DNA, 21 bp, Homo sapiens
ctttcccctctctgcccctga

SEQ ID NO: 6181368 - DNA, 14 bp, Homo sapiens
ctttcccctgtggg

SEQ ID NO: 6181369 - DNA, 14 bp, Homo sapiens
ctttcccctttctc

SEQ ID NO: 6181370 - DNA, 16 bp, Homo sapiens
ctttcccctttctctt

SEQ ID NO: 6181371 - DNA, 17 bp, Homo sapiens
ctttcccctttctcttt

SEQ ID NO: 6181372 - DNA, 23 bp, Homo sapiens
ctttcccgatgcgtggctcccag

SEQ ID NO: 6181373 - DNA, 19 bp, Homo sapiens
ctttcccgggccctcagcc

SEQ ID NO: 6181374 - DNA, 17 bp, Homo sapiens
ctttccctaagccagct

SEQ ID NO: 6181375 - DNA, 23 bp, Homo sapiens
ctttccctagaaagccatattcc

SEQ ID NO: 6181376 - DNA, 20 bp, Homo sapiens
ctttccctagaggcaaacat

SEQ ID NO: 6181377 - DNA, 18 bp, Homo sapiens
ctttccctcaccccctcc

SEQ ID NO: 6181378 - DNA, 14 bp, Homo sapiens
ctttccctccttgg

SEQ ID NO: 6181379 - DNA, 13 bp, Homo sapiens
ctttccctctccc

SEQ ID NO: 6181380 - DNA, 14 bp, Homo sapiens
ctttccctctggga

SEQ ID NO: 6181381 - DNA, 15 bp, Homo sapiens
ctttccctctgggat

SEQ ID NO: 6181382 - DNA, 20 bp, Homo sapiens
ctttccctgcatatgcttct

SEQ ID NO: 6181383 - DNA, 13 bp, Homo sapiens
ctttccctggagc

SEQ ID NO: 6181384 - DNA, 20 bp, Homo sapiens
ctttccctggagtcagtttt

SEQ ID NO: 6181385 - DNA, 17 bp, Homo sapiens
ctttccctggctcaggg

SEQ ID NO: 6181386 - DNA, 13 bp, Homo sapiens
ctttccctgtgcc

SEQ ID NO: 6181387 - DNA, 18 bp, Homo sapiens
ctttcccttagtgactct

SEQ ID NO: 6181388 - DNA, 15 bp, Homo sapiens
ctttcccttatcaaa

SEQ ID NO: 6181389 - DNA, 15 bp, Homo sapiens
ctttcccttccagtt

SEQ ID NO: 6181390 - DNA, 13 bp, Homo sapiens
ctttcccttcccc

SEQ ID NO: 6181391 - DNA, 21 bp, Homo sapiens
ctttcccttcccctgtggtct

SEQ ID NO: 6181392 - DNA, 15 bp, Homo sapiens
ctttcccttcctcca

SEQ ID NO: 6181393 - DNA, 14 bp, Homo sapiens
ctttcccttcctct

SEQ ID NO: 6181394 - DNA, 14 bp, Homo sapiens
ctttcccttgccct

SEQ ID NO: 6181395 - DNA, 21 bp, Homo sapiens
ctttcccttgcttttccctct

SEQ ID NO: 6181396 - DNA, 22 bp, Homo sapiens
ctttcccttgcttttccctctt

SEQ ID NO: 6181397 - DNA, 23 bp, Homo sapiens
ctttcccttgcttttccctcttt

SEQ ID NO: 6181398 - DNA, 21 bp, Homo sapiens
ctttcccttgtagctcctccc

SEQ ID NO: 6181399 - DNA, 23 bp, Homo sapiens
ctttcccttgtagctcctcccct

SEQ ID NO: 6181400 - DNA, 23 bp, Homo sapiens
ctttccctttaccactgtggttt

SEQ ID NO: 6181401 - DNA, 15 bp, Homo sapiens
ctttcccttttccat

SEQ ID NO: 6181402 - DNA, 20 bp, Homo sapiens
ctttcccttttccatttgaa

SEQ ID NO: 6181403 - DNA, 17 bp, Homo sapiens
ctttcccttttctgttt

SEQ ID NO: 6181404 - DNA, 20 bp, Homo sapiens
ctttcccttttctgtttagg

SEQ ID NO: 6181405 - DNA, 21 bp, Homo sapiens
ctttcccttttctgtttagga

SEQ ID NO: 6181406 - DNA, 16 bp, Homo sapiens
ctttccggcacactgc

SEQ ID NO: 6181407 - DNA, 19 bp, Homo sapiens
ctttccggcacactgccaa

SEQ ID NO: 6181408 - DNA, 20 bp, Homo sapiens
ctttccggcacactgccaaa

SEQ ID NO: 6181409 - DNA, 21 bp, Homo sapiens
ctttccggtgtttaagacatt

SEQ ID NO: 6181410 - DNA, 14 bp, Homo sapiens
ctttcctaaagcca

SEQ ID NO: 6181411 - DNA, 16 bp, Homo sapiens
ctttcctaaagccaaa

SEQ ID NO: 6181412 - DNA, 22 bp, Homo sapiens
ctttcctaaagccatcatgcct

SEQ ID NO: 6181413 - DNA, 21 bp, Homo sapiens
ctttcctaaatataaatgaaa

SEQ ID NO: 6181414 - DNA, 20 bp, Homo sapiens
ctttcctaaggctgcaaggt

SEQ ID NO: 6181415 - DNA, 15 bp, Homo sapiens
ctttcctacaaaatg

SEQ ID NO: 6181416 - DNA, 16 bp, Homo sapiens
ctttcctactttctat

SEQ ID NO: 6181417 - DNA, 21 bp, Homo sapiens
ctttcctagatggcagtcact

SEQ ID NO: 6181418 - DNA, 15 bp, Homo sapiens
ctttcctaggcccag

SEQ ID NO: 6181419 - DNA, 18 bp, Homo sapiens
ctttcctaggcccaggcc

SEQ ID NO: 6181420 - DNA, 19 bp, Homo sapiens
ctttcctatctagcattta

SEQ ID NO: 6181421 - DNA, 19 bp, Homo sapiens
ctttcctcaaatgttgaca

SEQ ID NO: 6181422 - DNA, 20 bp, Homo sapiens
ctttcctcaagtatcttcta

SEQ ID NO: 6181423 - DNA, 21 bp, Homo sapiens
ctttcctcaggcaaggtctgg

SEQ ID NO: 6181424 - DNA, 22 bp, Homo sapiens
ctttcctccaaactcctgcctg

SEQ ID NO: 6181425 - DNA, 13 bp, Homo sapiens
ctttcctccccac

SEQ ID NO: 6181426 - DNA, 19 bp, Homo sapiens
ctttcctccccaccttccc

SEQ ID NO: 6181427 - DNA, 21 bp, Homo sapiens
ctttcctccccatacacacac

SEQ ID NO: 6181428 - DNA, 16 bp, Homo sapiens
ctttcctccccctgca

SEQ ID NO: 6181429 - DNA, 19 bp, Homo sapiens
ctttcctccccctgcaact

SEQ ID NO: 6181430 - DNA, 14 bp, Homo sapiens
ctttcctcccttct

SEQ ID NO: 6181431 - DNA, 16 bp, Homo sapiens
ctttcctcctcatgaa

SEQ ID NO: 6181432 - DNA, 13 bp, Homo sapiens
ctttcctcctctg

SEQ ID NO: 6181433 - DNA, 14 bp, Homo sapiens
ctttcctccttcca

SEQ ID NO: 6181434 - DNA, 17 bp, Homo sapiens
ctttcctcctttatcac

SEQ ID NO: 6181435 - DNA, 18 bp, Homo sapiens
ctttcctctccaattgta

SEQ ID NO: 6181436 - DNA, 16 bp, Homo sapiens
ctttcctctctatatt

SEQ ID NO: 6181437 - DNA, 17 bp, Homo sapiens
ctttcctctgagattct

SEQ ID NO: 6181438 - DNA, 21 bp, Homo sapiens
ctttcctcttactttcagttt

SEQ ID NO: 6181439 - DNA, 13 bp, Homo sapiens
ctttcctcttccc

SEQ ID NO: 6181440 - DNA, 14 bp, Homo sapiens
ctttcctctttctg

SEQ ID NO: 6181441 - DNA, 15 bp, Homo sapiens
ctttcctgaatccaa

SEQ ID NO: 6181442 - DNA, 13 bp, Homo sapiens
ctttcctgagctg

SEQ ID NO: 6181443 - DNA, 20 bp, Homo sapiens
ctttcctgaggctgggctcc

SEQ ID NO: 6181444 - DNA, 20 bp, Homo sapiens
ctttcctgagtcccatccct

SEQ ID NO: 6181445 - DNA, 19 bp, Homo sapiens
ctttcctgatgatgctggc

SEQ ID NO: 6181446 - DNA, 12 bp, Homo sapiens
ctttcctgatgt

SEQ ID NO: 6181447 - DNA, 15 bp, Homo sapiens
ctttcctgatgttga

SEQ ID NO: 6181448 - DNA, 23 bp, Homo sapiens
ctttcctgatgttggtatctaag

SEQ ID NO: 6181449 - DNA, 21 bp, Homo sapiens
ctttcctgcaactcaaggact

SEQ ID NO: 6181450 - DNA, 19 bp, Homo sapiens
ctttcctgcatctctgtga

SEQ ID NO: 6181451 - DNA, 12 bp, Homo sapiens
ctttcctgcccc

SEQ ID NO: 6181452 - DNA, 14 bp, Homo sapiens
ctttcctgccccag

SEQ ID NO: 6181453 - DNA, 18 bp, Homo sapiens
ctttcctgccccaggcct

SEQ ID NO: 6181454 - DNA, 19 bp, Homo sapiens
ctttcctgccccaggcctg

SEQ ID NO: 6181455 - DNA, 22 bp, Homo sapiens
ctttcctgccctgtccaaaagc

SEQ ID NO: 6181456 - DNA, 19 bp, Homo sapiens
ctttcctgcctccttgaaa

SEQ ID NO: 6181457 - DNA, 17 bp, Homo sapiens
ctttcctgctgtcttct

SEQ ID NO: 6181458 - DNA, 13 bp, Homo sapiens
ctttcctggaagc

SEQ ID NO: 6181459 - DNA, 13 bp, Homo sapiens
ctttcctggagcc

SEQ ID NO: 6181460 - DNA, 20 bp, Homo sapiens
ctttcctggataaaaaagaa

SEQ ID NO: 6181461 - DNA, 16 bp, Homo sapiens
ctttcctggatgtctg

SEQ ID NO: 6181462 - DNA, 23 bp, Homo sapiens
ctttcctggatgtctgaactttg

SEQ ID NO: 6181463 - DNA, 14 bp, Homo sapiens
ctttcctggcagtc

SEQ ID NO: 6181464 - DNA, 13 bp, Homo sapiens
ctttcctgggcct

SEQ ID NO: 6181465 - DNA, 17 bp, Homo sapiens
ctttcctgggcctttgc

SEQ ID NO: 6181466 - DNA, 17 bp, Homo sapiens
ctttcctggttctgtct

SEQ ID NO: 6181467 - DNA, 20 bp, Homo sapiens
ctttcctgtagccttctgta

SEQ ID NO: 6181468 - DNA, 23 bp, Homo sapiens
ctttcctgtatttgttcccaaga

SEQ ID NO: 6181469 - DNA, 13 bp, Homo sapiens
ctttcctgtgcca

SEQ ID NO: 6181470 - DNA, 14 bp, Homo sapiens
ctttcctgttcagc

SEQ ID NO: 6181471 - DNA, 13 bp, Homo sapiens
ctttcctgtttct

SEQ ID NO: 6181472 - DNA, 17 bp, Homo sapiens
ctttcctgtttctcagt

SEQ ID NO: 6181473 - DNA, 15 bp, Homo sapiens
ctttccttcccaata

SEQ ID NO: 6181474 - DNA, 16 bp, Homo sapiens
ctttccttcccaggcc

SEQ ID NO: 6181475 - DNA, 18 bp, Homo sapiens
ctttccttcccaggccct

SEQ ID NO: 6181476 - DNA, 19 bp, Homo sapiens
ctttccttcccaggccctt

SEQ ID NO: 6181477 - DNA, 12 bp, Homo sapiens
ctttccttccct

SEQ ID NO: 6181478 - DNA, 13 bp, Homo sapiens
ctttccttccctc

SEQ ID NO: 6181479 - DNA, 17 bp, Homo sapiens
ctttccttccctctctg

SEQ ID NO: 6181480 - DNA, 18 bp, Homo sapiens
ctttccttccctctctga

SEQ ID NO: 6181481 - DNA, 14 bp, Homo sapiens
ctttccttcctaat

SEQ ID NO: 6181482 - DNA, 13 bp, Homo sapiens
ctttccttctcca

SEQ ID NO: 6181483 - DNA, 16 bp, Homo sapiens
ctttccttctctgaaa

SEQ ID NO: 6181484 - DNA, 15 bp, Homo sapiens
ctttccttctgccct

SEQ ID NO: 6181485 - DNA, 16 bp, Homo sapiens
ctttccttctgccctt

SEQ ID NO: 6181486 - DNA, 16 bp, Homo sapiens
ctttccttctggctcc

SEQ ID NO: 6181487 - DNA, 13 bp, Homo sapiens
ctttccttcttgc

SEQ ID NO: 6181488 - DNA, 17 bp, Homo sapiens
ctttccttgagctgttg

SEQ ID NO: 6181489 - DNA, 20 bp, Homo sapiens
ctttccttgtctctcattct

SEQ ID NO: 6181490 - DNA, 19 bp, Homo sapiens
ctttccttgtggcagagga

SEQ ID NO: 6181491 - DNA, 20 bp, Homo sapiens
ctttcctttaactccctttt

SEQ ID NO: 6181492 - DNA, 15 bp, Homo sapiens
ctttcctttactcct

SEQ ID NO: 6181493 - DNA, 17 bp, Homo sapiens
ctttcctttactcctgg

SEQ ID NO: 6181494 - DNA, 12 bp, Homo sapiens
ctttcctttcat

SEQ ID NO: 6181495 - DNA, 17 bp, Homo sapiens
ctttcctttcatcctca

SEQ ID NO: 6181496 - DNA, 18 bp, Homo sapiens
ctttcctttcatcctcag

SEQ ID NO: 6181497 - DNA, 12 bp, Homo sapiens
ctttcctttctt

SEQ ID NO: 6181498 - DNA, 13 bp, Homo sapiens
ctttcctttgcac

SEQ ID NO: 6181499 - DNA, 14 bp, Homo sapiens
ctttcctttgctct

SEQ ID NO: 6181500 - DNA, 18 bp, Homo sapiens
ctttccttttcttccttc

SEQ ID NO: 6181501 - DNA, 17 bp, Homo sapiens
ctttcctttttctttcc

SEQ ID NO: 6181502 - DNA, 17 bp, Homo sapiens
ctttccttttttgagat

SEQ ID NO: 6181503 - DNA, 20 bp, Homo sapiens
ctttcctttttttccctttt

SEQ ID NO: 6181504 - DNA, 20 bp, Homo sapiens
ctttcgaaatttcattttcc

SEQ ID NO: 6181505 - DNA, 18 bp, Homo sapiens
ctttcgaataaagtgaat

SEQ ID NO: 6181506 - DNA, 20 bp, Homo sapiens
ctttcgacttgcatttttgc

SEQ ID NO: 6181507 - DNA, 15 bp, Homo sapiens
ctttcgcacagcagt

SEQ ID NO: 6181508 - DNA, 16 bp, Homo sapiens
ctttcgcctcctccag

SEQ ID NO: 6181509 - DNA, 14 bp, Homo sapiens
ctttcggaaatgat

SEQ ID NO: 6181510 - DNA, 22 bp, Homo sapiens
ctttcggaatttttaaaataaa

SEQ ID NO: 6181511 - DNA, 16 bp, Homo sapiens
ctttcggagcctgcct

SEQ ID NO: 6181512 - DNA, 17 bp, Homo sapiens
ctttcggatccagggag

SEQ ID NO: 6181513 - DNA, 13 bp, Homo sapiens
ctttcggggaggg

SEQ ID NO: 6181514 - DNA, 14 bp, Homo sapiens
ctttcggggagggc

SEQ ID NO: 6181515 - DNA, 18 bp, Homo sapiens
ctttcgtaatagctcaga

SEQ ID NO: 6181516 - DNA, 15 bp, Homo sapiens
ctttcgtacattggc

SEQ ID NO: 6181517 - DNA, 15 bp, Homo sapiens
ctttcgtcacccttg

SEQ ID NO: 6181518 - DNA, 18 bp, Homo sapiens
ctttcgtccacagcttcc

SEQ ID NO: 6181519 - DNA, 21 bp, Homo sapiens
ctttcgtccacagcttcctgt

SEQ ID NO: 6181520 - DNA, 17 bp, Homo sapiens
ctttcgtctactgcaag

SEQ ID NO: 6181521 - DNA, 22 bp, Homo sapiens
ctttcgtgtaaattatgtaatg

SEQ ID NO: 6181522 - DNA, 17 bp, Homo sapiens
ctttcgttaatcttgct

SEQ ID NO: 6181523 - DNA, 19 bp, Homo sapiens
ctttcgttggttgtttctc

SEQ ID NO: 6181524 - DNA, 23 bp, Homo sapiens
ctttcgttggttgtttctctgag

SEQ ID NO: 6181525 - DNA, 16 bp, Homo sapiens
ctttctaaatgccttt

SEQ ID NO: 6181526 - DNA, 16 bp, Homo sapiens
ctgggcccttcctggc

SEQ ID NO: 6181527 - DNA, 13 bp, Homo sapiens
ctgggcccttgtg

SEQ ID NO: 6181528 - DNA, 17 bp, Homo sapiens
ctgggcccttgtgctcc

SEQ ID NO: 6181529 - DNA, 18 bp, Homo sapiens
ctgggcccttgtgctcct

SEQ ID NO: 6181530 - DNA, 20 bp, Homo sapiens
ctgggccgcaagggcctgga

SEQ ID NO: 6181531 - DNA, 21 bp, Homo sapiens
ctgggccgcaagggcctggac

SEQ ID NO: 6181532 - DNA, 17 bp, Homo sapiens
ctgggccggcagcctgg

SEQ ID NO: 6181533 - DNA, 19 bp, Homo sapiens
ctgggccggcagcctggtt

SEQ ID NO: 6181534 - DNA, 14 bp, Homo sapiens
ctgggccggccagc

SEQ ID NO: 6181535 - DNA, 15 bp, Homo sapiens
ctgggccggccagcc

SEQ ID NO: 6181536 - DNA, 15 bp, Homo sapiens
ctgggccggctgagt

SEQ ID NO: 6181537 - DNA, 20 bp, Homo sapiens
ctgggccggctgagtggcag

SEQ ID NO: 6181538 - DNA, 20 bp, Homo sapiens
ctgggccgggacccagggcc

SEQ ID NO: 6181539 - DNA, 16 bp, Homo sapiens
ctgggccgggcccagg

SEQ ID NO: 6181540 - DNA, 17 bp, Homo sapiens
ctgggccgggcccaggg

SEQ ID NO: 6181541 - DNA, 19 bp, Homo sapiens
ctgggccgggcccagggcc

SEQ ID NO: 6181542 - DNA, 21 bp, Homo sapiens
ctgggccgggcccagggcctc

SEQ ID NO: 6181543 - DNA, 16 bp, Homo sapiens
ctgggccgggcctggg

SEQ ID NO: 6181544 - DNA, 20 bp, Homo sapiens
ctgggccgggcctggggctc

SEQ ID NO: 6181545 - DNA, 19 bp, Homo sapiens
ctgggccgggctgtagatc

SEQ ID NO: 6181546 - DNA, 22 bp, Homo sapiens
ctgggccgttacatctgtgcag

SEQ ID NO: 6181547 - DNA, 17 bp, Homo sapiens
ctgggcctatggagagc

SEQ ID NO: 6181548 - DNA, 21 bp, Homo sapiens
ctgggcctatggagagccctg

SEQ ID NO: 6181549 - DNA, 23 bp, Homo sapiens
ctgggcctatggagagccctggg

SEQ ID NO: 6181550 - DNA, 14 bp, Homo sapiens
ctgggcctcagcct

SEQ ID NO: 6181551 - DNA, 20 bp, Homo sapiens
ctgggcctcagtgtgcccat

SEQ ID NO: 6181552 - DNA, 18 bp, Homo sapiens
ctgggcctcatcacagca

SEQ ID NO: 6181553 - DNA, 18 bp, Homo sapiens
ctgggcctccacctctgt

SEQ ID NO: 6181554 - DNA, 19 bp, Homo sapiens
ctgggcctccacctctgtg

SEQ ID NO: 6181555 - DNA, 20 bp, Homo sapiens
ctgggcctccacctctgtgc

SEQ ID NO: 6181556 - DNA, 21 bp, Homo sapiens
ctgggcctcccatagtgctgg

SEQ ID NO: 6181557 - DNA, 12 bp, Homo sapiens
ctgggcctcccg

SEQ ID NO: 6181558 - DNA, 21 bp, Homo sapiens
ctgggcctcccgtccgtccgc

SEQ ID NO: 6181559 - DNA, 13 bp, Homo sapiens
ctgggcctcctcc

SEQ ID NO: 6181560 - DNA, 19 bp, Homo sapiens
ctgggcctcctcctagctg

SEQ ID NO: 6181561 - DNA, 23 bp, Homo sapiens
ctgggcctcctctaacaggggct

SEQ ID NO: 6181562 - DNA, 16 bp, Homo sapiens
ctgggcctcctgcctc

SEQ ID NO: 6181563 - DNA, 15 bp, Homo sapiens
ctgggcctcctggga

SEQ ID NO: 6181564 - DNA, 23 bp, Homo sapiens
ctgggcctccttcttccacttct

SEQ ID NO: 6181565 - DNA, 20 bp, Homo sapiens
ctgggcctcgtgcgcccgtg

SEQ ID NO: 6181566 - DNA, 13 bp, Homo sapiens
ctgggcctctgac

SEQ ID NO: 6181567 - DNA, 15 bp, Homo sapiens
ctgggcctctgatgt

SEQ ID NO: 6181568 - DNA, 13 bp, Homo sapiens
ctgggcctctgcc

SEQ ID NO: 6181569 - DNA, 14 bp, Homo sapiens
ctgggcctctgccc

SEQ ID NO: 6181570 - DNA, 16 bp, Homo sapiens
ctgggcctctgcccct

SEQ ID NO: 6181571 - DNA, 18 bp, Homo sapiens
ctgggcctgagggtccac

SEQ ID NO: 6181572 - DNA, 15 bp, Homo sapiens
ctgggcctgatggag

SEQ ID NO: 6181573 - DNA, 18 bp, Homo sapiens
ctgggcctgatggagagg

SEQ ID NO: 6181574 - DNA, 22 bp, Homo sapiens
ctgggcctgatggagaggagaa

SEQ ID NO: 6181575 - DNA, 15 bp, Homo sapiens
ctgggcctgcctcac

SEQ ID NO: 6181576 - DNA, 20 bp, Homo sapiens
ctgggcctgcttttccagga

SEQ ID NO: 6181577 - DNA, 21 bp, Homo sapiens
ctgggcctgcttttccaggat

SEQ ID NO: 6181578 - DNA, 23 bp, Homo sapiens
ctgggcctggaccgcttcccaga

SEQ ID NO: 6181579 - DNA, 23 bp, Homo sapiens
ctgggcctggagggggagcacca

SEQ ID NO: 6181580 - DNA, 14 bp, Homo sapiens
ctgggcctggctcc

SEQ ID NO: 6181581 - DNA, 12 bp, Homo sapiens
ctgggcctgggc

SEQ ID NO: 6181582 - DNA, 13 bp, Homo sapiens
ctgggcctgggct

SEQ ID NO: 6181583 - DNA, 18 bp, Homo sapiens
ctgggcctgggcttccac

SEQ ID NO: 6181584 - DNA, 13 bp, Homo sapiens
ctgggcctggggg

SEQ ID NO: 6181585 - DNA, 14 bp, Homo sapiens
ctgggcctgtcccc

SEQ ID NO: 6181586 - DNA, 15 bp, Homo sapiens
ctgggcctgtctcag

SEQ ID NO: 6181587 - DNA, 13 bp, Homo sapiens
ctgggcctgtgca

SEQ ID NO: 6181588 - DNA, 17 bp, Homo sapiens
ctgggcctgtgcactgg

SEQ ID NO: 6181589 - DNA, 18 bp, Homo sapiens
ctgggcctgtgcactggg

SEQ ID NO: 6181590 - DNA, 20 bp, Homo sapiens
ctgggcctgtgcactgggca

SEQ ID NO: 6181591 - DNA, 22 bp, Homo sapiens
ctgggcctgtgcactgggcagg

SEQ ID NO: 6181592 - DNA, 14 bp, Homo sapiens
ctgggcctgtgcag

SEQ ID NO: 6181593 - DNA, 17 bp, Homo sapiens
ctgggccttaactgttg

SEQ ID NO: 6181594 - DNA, 15 bp, Homo sapiens
ctgggccttacctcc

SEQ ID NO: 6181595 - DNA, 17 bp, Homo sapiens
ctgggccttatgtgggg

SEQ ID NO: 6181596 - DNA, 13 bp, Homo sapiens
ctgggccttctca

SEQ ID NO: 6181597 - DNA, 14 bp, Homo sapiens
ctgggccttctcag

SEQ ID NO: 6181598 - DNA, 17 bp, Homo sapiens
ctgggccttggctgggc

SEQ ID NO: 6181599 - DNA, 14 bp, Homo sapiens
ctgggccttgggct

SEQ ID NO: 6181600 - DNA, 14 bp, Homo sapiens
ctgggcctttccag

SEQ ID NO: 6181601 - DNA, 21 bp, Homo sapiens
ctgggcctttccagagaactg

SEQ ID NO: 6181602 - DNA, 14 bp, Homo sapiens
ctgggcctttcctg

SEQ ID NO: 6181603 - DNA, 16 bp, Homo sapiens
ctgggcctttcctgtg

SEQ ID NO: 6181604 - DNA, 17 bp, Homo sapiens
ctgggcctttcctgtgc

SEQ ID NO: 6181605 - DNA, 17 bp, Homo sapiens
ctgggcctttgcaagat

SEQ ID NO: 6181606 - DNA, 17 bp, Homo sapiens
ctgggcctttgtttcct

SEQ ID NO: 6181607 - DNA, 14 bp, Homo sapiens
ctgggccttttaac

SEQ ID NO: 6181608 - DNA, 18 bp, Homo sapiens
ctgggcgacaaaaacgaa

SEQ ID NO: 6181609 - DNA, 16 bp, Homo sapiens
ctgggcgacagagcaa

SEQ ID NO: 6181610 - DNA, 21 bp, Homo sapiens
ctgggcgacagagcgagactc

SEQ ID NO: 6181611 - DNA, 22 bp, Homo sapiens
ctgggcgagcccctccttctcc

SEQ ID NO: 6181612 - DNA, 17 bp, Homo sapiens
ctgggcgcagctgaagc

SEQ ID NO: 6181613 - DNA, 18 bp, Homo sapiens
ctgggcgcagctgaagcc

SEQ ID NO: 6181614 - DNA, 20 bp, Homo sapiens
ctgggcgcagctgaagcctg

SEQ ID NO: 6181615 - DNA, 23 bp, Homo sapiens
ctgggcgcagctgaagcctggac

SEQ ID NO: 6181616 - DNA, 15 bp, Homo sapiens
ctgggcgccctggaa

SEQ ID NO: 6181617 - DNA, 14 bp, Homo sapiens
ctgggcgcctctgt

SEQ ID NO: 6181618 - DNA, 20 bp, Homo sapiens
ctgggcgcctctgtcctggc

SEQ ID NO: 6181619 - DNA, 18 bp, Homo sapiens
ctgggcggcatccctgca

SEQ ID NO: 6181620 - DNA, 20 bp, Homo sapiens
ctgggcggcccgtggacacc

SEQ ID NO: 6181621 - DNA, 14 bp, Homo sapiens
ctgggcggctgtgc

SEQ ID NO: 6181622 - DNA, 23 bp, Homo sapiens
ctgggcggggccgcagccacacc

SEQ ID NO: 6181623 - DNA, 23 bp, Homo sapiens
ctgggcgtagtggctcacacctg

SEQ ID NO: 6181624 - DNA, 17 bp, Homo sapiens
ctgggcgtccagctcag

SEQ ID NO: 6181625 - DNA, 20 bp, Homo sapiens
ctgggcgtccagctcagccc

SEQ ID NO: 6181626 - DNA, 14 bp, Homo sapiens
ctgggcgtctgact

SEQ ID NO: 6181627 - DNA, 15 bp, Homo sapiens
ctgggcgtctgagct

SEQ ID NO: 6181628 - DNA, 16 bp, Homo sapiens
ctgggcgtctgagctg

SEQ ID NO: 6181629 - DNA, 18 bp, Homo sapiens
ctgggcgtctgagctggg

SEQ ID NO: 6181630 - DNA, 15 bp, Homo sapiens
ctgggcgtctgttct

SEQ ID NO: 6181631 - DNA, 16 bp, Homo sapiens
ctgggcgtctgttctt

SEQ ID NO: 6181632 - DNA, 22 bp, Homo sapiens
ctgggctaaggaagtatcagca

SEQ ID NO: 6181633 - DNA, 19 bp, Homo sapiens
ctgggctaatttgtatgtt

SEQ ID NO: 6181634 - DNA, 21 bp, Homo sapiens
ctgggctacaaaccaggagca

SEQ ID NO: 6181635 - DNA, 15 bp, Homo sapiens
ctgggctaccccacc

SEQ ID NO: 6181636 - DNA, 18 bp, Homo sapiens
ctgggctaccccccctcc

SEQ ID NO: 6181637 - DNA, 23 bp, Homo sapiens
ctgggctagaaagaccactggca

SEQ ID NO: 6181638 - DNA, 18 bp, Homo sapiens
ctgggctatattcctgac

SEQ ID NO: 6181639 - DNA, 16 bp, Homo sapiens
ctgggctatggacaca

SEQ ID NO: 6181640 - DNA, 23 bp, Homo sapiens
ctgggctattgctgctgcccctt

SEQ ID NO: 6181641 - DNA, 22 bp, Homo sapiens
ctgggctcaaatgatcctccca

SEQ ID NO: 6181642 - DNA, 22 bp, Homo sapiens
ctgggctcaagcaatcctcctg

SEQ ID NO: 6181643 - DNA, 13 bp, Homo sapiens
ctgggctcaagct

SEQ ID NO: 6181644 - DNA, 19 bp, Homo sapiens
ctgggctcaagctttcccg

SEQ ID NO: 6181645 - DNA, 23 bp, Homo sapiens
ctgggctcacaccagccctggtg

SEQ ID NO: 6181646 - DNA, 15 bp, Homo sapiens
ctgggctcacaggcc

SEQ ID NO: 6181647 - DNA, 18 bp, Homo sapiens
ctgggctcacaggcctct

SEQ ID NO: 6181648 - DNA, 20 bp, Homo sapiens
ctgggctcacaggcctctct

SEQ ID NO: 6181649 - DNA, 19 bp, Homo sapiens
ctgggctcactgcaggcat

SEQ ID NO: 6181650 - DNA, 14 bp, Homo sapiens
ctgggctcagacat

SEQ ID NO: 6181651 - DNA, 15 bp, Homo sapiens
ctgggctcagacatc

SEQ ID NO: 6181652 - DNA, 14 bp, Homo sapiens
ctgggctcagggct

SEQ ID NO: 6181653 - DNA, 18 bp, Homo sapiens
ctgggctcagggctggag

SEQ ID NO: 6181654 - DNA, 14 bp, Homo sapiens
ctgggctcatcagc

SEQ ID NO: 6181655 - DNA, 17 bp, Homo sapiens
ctgggctccacacagca

SEQ ID NO: 6181656 - DNA, 13 bp, Homo sapiens
ctgggctccctgg

SEQ ID NO: 6181657 - DNA, 16 bp, Homo sapiens
ctgggctccctggagg

SEQ ID NO: 6181658 - DNA, 12 bp, Homo sapiens
ctgggctccctt

SEQ ID NO: 6181659 - DNA, 20 bp, Homo sapiens
ctgggctcccttcccacctc

SEQ ID NO: 6181660 - DNA, 13 bp, Homo sapiens
ctgggctcctctg

SEQ ID NO: 6181661 - DNA, 14 bp, Homo sapiens
ctgggctcctggac

SEQ ID NO: 6181662 - DNA, 21 bp, Homo sapiens
ctgggctcggaggctgccccc

SEQ ID NO: 6181663 - DNA, 20 bp, Homo sapiens
ctgggctctcacccagtccc

SEQ ID NO: 6181664 - DNA, 14 bp, Homo sapiens
ctgggctctccacc

SEQ ID NO: 6181665 - DNA, 16 bp, Homo sapiens
ctgggctctccacctc

SEQ ID NO: 6181666 - DNA, 18 bp, Homo sapiens
ctgggctctccctgcacg

SEQ ID NO: 6181667 - DNA, 20 bp, Homo sapiens
ctgggctctcgcggcctctt

SEQ ID NO: 6181668 - DNA, 20 bp, Homo sapiens
ctgggctctgaacacacacg

SEQ ID NO: 6181669 - DNA, 15 bp, Homo sapiens
ctgggctctgaggag

SEQ ID NO: 6181670 - DNA, 23 bp, Homo sapiens
ctgggctctgcaattcccctctg

SEQ ID NO: 6181671 - DNA, 20 bp, Homo sapiens
ctgggctctgccaccctacc

SEQ ID NO: 6181672 - DNA, 13 bp, Homo sapiens
ctgggctctgccc

SEQ ID NO: 6181673 - DNA, 17 bp, Homo sapiens
ctgggctctgccccagc

SEQ ID NO: 6181674 - DNA, 23 bp, Homo sapiens
ctgggctctgccccagctctggc

SEQ ID NO: 6181675 - DNA, 20 bp, Homo sapiens
ctgggctctgcctgtctggt

SEQ ID NO: 6181676 - DNA, 11 bp, Homo sapiens
ctgggctctgg

SEQ ID NO: 6181677 - DNA, 15 bp, Homo sapiens
ctgggctctggacct

SEQ ID NO: 6181678 - DNA, 21 bp, Homo sapiens
ctgggctctggacctcaggag

SEQ ID NO: 6181679 - DNA, 23 bp, Homo sapiens
ctgggctctggactccacggatg

SEQ ID NO: 6181680 - DNA, 17 bp, Homo sapiens
ctgggctctgtcttcct

SEQ ID NO: 6181681 - DNA, 15 bp, Homo sapiens
ctgggctctgtgggc

SEQ ID NO: 6181682 - DNA, 21 bp, Homo sapiens
ctgggctctgtgggctgcact

SEQ ID NO: 6181683 - DNA, 22 bp, Homo sapiens
ctgggctctgtgggctgcactc

SEQ ID NO: 6181684 - DNA, 20 bp, Homo sapiens
ctgggctgactgggccaggg

SEQ ID NO: 6181685 - DNA, 18 bp, Homo sapiens
ctgggctgagccaaagcc

SEQ ID NO: 6181686 - DNA, 19 bp, Homo sapiens
ctgggctgagccaaagcca

SEQ ID NO: 6181687 - DNA, 18 bp, Homo sapiens
ctgggctgagcccctacc

SEQ ID NO: 6181688 - DNA, 19 bp, Homo sapiens
ctgggctgagcccctaccc

SEQ ID NO: 6181689 - DNA, 23 bp, Homo sapiens
ctgggctgagcctactgtctcct

SEQ ID NO: 6181690 - DNA, 17 bp, Homo sapiens
ctgggctgaggaggcag

SEQ ID NO: 6181691 - DNA, 19 bp, Homo sapiens
ctgggctgagggagcctgg

SEQ ID NO: 6181692 - DNA, 21 bp, Homo sapiens
ctgggctgatttgggtctctc

SEQ ID NO: 6181693 - DNA, 20 bp, Homo sapiens
ctgggctgccatgtgaagag

SEQ ID NO: 6181694 - DNA, 14 bp, Homo sapiens
ctgggctgcctcct

SEQ ID NO: 6181695 - DNA, 18 bp, Homo sapiens
ctgggctgcgggaggccc

SEQ ID NO: 6181696 - DNA, 21 bp, Homo sapiens
ctgggctgcgggaggccctgg

SEQ ID NO: 6181697 - DNA, 19 bp, Homo sapiens
ctgggctgctacccagaaa

SEQ ID NO: 6181698 - DNA, 15 bp, Homo sapiens
ctgggctgctggagg

SEQ ID NO: 6181699 - DNA, 16 bp, Homo sapiens
ctgggctgctggggca

SEQ ID NO: 6181700 - DNA, 20 bp, Homo sapiens
ctgggctgctggggcagggc

SEQ ID NO: 6181701 - DNA, 21 bp, Homo sapiens
ctgggctgctggggcagggcc

SEQ ID NO: 6181702 - DNA, 12 bp, Homo sapiens
ctgggctggact

SEQ ID NO: 6181703 - DNA, 19 bp, Homo sapiens
ctttctaactttctttact

SEQ ID NO: 6181704 - DNA, 13 bp, Homo sapiens
ctttctaagaaat

SEQ ID NO: 6181705 - DNA, 18 bp, Homo sapiens
ctttctaagctttcttac

SEQ ID NO: 6181706 - DNA, 21 bp, Homo sapiens
ctttctaaggatagcctttgt

SEQ ID NO: 6181707 - DNA, 17 bp, Homo sapiens
ctttctaatagagagat

SEQ ID NO: 6181708 - DNA, 14 bp, Homo sapiens
ctttctaatgctga

SEQ ID NO: 6181709 - DNA, 17 bp, Homo sapiens
ctttctaatgtgtgaat

SEQ ID NO: 6181710 - DNA, 21 bp, Homo sapiens
ctttctacacctgttgcacct

SEQ ID NO: 6181711 - DNA, 20 bp, Homo sapiens
ctttctacatgactgggcct

SEQ ID NO: 6181712 - DNA, 22 bp, Homo sapiens
ctttctaccacacacagcctgt

SEQ ID NO: 6181713 - DNA, 15 bp, Homo sapiens
ctttctacccagcga

SEQ ID NO: 6181714 - DNA, 16 bp, Homo sapiens
ctttctacccagcgag

SEQ ID NO: 6181715 - DNA, 16 bp, Homo sapiens
ctttctactcatttta

SEQ ID NO: 6181716 - DNA, 14 bp, Homo sapiens
ctttctactttgtt

SEQ ID NO: 6181717 - DNA, 18 bp, Homo sapiens
ctttctacttttttcatt

SEQ ID NO: 6181718 - DNA, 23 bp, Homo sapiens
ctttctagaagtttcccttcctc

SEQ ID NO: 6181719 - DNA, 21 bp, Homo sapiens
ctttctagagcagttggccaa

SEQ ID NO: 6181720 - DNA, 17 bp, Homo sapiens
ctttctagatgtctctg

SEQ ID NO: 6181721 - DNA, 19 bp, Homo sapiens
ctttctagcaaatatgctg

SEQ ID NO: 6181722 - DNA, 20 bp, Homo sapiens
ctttctagcagcagatctgt

SEQ ID NO: 6181723 - DNA, 15 bp, Homo sapiens
ctttctagccagagg

SEQ ID NO: 6181724 - DNA, 16 bp, Homo sapiens
ctttctagccagagga

SEQ ID NO: 6181725 - DNA, 11 bp, Homo sapiens
ctttctagcct

SEQ ID NO: 6181726 - DNA, 21 bp, Homo sapiens
ctttctagtcctattctattg

SEQ ID NO: 6181727 - DNA, 21 bp, Homo sapiens
ctttctagtggtctttgtaag

SEQ ID NO: 6181728 - DNA, 22 bp, Homo sapiens
ctttctagtggtctttgtaaga

SEQ ID NO: 6181729 - DNA, 20 bp, Homo sapiens
ctttctagttcaatgcctca

SEQ ID NO: 6181730 - DNA, 16 bp, Homo sapiens
ctttctagttgaaaat

SEQ ID NO: 6181731 - DNA, 14 bp, Homo sapiens
ctttctataatttt

SEQ ID NO: 6181732 - DNA, 15 bp, Homo sapiens
ctttctatagaaata

SEQ ID NO: 6181733 - DNA, 19 bp, Homo sapiens
ctttctatagaaatattgt

SEQ ID NO: 6181734 - DNA, 20 bp, Homo sapiens
ctttctatataaaatgtatt

SEQ ID NO: 6181735 - DNA, 20 bp, Homo sapiens
ctttctatatcttcttataa

SEQ ID NO: 6181736 - DNA, 16 bp, Homo sapiens
ctttctatcctctgta

SEQ ID NO: 6181737 - DNA, 14 bp, Homo sapiens
ctttctatgctgct

SEQ ID NO: 6181738 - DNA, 20 bp, Homo sapiens
ctttctatgctgcttttata

SEQ ID NO: 6181739 - DNA, 21 bp, Homo sapiens
ctttctatgctgcttttatat

SEQ ID NO: 6181740 - DNA, 13 bp, Homo sapiens
ctttctatgtaga

SEQ ID NO: 6181741 - DNA, 19 bp, Homo sapiens
ctttctatgtagaactgtt

SEQ ID NO: 6181742 - DNA, 20 bp, Homo sapiens
ctttctatgtagaactgttc

SEQ ID NO: 6181743 - DNA, 19 bp, Homo sapiens
ctttctattaatatttatg

SEQ ID NO: 6181744 - DNA, 19 bp, Homo sapiens
ctttctattacccctcatt

SEQ ID NO: 6181745 - DNA, 19 bp, Homo sapiens
ctttctattcataataaac

SEQ ID NO: 6181746 - DNA, 21 bp, Homo sapiens
ctttctattcataataaacta

SEQ ID NO: 6181747 - DNA, 15 bp, Homo sapiens
ctttctattccaaag

SEQ ID NO: 6181748 - DNA, 13 bp, Homo sapiens
ctttctattggca

SEQ ID NO: 6181749 - DNA, 15 bp, Homo sapiens
ctttctattgtacag

SEQ ID NO: 6181750 - DNA, 16 bp, Homo sapiens
ctttctattgtacaga

SEQ ID NO: 6181751 - DNA, 17 bp, Homo sapiens
ctttctatttgacttgt

SEQ ID NO: 6181752 - DNA, 18 bp, Homo sapiens
ctttctatttgacttgtg

SEQ ID NO: 6181753 - DNA, 23 bp, Homo sapiens
ctttctatttttatgatgacaat

SEQ ID NO: 6181754 - DNA, 23 bp, Homo sapiens
ctttctcaaagagggggctctgc

SEQ ID NO: 6181755 - DNA, 18 bp, Homo sapiens
ctttctcaataagcctca

SEQ ID NO: 6181756 - DNA, 22 bp, Homo sapiens
ctttctcactaaatcttttata

SEQ ID NO: 6181757 - DNA, 13 bp, Homo sapiens
ctttctcactgct

SEQ ID NO: 6181758 - DNA, 17 bp, Homo sapiens
ctttctcaggcttctca

SEQ ID NO: 6181759 - DNA, 12 bp, Homo sapiens
ctttctcagtgt

SEQ ID NO: 6181760 - DNA, 13 bp, Homo sapiens
ctttctcagtgtg

SEQ ID NO: 6181761 - DNA, 22 bp, Homo sapiens
ctttctcattagagatctgaaa

SEQ ID NO: 6181762 - DNA, 15 bp, Homo sapiens
ctttctcatttcttt

SEQ ID NO: 6181763 - DNA, 18 bp, Homo sapiens
ctttctcatttctttcta

SEQ ID NO: 6181764 - DNA, 14 bp, Homo sapiens
ctttctccaaagtt

SEQ ID NO: 6181765 - DNA, 20 bp, Homo sapiens
ctttctccaaagttatccag

SEQ ID NO: 6181766 - DNA, 18 bp, Homo sapiens
ctttctccaagacagatt

SEQ ID NO: 6181767 - DNA, 23 bp, Homo sapiens
ctttctccagaaccagtgtctga

SEQ ID NO: 6181768 - DNA, 19 bp, Homo sapiens
ctttctccagccagcaatg

SEQ ID NO: 6181769 - DNA, 20 bp, Homo sapiens
ctttctccagccagcaatga

SEQ ID NO: 6181770 - DNA, 20 bp, Homo sapiens
ctttctccagcccatgctgg

SEQ ID NO: 6181771 - DNA, 14 bp, Homo sapiens
ctttctccagccct

SEQ ID NO: 6181772 - DNA, 17 bp, Homo sapiens
ctttctccagccctgac

SEQ ID NO: 6181773 - DNA, 13 bp, Homo sapiens
ctttctccaggcc

SEQ ID NO: 6181774 - DNA, 17 bp, Homo sapiens
ctttctccatggagcct

SEQ ID NO: 6181775 - DNA, 18 bp, Homo sapiens
ctttctccatggagccta

SEQ ID NO: 6181776 - DNA, 14 bp, Homo sapiens
ctttctccatttat

SEQ ID NO: 6181777 - DNA, 13 bp, Homo sapiens
ctttctcccaggc

SEQ ID NO: 6181778 - DNA, 17 bp, Homo sapiens
ctttctcccagtatgtt

SEQ ID NO: 6181779 - DNA, 15 bp, Homo sapiens
ctttctccccatccc

SEQ ID NO: 6181780 - DNA, 21 bp, Homo sapiens
ctttctcccccgacactgctg

SEQ ID NO: 6181781 - DNA, 22 bp, Homo sapiens
ctttctcccccgacactgctgc

SEQ ID NO: 6181782 - DNA, 23 bp, Homo sapiens
ctttctcccccgacactgctgca

SEQ ID NO: 6181783 - DNA, 14 bp, Homo sapiens
ctttctcccctgcc

SEQ ID NO: 6181784 - DNA, 22 bp, Homo sapiens
ctttctcccctgcccccaggac

SEQ ID NO: 6181785 - DNA, 18 bp, Homo sapiens
ctttctccctaaccacta

SEQ ID NO: 6181786 - DNA, 13 bp, Homo sapiens
ctttctccctcac

SEQ ID NO: 6181787 - DNA, 22 bp, Homo sapiens
ctttctccctgtcccttccttt

SEQ ID NO: 6181788 - DNA, 23 bp, Homo sapiens
ctttctccctgtcccttcctttc

SEQ ID NO: 6181789 - DNA, 13 bp, Homo sapiens
ctttctccctttt

SEQ ID NO: 6181790 - DNA, 14 bp, Homo sapiens
ctttctcccttttt

SEQ ID NO: 6181791 - DNA, 21 bp, Homo sapiens
ctttctccggggtctgtgctg

SEQ ID NO: 6181792 - DNA, 12 bp, Homo sapiens
ctttctcctcag

SEQ ID NO: 6181793 - DNA, 14 bp, Homo sapiens
ctttctcctcagga

SEQ ID NO: 6181794 - DNA, 20 bp, Homo sapiens
ctttctcctccccacctgta

SEQ ID NO: 6181795 - DNA, 23 bp, Homo sapiens
ctttctcctctgctatgcatttt

SEQ ID NO: 6181796 - DNA, 11 bp, Homo sapiens
ctttctcctgg

SEQ ID NO: 6181797 - DNA, 13 bp, Homo sapiens
ctttctcctggag

SEQ ID NO: 6181798 - DNA, 14 bp, Homo sapiens
ctttctcctggaga

SEQ ID NO: 6181799 - DNA, 23 bp, Homo sapiens
ctttctcctggagatagctgggg

SEQ ID NO: 6181800 - DNA, 12 bp, Homo sapiens
ctttctcctggc

SEQ ID NO: 6181801 - DNA, 14 bp, Homo sapiens
ctttctcctggtga

SEQ ID NO: 6181802 - DNA, 15 bp, Homo sapiens
ctttctcctggtgac

SEQ ID NO: 6181803 - DNA, 12 bp, Homo sapiens
ctttctcctgtg

SEQ ID NO: 6181804 - DNA, 13 bp, Homo sapiens
ctttctcctgtgc

SEQ ID NO: 6181805 - DNA, 15 bp, Homo sapiens
ctttctcctgtgccc

SEQ ID NO: 6181806 - DNA, 22 bp, Homo sapiens
ctttctcctgtttattcccatc

SEQ ID NO: 6181807 - DNA, 15 bp, Homo sapiens
ctttctccttagtct

SEQ ID NO: 6181808 - DNA, 20 bp, Homo sapiens
ctttctccttagtcttctca

SEQ ID NO: 6181809 - DNA, 23 bp, Homo sapiens
ctttctcctttgtactttgtgct

SEQ ID NO: 6181810 - DNA, 18 bp, Homo sapiens
ctttctcgattttatctt

SEQ ID NO: 6181811 - DNA, 16 bp, Homo sapiens
ctttctcgcgccctcc

SEQ ID NO: 6181812 - DNA, 15 bp, Homo sapiens
ctttctcgctggaat

SEQ ID NO: 6181813 - DNA, 17 bp, Homo sapiens
ctttctcgctggaatca

SEQ ID NO: 6181814 - DNA, 22 bp, Homo sapiens
ctttctctaataataaatagtt

SEQ ID NO: 6181815 - DNA, 13 bp, Homo sapiens
ctttctctcagaa

SEQ ID NO: 6181816 - DNA, 18 bp, Homo sapiens
ctttctctcagaaatgct

SEQ ID NO: 6181817 - DNA, 22 bp, Homo sapiens
ctttctctcccctcctctgaat

SEQ ID NO: 6181818 - DNA, 14 bp, Homo sapiens
ctttctctcctggc

SEQ ID NO: 6181819 - DNA, 21 bp, Homo sapiens
ctttctctcctggctcggggt

SEQ ID NO: 6181820 - DNA, 14 bp, Homo sapiens
ctttctctccttct

SEQ ID NO: 6181821 - DNA, 17 bp, Homo sapiens
ctttctctcctttcttt

SEQ ID NO: 6181822 - DNA, 21 bp, Homo sapiens
ctttctctctcactctcttcc

SEQ ID NO: 6181823 - DNA, 22 bp, Homo sapiens
ctttctctctcactctcttcct

SEQ ID NO: 6181824 - DNA, 16 bp, Homo sapiens
ctttctctctcatgcc

SEQ ID NO: 6181825 - DNA, 16 bp, Homo sapiens
ctttctctctccaccc

SEQ ID NO: 6181826 - DNA, 20 bp, Homo sapiens
ctttctctctcctctctgct

SEQ ID NO: 6181827 - DNA, 17 bp, Homo sapiens
ctttctctctcttttcc

SEQ ID NO: 6181828 - DNA, 16 bp, Homo sapiens
ctttctctctcttttt

SEQ ID NO: 6181829 - DNA, 16 bp, Homo sapiens
ctttctctctggcttc

SEQ ID NO: 6181830 - DNA, 19 bp, Homo sapiens
ctttctctctggcttctct

SEQ ID NO: 6181831 - DNA, 20 bp, Homo sapiens
ctttctctctggcttctctc

SEQ ID NO: 6181832 - DNA, 22 bp, Homo sapiens
ctttctctctggcttctctctt

SEQ ID NO: 6181833 - DNA, 13 bp, Homo sapiens
ctttctctctgtg

SEQ ID NO: 6181834 - DNA, 13 bp, Homo sapiens
ctttctctcttcc

SEQ ID NO: 6181835 - DNA, 15 bp, Homo sapiens
ctttctctcttccct

SEQ ID NO: 6181836 - DNA, 22 bp, Homo sapiens
ctttctctctttccatctccct

SEQ ID NO: 6181837 - DNA, 22 bp, Homo sapiens
ctttctctctttcttttgtgca

SEQ ID NO: 6181838 - DNA, 18 bp, Homo sapiens
ctttctctgacactgtgt

SEQ ID NO: 6181839 - DNA, 19 bp, Homo sapiens
ctttctctgagaaccaaaa

SEQ ID NO: 6181840 - DNA, 14 bp, Homo sapiens
ctttctctgcctct

SEQ ID NO: 6181841 - DNA, 15 bp, Homo sapiens
ctttctctgcctggc

SEQ ID NO: 6181842 - DNA, 12 bp, Homo sapiens
ctttctctgctt

SEQ ID NO: 6181843 - DNA, 16 bp, Homo sapiens
ctttctctgcttcagc

SEQ ID NO: 6181844 - DNA, 14 bp, Homo sapiens
ctttctctggctcc

SEQ ID NO: 6181845 - DNA, 16 bp, Homo sapiens
ctttctctggctccag

SEQ ID NO: 6181846 - DNA, 19 bp, Homo sapiens
ctttctctggctccagaat

SEQ ID NO: 6181847 - DNA, 13 bp, Homo sapiens
ctttctctgtata

SEQ ID NO: 6181848 - DNA, 13 bp, Homo sapiens
ctttctctgtgaa

SEQ ID NO: 6181849 - DNA, 21 bp, Homo sapiens
ctttctcttcatattcagctt

SEQ ID NO: 6181850 - DNA, 14 bp, Homo sapiens
ctttctcttccctg

SEQ ID NO: 6181851 - DNA, 15 bp, Homo sapiens
ctttctcttccctga

SEQ ID NO: 6181852 - DNA, 19 bp, Homo sapiens
ctttctcttccttttatat

SEQ ID NO: 6181853 - DNA, 20 bp, Homo sapiens
ctttctcttccttttatata

SEQ ID NO: 6181854 - DNA, 15 bp, Homo sapiens
ctttctcttctctgt

SEQ ID NO: 6181855 - DNA, 11 bp, Homo sapiens
ctttctcttgc

SEQ ID NO: 6181856 - DNA, 16 bp, Homo sapiens
ctttctcttgtttaaa

SEQ ID NO: 6181857 - DNA, 23 bp, Homo sapiens
ctttctcttgtttaaaaaaagaa

SEQ ID NO: 6181858 - DNA, 16 bp, Homo sapiens
ctttctctttcctcat

SEQ ID NO: 6181859 - DNA, 18 bp, Homo sapiens
ctttctctttcctcattt

SEQ ID NO: 6181860 - DNA, 13 bp, Homo sapiens
ctttctctttctc

SEQ ID NO: 6181861 - DNA, 15 bp, Homo sapiens
ctttctctttcttcc

SEQ ID NO: 6181862 - DNA, 16 bp, Homo sapiens
ctttctctttcttcct

SEQ ID NO: 6181863 - DNA, 13 bp, Homo sapiens
ctttctctttggt

SEQ ID NO: 6181864 - DNA, 12 bp, Homo sapiens
ctttctcttttc

SEQ ID NO: 6181865 - DNA, 20 bp, Homo sapiens
ctttctcttttctaaaagac

SEQ ID NO: 6181866 - DNA, 17 bp, Homo sapiens
ctttctgaaaatttata

SEQ ID NO: 6181867 - DNA, 22 bp, Homo sapiens
ctttctgaaactcccttgtgtt

SEQ ID NO: 6181868 - DNA, 16 bp, Homo sapiens
ctttctgaacagctgg

SEQ ID NO: 6181869 - DNA, 18 bp, Homo sapiens
ctttctgaacagctggtg

SEQ ID NO: 6181870 - DNA, 20 bp, Homo sapiens
ctttctgaacagctggtgta

SEQ ID NO: 6181871 - DNA, 21 bp, Homo sapiens
ctttctgaacagctggtgtag

SEQ ID NO: 6181872 - DNA, 14 bp, Homo sapiens
ctttctgaattgca

SEQ ID NO: 6181873 - DNA, 22 bp, Homo sapiens
ctttctgacaagataaaggaag

SEQ ID NO: 6181874 - DNA, 16 bp, Homo sapiens
ctttctgacatcagca

SEQ ID NO: 6181875 - DNA, 12 bp, Homo sapiens
ctttctgactgt

SEQ ID NO: 6181876 - DNA, 15 bp, Homo sapiens
ctttctgactgtccc

SEQ ID NO: 6181877 - DNA, 17 bp, Homo sapiens
ctttctgactgtccctg

SEQ ID NO: 6181878 - DNA, 21 bp, Homo sapiens
ctttctgagcaagaggatttt

SEQ ID NO: 6181879 - DNA, 21 bp, Homo sapiens
ctttctgagtgccttctgtgg

SEQ ID NO: 6181880 - DNA, 22 bp, Homo sapiens
ctttctgatacatctgtcagtg

SEQ ID NO: 6181881 - DNA, 18 bp, Homo sapiens
ctttctgatcaaggcctt

SEQ ID NO: 6181882 - DNA, 17 bp, Homo sapiens
ctgggctggactggagg

SEQ ID NO: 6181883 - DNA, 19 bp, Homo sapiens
ctgggctggactggaggtg

SEQ ID NO: 6181884 - DNA, 14 bp, Homo sapiens
ctgggctggagagt

SEQ ID NO: 6181885 - DNA, 16 bp, Homo sapiens
ctgggctggatgagct

SEQ ID NO: 6181886 - DNA, 15 bp, Homo sapiens
ctgggctggcacagc

SEQ ID NO: 6181887 - DNA, 12 bp, Homo sapiens
ctgggctggcag

SEQ ID NO: 6181888 - DNA, 13 bp, Homo sapiens
ctgggctggcaga

SEQ ID NO: 6181889 - DNA, 14 bp, Homo sapiens
ctgggctggcatgg

SEQ ID NO: 6181890 - DNA, 17 bp, Homo sapiens
ctgggctggcatgggga

SEQ ID NO: 6181891 - DNA, 12 bp, Homo sapiens
ctgggctggcca

SEQ ID NO: 6181892 - DNA, 12 bp, Homo sapiens
ctgggctggctc

SEQ ID NO: 6181893 - DNA, 18 bp, Homo sapiens
ctgggctggctccctctt

SEQ ID NO: 6181894 - DNA, 16 bp, Homo sapiens
ctgggctggctgaaga

SEQ ID NO: 6181895 - DNA, 15 bp, Homo sapiens
ctgggctggcttgag

SEQ ID NO: 6181896 - DNA, 11 bp, Homo sapiens
ctgggctgggc

SEQ ID NO: 6181897 - DNA, 16 bp, Homo sapiens
ctgggctgggcacctg

SEQ ID NO: 6181898 - DNA, 22 bp, Homo sapiens
ctgggctgggcactgctctcac

SEQ ID NO: 6181899 - DNA, 16 bp, Homo sapiens
ctgggctgggcagcct

SEQ ID NO: 6181900 - DNA, 12 bp, Homo sapiens
ctgggctgggcc

SEQ ID NO: 6181901 - DNA, 17 bp, Homo sapiens
ctgggctgggccctctt

SEQ ID NO: 6181902 - DNA, 14 bp, Homo sapiens
ctgggctggggcca

SEQ ID NO: 6181903 - DNA, 15 bp, Homo sapiens
ctgggctggggccac

SEQ ID NO: 6181904 - DNA, 17 bp, Homo sapiens
ctgggctggggccacca

SEQ ID NO: 6181905 - DNA, 22 bp, Homo sapiens
ctgggctggggccaccatccct

SEQ ID NO: 6181906 - DNA, 23 bp, Homo sapiens
ctgggctggggccaccatccctg

SEQ ID NO: 6181907 - DNA, 21 bp, Homo sapiens
ctgggctggggccacctttgt

SEQ ID NO: 6181908 - DNA, 23 bp, Homo sapiens
ctgggctggggccacctttgtgc

SEQ ID NO: 6181909 - DNA, 12 bp, Homo sapiens
ctgggctgggtg

SEQ ID NO: 6181910 - DNA, 22 bp, Homo sapiens
ctgggctgggtgcgaccccatc

SEQ ID NO: 6181911 - DNA, 15 bp, Homo sapiens
ctgggctgggtgctg

SEQ ID NO: 6181912 - DNA, 14 bp, Homo sapiens
ctgggctgggtggc

SEQ ID NO: 6181913 - DNA, 23 bp, Homo sapiens
ctgggctgtaacgtggcactggt

SEQ ID NO: 6181914 - DNA, 13 bp, Homo sapiens
ctgggctgtccag

SEQ ID NO: 6181915 - DNA, 22 bp, Homo sapiens
ctgggctgtctctcccttccag

SEQ ID NO: 6181916 - DNA, 17 bp, Homo sapiens
ctgggctgtctgtcacc

SEQ ID NO: 6181917 - DNA, 21 bp, Homo sapiens
ctgggctgtctgtcaccagct

SEQ ID NO: 6181918 - DNA, 15 bp, Homo sapiens
ctgggctgtgaggac

SEQ ID NO: 6181919 - DNA, 16 bp, Homo sapiens
ctgggctgtgaggaca

SEQ ID NO: 6181920 - DNA, 14 bp, Homo sapiens
ctgggctgtgcctg

SEQ ID NO: 6181921 - DNA, 13 bp, Homo sapiens
ctgggctgtgcta

SEQ ID NO: 6181922 - DNA, 15 bp, Homo sapiens
ctgggctgtgggtgc

SEQ ID NO: 6181923 - DNA, 12 bp, Homo sapiens
ctgggctgttgt

SEQ ID NO: 6181924 - DNA, 15 bp, Homo sapiens
ctgggcttagggtcc

SEQ ID NO: 6181925 - DNA, 22 bp, Homo sapiens
ctgggcttagggtcctgtcgaa

SEQ ID NO: 6181926 - DNA, 16 bp, Homo sapiens
ctgggcttcagcctct

SEQ ID NO: 6181927 - DNA, 19 bp, Homo sapiens
ctgggcttcagcctctccc

SEQ ID NO: 6181928 - DNA, 24 bp, Homo sapiens
ctgggcttcagtggcagctgcttt

SEQ ID NO: 6181929 - DNA, 15 bp, Homo sapiens
ctgggcttcatctgg

SEQ ID NO: 6181930 - DNA, 19 bp, Homo sapiens
ctgggcttcattccggact

SEQ ID NO: 6181931 - DNA, 15 bp, Homo sapiens
ctgggcttcattctg

SEQ ID NO: 6181932 - DNA, 20 bp, Homo sapiens
ctgggcttcattctggaaac

SEQ ID NO: 6181933 - DNA, 13 bp, Homo sapiens
ctgggcttcctgg

SEQ ID NO: 6181934 - DNA, 14 bp, Homo sapiens
ctgggcttcctgga

SEQ ID NO: 6181935 - DNA, 17 bp, Homo sapiens
ctgggcttcctggagca

SEQ ID NO: 6181936 - DNA, 18 bp, Homo sapiens
ctgggcttctgtaccaca

SEQ ID NO: 6181937 - DNA, 16 bp, Homo sapiens
ctgggcttggcctgct

SEQ ID NO: 6181938 - DNA, 17 bp, Homo sapiens
ctgggcttggcctgctg

SEQ ID NO: 6181939 - DNA, 20 bp, Homo sapiens
ctgggcttggcctgctgtga

SEQ ID NO: 6181940 - DNA, 15 bp, Homo sapiens
ctgggcttggcctgg

SEQ ID NO: 6181941 - DNA, 20 bp, Homo sapiens
ctgggcttggcctggagagg

SEQ ID NO: 6181942 - DNA, 12 bp, Homo sapiens
ctgggcttggct

SEQ ID NO: 6181943 - DNA, 21 bp, Homo sapiens
ctgggcttggggaccagagct

SEQ ID NO: 6181944 - DNA, 20 bp, Homo sapiens
ctgggcttggggcttcctaa

SEQ ID NO: 6181945 - DNA, 22 bp, Homo sapiens
ctgggcttgtagaccactgtcc

SEQ ID NO: 6181946 - DNA, 18 bp, Homo sapiens
ctgggcttgtctgtagat

SEQ ID NO: 6181947 - DNA, 15 bp, Homo sapiens
ctgggctttctcctg

SEQ ID NO: 6181948 - DNA, 16 bp, Homo sapiens
ctgggctttctcctgg

SEQ ID NO: 6181949 - DNA, 13 bp, Homo sapiens
ctgggctttggga

SEQ ID NO: 6181950 - DNA, 18 bp, Homo sapiens
ctgggctttggggctggt

SEQ ID NO: 6181951 - DNA, 19 bp, Homo sapiens
ctgggctttggggctggtg

SEQ ID NO: 6181952 - DNA, 20 bp, Homo sapiens
ctgggcttttccttttgcac

SEQ ID NO: 6181953 - DNA, 19 bp, Homo sapiens
ctgggcttttctcccagct

SEQ ID NO: 6181954 - DNA, 22 bp, Homo sapiens
ctgggcttttggtttgggggcg

SEQ ID NO: 6181955 - DNA, 20 bp, Homo sapiens
ctgggcttttgttttgcttt

SEQ ID NO: 6181956 - DNA, 20 bp, Homo sapiens
ctggggaaaaaaaagagact

SEQ ID NO: 6181957 - DNA, 23 bp, Homo sapiens
ctggggaaagacactgcctgggc

SEQ ID NO: 6181958 - DNA, 15 bp, Homo sapiens
ctggggaaagcctga

SEQ ID NO: 6181959 - DNA, 12 bp, Homo sapiens
ctggggaaaggg

SEQ ID NO: 6181960 - DNA, 16 bp, Homo sapiens
ctggggaaagggctgg

SEQ ID NO: 6181961 - DNA, 21 bp, Homo sapiens
ctggggaaagggctggctgca

SEQ ID NO: 6181962 - DNA, 15 bp, Homo sapiens
ctggggaaaggggac

SEQ ID NO: 6181963 - DNA, 16 bp, Homo sapiens
ctggggaaaggggaca

SEQ ID NO: 6181964 - DNA, 22 bp, Homo sapiens
ctggggaaaggggacaaggaag

SEQ ID NO: 6181965 - DNA, 13 bp, Homo sapiens
ctggggaacagag

SEQ ID NO: 6181966 - DNA, 14 bp, Homo sapiens
ctggggaacatttc

SEQ ID NO: 6181967 - DNA, 19 bp, Homo sapiens
ctggggaagaacagccccg

SEQ ID NO: 6181968 - DNA, 14 bp, Homo sapiens
ctggggaagacagt

SEQ ID NO: 6181969 - DNA, 15 bp, Homo sapiens
ctggggaagacagtg

SEQ ID NO: 6181970 - DNA, 16 bp, Homo sapiens
ctggggaagaggcctt

SEQ ID NO: 6181971 - DNA, 18 bp, Homo sapiens
ctggggaaggagccagtt

SEQ ID NO: 6181972 - DNA, 20 bp, Homo sapiens
ctggggaagggaaccagccc

SEQ ID NO: 6181973 - DNA, 21 bp, Homo sapiens
ctggggaagtacgtcccagcg

SEQ ID NO: 6181974 - DNA, 11 bp, Homo sapiens
ctggggacaga

SEQ ID NO: 6181975 - DNA, 12 bp, Homo sapiens
ctggggacagag

SEQ ID NO: 6181976 - DNA, 23 bp, Homo sapiens
ctggggacagagccaccccatga

SEQ ID NO: 6181977 - DNA, 13 bp, Homo sapiens
ctggggacagagg

SEQ ID NO: 6181978 - DNA, 16 bp, Homo sapiens
ctggggacagcaaggg

SEQ ID NO: 6181979 - DNA, 19 bp, Homo sapiens
ctggggacagctttcctgg

SEQ ID NO: 6181980 - DNA, 20 bp, Homo sapiens
ctggggacagctttcctggg

SEQ ID NO: 6181981 - DNA, 21 bp, Homo sapiens
ctggggacagctttcctgggt

SEQ ID NO: 6181982 - DNA, 12 bp, Homo sapiens
ctggggacaggc

SEQ ID NO: 6181983 - DNA, 13 bp, Homo sapiens
ctggggacaggcc

SEQ ID NO: 6181984 - DNA, 17 bp, Homo sapiens
ctggggacaggcccgct

SEQ ID NO: 6181985 - DNA, 13 bp, Homo sapiens
ctggggaccaaga

SEQ ID NO: 6181986 - DNA, 22 bp, Homo sapiens
ctggggaccagcttggctcagg

SEQ ID NO: 6181987 - DNA, 14 bp, Homo sapiens
ctggggaccaggag

SEQ ID NO: 6181988 - DNA, 11 bp, Homo sapiens
ctggggaccca

SEQ ID NO: 6181989 - DNA, 22 bp, Homo sapiens
ctggggacccaaaccccctgca

SEQ ID NO: 6181990 - DNA, 24 bp, Homo sapiens
ctggggacccaaaccccctgcagc

SEQ ID NO: 6181991 - DNA, 24 bp, Homo sapiens
ctggggaccccaacctcagaggca

SEQ ID NO: 6181992 - DNA, 17 bp, Homo sapiens
ctggggacccgctgggg

SEQ ID NO: 6181993 - DNA, 18 bp, Homo sapiens
ctggggacccgctggggg

SEQ ID NO: 6181994 - DNA, 15 bp, Homo sapiens
ctggggaccctccag

SEQ ID NO: 6181995 - DNA, 17 bp, Homo sapiens
ctggggaccggttccca

SEQ ID NO: 6181996 - DNA, 20 bp, Homo sapiens
ctggggacctggcactggga

SEQ ID NO: 6181997 - DNA, 14 bp, Homo sapiens
ctggggacggagca

SEQ ID NO: 6181998 - DNA, 14 bp, Homo sapiens
ctggggacggggct

SEQ ID NO: 6181999 - DNA, 21 bp, Homo sapiens
ctggggacgttgctgagccag

SEQ ID NO: 6182000 - DNA, 15 bp, Homo sapiens
ctggggactcctcaa

SEQ ID NO: 6182001 - DNA, 20 bp, Homo sapiens
ctggggactcctcaaaccac

SEQ ID NO: 6182002 - DNA, 21 bp, Homo sapiens
ctggggactgttccaaagcca

SEQ ID NO: 6182003 - DNA, 22 bp, Homo sapiens
ctggggacttcaactgcccagc

SEQ ID NO: 6182004 - DNA, 13 bp, Homo sapiens
ctggggacttgtg

SEQ ID NO: 6182005 - DNA, 18 bp, Homo sapiens
ctggggacttgtgtctgc

SEQ ID NO: 6182006 - DNA, 23 bp, Homo sapiens
ctggggactttatttatttctag

SEQ ID NO: 6182007 - DNA, 13 bp, Homo sapiens
ctggggagaaagt

SEQ ID NO: 6182008 - DNA, 14 bp, Homo sapiens
ctggggagaaagta

SEQ ID NO: 6182009 - DNA, 19 bp, Homo sapiens
ctggggagaccgagtgtgg

SEQ ID NO: 6182010 - DNA, 18 bp, Homo sapiens
ctggggagagcggctgga

SEQ ID NO: 6182011 - DNA, 16 bp, Homo sapiens
ctggggagaggaaaga

SEQ ID NO: 6182012 - DNA, 16 bp, Homo sapiens
ctggggagcaggcagc

SEQ ID NO: 6182013 - DNA, 21 bp, Homo sapiens
ctggggagcccactgaggggc

SEQ ID NO: 6182014 - DNA, 22 bp, Homo sapiens
ctggggagcccactgaggggcc

SEQ ID NO: 6182015 - DNA, 22 bp, Homo sapiens
ctggggagcgggtctgctccca

SEQ ID NO: 6182016 - DNA, 13 bp, Homo sapiens
ctggggagctcct

SEQ ID NO: 6182017 - DNA, 16 bp, Homo sapiens
ctggggagctcctggc

SEQ ID NO: 6182018 - DNA, 17 bp, Homo sapiens
ctggggagctcctggga

SEQ ID NO: 6182019 - DNA, 18 bp, Homo sapiens
ctggggaggaagggccag

SEQ ID NO: 6182020 - DNA, 17 bp, Homo sapiens
ctggggaggaccagggc

SEQ ID NO: 6182021 - DNA, 14 bp, Homo sapiens
ctggggaggaggag

SEQ ID NO: 6182022 - DNA, 18 bp, Homo sapiens
ctggggaggaggagagag

SEQ ID NO: 6182023 - DNA, 19 bp, Homo sapiens
ctggggaggaggagagagt

SEQ ID NO: 6182024 - DNA, 15 bp, Homo sapiens
ctggggaggcctgcc

SEQ ID NO: 6182025 - DNA, 17 bp, Homo sapiens
ctggggaggcctgcctg

SEQ ID NO: 6182026 - DNA, 13 bp, Homo sapiens
ctggggaggctga

SEQ ID NO: 6182027 - DNA, 20 bp, Homo sapiens
ctggggaggctgagactgca

SEQ ID NO: 6182028 - DNA, 15 bp, Homo sapiens
ctggggaggctgagg

SEQ ID NO: 6182029 - DNA, 18 bp, Homo sapiens
ctggggagggagagcacc

SEQ ID NO: 6182030 - DNA, 13 bp, Homo sapiens
ctggggagggagg

SEQ ID NO: 6182031 - DNA, 20 bp, Homo sapiens
ctggggagggctgcagtcac

SEQ ID NO: 6182032 - DNA, 21 bp, Homo sapiens
ctggggagggctgcagtcaca

SEQ ID NO: 6182033 - DNA, 13 bp, Homo sapiens
ctggggagggggt

SEQ ID NO: 6182034 - DNA, 17 bp, Homo sapiens
ctggggaggtgctgggg

SEQ ID NO: 6182035 - DNA, 22 bp, Homo sapiens
ctggggagtaaacggcccaggc

SEQ ID NO: 6182036 - DNA, 23 bp, Homo sapiens
ctggggagtcctcattgaatcct

SEQ ID NO: 6182037 - DNA, 14 bp, Homo sapiens
ctggggagtgagct

SEQ ID NO: 6182038 - DNA, 15 bp, Homo sapiens
ctggggagtgattac

SEQ ID NO: 6182039 - DNA, 19 bp, Homo sapiens
ctggggagtggttaggcag

SEQ ID NO: 6182040 - DNA, 17 bp, Homo sapiens
ctggggatcttcccaca

SEQ ID NO: 6182041 - DNA, 23 bp, Homo sapiens
ctggggatcttcccacaggaggg

SEQ ID NO: 6182042 - DNA, 23 bp, Homo sapiens
ctggggatggagaatgccagccc

SEQ ID NO: 6182043 - DNA, 14 bp, Homo sapiens
ctggggatggtggc

SEQ ID NO: 6182044 - DNA, 20 bp, Homo sapiens
ctggggatgtaaccaagctg

SEQ ID NO: 6182045 - DNA, 17 bp, Homo sapiens
ctggggatgtctctcat

SEQ ID NO: 6182046 - DNA, 15 bp, Homo sapiens
ctggggatgtgggag

SEQ ID NO: 6182047 - DNA, 22 bp, Homo sapiens
ctggggatgtgggagggagcag

SEQ ID NO: 6182048 - DNA, 18 bp, Homo sapiens
ctggggattcttgaactt

SEQ ID NO: 6182049 - DNA, 18 bp, Homo sapiens
ctggggattgggcccctg

SEQ ID NO: 6182050 - DNA, 18 bp, Homo sapiens
ctggggcaaggggcagcc

SEQ ID NO: 6182051 - DNA, 19 bp, Homo sapiens
ctggggcacagtccaggaa

SEQ ID NO: 6182052 - DNA, 19 bp, Homo sapiens
ctggggcactcccccagga

SEQ ID NO: 6182053 - DNA, 14 bp, Homo sapiens
ctggggcagagaag

SEQ ID NO: 6182054 - DNA, 23 bp, Homo sapiens
ctggggcagagaagttccttagg

SEQ ID NO: 6182055 - DNA, 12 bp, Homo sapiens
ctggggcagagc

SEQ ID NO: 6182056 - DNA, 13 bp, Homo sapiens
ctggggcagagct

SEQ ID NO: 6182057 - DNA, 14 bp, Homo sapiens
ctggggcagagctt

SEQ ID NO: 6182058 - DNA, 15 bp, Homo sapiens
ctggggcagaggaag

SEQ ID NO: 6182059 - DNA, 13 bp, Homo sapiens
ctggggcagaggg

SEQ ID NO: 6182060 - DNA, 18 bp, Homo sapiens
ctggggcagcactcccca

SEQ ID NO: 6182061 - DNA, 19 bp, Homo sapiens
ctggggcagcactccccag

SEQ ID NO: 6182062 - DNA, 20 bp, Homo sapiens
ctttctgatgacgcctgtct

SEQ ID NO: 6182063 - DNA, 16 bp, Homo sapiens
ctttctgattactgtc

SEQ ID NO: 6182064 - DNA, 16 bp, Homo sapiens
ctttctgcacacaaat

SEQ ID NO: 6182065 - DNA, 20 bp, Homo sapiens
ctttctgcagtttttcagga

SEQ ID NO: 6182066 - DNA, 21 bp, Homo sapiens
ctttctgcagtttttcaggag

SEQ ID NO: 6182067 - DNA, 15 bp, Homo sapiens
ctttctgccagggat

SEQ ID NO: 6182068 - DNA, 20 bp, Homo sapiens
ctttctgccagggatggcag

SEQ ID NO: 6182069 - DNA, 22 bp, Homo sapiens
ctttctgccagggatggcagtg

SEQ ID NO: 6182070 - DNA, 15 bp, Homo sapiens
ctttctgccccccag

SEQ ID NO: 6182071 - DNA, 12 bp, Homo sapiens
ctttctgcctct

SEQ ID NO: 6182072 - DNA, 17 bp, Homo sapiens
ctttctgcctctcctcc

SEQ ID NO: 6182073 - DNA, 13 bp, Homo sapiens
ctttctgccttag

SEQ ID NO: 6182074 - DNA, 15 bp, Homo sapiens
ctttctgccttggcc

SEQ ID NO: 6182075 - DNA, 16 bp, Homo sapiens
ctttctgctctgccat

SEQ ID NO: 6182076 - DNA, 19 bp, Homo sapiens
ctttctgctgggatccttg

SEQ ID NO: 6182077 - DNA, 12 bp, Homo sapiens
ctttctggaaaa

SEQ ID NO: 6182078 - DNA, 16 bp, Homo sapiens
ctttctggactcccac

SEQ ID NO: 6182079 - DNA, 17 bp, Homo sapiens
ctttctggactcccact

SEQ ID NO: 6182080 - DNA, 22 bp, Homo sapiens
ctttctggactcccactctttg

SEQ ID NO: 6182081 - DNA, 12 bp, Homo sapiens
ctttctggactg

SEQ ID NO: 6182082 - DNA, 14 bp, Homo sapiens
ctttctggccccag

SEQ ID NO: 6182083 - DNA, 23 bp, Homo sapiens
ctttctggcccttctttcagtga

SEQ ID NO: 6182084 - DNA, 19 bp, Homo sapiens
ctttctggctatgcatttg

SEQ ID NO: 6182085 - DNA, 13 bp, Homo sapiens
ctttctggctctc

SEQ ID NO: 6182086 - DNA, 21 bp, Homo sapiens
ctttctgggatgtcacagtcc

SEQ ID NO: 6182087 - DNA, 22 bp, Homo sapiens
ctttctgggatgtcacagtcca

SEQ ID NO: 6182088 - DNA, 20 bp, Homo sapiens
ctttctgggcaccggggcct

SEQ ID NO: 6182089 - DNA, 14 bp, Homo sapiens
ctttctgggccaag

SEQ ID NO: 6182090 - DNA, 12 bp, Homo sapiens
ctttctgggctc

SEQ ID NO: 6182091 - DNA, 15 bp, Homo sapiens
ctttctgggctctgg

SEQ ID NO: 6182092 - DNA, 20 bp, Homo sapiens
ctttctgggctctggactcc

SEQ ID NO: 6182093 - DNA, 17 bp, Homo sapiens
ctttctgggctttctcc

SEQ ID NO: 6182094 - DNA, 19 bp, Homo sapiens
ctttctggggcctaataaa

SEQ ID NO: 6182095 - DNA, 22 bp, Homo sapiens
ctttctggggcctaataaaact

SEQ ID NO: 6182096 - DNA, 19 bp, Homo sapiens
ctttctggggtttttctgt

SEQ ID NO: 6182097 - DNA, 20 bp, Homo sapiens
ctttctggggtttttctgtt

SEQ ID NO: 6182098 - DNA, 16 bp, Homo sapiens
ctttctgggtgtgtcc

SEQ ID NO: 6182099 - DNA, 22 bp, Homo sapiens
ctttctggttgtttttgttctt

SEQ ID NO: 6182100 - DNA, 14 bp, Homo sapiens
ctttctgtaaacag

SEQ ID NO: 6182101 - DNA, 13 bp, Homo sapiens
ctttctgtaaact

SEQ ID NO: 6182102 - DNA, 13 bp, Homo sapiens
ctttctgtatata

SEQ ID NO: 6182103 - DNA, 20 bp, Homo sapiens
ctttctgtatatactttttt

SEQ ID NO: 6182104 - DNA, 14 bp, Homo sapiens
ctttctgtatcaag

SEQ ID NO: 6182105 - DNA, 21 bp, Homo sapiens
ctttctgtatcaagcccctgt

SEQ ID NO: 6182106 - DNA, 19 bp, Homo sapiens
ctttctgtccttttggcac

SEQ ID NO: 6182107 - DNA, 22 bp, Homo sapiens
ctttctgtctaggttaaagcta

SEQ ID NO: 6182108 - DNA, 11 bp, Homo sapiens
ctttctgtctc

SEQ ID NO: 6182109 - DNA, 14 bp, Homo sapiens
ctttctgtctcaaa

SEQ ID NO: 6182110 - DNA, 14 bp, Homo sapiens
ctttctgtctccct

SEQ ID NO: 6182111 - DNA, 16 bp, Homo sapiens
ctttctgtgaaagcct

SEQ ID NO: 6182112 - DNA, 21 bp, Homo sapiens
ctttctgtgaaagccttaaga

SEQ ID NO: 6182113 - DNA, 20 bp, Homo sapiens
ctttctgtgcatgtgcaggt

SEQ ID NO: 6182114 - DNA, 15 bp, Homo sapiens
ctttctgtgcttgga

SEQ ID NO: 6182115 - DNA, 17 bp, Homo sapiens
ctttctgtgtggtgaaa

SEQ ID NO: 6182116 - DNA, 14 bp, Homo sapiens
ctttctgttaaaat

SEQ ID NO: 6182117 - DNA, 15 bp, Homo sapiens
ctttctgttcatctc

SEQ ID NO: 6182118 - DNA, 16 bp, Homo sapiens
ctttctgttcatctct

SEQ ID NO: 6182119 - DNA, 12 bp, Homo sapiens
ctttctgttcca

SEQ ID NO: 6182120 - DNA, 20 bp, Homo sapiens
ctttctgttccaaattcagt

SEQ ID NO: 6182121 - DNA, 22 bp, Homo sapiens
ctttctgttccaaattcagttt

SEQ ID NO: 6182122 - DNA, 13 bp, Homo sapiens
ctttctgttgcca

SEQ ID NO: 6182123 - DNA, 16 bp, Homo sapiens
ctttctgttgccacaa

SEQ ID NO: 6182124 - DNA, 15 bp, Homo sapiens
ctttctgttggtgta

SEQ ID NO: 6182125 - DNA, 23 bp, Homo sapiens
ctttctgtttcctggcctcagag

SEQ ID NO: 6182126 - DNA, 14 bp, Homo sapiens
ctttctgttttgtt

SEQ ID NO: 6182127 - DNA, 22 bp, Homo sapiens
ctttctgttttttttttttgta

SEQ ID NO: 6182128 - DNA, 20 bp, Homo sapiens
ctttcttaatagaaagtcag

SEQ ID NO: 6182129 - DNA, 13 bp, Homo sapiens
ctttcttaatttt

SEQ ID NO: 6182130 - DNA, 19 bp, Homo sapiens
ctttcttaattttgtcttt

SEQ ID NO: 6182131 - DNA, 22 bp, Homo sapiens
ctttcttattcagtgaaaaaga

SEQ ID NO: 6182132 - DNA, 17 bp, Homo sapiens
ctttcttattttgtaat

SEQ ID NO: 6182133 - DNA, 19 bp, Homo sapiens
ctttcttattttgtaataa

SEQ ID NO: 6182134 - DNA, 15 bp, Homo sapiens
ctttcttcaatacaa

SEQ ID NO: 6182135 - DNA, 22 bp, Homo sapiens
ctttcttcaatacaaaaagcca

SEQ ID NO: 6182136 - DNA, 16 bp, Homo sapiens
ctttcttcaattaatg

SEQ ID NO: 6182137 - DNA, 18 bp, Homo sapiens
ctttcttcaattaatgga

SEQ ID NO: 6182138 - DNA, 13 bp, Homo sapiens
ctttcttcaccaa

SEQ ID NO: 6182139 - DNA, 17 bp, Homo sapiens
ctttcttcactctggct

SEQ ID NO: 6182140 - DNA, 19 bp, Homo sapiens
ctttcttcactctggcttc

SEQ ID NO: 6182141 - DNA, 22 bp, Homo sapiens
ctttcttcactctggcttcaaa

SEQ ID NO: 6182142 - DNA, 16 bp, Homo sapiens
ctttcttcactgcaga

SEQ ID NO: 6182143 - DNA, 20 bp, Homo sapiens
ctttcttcagctgccagtgt

SEQ ID NO: 6182144 - DNA, 13 bp, Homo sapiens
ctttcttccaaac

SEQ ID NO: 6182145 - DNA, 17 bp, Homo sapiens
ctttcttccccaccctg

SEQ ID NO: 6182146 - DNA, 23 bp, Homo sapiens
ctttcttcccgtgtgtatttcta

SEQ ID NO: 6182147 - DNA, 21 bp, Homo sapiens
ctttcttccctcgtgacagtg

SEQ ID NO: 6182148 - DNA, 11 bp, Homo sapiens
ctttcttcctc

SEQ ID NO: 6182149 - DNA, 15 bp, Homo sapiens
ctttcttcctccagt

SEQ ID NO: 6182150 - DNA, 15 bp, Homo sapiens
ctttcttcctctgct

SEQ ID NO: 6182151 - DNA, 16 bp, Homo sapiens
ctttcttcctctgctg

SEQ ID NO: 6182152 - DNA, 16 bp, Homo sapiens
ctttcttcctcttctt

SEQ ID NO: 6182153 - DNA, 14 bp, Homo sapiens
ctttcttcctgcat

SEQ ID NO: 6182154 - DNA, 16 bp, Homo sapiens
ctttcttccttccttt

SEQ ID NO: 6182155 - DNA, 21 bp, Homo sapiens
ctttcttccttcctttctctc

SEQ ID NO: 6182156 - DNA, 15 bp, Homo sapiens
ctttcttccttggcc

SEQ ID NO: 6182157 - DNA, 19 bp, Homo sapiens
ctttcttcctttcttcctt

SEQ ID NO: 6182158 - DNA, 13 bp, Homo sapiens
ctttcttctgccc

SEQ ID NO: 6182159 - DNA, 14 bp, Homo sapiens
ctttcttctgtgtt

SEQ ID NO: 6182160 - DNA, 17 bp, Homo sapiens
ctttcttctgtgttaat

SEQ ID NO: 6182161 - DNA, 16 bp, Homo sapiens
ctttcttcttccacac

SEQ ID NO: 6182162 - DNA, 14 bp, Homo sapiens
ctttcttgaaattg

SEQ ID NO: 6182163 - DNA, 15 bp, Homo sapiens
ctttcttgaaattga

SEQ ID NO: 6182164 - DNA, 12 bp, Homo sapiens
ctttcttgacaa

SEQ ID NO: 6182165 - DNA, 21 bp, Homo sapiens
ctttcttgatcaacatctttt

SEQ ID NO: 6182166 - DNA, 13 bp, Homo sapiens
ctttcttgctccc

SEQ ID NO: 6182167 - DNA, 15 bp, Homo sapiens
ctttcttgctccctg

SEQ ID NO: 6182168 - DNA, 19 bp, Homo sapiens
ctttcttgctccctgactg

SEQ ID NO: 6182169 - DNA, 21 bp, Homo sapiens
ctttcttgctggttgtcattt

SEQ ID NO: 6182170 - DNA, 11 bp, Homo sapiens
ctttcttggga

SEQ ID NO: 6182171 - DNA, 17 bp, Homo sapiens
ctttcttggtgcattcg

SEQ ID NO: 6182172 - DNA, 13 bp, Homo sapiens
ctttcttgtcttt

SEQ ID NO: 6182173 - DNA, 14 bp, Homo sapiens
ctttcttgtttctt

SEQ ID NO: 6182174 - DNA, 22 bp, Homo sapiens
ctttcttgtttgtcagcatctg

SEQ ID NO: 6182175 - DNA, 15 bp, Homo sapiens
ctttctttaaatgtt

SEQ ID NO: 6182176 - DNA, 18 bp, Homo sapiens
ctttctttacctgagacc

SEQ ID NO: 6182177 - DNA, 16 bp, Homo sapiens
ctttctttactccttt

SEQ ID NO: 6182178 - DNA, 23 bp, Homo sapiens
ctttctttaggaaagagaagctt

SEQ ID NO: 6182179 - DNA, 16 bp, Homo sapiens
ctttctttcacaaaaa

SEQ ID NO: 6182180 - DNA, 12 bp, Homo sapiens
ctttctttccaa

SEQ ID NO: 6182181 - DNA, 14 bp, Homo sapiens
ctttctttccaaag

SEQ ID NO: 6182182 - DNA, 12 bp, Homo sapiens
ctttctttccct

SEQ ID NO: 6182183 - DNA, 13 bp, Homo sapiens
ctttctttctcct

SEQ ID NO: 6182184 - DNA, 15 bp, Homo sapiens
ctttctttcttagaa

SEQ ID NO: 6182185 - DNA, 13 bp, Homo sapiens
ctttctttctttt

SEQ ID NO: 6182186 - DNA, 18 bp, Homo sapiens
ctttctttgcaacagcag

SEQ ID NO: 6182187 - DNA, 21 bp, Homo sapiens
ctttctttgcaacagcagtgt

SEQ ID NO: 6182188 - DNA, 11 bp, Homo sapiens
ctttctttgct

SEQ ID NO: 6182189 - DNA, 18 bp, Homo sapiens
ctttctttgctgtttgca

SEQ ID NO: 6182190 - DNA, 23 bp, Homo sapiens
ctttctttggcctacattcttta

SEQ ID NO: 6182191 - DNA, 20 bp, Homo sapiens
ctttctttggggaaaaattc

SEQ ID NO: 6182192 - DNA, 19 bp, Homo sapiens
ctttctttggtaggtaaat

SEQ ID NO: 6182193 - DNA, 18 bp, Homo sapiens
ctttctttggtgcctttc

SEQ ID NO: 6182194 - DNA, 23 bp, Homo sapiens
ctttctttggtgcctttcctgtt

SEQ ID NO: 6182195 - DNA, 18 bp, Homo sapiens
ctttctttgtcattcagt

SEQ ID NO: 6182196 - DNA, 18 bp, Homo sapiens
ctttctttgtttggctgg

SEQ ID NO: 6182197 - DNA, 21 bp, Homo sapiens
ctttcttttcgccgtggctgc

SEQ ID NO: 6182198 - DNA, 14 bp, Homo sapiens
ctttcttttctctg

SEQ ID NO: 6182199 - DNA, 22 bp, Homo sapiens
ctttcttttctggaatgtaatc

SEQ ID NO: 6182200 - DNA, 12 bp, Homo sapiens
ctttcttttctt

SEQ ID NO: 6182201 - DNA, 18 bp, Homo sapiens
ctttcttttgattcttcc

SEQ ID NO: 6182202 - DNA, 21 bp, Homo sapiens
ctttcttttgtattaaaaaaa

SEQ ID NO: 6182203 - DNA, 14 bp, Homo sapiens
ctttcttttgtgca

SEQ ID NO: 6182204 - DNA, 15 bp, Homo sapiens
ctttcttttgtgcat

SEQ ID NO: 6182205 - DNA, 18 bp, Homo sapiens
ctttcttttgtgcatatg

SEQ ID NO: 6182206 - DNA, 21 bp, Homo sapiens
ctttctttttccttcataatt

SEQ ID NO: 6182207 - DNA, 13 bp, Homo sapiens
ctttctttttctg

SEQ ID NO: 6182208 - DNA, 20 bp, Homo sapiens
ctttctttttctggaaattt

SEQ ID NO: 6182209 - DNA, 14 bp, Homo sapiens
ctttctttttctgt

SEQ ID NO: 6182210 - DNA, 21 bp, Homo sapiens
ctttctttttctgtctctctt

SEQ ID NO: 6182211 - DNA, 15 bp, Homo sapiens
ctttctttttcttct

SEQ ID NO: 6182212 - DNA, 16 bp, Homo sapiens
ctttctttttcttctt

SEQ ID NO: 6182213 - DNA, 22 bp, Homo sapiens
ctttctttttgtagctggggct

SEQ ID NO: 6182214 - DNA, 23 bp, Homo sapiens
ctttcttttttggccatctgctc

SEQ ID NO: 6182215 - DNA, 19 bp, Homo sapiens
ctttctttttttccccccc

SEQ ID NO: 6182216 - DNA, 15 bp, Homo sapiens
ctttgaaaaaaaata

SEQ ID NO: 6182217 - DNA, 22 bp, Homo sapiens
ctttgaaaaaaagtttctattt

SEQ ID NO: 6182218 - DNA, 17 bp, Homo sapiens
ctttgaaaacaattcag

SEQ ID NO: 6182219 - DNA, 23 bp, Homo sapiens
ctttgaaaacaattcagtggtct

SEQ ID NO: 6182220 - DNA, 19 bp, Homo sapiens
ctttgaaaacaccagctgt

SEQ ID NO: 6182221 - DNA, 23 bp, Homo sapiens
ctttgaaaacaccagctgtatat

SEQ ID NO: 6182222 - DNA, 19 bp, Homo sapiens
ctttgaaaactcatacagt

SEQ ID NO: 6182223 - DNA, 14 bp, Homo sapiens
ctttgaaaactgaa

SEQ ID NO: 6182224 - DNA, 12 bp, Homo sapiens
ctttgaaaagaa

SEQ ID NO: 6182225 - DNA, 18 bp, Homo sapiens
ctttgaaaagttggaagg

SEQ ID NO: 6182226 - DNA, 20 bp, Homo sapiens
ctttgaaaagttggaaggat

SEQ ID NO: 6182227 - DNA, 16 bp, Homo sapiens
ctttgaaaatatatac

SEQ ID NO: 6182228 - DNA, 22 bp, Homo sapiens
ctttgaaacaagataactgaga

SEQ ID NO: 6182229 - DNA, 13 bp, Homo sapiens
ctttgaaacagaa

SEQ ID NO: 6182230 - DNA, 20 bp, Homo sapiens
ctttgaaacctgctctgtag

SEQ ID NO: 6182231 - DNA, 19 bp, Homo sapiens
ctttgaaacttgcaacttt

SEQ ID NO: 6182232 - DNA, 20 bp, Homo sapiens
ctttgaaagaagcaagacac

SEQ ID NO: 6182233 - DNA, 20 bp, Homo sapiens
ctttgaaagccccagaaatc

SEQ ID NO: 6182234 - DNA, 20 bp, Homo sapiens
ctttgaaaggttagagaata

SEQ ID NO: 6182235 - DNA, 15 bp, Homo sapiens
ctttgaaatacctca

SEQ ID NO: 6182236 - DNA, 20 bp, Homo sapiens
ctttgaaatacctcatgttt

SEQ ID NO: 6182237 - DNA, 21 bp, Homo sapiens
ctttgaaatacctcatgttta

SEQ ID NO: 6182238 - DNA, 20 bp, Homo sapiens
ctttgaaatatgcatgtact

SEQ ID NO: 6182239 - DNA, 23 bp, Homo sapiens
ctttgaaatgtgtttctgtataa

SEQ ID NO: 6182240 - DNA, 20 bp, Homo sapiens
ctttgaaattatgtaaatta

SEQ ID NO: 6182241 - DNA, 21 bp, Homo sapiens
ctggggcagcactccccagag

SEQ ID NO: 6182242 - DNA, 18 bp, Homo sapiens
ctggggcaggctctctcc

SEQ ID NO: 6182243 - DNA, 18 bp, Homo sapiens
ctggggcaggctgcttca

SEQ ID NO: 6182244 - DNA, 15 bp, Homo sapiens
ctggggcaggctggg

SEQ ID NO: 6182245 - DNA, 18 bp, Homo sapiens
ctggggcaggctgggcca

SEQ ID NO: 6182246 - DNA, 14 bp, Homo sapiens
ctggggcaggggtg

SEQ ID NO: 6182247 - DNA, 14 bp, Homo sapiens
ctggggcagggtgg

SEQ ID NO: 6182248 - DNA, 21 bp, Homo sapiens
ctggggcagggtggggggcca

SEQ ID NO: 6182249 - DNA, 22 bp, Homo sapiens
ctggggcatccaccttcctgcc

SEQ ID NO: 6182250 - DNA, 17 bp, Homo sapiens
ctggggcatggaaggca

SEQ ID NO: 6182251 - DNA, 17 bp, Homo sapiens
ctggggcatgtgtgcct

SEQ ID NO: 6182252 - DNA, 19 bp, Homo sapiens
ctggggcatgtgtgcctgt

SEQ ID NO: 6182253 - DNA, 18 bp, Homo sapiens
ctggggccaaataaagtc

SEQ ID NO: 6182254 - DNA, 19 bp, Homo sapiens
ctggggccaccatccctga

SEQ ID NO: 6182255 - DNA, 17 bp, Homo sapiens
ctggggccacctttgtg

SEQ ID NO: 6182256 - DNA, 23 bp, Homo sapiens
ctggggccacctttgtgcagctt

SEQ ID NO: 6182257 - DNA, 16 bp, Homo sapiens
ctggggccaggcccca

SEQ ID NO: 6182258 - DNA, 14 bp, Homo sapiens
ctggggccaggccg

SEQ ID NO: 6182259 - DNA, 13 bp, Homo sapiens
ctggggcccaagt

SEQ ID NO: 6182260 - DNA, 19 bp, Homo sapiens
ctggggcccaggaagccca

SEQ ID NO: 6182261 - DNA, 13 bp, Homo sapiens
ctggggccccacc

SEQ ID NO: 6182262 - DNA, 23 bp, Homo sapiens
ctggggcccctcccctcccgaac

SEQ ID NO: 6182263 - DNA, 15 bp, Homo sapiens
ctggggcccctcgac

SEQ ID NO: 6182264 - DNA, 12 bp, Homo sapiens
ctggggcccctt

SEQ ID NO: 6182265 - DNA, 15 bp, Homo sapiens
ctggggcccgcctgc

SEQ ID NO: 6182266 - DNA, 20 bp, Homo sapiens
ctggggcccgcctgccacct

SEQ ID NO: 6182267 - DNA, 21 bp, Homo sapiens
ctggggcccgcctgccacctc

SEQ ID NO: 6182268 - DNA, 14 bp, Homo sapiens
ctggggccctgggc

SEQ ID NO: 6182269 - DNA, 17 bp, Homo sapiens
ctggggccctgggcctc

SEQ ID NO: 6182270 - DNA, 18 bp, Homo sapiens
ctggggccctgggcctca

SEQ ID NO: 6182271 - DNA, 19 bp, Homo sapiens
ctggggccctgggcctcag

SEQ ID NO: 6182272 - DNA, 22 bp, Homo sapiens
ctggggccgaggggccagggtg

SEQ ID NO: 6182273 - DNA, 13 bp, Homo sapiens
ctggggccgccac

SEQ ID NO: 6182274 - DNA, 12 bp, Homo sapiens
ctggggccgcct

SEQ ID NO: 6182275 - DNA, 20 bp, Homo sapiens
ctggggccgcctgccctgcc

SEQ ID NO: 6182276 - DNA, 19 bp, Homo sapiens
ctggggccggcggggccca

SEQ ID NO: 6182277 - DNA, 16 bp, Homo sapiens
ctggggccggggctga

SEQ ID NO: 6182278 - DNA, 20 bp, Homo sapiens
ctggggccggtagaggctcc

SEQ ID NO: 6182279 - DNA, 22 bp, Homo sapiens
ctggggccggttttcctcagct

SEQ ID NO: 6182280 - DNA, 22 bp, Homo sapiens
ctggggcctagcgatctctcct

SEQ ID NO: 6182281 - DNA, 24 bp, Homo sapiens
ctggggcctagcgatctctcctgg

SEQ ID NO: 6182282 - DNA, 17 bp, Homo sapiens
ctggggcctatcagtgt

SEQ ID NO: 6182283 - DNA, 21 bp, Homo sapiens
ctggggcctatcagtgtgccc

SEQ ID NO: 6182284 - DNA, 14 bp, Homo sapiens
ctggggcctcagac

SEQ ID NO: 6182285 - DNA, 19 bp, Homo sapiens
ctggggcctcagaccccct

SEQ ID NO: 6182286 - DNA, 14 bp, Homo sapiens
ctggggcctcagcc

SEQ ID NO: 6182287 - DNA, 22 bp, Homo sapiens
ctggggcctccagaagctgctc

SEQ ID NO: 6182288 - DNA, 20 bp, Homo sapiens
ctggggcctcggagcctcat

SEQ ID NO: 6182289 - DNA, 12 bp, Homo sapiens
ctggggcctctt

SEQ ID NO: 6182290 - DNA, 13 bp, Homo sapiens
ctggggcctgaga

SEQ ID NO: 6182291 - DNA, 16 bp, Homo sapiens
ctggggcctgagagaa

SEQ ID NO: 6182292 - DNA, 17 bp, Homo sapiens
ctggggcctgagagaat

SEQ ID NO: 6182293 - DNA, 11 bp, Homo sapiens
ctggggcctgg

SEQ ID NO: 6182294 - DNA, 19 bp, Homo sapiens
ctggggcctggagaggggc

SEQ ID NO: 6182295 - DNA, 18 bp, Homo sapiens
ctggggcctggcagggag

SEQ ID NO: 6182296 - DNA, 14 bp, Homo sapiens
ctggggcctggcct

SEQ ID NO: 6182297 - DNA, 23 bp, Homo sapiens
ctggggcctggcctatttaagcc

SEQ ID NO: 6182298 - DNA, 13 bp, Homo sapiens
ctggggcctggga

SEQ ID NO: 6182299 - DNA, 14 bp, Homo sapiens
ctggggcctgggcc

SEQ ID NO: 6182300 - DNA, 20 bp, Homo sapiens
ctggggcctgtactgcctgc

SEQ ID NO: 6182301 - DNA, 18 bp, Homo sapiens
ctggggccttcctggctt

SEQ ID NO: 6182302 - DNA, 22 bp, Homo sapiens
ctggggcgcgatgtcaaaggtc

SEQ ID NO: 6182303 - DNA, 19 bp, Homo sapiens
ctggggcggcatgaaccct

SEQ ID NO: 6182304 - DNA, 16 bp, Homo sapiens
ctggggcggggcccag

SEQ ID NO: 6182305 - DNA, 18 bp, Homo sapiens
ctggggcggggcccagga

SEQ ID NO: 6182306 - DNA, 19 bp, Homo sapiens
ctggggcggggcccaggag

SEQ ID NO: 6182307 - DNA, 18 bp, Homo sapiens
ctggggcggggctggagg

SEQ ID NO: 6182308 - DNA, 21 bp, Homo sapiens
ctggggcggggctggaggtgg

SEQ ID NO: 6182309 - DNA, 21 bp, Homo sapiens
ctggggcgtttcctactgcgc

SEQ ID NO: 6182310 - DNA, 18 bp, Homo sapiens
ctggggctagggggagcc

SEQ ID NO: 6182311 - DNA, 13 bp, Homo sapiens
ctggggctcagag

SEQ ID NO: 6182312 - DNA, 17 bp, Homo sapiens
ctggggctcagagccgg

SEQ ID NO: 6182313 - DNA, 21 bp, Homo sapiens
ctggggctcagccctgagctg

SEQ ID NO: 6182314 - DNA, 19 bp, Homo sapiens
ctggggctccctctctggt

SEQ ID NO: 6182315 - DNA, 19 bp, Homo sapiens
ctggggctccctgcctgga

SEQ ID NO: 6182316 - DNA, 16 bp, Homo sapiens
ctggggctccgaaatt

SEQ ID NO: 6182317 - DNA, 20 bp, Homo sapiens
ctggggctcctttctccagc

SEQ ID NO: 6182318 - DNA, 20 bp, Homo sapiens
ctggggctctaacgcctgag

SEQ ID NO: 6182319 - DNA, 14 bp, Homo sapiens
ctggggctctgtgc

SEQ ID NO: 6182320 - DNA, 17 bp, Homo sapiens
ctggggctctgtgcagg

SEQ ID NO: 6182321 - DNA, 21 bp, Homo sapiens
ctggggctgacacccaggccc

SEQ ID NO: 6182322 - DNA, 14 bp, Homo sapiens
ctggggctgacctt

SEQ ID NO: 6182323 - DNA, 19 bp, Homo sapiens
ctggggctgagagtggggc

SEQ ID NO: 6182324 - DNA, 20 bp, Homo sapiens
ctggggctgagtgcagaggc

SEQ ID NO: 6182325 - DNA, 23 bp, Homo sapiens
ctggggctgagtgcagaggctga

SEQ ID NO: 6182326 - DNA, 21 bp, Homo sapiens
ctggggctgatctcagggaag

SEQ ID NO: 6182327 - DNA, 22 bp, Homo sapiens
ctggggctgatctcagggaagc

SEQ ID NO: 6182328 - DNA, 23 bp, Homo sapiens
ctggggctgatctcagggaagcc

SEQ ID NO: 6182329 - DNA, 17 bp, Homo sapiens
ctggggctgccagcctg

SEQ ID NO: 6182330 - DNA, 18 bp, Homo sapiens
ctggggctgccagcctga

SEQ ID NO: 6182331 - DNA, 13 bp, Homo sapiens
ctggggctgccct

SEQ ID NO: 6182332 - DNA, 14 bp, Homo sapiens
ctggggctgccctc

SEQ ID NO: 6182333 - DNA, 18 bp, Homo sapiens
ctggggctgcgcagggct

SEQ ID NO: 6182334 - DNA, 17 bp, Homo sapiens
ctggggctgcttaggaa

SEQ ID NO: 6182335 - DNA, 15 bp, Homo sapiens
ctggggctggcacaa

SEQ ID NO: 6182336 - DNA, 22 bp, Homo sapiens
ctggggctggcaccagcaggca

SEQ ID NO: 6182337 - DNA, 15 bp, Homo sapiens
ctggggctggcctcc

SEQ ID NO: 6182338 - DNA, 14 bp, Homo sapiens
ctggggctgggcct

SEQ ID NO: 6182339 - DNA, 20 bp, Homo sapiens
ctggggctgggcctgagcct

SEQ ID NO: 6182340 - DNA, 12 bp, Homo sapiens
ctggggctgggg

SEQ ID NO: 6182341 - DNA, 15 bp, Homo sapiens
ctggggctggtcctg

SEQ ID NO: 6182342 - DNA, 17 bp, Homo sapiens
ctggggctggtcctggg

SEQ ID NO: 6182343 - DNA, 12 bp, Homo sapiens
ctggggctggtg

SEQ ID NO: 6182344 - DNA, 19 bp, Homo sapiens
ctggggctgttgaagtcac

SEQ ID NO: 6182345 - DNA, 19 bp, Homo sapiens
ctggggcttatgggtggct

SEQ ID NO: 6182346 - DNA, 18 bp, Homo sapiens
ctggggcttcaccagtct

SEQ ID NO: 6182347 - DNA, 20 bp, Homo sapiens
ctggggcttcaccagtctgt

SEQ ID NO: 6182348 - DNA, 14 bp, Homo sapiens
ctggggcttgccag

SEQ ID NO: 6182349 - DNA, 19 bp, Homo sapiens
ctggggcttgtcctgtgct

SEQ ID NO: 6182350 - DNA, 18 bp, Homo sapiens
ctggggctttgccttgca

SEQ ID NO: 6182351 - DNA, 18 bp, Homo sapiens
ctgggggaacagatgcta

SEQ ID NO: 6182352 - DNA, 15 bp, Homo sapiens
ctgggggaagaagct

SEQ ID NO: 6182353 - DNA, 14 bp, Homo sapiens
ctgggggaagccct

SEQ ID NO: 6182354 - DNA, 16 bp, Homo sapiens
ctgggggaagccctgg

SEQ ID NO: 6182355 - DNA, 21 bp, Homo sapiens
ctgggggaaggatgcagaagg

SEQ ID NO: 6182356 - DNA, 20 bp, Homo sapiens
ctgggggaatgagcccagag

SEQ ID NO: 6182357 - DNA, 14 bp, Homo sapiens
ctgggggactcctt

SEQ ID NO: 6182358 - DNA, 22 bp, Homo sapiens
ctgggggactgctttcagtgcc

SEQ ID NO: 6182359 - DNA, 12 bp, Homo sapiens
ctgggggagaga

SEQ ID NO: 6182360 - DNA, 13 bp, Homo sapiens
ctgggggaggcag

SEQ ID NO: 6182361 - DNA, 14 bp, Homo sapiens
ctgggggaggcagg

SEQ ID NO: 6182362 - DNA, 18 bp, Homo sapiens
ctgggggaggcagggctg

SEQ ID NO: 6182363 - DNA, 23 bp, Homo sapiens
ctgggggaggcttccagctcagt

SEQ ID NO: 6182364 - DNA, 19 bp, Homo sapiens
ctgggggagggactgctga

SEQ ID NO: 6182365 - DNA, 22 bp, Homo sapiens
ctgggggagggactgctgaccc

SEQ ID NO: 6182366 - DNA, 24 bp, Homo sapiens
ctgggggagggactgctgacccac

SEQ ID NO: 6182367 - DNA, 18 bp, Homo sapiens
ctgggggagttttcctct

SEQ ID NO: 6182368 - DNA, 17 bp, Homo sapiens
ctgggggataccagctg

SEQ ID NO: 6182369 - DNA, 13 bp, Homo sapiens
ctgggggatatta

SEQ ID NO: 6182370 - DNA, 17 bp, Homo sapiens
ctgggggatgcaaataa

SEQ ID NO: 6182371 - DNA, 13 bp, Homo sapiens
ctgggggatgggc

SEQ ID NO: 6182372 - DNA, 18 bp, Homo sapiens
ctgggggatgggcctgag

SEQ ID NO: 6182373 - DNA, 18 bp, Homo sapiens
ctgggggattcctgagct

SEQ ID NO: 6182374 - DNA, 22 bp, Homo sapiens
ctgggggattcctgagctggcc

SEQ ID NO: 6182375 - DNA, 13 bp, Homo sapiens
ctgggggcaaagg

SEQ ID NO: 6182376 - DNA, 21 bp, Homo sapiens
ctgggggcaaaggtttgaaga

SEQ ID NO: 6182377 - DNA, 17 bp, Homo sapiens
ctgggggcaactggcca

SEQ ID NO: 6182378 - DNA, 21 bp, Homo sapiens
ctgggggcaattgacttcctc

SEQ ID NO: 6182379 - DNA, 22 bp, Homo sapiens
ctgggggcacaagactgacgcc

SEQ ID NO: 6182380 - DNA, 14 bp, Homo sapiens
ctgggggcacagct

SEQ ID NO: 6182381 - DNA, 16 bp, Homo sapiens
ctgggggcacagctgt

SEQ ID NO: 6182382 - DNA, 18 bp, Homo sapiens
ctgggggcacagctgtct

SEQ ID NO: 6182383 - DNA, 23 bp, Homo sapiens
ctgggggcacagctgtctgccag

SEQ ID NO: 6182384 - DNA, 19 bp, Homo sapiens
ctgggggcacaggaggcag

SEQ ID NO: 6182385 - DNA, 21 bp, Homo sapiens
ctgggggcagctgtcctgaac

SEQ ID NO: 6182386 - DNA, 12 bp, Homo sapiens
ctgggggcagtg

SEQ ID NO: 6182387 - DNA, 21 bp, Homo sapiens
ctgggggcagtgactggcagg

SEQ ID NO: 6182388 - DNA, 17 bp, Homo sapiens
ctgggggcatcctgctt

SEQ ID NO: 6182389 - DNA, 20 bp, Homo sapiens
ctgggggcatcctgcttcct

SEQ ID NO: 6182390 - DNA, 12 bp, Homo sapiens
ctgggggccagc

SEQ ID NO: 6182391 - DNA, 17 bp, Homo sapiens
ctgggggccagctccag

SEQ ID NO: 6182392 - DNA, 14 bp, Homo sapiens
ctgggggccagctg

SEQ ID NO: 6182393 - DNA, 18 bp, Homo sapiens
ctgggggccagctggtgc

SEQ ID NO: 6182394 - DNA, 22 bp, Homo sapiens
ctgggggccagggctggatgga

SEQ ID NO: 6182395 - DNA, 17 bp, Homo sapiens
ctgggggccagtgggga

SEQ ID NO: 6182396 - DNA, 16 bp, Homo sapiens
ctgggggccatgagct

SEQ ID NO: 6182397 - DNA, 22 bp, Homo sapiens
ctgggggccatgagctccagac

SEQ ID NO: 6182398 - DNA, 15 bp, Homo sapiens
ctgggggcccgacag

SEQ ID NO: 6182399 - DNA, 13 bp, Homo sapiens
ctgggggcctcag

SEQ ID NO: 6182400 - DNA, 13 bp, Homo sapiens
ctgggggcctctg

SEQ ID NO: 6182401 - DNA, 16 bp, Homo sapiens
ctgggggcctctgcct

SEQ ID NO: 6182402 - DNA, 19 bp, Homo sapiens
ctgggggcctctgcctcca

SEQ ID NO: 6182403 - DNA, 16 bp, Homo sapiens
ctgggggcctcttctg

SEQ ID NO: 6182404 - DNA, 15 bp, Homo sapiens
ctgggggcctgacct

SEQ ID NO: 6182405 - DNA, 14 bp, Homo sapiens
ctgggggcctggct

SEQ ID NO: 6182406 - DNA, 23 bp, Homo sapiens
ctgggggcctggctggctgaggg

SEQ ID NO: 6182407 - DNA, 15 bp, Homo sapiens
ctgggggcgggactc

SEQ ID NO: 6182408 - DNA, 18 bp, Homo sapiens
ctgggggcgggactcctc

SEQ ID NO: 6182409 - DNA, 18 bp, Homo sapiens
ctgggggcgggggagcca

SEQ ID NO: 6182410 - DNA, 19 bp, Homo sapiens
ctgggggcgggggagccaa

SEQ ID NO: 6182411 - DNA, 18 bp, Homo sapiens
ctgggggctagcagaagt

SEQ ID NO: 6182412 - DNA, 15 bp, Homo sapiens
ctgggggctatgtat

SEQ ID NO: 6182413 - DNA, 14 bp, Homo sapiens
ctgggggctcccct

SEQ ID NO: 6182414 - DNA, 20 bp, Homo sapiens
ctgggggctctggccaaggg

SEQ ID NO: 6182415 - DNA, 23 bp, Homo sapiens
ctgggggctctggccaagggcca

SEQ ID NO: 6182416 - DNA, 22 bp, Homo sapiens
ctgggggctctgttacactaat

SEQ ID NO: 6182417 - DNA, 16 bp, Homo sapiens
ctgggggctgcagggc

SEQ ID NO: 6182418 - DNA, 20 bp, Homo sapiens
ctgggggctgccgagccacc

SEQ ID NO: 6182419 - DNA, 18 bp, Homo sapiens
ctttgaacaattgtgttt

SEQ ID NO: 6182420 - DNA, 19 bp, Homo sapiens
ctttgaacattaatgttga

SEQ ID NO: 6182421 - DNA, 18 bp, Homo sapiens
ctttgaacgtgccagcag

SEQ ID NO: 6182422 - DNA, 19 bp, Homo sapiens
ctttgaacgtgcttctttg

SEQ ID NO: 6182423 - DNA, 20 bp, Homo sapiens
ctttgaacgtgcttctttgt

SEQ ID NO: 6182424 - DNA, 22 bp, Homo sapiens
ctttgaacgtgcttctttgtaa

SEQ ID NO: 6182425 - DNA, 23 bp, Homo sapiens
ctttgaactagttttactttgaa

SEQ ID NO: 6182426 - DNA, 19 bp, Homo sapiens
ctttgaactcctcaagggc

SEQ ID NO: 6182427 - DNA, 20 bp, Homo sapiens
ctttgaactcctcaagggca

SEQ ID NO: 6182428 - DNA, 16 bp, Homo sapiens
ctttgaagaaaagaaa

SEQ ID NO: 6182429 - DNA, 16 bp, Homo sapiens
ctttgaagaaggaatc

SEQ ID NO: 6182430 - DNA, 18 bp, Homo sapiens
ctttgaagaaggcaaggc

SEQ ID NO: 6182431 - DNA, 23 bp, Homo sapiens
ctttgaagagatgacaacaaatt

SEQ ID NO: 6182432 - DNA, 23 bp, Homo sapiens
ctttgaagagatgagcagtgagt

SEQ ID NO: 6182433 - DNA, 18 bp, Homo sapiens
ctttgaagaggaaaatga

SEQ ID NO: 6182434 - DNA, 22 bp, Homo sapiens
ctttgaagaggaaaatgaataa

SEQ ID NO: 6182435 - DNA, 17 bp, Homo sapiens
ctttgaagatagtttta

SEQ ID NO: 6182436 - DNA, 15 bp, Homo sapiens
ctttgaagcaaatac

SEQ ID NO: 6182437 - DNA, 14 bp, Homo sapiens
ctttgaagcagttg

SEQ ID NO: 6182438 - DNA, 13 bp, Homo sapiens
ctttgaagggcaa

SEQ ID NO: 6182439 - DNA, 23 bp, Homo sapiens
ctttgaaggtaataaatacacag

SEQ ID NO: 6182440 - DNA, 13 bp, Homo sapiens
ctttgaagtagct

SEQ ID NO: 6182441 - DNA, 16 bp, Homo sapiens
ctttgaagtcatacca

SEQ ID NO: 6182442 - DNA, 11 bp, Homo sapiens
ctttgaagtta

SEQ ID NO: 6182443 - DNA, 17 bp, Homo sapiens
ctttgaataaaaatgca

SEQ ID NO: 6182444 - DNA, 18 bp, Homo sapiens
ctttgaataaaaatgcac

SEQ ID NO: 6182445 - DNA, 17 bp, Homo sapiens
ctttgaataaagaatac

SEQ ID NO: 6182446 - DNA, 14 bp, Homo sapiens
ctttgaataaagtc

SEQ ID NO: 6182447 - DNA, 15 bp, Homo sapiens
ctttgaataaagtct

SEQ ID NO: 6182448 - DNA, 14 bp, Homo sapiens
ctttgaataaatgt

SEQ ID NO: 6182449 - DNA, 21 bp, Homo sapiens
ctttgaatagaggccaaatta

SEQ ID NO: 6182450 - DNA, 18 bp, Homo sapiens
ctttgaatagtcctaaaa

SEQ ID NO: 6182451 - DNA, 23 bp, Homo sapiens
ctttgaatatgtagtatctatat

SEQ ID NO: 6182452 - DNA, 12 bp, Homo sapiens
ctttgaatattt

SEQ ID NO: 6182453 - DNA, 18 bp, Homo sapiens
ctttgaatcctctctctg

SEQ ID NO: 6182454 - DNA, 19 bp, Homo sapiens
ctttgaatcctctctctgt

SEQ ID NO: 6182455 - DNA, 23 bp, Homo sapiens
ctttgaatcctctctctgtgtta

SEQ ID NO: 6182456 - DNA, 15 bp, Homo sapiens
ctttgaatgcatgtg

SEQ ID NO: 6182457 - DNA, 16 bp, Homo sapiens
ctttgaatgcggccca

SEQ ID NO: 6182458 - DNA, 13 bp, Homo sapiens
ctttgaatgcttt

SEQ ID NO: 6182459 - DNA, 16 bp, Homo sapiens
ctttgaatgctttttg

SEQ ID NO: 6182460 - DNA, 20 bp, Homo sapiens
ctttgaatggtcttctgcca

SEQ ID NO: 6182461 - DNA, 15 bp, Homo sapiens
ctttgaatgtaacca

SEQ ID NO: 6182462 - DNA, 14 bp, Homo sapiens
ctttgaatgtattg

SEQ ID NO: 6182463 - DNA, 14 bp, Homo sapiens
ctttgaatgtgttt

SEQ ID NO: 6182464 - DNA, 20 bp, Homo sapiens
ctttgaatttatataaagta

SEQ ID NO: 6182465 - DNA, 21 bp, Homo sapiens
ctttgaatttatataaagtat

SEQ ID NO: 6182466 - DNA, 12 bp, Homo sapiens
ctttgaattttc

SEQ ID NO: 6182467 - DNA, 18 bp, Homo sapiens
ctttgaattttcatttta

SEQ ID NO: 6182468 - DNA, 20 bp, Homo sapiens
ctttgaattttcattttaca

SEQ ID NO: 6182469 - DNA, 17 bp, Homo sapiens
ctttgacaaaagtaaat

SEQ ID NO: 6182470 - DNA, 18 bp, Homo sapiens
ctttgacaaaagtaaatg

SEQ ID NO: 6182471 - DNA, 21 bp, Homo sapiens
ctttgacaaaatgactggctc

SEQ ID NO: 6182472 - DNA, 16 bp, Homo sapiens
ctttgacaaggaaaat

SEQ ID NO: 6182473 - DNA, 16 bp, Homo sapiens
ctttgacaattactca

SEQ ID NO: 6182474 - DNA, 21 bp, Homo sapiens
ctttgacaattactcaggttt

SEQ ID NO: 6182475 - DNA, 18 bp, Homo sapiens
ctttgacaattctgggtg

SEQ ID NO: 6182476 - DNA, 23 bp, Homo sapiens
ctttgacaattgggagctgccaa

SEQ ID NO: 6182477 - DNA, 19 bp, Homo sapiens
ctttgacacccaggctgga

SEQ ID NO: 6182478 - DNA, 15 bp, Homo sapiens
ctttgacatgaaaag

SEQ ID NO: 6182479 - DNA, 14 bp, Homo sapiens
ctttgacatttaat

SEQ ID NO: 6182480 - DNA, 18 bp, Homo sapiens
ctttgacatttaatttag

SEQ ID NO: 6182481 - DNA, 19 bp, Homo sapiens
ctttgaccagatctttctc

SEQ ID NO: 6182482 - DNA, 22 bp, Homo sapiens
ctttgaccagatctttctcttc

SEQ ID NO: 6182483 - DNA, 13 bp, Homo sapiens
ctttgacctctgc

SEQ ID NO: 6182484 - DNA, 14 bp, Homo sapiens
ctttgacctgcctc

SEQ ID NO: 6182485 - DNA, 16 bp, Homo sapiens
ctttgaccttccccaa

SEQ ID NO: 6182486 - DNA, 17 bp, Homo sapiens
ctttgacgccatcccag

SEQ ID NO: 6182487 - DNA, 18 bp, Homo sapiens
ctttgacgccatcccagc

SEQ ID NO: 6182488 - DNA, 22 bp, Homo sapiens
ctttgacgggaggcctcagttc

SEQ ID NO: 6182489 - DNA, 14 bp, Homo sapiens
ctttgacgggccag

SEQ ID NO: 6182490 - DNA, 17 bp, Homo sapiens
ctttgacgggccaggcc

SEQ ID NO: 6182491 - DNA, 19 bp, Homo sapiens
ctttgacgggccaggccct

SEQ ID NO: 6182492 - DNA, 20 bp, Homo sapiens
ctttgacgggccaggccctg

SEQ ID NO: 6182493 - DNA, 18 bp, Homo sapiens
ctttgacgtaattaaatc

SEQ ID NO: 6182494 - DNA, 18 bp, Homo sapiens
ctttgactataacaaaat

SEQ ID NO: 6182495 - DNA, 20 bp, Homo sapiens
ctttgactataacaaaatct

SEQ ID NO: 6182496 - DNA, 19 bp, Homo sapiens
ctttgactcacctgttact

SEQ ID NO: 6182497 - DNA, 17 bp, Homo sapiens
ctttgactcagaggctg

SEQ ID NO: 6182498 - DNA, 23 bp, Homo sapiens
ctttgactcaggagcctgtgaca

SEQ ID NO: 6182499 - DNA, 13 bp, Homo sapiens
ctttgactctggg

SEQ ID NO: 6182500 - DNA, 14 bp, Homo sapiens
ctttgactctgggg

SEQ ID NO: 6182501 - DNA, 15 bp, Homo sapiens
ctttgactctggggt

SEQ ID NO: 6182502 - DNA, 15 bp, Homo sapiens
ctttgactgtgattt

SEQ ID NO: 6182503 - DNA, 20 bp, Homo sapiens
ctttgactgtgctggagaat

SEQ ID NO: 6182504 - DNA, 21 bp, Homo sapiens
ctttgacttaggtgtgaagac

SEQ ID NO: 6182505 - DNA, 22 bp, Homo sapiens
ctttgactttatctcctgctct

SEQ ID NO: 6182506 - DNA, 14 bp, Homo sapiens
ctttgagaaagaaa

SEQ ID NO: 6182507 - DNA, 18 bp, Homo sapiens
ctttgagaaaggattaag

SEQ ID NO: 6182508 - DNA, 21 bp, Homo sapiens
ctttgagaaaggattaagata

SEQ ID NO: 6182509 - DNA, 23 bp, Homo sapiens
ctttgagaagaatgtttaataga

SEQ ID NO: 6182510 - DNA, 13 bp, Homo sapiens
ctttgagaagatg

SEQ ID NO: 6182511 - DNA, 19 bp, Homo sapiens
ctttgagaagccttcagct

SEQ ID NO: 6182512 - DNA, 12 bp, Homo sapiens
ctttgagaagct

SEQ ID NO: 6182513 - DNA, 15 bp, Homo sapiens
ctttgagaatattat

SEQ ID NO: 6182514 - DNA, 20 bp, Homo sapiens
ctttgagaatgtgattcctt

SEQ ID NO: 6182515 - DNA, 13 bp, Homo sapiens
ctttgagactgtt

SEQ ID NO: 6182516 - DNA, 15 bp, Homo sapiens
ctttgagactgttcc

SEQ ID NO: 6182517 - DNA, 22 bp, Homo sapiens
ctttgagagacgccactccctg

SEQ ID NO: 6182518 - DNA, 12 bp, Homo sapiens
ctttgagagaga

SEQ ID NO: 6182519 - DNA, 15 bp, Homo sapiens
ctttgagagagaaag

SEQ ID NO: 6182520 - DNA, 20 bp, Homo sapiens
ctttgagagagggggcactg

SEQ ID NO: 6182521 - DNA, 21 bp, Homo sapiens
ctttgagagagggggcactgt

SEQ ID NO: 6182522 - DNA, 23 bp, Homo sapiens
ctttgagagcctccaggttcctc

SEQ ID NO: 6182523 - DNA, 14 bp, Homo sapiens
ctttgagaggctga

SEQ ID NO: 6182524 - DNA, 20 bp, Homo sapiens
ctttgagagggctgaaggga

SEQ ID NO: 6182525 - DNA, 20 bp, Homo sapiens
ctttgagataatttaaccct

SEQ ID NO: 6182526 - DNA, 19 bp, Homo sapiens
ctttgagatagaagaactg

SEQ ID NO: 6182527 - DNA, 16 bp, Homo sapiens
ctttgagatctgggga

SEQ ID NO: 6182528 - DNA, 18 bp, Homo sapiens
ctttgagatctggggagg

SEQ ID NO: 6182529 - DNA, 20 bp, Homo sapiens
ctttgagatgcttctggctc

SEQ ID NO: 6182530 - DNA, 23 bp, Homo sapiens
ctttgagatgtgttcctcctgct

SEQ ID NO: 6182531 - DNA, 15 bp, Homo sapiens
ctttgagcaggttta

SEQ ID NO: 6182532 - DNA, 13 bp, Homo sapiens
ctttgagcatttt

SEQ ID NO: 6182533 - DNA, 19 bp, Homo sapiens
ctttgagcccattcttctg

SEQ ID NO: 6182534 - DNA, 20 bp, Homo sapiens
ctttgagcccattcttctgg

SEQ ID NO: 6182535 - DNA, 18 bp, Homo sapiens
ctttgagcctgcatcttc

SEQ ID NO: 6182536 - DNA, 24 bp, Homo sapiens
ctttgagcctgcatcttcttgcat

SEQ ID NO: 6182537 - DNA, 16 bp, Homo sapiens
ctttgagcttaagaat

SEQ ID NO: 6182538 - DNA, 12 bp, Homo sapiens
ctttgaggataa

SEQ ID NO: 6182539 - DNA, 16 bp, Homo sapiens
ctttgaggccgaagct

SEQ ID NO: 6182540 - DNA, 19 bp, Homo sapiens
ctttgaggccgaagctgct

SEQ ID NO: 6182541 - DNA, 16 bp, Homo sapiens
ctttgaggctttctaa

SEQ ID NO: 6182542 - DNA, 13 bp, Homo sapiens
ctttgagggactg

SEQ ID NO: 6182543 - DNA, 18 bp, Homo sapiens
ctttgagggtggaaggat

SEQ ID NO: 6182544 - DNA, 22 bp, Homo sapiens
ctttgagggtggaaggatggga

SEQ ID NO: 6182545 - DNA, 16 bp, Homo sapiens
ctttgaggtctaaaca

SEQ ID NO: 6182546 - DNA, 17 bp, Homo sapiens
ctttgaggtggaagagg

SEQ ID NO: 6182547 - DNA, 23 bp, Homo sapiens
ctttgaggttattttccgccaga

SEQ ID NO: 6182548 - DNA, 15 bp, Homo sapiens
ctttgaggttgcttt

SEQ ID NO: 6182549 - DNA, 22 bp, Homo sapiens
ctttgaggttttggtaattgta

SEQ ID NO: 6182550 - DNA, 21 bp, Homo sapiens
ctttgagtaccaaatccacaa

SEQ ID NO: 6182551 - DNA, 23 bp, Homo sapiens
ctttgagtagatccatttccatt

SEQ ID NO: 6182552 - DNA, 16 bp, Homo sapiens
ctttgagtccacgccc

SEQ ID NO: 6182553 - DNA, 13 bp, Homo sapiens
ctttgagtgatcc

SEQ ID NO: 6182554 - DNA, 22 bp, Homo sapiens
ctttgagtgtcttctaacttta

SEQ ID NO: 6182555 - DNA, 17 bp, Homo sapiens
ctttgagtttcctcagg

SEQ ID NO: 6182556 - DNA, 18 bp, Homo sapiens
ctttgagtttcctcaggc

SEQ ID NO: 6182557 - DNA, 14 bp, Homo sapiens
ctttgataaaataa

SEQ ID NO: 6182558 - DNA, 18 bp, Homo sapiens
ctttgataaaatatttta

SEQ ID NO: 6182559 - DNA, 20 bp, Homo sapiens
ctttgataaagtaaaaaagt

SEQ ID NO: 6182560 - DNA, 15 bp, Homo sapiens
ctttgataatgttaa

SEQ ID NO: 6182561 - DNA, 21 bp, Homo sapiens
ctttgataatgttaaatttgt

SEQ ID NO: 6182562 - DNA, 21 bp, Homo sapiens
ctttgatactaccagggtctc

SEQ ID NO: 6182563 - DNA, 14 bp, Homo sapiens
ctttgatagtgtaa

SEQ ID NO: 6182564 - DNA, 20 bp, Homo sapiens
ctttgatatgttgatgaaat

SEQ ID NO: 6182565 - DNA, 15 bp, Homo sapiens
ctttgatcaggtggg

SEQ ID NO: 6182566 - DNA, 15 bp, Homo sapiens
ctttgatcccttctg

SEQ ID NO: 6182567 - DNA, 16 bp, Homo sapiens
ctttgatccttggaaa

SEQ ID NO: 6182568 - DNA, 22 bp, Homo sapiens
ctttgatcgcttttaataaact

SEQ ID NO: 6182569 - DNA, 15 bp, Homo sapiens
ctttgatctctgctt

SEQ ID NO: 6182570 - DNA, 18 bp, Homo sapiens
ctttgatgaattcttcct

SEQ ID NO: 6182571 - DNA, 23 bp, Homo sapiens
ctttgatgaattcttcctctcct

SEQ ID NO: 6182572 - DNA, 21 bp, Homo sapiens
ctttgatgcatttccacactg

SEQ ID NO: 6182573 - DNA, 14 bp, Homo sapiens
ctttgatgtatttt

SEQ ID NO: 6182574 - DNA, 18 bp, Homo sapiens
ctttgatgtcatatggaa

SEQ ID NO: 6182575 - DNA, 18 bp, Homo sapiens
ctttgatgtgttgttctt

SEQ ID NO: 6182576 - DNA, 15 bp, Homo sapiens
ctttgatgttaacac

SEQ ID NO: 6182577 - DNA, 21 bp, Homo sapiens
ctttgatgttaacacattttg

SEQ ID NO: 6182578 - DNA, 23 bp, Homo sapiens
ctttgatgttaacacattttgta

SEQ ID NO: 6182579 - DNA, 14 bp, Homo sapiens
ctttgatgttcctt

SEQ ID NO: 6182580 - DNA, 16 bp, Homo sapiens
ctttgatgttccttcc

SEQ ID NO: 6182581 - DNA, 20 bp, Homo sapiens
ctttgattaaagactccagt

SEQ ID NO: 6182582 - DNA, 19 bp, Homo sapiens
ctttgattagttttcttgt

SEQ ID NO: 6182583 - DNA, 20 bp, Homo sapiens
ctttgattagttttcttgtt

SEQ ID NO: 6182584 - DNA, 18 bp, Homo sapiens
ctttgattatttgcatgt

SEQ ID NO: 6182585 - DNA, 22 bp, Homo sapiens
ctttgattcacatgttttcaaa

SEQ ID NO: 6182586 - DNA, 21 bp, Homo sapiens
ctttgattcatagtaacttct

SEQ ID NO: 6182587 - DNA, 15 bp, Homo sapiens
ctttgattctccttc

SEQ ID NO: 6182588 - DNA, 18 bp, Homo sapiens
ctttgattctccttcagc

SEQ ID NO: 6182589 - DNA, 23 bp, Homo sapiens
ctttgattctccttttatgtgta

SEQ ID NO: 6182590 - DNA, 16 bp, Homo sapiens
ctttgattgaagtatt

SEQ ID NO: 6182591 - DNA, 18 bp, Homo sapiens
ctttgattgcacattgtt

SEQ ID NO: 6182592 - DNA, 13 bp, Homo sapiens
ctttgatttaact

SEQ ID NO: 6182593 - DNA, 18 bp, Homo sapiens
ctttgatttacagcaagt

SEQ ID NO: 6182594 - DNA, 16 bp, Homo sapiens
ctttgatttacagtgc

SEQ ID NO: 6182595 - DNA, 12 bp, Homo sapiens
ctttgatttcca

SEQ ID NO: 6182596 - DNA, 16 bp, Homo sapiens
ctgggggctggacctg

SEQ ID NO: 6182597 - DNA, 12 bp, Homo sapiens
ctgggggctggc

SEQ ID NO: 6182598 - DNA, 13 bp, Homo sapiens
ctgggggctggca

SEQ ID NO: 6182599 - DNA, 19 bp, Homo sapiens
ctgggggctgggcagagga

SEQ ID NO: 6182600 - DNA, 14 bp, Homo sapiens
ctgggggctggttg

SEQ ID NO: 6182601 - DNA, 14 bp, Homo sapiens
ctggggggaacgga

SEQ ID NO: 6182602 - DNA, 16 bp, Homo sapiens
ctggggggaccaaata

SEQ ID NO: 6182603 - DNA, 16 bp, Homo sapiens
ctggggggacccagtg

SEQ ID NO: 6182604 - DNA, 17 bp, Homo sapiens
ctggggggacccagtgc

SEQ ID NO: 6182605 - DNA, 18 bp, Homo sapiens
ctggggggacccagtgca

SEQ ID NO: 6182606 - DNA, 17 bp, Homo sapiens
ctggggggagaaaaaaa

SEQ ID NO: 6182607 - DNA, 21 bp, Homo sapiens
ctggggggagggacagggcag

SEQ ID NO: 6182608 - DNA, 22 bp, Homo sapiens
ctggggggagggacagggcagg

SEQ ID NO: 6182609 - DNA, 18 bp, Homo sapiens
ctggggggatgacggcca

SEQ ID NO: 6182610 - DNA, 20 bp, Homo sapiens
ctggggggatgacggccagg

SEQ ID NO: 6182611 - DNA, 22 bp, Homo sapiens
ctggggggatgacggccaggct

SEQ ID NO: 6182612 - DNA, 22 bp, Homo sapiens
ctggggggatgttctgcctctc

SEQ ID NO: 6182613 - DNA, 14 bp, Homo sapiens
ctggggggcacagc

SEQ ID NO: 6182614 - DNA, 20 bp, Homo sapiens
ctggggggcaggcctcccaa

SEQ ID NO: 6182615 - DNA, 22 bp, Homo sapiens
ctggggggcaggcctcccaagc

SEQ ID NO: 6182616 - DNA, 13 bp, Homo sapiens
ctggggggccacc

SEQ ID NO: 6182617 - DNA, 17 bp, Homo sapiens
ctggggggctgtcctga

SEQ ID NO: 6182618 - DNA, 21 bp, Homo sapiens
ctggggggctgtcctgagccc

SEQ ID NO: 6182619 - DNA, 22 bp, Homo sapiens
ctgggggggattgtaaaatggt

SEQ ID NO: 6182620 - DNA, 15 bp, Homo sapiens
ctggggggtggccag

SEQ ID NO: 6182621 - DNA, 18 bp, Homo sapiens
ctggggggttgcctcgag

SEQ ID NO: 6182622 - DNA, 23 bp, Homo sapiens
ctggggggttgcctcgagtcccc

SEQ ID NO: 6182623 - DNA, 16 bp, Homo sapiens
ctggggggttggcagc

SEQ ID NO: 6182624 - DNA, 21 bp, Homo sapiens
ctgggggtaaagccctcagat

SEQ ID NO: 6182625 - DNA, 19 bp, Homo sapiens
ctgggggtagccccgcccc

SEQ ID NO: 6182626 - DNA, 14 bp, Homo sapiens
ctgggggtagcctg

SEQ ID NO: 6182627 - DNA, 15 bp, Homo sapiens
ctgggggtagcctgg

SEQ ID NO: 6182628 - DNA, 14 bp, Homo sapiens
ctgggggtcctctc

SEQ ID NO: 6182629 - DNA, 17 bp, Homo sapiens
ctgggggtcctctctga

SEQ ID NO: 6182630 - DNA, 23 bp, Homo sapiens
ctgggggtcctctctgagtcaaa

SEQ ID NO: 6182631 - DNA, 19 bp, Homo sapiens
ctgggggtgaggaggacaa

SEQ ID NO: 6182632 - DNA, 15 bp, Homo sapiens
ctgggggtgccaacc

SEQ ID NO: 6182633 - DNA, 14 bp, Homo sapiens
ctgggggtgccagg

SEQ ID NO: 6182634 - DNA, 15 bp, Homo sapiens
ctgggggtgccagga

SEQ ID NO: 6182635 - DNA, 19 bp, Homo sapiens
ctgggggtgccaggaccag

SEQ ID NO: 6182636 - DNA, 14 bp, Homo sapiens
ctgggggtgctgga

SEQ ID NO: 6182637 - DNA, 15 bp, Homo sapiens
ctgggggtgctggat

SEQ ID NO: 6182638 - DNA, 17 bp, Homo sapiens
ctgggggtgctggatgg

SEQ ID NO: 6182639 - DNA, 21 bp, Homo sapiens
ctgggggtggacatctgaccc

SEQ ID NO: 6182640 - DNA, 22 bp, Homo sapiens
ctgggggtggacatctgacccc

SEQ ID NO: 6182641 - DNA, 17 bp, Homo sapiens
ctgggggtggcaggcac

SEQ ID NO: 6182642 - DNA, 13 bp, Homo sapiens
ctgggggtgggaa

SEQ ID NO: 6182643 - DNA, 19 bp, Homo sapiens
ctgggggtggggaggtgtc

SEQ ID NO: 6182644 - DNA, 14 bp, Homo sapiens
ctgggggtggggct

SEQ ID NO: 6182645 - DNA, 20 bp, Homo sapiens
ctgggggttctttcttcctc

SEQ ID NO: 6182646 - DNA, 23 bp, Homo sapiens
ctgggggttctttcttcctctgc

SEQ ID NO: 6182647 - DNA, 16 bp, Homo sapiens
ctgggggttgcggggg

SEQ ID NO: 6182648 - DNA, 19 bp, Homo sapiens
ctgggggtttaagctctgc

SEQ ID NO: 6182649 - DNA, 20 bp, Homo sapiens
ctgggggttttccaagccct

SEQ ID NO: 6182650 - DNA, 19 bp, Homo sapiens
ctggggtaagtggtctaag

SEQ ID NO: 6182651 - DNA, 22 bp, Homo sapiens
ctggggtacaaggggcccagtg

SEQ ID NO: 6182652 - DNA, 16 bp, Homo sapiens
ctggggtacaggtttg

SEQ ID NO: 6182653 - DNA, 14 bp, Homo sapiens
ctggggtaccacat

SEQ ID NO: 6182654 - DNA, 21 bp, Homo sapiens
ctggggtaggctgtctgtgcc

SEQ ID NO: 6182655 - DNA, 21 bp, Homo sapiens
ctggggtatgtgtgtgtgggt

SEQ ID NO: 6182656 - DNA, 16 bp, Homo sapiens
ctggggtcacagaggc

SEQ ID NO: 6182657 - DNA, 22 bp, Homo sapiens
ctggggtcaggtgccactgacc

SEQ ID NO: 6182658 - DNA, 22 bp, Homo sapiens
ctggggtcattttgactggctt

SEQ ID NO: 6182659 - DNA, 16 bp, Homo sapiens
ctggggtccagggagc

SEQ ID NO: 6182660 - DNA, 17 bp, Homo sapiens
ctggggtccagggctgt

SEQ ID NO: 6182661 - DNA, 16 bp, Homo sapiens
ctggggtcccagcagc

SEQ ID NO: 6182662 - DNA, 18 bp, Homo sapiens
ctggggtccccactccct

SEQ ID NO: 6182663 - DNA, 16 bp, Homo sapiens
ctggggtccccagggc

SEQ ID NO: 6182664 - DNA, 17 bp, Homo sapiens
ctggggtcccccctccc

SEQ ID NO: 6182665 - DNA, 18 bp, Homo sapiens
ctggggtcctcctgtgct

SEQ ID NO: 6182666 - DNA, 16 bp, Homo sapiens
ctggggtctctgagca

SEQ ID NO: 6182667 - DNA, 18 bp, Homo sapiens
ctggggtctctgagcagt

SEQ ID NO: 6182668 - DNA, 23 bp, Homo sapiens
ctggggtctctgagcagtgggga

SEQ ID NO: 6182669 - DNA, 18 bp, Homo sapiens
ctggggtctgggcagtgc

SEQ ID NO: 6182670 - DNA, 13 bp, Homo sapiens
ctggggtctgtga

SEQ ID NO: 6182671 - DNA, 19 bp, Homo sapiens
ctggggtcttgggttcctg

SEQ ID NO: 6182672 - DNA, 24 bp, Homo sapiens
ctggggtgagcctgactgccagga

SEQ ID NO: 6182673 - DNA, 16 bp, Homo sapiens
ctggggtgcagcttca

SEQ ID NO: 6182674 - DNA, 20 bp, Homo sapiens
ctggggtgcagggatgtggg

SEQ ID NO: 6182675 - DNA, 21 bp, Homo sapiens
ctggggtgcagggatgtgggt

SEQ ID NO: 6182676 - DNA, 14 bp, Homo sapiens
ctggggtgcatctc

SEQ ID NO: 6182677 - DNA, 16 bp, Homo sapiens
ctggggtgccgcctgc

SEQ ID NO: 6182678 - DNA, 17 bp, Homo sapiens
ctggggtgccgcctgcc

SEQ ID NO: 6182679 - DNA, 13 bp, Homo sapiens
ctggggtgcgaga

SEQ ID NO: 6182680 - DNA, 15 bp, Homo sapiens
ctggggtggccaggg

SEQ ID NO: 6182681 - DNA, 20 bp, Homo sapiens
ctggggtggccagggcttcc

SEQ ID NO: 6182682 - DNA, 14 bp, Homo sapiens
ctggggtggcctca

SEQ ID NO: 6182683 - DNA, 17 bp, Homo sapiens
ctggggtggcctgtgtg

SEQ ID NO: 6182684 - DNA, 21 bp, Homo sapiens
ctggggtggcctgtgtggcca

SEQ ID NO: 6182685 - DNA, 21 bp, Homo sapiens
ctggggtggcgtctgcctagg

SEQ ID NO: 6182686 - DNA, 15 bp, Homo sapiens
ctggggtgggacagg

SEQ ID NO: 6182687 - DNA, 17 bp, Homo sapiens
ctggggtgggacaggga

SEQ ID NO: 6182688 - DNA, 13 bp, Homo sapiens
ctggggtgggagg

SEQ ID NO: 6182689 - DNA, 22 bp, Homo sapiens
ctggggtgggagggtctgcagg

SEQ ID NO: 6182690 - DNA, 14 bp, Homo sapiens
ctggggtgggaggt

SEQ ID NO: 6182691 - DNA, 22 bp, Homo sapiens
ctggggtgggagtaacagggca

SEQ ID NO: 6182692 - DNA, 18 bp, Homo sapiens
ctggggtggggacctcag

SEQ ID NO: 6182693 - DNA, 23 bp, Homo sapiens
ctggggtggggacctcaggcctg

SEQ ID NO: 6182694 - DNA, 21 bp, Homo sapiens
ctggggtggggaggcagaggg

SEQ ID NO: 6182695 - DNA, 15 bp, Homo sapiens
ctggggtggggcttg

SEQ ID NO: 6182696 - DNA, 16 bp, Homo sapiens
ctggggtggggcttgg

SEQ ID NO: 6182697 - DNA, 18 bp, Homo sapiens
ctggggtggggcttggaa

SEQ ID NO: 6182698 - DNA, 13 bp, Homo sapiens
ctggggtggggtc

SEQ ID NO: 6182699 - DNA, 23 bp, Homo sapiens
ctggggtgggtggggcagtgctt

SEQ ID NO: 6182700 - DNA, 23 bp, Homo sapiens
ctggggtgggtgtgagcagggtg

SEQ ID NO: 6182701 - DNA, 22 bp, Homo sapiens
ctggggtgggtttagcaggctg

SEQ ID NO: 6182702 - DNA, 10 bp, Homo sapiens
ctggggtgtc

SEQ ID NO: 6182703 - DNA, 11 bp, Homo sapiens
ctggggtgtca

SEQ ID NO: 6182704 - DNA, 14 bp, Homo sapiens
ctggggttatctga

SEQ ID NO: 6182705 - DNA, 22 bp, Homo sapiens
ctggggttcaagcccaggcttc

SEQ ID NO: 6182706 - DNA, 19 bp, Homo sapiens
ctggggttcagcccctcct

SEQ ID NO: 6182707 - DNA, 22 bp, Homo sapiens
ctggggttcagcccctcctctg

SEQ ID NO: 6182708 - DNA, 23 bp, Homo sapiens
ctggggttcagcccctcctctgc

SEQ ID NO: 6182709 - DNA, 23 bp, Homo sapiens
ctggggttgccagaggccctgga

SEQ ID NO: 6182710 - DNA, 19 bp, Homo sapiens
ctggggttgcgtctgaggc

SEQ ID NO: 6182711 - DNA, 17 bp, Homo sapiens
ctggggttggcaacagg

SEQ ID NO: 6182712 - DNA, 19 bp, Homo sapiens
ctggggttggcaacaggac

SEQ ID NO: 6182713 - DNA, 18 bp, Homo sapiens
ctggggttgtcagctctc

SEQ ID NO: 6182714 - DNA, 19 bp, Homo sapiens
ctggggtttactgaggtga

SEQ ID NO: 6182715 - DNA, 19 bp, Homo sapiens
ctggggtttccacacaggc

SEQ ID NO: 6182716 - DNA, 15 bp, Homo sapiens
ctggggtttttttca

SEQ ID NO: 6182717 - DNA, 15 bp, Homo sapiens
ctgggtaaatgtggt

SEQ ID NO: 6182718 - DNA, 16 bp, Homo sapiens
ctgggtaagaagaaag

SEQ ID NO: 6182719 - DNA, 16 bp, Homo sapiens
ctgggtaagaagggtg

SEQ ID NO: 6182720 - DNA, 20 bp, Homo sapiens
ctgggtaagaagggtgggag

SEQ ID NO: 6182721 - DNA, 23 bp, Homo sapiens
ctgggtaagaagggtgggagtgg

SEQ ID NO: 6182722 - DNA, 15 bp, Homo sapiens
ctgggtaatgtgaag

SEQ ID NO: 6182723 - DNA, 14 bp, Homo sapiens
ctgggtaccaggcc

SEQ ID NO: 6182724 - DNA, 22 bp, Homo sapiens
ctgggtacccaaaacacatttt

SEQ ID NO: 6182725 - DNA, 17 bp, Homo sapiens
ctgggtacccaagtgaa

SEQ ID NO: 6182726 - DNA, 20 bp, Homo sapiens
ctgggtacctgcaagcagaa

SEQ ID NO: 6182727 - DNA, 18 bp, Homo sapiens
ctgggtactgaaagcctt

SEQ ID NO: 6182728 - DNA, 14 bp, Homo sapiens
ctgggtactgactg

SEQ ID NO: 6182729 - DNA, 19 bp, Homo sapiens
ctgggtactgactgagata

SEQ ID NO: 6182730 - DNA, 19 bp, Homo sapiens
ctgggtactgaggtgctat

SEQ ID NO: 6182731 - DNA, 23 bp, Homo sapiens
ctgggtactgaggtgctatgaag

SEQ ID NO: 6182732 - DNA, 20 bp, Homo sapiens
ctgggtacttcttgaaggtg

SEQ ID NO: 6182733 - DNA, 19 bp, Homo sapiens
ctgggtacttgtggacaca

SEQ ID NO: 6182734 - DNA, 14 bp, Homo sapiens
ctgggtagaagcca

SEQ ID NO: 6182735 - DNA, 15 bp, Homo sapiens
ctgggtagaagccac

SEQ ID NO: 6182736 - DNA, 23 bp, Homo sapiens
ctgggtagaggtatgtttgtgaa

SEQ ID NO: 6182737 - DNA, 15 bp, Homo sapiens
ctgggtagctgtaag

SEQ ID NO: 6182738 - DNA, 17 bp, Homo sapiens
ctgggtaggcaggtgtc

SEQ ID NO: 6182739 - DNA, 12 bp, Homo sapiens
ctgggtaggccc

SEQ ID NO: 6182740 - DNA, 14 bp, Homo sapiens
ctgggtaggcccca

SEQ ID NO: 6182741 - DNA, 16 bp, Homo sapiens
ctgggtaggccccaca

SEQ ID NO: 6182742 - DNA, 20 bp, Homo sapiens
ctgggtaggttctgaacagc

SEQ ID NO: 6182743 - DNA, 23 bp, Homo sapiens
ctgggtaggttctgaacagcaga

SEQ ID NO: 6182744 - DNA, 18 bp, Homo sapiens
ctgggtatagtgcagaaa

SEQ ID NO: 6182745 - DNA, 15 bp, Homo sapiens
ctgggtatgaggctg

SEQ ID NO: 6182746 - DNA, 16 bp, Homo sapiens
ctgggtatgaggctgg

SEQ ID NO: 6182747 - DNA, 17 bp, Homo sapiens
ctgggtatgctctgtga

SEQ ID NO: 6182748 - DNA, 13 bp, Homo sapiens
ctgggtatgtgta

SEQ ID NO: 6182749 - DNA, 15 bp, Homo sapiens
ctgggtattaccatg

SEQ ID NO: 6182750 - DNA, 21 bp, Homo sapiens
ctgggtattaccatgtaaata

SEQ ID NO: 6182751 - DNA, 16 bp, Homo sapiens
ctgggtcaaaagagcc

SEQ ID NO: 6182752 - DNA, 17 bp, Homo sapiens
ctgggtcaaaagagccc

SEQ ID NO: 6182753 - DNA, 16 bp, Homo sapiens
ctgggtcacagagtga

SEQ ID NO: 6182754 - DNA, 13 bp, Homo sapiens
ctgggtcacagga

SEQ ID NO: 6182755 - DNA, 17 bp, Homo sapiens
ctgggtcacatccatcc

SEQ ID NO: 6182756 - DNA, 17 bp, Homo sapiens
ctgggtcacctagctgg

SEQ ID NO: 6182757 - DNA, 18 bp, Homo sapiens
ctgggtcaccttcctggg

SEQ ID NO: 6182758 - DNA, 19 bp, Homo sapiens
ctgggtcaccttcctgggc

SEQ ID NO: 6182759 - DNA, 14 bp, Homo sapiens
ctgggtcagaccca

SEQ ID NO: 6182760 - DNA, 16 bp, Homo sapiens
ctgggtcagcttgaat

SEQ ID NO: 6182761 - DNA, 14 bp, Homo sapiens
ctgggtcagggcca

SEQ ID NO: 6182762 - DNA, 13 bp, Homo sapiens
ctgggtcagtctg

SEQ ID NO: 6182763 - DNA, 21 bp, Homo sapiens
ctgggtcagtctggtgggagg

SEQ ID NO: 6182764 - DNA, 12 bp, Homo sapiens
ctgggtcagtgg

SEQ ID NO: 6182765 - DNA, 17 bp, Homo sapiens
ctgggtcatgggcctgt

SEQ ID NO: 6182766 - DNA, 21 bp, Homo sapiens
ctgggtcattacttctgagcc

SEQ ID NO: 6182767 - DNA, 16 bp, Homo sapiens
ctgggtccaaataaaa

SEQ ID NO: 6182768 - DNA, 19 bp, Homo sapiens
ctgggtccaaataaaaact

SEQ ID NO: 6182769 - DNA, 16 bp, Homo sapiens
ctgggtccaggcctgg

SEQ ID NO: 6182770 - DNA, 20 bp, Homo sapiens
ctgggtccaggcctggccat

SEQ ID NO: 6182771 - DNA, 14 bp, Homo sapiens
ctgggtccagggag

SEQ ID NO: 6182772 - DNA, 15 bp, Homo sapiens
ctgggtccagggagg

SEQ ID NO: 6182773 - DNA, 22 bp, Homo sapiens
ctgggtccaggggatgggaggt

SEQ ID NO: 6182774 - DNA, 19 bp, Homo sapiens
ctttgcaaagtattgtaaa

SEQ ID NO: 6182775 - DNA, 20 bp, Homo sapiens
ctttgcaaagtattgtaaat

SEQ ID NO: 6182776 - DNA, 12 bp, Homo sapiens
ctttgcaaataa

SEQ ID NO: 6182777 - DNA, 20 bp, Homo sapiens
ctttgcaaattcaagagcct

SEQ ID NO: 6182778 - DNA, 18 bp, Homo sapiens
ctttgcaactcctgtaat

SEQ ID NO: 6182779 - DNA, 22 bp, Homo sapiens
ctttgcaatagcagttataaca

SEQ ID NO: 6182780 - DNA, 18 bp, Homo sapiens
ctttgcaatccaaataaa

SEQ ID NO: 6182781 - DNA, 17 bp, Homo sapiens
ctttgcaattgctcttc

SEQ ID NO: 6182782 - DNA, 18 bp, Homo sapiens
ctttgcaattgctcttct

SEQ ID NO: 6182783 - DNA, 19 bp, Homo sapiens
ctttgcaattgctcttctc

SEQ ID NO: 6182784 - DNA, 15 bp, Homo sapiens
ctttgcacactttgg

SEQ ID NO: 6182785 - DNA, 21 bp, Homo sapiens
ctttgcacaggaaagagtcac

SEQ ID NO: 6182786 - DNA, 16 bp, Homo sapiens
ctttgcacaggatgct

SEQ ID NO: 6182787 - DNA, 14 bp, Homo sapiens
ctttgcaccaaaga

SEQ ID NO: 6182788 - DNA, 16 bp, Homo sapiens
ctttgcaccaaagaca

SEQ ID NO: 6182789 - DNA, 18 bp, Homo sapiens
ctttgcaccaaagacatc

SEQ ID NO: 6182790 - DNA, 18 bp, Homo sapiens
ctttgcaccatgtgaagt

SEQ ID NO: 6182791 - DNA, 17 bp, Homo sapiens
ctttgcaccgtggtcag

SEQ ID NO: 6182792 - DNA, 14 bp, Homo sapiens
ctttgcacctgcaa

SEQ ID NO: 6182793 - DNA, 21 bp, Homo sapiens
ctttgcacgacgccctctccc

SEQ ID NO: 6182794 - DNA, 23 bp, Homo sapiens
ctttgcacgacgccctctcccca

SEQ ID NO: 6182795 - DNA, 16 bp, Homo sapiens
ctttgcactgagggcc

SEQ ID NO: 6182796 - DNA, 23 bp, Homo sapiens
ctttgcactgagggccacactat

SEQ ID NO: 6182797 - DNA, 15 bp, Homo sapiens
ctttgcactgtaatg

SEQ ID NO: 6182798 - DNA, 15 bp, Homo sapiens
ctttgcacttaaaaa

SEQ ID NO: 6182799 - DNA, 16 bp, Homo sapiens
ctttgcacttaaaaat

SEQ ID NO: 6182800 - DNA, 15 bp, Homo sapiens
ctttgcagaaacaga

SEQ ID NO: 6182801 - DNA, 23 bp, Homo sapiens
ctttgcagaaacagatttggtga

SEQ ID NO: 6182802 - DNA, 14 bp, Homo sapiens
ctttgcagacaggc

SEQ ID NO: 6182803 - DNA, 16 bp, Homo sapiens
ctttgcagacaggcaa

SEQ ID NO: 6182804 - DNA, 22 bp, Homo sapiens
ctttgcagaccgcatagtcact

SEQ ID NO: 6182805 - DNA, 15 bp, Homo sapiens
ctttgcagacctggg

SEQ ID NO: 6182806 - DNA, 13 bp, Homo sapiens
ctttgcagatgta

SEQ ID NO: 6182807 - DNA, 14 bp, Homo sapiens
ctttgcagcatacc

SEQ ID NO: 6182808 - DNA, 18 bp, Homo sapiens
ctttgcagccaaggtgct

SEQ ID NO: 6182809 - DNA, 14 bp, Homo sapiens
ctttgcagctaaaa

SEQ ID NO: 6182810 - DNA, 14 bp, Homo sapiens
ctttgcagctgccc

SEQ ID NO: 6182811 - DNA, 15 bp, Homo sapiens
ctttgcagctgcttt

SEQ ID NO: 6182812 - DNA, 19 bp, Homo sapiens
ctttgcaggcggccctcag

SEQ ID NO: 6182813 - DNA, 22 bp, Homo sapiens
ctttgcaggcggccctcagtgc

SEQ ID NO: 6182814 - DNA, 23 bp, Homo sapiens
ctttgcaggctctgggctcaggg

SEQ ID NO: 6182815 - DNA, 19 bp, Homo sapiens
ctttgcagggcagccccac

SEQ ID NO: 6182816 - DNA, 22 bp, Homo sapiens
ctttgcagggctaaggccccca

SEQ ID NO: 6182817 - DNA, 20 bp, Homo sapiens
ctttgcagtgaagatgtgta

SEQ ID NO: 6182818 - DNA, 23 bp, Homo sapiens
ctttgcagttcctcttcatctgt

SEQ ID NO: 6182819 - DNA, 21 bp, Homo sapiens
ctttgcagttggactctcagg

SEQ ID NO: 6182820 - DNA, 18 bp, Homo sapiens
ctttgcatagctttcaca

SEQ ID NO: 6182821 - DNA, 18 bp, Homo sapiens
ctttgcatcgtcccctcc

SEQ ID NO: 6182822 - DNA, 22 bp, Homo sapiens
ctttgcatcgtcccctccccca

SEQ ID NO: 6182823 - DNA, 22 bp, Homo sapiens
ctttgcatctcagtatgaatta

SEQ ID NO: 6182824 - DNA, 15 bp, Homo sapiens
ctttgcatgatctgt

SEQ ID NO: 6182825 - DNA, 19 bp, Homo sapiens
ctttgcatgatctgtcaaa

SEQ ID NO: 6182826 - DNA, 15 bp, Homo sapiens
ctttgcatggatttc

SEQ ID NO: 6182827 - DNA, 17 bp, Homo sapiens
ctttgcatggatttctt

SEQ ID NO: 6182828 - DNA, 19 bp, Homo sapiens
ctttgcatggcagggcctc

SEQ ID NO: 6182829 - DNA, 20 bp, Homo sapiens
ctttgcatgttccactaacc

SEQ ID NO: 6182830 - DNA, 21 bp, Homo sapiens
ctttgcattccatgattttac

SEQ ID NO: 6182831 - DNA, 20 bp, Homo sapiens
ctttgcattgtctgtctgca

SEQ ID NO: 6182832 - DNA, 12 bp, Homo sapiens
ctttgcatttat

SEQ ID NO: 6182833 - DNA, 13 bp, Homo sapiens
ctttgcatttctc

SEQ ID NO: 6182834 - DNA, 15 bp, Homo sapiens
ctttgcatttcttgt

SEQ ID NO: 6182835 - DNA, 21 bp, Homo sapiens
ctttgcattttctgatgtatt

SEQ ID NO: 6182836 - DNA, 22 bp, Homo sapiens
ctttgcattttctgatgtatta

SEQ ID NO: 6182837 - DNA, 14 bp, Homo sapiens
ctttgcattttgga

SEQ ID NO: 6182838 - DNA, 17 bp, Homo sapiens
ctttgcattttgtttca

SEQ ID NO: 6182839 - DNA, 17 bp, Homo sapiens
ctttgccaaaaagcata

SEQ ID NO: 6182840 - DNA, 20 bp, Homo sapiens
ctttgccaaacactttacag

SEQ ID NO: 6182841 - DNA, 17 bp, Homo sapiens
ctttgccaacttgccat

SEQ ID NO: 6182842 - DNA, 17 bp, Homo sapiens
ctttgccaagacctttc

SEQ ID NO: 6182843 - DNA, 20 bp, Homo sapiens
ctttgccaagacctttcaaa

SEQ ID NO: 6182844 - DNA, 17 bp, Homo sapiens
ctttgccaaggctctcc

SEQ ID NO: 6182845 - DNA, 18 bp, Homo sapiens
ctttgccaaggtactttt

SEQ ID NO: 6182846 - DNA, 22 bp, Homo sapiens
ctttgccacaagacctagccta

SEQ ID NO: 6182847 - DNA, 21 bp, Homo sapiens
ctttgccaccctcatgctgtg

SEQ ID NO: 6182848 - DNA, 16 bp, Homo sapiens
ctttgccactgctgta

SEQ ID NO: 6182849 - DNA, 18 bp, Homo sapiens
ctttgccagaaagcataa

SEQ ID NO: 6182850 - DNA, 12 bp, Homo sapiens
ctttgccagagc

SEQ ID NO: 6182851 - DNA, 18 bp, Homo sapiens
ctttgccagagcaggagc

SEQ ID NO: 6182852 - DNA, 20 bp, Homo sapiens
ctttgccagagcaggagccc

SEQ ID NO: 6182853 - DNA, 23 bp, Homo sapiens
ctttgccagagcaggagcccctg

SEQ ID NO: 6182854 - DNA, 20 bp, Homo sapiens
ctttgccagcagagccaggg

SEQ ID NO: 6182855 - DNA, 21 bp, Homo sapiens
ctttgccagcagagccagggc

SEQ ID NO: 6182856 - DNA, 12 bp, Homo sapiens
ctttgccagcca

SEQ ID NO: 6182857 - DNA, 18 bp, Homo sapiens
ctttgccagctgctgctg

SEQ ID NO: 6182858 - DNA, 13 bp, Homo sapiens
ctttgccaggtga

SEQ ID NO: 6182859 - DNA, 12 bp, Homo sapiens
ctttgccatctc

SEQ ID NO: 6182860 - DNA, 18 bp, Homo sapiens
ctttgccatctctgctcc

SEQ ID NO: 6182861 - DNA, 20 bp, Homo sapiens
ctttgccatttttctataaa

SEQ ID NO: 6182862 - DNA, 16 bp, Homo sapiens
ctttgcccaacaccag

SEQ ID NO: 6182863 - DNA, 22 bp, Homo sapiens
ctttgcccaacaccagcccctg

SEQ ID NO: 6182864 - DNA, 17 bp, Homo sapiens
ctttgcccaacctcagc

SEQ ID NO: 6182865 - DNA, 21 bp, Homo sapiens
ctttgcccaacctcagcaacc

SEQ ID NO: 6182866 - DNA, 15 bp, Homo sapiens
ctttgcccacccctc

SEQ ID NO: 6182867 - DNA, 18 bp, Homo sapiens
ctttgcccagggtcctgt

SEQ ID NO: 6182868 - DNA, 21 bp, Homo sapiens
ctttgcccagggtcctgtgcc

SEQ ID NO: 6182869 - DNA, 13 bp, Homo sapiens
ctttgccccactg

SEQ ID NO: 6182870 - DNA, 15 bp, Homo sapiens
ctttgccccagttac

SEQ ID NO: 6182871 - DNA, 20 bp, Homo sapiens
ctttgcccccttgcccatca

SEQ ID NO: 6182872 - DNA, 19 bp, Homo sapiens
ctttgccccggcttgcctg

SEQ ID NO: 6182873 - DNA, 15 bp, Homo sapiens
ctttgcccttcactg

SEQ ID NO: 6182874 - DNA, 14 bp, Homo sapiens
ctttgcccttcctc

SEQ ID NO: 6182875 - DNA, 18 bp, Homo sapiens
ctttgcccttctggttta

SEQ ID NO: 6182876 - DNA, 21 bp, Homo sapiens
ctttgccctttacttgtcttt

SEQ ID NO: 6182877 - DNA, 19 bp, Homo sapiens
ctttgccgcttttgtgcct

SEQ ID NO: 6182878 - DNA, 21 bp, Homo sapiens
ctttgcctccagaagcactgg

SEQ ID NO: 6182879 - DNA, 18 bp, Homo sapiens
ctttgcctcgaaagtgtc

SEQ ID NO: 6182880 - DNA, 12 bp, Homo sapiens
ctttgcctctgc

SEQ ID NO: 6182881 - DNA, 13 bp, Homo sapiens
ctttgcctctgct

SEQ ID NO: 6182882 - DNA, 11 bp, Homo sapiens
ctttgcctctt

SEQ ID NO: 6182883 - DNA, 12 bp, Homo sapiens
ctttgcctcttc

SEQ ID NO: 6182884 - DNA, 15 bp, Homo sapiens
ctttgcctcttcttt

SEQ ID NO: 6182885 - DNA, 16 bp, Homo sapiens
ctttgcctcttctttg

SEQ ID NO: 6182886 - DNA, 17 bp, Homo sapiens
ctttgcctcttctttgt

SEQ ID NO: 6182887 - DNA, 23 bp, Homo sapiens
ctttgcctcttctttgtgccttt

SEQ ID NO: 6182888 - DNA, 11 bp, Homo sapiens
ctttgcctggt

SEQ ID NO: 6182889 - DNA, 20 bp, Homo sapiens
ctttgcctgtagagccagcc

SEQ ID NO: 6182890 - DNA, 23 bp, Homo sapiens
ctttgcctgtagagccagccttg

SEQ ID NO: 6182891 - DNA, 12 bp, Homo sapiens
ctttgcctgtgt

SEQ ID NO: 6182892 - DNA, 18 bp, Homo sapiens
ctttgcctgtgtgagcat

SEQ ID NO: 6182893 - DNA, 15 bp, Homo sapiens
ctttgcctgttcagt

SEQ ID NO: 6182894 - DNA, 11 bp, Homo sapiens
ctttgccttgc

SEQ ID NO: 6182895 - DNA, 22 bp, Homo sapiens
ctttgccttgggctgctcctca

SEQ ID NO: 6182896 - DNA, 23 bp, Homo sapiens
ctttgccttgggctgctcctcat

SEQ ID NO: 6182897 - DNA, 23 bp, Homo sapiens
ctttgcctttaggggtgtgtatt

SEQ ID NO: 6182898 - DNA, 20 bp, Homo sapiens
ctttgcgcaaactttaacag

SEQ ID NO: 6182899 - DNA, 19 bp, Homo sapiens
ctttgcgggatatttaggg

SEQ ID NO: 6182900 - DNA, 16 bp, Homo sapiens
ctttgcggggcctgtc

SEQ ID NO: 6182901 - DNA, 18 bp, Homo sapiens
ctttgcggggcctgtctc

SEQ ID NO: 6182902 - DNA, 19 bp, Homo sapiens
ctttgcggggcctgtctca

SEQ ID NO: 6182903 - DNA, 22 bp, Homo sapiens
ctttgcggggcctgtctcagtg

SEQ ID NO: 6182904 - DNA, 17 bp, Homo sapiens
ctttgcgtcaggagcag

SEQ ID NO: 6182905 - DNA, 17 bp, Homo sapiens
ctttgcgtgcccggggc

SEQ ID NO: 6182906 - DNA, 21 bp, Homo sapiens
ctttgcgtgcccggggcagca

SEQ ID NO: 6182907 - DNA, 20 bp, Homo sapiens
ctttgcgtgtgtcataaagt

SEQ ID NO: 6182908 - DNA, 21 bp, Homo sapiens
ctttgctacaaatttatgcat

SEQ ID NO: 6182909 - DNA, 18 bp, Homo sapiens
ctttgctacaataaatgc

SEQ ID NO: 6182910 - DNA, 15 bp, Homo sapiens
ctttgctacgaagaa

SEQ ID NO: 6182911 - DNA, 21 bp, Homo sapiens
ctttgctaggcctcttgctga

SEQ ID NO: 6182912 - DNA, 21 bp, Homo sapiens
ctttgctatggggacattcca

SEQ ID NO: 6182913 - DNA, 15 bp, Homo sapiens
ctttgctcagtgtcc

SEQ ID NO: 6182914 - DNA, 18 bp, Homo sapiens
ctttgctccaccccactc

SEQ ID NO: 6182915 - DNA, 14 bp, Homo sapiens
ctttgctccagacc

SEQ ID NO: 6182916 - DNA, 13 bp, Homo sapiens
ctttgctccaggc

SEQ ID NO: 6182917 - DNA, 11 bp, Homo sapiens
ctttgctcccg

SEQ ID NO: 6182918 - DNA, 20 bp, Homo sapiens
ctttgctcccggcaagcgct

SEQ ID NO: 6182919 - DNA, 21 bp, Homo sapiens
ctttgctccgctcccaccgcc

SEQ ID NO: 6182920 - DNA, 14 bp, Homo sapiens
ctttgctccttcag

SEQ ID NO: 6182921 - DNA, 24 bp, Homo sapiens
ctttgctccttcagttctgcttgc

SEQ ID NO: 6182922 - DNA, 11 bp, Homo sapiens
ctttgctctga

SEQ ID NO: 6182923 - DNA, 12 bp, Homo sapiens
ctttgctcttgg

SEQ ID NO: 6182924 - DNA, 14 bp, Homo sapiens
ctttgctctttctt

SEQ ID NO: 6182925 - DNA, 13 bp, Homo sapiens
ctttgctgaagaa

SEQ ID NO: 6182926 - DNA, 18 bp, Homo sapiens
ctttgctgaagtctcccc

SEQ ID NO: 6182927 - DNA, 23 bp, Homo sapiens
ctttgctgaccctccccaaaggc

SEQ ID NO: 6182928 - DNA, 21 bp, Homo sapiens
ctttgctgcacaaacatgaaa

SEQ ID NO: 6182929 - DNA, 13 bp, Homo sapiens
ctttgctgcacag

SEQ ID NO: 6182930 - DNA, 14 bp, Homo sapiens
ctttgctgcacagc

SEQ ID NO: 6182931 - DNA, 12 bp, Homo sapiens
ctttgctgcaga

SEQ ID NO: 6182932 - DNA, 11 bp, Homo sapiens
ctttgctgccc

SEQ ID NO: 6182933 - DNA, 22 bp, Homo sapiens
ctttgctgcccttggtttctgg

SEQ ID NO: 6182934 - DNA, 14 bp, Homo sapiens
ctttgctgccttct

SEQ ID NO: 6182935 - DNA, 15 bp, Homo sapiens
ctttgctgccttctg

SEQ ID NO: 6182936 - DNA, 19 bp, Homo sapiens
ctttgctgccttctgtctc

SEQ ID NO: 6182937 - DNA, 24 bp, Homo sapiens
ctttgctgccttctgtctcttgca

SEQ ID NO: 6182938 - DNA, 16 bp, Homo sapiens
ctttgctgctgctctc

SEQ ID NO: 6182939 - DNA, 17 bp, Homo sapiens
ctttgctggagtcctgt

SEQ ID NO: 6182940 - DNA, 17 bp, Homo sapiens
ctttgctgtaagatgtc

SEQ ID NO: 6182941 - DNA, 22 bp, Homo sapiens
ctttgctgtaagatgtctgttt

SEQ ID NO: 6182942 - DNA, 22 bp, Homo sapiens
ctttgctgtcactttctctctt

SEQ ID NO: 6182943 - DNA, 13 bp, Homo sapiens
ctttgctgtctgg

SEQ ID NO: 6182944 - DNA, 23 bp, Homo sapiens
ctttgctgtgaggaatgctctgt

SEQ ID NO: 6182945 - DNA, 17 bp, Homo sapiens
ctttgctgtgaggctgt

SEQ ID NO: 6182946 - DNA, 22 bp, Homo sapiens
ctttgctgtgaggctgtcctgt

SEQ ID NO: 6182947 - DNA, 14 bp, Homo sapiens
ctttgctgtgccaa

SEQ ID NO: 6182948 - DNA, 17 bp, Homo sapiens
ctttgctgtgccaaagc

SEQ ID NO: 6182949 - DNA, 21 bp, Homo sapiens
ctttgctgttactgcttctct

SEQ ID NO: 6182950 - DNA, 22 bp, Homo sapiens
ctttgctgtttagcttcctcca

SEQ ID NO: 6182951 - DNA, 19 bp, Homo sapiens
ctttgcttatgaatattta

SEQ ID NO: 6182952 - DNA, 15 bp, Homo sapiens
ctgggtccatatcac

SEQ ID NO: 6182953 - DNA, 20 bp, Homo sapiens
ctgggtccatatcacacaca

SEQ ID NO: 6182954 - DNA, 14 bp, Homo sapiens
ctgggtcccagcct

SEQ ID NO: 6182955 - DNA, 20 bp, Homo sapiens
ctgggtcccagggctggccc

SEQ ID NO: 6182956 - DNA, 15 bp, Homo sapiens
ctgggtccccctcct

SEQ ID NO: 6182957 - DNA, 22 bp, Homo sapiens
ctgggtcccggggtgcatttgt

SEQ ID NO: 6182958 - DNA, 14 bp, Homo sapiens
ctgggtccctcctc

SEQ ID NO: 6182959 - DNA, 14 bp, Homo sapiens
ctgggtccctcgga

SEQ ID NO: 6182960 - DNA, 20 bp, Homo sapiens
ctgggtccctcggagctgcc

SEQ ID NO: 6182961 - DNA, 18 bp, Homo sapiens
ctgggtccctgctcccct

SEQ ID NO: 6182962 - DNA, 22 bp, Homo sapiens
ctgggtccctgctcccctttgg

SEQ ID NO: 6182963 - DNA, 16 bp, Homo sapiens
ctgggtcctccaaaga

SEQ ID NO: 6182964 - DNA, 19 bp, Homo sapiens
ctgggtcctcccagctgac

SEQ ID NO: 6182965 - DNA, 15 bp, Homo sapiens
ctgggtcctcggccc

SEQ ID NO: 6182966 - DNA, 13 bp, Homo sapiens
ctgggtcctgcca

SEQ ID NO: 6182967 - DNA, 15 bp, Homo sapiens
ctgggtcctgccagc

SEQ ID NO: 6182968 - DNA, 16 bp, Homo sapiens
ctgggtcctgccagct

SEQ ID NO: 6182969 - DNA, 21 bp, Homo sapiens
ctgggtcctgccagctggatc

SEQ ID NO: 6182970 - DNA, 19 bp, Homo sapiens
ctgggtcctgcctggtcct

SEQ ID NO: 6182971 - DNA, 15 bp, Homo sapiens
ctgggtccttcctga

SEQ ID NO: 6182972 - DNA, 19 bp, Homo sapiens
ctgggtccttcctgaaact

SEQ ID NO: 6182973 - DNA, 18 bp, Homo sapiens
ctgggtccttgcacccct

SEQ ID NO: 6182974 - DNA, 14 bp, Homo sapiens
ctgggtcgcccctc

SEQ ID NO: 6182975 - DNA, 15 bp, Homo sapiens
ctgggtcgcccctcc

SEQ ID NO: 6182976 - DNA, 16 bp, Homo sapiens
ctgggtcgcccctcct

SEQ ID NO: 6182977 - DNA, 16 bp, Homo sapiens
ctgggtcgccctggac

SEQ ID NO: 6182978 - DNA, 15 bp, Homo sapiens
ctgggtctaaagggc

SEQ ID NO: 6182979 - DNA, 16 bp, Homo sapiens
ctgggtctacaaggac

SEQ ID NO: 6182980 - DNA, 21 bp, Homo sapiens
ctgggtctccacatccccagc

SEQ ID NO: 6182981 - DNA, 17 bp, Homo sapiens
ctgggtctcccaggaca

SEQ ID NO: 6182982 - DNA, 14 bp, Homo sapiens
ctgggtctccctgg

SEQ ID NO: 6182983 - DNA, 14 bp, Homo sapiens
ctgggtctgacctg

SEQ ID NO: 6182984 - DNA, 17 bp, Homo sapiens
ctgggtctgacctggtg

SEQ ID NO: 6182985 - DNA, 19 bp, Homo sapiens
ctgggtctgacctggtggg

SEQ ID NO: 6182986 - DNA, 20 bp, Homo sapiens
ctgggtctgaggcccctgcc

SEQ ID NO: 6182987 - DNA, 22 bp, Homo sapiens
ctgggtctgaggcccctgcctc

SEQ ID NO: 6182988 - DNA, 22 bp, Homo sapiens
ctgggtctgattttctcactga

SEQ ID NO: 6182989 - DNA, 18 bp, Homo sapiens
ctgggtctgcgatgcagc

SEQ ID NO: 6182990 - DNA, 14 bp, Homo sapiens
ctgggtctggatgg

SEQ ID NO: 6182991 - DNA, 16 bp, Homo sapiens
ctgggtctgtgtctct

SEQ ID NO: 6182992 - DNA, 15 bp, Homo sapiens
ctgggtcttcagctt

SEQ ID NO: 6182993 - DNA, 14 bp, Homo sapiens
ctgggtcttgccat

SEQ ID NO: 6182994 - DNA, 17 bp, Homo sapiens
ctgggtgacagagcgag

SEQ ID NO: 6182995 - DNA, 14 bp, Homo sapiens
ctgggtgacagtga

SEQ ID NO: 6182996 - DNA, 22 bp, Homo sapiens
ctgggtgaccgactaccccagt

SEQ ID NO: 6182997 - DNA, 16 bp, Homo sapiens
ctgggtgagaatcctg

SEQ ID NO: 6182998 - DNA, 17 bp, Homo sapiens
ctgggtgagccaaggac

SEQ ID NO: 6182999 - DNA, 20 bp, Homo sapiens
ctgggtgagccaaggacagg

SEQ ID NO: 6183000 - DNA, 22 bp, Homo sapiens
ctgggtgagccaaggacagggc

SEQ ID NO: 6183001 - DNA, 14 bp, Homo sapiens
ctgggtgagtgggg

SEQ ID NO: 6183002 - DNA, 18 bp, Homo sapiens
ctgggtgagtttttcttt

SEQ ID NO: 6183003 - DNA, 19 bp, Homo sapiens
ctgggtgataattttgaat

SEQ ID NO: 6183004 - DNA, 19 bp, Homo sapiens
ctgggtgatcaccacatct

SEQ ID NO: 6183005 - DNA, 17 bp, Homo sapiens
ctgggtgatctgctgct

SEQ ID NO: 6183006 - DNA, 13 bp, Homo sapiens
ctgggtgatggaa

SEQ ID NO: 6183007 - DNA, 21 bp, Homo sapiens
ctgggtgatggaaactgccaa

SEQ ID NO: 6183008 - DNA, 12 bp, Homo sapiens
ctgggtgcagaa

SEQ ID NO: 6183009 - DNA, 15 bp, Homo sapiens
ctgggtgcagaagct

SEQ ID NO: 6183010 - DNA, 17 bp, Homo sapiens
ctgggtgcagaagctgt

SEQ ID NO: 6183011 - DNA, 14 bp, Homo sapiens
ctgggtgcagctga

SEQ ID NO: 6183012 - DNA, 18 bp, Homo sapiens
ctgggtgcagctgggctt

SEQ ID NO: 6183013 - DNA, 22 bp, Homo sapiens
ctgggtgcaggagcgctccctt

SEQ ID NO: 6183014 - DNA, 19 bp, Homo sapiens
ctgggtgccaagtcctagc

SEQ ID NO: 6183015 - DNA, 21 bp, Homo sapiens
ctgggtgcccaagctcagaag

SEQ ID NO: 6183016 - DNA, 16 bp, Homo sapiens
ctgggtgcccacagcc

SEQ ID NO: 6183017 - DNA, 19 bp, Homo sapiens
ctgggtgcccacagcccgc

SEQ ID NO: 6183018 - DNA, 22 bp, Homo sapiens
ctgggtgcctcccacacttgct

SEQ ID NO: 6183019 - DNA, 16 bp, Homo sapiens
ctgggtgcctcctccc

SEQ ID NO: 6183020 - DNA, 15 bp, Homo sapiens
ctgggtgcctgcagc

SEQ ID NO: 6183021 - DNA, 18 bp, Homo sapiens
ctgggtgcctgcagcgcc

SEQ ID NO: 6183022 - DNA, 19 bp, Homo sapiens
ctgggtgcgaccccatctg

SEQ ID NO: 6183023 - DNA, 21 bp, Homo sapiens
ctgggtgcgaccccatctgcc

SEQ ID NO: 6183024 - DNA, 17 bp, Homo sapiens
ctgggtgctagatccag

SEQ ID NO: 6183025 - DNA, 11 bp, Homo sapiens
ctgggtgctca

SEQ ID NO: 6183026 - DNA, 17 bp, Homo sapiens
ctgggtgctcaccgcct

SEQ ID NO: 6183027 - DNA, 13 bp, Homo sapiens
ctgggtgctctgg

SEQ ID NO: 6183028 - DNA, 21 bp, Homo sapiens
ctgggtgctctggctggagag

SEQ ID NO: 6183029 - DNA, 13 bp, Homo sapiens
ctgggtgctgccc

SEQ ID NO: 6183030 - DNA, 15 bp, Homo sapiens
ctgggtgctggctgc

SEQ ID NO: 6183031 - DNA, 13 bp, Homo sapiens
ctgggtgctggga

SEQ ID NO: 6183032 - DNA, 14 bp, Homo sapiens
ctgggtggagcagg

SEQ ID NO: 6183033 - DNA, 16 bp, Homo sapiens
ctgggtggagcaggac

SEQ ID NO: 6183034 - DNA, 20 bp, Homo sapiens
ctgggtggatcggcctcctc

SEQ ID NO: 6183035 - DNA, 18 bp, Homo sapiens
ctgggtggatgtgagcag

SEQ ID NO: 6183036 - DNA, 19 bp, Homo sapiens
ctgggtggatgtgagcaga

SEQ ID NO: 6183037 - DNA, 19 bp, Homo sapiens
ctgggtggattataaacaa

SEQ ID NO: 6183038 - DNA, 21 bp, Homo sapiens
ctgggtggcaccagcagcctg

SEQ ID NO: 6183039 - DNA, 23 bp, Homo sapiens
ctgggtggcaccagcagcctgga

SEQ ID NO: 6183040 - DNA, 15 bp, Homo sapiens
ctgggtggcactgcc

SEQ ID NO: 6183041 - DNA, 16 bp, Homo sapiens
ctgggtggcactgcca

SEQ ID NO: 6183042 - DNA, 20 bp, Homo sapiens
ctgggtggcactgccatgca

SEQ ID NO: 6183043 - DNA, 15 bp, Homo sapiens
ctgggtggccatcct

SEQ ID NO: 6183044 - DNA, 23 bp, Homo sapiens
ctgggtggccatcctacccagcg

SEQ ID NO: 6183045 - DNA, 14 bp, Homo sapiens
ctgggtggcccatc

SEQ ID NO: 6183046 - DNA, 16 bp, Homo sapiens
ctgggtggcccatccc

SEQ ID NO: 6183047 - DNA, 20 bp, Homo sapiens
ctgggtggcccatcccccct

SEQ ID NO: 6183048 - DNA, 20 bp, Homo sapiens
ctgggtggccggccctgccc

SEQ ID NO: 6183049 - DNA, 15 bp, Homo sapiens
ctgggtggctcctgc

SEQ ID NO: 6183050 - DNA, 18 bp, Homo sapiens
ctgggtggctcctgccac

SEQ ID NO: 6183051 - DNA, 19 bp, Homo sapiens
ctgggtggctcctgccact

SEQ ID NO: 6183052 - DNA, 20 bp, Homo sapiens
ctgggtggctcctgccactg

SEQ ID NO: 6183053 - DNA, 23 bp, Homo sapiens
ctgggtgggatggatgctgggga

SEQ ID NO: 6183054 - DNA, 17 bp, Homo sapiens
ctgggtgggccccacag

SEQ ID NO: 6183055 - DNA, 19 bp, Homo sapiens
ctgggtgggccccacagtg

SEQ ID NO: 6183056 - DNA, 21 bp, Homo sapiens
ctgggtgggccccacagtggt

SEQ ID NO: 6183057 - DNA, 14 bp, Homo sapiens
ctgggtgggccctg

SEQ ID NO: 6183058 - DNA, 19 bp, Homo sapiens
ctgggtgggcgtggcctgc

SEQ ID NO: 6183059 - DNA, 23 bp, Homo sapiens
ctgggtgggcgtggcctgcatag

SEQ ID NO: 6183060 - DNA, 13 bp, Homo sapiens
ctgggtgggctct

SEQ ID NO: 6183061 - DNA, 13 bp, Homo sapiens
ctgggtggggaca

SEQ ID NO: 6183062 - DNA, 14 bp, Homo sapiens
ctgggtggggacag

SEQ ID NO: 6183063 - DNA, 22 bp, Homo sapiens
ctgggtggggcagcacacctct

SEQ ID NO: 6183064 - DNA, 12 bp, Homo sapiens
ctgggtggggcc

SEQ ID NO: 6183065 - DNA, 21 bp, Homo sapiens
ctgggtggggctgctcctcca

SEQ ID NO: 6183066 - DNA, 19 bp, Homo sapiens
ctgggtggggggagaagac

SEQ ID NO: 6183067 - DNA, 21 bp, Homo sapiens
ctgggtggggtgaggaccact

SEQ ID NO: 6183068 - DNA, 12 bp, Homo sapiens
ctgggtgggtgg

SEQ ID NO: 6183069 - DNA, 15 bp, Homo sapiens
ctgggtgggtggtgg

SEQ ID NO: 6183070 - DNA, 17 bp, Homo sapiens
ctgggtgggtggtgggg

SEQ ID NO: 6183071 - DNA, 19 bp, Homo sapiens
ctgggtggtacccaggctt

SEQ ID NO: 6183072 - DNA, 19 bp, Homo sapiens
ctgggtggtctgcaggcag

SEQ ID NO: 6183073 - DNA, 21 bp, Homo sapiens
ctgggtggtctgcaggcaggg

SEQ ID NO: 6183074 - DNA, 15 bp, Homo sapiens
ctgggtggtgaagga

SEQ ID NO: 6183075 - DNA, 17 bp, Homo sapiens
ctgggtggtggcctggt

SEQ ID NO: 6183076 - DNA, 20 bp, Homo sapiens
ctgggtgtaaaacctggaga

SEQ ID NO: 6183077 - DNA, 18 bp, Homo sapiens
ctgggtgtcaagtgcctg

SEQ ID NO: 6183078 - DNA, 20 bp, Homo sapiens
ctgggtgtccccgctgctgt

SEQ ID NO: 6183079 - DNA, 17 bp, Homo sapiens
ctgggtgtgacctgaca

SEQ ID NO: 6183080 - DNA, 13 bp, Homo sapiens
ctgggtgtgctcc

SEQ ID NO: 6183081 - DNA, 16 bp, Homo sapiens
ctgggtgtgctccagg

SEQ ID NO: 6183082 - DNA, 20 bp, Homo sapiens
ctgggtgtggcctggcttct

SEQ ID NO: 6183083 - DNA, 22 bp, Homo sapiens
ctgggtgtggcctggcttctgg

SEQ ID NO: 6183084 - DNA, 14 bp, Homo sapiens
ctgggtgtggcgca

SEQ ID NO: 6183085 - DNA, 16 bp, Homo sapiens
ctgggtgtggcgcagc

SEQ ID NO: 6183086 - DNA, 17 bp, Homo sapiens
ctgggtgtggcgcagca

SEQ ID NO: 6183087 - DNA, 22 bp, Homo sapiens
ctgggtgtgttcttactgacac

SEQ ID NO: 6183088 - DNA, 22 bp, Homo sapiens
ctgggtgtgtttggcttggcct

SEQ ID NO: 6183089 - DNA, 19 bp, Homo sapiens
ctgggtgttgaccactcca

SEQ ID NO: 6183090 - DNA, 15 bp, Homo sapiens
ctgggtgttgcattt

SEQ ID NO: 6183091 - DNA, 22 bp, Homo sapiens
ctgggttaaatattttgctaac

SEQ ID NO: 6183092 - DNA, 15 bp, Homo sapiens
ctgggttaacaaatg

SEQ ID NO: 6183093 - DNA, 16 bp, Homo sapiens
ctgggttaacaaatga

SEQ ID NO: 6183094 - DNA, 17 bp, Homo sapiens
ctgggttaacaaatgag

SEQ ID NO: 6183095 - DNA, 19 bp, Homo sapiens
ctgggttagactgccagct

SEQ ID NO: 6183096 - DNA, 20 bp, Homo sapiens
ctgggttagactgccagctc

SEQ ID NO: 6183097 - DNA, 21 bp, Homo sapiens
ctgggttagggtgtgtgttca

SEQ ID NO: 6183098 - DNA, 15 bp, Homo sapiens
ctgggttattcagaa

SEQ ID NO: 6183099 - DNA, 16 bp, Homo sapiens
ctgggttattcagaac

SEQ ID NO: 6183100 - DNA, 22 bp, Homo sapiens
ctgggttcacgtaatcctcctg

SEQ ID NO: 6183101 - DNA, 14 bp, Homo sapiens
ctgggttcactgca

SEQ ID NO: 6183102 - DNA, 23 bp, Homo sapiens
ctgggttcagaaatgctgcctgc

SEQ ID NO: 6183103 - DNA, 22 bp, Homo sapiens
ctgggttccagcaattctcctg

SEQ ID NO: 6183104 - DNA, 20 bp, Homo sapiens
ctgggttccccactggtctg

SEQ ID NO: 6183105 - DNA, 15 bp, Homo sapiens
ctgggttccctaggc

SEQ ID NO: 6183106 - DNA, 18 bp, Homo sapiens
ctgggttccgggaggcag

SEQ ID NO: 6183107 - DNA, 13 bp, Homo sapiens
ctgggttcctgca

SEQ ID NO: 6183108 - DNA, 18 bp, Homo sapiens
ctgggttccttcctctga

SEQ ID NO: 6183109 - DNA, 20 bp, Homo sapiens
ctgggttctgactctggacc

SEQ ID NO: 6183110 - DNA, 15 bp, Homo sapiens
ctgggttctggggca

SEQ ID NO: 6183111 - DNA, 16 bp, Homo sapiens
ctgggttctggggcat

SEQ ID NO: 6183112 - DNA, 17 bp, Homo sapiens
ctgggttctggggcatc

SEQ ID NO: 6183113 - DNA, 20 bp, Homo sapiens
ctgggttgccatggcaatgg

SEQ ID NO: 6183114 - DNA, 20 bp, Homo sapiens
ctgggttgctgctgtccagt

SEQ ID NO: 6183115 - DNA, 13 bp, Homo sapiens
ctgggttggaggg

SEQ ID NO: 6183116 - DNA, 20 bp, Homo sapiens
ctgggttggccagagggccc

SEQ ID NO: 6183117 - DNA, 22 bp, Homo sapiens
ctgggttggcgcaccctcccct

SEQ ID NO: 6183118 - DNA, 23 bp, Homo sapiens
ctgggttggcgcaccctcccctc

SEQ ID NO: 6183119 - DNA, 23 bp, Homo sapiens
ctgggttgggatcaggggtagga

SEQ ID NO: 6183120 - DNA, 15 bp, Homo sapiens
ctgggttgggggcac

SEQ ID NO: 6183121 - DNA, 15 bp, Homo sapiens
ctgggttggtgcaca

SEQ ID NO: 6183122 - DNA, 19 bp, Homo sapiens
ctgggttggtgcacagtga

SEQ ID NO: 6183123 - DNA, 17 bp, Homo sapiens
ctgggttgtcactgaga

SEQ ID NO: 6183124 - DNA, 19 bp, Homo sapiens
ctgggttgtcactgagact

SEQ ID NO: 6183125 - DNA, 22 bp, Homo sapiens
ctgggttgttgtttttttcttt

SEQ ID NO: 6183126 - DNA, 22 bp, Homo sapiens
ctgggtttaaggggagaggaaa

SEQ ID NO: 6183127 - DNA, 22 bp, Homo sapiens
ctgggtttacaacaaacactgt

SEQ ID NO: 6183128 - DNA, 21 bp, Homo sapiens
ctgggtttagcccgaggctgg

SEQ ID NO: 6183129 - DNA, 23 bp, Homo sapiens
ctttgcttcaaattcaaggcctt

SEQ ID NO: 6183130 - DNA, 14 bp, Homo sapiens
ctttgcttcatgtt

SEQ ID NO: 6183131 - DNA, 23 bp, Homo sapiens
ctttgcttcattcaagtcagctc

SEQ ID NO: 6183132 - DNA, 21 bp, Homo sapiens
ctttgcttcccctccaggagg

SEQ ID NO: 6183133 - DNA, 23 bp, Homo sapiens
ctttgcttctccaaatacaagta

SEQ ID NO: 6183134 - DNA, 16 bp, Homo sapiens
ctttgcttctctccac

SEQ ID NO: 6183135 - DNA, 15 bp, Homo sapiens
ctttgcttctttttc

SEQ ID NO: 6183136 - DNA, 14 bp, Homo sapiens
ctttgcttgaaaga

SEQ ID NO: 6183137 - DNA, 14 bp, Homo sapiens
ctttgcttgaacac

SEQ ID NO: 6183138 - DNA, 16 bp, Homo sapiens
ctttgcttgaacacag

SEQ ID NO: 6183139 - DNA, 17 bp, Homo sapiens
ctttgcttgaacacagt

SEQ ID NO: 6183140 - DNA, 14 bp, Homo sapiens
ctttgcttgcagta

SEQ ID NO: 6183141 - DNA, 21 bp, Homo sapiens
ctttgctttaatataaatgca

SEQ ID NO: 6183142 - DNA, 15 bp, Homo sapiens
ctttgctttctgctc

SEQ ID NO: 6183143 - DNA, 16 bp, Homo sapiens
ctttgctttctgctca

SEQ ID NO: 6183144 - DNA, 17 bp, Homo sapiens
ctttgctttgctttctg

SEQ ID NO: 6183145 - DNA, 12 bp, Homo sapiens
ctttgctttggg

SEQ ID NO: 6183146 - DNA, 18 bp, Homo sapiens
ctttgcttttcaaaccag

SEQ ID NO: 6183147 - DNA, 12 bp, Homo sapiens
ctttggaaaaat

SEQ ID NO: 6183148 - DNA, 16 bp, Homo sapiens
ctttggaaaaatcttg

SEQ ID NO: 6183149 - DNA, 18 bp, Homo sapiens
ctttggaaaaatgtttgt

SEQ ID NO: 6183150 - DNA, 21 bp, Homo sapiens
ctttggaaaatgcattgtatc

SEQ ID NO: 6183151 - DNA, 16 bp, Homo sapiens
ctttggaaacaacatt

SEQ ID NO: 6183152 - DNA, 17 bp, Homo sapiens
ctttggaaacaggacca

SEQ ID NO: 6183153 - DNA, 19 bp, Homo sapiens
ctttggaaagagtaggaag

SEQ ID NO: 6183154 - DNA, 22 bp, Homo sapiens
ctttggaaatttggaagatggt

SEQ ID NO: 6183155 - DNA, 20 bp, Homo sapiens
ctttggaacaacagctatct

SEQ ID NO: 6183156 - DNA, 17 bp, Homo sapiens
ctttggaacaagacagc

SEQ ID NO: 6183157 - DNA, 21 bp, Homo sapiens
ctttggaacaagacagccttc

SEQ ID NO: 6183158 - DNA, 14 bp, Homo sapiens
ctttggaacagata

SEQ ID NO: 6183159 - DNA, 14 bp, Homo sapiens
ctttggaaccagac

SEQ ID NO: 6183160 - DNA, 17 bp, Homo sapiens
ctttggaagaaaaaatc

SEQ ID NO: 6183161 - DNA, 13 bp, Homo sapiens
ctttggaagcagc

SEQ ID NO: 6183162 - DNA, 20 bp, Homo sapiens
ctttggaagcagcaaggtgg

SEQ ID NO: 6183163 - DNA, 15 bp, Homo sapiens
ctttggaagcagccc

SEQ ID NO: 6183164 - DNA, 11 bp, Homo sapiens
ctttggaagga

SEQ ID NO: 6183165 - DNA, 17 bp, Homo sapiens
ctttggaaggagtgaga

SEQ ID NO: 6183166 - DNA, 23 bp, Homo sapiens
ctttggaagggtctctctccagg

SEQ ID NO: 6183167 - DNA, 18 bp, Homo sapiens
ctttggaagtttagctct

SEQ ID NO: 6183168 - DNA, 17 bp, Homo sapiens
ctttggaatattttatc

SEQ ID NO: 6183169 - DNA, 22 bp, Homo sapiens
ctttggaatgaaattcctcctt

SEQ ID NO: 6183170 - DNA, 20 bp, Homo sapiens
ctttggaattctgcttctct

SEQ ID NO: 6183171 - DNA, 14 bp, Homo sapiens
ctttggaatttgaa

SEQ ID NO: 6183172 - DNA, 18 bp, Homo sapiens
ctttggaatttgaagaat

SEQ ID NO: 6183173 - DNA, 17 bp, Homo sapiens
ctttggacaacaggaag

SEQ ID NO: 6183174 - DNA, 18 bp, Homo sapiens
ctttggacaacaggaagt

SEQ ID NO: 6183175 - DNA, 15 bp, Homo sapiens
ctttggacaagagga

SEQ ID NO: 6183176 - DNA, 18 bp, Homo sapiens
ctttggacacacacagct

SEQ ID NO: 6183177 - DNA, 14 bp, Homo sapiens
ctttggacagtggc

SEQ ID NO: 6183178 - DNA, 17 bp, Homo sapiens
ctttggacagtggcctc

SEQ ID NO: 6183179 - DNA, 15 bp, Homo sapiens
ctttggacccagggc

SEQ ID NO: 6183180 - DNA, 19 bp, Homo sapiens
ctttggaccctgaggccca

SEQ ID NO: 6183181 - DNA, 15 bp, Homo sapiens
ctttggacctgcagt

SEQ ID NO: 6183182 - DNA, 18 bp, Homo sapiens
ctttggacgcacacagct

SEQ ID NO: 6183183 - DNA, 21 bp, Homo sapiens
ctttggactctcccctcttat

SEQ ID NO: 6183184 - DNA, 16 bp, Homo sapiens
ctttggacttctgaag

SEQ ID NO: 6183185 - DNA, 20 bp, Homo sapiens
ctttggagaacgccagtctc

SEQ ID NO: 6183186 - DNA, 15 bp, Homo sapiens
ctttggagactgggg

SEQ ID NO: 6183187 - DNA, 21 bp, Homo sapiens
ctttggagagctcagtacagg

SEQ ID NO: 6183188 - DNA, 20 bp, Homo sapiens
ctttggagcaaagaaggagc

SEQ ID NO: 6183189 - DNA, 20 bp, Homo sapiens
ctttggaggaattttctaaa

SEQ ID NO: 6183190 - DNA, 14 bp, Homo sapiens
ctttggaggcccct

SEQ ID NO: 6183191 - DNA, 14 bp, Homo sapiens
ctttggagtcccct

SEQ ID NO: 6183192 - DNA, 16 bp, Homo sapiens
ctttggagtcccctca

SEQ ID NO: 6183193 - DNA, 18 bp, Homo sapiens
ctttggataataggaatt

SEQ ID NO: 6183194 - DNA, 19 bp, Homo sapiens
ctttggataataggaattc

SEQ ID NO: 6183195 - DNA, 18 bp, Homo sapiens
ctttggattctaaataca

SEQ ID NO: 6183196 - DNA, 16 bp, Homo sapiens
ctttggcaacatcttg

SEQ ID NO: 6183197 - DNA, 20 bp, Homo sapiens
ctttggcacaccctctctgt

SEQ ID NO: 6183198 - DNA, 21 bp, Homo sapiens
ctttggcacaccctctctgtc

SEQ ID NO: 6183199 - DNA, 14 bp, Homo sapiens
ctttggcactctct

SEQ ID NO: 6183200 - DNA, 12 bp, Homo sapiens
ctttggcactgg

SEQ ID NO: 6183201 - DNA, 16 bp, Homo sapiens
ctttggcactggatgg

SEQ ID NO: 6183202 - DNA, 19 bp, Homo sapiens
ctttggcagaccatctcca

SEQ ID NO: 6183203 - DNA, 13 bp, Homo sapiens
ctttggcaggcct

SEQ ID NO: 6183204 - DNA, 17 bp, Homo sapiens
ctttggcagtgttttgg

SEQ ID NO: 6183205 - DNA, 15 bp, Homo sapiens
ctttggcatgtttaa

SEQ ID NO: 6183206 - DNA, 17 bp, Homo sapiens
ctttggcatgtttaatt

SEQ ID NO: 6183207 - DNA, 22 bp, Homo sapiens
ctttggcattgctgcatatttg

SEQ ID NO: 6183208 - DNA, 18 bp, Homo sapiens
ctttggccaacagggtag

SEQ ID NO: 6183209 - DNA, 12 bp, Homo sapiens
ctttggccacag

SEQ ID NO: 6183210 - DNA, 15 bp, Homo sapiens
ctttggcccaatgcc

SEQ ID NO: 6183211 - DNA, 15 bp, Homo sapiens
ctttggcccagggtg

SEQ ID NO: 6183212 - DNA, 17 bp, Homo sapiens
ctttggccccactttga

SEQ ID NO: 6183213 - DNA, 16 bp, Homo sapiens
ctttggccctcagtgg

SEQ ID NO: 6183214 - DNA, 13 bp, Homo sapiens
ctttggcctgagt

SEQ ID NO: 6183215 - DNA, 21 bp, Homo sapiens
ctttggcctggggtgcatctc

SEQ ID NO: 6183216 - DNA, 14 bp, Homo sapiens
ctttggcctttcct

SEQ ID NO: 6183217 - DNA, 17 bp, Homo sapiens
ctttggcctttccttgt

SEQ ID NO: 6183218 - DNA, 13 bp, Homo sapiens
ctttggctattgt

SEQ ID NO: 6183219 - DNA, 22 bp, Homo sapiens
ctttggctattgtccttgtgta

SEQ ID NO: 6183220 - DNA, 13 bp, Homo sapiens
ctttggctcccct

SEQ ID NO: 6183221 - DNA, 15 bp, Homo sapiens
ctttggctcgggact

SEQ ID NO: 6183222 - DNA, 20 bp, Homo sapiens
ctttggctcgggacttcaaa

SEQ ID NO: 6183223 - DNA, 20 bp, Homo sapiens
ctttggctctattggatttg

SEQ ID NO: 6183224 - DNA, 13 bp, Homo sapiens
ctttggctctgga

SEQ ID NO: 6183225 - DNA, 14 bp, Homo sapiens
ctttggctgagacc

SEQ ID NO: 6183226 - DNA, 22 bp, Homo sapiens
ctttggctgagacctgggattt

SEQ ID NO: 6183227 - DNA, 13 bp, Homo sapiens
ctttggctgcagg

SEQ ID NO: 6183228 - DNA, 14 bp, Homo sapiens
ctttggctgcatgc

SEQ ID NO: 6183229 - DNA, 16 bp, Homo sapiens
ctttggctgcatgcga

SEQ ID NO: 6183230 - DNA, 21 bp, Homo sapiens
ctttggctggtagcagcaggc

SEQ ID NO: 6183231 - DNA, 17 bp, Homo sapiens
ctttggctgtgatgtca

SEQ ID NO: 6183232 - DNA, 14 bp, Homo sapiens
ctttggcttctcct

SEQ ID NO: 6183233 - DNA, 17 bp, Homo sapiens
ctttggcttctcctgtg

SEQ ID NO: 6183234 - DNA, 23 bp, Homo sapiens
ctttggcttctgatttttctctt

SEQ ID NO: 6183235 - DNA, 14 bp, Homo sapiens
ctttgggaaaacat

SEQ ID NO: 6183236 - DNA, 21 bp, Homo sapiens
ctttgggaaaaggtgtaaaac

SEQ ID NO: 6183237 - DNA, 23 bp, Homo sapiens
ctttgggaaaaggtgtaaaacag

SEQ ID NO: 6183238 - DNA, 16 bp, Homo sapiens
ctttgggaaagcccag

SEQ ID NO: 6183239 - DNA, 15 bp, Homo sapiens
ctttgggaaagctgc

SEQ ID NO: 6183240 - DNA, 15 bp, Homo sapiens
ctttgggaaaggaga

SEQ ID NO: 6183241 - DNA, 19 bp, Homo sapiens
ctttgggaacactggcctg

SEQ ID NO: 6183242 - DNA, 21 bp, Homo sapiens
ctttgggaagtttgctgtgct

SEQ ID NO: 6183243 - DNA, 17 bp, Homo sapiens
ctttgggacttgggagc

SEQ ID NO: 6183244 - DNA, 17 bp, Homo sapiens
ctttgggagctcattct

SEQ ID NO: 6183245 - DNA, 14 bp, Homo sapiens
ctttgggaggcagg

SEQ ID NO: 6183246 - DNA, 15 bp, Homo sapiens
ctttgggaggcaggg

SEQ ID NO: 6183247 - DNA, 23 bp, Homo sapiens
ctttgggaggccaaggtgggagg

SEQ ID NO: 6183248 - DNA, 17 bp, Homo sapiens
ctttgggaggctgaggt

SEQ ID NO: 6183249 - DNA, 12 bp, Homo sapiens
ctttgggagtcc

SEQ ID NO: 6183250 - DNA, 17 bp, Homo sapiens
ctttgggatcagcctcc

SEQ ID NO: 6183251 - DNA, 18 bp, Homo sapiens
ctttgggatcccaccctg

SEQ ID NO: 6183252 - DNA, 16 bp, Homo sapiens
ctttgggatcttgaag

SEQ ID NO: 6183253 - DNA, 20 bp, Homo sapiens
ctttgggatgctatttcagc

SEQ ID NO: 6183254 - DNA, 18 bp, Homo sapiens
ctttgggcagatttgcaa

SEQ ID NO: 6183255 - DNA, 19 bp, Homo sapiens
ctttgggcaggtctgagat

SEQ ID NO: 6183256 - DNA, 15 bp, Homo sapiens
ctttgggcccaagaa

SEQ ID NO: 6183257 - DNA, 20 bp, Homo sapiens
ctttgggcccaagaactgca

SEQ ID NO: 6183258 - DNA, 22 bp, Homo sapiens
ctttgggcccaagaactgcaga

SEQ ID NO: 6183259 - DNA, 15 bp, Homo sapiens
ctttgggcccaggga

SEQ ID NO: 6183260 - DNA, 23 bp, Homo sapiens
ctttgggcccagggacaccagcc

SEQ ID NO: 6183261 - DNA, 17 bp, Homo sapiens
ctttgggccctgcatgt

SEQ ID NO: 6183262 - DNA, 23 bp, Homo sapiens
ctttgggccgaatcccccaggga

SEQ ID NO: 6183263 - DNA, 18 bp, Homo sapiens
ctttgggcctctgcttct

SEQ ID NO: 6183264 - DNA, 20 bp, Homo sapiens
ctttgggctgccctggtgct

SEQ ID NO: 6183265 - DNA, 15 bp, Homo sapiens
ctttgggcttttatt

SEQ ID NO: 6183266 - DNA, 20 bp, Homo sapiens
ctttggggaaaaattcttgg

SEQ ID NO: 6183267 - DNA, 22 bp, Homo sapiens
ctttggggaactcaaaggactg

SEQ ID NO: 6183268 - DNA, 19 bp, Homo sapiens
ctttggggacaccctcctg

SEQ ID NO: 6183269 - DNA, 21 bp, Homo sapiens
ctttggggatagtctggaaag

SEQ ID NO: 6183270 - DNA, 15 bp, Homo sapiens
ctttggggctggtgg

SEQ ID NO: 6183271 - DNA, 21 bp, Homo sapiens
ctttggggcttatcagaactc

SEQ ID NO: 6183272 - DNA, 19 bp, Homo sapiens
ctttggggcttctgtgaaa

SEQ ID NO: 6183273 - DNA, 20 bp, Homo sapiens
ctttgggggattcaaatgca

SEQ ID NO: 6183274 - DNA, 21 bp, Homo sapiens
ctttgggggattcaaatgcat

SEQ ID NO: 6183275 - DNA, 23 bp, Homo sapiens
ctttggggggcactagaagatga

SEQ ID NO: 6183276 - DNA, 17 bp, Homo sapiens
ctttggggggtgtgctg

SEQ ID NO: 6183277 - DNA, 18 bp, Homo sapiens
ctttggggggtgtgctga

SEQ ID NO: 6183278 - DNA, 23 bp, Homo sapiens
ctttgggggtgattgtctcgctt

SEQ ID NO: 6183279 - DNA, 18 bp, Homo sapiens
ctttgggggtggaaaagg

SEQ ID NO: 6183280 - DNA, 21 bp, Homo sapiens
ctttggggtcagccagggcca

SEQ ID NO: 6183281 - DNA, 23 bp, Homo sapiens
ctttggggtcctagcccagtgct

SEQ ID NO: 6183282 - DNA, 21 bp, Homo sapiens
ctttgggtactactgctgcaa

SEQ ID NO: 6183283 - DNA, 21 bp, Homo sapiens
ctttgggtagtgccatggcca

SEQ ID NO: 6183284 - DNA, 22 bp, Homo sapiens
ctttgggtcataaatcagaaag

SEQ ID NO: 6183285 - DNA, 20 bp, Homo sapiens
ctttgggtcatttttaacta

SEQ ID NO: 6183286 - DNA, 18 bp, Homo sapiens
ctttgggtccattcagat

SEQ ID NO: 6183287 - DNA, 16 bp, Homo sapiens
ctttgggtcctgggca

SEQ ID NO: 6183288 - DNA, 20 bp, Homo sapiens
ctttgggtcctgggcaggtg

SEQ ID NO: 6183289 - DNA, 23 bp, Homo sapiens
ctttgggtggctcactactgaac

SEQ ID NO: 6183290 - DNA, 20 bp, Homo sapiens
ctttgggttaagcattacca

SEQ ID NO: 6183291 - DNA, 22 bp, Homo sapiens
ctttgggttaagcattaccact

SEQ ID NO: 6183292 - DNA, 22 bp, Homo sapiens
ctttggtaagagttaaagagta

SEQ ID NO: 6183293 - DNA, 20 bp, Homo sapiens
ctttggtaatgtgtcaaaga

SEQ ID NO: 6183294 - DNA, 18 bp, Homo sapiens
ctttggtaattggtttta

SEQ ID NO: 6183295 - DNA, 22 bp, Homo sapiens
ctttggtaattttttttgtttt

SEQ ID NO: 6183296 - DNA, 15 bp, Homo sapiens
ctttggtacacagtt

SEQ ID NO: 6183297 - DNA, 21 bp, Homo sapiens
ctttggtactaataatcttgt

SEQ ID NO: 6183298 - DNA, 18 bp, Homo sapiens
ctttggtactgctgtctt

SEQ ID NO: 6183299 - DNA, 23 bp, Homo sapiens
ctttggtactgctgtcttccaag

SEQ ID NO: 6183300 - DNA, 17 bp, Homo sapiens
ctttggtaggtaaatct

SEQ ID NO: 6183301 - DNA, 15 bp, Homo sapiens
ctttggtcactttta

SEQ ID NO: 6183302 - DNA, 23 bp, Homo sapiens
ctttggtcctaagtccctgcccc

SEQ ID NO: 6183303 - DNA, 21 bp, Homo sapiens
ctttggtcctacccgcttccc

SEQ ID NO: 6183304 - DNA, 12 bp, Homo sapiens
ctttggtcctgg

SEQ ID NO: 6183305 - DNA, 13 bp, Homo sapiens
ctttggtcctggt

SEQ ID NO: 6183306 - DNA, 23 bp, Homo sapiens
ctgggtttattacatggcagtgt

SEQ ID NO: 6183307 - DNA, 17 bp, Homo sapiens
ctgggtttccacacagc

SEQ ID NO: 6183308 - DNA, 12 bp, Homo sapiens
ctgggtttcttt

SEQ ID NO: 6183309 - DNA, 17 bp, Homo sapiens
ctgggtttgaagctgct

SEQ ID NO: 6183310 - DNA, 14 bp, Homo sapiens
ctgggtttgcccag

SEQ ID NO: 6183311 - DNA, 19 bp, Homo sapiens
ctgggtttgcccagtcctg

SEQ ID NO: 6183312 - DNA, 14 bp, Homo sapiens
ctgggtttgctccc

SEQ ID NO: 6183313 - DNA, 16 bp, Homo sapiens
ctgggtttgctgtctt

SEQ ID NO: 6183314 - DNA, 16 bp, Homo sapiens
ctgggtttggacccca

SEQ ID NO: 6183315 - DNA, 18 bp, Homo sapiens
ctgggtttggaccccagc

SEQ ID NO: 6183316 - DNA, 21 bp, Homo sapiens
ctgggtttggaccccagctgg

SEQ ID NO: 6183317 - DNA, 22 bp, Homo sapiens
ctgggtttggaccccagctggg

SEQ ID NO: 6183318 - DNA, 17 bp, Homo sapiens
ctgggtttggcccaaga

SEQ ID NO: 6183319 - DNA, 14 bp, Homo sapiens
ctgggtttggcccc

SEQ ID NO: 6183320 - DNA, 17 bp, Homo sapiens
ctgggtttgggagccag

SEQ ID NO: 6183321 - DNA, 18 bp, Homo sapiens
ctgggtttgggagccagg

SEQ ID NO: 6183322 - DNA, 20 bp, Homo sapiens
ctgggtttgggagccaggac

SEQ ID NO: 6183323 - DNA, 18 bp, Homo sapiens
ctgggtttgggcagtgga

SEQ ID NO: 6183324 - DNA, 22 bp, Homo sapiens
ctgggtttgggcagtggagagg

SEQ ID NO: 6183325 - DNA, 23 bp, Homo sapiens
ctgggtttgtttttcaaagcctg

SEQ ID NO: 6183326 - DNA, 17 bp, Homo sapiens
ctgggttttagaaattc

SEQ ID NO: 6183327 - DNA, 20 bp, Homo sapiens
ctgggttttctaactgtaaa

SEQ ID NO: 6183328 - DNA, 21 bp, Homo sapiens
ctgggttttgtctctgcatct

SEQ ID NO: 6183329 - DNA, 18 bp, Homo sapiens
ctgggttttgttggcttt

SEQ ID NO: 6183330 - DNA, 20 bp, Homo sapiens
ctggtaaaaagatccaggga

SEQ ID NO: 6183331 - DNA, 12 bp, Homo sapiens
ctggtaaaaatg

SEQ ID NO: 6183332 - DNA, 17 bp, Homo sapiens
ctggtaaaagggataca

SEQ ID NO: 6183333 - DNA, 16 bp, Homo sapiens
ctggtaaaatgaagaa

SEQ ID NO: 6183334 - DNA, 22 bp, Homo sapiens
ctggtaaccaaatattaaagat

SEQ ID NO: 6183335 - DNA, 19 bp, Homo sapiens
ctggtaactggaaggcctt

SEQ ID NO: 6183336 - DNA, 15 bp, Homo sapiens
ctggtaagactgctg

SEQ ID NO: 6183337 - DNA, 18 bp, Homo sapiens
ctggtaagactgctggtt

SEQ ID NO: 6183338 - DNA, 20 bp, Homo sapiens
ctggtaagattgttattaaa

SEQ ID NO: 6183339 - DNA, 19 bp, Homo sapiens
ctggtaagcgatttgaaac

SEQ ID NO: 6183340 - DNA, 20 bp, Homo sapiens
ctggtaagggaccttcaggg

SEQ ID NO: 6183341 - DNA, 15 bp, Homo sapiens
ctggtaagggccaag

SEQ ID NO: 6183342 - DNA, 18 bp, Homo sapiens
ctggtaagtggctttttg

SEQ ID NO: 6183343 - DNA, 22 bp, Homo sapiens
ctggtaagtggctttttgtact

SEQ ID NO: 6183344 - DNA, 21 bp, Homo sapiens
ctggtaataaatgtgactcag

SEQ ID NO: 6183345 - DNA, 15 bp, Homo sapiens
ctggtaatattgact

SEQ ID NO: 6183346 - DNA, 19 bp, Homo sapiens
ctggtaattcctctccagg

SEQ ID NO: 6183347 - DNA, 22 bp, Homo sapiens
ctggtaattcctctccaggcca

SEQ ID NO: 6183348 - DNA, 17 bp, Homo sapiens
ctggtaattgtacaata

SEQ ID NO: 6183349 - DNA, 22 bp, Homo sapiens
ctggtaatttgtatctgaagga

SEQ ID NO: 6183350 - DNA, 15 bp, Homo sapiens
ctggtacagcagggt

SEQ ID NO: 6183351 - DNA, 17 bp, Homo sapiens
ctggtacagcagggtct

SEQ ID NO: 6183352 - DNA, 23 bp, Homo sapiens
ctggtacagcagggtcttgctgt

SEQ ID NO: 6183353 - DNA, 14 bp, Homo sapiens
ctggtacccagcca

SEQ ID NO: 6183354 - DNA, 16 bp, Homo sapiens
ctggtacccagccatc

SEQ ID NO: 6183355 - DNA, 18 bp, Homo sapiens
ctggtacccagccatctg

SEQ ID NO: 6183356 - DNA, 23 bp, Homo sapiens
ctggtacccagccatctgcccag

SEQ ID NO: 6183357 - DNA, 19 bp, Homo sapiens
ctggtacccgcccttccga

SEQ ID NO: 6183358 - DNA, 14 bp, Homo sapiens
ctggtaccctcctg

SEQ ID NO: 6183359 - DNA, 21 bp, Homo sapiens
ctggtacctgccctctattta

SEQ ID NO: 6183360 - DNA, 19 bp, Homo sapiens
ctggtacctggacggtgcg

SEQ ID NO: 6183361 - DNA, 15 bp, Homo sapiens
ctggtaccttccccc

SEQ ID NO: 6183362 - DNA, 21 bp, Homo sapiens
ctggtaccttcccccagcttt

SEQ ID NO: 6183363 - DNA, 16 bp, Homo sapiens
ctggtactctcctaga

SEQ ID NO: 6183364 - DNA, 16 bp, Homo sapiens
ctggtactctggcaaa

SEQ ID NO: 6183365 - DNA, 16 bp, Homo sapiens
ctggtactctgtgaaa

SEQ ID NO: 6183366 - DNA, 15 bp, Homo sapiens
ctggtactgatgttc

SEQ ID NO: 6183367 - DNA, 16 bp, Homo sapiens
ctggtactgatgttca

SEQ ID NO: 6183368 - DNA, 17 bp, Homo sapiens
ctggtactgatgttcac

SEQ ID NO: 6183369 - DNA, 16 bp, Homo sapiens
ctggtacttcctttct

SEQ ID NO: 6183370 - DNA, 15 bp, Homo sapiens
ctggtactttctgta

SEQ ID NO: 6183371 - DNA, 22 bp, Homo sapiens
ctggtagaagggaaagcccata

SEQ ID NO: 6183372 - DNA, 20 bp, Homo sapiens
ctggtagaattgggaagctg

SEQ ID NO: 6183373 - DNA, 16 bp, Homo sapiens
ctggtagagaccccca

SEQ ID NO: 6183374 - DNA, 14 bp, Homo sapiens
ctggtagagatgga

SEQ ID NO: 6183375 - DNA, 15 bp, Homo sapiens
ctggtagatagaaat

SEQ ID NO: 6183376 - DNA, 20 bp, Homo sapiens
ctggtagcagaatgcacatt

SEQ ID NO: 6183377 - DNA, 14 bp, Homo sapiens
ctggtagcagcagg

SEQ ID NO: 6183378 - DNA, 19 bp, Homo sapiens
ctggtagcagcaggctcag

SEQ ID NO: 6183379 - DNA, 20 bp, Homo sapiens
ctggtagcataaataaaact

SEQ ID NO: 6183380 - DNA, 21 bp, Homo sapiens
ctggtagcataaataaaactg

SEQ ID NO: 6183381 - DNA, 19 bp, Homo sapiens
ctggtagcatgatggctgt

SEQ ID NO: 6183382 - DNA, 16 bp, Homo sapiens
ctggtagctcaggtgg

SEQ ID NO: 6183383 - DNA, 14 bp, Homo sapiens
ctggtagctgaggg

SEQ ID NO: 6183384 - DNA, 18 bp, Homo sapiens
ctggtaggaaagggcaag

SEQ ID NO: 6183385 - DNA, 17 bp, Homo sapiens
ctggtaggaagaggtac

SEQ ID NO: 6183386 - DNA, 23 bp, Homo sapiens
ctggtaggaatagcatgtcacta

SEQ ID NO: 6183387 - DNA, 17 bp, Homo sapiens
ctggtaggaccaagcat

SEQ ID NO: 6183388 - DNA, 18 bp, Homo sapiens
ctggtaggaccaagcatc

SEQ ID NO: 6183389 - DNA, 17 bp, Homo sapiens
ctggtaggggagaaatg

SEQ ID NO: 6183390 - DNA, 21 bp, Homo sapiens
ctggtaggtctggattttcaa

SEQ ID NO: 6183391 - DNA, 17 bp, Homo sapiens
ctggtaggttctgtctg

SEQ ID NO: 6183392 - DNA, 18 bp, Homo sapiens
ctggtaggttctgtctgt

SEQ ID NO: 6183393 - DNA, 22 bp, Homo sapiens
ctggtagttcattgtaaatgaa

SEQ ID NO: 6183394 - DNA, 22 bp, Homo sapiens
ctggtatatatttaggatttgt

SEQ ID NO: 6183395 - DNA, 19 bp, Homo sapiens
ctggtatatccaaaagctt

SEQ ID NO: 6183396 - DNA, 23 bp, Homo sapiens
ctggtatctcagaaagtgcctga

SEQ ID NO: 6183397 - DNA, 19 bp, Homo sapiens
ctggtatctggcgttcttt

SEQ ID NO: 6183398 - DNA, 20 bp, Homo sapiens
ctggtatgaacttgaggaca

SEQ ID NO: 6183399 - DNA, 14 bp, Homo sapiens
ctggtatgaataat

SEQ ID NO: 6183400 - DNA, 13 bp, Homo sapiens
ctggtatgatgta

SEQ ID NO: 6183401 - DNA, 17 bp, Homo sapiens
ctggtatggctgcagtc

SEQ ID NO: 6183402 - DNA, 19 bp, Homo sapiens
ctggtatgggtttctccca

SEQ ID NO: 6183403 - DNA, 23 bp, Homo sapiens
ctggtatgggtttctcccagttc

SEQ ID NO: 6183404 - DNA, 21 bp, Homo sapiens
ctggtatggtgctaatatttt

SEQ ID NO: 6183405 - DNA, 12 bp, Homo sapiens
ctggtattaaat

SEQ ID NO: 6183406 - DNA, 15 bp, Homo sapiens
ctggtattaaatgcc

SEQ ID NO: 6183407 - DNA, 20 bp, Homo sapiens
ctggtattagttaaaacaca

SEQ ID NO: 6183408 - DNA, 14 bp, Homo sapiens
ctggtattcacaga

SEQ ID NO: 6183409 - DNA, 14 bp, Homo sapiens
ctggtattcctgcc

SEQ ID NO: 6183410 - DNA, 21 bp, Homo sapiens
ctggtattctctctatgcaaa

SEQ ID NO: 6183411 - DNA, 18 bp, Homo sapiens
ctggtattctgttctgga

SEQ ID NO: 6183412 - DNA, 20 bp, Homo sapiens
ctggtattctgttctggagg

SEQ ID NO: 6183413 - DNA, 16 bp, Homo sapiens
ctggtattggaatagc

SEQ ID NO: 6183414 - DNA, 21 bp, Homo sapiens
ctggtattggaatagcagcct

SEQ ID NO: 6183415 - DNA, 20 bp, Homo sapiens
ctggtattggtggctttcct

SEQ ID NO: 6183416 - DNA, 15 bp, Homo sapiens
ctggtattgtaatat

SEQ ID NO: 6183417 - DNA, 16 bp, Homo sapiens
ctggtattgtaatatt

SEQ ID NO: 6183418 - DNA, 15 bp, Homo sapiens
ctggtattgttctca

SEQ ID NO: 6183419 - DNA, 17 bp, Homo sapiens
ctggtattgttctcaca

SEQ ID NO: 6183420 - DNA, 14 bp, Homo sapiens
ctggtatttcccct

SEQ ID NO: 6183421 - DNA, 12 bp, Homo sapiens
ctggtatttcct

SEQ ID NO: 6183422 - DNA, 14 bp, Homo sapiens
ctggtattttatct

SEQ ID NO: 6183423 - DNA, 23 bp, Homo sapiens
ctggtcaaacaaactctctgaac

SEQ ID NO: 6183424 - DNA, 14 bp, Homo sapiens
ctggtcaaccccac

SEQ ID NO: 6183425 - DNA, 19 bp, Homo sapiens
ctggtcaacccgctgcttc

SEQ ID NO: 6183426 - DNA, 20 bp, Homo sapiens
ctggtcaagttgagattttt

SEQ ID NO: 6183427 - DNA, 22 bp, Homo sapiens
ctggtcacacaaggaactcttg

SEQ ID NO: 6183428 - DNA, 19 bp, Homo sapiens
ctggtcacagcctcctctg

SEQ ID NO: 6183429 - DNA, 21 bp, Homo sapiens
ctggtcacaggactctgcctc

SEQ ID NO: 6183430 - DNA, 23 bp, Homo sapiens
ctggtcacaggactctgcctcct

SEQ ID NO: 6183431 - DNA, 23 bp, Homo sapiens
ctggtcacagggcatgccccggc

SEQ ID NO: 6183432 - DNA, 19 bp, Homo sapiens
ctggtcaccaaggcagtgc

SEQ ID NO: 6183433 - DNA, 20 bp, Homo sapiens
ctggtcaccaaggcagtgca

SEQ ID NO: 6183434 - DNA, 22 bp, Homo sapiens
ctggtcaccaaggcagtgcatg

SEQ ID NO: 6183435 - DNA, 20 bp, Homo sapiens
ctggtcaccctggggctgct

SEQ ID NO: 6183436 - DNA, 20 bp, Homo sapiens
ctggtcaccgagactcagcc

SEQ ID NO: 6183437 - DNA, 24 bp, Homo sapiens
ctggtcaccgagactcagcctctg

SEQ ID NO: 6183438 - DNA, 14 bp, Homo sapiens
ctggtcacctagga

SEQ ID NO: 6183439 - DNA, 16 bp, Homo sapiens
ctggtcacctaggaag

SEQ ID NO: 6183440 - DNA, 19 bp, Homo sapiens
ctggtcacctaggaagcct

SEQ ID NO: 6183441 - DNA, 13 bp, Homo sapiens
ctggtcacctccc

SEQ ID NO: 6183442 - DNA, 15 bp, Homo sapiens
ctggtcacctcccat

SEQ ID NO: 6183443 - DNA, 19 bp, Homo sapiens
ctggtcaccttgcactcct

SEQ ID NO: 6183444 - DNA, 17 bp, Homo sapiens
ctggtcactctgccctc

SEQ ID NO: 6183445 - DNA, 18 bp, Homo sapiens
ctggtcactctgccctct

SEQ ID NO: 6183446 - DNA, 19 bp, Homo sapiens
ctggtcactctgccctctg

SEQ ID NO: 6183447 - DNA, 20 bp, Homo sapiens
ctggtcactctgccctctgc

SEQ ID NO: 6183448 - DNA, 24 bp, Homo sapiens
ctggtcactctgccctctgctgct

SEQ ID NO: 6183449 - DNA, 14 bp, Homo sapiens
ctggtcactgccat

SEQ ID NO: 6183450 - DNA, 21 bp, Homo sapiens
ctggtcagaactgcagggcct

SEQ ID NO: 6183451 - DNA, 13 bp, Homo sapiens
ctggtcagagaga

SEQ ID NO: 6183452 - DNA, 18 bp, Homo sapiens
ctggtcagagagacctca

SEQ ID NO: 6183453 - DNA, 13 bp, Homo sapiens
ctggtcagagcca

SEQ ID NO: 6183454 - DNA, 14 bp, Homo sapiens
ctggtcagagccac

SEQ ID NO: 6183455 - DNA, 15 bp, Homo sapiens
ctggtcagagccaca

SEQ ID NO: 6183456 - DNA, 19 bp, Homo sapiens
ctggtcagagccacagggt

SEQ ID NO: 6183457 - DNA, 13 bp, Homo sapiens
ctggtcagagtgg

SEQ ID NO: 6183458 - DNA, 20 bp, Homo sapiens
ctggtcagcagagccgcccc

SEQ ID NO: 6183459 - DNA, 13 bp, Homo sapiens
ctggtcagcccaa

SEQ ID NO: 6183460 - DNA, 14 bp, Homo sapiens
ctggtcagcttgct

SEQ ID NO: 6183461 - DNA, 19 bp, Homo sapiens
ctggtcaggcaatgccctg

SEQ ID NO: 6183462 - DNA, 21 bp, Homo sapiens
ctggtcaggcaatgccctgcg

SEQ ID NO: 6183463 - DNA, 22 bp, Homo sapiens
ctggtcaggcaatgccctgcgg

SEQ ID NO: 6183464 - DNA, 21 bp, Homo sapiens
ctggtcaggcccactgcagag

SEQ ID NO: 6183465 - DNA, 15 bp, Homo sapiens
ctggtcagggcagtg

SEQ ID NO: 6183466 - DNA, 18 bp, Homo sapiens
ctggtcagggcagtggcc

SEQ ID NO: 6183467 - DNA, 22 bp, Homo sapiens
ctggtcagggcagtggccaagc

SEQ ID NO: 6183468 - DNA, 12 bp, Homo sapiens
ctggtcagtctt

SEQ ID NO: 6183469 - DNA, 22 bp, Homo sapiens
ctggtcagtgaagcccaggagg

SEQ ID NO: 6183470 - DNA, 19 bp, Homo sapiens
ctggtcagttttcacagag

SEQ ID NO: 6183471 - DNA, 21 bp, Homo sapiens
ctggtcagttttcacagaggc

SEQ ID NO: 6183472 - DNA, 13 bp, Homo sapiens
ctggtcatacatt

SEQ ID NO: 6183473 - DNA, 19 bp, Homo sapiens
ctggtcatcagtattgtgt

SEQ ID NO: 6183474 - DNA, 15 bp, Homo sapiens
ctggtcatcctgggc

SEQ ID NO: 6183475 - DNA, 20 bp, Homo sapiens
ctggtcatccttggtgctct

SEQ ID NO: 6183476 - DNA, 21 bp, Homo sapiens
ctggtcatccttggtgctctt

SEQ ID NO: 6183477 - DNA, 21 bp, Homo sapiens
ctggtcattaatgtgtcccct

SEQ ID NO: 6183478 - DNA, 20 bp, Homo sapiens
ctggtcatttcccccaaagg

SEQ ID NO: 6183479 - DNA, 15 bp, Homo sapiens
ctggtccaaaagatt

SEQ ID NO: 6183480 - DNA, 22 bp, Homo sapiens
ctggtccaaaagattgctgaaa

SEQ ID NO: 6183481 - DNA, 18 bp, Homo sapiens
ctggtccacacaccacag

SEQ ID NO: 6183482 - DNA, 19 bp, Homo sapiens
ctttggtcctggtgctgcc

SEQ ID NO: 6183483 - DNA, 14 bp, Homo sapiens
ctttggtccttcaa

SEQ ID NO: 6183484 - DNA, 23 bp, Homo sapiens
ctttggtctccatttttcccagg

SEQ ID NO: 6183485 - DNA, 15 bp, Homo sapiens
ctttggtctcttgct

SEQ ID NO: 6183486 - DNA, 16 bp, Homo sapiens
ctttggtctcttgctt

SEQ ID NO: 6183487 - DNA, 22 bp, Homo sapiens
ctttggtgcagaggtttcttga

SEQ ID NO: 6183488 - DNA, 13 bp, Homo sapiens
ctttggtgcctca

SEQ ID NO: 6183489 - DNA, 16 bp, Homo sapiens
ctttggtgcctttcct

SEQ ID NO: 6183490 - DNA, 17 bp, Homo sapiens
ctttggtggagataaag

SEQ ID NO: 6183491 - DNA, 23 bp, Homo sapiens
ctttggtggcccctccccaactc

SEQ ID NO: 6183492 - DNA, 15 bp, Homo sapiens
ctttggtgttctggc

SEQ ID NO: 6183493 - DNA, 14 bp, Homo sapiens
ctttggttaaaaat

SEQ ID NO: 6183494 - DNA, 20 bp, Homo sapiens
ctttggttaaatagtctaga

SEQ ID NO: 6183495 - DNA, 19 bp, Homo sapiens
ctttggttatatttagctc

SEQ ID NO: 6183496 - DNA, 20 bp, Homo sapiens
ctttggttatgaaacatgtg

SEQ ID NO: 6183497 - DNA, 23 bp, Homo sapiens
ctttggttattttactttttgga

SEQ ID NO: 6183498 - DNA, 14 bp, Homo sapiens
ctttggttccatgt

SEQ ID NO: 6183499 - DNA, 16 bp, Homo sapiens
ctttggttccttctct

SEQ ID NO: 6183500 - DNA, 15 bp, Homo sapiens
ctttggttctaagga

SEQ ID NO: 6183501 - DNA, 15 bp, Homo sapiens
ctttggttctctgat

SEQ ID NO: 6183502 - DNA, 19 bp, Homo sapiens
ctttggttggcagcattcc

SEQ ID NO: 6183503 - DNA, 20 bp, Homo sapiens
ctttggtttaatttaaagcc

SEQ ID NO: 6183504 - DNA, 23 bp, Homo sapiens
ctttggtttatggttttcattca

SEQ ID NO: 6183505 - DNA, 16 bp, Homo sapiens
ctttggtttggcctcc

SEQ ID NO: 6183506 - DNA, 16 bp, Homo sapiens
ctttggttttcttgtt

SEQ ID NO: 6183507 - DNA, 17 bp, Homo sapiens
ctttggttttgctgaga

SEQ ID NO: 6183508 - DNA, 18 bp, Homo sapiens
ctttggttttggaggagg

SEQ ID NO: 6183509 - DNA, 15 bp, Homo sapiens
ctttgtaaaacagcc

SEQ ID NO: 6183510 - DNA, 15 bp, Homo sapiens
ctttgtaaaggtcag

SEQ ID NO: 6183511 - DNA, 13 bp, Homo sapiens
ctttgtaaattat

SEQ ID NO: 6183512 - DNA, 22 bp, Homo sapiens
ctttgtaaattattttatgtca

SEQ ID NO: 6183513 - DNA, 12 bp, Homo sapiens
ctttgtaaattc

SEQ ID NO: 6183514 - DNA, 16 bp, Homo sapiens
ctttgtaaattctgat

SEQ ID NO: 6183515 - DNA, 15 bp, Homo sapiens
ctttgtaaattgtca

SEQ ID NO: 6183516 - DNA, 21 bp, Homo sapiens
ctttgtaaccagaattataca

SEQ ID NO: 6183517 - DNA, 16 bp, Homo sapiens
ctttgtaagaaaacca

SEQ ID NO: 6183518 - DNA, 18 bp, Homo sapiens
ctttgtaagaactaaaga

SEQ ID NO: 6183519 - DNA, 18 bp, Homo sapiens
ctttgtaagacatttgta

SEQ ID NO: 6183520 - DNA, 20 bp, Homo sapiens
ctttgtaagagtgtagaagc

SEQ ID NO: 6183521 - DNA, 22 bp, Homo sapiens
ctttgtaagagtgtagaagcat

SEQ ID NO: 6183522 - DNA, 21 bp, Homo sapiens
ctttgtaagtaaactgccctg

SEQ ID NO: 6183523 - DNA, 16 bp, Homo sapiens
ctttgtaatactttct

SEQ ID NO: 6183524 - DNA, 13 bp, Homo sapiens
ctttgtaatatga

SEQ ID NO: 6183525 - DNA, 15 bp, Homo sapiens
ctttgtaatatgaga

SEQ ID NO: 6183526 - DNA, 21 bp, Homo sapiens
ctttgtaatatgagaatgtat

SEQ ID NO: 6183527 - DNA, 18 bp, Homo sapiens
ctttgtaattcagaaatc

SEQ ID NO: 6183528 - DNA, 14 bp, Homo sapiens
ctttgtaattgaca

SEQ ID NO: 6183529 - DNA, 21 bp, Homo sapiens
ctttgtaatttttggggaaaa

SEQ ID NO: 6183530 - DNA, 22 bp, Homo sapiens
ctttgtacagtggagaaatatt

SEQ ID NO: 6183531 - DNA, 15 bp, Homo sapiens
ctttgtaccaaaatt

SEQ ID NO: 6183532 - DNA, 12 bp, Homo sapiens
ctttgtaccccc

SEQ ID NO: 6183533 - DNA, 16 bp, Homo sapiens
ctttgtacttgtgatg

SEQ ID NO: 6183534 - DNA, 21 bp, Homo sapiens
ctttgtacttgtgtttgctta

SEQ ID NO: 6183535 - DNA, 14 bp, Homo sapiens
ctttgtagaaagca

SEQ ID NO: 6183536 - DNA, 20 bp, Homo sapiens
ctttgtagactgtttcacat

SEQ ID NO: 6183537 - DNA, 21 bp, Homo sapiens
ctttgtagatccttagaggtc

SEQ ID NO: 6183538 - DNA, 23 bp, Homo sapiens
ctttgtagatgtattttcaataa

SEQ ID NO: 6183539 - DNA, 21 bp, Homo sapiens
ctttgtagctaacagtgaaga

SEQ ID NO: 6183540 - DNA, 13 bp, Homo sapiens
ctttgtagctact

SEQ ID NO: 6183541 - DNA, 15 bp, Homo sapiens
ctttgtagctacttt

SEQ ID NO: 6183542 - DNA, 15 bp, Homo sapiens
ctttgtagcttaaaa

SEQ ID NO: 6183543 - DNA, 17 bp, Homo sapiens
ctttgtagcttaaaaaa

SEQ ID NO: 6183544 - DNA, 15 bp, Homo sapiens
ctttgtaggacaaaa

SEQ ID NO: 6183545 - DNA, 20 bp, Homo sapiens
ctttgtaggtgagatgcaac

SEQ ID NO: 6183546 - DNA, 22 bp, Homo sapiens
ctttgtaggtgagatgcaacaa

SEQ ID NO: 6183547 - DNA, 20 bp, Homo sapiens
ctttgtagttaatgtactct

SEQ ID NO: 6183548 - DNA, 18 bp, Homo sapiens
ctttgtagttactcaagc

SEQ ID NO: 6183549 - DNA, 15 bp, Homo sapiens
ctttgtagtttgctt

SEQ ID NO: 6183550 - DNA, 13 bp, Homo sapiens
ctttgtataaatt

SEQ ID NO: 6183551 - DNA, 14 bp, Homo sapiens
ctttgtatacttta

SEQ ID NO: 6183552 - DNA, 11 bp, Homo sapiens
ctttgtataga

SEQ ID NO: 6183553 - DNA, 12 bp, Homo sapiens
ctttgtatagtt

SEQ ID NO: 6183554 - DNA, 15 bp, Homo sapiens
ctttgtatcttccat

SEQ ID NO: 6183555 - DNA, 13 bp, Homo sapiens
ctttgtatgtgga

SEQ ID NO: 6183556 - DNA, 16 bp, Homo sapiens
ctttgtatgtggaagt

SEQ ID NO: 6183557 - DNA, 13 bp, Homo sapiens
ctttgtattataa

SEQ ID NO: 6183558 - DNA, 14 bp, Homo sapiens
ctttgtattataaa

SEQ ID NO: 6183559 - DNA, 15 bp, Homo sapiens
ctttgtattataaaa

SEQ ID NO: 6183560 - DNA, 18 bp, Homo sapiens
ctttgtattataaaattt

SEQ ID NO: 6183561 - DNA, 20 bp, Homo sapiens
ctttgtattataattgttga

SEQ ID NO: 6183562 - DNA, 23 bp, Homo sapiens
ctttgtattataattgttgatat

SEQ ID NO: 6183563 - DNA, 13 bp, Homo sapiens
ctttgtattcaaa

SEQ ID NO: 6183564 - DNA, 18 bp, Homo sapiens
ctttgtattctctgtcca

SEQ ID NO: 6183565 - DNA, 22 bp, Homo sapiens
ctttgtattctctgtccagggc

SEQ ID NO: 6183566 - DNA, 16 bp, Homo sapiens
ctttgtattctgtctt

SEQ ID NO: 6183567 - DNA, 17 bp, Homo sapiens
ctttgtattcttcatga

SEQ ID NO: 6183568 - DNA, 21 bp, Homo sapiens
ctttgtattcttcatgaaatg

SEQ ID NO: 6183569 - DNA, 22 bp, Homo sapiens
ctttgtattgtatattacaatg

SEQ ID NO: 6183570 - DNA, 15 bp, Homo sapiens
ctttgtattgtccta

SEQ ID NO: 6183571 - DNA, 22 bp, Homo sapiens
ctttgtattgtcctattagtgt

SEQ ID NO: 6183572 - DNA, 23 bp, Homo sapiens
ctttgtatttttacttttaaatg

SEQ ID NO: 6183573 - DNA, 14 bp, Homo sapiens
ctttgtatttttct

SEQ ID NO: 6183574 - DNA, 16 bp, Homo sapiens
ctttgtcaaaaggaag

SEQ ID NO: 6183575 - DNA, 13 bp, Homo sapiens
ctttgtcaaatgg

SEQ ID NO: 6183576 - DNA, 22 bp, Homo sapiens
ctttgtcaccctaacttcgtat

SEQ ID NO: 6183577 - DNA, 16 bp, Homo sapiens
ctttgtcactgtttca

SEQ ID NO: 6183578 - DNA, 16 bp, Homo sapiens
ctttgtcacttatttc

SEQ ID NO: 6183579 - DNA, 13 bp, Homo sapiens
ctttgtcacttct

SEQ ID NO: 6183580 - DNA, 16 bp, Homo sapiens
ctttgtcacttgccac

SEQ ID NO: 6183581 - DNA, 14 bp, Homo sapiens
ctttgtcagtgttg

SEQ ID NO: 6183582 - DNA, 18 bp, Homo sapiens
ctttgtcatctttcttct

SEQ ID NO: 6183583 - DNA, 18 bp, Homo sapiens
ctttgtcattcagttcta

SEQ ID NO: 6183584 - DNA, 21 bp, Homo sapiens
ctttgtcattcagttctaggc

SEQ ID NO: 6183585 - DNA, 15 bp, Homo sapiens
ctttgtcccacagct

SEQ ID NO: 6183586 - DNA, 21 bp, Homo sapiens
ctttgtccccacacagcctct

SEQ ID NO: 6183587 - DNA, 15 bp, Homo sapiens
ctttgtccccaccgc

SEQ ID NO: 6183588 - DNA, 15 bp, Homo sapiens
ctttgtcctcctgct

SEQ ID NO: 6183589 - DNA, 16 bp, Homo sapiens
ctttgtcctcctgctg

SEQ ID NO: 6183590 - DNA, 17 bp, Homo sapiens
ctttgtcctcctgctgc

SEQ ID NO: 6183591 - DNA, 18 bp, Homo sapiens
ctttgtcctcctgctgcc

SEQ ID NO: 6183592 - DNA, 18 bp, Homo sapiens
ctttgtctaagaaacatt

SEQ ID NO: 6183593 - DNA, 22 bp, Homo sapiens
ctttgtctaagtagggccaggg

SEQ ID NO: 6183594 - DNA, 23 bp, Homo sapiens
ctttgtctaagtagggccagggc

SEQ ID NO: 6183595 - DNA, 24 bp, Homo sapiens
ctttgtctaagtagggccagggca

SEQ ID NO: 6183596 - DNA, 20 bp, Homo sapiens
ctttgtctacaccattatgt

SEQ ID NO: 6183597 - DNA, 23 bp, Homo sapiens
ctttgtctacaccattatgtgcg

SEQ ID NO: 6183598 - DNA, 15 bp, Homo sapiens
ctttgtctcaccagc

SEQ ID NO: 6183599 - DNA, 19 bp, Homo sapiens
ctttgtctcacgattccag

SEQ ID NO: 6183600 - DNA, 21 bp, Homo sapiens
ctttgtctcacgattccagtg

SEQ ID NO: 6183601 - DNA, 23 bp, Homo sapiens
ctttgtctcacgattccagtgca

SEQ ID NO: 6183602 - DNA, 19 bp, Homo sapiens
ctttgtctctcctggctgg

SEQ ID NO: 6183603 - DNA, 13 bp, Homo sapiens
ctttgtctgaagg

SEQ ID NO: 6183604 - DNA, 16 bp, Homo sapiens
ctttgtctgctcccaa

SEQ ID NO: 6183605 - DNA, 16 bp, Homo sapiens
ctttgtctggatgcac

SEQ ID NO: 6183606 - DNA, 13 bp, Homo sapiens
ctttgtctgtaca

SEQ ID NO: 6183607 - DNA, 22 bp, Homo sapiens
ctttgtctgtacatactggcct

SEQ ID NO: 6183608 - DNA, 14 bp, Homo sapiens
ctttgtcttgaaaa

SEQ ID NO: 6183609 - DNA, 17 bp, Homo sapiens
ctttgtcttgaaaaaaa

SEQ ID NO: 6183610 - DNA, 21 bp, Homo sapiens
ctttgtctttctttgtcattc

SEQ ID NO: 6183611 - DNA, 15 bp, Homo sapiens
ctttgtctttttcct

SEQ ID NO: 6183612 - DNA, 17 bp, Homo sapiens
ctttgtcttttttttca

SEQ ID NO: 6183613 - DNA, 23 bp, Homo sapiens
ctttgtgacaggaaagccctccc

SEQ ID NO: 6183614 - DNA, 13 bp, Homo sapiens
ctttgtgaccaga

SEQ ID NO: 6183615 - DNA, 15 bp, Homo sapiens
ctttgtgactattaa

SEQ ID NO: 6183616 - DNA, 19 bp, Homo sapiens
ctttgtgactattaaatgt

SEQ ID NO: 6183617 - DNA, 23 bp, Homo sapiens
ctttgtgactgtcacttgctgct

SEQ ID NO: 6183618 - DNA, 14 bp, Homo sapiens
ctttgtgagagagg

SEQ ID NO: 6183619 - DNA, 22 bp, Homo sapiens
ctttgtgagagaggacctccat

SEQ ID NO: 6183620 - DNA, 19 bp, Homo sapiens
ctttgtgagagtgagctgt

SEQ ID NO: 6183621 - DNA, 22 bp, Homo sapiens
ctttgtgagccaaagcttatgt

SEQ ID NO: 6183622 - DNA, 15 bp, Homo sapiens
ctttgtgaggaagcc

SEQ ID NO: 6183623 - DNA, 22 bp, Homo sapiens
ctttgtgagtattctatgtaaa

SEQ ID NO: 6183624 - DNA, 13 bp, Homo sapiens
ctttgtgagtcaa

SEQ ID NO: 6183625 - DNA, 13 bp, Homo sapiens
ctttgtgataatt

SEQ ID NO: 6183626 - DNA, 18 bp, Homo sapiens
ctttgtgataatttaaga

SEQ ID NO: 6183627 - DNA, 23 bp, Homo sapiens
ctttgtgattcaatctgtaaact

SEQ ID NO: 6183628 - DNA, 14 bp, Homo sapiens
ctttgtgatttttg

SEQ ID NO: 6183629 - DNA, 18 bp, Homo sapiens
ctttgtgcagcttcgagg

SEQ ID NO: 6183630 - DNA, 13 bp, Homo sapiens
ctttgtgcattct

SEQ ID NO: 6183631 - DNA, 14 bp, Homo sapiens
ctttgtgcattctg

SEQ ID NO: 6183632 - DNA, 13 bp, Homo sapiens
ctttgtgccctat

SEQ ID NO: 6183633 - DNA, 20 bp, Homo sapiens
ctttgtgctaaatcctagca

SEQ ID NO: 6183634 - DNA, 11 bp, Homo sapiens
ctttgtgctga

SEQ ID NO: 6183635 - DNA, 15 bp, Homo sapiens
ctttgtgctggggtt

SEQ ID NO: 6183636 - DNA, 13 bp, Homo sapiens
ctttgtgctgtgg

SEQ ID NO: 6183637 - DNA, 11 bp, Homo sapiens
ctttgtgctta

SEQ ID NO: 6183638 - DNA, 14 bp, Homo sapiens
ctttgtgcttgttc

SEQ ID NO: 6183639 - DNA, 16 bp, Homo sapiens
ctttgtgctttcctga

SEQ ID NO: 6183640 - DNA, 20 bp, Homo sapiens
ctttgtgctttttgtcatgt

SEQ ID NO: 6183641 - DNA, 16 bp, Homo sapiens
ctttgtggactttatt

SEQ ID NO: 6183642 - DNA, 14 bp, Homo sapiens
ctttgtggcactgg

SEQ ID NO: 6183643 - DNA, 16 bp, Homo sapiens
ctttgtggccaaggag

SEQ ID NO: 6183644 - DNA, 20 bp, Homo sapiens
ctttgtggccaaggagctgc

SEQ ID NO: 6183645 - DNA, 22 bp, Homo sapiens
ctttgtggccttcccccttcct

SEQ ID NO: 6183646 - DNA, 13 bp, Homo sapiens
ctttgtggcttct

SEQ ID NO: 6183647 - DNA, 23 bp, Homo sapiens
ctttgtgggaaacagagtccaat

SEQ ID NO: 6183648 - DNA, 16 bp, Homo sapiens
ctttgtggggaagagg

SEQ ID NO: 6183649 - DNA, 16 bp, Homo sapiens
ctttgtggggcttggc

SEQ ID NO: 6183650 - DNA, 21 bp, Homo sapiens
ctttgtggggcttggcgtgga

SEQ ID NO: 6183651 - DNA, 21 bp, Homo sapiens
ctttgtgggttggccaggagg

SEQ ID NO: 6183652 - DNA, 19 bp, Homo sapiens
ctttgtggtctaaagtgtt

SEQ ID NO: 6183653 - DNA, 15 bp, Homo sapiens
ctttgtggtgggcgc

SEQ ID NO: 6183654 - DNA, 21 bp, Homo sapiens
ctttgtggtgggcgctgggga

SEQ ID NO: 6183655 - DNA, 22 bp, Homo sapiens
ctttgtgtacttcagtcttgga

SEQ ID NO: 6183656 - DNA, 17 bp, Homo sapiens
ctttgtgtagtatcttg

SEQ ID NO: 6183657 - DNA, 20 bp, Homo sapiens
ctttgtgtagtatcttgaaa

SEQ ID NO: 6183658 - DNA, 12 bp, Homo sapiens
ctttgtgtatgg

SEQ ID NO: 6183659 - DNA, 23 bp, Homo sapiens
ctttgtgtccattgatgtcattc

SEQ ID NO: 6183660 - DNA, 21 bp, Homo sapiens
ctttgtgtctagttttctaga

SEQ ID NO: 6183661 - DNA, 21 bp, Homo sapiens
ctggtccacacaccacagaag

SEQ ID NO: 6183662 - DNA, 14 bp, Homo sapiens
ctggtccagctctg

SEQ ID NO: 6183663 - DNA, 15 bp, Homo sapiens
ctggtccagctctga

SEQ ID NO: 6183664 - DNA, 14 bp, Homo sapiens
ctggtccaggccag

SEQ ID NO: 6183665 - DNA, 20 bp, Homo sapiens
ctggtccaggccaggcctca

SEQ ID NO: 6183666 - DNA, 20 bp, Homo sapiens
ctggtccaggtcttcagttt

SEQ ID NO: 6183667 - DNA, 15 bp, Homo sapiens
ctggtccatagagag

SEQ ID NO: 6183668 - DNA, 21 bp, Homo sapiens
ctggtccatagagagcaagac

SEQ ID NO: 6183669 - DNA, 17 bp, Homo sapiens
ctggtccatctggtttt

SEQ ID NO: 6183670 - DNA, 17 bp, Homo sapiens
ctggtccatgatggagt

SEQ ID NO: 6183671 - DNA, 19 bp, Homo sapiens
ctggtccatgtaaatactt

SEQ ID NO: 6183672 - DNA, 23 bp, Homo sapiens
ctggtccatgtaaatactttcca

SEQ ID NO: 6183673 - DNA, 13 bp, Homo sapiens
ctggtcccactca

SEQ ID NO: 6183674 - DNA, 18 bp, Homo sapiens
ctggtcccactcagtcca

SEQ ID NO: 6183675 - DNA, 14 bp, Homo sapiens
ctggtcccacttca

SEQ ID NO: 6183676 - DNA, 19 bp, Homo sapiens
ctggtcccacttcacagct

SEQ ID NO: 6183677 - DNA, 22 bp, Homo sapiens
ctggtcccacttcacagctgga

SEQ ID NO: 6183678 - DNA, 23 bp, Homo sapiens
ctggtcccacttcacagctggag

SEQ ID NO: 6183679 - DNA, 21 bp, Homo sapiens
ctggtcccagccagcagttca

SEQ ID NO: 6183680 - DNA, 15 bp, Homo sapiens
ctggtccccactgct

SEQ ID NO: 6183681 - DNA, 16 bp, Homo sapiens
ctggtccccccaaatc

SEQ ID NO: 6183682 - DNA, 20 bp, Homo sapiens
ctggtcccctcccccatccc

SEQ ID NO: 6183683 - DNA, 17 bp, Homo sapiens
ctggtcccctcctcagt

SEQ ID NO: 6183684 - DNA, 14 bp, Homo sapiens
ctggtcccctgtgg

SEQ ID NO: 6183685 - DNA, 12 bp, Homo sapiens
ctggtccctctt

SEQ ID NO: 6183686 - DNA, 20 bp, Homo sapiens
ctggtccctcttctctcctc

SEQ ID NO: 6183687 - DNA, 12 bp, Homo sapiens
ctggtccctgcc

SEQ ID NO: 6183688 - DNA, 13 bp, Homo sapiens
ctggtccctgccc

SEQ ID NO: 6183689 - DNA, 15 bp, Homo sapiens
ctggtccctgccctc

SEQ ID NO: 6183690 - DNA, 16 bp, Homo sapiens
ctggtccctggaaatc

SEQ ID NO: 6183691 - DNA, 14 bp, Homo sapiens
ctggtccctggtcc

SEQ ID NO: 6183692 - DNA, 16 bp, Homo sapiens
ctggtccctggtcctt

SEQ ID NO: 6183693 - DNA, 21 bp, Homo sapiens
ctggtcccttgcagctagttt

SEQ ID NO: 6183694 - DNA, 22 bp, Homo sapiens
ctggtcccttgtatcccctgca

SEQ ID NO: 6183695 - DNA, 16 bp, Homo sapiens
ctggtccgagctgagg

SEQ ID NO: 6183696 - DNA, 17 bp, Homo sapiens
ctggtccgagctgagga

SEQ ID NO: 6183697 - DNA, 21 bp, Homo sapiens
ctggtccggacactcctagag

SEQ ID NO: 6183698 - DNA, 22 bp, Homo sapiens
ctggtccggacactcctagaga

SEQ ID NO: 6183699 - DNA, 16 bp, Homo sapiens
ctggtcctacccatcc

SEQ ID NO: 6183700 - DNA, 17 bp, Homo sapiens
ctggtcctacccatccc

SEQ ID NO: 6183701 - DNA, 22 bp, Homo sapiens
ctggtcctacccatccccgcag

SEQ ID NO: 6183702 - DNA, 20 bp, Homo sapiens
ctggtcctaggctggaagga

SEQ ID NO: 6183703 - DNA, 21 bp, Homo sapiens
ctggtcctatggcctcatgtt

SEQ ID NO: 6183704 - DNA, 20 bp, Homo sapiens
ctggtcctccactttgctgg

SEQ ID NO: 6183705 - DNA, 21 bp, Homo sapiens
ctggtcctccactttgctggt

SEQ ID NO: 6183706 - DNA, 16 bp, Homo sapiens
ctggtcctccctccca

SEQ ID NO: 6183707 - DNA, 20 bp, Homo sapiens
ctggtcctccctcccaagga

SEQ ID NO: 6183708 - DNA, 18 bp, Homo sapiens
ctggtcctccgcctactg

SEQ ID NO: 6183709 - DNA, 18 bp, Homo sapiens
ctggtcctgaccaggatg

SEQ ID NO: 6183710 - DNA, 12 bp, Homo sapiens
ctggtcctgcac

SEQ ID NO: 6183711 - DNA, 18 bp, Homo sapiens
ctggtcctgcacatgagt

SEQ ID NO: 6183712 - DNA, 16 bp, Homo sapiens
ctggtcctggacacct

SEQ ID NO: 6183713 - DNA, 17 bp, Homo sapiens
ctggtcctggctgcact

SEQ ID NO: 6183714 - DNA, 18 bp, Homo sapiens
ctggtcctggctgcactc

SEQ ID NO: 6183715 - DNA, 19 bp, Homo sapiens
ctggtcctggctgcactct

SEQ ID NO: 6183716 - DNA, 15 bp, Homo sapiens
ctggtcctgggagcc

SEQ ID NO: 6183717 - DNA, 20 bp, Homo sapiens
ctggtccttagtaaattcct

SEQ ID NO: 6183718 - DNA, 13 bp, Homo sapiens
ctggtccttattt

SEQ ID NO: 6183719 - DNA, 16 bp, Homo sapiens
ctggtccttccaggcc

SEQ ID NO: 6183720 - DNA, 19 bp, Homo sapiens
ctggtccttccaggccccc

SEQ ID NO: 6183721 - DNA, 16 bp, Homo sapiens
ctggtcctttcttccg

SEQ ID NO: 6183722 - DNA, 14 bp, Homo sapiens
ctggtcgctcctgc

SEQ ID NO: 6183723 - DNA, 18 bp, Homo sapiens
ctggtcgctcctgcccac

SEQ ID NO: 6183724 - DNA, 20 bp, Homo sapiens
ctggtcgtaaacatctcaga

SEQ ID NO: 6183725 - DNA, 21 bp, Homo sapiens
ctggtcgtaaacatctcagag

SEQ ID NO: 6183726 - DNA, 15 bp, Homo sapiens
ctggtcgtcacctgg

SEQ ID NO: 6183727 - DNA, 21 bp, Homo sapiens
ctggtcgtgaactcctgagct

SEQ ID NO: 6183728 - DNA, 18 bp, Homo sapiens
ctggtctcaaactcctgg

SEQ ID NO: 6183729 - DNA, 23 bp, Homo sapiens
ctggtctcaaactcttgacctca

SEQ ID NO: 6183730 - DNA, 23 bp, Homo sapiens
ctggtctcaaacttgtggcctca

SEQ ID NO: 6183731 - DNA, 23 bp, Homo sapiens
ctggtctcaccctggaggcacct

SEQ ID NO: 6183732 - DNA, 14 bp, Homo sapiens
ctggtctcagagga

SEQ ID NO: 6183733 - DNA, 13 bp, Homo sapiens
ctggtctcagcag

SEQ ID NO: 6183734 - DNA, 19 bp, Homo sapiens
ctggtctcatttgggggcg

SEQ ID NO: 6183735 - DNA, 13 bp, Homo sapiens
ctggtctccccca

SEQ ID NO: 6183736 - DNA, 15 bp, Homo sapiens
ctggtctccctccag

SEQ ID NO: 6183737 - DNA, 22 bp, Homo sapiens
ctggtctcctgcccccacacct

SEQ ID NO: 6183738 - DNA, 16 bp, Homo sapiens
ctggtctcgaactcct

SEQ ID NO: 6183739 - DNA, 21 bp, Homo sapiens
ctggtctcgtgttcgctggct

SEQ ID NO: 6183740 - DNA, 22 bp, Homo sapiens
ctggtctcgtgttcgctggctg

SEQ ID NO: 6183741 - DNA, 19 bp, Homo sapiens
ctggtctctaagtgtaaaa

SEQ ID NO: 6183742 - DNA, 17 bp, Homo sapiens
ctggtctctagagggtt

SEQ ID NO: 6183743 - DNA, 17 bp, Homo sapiens
ctggtctctaggcctga

SEQ ID NO: 6183744 - DNA, 14 bp, Homo sapiens
ctggtctctaggct

SEQ ID NO: 6183745 - DNA, 18 bp, Homo sapiens
ctggtctctaggctgggg

SEQ ID NO: 6183746 - DNA, 20 bp, Homo sapiens
ctggtctctaggctggggaa

SEQ ID NO: 6183747 - DNA, 14 bp, Homo sapiens
ctggtctctccttg

SEQ ID NO: 6183748 - DNA, 17 bp, Homo sapiens
ctggtctctctatgcct

SEQ ID NO: 6183749 - DNA, 23 bp, Homo sapiens
ctggtctctctatgcctctctac

SEQ ID NO: 6183750 - DNA, 24 bp, Homo sapiens
ctggtctctctatgcctctctaca

SEQ ID NO: 6183751 - DNA, 19 bp, Homo sapiens
ctggtctcttcaccactgt

SEQ ID NO: 6183752 - DNA, 12 bp, Homo sapiens
ctggtctgaggg

SEQ ID NO: 6183753 - DNA, 20 bp, Homo sapiens
ctggtctgatgacttgctta

SEQ ID NO: 6183754 - DNA, 23 bp, Homo sapiens
ctggtctgatggaactgtgtatt

SEQ ID NO: 6183755 - DNA, 18 bp, Homo sapiens
ctggtctgccaggggctt

SEQ ID NO: 6183756 - DNA, 22 bp, Homo sapiens
ctggtctgccaggggcttccca

SEQ ID NO: 6183757 - DNA, 13 bp, Homo sapiens
ctggtctgccctg

SEQ ID NO: 6183758 - DNA, 14 bp, Homo sapiens
ctggtctggagccc

SEQ ID NO: 6183759 - DNA, 14 bp, Homo sapiens
ctggtctggctctg

SEQ ID NO: 6183760 - DNA, 18 bp, Homo sapiens
ctggtctggctctgctgg

SEQ ID NO: 6183761 - DNA, 12 bp, Homo sapiens
ctggtctggctt

SEQ ID NO: 6183762 - DNA, 15 bp, Homo sapiens
ctggtctggtcaggc

SEQ ID NO: 6183763 - DNA, 17 bp, Homo sapiens
ctggtctggtcaggcaa

SEQ ID NO: 6183764 - DNA, 22 bp, Homo sapiens
ctggtctgtagaagagggataa

SEQ ID NO: 6183765 - DNA, 14 bp, Homo sapiens
ctggtctgtctgga

SEQ ID NO: 6183766 - DNA, 15 bp, Homo sapiens
ctggtctgtctggat

SEQ ID NO: 6183767 - DNA, 17 bp, Homo sapiens
ctggtctgtctggatcc

SEQ ID NO: 6183768 - DNA, 12 bp, Homo sapiens
ctggtctgtgca

SEQ ID NO: 6183769 - DNA, 21 bp, Homo sapiens
ctggtctgtgctgccctgctc

SEQ ID NO: 6183770 - DNA, 21 bp, Homo sapiens
ctggtctgtggagatggactc

SEQ ID NO: 6183771 - DNA, 11 bp, Homo sapiens
ctggtctgtgt

SEQ ID NO: 6183772 - DNA, 13 bp, Homo sapiens
ctggtctgtgtgt

SEQ ID NO: 6183773 - DNA, 16 bp, Homo sapiens
ctggtctgttttctgt

SEQ ID NO: 6183774 - DNA, 15 bp, Homo sapiens
ctggtcttcactgcc

SEQ ID NO: 6183775 - DNA, 12 bp, Homo sapiens
ctggtcttcctt

SEQ ID NO: 6183776 - DNA, 18 bp, Homo sapiens
ctggtcttgaactcctga

SEQ ID NO: 6183777 - DNA, 19 bp, Homo sapiens
ctggtcttgaactcctggg

SEQ ID NO: 6183778 - DNA, 22 bp, Homo sapiens
ctggtcttgaactcttggcctc

SEQ ID NO: 6183779 - DNA, 14 bp, Homo sapiens
ctggtcttgagatg

SEQ ID NO: 6183780 - DNA, 14 bp, Homo sapiens
ctggtcttgtaaga

SEQ ID NO: 6183781 - DNA, 15 bp, Homo sapiens
ctggtcttgtaagag

SEQ ID NO: 6183782 - DNA, 20 bp, Homo sapiens
ctggtcttgtggaattggga

SEQ ID NO: 6183783 - DNA, 15 bp, Homo sapiens
ctggtcttgttagaa

SEQ ID NO: 6183784 - DNA, 19 bp, Homo sapiens
ctggtcttgttagaaaaca

SEQ ID NO: 6183785 - DNA, 15 bp, Homo sapiens
ctggtctttcctctg

SEQ ID NO: 6183786 - DNA, 22 bp, Homo sapiens
ctggtctttgaaagaaatgtac

SEQ ID NO: 6183787 - DNA, 14 bp, Homo sapiens
ctggtctttgagcg

SEQ ID NO: 6183788 - DNA, 18 bp, Homo sapiens
ctggtctttgagctccca

SEQ ID NO: 6183789 - DNA, 16 bp, Homo sapiens
ctggtcttttctccta

SEQ ID NO: 6183790 - DNA, 15 bp, Homo sapiens
ctggtgaacactgtg

SEQ ID NO: 6183791 - DNA, 16 bp, Homo sapiens
ctggtgaacactgtga

SEQ ID NO: 6183792 - DNA, 18 bp, Homo sapiens
ctggtgaacactgtgacc

SEQ ID NO: 6183793 - DNA, 21 bp, Homo sapiens
ctggtgaacactgtgaccagg

SEQ ID NO: 6183794 - DNA, 15 bp, Homo sapiens
ctggtgaagctcact

SEQ ID NO: 6183795 - DNA, 16 bp, Homo sapiens
ctggtgaatattttca

SEQ ID NO: 6183796 - DNA, 20 bp, Homo sapiens
ctggtgaatcacctggctga

SEQ ID NO: 6183797 - DNA, 13 bp, Homo sapiens
ctggtgaatccat

SEQ ID NO: 6183798 - DNA, 14 bp, Homo sapiens
ctggtgacaccagc

SEQ ID NO: 6183799 - DNA, 19 bp, Homo sapiens
ctggtgaccagaccaaggc

SEQ ID NO: 6183800 - DNA, 20 bp, Homo sapiens
ctggtgactttcctctttgg

SEQ ID NO: 6183801 - DNA, 16 bp, Homo sapiens
ctggtgagaaaatata

SEQ ID NO: 6183802 - DNA, 13 bp, Homo sapiens
ctggtgagaactg

SEQ ID NO: 6183803 - DNA, 13 bp, Homo sapiens
ctggtgagacccc

SEQ ID NO: 6183804 - DNA, 17 bp, Homo sapiens
ctggtgagaccccgcac

SEQ ID NO: 6183805 - DNA, 19 bp, Homo sapiens
ctggtgagaccccgcactg

SEQ ID NO: 6183806 - DNA, 22 bp, Homo sapiens
ctggtgagatacccagagagaa

SEQ ID NO: 6183807 - DNA, 21 bp, Homo sapiens
ctggtgagcaggggaagcagg

SEQ ID NO: 6183808 - DNA, 19 bp, Homo sapiens
ctggtgaggaagctccagt

SEQ ID NO: 6183809 - DNA, 17 bp, Homo sapiens
ctggtgaggcccagcct

SEQ ID NO: 6183810 - DNA, 18 bp, Homo sapiens
ctggtgaggcccagcctg

SEQ ID NO: 6183811 - DNA, 12 bp, Homo sapiens
ctggtgaggccg

SEQ ID NO: 6183812 - DNA, 17 bp, Homo sapiens
ctggtgaggccggccct

SEQ ID NO: 6183813 - DNA, 21 bp, Homo sapiens
ctggtgaggccggccctgccc

SEQ ID NO: 6183814 - DNA, 15 bp, Homo sapiens
ctggtgaggccttgc

SEQ ID NO: 6183815 - DNA, 16 bp, Homo sapiens
ctggtgaggccttgct

SEQ ID NO: 6183816 - DNA, 16 bp, Homo sapiens
ctggtgagggagcctc

SEQ ID NO: 6183817 - DNA, 17 bp, Homo sapiens
ctggtgagggagcctcg

SEQ ID NO: 6183818 - DNA, 14 bp, Homo sapiens
ctggtgaggtggcc

SEQ ID NO: 6183819 - DNA, 16 bp, Homo sapiens
ctggtgaggtggccca

SEQ ID NO: 6183820 - DNA, 17 bp, Homo sapiens
ctggtgaggtggcccag

SEQ ID NO: 6183821 - DNA, 21 bp, Homo sapiens
ctggtgaggtggcccaggccc

SEQ ID NO: 6183822 - DNA, 19 bp, Homo sapiens
ctggtgaggttgaggaata

SEQ ID NO: 6183823 - DNA, 22 bp, Homo sapiens
ctggtgagtaacttagaaaagt

SEQ ID NO: 6183824 - DNA, 19 bp, Homo sapiens
ctggtgagtgcaagagcct

SEQ ID NO: 6183825 - DNA, 13 bp, Homo sapiens
ctggtgatgccta

SEQ ID NO: 6183826 - DNA, 19 bp, Homo sapiens
ctggtgatgcgcagttgct

SEQ ID NO: 6183827 - DNA, 15 bp, Homo sapiens
ctggtgatgggacaa

SEQ ID NO: 6183828 - DNA, 23 bp, Homo sapiens
ctggtgatgttgaaatatgcata

SEQ ID NO: 6183829 - DNA, 15 bp, Homo sapiens
ctggtgatttctgag

SEQ ID NO: 6183830 - DNA, 23 bp, Homo sapiens
ctggtgcaagttgaggacttctt

SEQ ID NO: 6183831 - DNA, 20 bp, Homo sapiens
ctggtgcacatgacatttgt

SEQ ID NO: 6183832 - DNA, 19 bp, Homo sapiens
ctggtgcacgcaggcacag

SEQ ID NO: 6183833 - DNA, 17 bp, Homo sapiens
ctggtgcagggcctcca

SEQ ID NO: 6183834 - DNA, 22 bp, Homo sapiens
ctggtgcatgttcttttctgga

SEQ ID NO: 6183835 - DNA, 18 bp, Homo sapiens
ctggtgcattacagagag

SEQ ID NO: 6183836 - DNA, 16 bp, Homo sapiens
ctggtgcattgctgtg

SEQ ID NO: 6183837 - DNA, 22 bp, Homo sapiens
ctggtgcatttaaaatggactt

SEQ ID NO: 6183838 - DNA, 12 bp, Homo sapiens
ctggtgccaaaa

SEQ ID NO: 6183839 - DNA, 22 bp, Homo sapiens
ctttgtgtctagttttctagac

SEQ ID NO: 6183840 - DNA, 15 bp, Homo sapiens
ctttgtgtcttttgt

SEQ ID NO: 6183841 - DNA, 15 bp, Homo sapiens
ctttgtgtgctgtgg

SEQ ID NO: 6183842 - DNA, 14 bp, Homo sapiens
ctttgtgtggctcc

SEQ ID NO: 6183843 - DNA, 17 bp, Homo sapiens
ctttgtgtggctcctgg

SEQ ID NO: 6183844 - DNA, 18 bp, Homo sapiens
ctttgtgtgtactcactg

SEQ ID NO: 6183845 - DNA, 15 bp, Homo sapiens
ctttgtgtgtattca

SEQ ID NO: 6183846 - DNA, 15 bp, Homo sapiens
ctttgtgtgtgtgtc

SEQ ID NO: 6183847 - DNA, 15 bp, Homo sapiens
ctttgtgttcatttc

SEQ ID NO: 6183848 - DNA, 19 bp, Homo sapiens
ctttgtgttctttgtgtca

SEQ ID NO: 6183849 - DNA, 11 bp, Homo sapiens
ctttgtgttgg

SEQ ID NO: 6183850 - DNA, 20 bp, Homo sapiens
ctttgtgttgggagggatta

SEQ ID NO: 6183851 - DNA, 13 bp, Homo sapiens
ctttgtgttgtaa

SEQ ID NO: 6183852 - DNA, 14 bp, Homo sapiens
ctttgtgttgtaat

SEQ ID NO: 6183853 - DNA, 22 bp, Homo sapiens
ctttgtgttgtaattcttcagt

SEQ ID NO: 6183854 - DNA, 14 bp, Homo sapiens
ctttgtgtttactt

SEQ ID NO: 6183855 - DNA, 14 bp, Homo sapiens
ctttgtgtttagct

SEQ ID NO: 6183856 - DNA, 13 bp, Homo sapiens
ctttgtgtttata

SEQ ID NO: 6183857 - DNA, 14 bp, Homo sapiens
ctttgtgtttctat

SEQ ID NO: 6183858 - DNA, 14 bp, Homo sapiens
ctttgtgtttgctt

SEQ ID NO: 6183859 - DNA, 21 bp, Homo sapiens
ctttgtgtttgcttggtgctg

SEQ ID NO: 6183860 - DNA, 20 bp, Homo sapiens
ctttgtgtttggtttacatt

SEQ ID NO: 6183861 - DNA, 21 bp, Homo sapiens
ctttgtgtttggtttacattt

SEQ ID NO: 6183862 - DNA, 22 bp, Homo sapiens
ctttgtgtttggtttacattta

SEQ ID NO: 6183863 - DNA, 15 bp, Homo sapiens
ctttgttaaaaacac

SEQ ID NO: 6183864 - DNA, 19 bp, Homo sapiens
ctttgttaaaaatattttc

SEQ ID NO: 6183865 - DNA, 12 bp, Homo sapiens
ctttgttaaaat

SEQ ID NO: 6183866 - DNA, 14 bp, Homo sapiens
ctttgttaaaatat

SEQ ID NO: 6183867 - DNA, 16 bp, Homo sapiens
ctttgttaaaatatag

SEQ ID NO: 6183868 - DNA, 21 bp, Homo sapiens
ctttgttaaccttaaatacac

SEQ ID NO: 6183869 - DNA, 16 bp, Homo sapiens
ctttgttacaataaaa

SEQ ID NO: 6183870 - DNA, 13 bp, Homo sapiens
ctttgttacactg

SEQ ID NO: 6183871 - DNA, 19 bp, Homo sapiens
ctttgttacttctctaatt

SEQ ID NO: 6183872 - DNA, 19 bp, Homo sapiens
ctttgttattatcctgcat

SEQ ID NO: 6183873 - DNA, 21 bp, Homo sapiens
ctttgttattatcctgcattt

SEQ ID NO: 6183874 - DNA, 20 bp, Homo sapiens
ctttgttattgcaaattgag

SEQ ID NO: 6183875 - DNA, 22 bp, Homo sapiens
ctttgttatttttgtttcttcc

SEQ ID NO: 6183876 - DNA, 18 bp, Homo sapiens
ctttgttcaggtctctag

SEQ ID NO: 6183877 - DNA, 18 bp, Homo sapiens
ctttgttccccactggag

SEQ ID NO: 6183878 - DNA, 14 bp, Homo sapiens
ctttgttcccggct

SEQ ID NO: 6183879 - DNA, 14 bp, Homo sapiens
ctttgttcctgctt

SEQ ID NO: 6183880 - DNA, 19 bp, Homo sapiens
ctttgttcctgctttctct

SEQ ID NO: 6183881 - DNA, 22 bp, Homo sapiens
ctttgttcctgctttctctttc

SEQ ID NO: 6183882 - DNA, 20 bp, Homo sapiens
ctttgttctcagctccccct

SEQ ID NO: 6183883 - DNA, 15 bp, Homo sapiens
ctttgttctggctct

SEQ ID NO: 6183884 - DNA, 14 bp, Homo sapiens
ctttgttctgttgt

SEQ ID NO: 6183885 - DNA, 13 bp, Homo sapiens
ctttgttctgttt

SEQ ID NO: 6183886 - DNA, 16 bp, Homo sapiens
ctttgttcttcaatgt

SEQ ID NO: 6183887 - DNA, 19 bp, Homo sapiens
ctttgttcttcaatgtgaa

SEQ ID NO: 6183888 - DNA, 18 bp, Homo sapiens
ctttgttcttcctgtctc

SEQ ID NO: 6183889 - DNA, 13 bp, Homo sapiens
ctttgttgaaaaa

SEQ ID NO: 6183890 - DNA, 22 bp, Homo sapiens
ctttgttgaactgttagaatgt

SEQ ID NO: 6183891 - DNA, 18 bp, Homo sapiens
ctttgttgatttagatga

SEQ ID NO: 6183892 - DNA, 19 bp, Homo sapiens
ctttgttgcaagatgtgaa

SEQ ID NO: 6183893 - DNA, 16 bp, Homo sapiens
ctttgttgcccaggct

SEQ ID NO: 6183894 - DNA, 20 bp, Homo sapiens
ctttgttgccttatcttgaa

SEQ ID NO: 6183895 - DNA, 14 bp, Homo sapiens
ctttgttggaagaa

SEQ ID NO: 6183896 - DNA, 19 bp, Homo sapiens
ctttgttggcccttccagt

SEQ ID NO: 6183897 - DNA, 14 bp, Homo sapiens
ctttgttggctcag

SEQ ID NO: 6183898 - DNA, 17 bp, Homo sapiens
ctttgttgtcctcccag

SEQ ID NO: 6183899 - DNA, 14 bp, Homo sapiens
ctttgttgtgagaa

SEQ ID NO: 6183900 - DNA, 15 bp, Homo sapiens
ctttgttgtgagaat

SEQ ID NO: 6183901 - DNA, 17 bp, Homo sapiens
ctttgttgtgagaatgg

SEQ ID NO: 6183902 - DNA, 23 bp, Homo sapiens
ctttgttgtgagaatggcctgga

SEQ ID NO: 6183903 - DNA, 18 bp, Homo sapiens
ctttgttgtgtgcctcta

SEQ ID NO: 6183904 - DNA, 19 bp, Homo sapiens
ctttgttgttctgcctgtc

SEQ ID NO: 6183905 - DNA, 14 bp, Homo sapiens
ctttgttgtttgga

SEQ ID NO: 6183906 - DNA, 22 bp, Homo sapiens
ctttgttgtttggattcctcac

SEQ ID NO: 6183907 - DNA, 16 bp, Homo sapiens
ctttgtttaaatgcca

SEQ ID NO: 6183908 - DNA, 15 bp, Homo sapiens
ctttgtttaataaag

SEQ ID NO: 6183909 - DNA, 13 bp, Homo sapiens
ctttgtttagaaa

SEQ ID NO: 6183910 - DNA, 19 bp, Homo sapiens
ctttgtttagtctttatac

SEQ ID NO: 6183911 - DNA, 22 bp, Homo sapiens
ctttgtttatgaagaaagatac

SEQ ID NO: 6183912 - DNA, 23 bp, Homo sapiens
ctttgtttatgaagaaagatact

SEQ ID NO: 6183913 - DNA, 15 bp, Homo sapiens
ctttgtttcaacttt

SEQ ID NO: 6183914 - DNA, 22 bp, Homo sapiens
ctttgtttccagaaattcttca

SEQ ID NO: 6183915 - DNA, 17 bp, Homo sapiens
ctttgtttcgtggggag

SEQ ID NO: 6183916 - DNA, 18 bp, Homo sapiens
ctttgtttcgtggggagg

SEQ ID NO: 6183917 - DNA, 16 bp, Homo sapiens
ctttgtttctccccca

SEQ ID NO: 6183918 - DNA, 17 bp, Homo sapiens
ctttgtttctttcttcc

SEQ ID NO: 6183919 - DNA, 22 bp, Homo sapiens
ctttgtttcttttgcttaggaa

SEQ ID NO: 6183920 - DNA, 19 bp, Homo sapiens
ctttgtttctttttacagc

SEQ ID NO: 6183921 - DNA, 15 bp, Homo sapiens
ctttgtttggctggg

SEQ ID NO: 6183922 - DNA, 22 bp, Homo sapiens
ctttgtttgggccactgccagc

SEQ ID NO: 6183923 - DNA, 13 bp, Homo sapiens
ctttgtttgttct

SEQ ID NO: 6183924 - DNA, 15 bp, Homo sapiens
ctttgtttgttcttg

SEQ ID NO: 6183925 - DNA, 18 bp, Homo sapiens
ctttgtttgttgtcagct

SEQ ID NO: 6183926 - DNA, 21 bp, Homo sapiens
ctttgtttgttgtcagctgaa

SEQ ID NO: 6183927 - DNA, 20 bp, Homo sapiens
ctttgtttgtttgttttctt

SEQ ID NO: 6183928 - DNA, 17 bp, Homo sapiens
ctttgttttactgtctt

SEQ ID NO: 6183929 - DNA, 15 bp, Homo sapiens
ctttgttttatttta

SEQ ID NO: 6183930 - DNA, 16 bp, Homo sapiens
ctttgttttattttca

SEQ ID NO: 6183931 - DNA, 14 bp, Homo sapiens
ctttgttttctaaa

SEQ ID NO: 6183932 - DNA, 20 bp, Homo sapiens
ctttgttttctgactaatta

SEQ ID NO: 6183933 - DNA, 13 bp, Homo sapiens
ctttgttttctta

SEQ ID NO: 6183934 - DNA, 19 bp, Homo sapiens
ctttgttttgatgtttgtg

SEQ ID NO: 6183935 - DNA, 15 bp, Homo sapiens
ctttgttttgcactg

SEQ ID NO: 6183936 - DNA, 20 bp, Homo sapiens
ctttgttttggctgctctcc

SEQ ID NO: 6183937 - DNA, 18 bp, Homo sapiens
ctttgttttgtgtctctt

SEQ ID NO: 6183938 - DNA, 18 bp, Homo sapiens
ctttgtttttatgaagaa

SEQ ID NO: 6183939 - DNA, 12 bp, Homo sapiens
ctttgtttttcc

SEQ ID NO: 6183940 - DNA, 17 bp, Homo sapiens
ctttgtttttccatgtg

SEQ ID NO: 6183941 - DNA, 13 bp, Homo sapiens
ctttgtttttccg

SEQ ID NO: 6183942 - DNA, 18 bp, Homo sapiens
ctttgtttttggcatttc

SEQ ID NO: 6183943 - DNA, 18 bp, Homo sapiens
ctttgttttttgttggag

SEQ ID NO: 6183944 - DNA, 23 bp, Homo sapiens
ctttgtttttttttcctgtcctt

SEQ ID NO: 6183945 - DNA, 12 bp, Homo sapiens
cttttaaaaaaa

SEQ ID NO: 6183946 - DNA, 13 bp, Homo sapiens
cttttaaaaaata

SEQ ID NO: 6183947 - DNA, 21 bp, Homo sapiens
cttttaaaaaatactctgcta

SEQ ID NO: 6183948 - DNA, 22 bp, Homo sapiens
cttttaaaaaatactctgctat

SEQ ID NO: 6183949 - DNA, 18 bp, Homo sapiens
cttttaaaaacataacat

SEQ ID NO: 6183950 - DNA, 22 bp, Homo sapiens
cttttaaaaagaaggggagaag

SEQ ID NO: 6183951 - DNA, 17 bp, Homo sapiens
cttttaaaaaggcagta

SEQ ID NO: 6183952 - DNA, 14 bp, Homo sapiens
cttttaaaaagtat

SEQ ID NO: 6183953 - DNA, 23 bp, Homo sapiens
cttttaaaaagtattgccaaaca

SEQ ID NO: 6183954 - DNA, 12 bp, Homo sapiens
cttttaaaaata

SEQ ID NO: 6183955 - DNA, 14 bp, Homo sapiens
cttttaaaaatgta

SEQ ID NO: 6183956 - DNA, 19 bp, Homo sapiens
cttttaaaactacttagca

SEQ ID NO: 6183957 - DNA, 19 bp, Homo sapiens
cttttaaaagaaaaagtat

SEQ ID NO: 6183958 - DNA, 16 bp, Homo sapiens
cttttaaaagacaaga

SEQ ID NO: 6183959 - DNA, 12 bp, Homo sapiens
cttttaaaagga

SEQ ID NO: 6183960 - DNA, 14 bp, Homo sapiens
cttttaaaaggaaa

SEQ ID NO: 6183961 - DNA, 11 bp, Homo sapiens
cttttaaaata

SEQ ID NO: 6183962 - DNA, 14 bp, Homo sapiens
cttttaaaataaaa

SEQ ID NO: 6183963 - DNA, 15 bp, Homo sapiens
cttttaaaataaaat

SEQ ID NO: 6183964 - DNA, 14 bp, Homo sapiens
cttttaaaataagc

SEQ ID NO: 6183965 - DNA, 21 bp, Homo sapiens
cttttaaaataagctttctca

SEQ ID NO: 6183966 - DNA, 17 bp, Homo sapiens
cttttaaaatgaaatgt

SEQ ID NO: 6183967 - DNA, 13 bp, Homo sapiens
cttttaaaatgca

SEQ ID NO: 6183968 - DNA, 19 bp, Homo sapiens
cttttaaaatgcaatgtaa

SEQ ID NO: 6183969 - DNA, 23 bp, Homo sapiens
cttttaaaatttgtcttaaaaat

SEQ ID NO: 6183970 - DNA, 14 bp, Homo sapiens
cttttaaacaaaag

SEQ ID NO: 6183971 - DNA, 13 bp, Homo sapiens
cttttaaacacat

SEQ ID NO: 6183972 - DNA, 15 bp, Homo sapiens
cttttaaacaggcaa

SEQ ID NO: 6183973 - DNA, 17 bp, Homo sapiens
cttttaaaccattttct

SEQ ID NO: 6183974 - DNA, 17 bp, Homo sapiens
cttttaaacctgttcct

SEQ ID NO: 6183975 - DNA, 17 bp, Homo sapiens
cttttaaactgcagttt

SEQ ID NO: 6183976 - DNA, 15 bp, Homo sapiens
cttttaaagaaaaaa

SEQ ID NO: 6183977 - DNA, 23 bp, Homo sapiens
cttttaaagaaaaaaattgaaat

SEQ ID NO: 6183978 - DNA, 22 bp, Homo sapiens
cttttaaagaaaaatatgatac

SEQ ID NO: 6183979 - DNA, 17 bp, Homo sapiens
cttttaaagaagtaaat

SEQ ID NO: 6183980 - DNA, 18 bp, Homo sapiens
cttttaaagaccctccta

SEQ ID NO: 6183981 - DNA, 18 bp, Homo sapiens
cttttaaagactacctgg

SEQ ID NO: 6183982 - DNA, 21 bp, Homo sapiens
cttttaaaggaatgtgaaatt

SEQ ID NO: 6183983 - DNA, 12 bp, Homo sapiens
cttttaaagtat

SEQ ID NO: 6183984 - DNA, 13 bp, Homo sapiens
cttttaaatcatc

SEQ ID NO: 6183985 - DNA, 12 bp, Homo sapiens
cttttaaatcct

SEQ ID NO: 6183986 - DNA, 23 bp, Homo sapiens
cttttaaatctctgatatctttg

SEQ ID NO: 6183987 - DNA, 22 bp, Homo sapiens
cttttaaatgattgaattatat

SEQ ID NO: 6183988 - DNA, 14 bp, Homo sapiens
cttttaaatggcat

SEQ ID NO: 6183989 - DNA, 15 bp, Homo sapiens
cttttaaatggcatg

SEQ ID NO: 6183990 - DNA, 12 bp, Homo sapiens
cttttaaatggg

SEQ ID NO: 6183991 - DNA, 15 bp, Homo sapiens
cttttaaattataca

SEQ ID NO: 6183992 - DNA, 12 bp, Homo sapiens
cttttaacattt

SEQ ID NO: 6183993 - DNA, 20 bp, Homo sapiens
cttttaacgtatgtatttca

SEQ ID NO: 6183994 - DNA, 13 bp, Homo sapiens
cttttaactattt

SEQ ID NO: 6183995 - DNA, 14 bp, Homo sapiens
cttttaactgccgc

SEQ ID NO: 6183996 - DNA, 22 bp, Homo sapiens
cttttaactgttgtagaagaca

SEQ ID NO: 6183997 - DNA, 18 bp, Homo sapiens
cttttaactgttttaggt

SEQ ID NO: 6183998 - DNA, 14 bp, Homo sapiens
cttttaacttcacc

SEQ ID NO: 6183999 - DNA, 16 bp, Homo sapiens
cttttaacttcacctt

SEQ ID NO: 6184000 - DNA, 10 bp, Homo sapiens
cttttaagaa

SEQ ID NO: 6184001 - DNA, 17 bp, Homo sapiens
cttttaagaaaaacaaa

SEQ ID NO: 6184002 - DNA, 22 bp, Homo sapiens
cttttaagaaagcttcttgtga

SEQ ID NO: 6184003 - DNA, 13 bp, Homo sapiens
cttttaagacatt

SEQ ID NO: 6184004 - DNA, 21 bp, Homo sapiens
cttttaagacattttcatgct

SEQ ID NO: 6184005 - DNA, 22 bp, Homo sapiens
cttttaagacattttcatgctt

SEQ ID NO: 6184006 - DNA, 17 bp, Homo sapiens
cttttaagactttggtt

SEQ ID NO: 6184007 - DNA, 17 bp, Homo sapiens
cttttaagatcttgtta

SEQ ID NO: 6184008 - DNA, 20 bp, Homo sapiens
cttttaagatgtgtcttcaa

SEQ ID NO: 6184009 - DNA, 21 bp, Homo sapiens
cttttaagcaaagttgggtgt

SEQ ID NO: 6184010 - DNA, 12 bp, Homo sapiens
cttttaagcaga

SEQ ID NO: 6184011 - DNA, 17 bp, Homo sapiens
cttttaagcatttgtat

SEQ ID NO: 6184012 - DNA, 13 bp, Homo sapiens
cttttaagccctg

SEQ ID NO: 6184013 - DNA, 15 bp, Homo sapiens
cttttaagccctgct

SEQ ID NO: 6184014 - DNA, 16 bp, Homo sapiens
cttttaagccctgctc

SEQ ID NO: 6184015 - DNA, 17 bp, Homo sapiens
cttttaagccctgctct

SEQ ID NO: 6184016 - DNA, 21 bp, Homo sapiens
cttttaagccctgctctttct

SEQ ID NO: 6184017 - DNA, 20 bp, Homo sapiens
cttttaagtggactctctga

SEQ ID NO: 6184018 - DNA, 21 bp, Homo sapiens
cttttaagtttgaaactaact

SEQ ID NO: 6184019 - DNA, 22 bp, Homo sapiens
ctggtgccaaaaccaggcctct

SEQ ID NO: 6184020 - DNA, 20 bp, Homo sapiens
ctggtgccaaatagccccag

SEQ ID NO: 6184021 - DNA, 22 bp, Homo sapiens
ctggtgccaaatagccccagac

SEQ ID NO: 6184022 - DNA, 16 bp, Homo sapiens
ctggtgccaatttcaa

SEQ ID NO: 6184023 - DNA, 12 bp, Homo sapiens
ctggtgccacct

SEQ ID NO: 6184024 - DNA, 14 bp, Homo sapiens
ctggtgccagggtg

SEQ ID NO: 6184025 - DNA, 16 bp, Homo sapiens
ctggtgcccacagcag

SEQ ID NO: 6184026 - DNA, 18 bp, Homo sapiens
ctggtgcccaccagctgg

SEQ ID NO: 6184027 - DNA, 17 bp, Homo sapiens
ctggtgccccacagcta

SEQ ID NO: 6184028 - DNA, 18 bp, Homo sapiens
ctggtgccccacagctac

SEQ ID NO: 6184029 - DNA, 20 bp, Homo sapiens
ctggtgcccccagacagctg

SEQ ID NO: 6184030 - DNA, 20 bp, Homo sapiens
ctggtgccccccacccctgg

SEQ ID NO: 6184031 - DNA, 20 bp, Homo sapiens
ctggtgccctaacctctgag

SEQ ID NO: 6184032 - DNA, 14 bp, Homo sapiens
ctggtgccctggcc

SEQ ID NO: 6184033 - DNA, 17 bp, Homo sapiens
ctggtgccctggtggcc

SEQ ID NO: 6184034 - DNA, 22 bp, Homo sapiens
ctggtgccctggtggcctgccc

SEQ ID NO: 6184035 - DNA, 20 bp, Homo sapiens
ctggtgcctatctgcctgga

SEQ ID NO: 6184036 - DNA, 23 bp, Homo sapiens
ctggtgcctatctgcctggaggc

SEQ ID NO: 6184037 - DNA, 16 bp, Homo sapiens
ctggtgcctatttatt

SEQ ID NO: 6184038 - DNA, 22 bp, Homo sapiens
ctggtgcctatttattcattca

SEQ ID NO: 6184039 - DNA, 23 bp, Homo sapiens
ctggtgcctatttattcattcag

SEQ ID NO: 6184040 - DNA, 16 bp, Homo sapiens
ctggtgcctccagagg

SEQ ID NO: 6184041 - DNA, 12 bp, Homo sapiens
ctggtgcctcct

SEQ ID NO: 6184042 - DNA, 13 bp, Homo sapiens
ctggtgcctcctc

SEQ ID NO: 6184043 - DNA, 12 bp, Homo sapiens
ctggtgcctctg

SEQ ID NO: 6184044 - DNA, 21 bp, Homo sapiens
ctggtgcctgaagaccccaga

SEQ ID NO: 6184045 - DNA, 20 bp, Homo sapiens
ctggtgcctgagcccctcag

SEQ ID NO: 6184046 - DNA, 16 bp, Homo sapiens
ctggtgcctggctctt

SEQ ID NO: 6184047 - DNA, 15 bp, Homo sapiens
ctggtgcgacccccc

SEQ ID NO: 6184048 - DNA, 21 bp, Homo sapiens
ctggtgcgctgtgctccagca

SEQ ID NO: 6184049 - DNA, 19 bp, Homo sapiens
ctggtgcggatggacacta

SEQ ID NO: 6184050 - DNA, 18 bp, Homo sapiens
ctggtgcggctggccatg

SEQ ID NO: 6184051 - DNA, 20 bp, Homo sapiens
ctggtgcggctggccatgga

SEQ ID NO: 6184052 - DNA, 17 bp, Homo sapiens
ctggtgcgggcctggcc

SEQ ID NO: 6184053 - DNA, 19 bp, Homo sapiens
ctggtgcgggcctggccct

SEQ ID NO: 6184054 - DNA, 21 bp, Homo sapiens
ctggtgcgggcctggccctca

SEQ ID NO: 6184055 - DNA, 18 bp, Homo sapiens
ctggtgcgtgtggccctg

SEQ ID NO: 6184056 - DNA, 15 bp, Homo sapiens
ctggtgctactccat

SEQ ID NO: 6184057 - DNA, 20 bp, Homo sapiens
ctggtgctataggctggaga

SEQ ID NO: 6184058 - DNA, 23 bp, Homo sapiens
ctggtgctataggctggagaagc

SEQ ID NO: 6184059 - DNA, 13 bp, Homo sapiens
ctggtgctcctgc

SEQ ID NO: 6184060 - DNA, 19 bp, Homo sapiens
ctggtgctcctgcccagcc

SEQ ID NO: 6184061 - DNA, 21 bp, Homo sapiens
ctggtgctcctgcccagccac

SEQ ID NO: 6184062 - DNA, 22 bp, Homo sapiens
ctggtgctcctgcccagccacc

SEQ ID NO: 6184063 - DNA, 21 bp, Homo sapiens
ctggtgctcgggaagggaggg

SEQ ID NO: 6184064 - DNA, 16 bp, Homo sapiens
ctggtgctctctgcca

SEQ ID NO: 6184065 - DNA, 16 bp, Homo sapiens
ctggtgctgcaaggaa

SEQ ID NO: 6184066 - DNA, 12 bp, Homo sapiens
ctggtgctgcca

SEQ ID NO: 6184067 - DNA, 13 bp, Homo sapiens
ctggtgctgccac

SEQ ID NO: 6184068 - DNA, 18 bp, Homo sapiens
ctggtgctgccgagggct

SEQ ID NO: 6184069 - DNA, 14 bp, Homo sapiens
ctggtgctgcctct

SEQ ID NO: 6184070 - DNA, 15 bp, Homo sapiens
ctggtgctgctgggg

SEQ ID NO: 6184071 - DNA, 16 bp, Homo sapiens
ctggtgctgtggccag

SEQ ID NO: 6184072 - DNA, 17 bp, Homo sapiens
ctggtgctgtggccagg

SEQ ID NO: 6184073 - DNA, 18 bp, Homo sapiens
ctggtgctgtggccaggg

SEQ ID NO: 6184074 - DNA, 19 bp, Homo sapiens
ctggtgctgtggccagggt

SEQ ID NO: 6184075 - DNA, 19 bp, Homo sapiens
ctggtgcttatgctcttaa

SEQ ID NO: 6184076 - DNA, 22 bp, Homo sapiens
ctggtgctttagttaggtcatt

SEQ ID NO: 6184077 - DNA, 16 bp, Homo sapiens
ctggtggaagtcttgg

SEQ ID NO: 6184078 - DNA, 21 bp, Homo sapiens
ctggtggacagtcctgggaga

SEQ ID NO: 6184079 - DNA, 20 bp, Homo sapiens
ctggtggaccacaggcatct

SEQ ID NO: 6184080 - DNA, 15 bp, Homo sapiens
ctggtggacccaggg

SEQ ID NO: 6184081 - DNA, 12 bp, Homo sapiens
ctggtggaggaa

SEQ ID NO: 6184082 - DNA, 18 bp, Homo sapiens
ctggtggaggaagggctg

SEQ ID NO: 6184083 - DNA, 22 bp, Homo sapiens
ctggtggaggaagggctgggcc

SEQ ID NO: 6184084 - DNA, 23 bp, Homo sapiens
ctggtggaggaagggctgggcca

SEQ ID NO: 6184085 - DNA, 15 bp, Homo sapiens
ctggtggaggagctg

SEQ ID NO: 6184086 - DNA, 20 bp, Homo sapiens
ctggtggaggagctgaggga

SEQ ID NO: 6184087 - DNA, 22 bp, Homo sapiens
ctggtggaggagctgagggagg

SEQ ID NO: 6184088 - DNA, 23 bp, Homo sapiens
ctggtggaggagctgagggaggg

SEQ ID NO: 6184089 - DNA, 16 bp, Homo sapiens
ctggtggatggtgact

SEQ ID NO: 6184090 - DNA, 17 bp, Homo sapiens
ctggtggatggtgactt

SEQ ID NO: 6184091 - DNA, 18 bp, Homo sapiens
ctggtggatggtgacttt

SEQ ID NO: 6184092 - DNA, 12 bp, Homo sapiens
ctggtggcacca

SEQ ID NO: 6184093 - DNA, 16 bp, Homo sapiens
ctggtggcagagtcct

SEQ ID NO: 6184094 - DNA, 12 bp, Homo sapiens
ctggtggcagct

SEQ ID NO: 6184095 - DNA, 22 bp, Homo sapiens
ctggtggcaggggcttctagct

SEQ ID NO: 6184096 - DNA, 18 bp, Homo sapiens
ctggtggcagtgggagct

SEQ ID NO: 6184097 - DNA, 23 bp, Homo sapiens
ctggtggcagtgggagctgcctg

SEQ ID NO: 6184098 - DNA, 20 bp, Homo sapiens
ctggtggccaagcctgcccc

SEQ ID NO: 6184099 - DNA, 22 bp, Homo sapiens
ctggtggccacttcattccagc

SEQ ID NO: 6184100 - DNA, 19 bp, Homo sapiens
ctggtggccatgtcgcctg

SEQ ID NO: 6184101 - DNA, 22 bp, Homo sapiens
ctggtggccatgtcgcctgccc

SEQ ID NO: 6184102 - DNA, 13 bp, Homo sapiens
ctggtggcccagc

SEQ ID NO: 6184103 - DNA, 15 bp, Homo sapiens
ctggtggcctctgca

SEQ ID NO: 6184104 - DNA, 12 bp, Homo sapiens
ctggtggcctgc

SEQ ID NO: 6184105 - DNA, 15 bp, Homo sapiens
ctggtggccttgggc

SEQ ID NO: 6184106 - DNA, 18 bp, Homo sapiens
ctggtggccttgggcctt

SEQ ID NO: 6184107 - DNA, 23 bp, Homo sapiens
ctggtggctcccggagggccctg

SEQ ID NO: 6184108 - DNA, 12 bp, Homo sapiens
ctggtggctgca

SEQ ID NO: 6184109 - DNA, 15 bp, Homo sapiens
ctggtggctgcaggc

SEQ ID NO: 6184110 - DNA, 18 bp, Homo sapiens
ctggtggctgcaggcacc

SEQ ID NO: 6184111 - DNA, 18 bp, Homo sapiens
ctggtggctgggcccagc

SEQ ID NO: 6184112 - DNA, 20 bp, Homo sapiens
ctggtggctgggcccagcag

SEQ ID NO: 6184113 - DNA, 15 bp, Homo sapiens
ctggtggctgggctg

SEQ ID NO: 6184114 - DNA, 17 bp, Homo sapiens
ctggtgggacagtggtg

SEQ ID NO: 6184115 - DNA, 17 bp, Homo sapiens
ctggtgggagcacctgc

SEQ ID NO: 6184116 - DNA, 20 bp, Homo sapiens
ctggtgggagcacctgccag

SEQ ID NO: 6184117 - DNA, 15 bp, Homo sapiens
ctggtgggaggcccg

SEQ ID NO: 6184118 - DNA, 17 bp, Homo sapiens
ctggtgggataggaggg

SEQ ID NO: 6184119 - DNA, 17 bp, Homo sapiens
ctggtgggcaccaagag

SEQ ID NO: 6184120 - DNA, 21 bp, Homo sapiens
ctggtgggcaccaagagccaa

SEQ ID NO: 6184121 - DNA, 17 bp, Homo sapiens
ctggtgggcagctgagg

SEQ ID NO: 6184122 - DNA, 18 bp, Homo sapiens
ctggtgggcagctgagga

SEQ ID NO: 6184123 - DNA, 18 bp, Homo sapiens
ctggtgggctcaaccaca

SEQ ID NO: 6184124 - DNA, 22 bp, Homo sapiens
ctggtgggctggccgctgtgcc

SEQ ID NO: 6184125 - DNA, 22 bp, Homo sapiens
ctggtggggcagaaaggctgca

SEQ ID NO: 6184126 - DNA, 16 bp, Homo sapiens
ctggtggggcagctcc

SEQ ID NO: 6184127 - DNA, 20 bp, Homo sapiens
ctggtggggcagctcctctg

SEQ ID NO: 6184128 - DNA, 24 bp, Homo sapiens
ctggtggggcccatggaggagaca

SEQ ID NO: 6184129 - DNA, 22 bp, Homo sapiens
ctggtggggctgagcctgaggc

SEQ ID NO: 6184130 - DNA, 20 bp, Homo sapiens
ctggtggggctgtcctgctg

SEQ ID NO: 6184131 - DNA, 20 bp, Homo sapiens
ctggtgggggttctggcagg

SEQ ID NO: 6184132 - DNA, 21 bp, Homo sapiens
ctggtgggggttctggcagga

SEQ ID NO: 6184133 - DNA, 23 bp, Homo sapiens
ctggtgggggttctggcaggacc

SEQ ID NO: 6184134 - DNA, 23 bp, Homo sapiens
ctggtggggtgtgcatgccacgc

SEQ ID NO: 6184135 - DNA, 16 bp, Homo sapiens
ctggtgggtcagccca

SEQ ID NO: 6184136 - DNA, 19 bp, Homo sapiens
ctggtgggtcagcccagca

SEQ ID NO: 6184137 - DNA, 21 bp, Homo sapiens
ctggtgggtcagcccagcacc

SEQ ID NO: 6184138 - DNA, 13 bp, Homo sapiens
ctggtgggtcagg

SEQ ID NO: 6184139 - DNA, 23 bp, Homo sapiens
ctggtgggtcggccgccatagcc

SEQ ID NO: 6184140 - DNA, 19 bp, Homo sapiens
ctggtgggtctgagctgga

SEQ ID NO: 6184141 - DNA, 23 bp, Homo sapiens
ctggtgggtctttaataaaacaa

SEQ ID NO: 6184142 - DNA, 20 bp, Homo sapiens
ctggtgggtgaaagaaatca

SEQ ID NO: 6184143 - DNA, 21 bp, Homo sapiens
ctggtgggttagctaaaccaa

SEQ ID NO: 6184144 - DNA, 16 bp, Homo sapiens
ctggtggtattttcaa

SEQ ID NO: 6184145 - DNA, 18 bp, Homo sapiens
ctggtggtctgttggcag

SEQ ID NO: 6184146 - DNA, 22 bp, Homo sapiens
ctggtggtctgttggcaggctg

SEQ ID NO: 6184147 - DNA, 14 bp, Homo sapiens
ctggtggtgctttt

SEQ ID NO: 6184148 - DNA, 17 bp, Homo sapiens
ctggtggttaaggccag

SEQ ID NO: 6184149 - DNA, 20 bp, Homo sapiens
ctggtggtttgatcatttct

SEQ ID NO: 6184150 - DNA, 23 bp, Homo sapiens
ctggtggttttcagagcaggagg

SEQ ID NO: 6184151 - DNA, 19 bp, Homo sapiens
ctggtgtaaaaaacaaaca

SEQ ID NO: 6184152 - DNA, 18 bp, Homo sapiens
ctggtgtactctaggact

SEQ ID NO: 6184153 - DNA, 22 bp, Homo sapiens
ctggtgtactctaggacttcaa

SEQ ID NO: 6184154 - DNA, 18 bp, Homo sapiens
ctggtgtagctacagaga

SEQ ID NO: 6184155 - DNA, 16 bp, Homo sapiens
ctggtgtagtcttttt

SEQ ID NO: 6184156 - DNA, 19 bp, Homo sapiens
ctggtgtcaccccagagcc

SEQ ID NO: 6184157 - DNA, 15 bp, Homo sapiens
ctggtgtcagcccca

SEQ ID NO: 6184158 - DNA, 20 bp, Homo sapiens
ctggtgtcattgctgtagga

SEQ ID NO: 6184159 - DNA, 16 bp, Homo sapiens
ctggtgtccagctgag

SEQ ID NO: 6184160 - DNA, 12 bp, Homo sapiens
ctggtgtcccct

SEQ ID NO: 6184161 - DNA, 16 bp, Homo sapiens
ctggtgtccccttccc

SEQ ID NO: 6184162 - DNA, 13 bp, Homo sapiens
ctggtgtcctgac

SEQ ID NO: 6184163 - DNA, 16 bp, Homo sapiens
ctggtgtcctgaccac

SEQ ID NO: 6184164 - DNA, 17 bp, Homo sapiens
ctggtgtcctgaccacc

SEQ ID NO: 6184165 - DNA, 21 bp, Homo sapiens
ctggtgtcctgaccaccctcc

SEQ ID NO: 6184166 - DNA, 17 bp, Homo sapiens
ctggtgtctgctttctc

SEQ ID NO: 6184167 - DNA, 17 bp, Homo sapiens
ctggtgtgacctgaggg

SEQ ID NO: 6184168 - DNA, 20 bp, Homo sapiens
ctggtgtgaggctgggccag

SEQ ID NO: 6184169 - DNA, 16 bp, Homo sapiens
ctggtgtggccaaggc

SEQ ID NO: 6184170 - DNA, 20 bp, Homo sapiens
ctggtgtggtacagagaagc

SEQ ID NO: 6184171 - DNA, 23 bp, Homo sapiens
ctggtgtgtccctctgccttttt

SEQ ID NO: 6184172 - DNA, 22 bp, Homo sapiens
ctggtgtgtggtgaggggcttt

SEQ ID NO: 6184173 - DNA, 23 bp, Homo sapiens
ctggtgtgttcaagaccagcctg

SEQ ID NO: 6184174 - DNA, 16 bp, Homo sapiens
ctggtgttaacagaag

SEQ ID NO: 6184175 - DNA, 23 bp, Homo sapiens
ctggtgttaagatatattttgag

SEQ ID NO: 6184176 - DNA, 14 bp, Homo sapiens
ctggtgttacacat

SEQ ID NO: 6184177 - DNA, 13 bp, Homo sapiens
ctggtgttctgaa

SEQ ID NO: 6184178 - DNA, 21 bp, Homo sapiens
ctggtgtttattataaagctt

SEQ ID NO: 6184179 - DNA, 24 bp, Homo sapiens
ctggtgtttctagcactggcctgc

SEQ ID NO: 6184180 - DNA, 15 bp, Homo sapiens
ctggtgtttgtcatg

SEQ ID NO: 6184181 - DNA, 17 bp, Homo sapiens
ctggtgtttgtcatggt

SEQ ID NO: 6184182 - DNA, 19 bp, Homo sapiens
ctggttaaataaggcaggg

SEQ ID NO: 6184183 - DNA, 21 bp, Homo sapiens
ctggttaaccttgaagtgact

SEQ ID NO: 6184184 - DNA, 16 bp, Homo sapiens
ctggttaagcaggcat

SEQ ID NO: 6184185 - DNA, 13 bp, Homo sapiens
ctggttaatgtag

SEQ ID NO: 6184186 - DNA, 14 bp, Homo sapiens
ctggttaatttata

SEQ ID NO: 6184187 - DNA, 18 bp, Homo sapiens
ctggttacaatttacagt

SEQ ID NO: 6184188 - DNA, 17 bp, Homo sapiens
ctggttaccactctttt

SEQ ID NO: 6184189 - DNA, 16 bp, Homo sapiens
ctggttacctgttcca

SEQ ID NO: 6184190 - DNA, 17 bp, Homo sapiens
ctggttactcagggttc

SEQ ID NO: 6184191 - DNA, 14 bp, Homo sapiens
ctggttactttcaa

SEQ ID NO: 6184192 - DNA, 18 bp, Homo sapiens
ctggttactttcaaaatg

SEQ ID NO: 6184193 - DNA, 21 bp, Homo sapiens
ctggttagaggttccctttga

SEQ ID NO: 6184194 - DNA, 20 bp, Homo sapiens
cttttaataaaaaggaaata

SEQ ID NO: 6184195 - DNA, 15 bp, Homo sapiens
cttttaataaactgc

SEQ ID NO: 6184196 - DNA, 17 bp, Homo sapiens
cttttaataaactgcaa

SEQ ID NO: 6184197 - DNA, 22 bp, Homo sapiens
cttttaataaacttttttttga

SEQ ID NO: 6184198 - DNA, 14 bp, Homo sapiens
cttttaataaagta

SEQ ID NO: 6184199 - DNA, 14 bp, Homo sapiens
cttttaatataaaa

SEQ ID NO: 6184200 - DNA, 19 bp, Homo sapiens
cttttaatataaaagatat

SEQ ID NO: 6184201 - DNA, 14 bp, Homo sapiens
cttttaatcagaca

SEQ ID NO: 6184202 - DNA, 16 bp, Homo sapiens
cttttaatcagtgaag

SEQ ID NO: 6184203 - DNA, 18 bp, Homo sapiens
cttttaatcatgagcctg

SEQ ID NO: 6184204 - DNA, 22 bp, Homo sapiens
cttttaatccaatccactaaca

SEQ ID NO: 6184205 - DNA, 19 bp, Homo sapiens
cttttaatccatttcagga

SEQ ID NO: 6184206 - DNA, 21 bp, Homo sapiens
cttttaatccatttcaggact

SEQ ID NO: 6184207 - DNA, 15 bp, Homo sapiens
cttttaatcctggct

SEQ ID NO: 6184208 - DNA, 13 bp, Homo sapiens
cttttaatgaaaa

SEQ ID NO: 6184209 - DNA, 18 bp, Homo sapiens
cttttaatgaacaaatgg

SEQ ID NO: 6184210 - DNA, 16 bp, Homo sapiens
cttttaatgccttcca

SEQ ID NO: 6184211 - DNA, 18 bp, Homo sapiens
cttttaatgctccaaatg

SEQ ID NO: 6184212 - DNA, 19 bp, Homo sapiens
cttttaatgctccaaatgc

SEQ ID NO: 6184213 - DNA, 17 bp, Homo sapiens
cttttaatgcttcattc

SEQ ID NO: 6184214 - DNA, 23 bp, Homo sapiens
cttttaatgcttcattcaatatt

SEQ ID NO: 6184215 - DNA, 15 bp, Homo sapiens
cttttaatggcattt

SEQ ID NO: 6184216 - DNA, 14 bp, Homo sapiens
cttttaatgggatt

SEQ ID NO: 6184217 - DNA, 14 bp, Homo sapiens
cttttaattaaatg

SEQ ID NO: 6184218 - DNA, 12 bp, Homo sapiens
cttttaattaca

SEQ ID NO: 6184219 - DNA, 16 bp, Homo sapiens
cttttaattactgttt

SEQ ID NO: 6184220 - DNA, 20 bp, Homo sapiens
cttttaattagatcctgaaa

SEQ ID NO: 6184221 - DNA, 14 bp, Homo sapiens
cttttaattcctag

SEQ ID NO: 6184222 - DNA, 15 bp, Homo sapiens
cttttaattctcatt

SEQ ID NO: 6184223 - DNA, 17 bp, Homo sapiens
cttttaattgaaattaa

SEQ ID NO: 6184224 - DNA, 19 bp, Homo sapiens
cttttaattgaaattaact

SEQ ID NO: 6184225 - DNA, 22 bp, Homo sapiens
cttttaattgaaattaactttt

SEQ ID NO: 6184226 - DNA, 11 bp, Homo sapiens
cttttaattta

SEQ ID NO: 6184227 - DNA, 22 bp, Homo sapiens
cttttacaagtggttaaaacat

SEQ ID NO: 6184228 - DNA, 20 bp, Homo sapiens
cttttacagaatgcattaaa

SEQ ID NO: 6184229 - DNA, 21 bp, Homo sapiens
cttttacagaatgcattaaaa

SEQ ID NO: 6184230 - DNA, 14 bp, Homo sapiens
cttttacagctttt

SEQ ID NO: 6184231 - DNA, 16 bp, Homo sapiens
cttttacagcttttct

SEQ ID NO: 6184232 - DNA, 20 bp, Homo sapiens
cttttacagcttttctcttt

SEQ ID NO: 6184233 - DNA, 20 bp, Homo sapiens
cttttacagtcattttccta

SEQ ID NO: 6184234 - DNA, 14 bp, Homo sapiens
cttttacatactgc

SEQ ID NO: 6184235 - DNA, 13 bp, Homo sapiens
cttttacattgtg

SEQ ID NO: 6184236 - DNA, 22 bp, Homo sapiens
cttttaccaacttcctctgcca

SEQ ID NO: 6184237 - DNA, 19 bp, Homo sapiens
cttttaccactatttaagt

SEQ ID NO: 6184238 - DNA, 21 bp, Homo sapiens
cttttaccagcttttaaccat

SEQ ID NO: 6184239 - DNA, 19 bp, Homo sapiens
cttttaccatgaattcttg

SEQ ID NO: 6184240 - DNA, 16 bp, Homo sapiens
cttttaccatgcccct

SEQ ID NO: 6184241 - DNA, 22 bp, Homo sapiens
cttttaccctggcccctctccc

SEQ ID NO: 6184242 - DNA, 15 bp, Homo sapiens
cttttaccctgtgtc

SEQ ID NO: 6184243 - DNA, 21 bp, Homo sapiens
cttttaccctgtgtcagagcc

SEQ ID NO: 6184244 - DNA, 15 bp, Homo sapiens
cttttaccctttttc

SEQ ID NO: 6184245 - DNA, 22 bp, Homo sapiens
cttttaccgttggggcccttaa

SEQ ID NO: 6184246 - DNA, 23 bp, Homo sapiens
cttttaccgttggggcccttaac

SEQ ID NO: 6184247 - DNA, 20 bp, Homo sapiens
cttttacctgctgcttctcc

SEQ ID NO: 6184248 - DNA, 15 bp, Homo sapiens
cttttacctggatat

SEQ ID NO: 6184249 - DNA, 20 bp, Homo sapiens
cttttacctggatataaatt

SEQ ID NO: 6184250 - DNA, 20 bp, Homo sapiens
cttttaccttttttttttct

SEQ ID NO: 6184251 - DNA, 21 bp, Homo sapiens
cttttaccttttttttttctt

SEQ ID NO: 6184252 - DNA, 20 bp, Homo sapiens
cttttacgtccatctcttgt

SEQ ID NO: 6184253 - DNA, 18 bp, Homo sapiens
cttttactacagctatga

SEQ ID NO: 6184254 - DNA, 23 bp, Homo sapiens
cttttactcatgatcttgtgaca

SEQ ID NO: 6184255 - DNA, 19 bp, Homo sapiens
cttttactcctttgcattc

SEQ ID NO: 6184256 - DNA, 20 bp, Homo sapiens
cttttactcctttgcattcc

SEQ ID NO: 6184257 - DNA, 15 bp, Homo sapiens
cttttactgtggagg

SEQ ID NO: 6184258 - DNA, 16 bp, Homo sapiens
cttttacttttcttct

SEQ ID NO: 6184259 - DNA, 23 bp, Homo sapiens
cttttagaaacctcattggccag

SEQ ID NO: 6184260 - DNA, 21 bp, Homo sapiens
cttttagaaatactgcaagaa

SEQ ID NO: 6184261 - DNA, 19 bp, Homo sapiens
cttttagatcaacaataaa

SEQ ID NO: 6184262 - DNA, 13 bp, Homo sapiens
cttttagattaaa

SEQ ID NO: 6184263 - DNA, 14 bp, Homo sapiens
cttttagattaaaa

SEQ ID NO: 6184264 - DNA, 14 bp, Homo sapiens
cttttagcctggct

SEQ ID NO: 6184265 - DNA, 22 bp, Homo sapiens
cttttagcggtttgcaaacaaa

SEQ ID NO: 6184266 - DNA, 21 bp, Homo sapiens
cttttagctagaatccacaca

SEQ ID NO: 6184267 - DNA, 20 bp, Homo sapiens
cttttaggatgggggagagg

SEQ ID NO: 6184268 - DNA, 18 bp, Homo sapiens
cttttaggccaaaaaaat

SEQ ID NO: 6184269 - DNA, 20 bp, Homo sapiens
cttttagggagctggtctga

SEQ ID NO: 6184270 - DNA, 18 bp, Homo sapiens
cttttagggtaagaagtt

SEQ ID NO: 6184271 - DNA, 16 bp, Homo sapiens
cttttaggtcatccaa

SEQ ID NO: 6184272 - DNA, 16 bp, Homo sapiens
cttttaggttgttacc

SEQ ID NO: 6184273 - DNA, 17 bp, Homo sapiens
cttttagtacccacctg

SEQ ID NO: 6184274 - DNA, 21 bp, Homo sapiens
cttttagtacccacctgagct

SEQ ID NO: 6184275 - DNA, 18 bp, Homo sapiens
cttttagtagagacagtg

SEQ ID NO: 6184276 - DNA, 22 bp, Homo sapiens
cttttagtagagacagtgtttc

SEQ ID NO: 6184277 - DNA, 12 bp, Homo sapiens
cttttagtcaga

SEQ ID NO: 6184278 - DNA, 20 bp, Homo sapiens
cttttagtcagaaatgattc

SEQ ID NO: 6184279 - DNA, 21 bp, Homo sapiens
cttttagtcagaaatgattca

SEQ ID NO: 6184280 - DNA, 15 bp, Homo sapiens
cttttagttcatata

SEQ ID NO: 6184281 - DNA, 21 bp, Homo sapiens
cttttagttccaacaaagaaa

SEQ ID NO: 6184282 - DNA, 18 bp, Homo sapiens
cttttagttgactcacag

SEQ ID NO: 6184283 - DNA, 19 bp, Homo sapiens
cttttagttgactcacagg

SEQ ID NO: 6184284 - DNA, 18 bp, Homo sapiens
cttttagttgtatctctt

SEQ ID NO: 6184285 - DNA, 19 bp, Homo sapiens
cttttagttgtatctcttt

SEQ ID NO: 6184286 - DNA, 14 bp, Homo sapiens
cttttagtttttct

SEQ ID NO: 6184287 - DNA, 22 bp, Homo sapiens
cttttataaacctctaatttat

SEQ ID NO: 6184288 - DNA, 18 bp, Homo sapiens
cttttataaactttacct

SEQ ID NO: 6184289 - DNA, 13 bp, Homo sapiens
cttttataaatgt

SEQ ID NO: 6184290 - DNA, 17 bp, Homo sapiens
cttttataaatgtttta

SEQ ID NO: 6184291 - DNA, 16 bp, Homo sapiens
cttttataaattaaat

SEQ ID NO: 6184292 - DNA, 18 bp, Homo sapiens
cttttataaattaaatat

SEQ ID NO: 6184293 - DNA, 14 bp, Homo sapiens
cttttataagacaa

SEQ ID NO: 6184294 - DNA, 18 bp, Homo sapiens
cttttataagatttaatt

SEQ ID NO: 6184295 - DNA, 15 bp, Homo sapiens
cttttataaggaaac

SEQ ID NO: 6184296 - DNA, 16 bp, Homo sapiens
cttttataaggaaact

SEQ ID NO: 6184297 - DNA, 18 bp, Homo sapiens
cttttataattaatgttt

SEQ ID NO: 6184298 - DNA, 17 bp, Homo sapiens
cttttatagctattact

SEQ ID NO: 6184299 - DNA, 18 bp, Homo sapiens
cttttatagctattactg

SEQ ID NO: 6184300 - DNA, 21 bp, Homo sapiens
cttttataggatttatttaaa

SEQ ID NO: 6184301 - DNA, 21 bp, Homo sapiens
cttttataggtgagaaaaaaa

SEQ ID NO: 6184302 - DNA, 21 bp, Homo sapiens
cttttatagttgtattttgta

SEQ ID NO: 6184303 - DNA, 13 bp, Homo sapiens
cttttatatataa

SEQ ID NO: 6184304 - DNA, 18 bp, Homo sapiens
cttttatatataaaataa

SEQ ID NO: 6184305 - DNA, 21 bp, Homo sapiens
cttttatatataaaataaata

SEQ ID NO: 6184306 - DNA, 14 bp, Homo sapiens
cttttatatctgta

SEQ ID NO: 6184307 - DNA, 15 bp, Homo sapiens
cttttatatctgtat

SEQ ID NO: 6184308 - DNA, 23 bp, Homo sapiens
cttttatatctgtatgtattagt

SEQ ID NO: 6184309 - DNA, 14 bp, Homo sapiens
cttttatattctaa

SEQ ID NO: 6184310 - DNA, 15 bp, Homo sapiens
cttttatatttgaaa

SEQ ID NO: 6184311 - DNA, 19 bp, Homo sapiens
cttttatatttgaaaaaat

SEQ ID NO: 6184312 - DNA, 21 bp, Homo sapiens
cttttatatttgaaaaaatta

SEQ ID NO: 6184313 - DNA, 13 bp, Homo sapiens
cttttatcaaaca

SEQ ID NO: 6184314 - DNA, 22 bp, Homo sapiens
cttttatcccaaagttgttgta

SEQ ID NO: 6184315 - DNA, 20 bp, Homo sapiens
cttttatctccttgtggcct

SEQ ID NO: 6184316 - DNA, 22 bp, Homo sapiens
cttttatctgtttaaagcatat

SEQ ID NO: 6184317 - DNA, 13 bp, Homo sapiens
cttttatgacaaa

SEQ ID NO: 6184318 - DNA, 16 bp, Homo sapiens
cttttatgagcagaag

SEQ ID NO: 6184319 - DNA, 18 bp, Homo sapiens
cttttatgccaaattgat

SEQ ID NO: 6184320 - DNA, 20 bp, Homo sapiens
cttttatggggccctgtcca

SEQ ID NO: 6184321 - DNA, 15 bp, Homo sapiens
cttttatgtagtaat

SEQ ID NO: 6184322 - DNA, 18 bp, Homo sapiens
cttttatgtagtaattga

SEQ ID NO: 6184323 - DNA, 22 bp, Homo sapiens
cttttatgtagtaattgacatg

SEQ ID NO: 6184324 - DNA, 18 bp, Homo sapiens
cttttatgtattttccaa

SEQ ID NO: 6184325 - DNA, 16 bp, Homo sapiens
cttttatgtgagattt

SEQ ID NO: 6184326 - DNA, 18 bp, Homo sapiens
cttttatgttatttatat

SEQ ID NO: 6184327 - DNA, 14 bp, Homo sapiens
cttttatgtttgaa

SEQ ID NO: 6184328 - DNA, 16 bp, Homo sapiens
cttttatgtttgaata

SEQ ID NO: 6184329 - DNA, 23 bp, Homo sapiens
cttttatgtttgaatatggacaa

SEQ ID NO: 6184330 - DNA, 16 bp, Homo sapiens
cttttatgtttgtaca

SEQ ID NO: 6184331 - DNA, 23 bp, Homo sapiens
cttttatgtttgtacacaacacc

SEQ ID NO: 6184332 - DNA, 22 bp, Homo sapiens
cttttattaacatatattgtta

SEQ ID NO: 6184333 - DNA, 18 bp, Homo sapiens
cttttattaataaaacaa

SEQ ID NO: 6184334 - DNA, 15 bp, Homo sapiens
cttttattagaaagc

SEQ ID NO: 6184335 - DNA, 15 bp, Homo sapiens
cttttattatcagtt

SEQ ID NO: 6184336 - DNA, 16 bp, Homo sapiens
cttttattcctttgaa

SEQ ID NO: 6184337 - DNA, 15 bp, Homo sapiens
cttttattctccaga

SEQ ID NO: 6184338 - DNA, 18 bp, Homo sapiens
cttttattctccagaata

SEQ ID NO: 6184339 - DNA, 17 bp, Homo sapiens
cttttattctgtacctt

SEQ ID NO: 6184340 - DNA, 14 bp, Homo sapiens
cttttattctgtta

SEQ ID NO: 6184341 - DNA, 17 bp, Homo sapiens
cttttattgacacagaa

SEQ ID NO: 6184342 - DNA, 18 bp, Homo sapiens
cttttattgacacagaaa

SEQ ID NO: 6184343 - DNA, 15 bp, Homo sapiens
cttttattgagctct

SEQ ID NO: 6184344 - DNA, 16 bp, Homo sapiens
cttttattgagctctt

SEQ ID NO: 6184345 - DNA, 15 bp, Homo sapiens
cttttattgtaaagt

SEQ ID NO: 6184346 - DNA, 13 bp, Homo sapiens
cttttattgtcag

SEQ ID NO: 6184347 - DNA, 14 bp, Homo sapiens
cttttattgttata

SEQ ID NO: 6184348 - DNA, 12 bp, Homo sapiens
cttttatttcca

SEQ ID NO: 6184349 - DNA, 15 bp, Homo sapiens
cttttatttccaaaa

SEQ ID NO: 6184350 - DNA, 17 bp, Homo sapiens
cttttatttcttaaaca

SEQ ID NO: 6184351 - DNA, 21 bp, Homo sapiens
cttttatttgcaacatttaca

SEQ ID NO: 6184352 - DNA, 19 bp, Homo sapiens
cttttatttggtgtgttcg

SEQ ID NO: 6184353 - DNA, 18 bp, Homo sapiens
cttttattttaatattga

SEQ ID NO: 6184354 - DNA, 21 bp, Homo sapiens
cttttattttacacagaaaca

SEQ ID NO: 6184355 - DNA, 22 bp, Homo sapiens
cttttattttacacagaaacac

SEQ ID NO: 6184356 - DNA, 21 bp, Homo sapiens
cttttattttcacagcccata

SEQ ID NO: 6184357 - DNA, 13 bp, Homo sapiens
cttttattttgaa

SEQ ID NO: 6184358 - DNA, 23 bp, Homo sapiens
cttttattttggaactatgaaga

SEQ ID NO: 6184359 - DNA, 19 bp, Homo sapiens
cttttattttttaaatgta

SEQ ID NO: 6184360 - DNA, 13 bp, Homo sapiens
cttttattttttc

SEQ ID NO: 6184361 - DNA, 15 bp, Homo sapiens
cttttattttttctt

SEQ ID NO: 6184362 - DNA, 19 bp, Homo sapiens
cttttattttttcttttgt

SEQ ID NO: 6184363 - DNA, 12 bp, Homo sapiens
cttttcaaaatc

SEQ ID NO: 6184364 - DNA, 21 bp, Homo sapiens
cttttcaaggaaaaatgctgc

SEQ ID NO: 6184365 - DNA, 17 bp, Homo sapiens
cttttcaaggcacattg

SEQ ID NO: 6184366 - DNA, 19 bp, Homo sapiens
cttttcaagtaattttcat

SEQ ID NO: 6184367 - DNA, 21 bp, Homo sapiens
cttttcaatcttctactttta

SEQ ID NO: 6184368 - DNA, 13 bp, Homo sapiens
cttttcaatgcaa

SEQ ID NO: 6184369 - DNA, 14 bp, Homo sapiens
cttttcaatgcaat

SEQ ID NO: 6184370 - DNA, 17 bp, Homo sapiens
cttttcaatgcaatgca

SEQ ID NO: 6184371 - DNA, 20 bp, Homo sapiens
ctggttagctcagccccagc

SEQ ID NO: 6184372 - DNA, 22 bp, Homo sapiens
ctggttagctcagccccagccc

SEQ ID NO: 6184373 - DNA, 15 bp, Homo sapiens
ctggttagctgacag

SEQ ID NO: 6184374 - DNA, 13 bp, Homo sapiens
ctggttagtgatg

SEQ ID NO: 6184375 - DNA, 17 bp, Homo sapiens
ctggttagtgatgcagt

SEQ ID NO: 6184376 - DNA, 20 bp, Homo sapiens
ctggttagttaaaagcccat

SEQ ID NO: 6184377 - DNA, 16 bp, Homo sapiens
ctggttataagcagca

SEQ ID NO: 6184378 - DNA, 17 bp, Homo sapiens
ctggttatagttgatat

SEQ ID NO: 6184379 - DNA, 20 bp, Homo sapiens
ctggttatatcattctgggt

SEQ ID NO: 6184380 - DNA, 21 bp, Homo sapiens
ctggttatcctgtgctacaga

SEQ ID NO: 6184381 - DNA, 13 bp, Homo sapiens
ctggttatcttgt

SEQ ID NO: 6184382 - DNA, 21 bp, Homo sapiens
ctggttatcttgttattattg

SEQ ID NO: 6184383 - DNA, 16 bp, Homo sapiens
ctggttatttttctct

SEQ ID NO: 6184384 - DNA, 22 bp, Homo sapiens
ctggttcaaacgggtgcctggt

SEQ ID NO: 6184385 - DNA, 13 bp, Homo sapiens
ctggttcacctga

SEQ ID NO: 6184386 - DNA, 22 bp, Homo sapiens
ctggttcactctaattggtcat

SEQ ID NO: 6184387 - DNA, 23 bp, Homo sapiens
ctggttcaggctcaaccttccaa

SEQ ID NO: 6184388 - DNA, 17 bp, Homo sapiens
ctggttcagtgggaatg

SEQ ID NO: 6184389 - DNA, 15 bp, Homo sapiens
ctggttccagggtcc

SEQ ID NO: 6184390 - DNA, 18 bp, Homo sapiens
ctggttcccaagagctat

SEQ ID NO: 6184391 - DNA, 16 bp, Homo sapiens
ctggttcccactgagg

SEQ ID NO: 6184392 - DNA, 15 bp, Homo sapiens
ctggttcccccagga

SEQ ID NO: 6184393 - DNA, 21 bp, Homo sapiens
ctggttcccccaggaccctga

SEQ ID NO: 6184394 - DNA, 22 bp, Homo sapiens
ctggttccctctttcctgtgcc

SEQ ID NO: 6184395 - DNA, 22 bp, Homo sapiens
ctggttccctgctgcgctgctt

SEQ ID NO: 6184396 - DNA, 23 bp, Homo sapiens
ctggttccgccaggcgctgcagg

SEQ ID NO: 6184397 - DNA, 17 bp, Homo sapiens
ctggttccggaatcctg

SEQ ID NO: 6184398 - DNA, 16 bp, Homo sapiens
ctggttcctaggggaa

SEQ ID NO: 6184399 - DNA, 20 bp, Homo sapiens
ctggttcctaggggaatgag

SEQ ID NO: 6184400 - DNA, 23 bp, Homo sapiens
ctggttcctaggggaatgagggg

SEQ ID NO: 6184401 - DNA, 12 bp, Homo sapiens
ctggttcctcca

SEQ ID NO: 6184402 - DNA, 12 bp, Homo sapiens
ctggttcctccc

SEQ ID NO: 6184403 - DNA, 13 bp, Homo sapiens
ctggttcctcccc

SEQ ID NO: 6184404 - DNA, 18 bp, Homo sapiens
ctggttcctgactggcaa

SEQ ID NO: 6184405 - DNA, 12 bp, Homo sapiens
ctggttcctgct

SEQ ID NO: 6184406 - DNA, 18 bp, Homo sapiens
ctggttcctgctagaaat

SEQ ID NO: 6184407 - DNA, 23 bp, Homo sapiens
ctggttcctgctgtcctggtggc

SEQ ID NO: 6184408 - DNA, 13 bp, Homo sapiens
ctggttcctgtgt

SEQ ID NO: 6184409 - DNA, 16 bp, Homo sapiens
ctggttccttaagtgg

SEQ ID NO: 6184410 - DNA, 15 bp, Homo sapiens
ctggttccttcctta

SEQ ID NO: 6184411 - DNA, 17 bp, Homo sapiens
ctggttccttccttagt

SEQ ID NO: 6184412 - DNA, 19 bp, Homo sapiens
ctggttccttccttagttt

SEQ ID NO: 6184413 - DNA, 21 bp, Homo sapiens
ctggttcggatttggggtgga

SEQ ID NO: 6184414 - DNA, 19 bp, Homo sapiens
ctggttctaggctgctgca

SEQ ID NO: 6184415 - DNA, 21 bp, Homo sapiens
ctggttctaggctgctgcaca

SEQ ID NO: 6184416 - DNA, 17 bp, Homo sapiens
ctggttctatttaatgg

SEQ ID NO: 6184417 - DNA, 13 bp, Homo sapiens
ctggttctcaatg

SEQ ID NO: 6184418 - DNA, 16 bp, Homo sapiens
ctggttctcaatgaaa

SEQ ID NO: 6184419 - DNA, 17 bp, Homo sapiens
ctggttctcaatgaaaa

SEQ ID NO: 6184420 - DNA, 17 bp, Homo sapiens
ctggttctcaattccaa

SEQ ID NO: 6184421 - DNA, 15 bp, Homo sapiens
ctggttctcatcttt

SEQ ID NO: 6184422 - DNA, 17 bp, Homo sapiens
ctggttctccatcccca

SEQ ID NO: 6184423 - DNA, 23 bp, Homo sapiens
ctggttctgatgatgtgcctggg

SEQ ID NO: 6184424 - DNA, 17 bp, Homo sapiens
ctggttctggctgtggt

SEQ ID NO: 6184425 - DNA, 14 bp, Homo sapiens
ctggttcttgcctt

SEQ ID NO: 6184426 - DNA, 18 bp, Homo sapiens
ctggttcttggcttcctt

SEQ ID NO: 6184427 - DNA, 19 bp, Homo sapiens
ctggttgaagaagatgatc

SEQ ID NO: 6184428 - DNA, 15 bp, Homo sapiens
ctggttgactttcta

SEQ ID NO: 6184429 - DNA, 19 bp, Homo sapiens
ctggttgagaaacattgct

SEQ ID NO: 6184430 - DNA, 18 bp, Homo sapiens
ctggttgagggagtgggg

SEQ ID NO: 6184431 - DNA, 14 bp, Homo sapiens
ctggttgagtgtgt

SEQ ID NO: 6184432 - DNA, 22 bp, Homo sapiens
ctggttgcatggaaatcagcca

SEQ ID NO: 6184433 - DNA, 22 bp, Homo sapiens
ctggttgcctcatggccagcgc

SEQ ID NO: 6184434 - DNA, 13 bp, Homo sapiens
ctggttgcctccc

SEQ ID NO: 6184435 - DNA, 13 bp, Homo sapiens
ctggttgcctctc

SEQ ID NO: 6184436 - DNA, 18 bp, Homo sapiens
ctggttgcctctcttgcc

SEQ ID NO: 6184437 - DNA, 19 bp, Homo sapiens
ctggttgctaatgacagcc

SEQ ID NO: 6184438 - DNA, 19 bp, Homo sapiens
ctggttgctacattttcag

SEQ ID NO: 6184439 - DNA, 13 bp, Homo sapiens
ctggttgctgtag

SEQ ID NO: 6184440 - DNA, 16 bp, Homo sapiens
ctggttgctgtagaaa

SEQ ID NO: 6184441 - DNA, 14 bp, Homo sapiens
ctggttgctgtgtg

SEQ ID NO: 6184442 - DNA, 19 bp, Homo sapiens
ctggttggagaaggtcaca

SEQ ID NO: 6184443 - DNA, 13 bp, Homo sapiens
ctggttggaggcc

SEQ ID NO: 6184444 - DNA, 18 bp, Homo sapiens
ctggttggcatttgctgg

SEQ ID NO: 6184445 - DNA, 21 bp, Homo sapiens
ctggttggctcccgcggtgcc

SEQ ID NO: 6184446 - DNA, 21 bp, Homo sapiens
ctggttgggggcaccatctgg

SEQ ID NO: 6184447 - DNA, 22 bp, Homo sapiens
ctggttgggggcaccatctgga

SEQ ID NO: 6184448 - DNA, 15 bp, Homo sapiens
ctggttggtgttctt

SEQ ID NO: 6184449 - DNA, 20 bp, Homo sapiens
ctggttggtgttgcagaagg

SEQ ID NO: 6184450 - DNA, 21 bp, Homo sapiens
ctggttggtgttgcagaaggt

SEQ ID NO: 6184451 - DNA, 15 bp, Homo sapiens
ctggttgtaaaagag

SEQ ID NO: 6184452 - DNA, 16 bp, Homo sapiens
ctggttgtaaaagaga

SEQ ID NO: 6184453 - DNA, 19 bp, Homo sapiens
ctggttgtaccctctccag

SEQ ID NO: 6184454 - DNA, 21 bp, Homo sapiens
ctggttgtaccctctccaggc

SEQ ID NO: 6184455 - DNA, 12 bp, Homo sapiens
ctggttgtattt

SEQ ID NO: 6184456 - DNA, 22 bp, Homo sapiens
ctggttgtatttctatatttat

SEQ ID NO: 6184457 - DNA, 21 bp, Homo sapiens
ctggttgtcacctatgagacc

SEQ ID NO: 6184458 - DNA, 13 bp, Homo sapiens
ctggttgtcattt

SEQ ID NO: 6184459 - DNA, 14 bp, Homo sapiens
ctggttgtcatttt

SEQ ID NO: 6184460 - DNA, 13 bp, Homo sapiens
ctggttgtctgaa

SEQ ID NO: 6184461 - DNA, 21 bp, Homo sapiens
ctggttgtctgaacccaggca

SEQ ID NO: 6184462 - DNA, 15 bp, Homo sapiens
ctggttgtgggcact

SEQ ID NO: 6184463 - DNA, 16 bp, Homo sapiens
ctggttgttatgtgat

SEQ ID NO: 6184464 - DNA, 17 bp, Homo sapiens
ctggttgttcctgcatc

SEQ ID NO: 6184465 - DNA, 16 bp, Homo sapiens
ctggttgttgccaggt

SEQ ID NO: 6184466 - DNA, 17 bp, Homo sapiens
ctggttgttgccaggtt

SEQ ID NO: 6184467 - DNA, 22 bp, Homo sapiens
ctggttgttgccaggttgcagc

SEQ ID NO: 6184468 - DNA, 19 bp, Homo sapiens
ctggttgtttttgttcttt

SEQ ID NO: 6184469 - DNA, 16 bp, Homo sapiens
ctggtttaactaatat

SEQ ID NO: 6184470 - DNA, 19 bp, Homo sapiens
ctggtttaattcagcagag

SEQ ID NO: 6184471 - DNA, 17 bp, Homo sapiens
ctggtttacaaatatag

SEQ ID NO: 6184472 - DNA, 16 bp, Homo sapiens
ctggtttacaggccct

SEQ ID NO: 6184473 - DNA, 21 bp, Homo sapiens
ctggtttacaggccctgctcc

SEQ ID NO: 6184474 - DNA, 22 bp, Homo sapiens
ctggtttacaggccctgctcct

SEQ ID NO: 6184475 - DNA, 20 bp, Homo sapiens
ctggtttagcacaatttata

SEQ ID NO: 6184476 - DNA, 13 bp, Homo sapiens
ctggtttcactgg

SEQ ID NO: 6184477 - DNA, 13 bp, Homo sapiens
ctggtttcccttt

SEQ ID NO: 6184478 - DNA, 14 bp, Homo sapiens
ctggtttcccttta

SEQ ID NO: 6184479 - DNA, 17 bp, Homo sapiens
ctggtttccctttattt

SEQ ID NO: 6184480 - DNA, 21 bp, Homo sapiens
ctggtttcctgccctgggagg

SEQ ID NO: 6184481 - DNA, 15 bp, Homo sapiens
ctggtttcctttctc

SEQ ID NO: 6184482 - DNA, 16 bp, Homo sapiens
ctggtttcctttctca

SEQ ID NO: 6184483 - DNA, 23 bp, Homo sapiens
ctggtttctcagaatccaaagat

SEQ ID NO: 6184484 - DNA, 18 bp, Homo sapiens
ctggtttctcattcttgt

SEQ ID NO: 6184485 - DNA, 12 bp, Homo sapiens
ctggtttctgag

SEQ ID NO: 6184486 - DNA, 16 bp, Homo sapiens
ctggtttctgtccccg

SEQ ID NO: 6184487 - DNA, 14 bp, Homo sapiens
ctggtttctgttct

SEQ ID NO: 6184488 - DNA, 16 bp, Homo sapiens
ctggtttgaaagatta

SEQ ID NO: 6184489 - DNA, 14 bp, Homo sapiens
ctggtttgaaattt

SEQ ID NO: 6184490 - DNA, 18 bp, Homo sapiens
ctggtttgaatcctggct

SEQ ID NO: 6184491 - DNA, 18 bp, Homo sapiens
ctggtttgactctgtcca

SEQ ID NO: 6184492 - DNA, 15 bp, Homo sapiens
ctggtttgcaagaat

SEQ ID NO: 6184493 - DNA, 17 bp, Homo sapiens
ctggtttggaatgcttc

SEQ ID NO: 6184494 - DNA, 16 bp, Homo sapiens
ctggtttggggcgagg

SEQ ID NO: 6184495 - DNA, 21 bp, Homo sapiens
ctggtttggtggccaggctgg

SEQ ID NO: 6184496 - DNA, 17 bp, Homo sapiens
ctggtttgtggggcaca

SEQ ID NO: 6184497 - DNA, 18 bp, Homo sapiens
ctggtttgtggggcacag

SEQ ID NO: 6184498 - DNA, 17 bp, Homo sapiens
ctggtttgttctgactt

SEQ ID NO: 6184499 - DNA, 15 bp, Homo sapiens
ctggtttgtttctca

SEQ ID NO: 6184500 - DNA, 20 bp, Homo sapiens
ctggtttgtttgcttaattt

SEQ ID NO: 6184501 - DNA, 23 bp, Homo sapiens
ctggtttgtttgcttaatttcct

SEQ ID NO: 6184502 - DNA, 22 bp, Homo sapiens
ctggttttaaatattttgactt

SEQ ID NO: 6184503 - DNA, 14 bp, Homo sapiens
ctggttttacacag

SEQ ID NO: 6184504 - DNA, 18 bp, Homo sapiens
ctggttttaccccagctc

SEQ ID NO: 6184505 - DNA, 19 bp, Homo sapiens
ctggttttaccccagctcc

SEQ ID NO: 6184506 - DNA, 19 bp, Homo sapiens
ctggttttattactctcac

SEQ ID NO: 6184507 - DNA, 16 bp, Homo sapiens
ctggttttatttatat

SEQ ID NO: 6184508 - DNA, 21 bp, Homo sapiens
ctggttttcgtcatcttccct

SEQ ID NO: 6184509 - DNA, 23 bp, Homo sapiens
ctggttttcgtcatcttccctgc

SEQ ID NO: 6184510 - DNA, 16 bp, Homo sapiens
ctggttttctctgatg

SEQ ID NO: 6184511 - DNA, 20 bp, Homo sapiens
ctggttttctggtggggctg

SEQ ID NO: 6184512 - DNA, 21 bp, Homo sapiens
ctggttttgatggctgggtcc

SEQ ID NO: 6184513 - DNA, 14 bp, Homo sapiens
ctggttttgctatt

SEQ ID NO: 6184514 - DNA, 14 bp, Homo sapiens
ctggttttgcttcc

SEQ ID NO: 6184515 - DNA, 16 bp, Homo sapiens
ctggttttggtttcca

SEQ ID NO: 6184516 - DNA, 13 bp, Homo sapiens
ctggttttgtaag

SEQ ID NO: 6184517 - DNA, 13 bp, Homo sapiens
ctggtttttctca

SEQ ID NO: 6184518 - DNA, 16 bp, Homo sapiens
ctggtttttctgttcc

SEQ ID NO: 6184519 - DNA, 23 bp, Homo sapiens
ctggtttttctgttccctgctgg

SEQ ID NO: 6184520 - DNA, 18 bp, Homo sapiens
ctggtttttctttttcct

SEQ ID NO: 6184521 - DNA, 20 bp, Homo sapiens
ctggtttttggattaaatta

SEQ ID NO: 6184522 - DNA, 15 bp, Homo sapiens
ctggtttttgtagcc

SEQ ID NO: 6184523 - DNA, 17 bp, Homo sapiens
ctgtaaaaaatggagct

SEQ ID NO: 6184524 - DNA, 18 bp, Homo sapiens
ctgtaaaaaatggagctc

SEQ ID NO: 6184525 - DNA, 12 bp, Homo sapiens
ctgtaaaaattg

SEQ ID NO: 6184526 - DNA, 12 bp, Homo sapiens
ctgtaaaacgct

SEQ ID NO: 6184527 - DNA, 13 bp, Homo sapiens
ctgtaaaacttta

SEQ ID NO: 6184528 - DNA, 14 bp, Homo sapiens
ctgtaaaactttat

SEQ ID NO: 6184529 - DNA, 21 bp, Homo sapiens
ctgtaaaagtgtacagactct

SEQ ID NO: 6184530 - DNA, 14 bp, Homo sapiens
ctgtaaaagtgtct

SEQ ID NO: 6184531 - DNA, 19 bp, Homo sapiens
ctgtaaaagttactaatat

SEQ ID NO: 6184532 - DNA, 21 bp, Homo sapiens
ctgtaaaagttactaatatat

SEQ ID NO: 6184533 - DNA, 15 bp, Homo sapiens
ctgtaaaagttataa

SEQ ID NO: 6184534 - DNA, 22 bp, Homo sapiens
ctgtaaaagttataataactga

SEQ ID NO: 6184535 - DNA, 14 bp, Homo sapiens
ctgtaaaatatagt

SEQ ID NO: 6184536 - DNA, 13 bp, Homo sapiens
ctgtaaaatgaac

SEQ ID NO: 6184537 - DNA, 18 bp, Homo sapiens
ctgtaaaatgcaaaaaat

SEQ ID NO: 6184538 - DNA, 23 bp, Homo sapiens
ctgtaaaatgcaccaatcagcag

SEQ ID NO: 6184539 - DNA, 21 bp, Homo sapiens
ctgtaaaatgtgggattatgg

SEQ ID NO: 6184540 - DNA, 17 bp, Homo sapiens
ctgtaaaattataaact

SEQ ID NO: 6184541 - DNA, 18 bp, Homo sapiens
ctgtaaaattataaactt

SEQ ID NO: 6184542 - DNA, 20 bp, Homo sapiens
ctgtaaaattataaactttt

SEQ ID NO: 6184543 - DNA, 21 bp, Homo sapiens
ctgtaaaattataaactttta

SEQ ID NO: 6184544 - DNA, 19 bp, Homo sapiens
ctgtaaaatttgtgtaaat

SEQ ID NO: 6184545 - DNA, 15 bp, Homo sapiens
ctgtaaacacagaca

SEQ ID NO: 6184546 - DNA, 13 bp, Homo sapiens
ctgtaaacacagt

SEQ ID NO: 6184547 - DNA, 14 bp, Homo sapiens
ctgtaaacagaata

SEQ ID NO: 6184548 - DNA, 16 bp, Homo sapiens
ctgtaaacagaataaa

SEQ ID NO: 6184549 - DNA, 21 bp, Homo sapiens
ctgtaaacatagatagtgctt

SEQ ID NO: 6184550 - DNA, 20 bp, Homo sapiens
cttttcaatgtctaaaaaca

SEQ ID NO: 6184551 - DNA, 15 bp, Homo sapiens
cttttcaatgtgatt

SEQ ID NO: 6184552 - DNA, 14 bp, Homo sapiens
cttttcaattatat

SEQ ID NO: 6184553 - DNA, 15 bp, Homo sapiens
cttttcacaaacatt

SEQ ID NO: 6184554 - DNA, 16 bp, Homo sapiens
cttttcacaaacatta

SEQ ID NO: 6184555 - DNA, 20 bp, Homo sapiens
cttttcacaaacattagtat

SEQ ID NO: 6184556 - DNA, 15 bp, Homo sapiens
cttttcacaaataaa

SEQ ID NO: 6184557 - DNA, 21 bp, Homo sapiens
cttttcacatccatttcccct

SEQ ID NO: 6184558 - DNA, 17 bp, Homo sapiens
cttttcacattagataa

SEQ ID NO: 6184559 - DNA, 19 bp, Homo sapiens
cttttcacattcttataaa

SEQ ID NO: 6184560 - DNA, 16 bp, Homo sapiens
cttttcacctccttca

SEQ ID NO: 6184561 - DNA, 13 bp, Homo sapiens
cttttcacctctt

SEQ ID NO: 6184562 - DNA, 21 bp, Homo sapiens
cttttcacctttactttagaa

SEQ ID NO: 6184563 - DNA, 18 bp, Homo sapiens
cttttcactgctgttata

SEQ ID NO: 6184564 - DNA, 14 bp, Homo sapiens
cttttcacttgtct

SEQ ID NO: 6184565 - DNA, 15 bp, Homo sapiens
cttttcacttgtctt

SEQ ID NO: 6184566 - DNA, 23 bp, Homo sapiens
cttttcactttctacttttttca

SEQ ID NO: 6184567 - DNA, 15 bp, Homo sapiens
cttttcactttctgt

SEQ ID NO: 6184568 - DNA, 12 bp, Homo sapiens
cttttcagaaga

SEQ ID NO: 6184569 - DNA, 21 bp, Homo sapiens
cttttcagaagcaagccagac

SEQ ID NO: 6184570 - DNA, 19 bp, Homo sapiens
cttttcagaagtgagcttt

SEQ ID NO: 6184571 - DNA, 21 bp, Homo sapiens
cttttcagaagtgagctttgc

SEQ ID NO: 6184572 - DNA, 20 bp, Homo sapiens
cttttcagcatggtttgcat

SEQ ID NO: 6184573 - DNA, 22 bp, Homo sapiens
cttttcagccaatttgtctcct

SEQ ID NO: 6184574 - DNA, 22 bp, Homo sapiens
cttttcagctgagccctgggga

SEQ ID NO: 6184575 - DNA, 14 bp, Homo sapiens
cttttcagcttctg

SEQ ID NO: 6184576 - DNA, 18 bp, Homo sapiens
cttttcagcttctgctgg

SEQ ID NO: 6184577 - DNA, 19 bp, Homo sapiens
cttttcagcttctgctggg

SEQ ID NO: 6184578 - DNA, 19 bp, Homo sapiens
cttttcagcttgtttctat

SEQ ID NO: 6184579 - DNA, 16 bp, Homo sapiens
cttttcaggaagctct

SEQ ID NO: 6184580 - DNA, 13 bp, Homo sapiens
cttttcaggagat

SEQ ID NO: 6184581 - DNA, 19 bp, Homo sapiens
cttttcaggcactttagaa

SEQ ID NO: 6184582 - DNA, 13 bp, Homo sapiens
cttttcagggctg

SEQ ID NO: 6184583 - DNA, 22 bp, Homo sapiens
cttttcagtgttcccaaagtga

SEQ ID NO: 6184584 - DNA, 16 bp, Homo sapiens
cttttcagttagacaa

SEQ ID NO: 6184585 - DNA, 20 bp, Homo sapiens
cttttcataggtctgaaatt

SEQ ID NO: 6184586 - DNA, 18 bp, Homo sapiens
cttttcatctcattaatt

SEQ ID NO: 6184587 - DNA, 16 bp, Homo sapiens
cttttcatctgggaaa

SEQ ID NO: 6184588 - DNA, 18 bp, Homo sapiens
cttttcatctgttgttct

SEQ ID NO: 6184589 - DNA, 19 bp, Homo sapiens
cttttcatgtagaactcag

SEQ ID NO: 6184590 - DNA, 15 bp, Homo sapiens
cttttcattagcagt

SEQ ID NO: 6184591 - DNA, 14 bp, Homo sapiens
cttttcattccctg

SEQ ID NO: 6184592 - DNA, 15 bp, Homo sapiens
cttttcattctcatt

SEQ ID NO: 6184593 - DNA, 21 bp, Homo sapiens
cttttcattctggatgggctt

SEQ ID NO: 6184594 - DNA, 16 bp, Homo sapiens
cttttcattgcaaagt

SEQ ID NO: 6184595 - DNA, 14 bp, Homo sapiens
cttttcattgctgt

SEQ ID NO: 6184596 - DNA, 15 bp, Homo sapiens
cttttcattgtgtat

SEQ ID NO: 6184597 - DNA, 15 bp, Homo sapiens
cttttcatttcagat

SEQ ID NO: 6184598 - DNA, 18 bp, Homo sapiens
cttttcatttcagatttt

SEQ ID NO: 6184599 - DNA, 17 bp, Homo sapiens
cttttcattttaatata

SEQ ID NO: 6184600 - DNA, 14 bp, Homo sapiens
cttttcatttttgc

SEQ ID NO: 6184601 - DNA, 23 bp, Homo sapiens
cttttccaaatcaaggataaata

SEQ ID NO: 6184602 - DNA, 20 bp, Homo sapiens
cttttccaacatacaattta

SEQ ID NO: 6184603 - DNA, 16 bp, Homo sapiens
cttttccaacccatga

SEQ ID NO: 6184604 - DNA, 23 bp, Homo sapiens
cttttccaaccctcatcaccaac

SEQ ID NO: 6184605 - DNA, 17 bp, Homo sapiens
cttttccaatatgtgat

SEQ ID NO: 6184606 - DNA, 18 bp, Homo sapiens
cttttccataaccaacat

SEQ ID NO: 6184607 - DNA, 16 bp, Homo sapiens
cttttccatcccactc

SEQ ID NO: 6184608 - DNA, 14 bp, Homo sapiens
cttttccatcctga

SEQ ID NO: 6184609 - DNA, 16 bp, Homo sapiens
cttttccatcctgagg

SEQ ID NO: 6184610 - DNA, 16 bp, Homo sapiens
cttttccattatgctg

SEQ ID NO: 6184611 - DNA, 16 bp, Homo sapiens
cttttccattctgggt

SEQ ID NO: 6184612 - DNA, 17 bp, Homo sapiens
cttttccattgaccagc

SEQ ID NO: 6184613 - DNA, 20 bp, Homo sapiens
cttttccatttatttattca

SEQ ID NO: 6184614 - DNA, 15 bp, Homo sapiens
cttttcccaccagct

SEQ ID NO: 6184615 - DNA, 18 bp, Homo sapiens
cttttcccacctctttgg

SEQ ID NO: 6184616 - DNA, 20 bp, Homo sapiens
cttttcccaggaatatccca

SEQ ID NO: 6184617 - DNA, 19 bp, Homo sapiens
cttttcccatttgtaattt

SEQ ID NO: 6184618 - DNA, 19 bp, Homo sapiens
cttttccccaaccacagag

SEQ ID NO: 6184619 - DNA, 19 bp, Homo sapiens
cttttccccaattcatgtt

SEQ ID NO: 6184620 - DNA, 17 bp, Homo sapiens
cttttcccccaaagtgg

SEQ ID NO: 6184621 - DNA, 18 bp, Homo sapiens
cttttccccgcctgcagt

SEQ ID NO: 6184622 - DNA, 19 bp, Homo sapiens
cttttccccgcctgcagtc

SEQ ID NO: 6184623 - DNA, 19 bp, Homo sapiens
cttttcccctacagaattt

SEQ ID NO: 6184624 - DNA, 20 bp, Homo sapiens
cttttcccctttcctgtccc

SEQ ID NO: 6184625 - DNA, 15 bp, Homo sapiens
cttttccctatccac

SEQ ID NO: 6184626 - DNA, 13 bp, Homo sapiens
cttttccctcact

SEQ ID NO: 6184627 - DNA, 22 bp, Homo sapiens
cttttccctcggagttcttctt

SEQ ID NO: 6184628 - DNA, 14 bp, Homo sapiens
cttttccctctcta

SEQ ID NO: 6184629 - DNA, 13 bp, Homo sapiens
cttttccctcttt

SEQ ID NO: 6184630 - DNA, 15 bp, Homo sapiens
cttttccctcttttc

SEQ ID NO: 6184631 - DNA, 19 bp, Homo sapiens
cttttccctcttttcttac

SEQ ID NO: 6184632 - DNA, 14 bp, Homo sapiens
cttttccctgggtg

SEQ ID NO: 6184633 - DNA, 19 bp, Homo sapiens
cttttccctttgtgagtca

SEQ ID NO: 6184634 - DNA, 18 bp, Homo sapiens
cttttccgttctgttctg

SEQ ID NO: 6184635 - DNA, 22 bp, Homo sapiens
cttttcctagttttatgtttct

SEQ ID NO: 6184636 - DNA, 19 bp, Homo sapiens
cttttcctattttcagccc

SEQ ID NO: 6184637 - DNA, 20 bp, Homo sapiens
cttttcctattttcagccca

SEQ ID NO: 6184638 - DNA, 17 bp, Homo sapiens
cttttcctcccatttta

SEQ ID NO: 6184639 - DNA, 19 bp, Homo sapiens
cttttcctcccattttaga

SEQ ID NO: 6184640 - DNA, 15 bp, Homo sapiens
cttttcctcccttgg

SEQ ID NO: 6184641 - DNA, 15 bp, Homo sapiens
cttttcctcctccac

SEQ ID NO: 6184642 - DNA, 16 bp, Homo sapiens
cttttcctcgcttctt

SEQ ID NO: 6184643 - DNA, 18 bp, Homo sapiens
cttttcctcgcttctttc

SEQ ID NO: 6184644 - DNA, 15 bp, Homo sapiens
cttttcctctctctc

SEQ ID NO: 6184645 - DNA, 16 bp, Homo sapiens
cttttcctctctctcc

SEQ ID NO: 6184646 - DNA, 16 bp, Homo sapiens
cttttcctctctgtct

SEQ ID NO: 6184647 - DNA, 21 bp, Homo sapiens
cttttcctgaggtcatctgta

SEQ ID NO: 6184648 - DNA, 18 bp, Homo sapiens
cttttcctggcagctgct

SEQ ID NO: 6184649 - DNA, 14 bp, Homo sapiens
cttttcctgggcct

SEQ ID NO: 6184650 - DNA, 17 bp, Homo sapiens
cttttcctgggtgctca

SEQ ID NO: 6184651 - DNA, 18 bp, Homo sapiens
cttttcctgtcagtgttt

SEQ ID NO: 6184652 - DNA, 15 bp, Homo sapiens
cttttcctgtctgta

SEQ ID NO: 6184653 - DNA, 17 bp, Homo sapiens
cttttccttatttgcct

SEQ ID NO: 6184654 - DNA, 23 bp, Homo sapiens
cttttccttatttgccttctact

SEQ ID NO: 6184655 - DNA, 13 bp, Homo sapiens
cttttccttccct

SEQ ID NO: 6184656 - DNA, 13 bp, Homo sapiens
cttttccttgggg

SEQ ID NO: 6184657 - DNA, 21 bp, Homo sapiens
cttttccttggggcaggcagt

SEQ ID NO: 6184658 - DNA, 11 bp, Homo sapiens
cttttcctttg

SEQ ID NO: 6184659 - DNA, 16 bp, Homo sapiens
cttttccttttcttaa

SEQ ID NO: 6184660 - DNA, 19 bp, Homo sapiens
cttttcgaactgtgctccc

SEQ ID NO: 6184661 - DNA, 20 bp, Homo sapiens
cttttcgcaggattcttcct

SEQ ID NO: 6184662 - DNA, 21 bp, Homo sapiens
cttttcgcaggattcttcctc

SEQ ID NO: 6184663 - DNA, 13 bp, Homo sapiens
cttttcgccccct

SEQ ID NO: 6184664 - DNA, 16 bp, Homo sapiens
cttttcgccgtggctg

SEQ ID NO: 6184665 - DNA, 15 bp, Homo sapiens
cttttcgcctttcct

SEQ ID NO: 6184666 - DNA, 18 bp, Homo sapiens
cttttcgcttgcttctgc

SEQ ID NO: 6184667 - DNA, 20 bp, Homo sapiens
cttttcgcttgcttctgcag

SEQ ID NO: 6184668 - DNA, 11 bp, Homo sapiens
cttttcgttaa

SEQ ID NO: 6184669 - DNA, 20 bp, Homo sapiens
cttttcgttaacattgacca

SEQ ID NO: 6184670 - DNA, 22 bp, Homo sapiens
cttttcgtttagaatcagaata

SEQ ID NO: 6184671 - DNA, 23 bp, Homo sapiens
cttttcgtttagaatcagaataa

SEQ ID NO: 6184672 - DNA, 23 bp, Homo sapiens
cttttctaaactaggctccttca

SEQ ID NO: 6184673 - DNA, 14 bp, Homo sapiens
cttttctaaatcct

SEQ ID NO: 6184674 - DNA, 19 bp, Homo sapiens
cttttctaaatccttgtta

SEQ ID NO: 6184675 - DNA, 14 bp, Homo sapiens
cttttctaaatgtt

SEQ ID NO: 6184676 - DNA, 22 bp, Homo sapiens
cttttctaaatgttattacttg

SEQ ID NO: 6184677 - DNA, 18 bp, Homo sapiens
cttttctaatgccttttg

SEQ ID NO: 6184678 - DNA, 18 bp, Homo sapiens
cttttctaatggatattt

SEQ ID NO: 6184679 - DNA, 16 bp, Homo sapiens
cttttctagagacaca

SEQ ID NO: 6184680 - DNA, 18 bp, Homo sapiens
cttttctagagacacatt

SEQ ID NO: 6184681 - DNA, 21 bp, Homo sapiens
cttttctagcccgaatacaaa

SEQ ID NO: 6184682 - DNA, 18 bp, Homo sapiens
cttttctaggctacaatt

SEQ ID NO: 6184683 - DNA, 20 bp, Homo sapiens
cttttctataagttgtacca

SEQ ID NO: 6184684 - DNA, 23 bp, Homo sapiens
cttttctataagttgtaccaaaa

SEQ ID NO: 6184685 - DNA, 19 bp, Homo sapiens
cttttctataatgtgcctg

SEQ ID NO: 6184686 - DNA, 12 bp, Homo sapiens
cttttctatgtt

SEQ ID NO: 6184687 - DNA, 22 bp, Homo sapiens
cttttctatgttgctattgtaa

SEQ ID NO: 6184688 - DNA, 21 bp, Homo sapiens
cttttctattccttctggcct

SEQ ID NO: 6184689 - DNA, 21 bp, Homo sapiens
cttttctatttataagtgact

SEQ ID NO: 6184690 - DNA, 22 bp, Homo sapiens
cttttctcaatattaagtcatt

SEQ ID NO: 6184691 - DNA, 11 bp, Homo sapiens
cttttctcagg

SEQ ID NO: 6184692 - DNA, 13 bp, Homo sapiens
cttttctcaggac

SEQ ID NO: 6184693 - DNA, 14 bp, Homo sapiens
cttttctcatggta

SEQ ID NO: 6184694 - DNA, 21 bp, Homo sapiens
cttttctccaatatcagtgct

SEQ ID NO: 6184695 - DNA, 15 bp, Homo sapiens
cttttctccatgagt

SEQ ID NO: 6184696 - DNA, 16 bp, Homo sapiens
cttttctcccagaagg

SEQ ID NO: 6184697 - DNA, 17 bp, Homo sapiens
cttttctcccagaaggc

SEQ ID NO: 6184698 - DNA, 17 bp, Homo sapiens
cttttctcctgcatgtg

SEQ ID NO: 6184699 - DNA, 21 bp, Homo sapiens
cttttctcctgcatgtgtata

SEQ ID NO: 6184700 - DNA, 17 bp, Homo sapiens
cttttctcctttaccag

SEQ ID NO: 6184701 - DNA, 18 bp, Homo sapiens
cttttctcctttaccagt

SEQ ID NO: 6184702 - DNA, 14 bp, Homo sapiens
cttttctctcccat

SEQ ID NO: 6184703 - DNA, 14 bp, Homo sapiens
cttttctctgagat

SEQ ID NO: 6184704 - DNA, 15 bp, Homo sapiens
cttttctctgctctt

SEQ ID NO: 6184705 - DNA, 21 bp, Homo sapiens
cttttctctttaattttaact

SEQ ID NO: 6184706 - DNA, 13 bp, Homo sapiens
cttttctctttct

SEQ ID NO: 6184707 - DNA, 21 bp, Homo sapiens
cttttctctttgggtttcttg

SEQ ID NO: 6184708 - DNA, 13 bp, Homo sapiens
cttttctgaggtt

SEQ ID NO: 6184709 - DNA, 18 bp, Homo sapiens
cttttctgagttcttgaa

SEQ ID NO: 6184710 - DNA, 14 bp, Homo sapiens
cttttctgatagag

SEQ ID NO: 6184711 - DNA, 16 bp, Homo sapiens
cttttctgatccagtt

SEQ ID NO: 6184712 - DNA, 21 bp, Homo sapiens
cttttctgatcgtctcggccc

SEQ ID NO: 6184713 - DNA, 15 bp, Homo sapiens
cttttctgatggtat

SEQ ID NO: 6184714 - DNA, 15 bp, Homo sapiens
cttttctgcagaggg

SEQ ID NO: 6184715 - DNA, 13 bp, Homo sapiens
cttttctgcattt

SEQ ID NO: 6184716 - DNA, 14 bp, Homo sapiens
cttttctgccaaaa

SEQ ID NO: 6184717 - DNA, 13 bp, Homo sapiens
cttttctgccctg

SEQ ID NO: 6184718 - DNA, 16 bp, Homo sapiens
cttttctgctgttgcc

SEQ ID NO: 6184719 - DNA, 22 bp, Homo sapiens
cttttctggaagggcagcatat

SEQ ID NO: 6184720 - DNA, 19 bp, Homo sapiens
cttttctggaatggaattg

SEQ ID NO: 6184721 - DNA, 13 bp, Homo sapiens
cttttctggaatt

SEQ ID NO: 6184722 - DNA, 14 bp, Homo sapiens
cttttctggcaccg

SEQ ID NO: 6184723 - DNA, 15 bp, Homo sapiens
cttttctggctcctg

SEQ ID NO: 6184724 - DNA, 17 bp, Homo sapiens
cttttctggctcctgtg

SEQ ID NO: 6184725 - DNA, 18 bp, Homo sapiens
cttttctggctggggatg

SEQ ID NO: 6184726 - DNA, 16 bp, Homo sapiens
cttttctggggcccag

SEQ ID NO: 6184727 - DNA, 21 bp, Homo sapiens
cttttctggtaattttgggtt

SEQ ID NO: 6184728 - DNA, 16 bp, Homo sapiens
cttttctggttccaaa

SEQ ID NO: 6184729 - DNA, 15 bp, Homo sapiens
ctgtaaaccacttgt

SEQ ID NO: 6184730 - DNA, 22 bp, Homo sapiens
ctgtaaactcaaaacttaacat

SEQ ID NO: 6184731 - DNA, 13 bp, Homo sapiens
ctgtaaactgaat

SEQ ID NO: 6184732 - DNA, 14 bp, Homo sapiens
ctgtaaacttaaaa

SEQ ID NO: 6184733 - DNA, 19 bp, Homo sapiens
ctgtaaagaaacatttcct

SEQ ID NO: 6184734 - DNA, 15 bp, Homo sapiens
ctgtaaagaaagaga

SEQ ID NO: 6184735 - DNA, 19 bp, Homo sapiens
ctgtaaagaaagagagaaa

SEQ ID NO: 6184736 - DNA, 16 bp, Homo sapiens
ctgtaaagacaaataa

SEQ ID NO: 6184737 - DNA, 20 bp, Homo sapiens
ctgtaaagagacctacctca

SEQ ID NO: 6184738 - DNA, 14 bp, Homo sapiens
ctgtaaagagttgc

SEQ ID NO: 6184739 - DNA, 17 bp, Homo sapiens
ctgtaaagatgaatgtc

SEQ ID NO: 6184740 - DNA, 16 bp, Homo sapiens
ctgtaaagatgtttat

SEQ ID NO: 6184741 - DNA, 12 bp, Homo sapiens
ctgtaaagcaaa

SEQ ID NO: 6184742 - DNA, 13 bp, Homo sapiens
ctgtaaagcaaaa

SEQ ID NO: 6184743 - DNA, 13 bp, Homo sapiens
ctgtaaagcaaat

SEQ ID NO: 6184744 - DNA, 12 bp, Homo sapiens
ctgtaaagccag

SEQ ID NO: 6184745 - DNA, 15 bp, Homo sapiens
ctgtaaagtgcctta

SEQ ID NO: 6184746 - DNA, 21 bp, Homo sapiens
ctgtaaagttcaattgtgaaa

SEQ ID NO: 6184747 - DNA, 19 bp, Homo sapiens
ctgtaaagttgaggggaga

SEQ ID NO: 6184748 - DNA, 17 bp, Homo sapiens
ctgtaaataaaaatagc

SEQ ID NO: 6184749 - DNA, 18 bp, Homo sapiens
ctgtaaataaaaatagct

SEQ ID NO: 6184750 - DNA, 21 bp, Homo sapiens
ctgtaaataaaatgtgtacag

SEQ ID NO: 6184751 - DNA, 17 bp, Homo sapiens
ctgtaaatacaaaataa

SEQ ID NO: 6184752 - DNA, 21 bp, Homo sapiens
ctgtaaatacaaaataaaatt

SEQ ID NO: 6184753 - DNA, 21 bp, Homo sapiens
ctgtaaatacatcctttttct

SEQ ID NO: 6184754 - DNA, 15 bp, Homo sapiens
ctgtaaatacatgtg

SEQ ID NO: 6184755 - DNA, 16 bp, Homo sapiens
ctgtaaatacatgtgt

SEQ ID NO: 6184756 - DNA, 17 bp, Homo sapiens
ctgtaaatacatgtgtg

SEQ ID NO: 6184757 - DNA, 12 bp, Homo sapiens
ctgtaaatacca

SEQ ID NO: 6184758 - DNA, 13 bp, Homo sapiens
ctgtaaataccat

SEQ ID NO: 6184759 - DNA, 19 bp, Homo sapiens
ctgtaaatagttttaaata

SEQ ID NO: 6184760 - DNA, 19 bp, Homo sapiens
ctgtaaatataaattttgt

SEQ ID NO: 6184761 - DNA, 13 bp, Homo sapiens
ctgtaaatatatc

SEQ ID NO: 6184762 - DNA, 15 bp, Homo sapiens
ctgtaaatatgtcac

SEQ ID NO: 6184763 - DNA, 17 bp, Homo sapiens
ctgtaaatatgtttgtg

SEQ ID NO: 6184764 - DNA, 22 bp, Homo sapiens
ctgtaaatatgtttgtgcctta

SEQ ID NO: 6184765 - DNA, 14 bp, Homo sapiens
ctgtaaatatttca

SEQ ID NO: 6184766 - DNA, 12 bp, Homo sapiens
ctgtaaatcact

SEQ ID NO: 6184767 - DNA, 13 bp, Homo sapiens
ctgtaaatcactt

SEQ ID NO: 6184768 - DNA, 14 bp, Homo sapiens
ctgtaaatcctaga

SEQ ID NO: 6184769 - DNA, 18 bp, Homo sapiens
ctgtaaatcctagacttg

SEQ ID NO: 6184770 - DNA, 22 bp, Homo sapiens
ctgtaaatgaacacatggcaga

SEQ ID NO: 6184771 - DNA, 22 bp, Homo sapiens
ctgtaaatgaagggtcatttct

SEQ ID NO: 6184772 - DNA, 15 bp, Homo sapiens
ctgtaaatgccttgc

SEQ ID NO: 6184773 - DNA, 18 bp, Homo sapiens
ctgtaaatggtgtacata

SEQ ID NO: 6184774 - DNA, 17 bp, Homo sapiens
ctgtaaattattttaaa

SEQ ID NO: 6184775 - DNA, 15 bp, Homo sapiens
ctgtaaattccaaag

SEQ ID NO: 6184776 - DNA, 18 bp, Homo sapiens
ctgtaaattccaaagatc

SEQ ID NO: 6184777 - DNA, 19 bp, Homo sapiens
ctgtaaattccaaagatct

SEQ ID NO: 6184778 - DNA, 17 bp, Homo sapiens
ctgtaaattgaacttcc

SEQ ID NO: 6184779 - DNA, 16 bp, Homo sapiens
ctgtaaatttaactgc

SEQ ID NO: 6184780 - DNA, 12 bp, Homo sapiens
ctgtaacaaatt

SEQ ID NO: 6184781 - DNA, 17 bp, Homo sapiens
ctgtaacaaattgggat

SEQ ID NO: 6184782 - DNA, 18 bp, Homo sapiens
ctgtaacacaagccacag

SEQ ID NO: 6184783 - DNA, 20 bp, Homo sapiens
ctgtaacacaagccacagaa

SEQ ID NO: 6184784 - DNA, 16 bp, Homo sapiens
ctgtaacactattaca

SEQ ID NO: 6184785 - DNA, 17 bp, Homo sapiens
ctgtaacactcctctgc

SEQ ID NO: 6184786 - DNA, 16 bp, Homo sapiens
ctgtaacactttacaa

SEQ ID NO: 6184787 - DNA, 18 bp, Homo sapiens
ctgtaacagttctttttg

SEQ ID NO: 6184788 - DNA, 19 bp, Homo sapiens
ctgtaacatactggcctgg

SEQ ID NO: 6184789 - DNA, 21 bp, Homo sapiens
ctgtaacatatctgtaaatag

SEQ ID NO: 6184790 - DNA, 21 bp, Homo sapiens
ctgtaacatcactatccatgc

SEQ ID NO: 6184791 - DNA, 19 bp, Homo sapiens
ctgtaacatcgcacagttt

SEQ ID NO: 6184792 - DNA, 18 bp, Homo sapiens
ctgtaaccacctctctgt

SEQ ID NO: 6184793 - DNA, 21 bp, Homo sapiens
ctgtaaccacctctctgtctt

SEQ ID NO: 6184794 - DNA, 22 bp, Homo sapiens
ctgtaaccacctctctgtcttt

SEQ ID NO: 6184795 - DNA, 14 bp, Homo sapiens
ctgtaacccttgaa

SEQ ID NO: 6184796 - DNA, 18 bp, Homo sapiens
ctgtaacctcaaactctg

SEQ ID NO: 6184797 - DNA, 17 bp, Homo sapiens
ctgtaacctgaagtcaa

SEQ ID NO: 6184798 - DNA, 23 bp, Homo sapiens
ctgtaacctgctggatgggactc

SEQ ID NO: 6184799 - DNA, 20 bp, Homo sapiens
ctgtaaccttctattttcta

SEQ ID NO: 6184800 - DNA, 19 bp, Homo sapiens
ctgtaactcagacattcca

SEQ ID NO: 6184801 - DNA, 11 bp, Homo sapiens
ctgtaactgcc

SEQ ID NO: 6184802 - DNA, 17 bp, Homo sapiens
ctgtaactgccctttta

SEQ ID NO: 6184803 - DNA, 13 bp, Homo sapiens
ctgtaactgctca

SEQ ID NO: 6184804 - DNA, 22 bp, Homo sapiens
ctgtaactgctcagagctttaa

SEQ ID NO: 6184805 - DNA, 20 bp, Homo sapiens
ctgtaactgctgagccactc

SEQ ID NO: 6184806 - DNA, 13 bp, Homo sapiens
ctgtaactgtcac

SEQ ID NO: 6184807 - DNA, 14 bp, Homo sapiens
ctgtaactgtcagt

SEQ ID NO: 6184808 - DNA, 16 bp, Homo sapiens
ctgtaacttaaaatag

SEQ ID NO: 6184809 - DNA, 22 bp, Homo sapiens
ctgtaacttgatccatttctaa

SEQ ID NO: 6184810 - DNA, 18 bp, Homo sapiens
ctgtaagaaaaaaaatgt

SEQ ID NO: 6184811 - DNA, 21 bp, Homo sapiens
ctgtaagaaaatgctgtcaca

SEQ ID NO: 6184812 - DNA, 13 bp, Homo sapiens
ctgtaagaaacct

SEQ ID NO: 6184813 - DNA, 22 bp, Homo sapiens
ctgtaagaaacctactgcccag

SEQ ID NO: 6184814 - DNA, 17 bp, Homo sapiens
ctgtaagaagagactgg

SEQ ID NO: 6184815 - DNA, 16 bp, Homo sapiens
ctgtaagaagagccat

SEQ ID NO: 6184816 - DNA, 20 bp, Homo sapiens
ctgtaagaataatttatagt

SEQ ID NO: 6184817 - DNA, 21 bp, Homo sapiens
ctgtaagaataatttatagta

SEQ ID NO: 6184818 - DNA, 20 bp, Homo sapiens
ctgtaagagaaaatattact

SEQ ID NO: 6184819 - DNA, 17 bp, Homo sapiens
ctgtaagagcttgctcc

SEQ ID NO: 6184820 - DNA, 16 bp, Homo sapiens
ctgtaagatgtctgtt

SEQ ID NO: 6184821 - DNA, 21 bp, Homo sapiens
ctgtaagatgtctgtttgctg

SEQ ID NO: 6184822 - DNA, 22 bp, Homo sapiens
ctgtaagatgtctgtttgctga

SEQ ID NO: 6184823 - DNA, 13 bp, Homo sapiens
ctgtaagatgttg

SEQ ID NO: 6184824 - DNA, 21 bp, Homo sapiens
ctgtaagcagattacaataaa

SEQ ID NO: 6184825 - DNA, 13 bp, Homo sapiens
ctgtaagcctgca

SEQ ID NO: 6184826 - DNA, 16 bp, Homo sapiens
ctgtaagcctgcaagc

SEQ ID NO: 6184827 - DNA, 22 bp, Homo sapiens
ctgtaagcggtggtttgtaatt

SEQ ID NO: 6184828 - DNA, 15 bp, Homo sapiens
ctgtaagctcaagct

SEQ ID NO: 6184829 - DNA, 13 bp, Homo sapiens
ctgtaagctcttt

SEQ ID NO: 6184830 - DNA, 20 bp, Homo sapiens
ctgtaagcttttaagaaaaa

SEQ ID NO: 6184831 - DNA, 19 bp, Homo sapiens
ctgtaaggactcagtgttg

SEQ ID NO: 6184832 - DNA, 21 bp, Homo sapiens
ctgtaaggatccggaaagaag

SEQ ID NO: 6184833 - DNA, 16 bp, Homo sapiens
ctgtaaggcatgaagg

SEQ ID NO: 6184834 - DNA, 13 bp, Homo sapiens
ctgtaaggctcta

SEQ ID NO: 6184835 - DNA, 15 bp, Homo sapiens
ctgtaaggctctaga

SEQ ID NO: 6184836 - DNA, 17 bp, Homo sapiens
ctgtaaggctctagatc

SEQ ID NO: 6184837 - DNA, 18 bp, Homo sapiens
ctgtaagggcagtgccca

SEQ ID NO: 6184838 - DNA, 22 bp, Homo sapiens
ctgtaaggggcagcagttgagg

SEQ ID NO: 6184839 - DNA, 18 bp, Homo sapiens
ctgtaaggtgcttgctcc

SEQ ID NO: 6184840 - DNA, 12 bp, Homo sapiens
ctgtaaggttcc

SEQ ID NO: 6184841 - DNA, 18 bp, Homo sapiens
ctgtaaggttccatccac

SEQ ID NO: 6184842 - DNA, 17 bp, Homo sapiens
ctgtaaggtttcaatgc

SEQ ID NO: 6184843 - DNA, 19 bp, Homo sapiens
ctgtaagtaattgccacag

SEQ ID NO: 6184844 - DNA, 21 bp, Homo sapiens
ctgtaagttgggcttgctatt

SEQ ID NO: 6184845 - DNA, 22 bp, Homo sapiens
ctgtaagttgggcttgctattc

SEQ ID NO: 6184846 - DNA, 22 bp, Homo sapiens
ctgtaagtttattttttctaca

SEQ ID NO: 6184847 - DNA, 13 bp, Homo sapiens
ctgtaataaatat

SEQ ID NO: 6184848 - DNA, 16 bp, Homo sapiens
ctgtaataaatatgag

SEQ ID NO: 6184849 - DNA, 17 bp, Homo sapiens
ctgtaataaatatgagt

SEQ ID NO: 6184850 - DNA, 22 bp, Homo sapiens
ctgtaataatacctcaatgttt

SEQ ID NO: 6184851 - DNA, 12 bp, Homo sapiens
ctgtaataatag

SEQ ID NO: 6184852 - DNA, 20 bp, Homo sapiens
ctgtaatacgtagctctctt

SEQ ID NO: 6184853 - DNA, 17 bp, Homo sapiens
ctgtaatagatcagcat

SEQ ID NO: 6184854 - DNA, 17 bp, Homo sapiens
ctgtaatagcctcacct

SEQ ID NO: 6184855 - DNA, 23 bp, Homo sapiens
ctgtaatagttcagtagaattac

SEQ ID NO: 6184856 - DNA, 23 bp, Homo sapiens
ctgtaatatacaagcaagcaaaa

SEQ ID NO: 6184857 - DNA, 20 bp, Homo sapiens
ctgtaatatcattttataga

SEQ ID NO: 6184858 - DNA, 17 bp, Homo sapiens
ctgtaatatctttaaat

SEQ ID NO: 6184859 - DNA, 14 bp, Homo sapiens
ctgtaatattgtaa

SEQ ID NO: 6184860 - DNA, 15 bp, Homo sapiens
ctgtaatattgtaaa

SEQ ID NO: 6184861 - DNA, 15 bp, Homo sapiens
ctgtaatatttacaa

SEQ ID NO: 6184862 - DNA, 15 bp, Homo sapiens
ctgtaatcaagaaaa

SEQ ID NO: 6184863 - DNA, 14 bp, Homo sapiens
ctgtaatcagcaat

SEQ ID NO: 6184864 - DNA, 23 bp, Homo sapiens
ctgtaatcaggcaaggaggagga

SEQ ID NO: 6184865 - DNA, 19 bp, Homo sapiens
ctgtaatcatataataaat

SEQ ID NO: 6184866 - DNA, 18 bp, Homo sapiens
ctgtaatcatttgtttac

SEQ ID NO: 6184867 - DNA, 13 bp, Homo sapiens
ctgtaatcccaga

SEQ ID NO: 6184868 - DNA, 13 bp, Homo sapiens
ctgtaatcccagc

SEQ ID NO: 6184869 - DNA, 14 bp, Homo sapiens
ctgtaatcccagca

SEQ ID NO: 6184870 - DNA, 18 bp, Homo sapiens
ctgtaatcccagcacttt

SEQ ID NO: 6184871 - DNA, 20 bp, Homo sapiens
ctgtaatcccagcatgctga

SEQ ID NO: 6184872 - DNA, 19 bp, Homo sapiens
ctgtaatcccagctactca

SEQ ID NO: 6184873 - DNA, 18 bp, Homo sapiens
ctgtaatcccagtacttt

SEQ ID NO: 6184874 - DNA, 15 bp, Homo sapiens
ctgtaatcgtgctat

SEQ ID NO: 6184875 - DNA, 20 bp, Homo sapiens
ctgtaatctcgtttcaaaaa

SEQ ID NO: 6184876 - DNA, 22 bp, Homo sapiens
ctgtaatctcgtttcaaaaaca

SEQ ID NO: 6184877 - DNA, 21 bp, Homo sapiens
ctgtaatctctgtcaaggtaa

SEQ ID NO: 6184878 - DNA, 20 bp, Homo sapiens
ctgtaatcttttatttaagt

SEQ ID NO: 6184879 - DNA, 20 bp, Homo sapiens
ctgtaatctttttctccacc

SEQ ID NO: 6184880 - DNA, 15 bp, Homo sapiens
ctgtaatgaatctaa

SEQ ID NO: 6184881 - DNA, 21 bp, Homo sapiens
ctgtaatgaatctaagcagca

SEQ ID NO: 6184882 - DNA, 15 bp, Homo sapiens
ctgtaatgacaaaag

SEQ ID NO: 6184883 - DNA, 17 bp, Homo sapiens
ctgtaatgacaaaagat

SEQ ID NO: 6184884 - DNA, 22 bp, Homo sapiens
ctgtaatgagaacttcaatcac

SEQ ID NO: 6184885 - DNA, 19 bp, Homo sapiens
ctgtaatgagtcagtgaag

SEQ ID NO: 6184886 - DNA, 16 bp, Homo sapiens
ctgtaatgcactcctg

SEQ ID NO: 6184887 - DNA, 16 bp, Homo sapiens
ctgtaatgctgcctca

SEQ ID NO: 6184888 - DNA, 22 bp, Homo sapiens
ctgtaatggaactgaccccctc

SEQ ID NO: 6184889 - DNA, 13 bp, Homo sapiens
ctgtaatggttgg

SEQ ID NO: 6184890 - DNA, 17 bp, Homo sapiens
ctgtaatgtaaataaac

SEQ ID NO: 6184891 - DNA, 21 bp, Homo sapiens
ctgtaatgttaaactctttgg

SEQ ID NO: 6184892 - DNA, 14 bp, Homo sapiens
ctgtaatgttaata

SEQ ID NO: 6184893 - DNA, 18 bp, Homo sapiens
ctgtaatgttaatattga

SEQ ID NO: 6184894 - DNA, 19 bp, Homo sapiens
ctgtaatgttaatattgat

SEQ ID NO: 6184895 - DNA, 13 bp, Homo sapiens
ctgtaattacaac

SEQ ID NO: 6184896 - DNA, 18 bp, Homo sapiens
ctgtaattacaactaaat

SEQ ID NO: 6184897 - DNA, 14 bp, Homo sapiens
ctgtaattatttga

SEQ ID NO: 6184898 - DNA, 23 bp, Homo sapiens
ctgtaattcagtgtatttcagtt

SEQ ID NO: 6184899 - DNA, 21 bp, Homo sapiens
ctgtaattgcactttttaagt

SEQ ID NO: 6184900 - DNA, 12 bp, Homo sapiens
ctgtaattgtgt

SEQ ID NO: 6184901 - DNA, 20 bp, Homo sapiens
ctgtaatttcgccttaaact

SEQ ID NO: 6184902 - DNA, 12 bp, Homo sapiens
ctgtaatttgaa

SEQ ID NO: 6184903 - DNA, 13 bp, Homo sapiens
ctgtaattttata

SEQ ID NO: 6184904 - DNA, 23 bp, Homo sapiens
ctgtaatttttattttcaccctc

SEQ ID NO: 6184905 - DNA, 14 bp, Homo sapiens
ctgtacaaaaacaa

SEQ ID NO: 6184906 - DNA, 13 bp, Homo sapiens
ctgtacaaaatgg

SEQ ID NO: 6184907 - DNA, 12 bp, Homo sapiens
ctgtacaaaggg

SEQ ID NO: 6184908 - DNA, 21 bp, Homo sapiens
cttttctggttccaaaccagt

SEQ ID NO: 6184909 - DNA, 13 bp, Homo sapiens
cttttctgtaatg

SEQ ID NO: 6184910 - DNA, 16 bp, Homo sapiens
cttttctgtaattcag

SEQ ID NO: 6184911 - DNA, 21 bp, Homo sapiens
cttttctgtagatgttgtctt

SEQ ID NO: 6184912 - DNA, 15 bp, Homo sapiens
cttttctgtcaccaa

SEQ ID NO: 6184913 - DNA, 13 bp, Homo sapiens
cttttctgtcagt

SEQ ID NO: 6184914 - DNA, 13 bp, Homo sapiens
cttttctgtcctg

SEQ ID NO: 6184915 - DNA, 14 bp, Homo sapiens
cttttctgtcctgg

SEQ ID NO: 6184916 - DNA, 15 bp, Homo sapiens
cttttctgtcctggg

SEQ ID NO: 6184917 - DNA, 23 bp, Homo sapiens
cttttctgtgaagccctttgcct

SEQ ID NO: 6184918 - DNA, 17 bp, Homo sapiens
cttttctgtggctggct

SEQ ID NO: 6184919 - DNA, 19 bp, Homo sapiens
cttttctgtttcctgtacc

SEQ ID NO: 6184920 - DNA, 20 bp, Homo sapiens
cttttctgtttctgtttata

SEQ ID NO: 6184921 - DNA, 15 bp, Homo sapiens
cttttcttactcctc

SEQ ID NO: 6184922 - DNA, 21 bp, Homo sapiens
cttttcttagtttcagaagta

SEQ ID NO: 6184923 - DNA, 15 bp, Homo sapiens
cttttcttatttaaa

SEQ ID NO: 6184924 - DNA, 17 bp, Homo sapiens
cttttcttatttaaaat

SEQ ID NO: 6184925 - DNA, 18 bp, Homo sapiens
cttttcttctattgcctc

SEQ ID NO: 6184926 - DNA, 15 bp, Homo sapiens
cttttcttcttcctg

SEQ ID NO: 6184927 - DNA, 14 bp, Homo sapiens
cttttcttgaggca

SEQ ID NO: 6184928 - DNA, 19 bp, Homo sapiens
cttttcttgatatctttcc

SEQ ID NO: 6184929 - DNA, 16 bp, Homo sapiens
cttttcttgccagctc

SEQ ID NO: 6184930 - DNA, 18 bp, Homo sapiens
cttttcttgccagctcag

SEQ ID NO: 6184931 - DNA, 11 bp, Homo sapiens
cttttcttggc

SEQ ID NO: 6184932 - DNA, 21 bp, Homo sapiens
cttttcttggcaaaagccttg

SEQ ID NO: 6184933 - DNA, 17 bp, Homo sapiens
cttttcttggttctttt

SEQ ID NO: 6184934 - DNA, 23 bp, Homo sapiens
cttttcttggttcttttttcagt

SEQ ID NO: 6184935 - DNA, 15 bp, Homo sapiens
cttttcttgtctctg

SEQ ID NO: 6184936 - DNA, 17 bp, Homo sapiens
cttttcttgtctctgag

SEQ ID NO: 6184937 - DNA, 14 bp, Homo sapiens
cttttctttaactt

SEQ ID NO: 6184938 - DNA, 21 bp, Homo sapiens
cttttctttagagaactgaaa

SEQ ID NO: 6184939 - DNA, 12 bp, Homo sapiens
cttttctttcaa

SEQ ID NO: 6184940 - DNA, 12 bp, Homo sapiens
cttttctttcct

SEQ ID NO: 6184941 - DNA, 19 bp, Homo sapiens
cttttctttctttcattct

SEQ ID NO: 6184942 - DNA, 14 bp, Homo sapiens
cttttctttctttt

SEQ ID NO: 6184943 - DNA, 12 bp, Homo sapiens
cttttctttgta

SEQ ID NO: 6184944 - DNA, 14 bp, Homo sapiens
cttttctttgtatc

SEQ ID NO: 6184945 - DNA, 19 bp, Homo sapiens
cttttcttttgctttcctt

SEQ ID NO: 6184946 - DNA, 15 bp, Homo sapiens
cttttcttttgttac

SEQ ID NO: 6184947 - DNA, 17 bp, Homo sapiens
cttttcttttgttactg

SEQ ID NO: 6184948 - DNA, 19 bp, Homo sapiens
cttttcttttgttactgtt

SEQ ID NO: 6184949 - DNA, 15 bp, Homo sapiens
cttttctttttaatt

SEQ ID NO: 6184950 - DNA, 17 bp, Homo sapiens
cttttctttttattagg

SEQ ID NO: 6184951 - DNA, 17 bp, Homo sapiens
cttttgaaaaaaaagtt

SEQ ID NO: 6184952 - DNA, 19 bp, Homo sapiens
cttttgaaaaaaaagtttt

SEQ ID NO: 6184953 - DNA, 17 bp, Homo sapiens
cttttgaaaactgctga

SEQ ID NO: 6184954 - DNA, 20 bp, Homo sapiens
cttttgaaaatcaagatgag

SEQ ID NO: 6184955 - DNA, 14 bp, Homo sapiens
cttttgaaagatgt

SEQ ID NO: 6184956 - DNA, 14 bp, Homo sapiens
cttttgaaagtaga

SEQ ID NO: 6184957 - DNA, 18 bp, Homo sapiens
cttttgaacccaggagtt

SEQ ID NO: 6184958 - DNA, 13 bp, Homo sapiens
cttttgaaccttg

SEQ ID NO: 6184959 - DNA, 21 bp, Homo sapiens
cttttgaacgcccccccccac

SEQ ID NO: 6184960 - DNA, 19 bp, Homo sapiens
cttttgaactcacgagcct

SEQ ID NO: 6184961 - DNA, 23 bp, Homo sapiens
cttttgaactcacgagccttgcg

SEQ ID NO: 6184962 - DNA, 22 bp, Homo sapiens
cttttgaactggcaattgtcta

SEQ ID NO: 6184963 - DNA, 15 bp, Homo sapiens
cttttgaacttgtca

SEQ ID NO: 6184964 - DNA, 15 bp, Homo sapiens
cttttgaagaacaaa

SEQ ID NO: 6184965 - DNA, 21 bp, Homo sapiens
cttttgaagcatagataatat

SEQ ID NO: 6184966 - DNA, 18 bp, Homo sapiens
cttttgaagctcaactgt

SEQ ID NO: 6184967 - DNA, 18 bp, Homo sapiens
cttttgaataatgtagtg

SEQ ID NO: 6184968 - DNA, 21 bp, Homo sapiens
cttttgaatacatttgtattt

SEQ ID NO: 6184969 - DNA, 13 bp, Homo sapiens
cttttgaatattc

SEQ ID NO: 6184970 - DNA, 21 bp, Homo sapiens
cttttgaatcaatctggcttc

SEQ ID NO: 6184971 - DNA, 22 bp, Homo sapiens
cttttgaatcaatctggcttct

SEQ ID NO: 6184972 - DNA, 16 bp, Homo sapiens
cttttgaatgtccaaa

SEQ ID NO: 6184973 - DNA, 21 bp, Homo sapiens
cttttgaatgttaagaataac

SEQ ID NO: 6184974 - DNA, 15 bp, Homo sapiens
cttttgaattacaga

SEQ ID NO: 6184975 - DNA, 16 bp, Homo sapiens
cttttgaattgttaca

SEQ ID NO: 6184976 - DNA, 19 bp, Homo sapiens
cttttgacaatcaaagaaa

SEQ ID NO: 6184977 - DNA, 12 bp, Homo sapiens
cttttgacactg

SEQ ID NO: 6184978 - DNA, 17 bp, Homo sapiens
cttttgacactgctcta

SEQ ID NO: 6184979 - DNA, 20 bp, Homo sapiens
cttttgacataactatcttt

SEQ ID NO: 6184980 - DNA, 17 bp, Homo sapiens
cttttgaccccttcctg

SEQ ID NO: 6184981 - DNA, 10 bp, Homo sapiens
cttttgacct

SEQ ID NO: 6184982 - DNA, 16 bp, Homo sapiens
cttttgactaagaatt

SEQ ID NO: 6184983 - DNA, 12 bp, Homo sapiens
cttttgactctt

SEQ ID NO: 6184984 - DNA, 18 bp, Homo sapiens
cttttgactcttccgtgc

SEQ ID NO: 6184985 - DNA, 15 bp, Homo sapiens
cttttgagacttttt

SEQ ID NO: 6184986 - DNA, 16 bp, Homo sapiens
cttttgaggagctgga

SEQ ID NO: 6184987 - DNA, 22 bp, Homo sapiens
cttttgaggatgggatgtattt

SEQ ID NO: 6184988 - DNA, 12 bp, Homo sapiens
cttttgaggctt

SEQ ID NO: 6184989 - DNA, 16 bp, Homo sapiens
cttttgaggcttctcc

SEQ ID NO: 6184990 - DNA, 16 bp, Homo sapiens
cttttgaggtccctgt

SEQ ID NO: 6184991 - DNA, 16 bp, Homo sapiens
cttttgagtgggccct

SEQ ID NO: 6184992 - DNA, 17 bp, Homo sapiens
cttttgagtgggccctg

SEQ ID NO: 6184993 - DNA, 21 bp, Homo sapiens
cttttgagtgggccctgcccg

SEQ ID NO: 6184994 - DNA, 23 bp, Homo sapiens
cttttgagtgggccctgcccggg

SEQ ID NO: 6184995 - DNA, 13 bp, Homo sapiens
cttttgagtgttc

SEQ ID NO: 6184996 - DNA, 22 bp, Homo sapiens
cttttgagtgttcccaatctga

SEQ ID NO: 6184997 - DNA, 21 bp, Homo sapiens
cttttgataaaatgttccttt

SEQ ID NO: 6184998 - DNA, 11 bp, Homo sapiens
cttttgataca

SEQ ID NO: 6184999 - DNA, 19 bp, Homo sapiens
cttttgatacatttatctt

SEQ ID NO: 6185000 - DNA, 17 bp, Homo sapiens
cttttgatagtatttat

SEQ ID NO: 6185001 - DNA, 19 bp, Homo sapiens
cttttgatagtatttataa

SEQ ID NO: 6185002 - DNA, 14 bp, Homo sapiens
cttttgatagttct

SEQ ID NO: 6185003 - DNA, 23 bp, Homo sapiens
cttttgatatgcatatttgttta

SEQ ID NO: 6185004 - DNA, 16 bp, Homo sapiens
cttttgatattaaatt

SEQ ID NO: 6185005 - DNA, 14 bp, Homo sapiens
cttttgatctctgc

SEQ ID NO: 6185006 - DNA, 15 bp, Homo sapiens
cttttgatctctgct

SEQ ID NO: 6185007 - DNA, 15 bp, Homo sapiens
cttttgatgaaataa

SEQ ID NO: 6185008 - DNA, 15 bp, Homo sapiens
cttttgatgacttca

SEQ ID NO: 6185009 - DNA, 20 bp, Homo sapiens
cttttgatggctatgttttg

SEQ ID NO: 6185010 - DNA, 15 bp, Homo sapiens
cttttgatggggaga

SEQ ID NO: 6185011 - DNA, 19 bp, Homo sapiens
cttttgatggggagaaagg

SEQ ID NO: 6185012 - DNA, 18 bp, Homo sapiens
cttttgcaaaagaagttg

SEQ ID NO: 6185013 - DNA, 21 bp, Homo sapiens
cttttgcaaagaaagaaaaaa

SEQ ID NO: 6185014 - DNA, 11 bp, Homo sapiens
cttttgcaaat

SEQ ID NO: 6185015 - DNA, 18 bp, Homo sapiens
cttttgcaacaagacaaa

SEQ ID NO: 6185016 - DNA, 15 bp, Homo sapiens
cttttgcaaccagga

SEQ ID NO: 6185017 - DNA, 24 bp, Homo sapiens
cttttgcaaccaggaacagcaaat

SEQ ID NO: 6185018 - DNA, 23 bp, Homo sapiens
cttttgcacaaggaaataaagcg

SEQ ID NO: 6185019 - DNA, 18 bp, Homo sapiens
cttttgcacattccaaaa

SEQ ID NO: 6185020 - DNA, 17 bp, Homo sapiens
cttttgcacccctccca

SEQ ID NO: 6185021 - DNA, 20 bp, Homo sapiens
cttttgcacccctcccatta

SEQ ID NO: 6185022 - DNA, 14 bp, Homo sapiens
cttttgcagaagag

SEQ ID NO: 6185023 - DNA, 16 bp, Homo sapiens
cttttgcagcagagga

SEQ ID NO: 6185024 - DNA, 21 bp, Homo sapiens
cttttgcagcttccttccaag

SEQ ID NO: 6185025 - DNA, 22 bp, Homo sapiens
cttttgcaggagtttgtggtaa

SEQ ID NO: 6185026 - DNA, 19 bp, Homo sapiens
cttttgcatagaataatga

SEQ ID NO: 6185027 - DNA, 23 bp, Homo sapiens
cttttgcatagaataatgaagat

SEQ ID NO: 6185028 - DNA, 23 bp, Homo sapiens
cttttgcatattgcatactatta

SEQ ID NO: 6185029 - DNA, 15 bp, Homo sapiens
cttttgcatcattgt

SEQ ID NO: 6185030 - DNA, 21 bp, Homo sapiens
cttttgcatgtcgcacaatgt

SEQ ID NO: 6185031 - DNA, 19 bp, Homo sapiens
cttttgcatttcctgtgtt

SEQ ID NO: 6185032 - DNA, 23 bp, Homo sapiens
cttttgcatttctcttcctaaat

SEQ ID NO: 6185033 - DNA, 21 bp, Homo sapiens
cttttgccaactgaagccttc

SEQ ID NO: 6185034 - DNA, 19 bp, Homo sapiens
cttttgccactttggcttc

SEQ ID NO: 6185035 - DNA, 12 bp, Homo sapiens
cttttgcccaca

SEQ ID NO: 6185036 - DNA, 23 bp, Homo sapiens
cttttgcccacacttgggagcaa

SEQ ID NO: 6185037 - DNA, 14 bp, Homo sapiens
cttttgccccagaa

SEQ ID NO: 6185038 - DNA, 16 bp, Homo sapiens
cttttgccccagaaag

SEQ ID NO: 6185039 - DNA, 18 bp, Homo sapiens
cttttgccgttattaaaa

SEQ ID NO: 6185040 - DNA, 16 bp, Homo sapiens
cttttgcctctgccca

SEQ ID NO: 6185041 - DNA, 23 bp, Homo sapiens
cttttgcctgcctgtgctatttt

SEQ ID NO: 6185042 - DNA, 13 bp, Homo sapiens
cttttgcctgtaa

SEQ ID NO: 6185043 - DNA, 20 bp, Homo sapiens
cttttgccttttgcaaccag

SEQ ID NO: 6185044 - DNA, 17 bp, Homo sapiens
cttttgcgatttcacag

SEQ ID NO: 6185045 - DNA, 18 bp, Homo sapiens
cttttgcgcttatttgga

SEQ ID NO: 6185046 - DNA, 19 bp, Homo sapiens
cttttgcgcttatttggaa

SEQ ID NO: 6185047 - DNA, 23 bp, Homo sapiens
cttttgcgcttatttggaaattt

SEQ ID NO: 6185048 - DNA, 16 bp, Homo sapiens
cttttgctacgtgcct

SEQ ID NO: 6185049 - DNA, 14 bp, Homo sapiens
cttttgctctctca

SEQ ID NO: 6185050 - DNA, 20 bp, Homo sapiens
cttttgctctctcattccca

SEQ ID NO: 6185051 - DNA, 16 bp, Homo sapiens
cttttgctgcgcacca

SEQ ID NO: 6185052 - DNA, 18 bp, Homo sapiens
cttttgctgctgcttaat

SEQ ID NO: 6185053 - DNA, 15 bp, Homo sapiens
cttttgctgtctttc

SEQ ID NO: 6185054 - DNA, 17 bp, Homo sapiens
cttttgctgtctttctc

SEQ ID NO: 6185055 - DNA, 20 bp, Homo sapiens
cttttgcttaggaaattgct

SEQ ID NO: 6185056 - DNA, 20 bp, Homo sapiens
cttttgcttgccaaagtaca

SEQ ID NO: 6185057 - DNA, 18 bp, Homo sapiens
cttttgctttaattccat

SEQ ID NO: 6185058 - DNA, 14 bp, Homo sapiens
cttttgctttattc

SEQ ID NO: 6185059 - DNA, 24 bp, Homo sapiens
cttttgctttctgtttcttaaggg

SEQ ID NO: 6185060 - DNA, 18 bp, Homo sapiens
cttttgcttttgcccatt

SEQ ID NO: 6185061 - DNA, 15 bp, Homo sapiens
cttttgcttttggca

SEQ ID NO: 6185062 - DNA, 17 bp, Homo sapiens
cttttgcttttggcaaa

SEQ ID NO: 6185063 - DNA, 18 bp, Homo sapiens
cttttggaaggtatttaa

SEQ ID NO: 6185064 - DNA, 18 bp, Homo sapiens
cttttggaagttttgcta

SEQ ID NO: 6185065 - DNA, 13 bp, Homo sapiens
cttttggaatcat

SEQ ID NO: 6185066 - DNA, 15 bp, Homo sapiens
cttttggcactgaga

SEQ ID NO: 6185067 - DNA, 19 bp, Homo sapiens
cttttggcatgaaagtgcg

SEQ ID NO: 6185068 - DNA, 15 bp, Homo sapiens
cttttggcattttac

SEQ ID NO: 6185069 - DNA, 22 bp, Homo sapiens
cttttggccgggcatggtagct

SEQ ID NO: 6185070 - DNA, 14 bp, Homo sapiens
cttttggcctcctg

SEQ ID NO: 6185071 - DNA, 16 bp, Homo sapiens
cttttggcctcctgca

SEQ ID NO: 6185072 - DNA, 22 bp, Homo sapiens
cttttggcctcctgcaaagtct

SEQ ID NO: 6185073 - DNA, 17 bp, Homo sapiens
cttttggcctgggggag

SEQ ID NO: 6185074 - DNA, 13 bp, Homo sapiens
cttttggccttgt

SEQ ID NO: 6185075 - DNA, 14 bp, Homo sapiens
cttttggccttgtg

SEQ ID NO: 6185076 - DNA, 17 bp, Homo sapiens
cttttggcggggaggag

SEQ ID NO: 6185077 - DNA, 21 bp, Homo sapiens
cttttggctgcaagtaacaga

SEQ ID NO: 6185078 - DNA, 11 bp, Homo sapiens
cttttgggaag

SEQ ID NO: 6185079 - DNA, 20 bp, Homo sapiens
cttttgggaggatttgatgt

SEQ ID NO: 6185080 - DNA, 21 bp, Homo sapiens
cttttgggaggatttgatgta

SEQ ID NO: 6185081 - DNA, 21 bp, Homo sapiens
cttttgggaggtccaggcagg

SEQ ID NO: 6185082 - DNA, 19 bp, Homo sapiens
cttttgggcctccttccca

SEQ ID NO: 6185083 - DNA, 14 bp, Homo sapiens
cttttggggaggag

SEQ ID NO: 6185084 - DNA, 19 bp, Homo sapiens
cttttggggagggagggga

SEQ ID NO: 6185085 - DNA, 16 bp, Homo sapiens
cttttggggctcttga

SEQ ID NO: 6185086 - DNA, 14 bp, Homo sapiens
cttttgggggaggg

SEQ ID NO: 6185087 - DNA, 15 bp, Homo sapiens
ctgtacaaagggaag

SEQ ID NO: 6185088 - DNA, 15 bp, Homo sapiens
ctgtacaaagtagaa

SEQ ID NO: 6185089 - DNA, 15 bp, Homo sapiens
ctgtacaaatataag

SEQ ID NO: 6185090 - DNA, 20 bp, Homo sapiens
ctgtacaaatataagaataa

SEQ ID NO: 6185091 - DNA, 17 bp, Homo sapiens
ctgtacaaatcctctgt

SEQ ID NO: 6185092 - DNA, 15 bp, Homo sapiens
ctgtacaacttctgg

SEQ ID NO: 6185093 - DNA, 23 bp, Homo sapiens
ctgtacaataagttacttgaaat

SEQ ID NO: 6185094 - DNA, 18 bp, Homo sapiens
ctgtacaatatttaaaat

SEQ ID NO: 6185095 - DNA, 17 bp, Homo sapiens
ctgtacacaactcactc

SEQ ID NO: 6185096 - DNA, 22 bp, Homo sapiens
ctgtacacaactcactcctttt

SEQ ID NO: 6185097 - DNA, 13 bp, Homo sapiens
ctgtacacacaca

SEQ ID NO: 6185098 - DNA, 17 bp, Homo sapiens
ctgtacacacacagaca

SEQ ID NO: 6185099 - DNA, 21 bp, Homo sapiens
ctgtacacacacagacacaca

SEQ ID NO: 6185100 - DNA, 21 bp, Homo sapiens
ctgtacacacccgcctgacac

SEQ ID NO: 6185101 - DNA, 20 bp, Homo sapiens
ctgtacacaccctccagcac

SEQ ID NO: 6185102 - DNA, 16 bp, Homo sapiens
ctgtacacactttatt

SEQ ID NO: 6185103 - DNA, 20 bp, Homo sapiens
ctgtacacactttatttact

SEQ ID NO: 6185104 - DNA, 12 bp, Homo sapiens
ctgtacacattt

SEQ ID NO: 6185105 - DNA, 14 bp, Homo sapiens
ctgtacacatttct

SEQ ID NO: 6185106 - DNA, 15 bp, Homo sapiens
ctgtacacatttctt

SEQ ID NO: 6185107 - DNA, 24 bp, Homo sapiens
ctgtacacatttcttaaaacacat

SEQ ID NO: 6185108 - DNA, 20 bp, Homo sapiens
ctgtacaccatagtttacaa

SEQ ID NO: 6185109 - DNA, 13 bp, Homo sapiens
ctgtacacggacc

SEQ ID NO: 6185110 - DNA, 13 bp, Homo sapiens
ctgtacactgcac

SEQ ID NO: 6185111 - DNA, 19 bp, Homo sapiens
ctgtacagaagaaactgaa

SEQ ID NO: 6185112 - DNA, 22 bp, Homo sapiens
ctgtacagaagaaactgaatct

SEQ ID NO: 6185113 - DNA, 21 bp, Homo sapiens
ctgtacagaatgctatttcac

SEQ ID NO: 6185114 - DNA, 16 bp, Homo sapiens
ctgtacagagactcta

SEQ ID NO: 6185115 - DNA, 21 bp, Homo sapiens
ctgtacagagactctatttta

SEQ ID NO: 6185116 - DNA, 15 bp, Homo sapiens
ctgtacagagcccac

SEQ ID NO: 6185117 - DNA, 22 bp, Homo sapiens
ctgtacagagccgtaaaaactg

SEQ ID NO: 6185118 - DNA, 19 bp, Homo sapiens
ctgtacagatcaagaaaaa

SEQ ID NO: 6185119 - DNA, 16 bp, Homo sapiens
ctgtacagctggctct

SEQ ID NO: 6185120 - DNA, 17 bp, Homo sapiens
ctgtacagctggctcta

SEQ ID NO: 6185121 - DNA, 22 bp, Homo sapiens
ctgtacaggtacaggctggaga

SEQ ID NO: 6185122 - DNA, 20 bp, Homo sapiens
ctgtacagtctgtcttctgt

SEQ ID NO: 6185123 - DNA, 22 bp, Homo sapiens
ctgtacagtctgtcttctgtat

SEQ ID NO: 6185124 - DNA, 11 bp, Homo sapiens
ctgtacagtgt

SEQ ID NO: 6185125 - DNA, 14 bp, Homo sapiens
ctgtacagtgtctt

SEQ ID NO: 6185126 - DNA, 21 bp, Homo sapiens
ctgtacagtgtctttttttgt

SEQ ID NO: 6185127 - DNA, 13 bp, Homo sapiens
ctgtacagtgtta

SEQ ID NO: 6185128 - DNA, 13 bp, Homo sapiens
ctgtacagttttg

SEQ ID NO: 6185129 - DNA, 17 bp, Homo sapiens
ctgtacataaacaatga

SEQ ID NO: 6185130 - DNA, 19 bp, Homo sapiens
ctgtacataaattccagag

SEQ ID NO: 6185131 - DNA, 20 bp, Homo sapiens
ctgtacataattgcatgaaa

SEQ ID NO: 6185132 - DNA, 21 bp, Homo sapiens
ctgtacataattgcatgaaaa

SEQ ID NO: 6185133 - DNA, 16 bp, Homo sapiens
ctgtacatacaaattc

SEQ ID NO: 6185134 - DNA, 21 bp, Homo sapiens
ctgtacatacattgtataggc

SEQ ID NO: 6185135 - DNA, 17 bp, Homo sapiens
ctgtacatactggcctc

SEQ ID NO: 6185136 - DNA, 16 bp, Homo sapiens
ctgtacatactttttc

SEQ ID NO: 6185137 - DNA, 15 bp, Homo sapiens
ctgtacatagatgta

SEQ ID NO: 6185138 - DNA, 15 bp, Homo sapiens
ctgtacatagcctat

SEQ ID NO: 6185139 - DNA, 12 bp, Homo sapiens
ctgtacatagtc

SEQ ID NO: 6185140 - DNA, 17 bp, Homo sapiens
ctgtacatatctttgag

SEQ ID NO: 6185141 - DNA, 20 bp, Homo sapiens
ctgtacatatttgagactag

SEQ ID NO: 6185142 - DNA, 17 bp, Homo sapiens
ctgtacatgaaaacaca

SEQ ID NO: 6185143 - DNA, 17 bp, Homo sapiens
ctgtacattgtgagctc

SEQ ID NO: 6185144 - DNA, 21 bp, Homo sapiens
ctgtacattgtgagctctggt

SEQ ID NO: 6185145 - DNA, 13 bp, Homo sapiens
ctgtacatttaaa

SEQ ID NO: 6185146 - DNA, 20 bp, Homo sapiens
ctgtacatttgcaattagaa

SEQ ID NO: 6185147 - DNA, 20 bp, Homo sapiens
ctgtacattttgttgtaaaa

SEQ ID NO: 6185148 - DNA, 21 bp, Homo sapiens
ctgtacattttgttgtaaaaa

SEQ ID NO: 6185149 - DNA, 23 bp, Homo sapiens
ctgtacattttgttgtaaaaaga

SEQ ID NO: 6185150 - DNA, 14 bp, Homo sapiens
ctgtaccaaatctg

SEQ ID NO: 6185151 - DNA, 15 bp, Homo sapiens
ctgtaccaaatctga

SEQ ID NO: 6185152 - DNA, 18 bp, Homo sapiens
ctgtaccacatctgctct

SEQ ID NO: 6185153 - DNA, 15 bp, Homo sapiens
ctgtaccatccatgg

SEQ ID NO: 6185154 - DNA, 17 bp, Homo sapiens
ctgtacccaccccagca

SEQ ID NO: 6185155 - DNA, 18 bp, Homo sapiens
ctgtacccaccccagcac

SEQ ID NO: 6185156 - DNA, 23 bp, Homo sapiens
ctgtacccaccccagcacagcca

SEQ ID NO: 6185157 - DNA, 15 bp, Homo sapiens
ctgtacccagatgcc

SEQ ID NO: 6185158 - DNA, 17 bp, Homo sapiens
ctgtacccagatgccta

SEQ ID NO: 6185159 - DNA, 12 bp, Homo sapiens
ctgtacccagcc

SEQ ID NO: 6185160 - DNA, 20 bp, Homo sapiens
ctgtacccagccaccttcct

SEQ ID NO: 6185161 - DNA, 14 bp, Homo sapiens
ctgtacccagctcc

SEQ ID NO: 6185162 - DNA, 15 bp, Homo sapiens
ctgtacccagctcct

SEQ ID NO: 6185163 - DNA, 23 bp, Homo sapiens
ctgtaccctcgcatgactgttac

SEQ ID NO: 6185164 - DNA, 17 bp, Homo sapiens
ctgtacccttccacctc

SEQ ID NO: 6185165 - DNA, 21 bp, Homo sapiens
ctgtacccttccacctcctag

SEQ ID NO: 6185166 - DNA, 15 bp, Homo sapiens
ctgtaccggccactg

SEQ ID NO: 6185167 - DNA, 17 bp, Homo sapiens
ctgtaccggccactgca

SEQ ID NO: 6185168 - DNA, 20 bp, Homo sapiens
ctgtaccgtcgacaagaatg

SEQ ID NO: 6185169 - DNA, 14 bp, Homo sapiens
ctgtacctaaagca

SEQ ID NO: 6185170 - DNA, 15 bp, Homo sapiens
ctgtacctaaagcaa

SEQ ID NO: 6185171 - DNA, 14 bp, Homo sapiens
ctgtacctcagtgg

SEQ ID NO: 6185172 - DNA, 15 bp, Homo sapiens
ctgtacctcagtgga

SEQ ID NO: 6185173 - DNA, 18 bp, Homo sapiens
ctgtacctcatcccatga

SEQ ID NO: 6185174 - DNA, 14 bp, Homo sapiens
ctgtacctctctct

SEQ ID NO: 6185175 - DNA, 20 bp, Homo sapiens
ctgtacctctctctgctcct

SEQ ID NO: 6185176 - DNA, 14 bp, Homo sapiens
ctgtacctgagagg

SEQ ID NO: 6185177 - DNA, 13 bp, Homo sapiens
ctgtacctggctg

SEQ ID NO: 6185178 - DNA, 13 bp, Homo sapiens
ctgtacctgtagg

SEQ ID NO: 6185179 - DNA, 21 bp, Homo sapiens
ctgtacctgttccttagacct

SEQ ID NO: 6185180 - DNA, 20 bp, Homo sapiens
ctgtaccttttgaggagccc

SEQ ID NO: 6185181 - DNA, 13 bp, Homo sapiens
ctgtacgaaaaag

SEQ ID NO: 6185182 - DNA, 20 bp, Homo sapiens
ctgtacgaacccctcccctc

SEQ ID NO: 6185183 - DNA, 17 bp, Homo sapiens
ctgtacgaggcttctct

SEQ ID NO: 6185184 - DNA, 13 bp, Homo sapiens
ctgtacgcgcaga

SEQ ID NO: 6185185 - DNA, 14 bp, Homo sapiens
ctgtacgtctgaca

SEQ ID NO: 6185186 - DNA, 18 bp, Homo sapiens
ctgtacgtctgacaggca

SEQ ID NO: 6185187 - DNA, 19 bp, Homo sapiens
ctgtacgtctgacaggcaa

SEQ ID NO: 6185188 - DNA, 18 bp, Homo sapiens
ctgtactaacccagtctt

SEQ ID NO: 6185189 - DNA, 19 bp, Homo sapiens
ctgtactaaggagaaatga

SEQ ID NO: 6185190 - DNA, 17 bp, Homo sapiens
ctgtactaaggagcatg

SEQ ID NO: 6185191 - DNA, 18 bp, Homo sapiens
ctgtactaaggagcatga

SEQ ID NO: 6185192 - DNA, 21 bp, Homo sapiens
ctgtactactcctaattattg

SEQ ID NO: 6185193 - DNA, 17 bp, Homo sapiens
ctgtactactctaggga

SEQ ID NO: 6185194 - DNA, 15 bp, Homo sapiens
ctgtactactgcctt

SEQ ID NO: 6185195 - DNA, 22 bp, Homo sapiens
ctgtactagcttttgaaatcca

SEQ ID NO: 6185196 - DNA, 23 bp, Homo sapiens
ctgtactatcctgtaaatatatc

SEQ ID NO: 6185197 - DNA, 18 bp, Homo sapiens
ctgtactatctagtgtct

SEQ ID NO: 6185198 - DNA, 19 bp, Homo sapiens
ctgtactatctagtgtcta

SEQ ID NO: 6185199 - DNA, 23 bp, Homo sapiens
ctgtactatgatgggcttctgtt

SEQ ID NO: 6185200 - DNA, 16 bp, Homo sapiens
ctgtactcactgagta

SEQ ID NO: 6185201 - DNA, 13 bp, Homo sapiens
ctgtactcagagc

SEQ ID NO: 6185202 - DNA, 20 bp, Homo sapiens
ctgtactccttggatttgca

SEQ ID NO: 6185203 - DNA, 21 bp, Homo sapiens
ctgtactccttggatttgcat

SEQ ID NO: 6185204 - DNA, 16 bp, Homo sapiens
ctgtactgaaagcaaa

SEQ ID NO: 6185205 - DNA, 20 bp, Homo sapiens
ctgtactgaagtaaaacaaa

SEQ ID NO: 6185206 - DNA, 15 bp, Homo sapiens
ctgtactgaataggt

SEQ ID NO: 6185207 - DNA, 16 bp, Homo sapiens
ctgtactgacttgagg

SEQ ID NO: 6185208 - DNA, 12 bp, Homo sapiens
ctgtactgagtt

SEQ ID NO: 6185209 - DNA, 14 bp, Homo sapiens
ctgtactgagttct

SEQ ID NO: 6185210 - DNA, 20 bp, Homo sapiens
ctgtactgagttctcatcca

SEQ ID NO: 6185211 - DNA, 20 bp, Homo sapiens
ctgtactgatttttgtaaga

SEQ ID NO: 6185212 - DNA, 22 bp, Homo sapiens
ctgtactgatttttgtaagaca

SEQ ID NO: 6185213 - DNA, 12 bp, Homo sapiens
ctgtactgcatg

SEQ ID NO: 6185214 - DNA, 16 bp, Homo sapiens
ctgtactgcctgcttg

SEQ ID NO: 6185215 - DNA, 18 bp, Homo sapiens
ctgtactgcctgcttggg

SEQ ID NO: 6185216 - DNA, 19 bp, Homo sapiens
ctgtactgcctgcttgggg

SEQ ID NO: 6185217 - DNA, 14 bp, Homo sapiens
ctgtactgctcagg

SEQ ID NO: 6185218 - DNA, 13 bp, Homo sapiens
ctgtactggagag

SEQ ID NO: 6185219 - DNA, 19 bp, Homo sapiens
ctgtactgggttatttttg

SEQ ID NO: 6185220 - DNA, 20 bp, Homo sapiens
ctgtactgggttatttttgt

SEQ ID NO: 6185221 - DNA, 14 bp, Homo sapiens
ctgtactgtaattt

SEQ ID NO: 6185222 - DNA, 20 bp, Homo sapiens
ctgtactgttactgggccct

SEQ ID NO: 6185223 - DNA, 17 bp, Homo sapiens
ctgtacttattttccaa

SEQ ID NO: 6185224 - DNA, 17 bp, Homo sapiens
ctgtacttcactgtcag

SEQ ID NO: 6185225 - DNA, 20 bp, Homo sapiens
ctgtacttcagtatgtgtca

SEQ ID NO: 6185226 - DNA, 22 bp, Homo sapiens
ctgtacttcccaattgccacat

SEQ ID NO: 6185227 - DNA, 17 bp, Homo sapiens
ctgtacttcttgaatat

SEQ ID NO: 6185228 - DNA, 17 bp, Homo sapiens
ctgtacttgatgacaga

SEQ ID NO: 6185229 - DNA, 19 bp, Homo sapiens
ctgtacttgctcttgatgc

SEQ ID NO: 6185230 - DNA, 23 bp, Homo sapiens
ctgtacttgctcttgatgcctgg

SEQ ID NO: 6185231 - DNA, 23 bp, Homo sapiens
ctgtacttggtccaactgcaact

SEQ ID NO: 6185232 - DNA, 14 bp, Homo sapiens
ctgtactttcccag

SEQ ID NO: 6185233 - DNA, 15 bp, Homo sapiens
ctgtactttgattca

SEQ ID NO: 6185234 - DNA, 13 bp, Homo sapiens
ctgtactttgtgt

SEQ ID NO: 6185235 - DNA, 16 bp, Homo sapiens
ctgtactttgtgttta

SEQ ID NO: 6185236 - DNA, 19 bp, Homo sapiens
ctgtacttttcccatttgt

SEQ ID NO: 6185237 - DNA, 15 bp, Homo sapiens
ctgtacttttttcaa

SEQ ID NO: 6185238 - DNA, 17 bp, Homo sapiens
ctgtagaaaggaaatag

SEQ ID NO: 6185239 - DNA, 18 bp, Homo sapiens
ctgtagaaaggaaataga

SEQ ID NO: 6185240 - DNA, 13 bp, Homo sapiens
ctgtagaaatggt

SEQ ID NO: 6185241 - DNA, 19 bp, Homo sapiens
ctgtagaacacccctgtgc

SEQ ID NO: 6185242 - DNA, 18 bp, Homo sapiens
ctgtagaactcaacctct

SEQ ID NO: 6185243 - DNA, 15 bp, Homo sapiens
ctgtagaactgattt

SEQ ID NO: 6185244 - DNA, 16 bp, Homo sapiens
ctgtagaactgatttt

SEQ ID NO: 6185245 - DNA, 22 bp, Homo sapiens
ctgtagaagaagtgaacactta

SEQ ID NO: 6185246 - DNA, 15 bp, Homo sapiens
ctgtagacactctga

SEQ ID NO: 6185247 - DNA, 21 bp, Homo sapiens
ctgtagacactctgacaagct

SEQ ID NO: 6185248 - DNA, 14 bp, Homo sapiens
ctgtagacatctgt

SEQ ID NO: 6185249 - DNA, 15 bp, Homo sapiens
ctgtagactagtgcc

SEQ ID NO: 6185250 - DNA, 21 bp, Homo sapiens
ctgtagactctaagatacact

SEQ ID NO: 6185251 - DNA, 21 bp, Homo sapiens
ctgtagacttactttcctatt

SEQ ID NO: 6185252 - DNA, 18 bp, Homo sapiens
ctgtagagaatgaaagga

SEQ ID NO: 6185253 - DNA, 13 bp, Homo sapiens
ctgtagagagaga

SEQ ID NO: 6185254 - DNA, 17 bp, Homo sapiens
ctgtagagagagaccta

SEQ ID NO: 6185255 - DNA, 19 bp, Homo sapiens
ctgtagagagagacctaga

SEQ ID NO: 6185256 - DNA, 19 bp, Homo sapiens
ctgtagagatttttatgtg

SEQ ID NO: 6185257 - DNA, 17 bp, Homo sapiens
ctgtagagccagccttg

SEQ ID NO: 6185258 - DNA, 14 bp, Homo sapiens
ctgtagaggagcct

SEQ ID NO: 6185259 - DNA, 15 bp, Homo sapiens
ctgtagagtgggagc

SEQ ID NO: 6185260 - DNA, 16 bp, Homo sapiens
ctgtagagttgctgag

SEQ ID NO: 6185261 - DNA, 15 bp, Homo sapiens
ctgtagataacagca

SEQ ID NO: 6185262 - DNA, 16 bp, Homo sapiens
ctgtagataattaacc

SEQ ID NO: 6185263 - DNA, 17 bp, Homo sapiens
ctgtagatacaggggca

SEQ ID NO: 6185264 - DNA, 14 bp, Homo sapiens
ctgtagatatgtat

SEQ ID NO: 6185265 - DNA, 14 bp, Homo sapiens
ctgtagatgcagaa

SEQ ID NO: 6185266 - DNA, 17 bp, Homo sapiens
cttttgggggtcagcat

SEQ ID NO: 6185267 - DNA, 20 bp, Homo sapiens
cttttgggtagttgtttttt

SEQ ID NO: 6185268 - DNA, 23 bp, Homo sapiens
cttttgggtttgccttaattctt

SEQ ID NO: 6185269 - DNA, 14 bp, Homo sapiens
cttttggtctccct

SEQ ID NO: 6185270 - DNA, 22 bp, Homo sapiens
cttttggtctccttgggccctt

SEQ ID NO: 6185271 - DNA, 16 bp, Homo sapiens
cttttggtctgtgtga

SEQ ID NO: 6185272 - DNA, 21 bp, Homo sapiens
cttttggtcttcagcctccct

SEQ ID NO: 6185273 - DNA, 19 bp, Homo sapiens
cttttggtgagaaggtgtt

SEQ ID NO: 6185274 - DNA, 22 bp, Homo sapiens
cttttggtgcctggctggtttg

SEQ ID NO: 6185275 - DNA, 19 bp, Homo sapiens
cttttggtgtcattattcc

SEQ ID NO: 6185276 - DNA, 21 bp, Homo sapiens
cttttggtgtcattattccat

SEQ ID NO: 6185277 - DNA, 20 bp, Homo sapiens
cttttggttaagtctgtttt

SEQ ID NO: 6185278 - DNA, 17 bp, Homo sapiens
cttttggttgccttaaa

SEQ ID NO: 6185279 - DNA, 21 bp, Homo sapiens
cttttggttgccttaaaagaa

SEQ ID NO: 6185280 - DNA, 12 bp, Homo sapiens
cttttggtttaa

SEQ ID NO: 6185281 - DNA, 20 bp, Homo sapiens
cttttggtttcaccttccct

SEQ ID NO: 6185282 - DNA, 14 bp, Homo sapiens
cttttggtttctgc

SEQ ID NO: 6185283 - DNA, 19 bp, Homo sapiens
cttttgtaaagtaaaatat

SEQ ID NO: 6185284 - DNA, 21 bp, Homo sapiens
cttttgtaaagtaaaatatgt

SEQ ID NO: 6185285 - DNA, 12 bp, Homo sapiens
cttttgtaaata

SEQ ID NO: 6185286 - DNA, 15 bp, Homo sapiens
cttttgtaaatgaga

SEQ ID NO: 6185287 - DNA, 14 bp, Homo sapiens
cttttgtaaattaa

SEQ ID NO: 6185288 - DNA, 20 bp, Homo sapiens
cttttgtaagacaaaggttt

SEQ ID NO: 6185289 - DNA, 12 bp, Homo sapiens
cttttgtaagta

SEQ ID NO: 6185290 - DNA, 14 bp, Homo sapiens
cttttgtaagttga

SEQ ID NO: 6185291 - DNA, 14 bp, Homo sapiens
cttttgtaattgtg

SEQ ID NO: 6185292 - DNA, 16 bp, Homo sapiens
cttttgtaattgtgta

SEQ ID NO: 6185293 - DNA, 20 bp, Homo sapiens
cttttgtaattgtgtaaaaa

SEQ ID NO: 6185294 - DNA, 21 bp, Homo sapiens
cttttgtaattgtgtaaaaaa

SEQ ID NO: 6185295 - DNA, 17 bp, Homo sapiens
cttttgtaatttgaatt

SEQ ID NO: 6185296 - DNA, 12 bp, Homo sapiens
cttttgtacatc

SEQ ID NO: 6185297 - DNA, 17 bp, Homo sapiens
cttttgtacatctggct

SEQ ID NO: 6185298 - DNA, 17 bp, Homo sapiens
cttttgtaccagtgtga

SEQ ID NO: 6185299 - DNA, 19 bp, Homo sapiens
cttttgtaccagtgtgaat

SEQ ID NO: 6185300 - DNA, 22 bp, Homo sapiens
cttttgtacgttaattaaacaa

SEQ ID NO: 6185301 - DNA, 23 bp, Homo sapiens
cttttgtagatggcgatgtgtta

SEQ ID NO: 6185302 - DNA, 19 bp, Homo sapiens
cttttgtagctgtcatggt

SEQ ID NO: 6185303 - DNA, 17 bp, Homo sapiens
cttttgtaggctgttcc

SEQ ID NO: 6185304 - DNA, 21 bp, Homo sapiens
cttttgtagtgtgttttcata

SEQ ID NO: 6185305 - DNA, 23 bp, Homo sapiens
cttttgtagttttatttgtatta

SEQ ID NO: 6185306 - DNA, 14 bp, Homo sapiens
cttttgtatagttg

SEQ ID NO: 6185307 - DNA, 16 bp, Homo sapiens
cttttgtatcttcctt

SEQ ID NO: 6185308 - DNA, 17 bp, Homo sapiens
cttttgtatcttccttt

SEQ ID NO: 6185309 - DNA, 14 bp, Homo sapiens
cttttgtatctttt

SEQ ID NO: 6185310 - DNA, 15 bp, Homo sapiens
cttttgtatgtaaat

SEQ ID NO: 6185311 - DNA, 20 bp, Homo sapiens
cttttgtatgtaaatgtgca

SEQ ID NO: 6185312 - DNA, 23 bp, Homo sapiens
cttttgtatgtaaatgtgcattc

SEQ ID NO: 6185313 - DNA, 16 bp, Homo sapiens
cttttgtattaaaaaa

SEQ ID NO: 6185314 - DNA, 19 bp, Homo sapiens
cttttgtatttaaaacctt

SEQ ID NO: 6185315 - DNA, 16 bp, Homo sapiens
cttttgtccacttgta

SEQ ID NO: 6185316 - DNA, 19 bp, Homo sapiens
cttttgtccattccattaa

SEQ ID NO: 6185317 - DNA, 16 bp, Homo sapiens
cttttgtccccagggc

SEQ ID NO: 6185318 - DNA, 17 bp, Homo sapiens
cttttgtcctgttattt

SEQ ID NO: 6185319 - DNA, 20 bp, Homo sapiens
cttttgtccttcctgtgccc

SEQ ID NO: 6185320 - DNA, 11 bp, Homo sapiens
cttttgtctac

SEQ ID NO: 6185321 - DNA, 14 bp, Homo sapiens
cttttgtctccctt

SEQ ID NO: 6185322 - DNA, 21 bp, Homo sapiens
cttttgtgaagaactatttta

SEQ ID NO: 6185323 - DNA, 12 bp, Homo sapiens
cttttgtgagaa

SEQ ID NO: 6185324 - DNA, 22 bp, Homo sapiens
cttttgtgagaagatgggggct

SEQ ID NO: 6185325 - DNA, 22 bp, Homo sapiens
cttttgtgatggagtgctgttt

SEQ ID NO: 6185326 - DNA, 14 bp, Homo sapiens
cttttgtgcattat

SEQ ID NO: 6185327 - DNA, 16 bp, Homo sapiens
cttttgtgccaggagt

SEQ ID NO: 6185328 - DNA, 22 bp, Homo sapiens
cttttgtgccatgttcaaaaga

SEQ ID NO: 6185329 - DNA, 18 bp, Homo sapiens
cttttgtgcctggcttct

SEQ ID NO: 6185330 - DNA, 21 bp, Homo sapiens
cttttgtggaggggagggatg

SEQ ID NO: 6185331 - DNA, 13 bp, Homo sapiens
cttttgtggagtt

SEQ ID NO: 6185332 - DNA, 12 bp, Homo sapiens
cttttgtggatt

SEQ ID NO: 6185333 - DNA, 16 bp, Homo sapiens
cttttgtggattgaca

SEQ ID NO: 6185334 - DNA, 17 bp, Homo sapiens
cttttgtgggtttctct

SEQ ID NO: 6185335 - DNA, 17 bp, Homo sapiens
cttttgtggtgtcttcc

SEQ ID NO: 6185336 - DNA, 18 bp, Homo sapiens
cttttgtgtaataagaaa

SEQ ID NO: 6185337 - DNA, 19 bp, Homo sapiens
cttttgtgtaataagaaag

SEQ ID NO: 6185338 - DNA, 17 bp, Homo sapiens
cttttgtgtaatgaaaa

SEQ ID NO: 6185339 - DNA, 23 bp, Homo sapiens
cttttgtgtacagtgtgtaaagt

SEQ ID NO: 6185340 - DNA, 16 bp, Homo sapiens
cttttgtgtattctgt

SEQ ID NO: 6185341 - DNA, 12 bp, Homo sapiens
cttttgtgttct

SEQ ID NO: 6185342 - DNA, 15 bp, Homo sapiens
cttttgttaaataat

SEQ ID NO: 6185343 - DNA, 20 bp, Homo sapiens
cttttgttaacagtatttct

SEQ ID NO: 6185344 - DNA, 12 bp, Homo sapiens
cttttgttaatg

SEQ ID NO: 6185345 - DNA, 20 bp, Homo sapiens
cttttgttaatgcattgttg

SEQ ID NO: 6185346 - DNA, 10 bp, Homo sapiens
cttttgttac

SEQ ID NO: 6185347 - DNA, 11 bp, Homo sapiens
cttttgttact

SEQ ID NO: 6185348 - DNA, 14 bp, Homo sapiens
cttttgttactgtt

SEQ ID NO: 6185349 - DNA, 22 bp, Homo sapiens
cttttgttactgttcttgctgc

SEQ ID NO: 6185350 - DNA, 20 bp, Homo sapiens
cttttgttaggaaaaaattg

SEQ ID NO: 6185351 - DNA, 21 bp, Homo sapiens
cttttgttagggctgcttttc

SEQ ID NO: 6185352 - DNA, 22 bp, Homo sapiens
cttttgttattaaaaaaacaca

SEQ ID NO: 6185353 - DNA, 18 bp, Homo sapiens
cttttgttattccatcaa

SEQ ID NO: 6185354 - DNA, 19 bp, Homo sapiens
cttttgttcatttcatcct

SEQ ID NO: 6185355 - DNA, 14 bp, Homo sapiens
cttttgttcccatc

SEQ ID NO: 6185356 - DNA, 11 bp, Homo sapiens
cttttgttcta

SEQ ID NO: 6185357 - DNA, 21 bp, Homo sapiens
cttttgttctactccttccct

SEQ ID NO: 6185358 - DNA, 12 bp, Homo sapiens
cttttgttctct

SEQ ID NO: 6185359 - DNA, 17 bp, Homo sapiens
cttttgttctctcttgg

SEQ ID NO: 6185360 - DNA, 14 bp, Homo sapiens
cttttgttctctga

SEQ ID NO: 6185361 - DNA, 14 bp, Homo sapiens
cttttgttctcttc

SEQ ID NO: 6185362 - DNA, 15 bp, Homo sapiens
cttttgttctcttct

SEQ ID NO: 6185363 - DNA, 17 bp, Homo sapiens
cttttgttctgaggggt

SEQ ID NO: 6185364 - DNA, 11 bp, Homo sapiens
cttttgttctt

SEQ ID NO: 6185365 - DNA, 20 bp, Homo sapiens
cttttgttcttggtttgtaa

SEQ ID NO: 6185366 - DNA, 16 bp, Homo sapiens
cttttgttgtacttta

SEQ ID NO: 6185367 - DNA, 22 bp, Homo sapiens
cttttgttgtactttatatctt

SEQ ID NO: 6185368 - DNA, 15 bp, Homo sapiens
cttttgttgtatggg

SEQ ID NO: 6185369 - DNA, 14 bp, Homo sapiens
cttttgttgtttat

SEQ ID NO: 6185370 - DNA, 16 bp, Homo sapiens
cttttgtttacaacac

SEQ ID NO: 6185371 - DNA, 22 bp, Homo sapiens
cttttgtttagagccctcccta

SEQ ID NO: 6185372 - DNA, 13 bp, Homo sapiens
cttttgtttattt

SEQ ID NO: 6185373 - DNA, 13 bp, Homo sapiens
cttttgtttcagg

SEQ ID NO: 6185374 - DNA, 13 bp, Homo sapiens
cttttgtttccat

SEQ ID NO: 6185375 - DNA, 22 bp, Homo sapiens
cttttgtttcccttgctttgtt

SEQ ID NO: 6185376 - DNA, 15 bp, Homo sapiens
cttttgtttcctttt

SEQ ID NO: 6185377 - DNA, 12 bp, Homo sapiens
cttttgtttctt

SEQ ID NO: 6185378 - DNA, 14 bp, Homo sapiens
cttttgtttcttaa

SEQ ID NO: 6185379 - DNA, 20 bp, Homo sapiens
cttttgtttcttcccttcaa

SEQ ID NO: 6185380 - DNA, 15 bp, Homo sapiens
cttttgtttggtaaa

SEQ ID NO: 6185381 - DNA, 15 bp, Homo sapiens
cttttgttttgcttt

SEQ ID NO: 6185382 - DNA, 13 bp, Homo sapiens
cttttgttttggt

SEQ ID NO: 6185383 - DNA, 19 bp, Homo sapiens
cttttgttttttgaagtgt

SEQ ID NO: 6185384 - DNA, 15 bp, Homo sapiens
cttttgttttttggg

SEQ ID NO: 6185385 - DNA, 13 bp, Homo sapiens
cttttgttttttt

SEQ ID NO: 6185386 - DNA, 22 bp, Homo sapiens
ctttttaaaaaaataaaacagt

SEQ ID NO: 6185387 - DNA, 19 bp, Homo sapiens
ctttttaaaaaactctttg

SEQ ID NO: 6185388 - DNA, 15 bp, Homo sapiens
ctttttaaaaaatac

SEQ ID NO: 6185389 - DNA, 20 bp, Homo sapiens
ctttttaaaaaataccattg

SEQ ID NO: 6185390 - DNA, 19 bp, Homo sapiens
ctttttaaaaactcttcag

SEQ ID NO: 6185391 - DNA, 22 bp, Homo sapiens
ctttttaaaaagtactctttaa

SEQ ID NO: 6185392 - DNA, 21 bp, Homo sapiens
ctttttaaaaattgttattta

SEQ ID NO: 6185393 - DNA, 17 bp, Homo sapiens
ctttttaaaacacatgt

SEQ ID NO: 6185394 - DNA, 14 bp, Homo sapiens
ctttttaaaatact

SEQ ID NO: 6185395 - DNA, 15 bp, Homo sapiens
ctttttaaaatataa

SEQ ID NO: 6185396 - DNA, 16 bp, Homo sapiens
ctttttaaaatataag

SEQ ID NO: 6185397 - DNA, 18 bp, Homo sapiens
ctttttaaaatatatgta

SEQ ID NO: 6185398 - DNA, 14 bp, Homo sapiens
ctttttaaaattct

SEQ ID NO: 6185399 - DNA, 12 bp, Homo sapiens
ctttttaaacag

SEQ ID NO: 6185400 - DNA, 14 bp, Homo sapiens
ctttttaaacagtg

SEQ ID NO: 6185401 - DNA, 18 bp, Homo sapiens
ctttttaaactgatgtat

SEQ ID NO: 6185402 - DNA, 15 bp, Homo sapiens
ctttttaaagcttat

SEQ ID NO: 6185403 - DNA, 13 bp, Homo sapiens
ctttttaaagttt

SEQ ID NO: 6185404 - DNA, 20 bp, Homo sapiens
ctttttaaagtttgttcact

SEQ ID NO: 6185405 - DNA, 21 bp, Homo sapiens
ctttttaaatgtaaagatatt

SEQ ID NO: 6185406 - DNA, 16 bp, Homo sapiens
ctttttaaatgtgaat

SEQ ID NO: 6185407 - DNA, 22 bp, Homo sapiens
ctttttaacatagtaacgtgtt

SEQ ID NO: 6185408 - DNA, 21 bp, Homo sapiens
ctttttaaccctaatctttca

SEQ ID NO: 6185409 - DNA, 15 bp, Homo sapiens
ctttttaacctctgt

SEQ ID NO: 6185410 - DNA, 15 bp, Homo sapiens
ctttttaagagatac

SEQ ID NO: 6185411 - DNA, 23 bp, Homo sapiens
ctttttaagatagacttattctt

SEQ ID NO: 6185412 - DNA, 19 bp, Homo sapiens
ctttttaagcctttgaagt

SEQ ID NO: 6185413 - DNA, 14 bp, Homo sapiens
ctttttaagggatt

SEQ ID NO: 6185414 - DNA, 21 bp, Homo sapiens
ctttttaagttattgtacaag

SEQ ID NO: 6185415 - DNA, 19 bp, Homo sapiens
ctttttaataaaaatacac

SEQ ID NO: 6185416 - DNA, 22 bp, Homo sapiens
ctttttaataaagtatattgaa

SEQ ID NO: 6185417 - DNA, 16 bp, Homo sapiens
ctttttaatagcacta

SEQ ID NO: 6185418 - DNA, 17 bp, Homo sapiens
ctttttaatagcactaa

SEQ ID NO: 6185419 - DNA, 15 bp, Homo sapiens
ctttttaatatgctt

SEQ ID NO: 6185420 - DNA, 19 bp, Homo sapiens
ctttttaatgctgtaaaat

SEQ ID NO: 6185421 - DNA, 21 bp, Homo sapiens
ctttttaatgttatttggaat

SEQ ID NO: 6185422 - DNA, 14 bp, Homo sapiens
ctttttaattagta

SEQ ID NO: 6185423 - DNA, 22 bp, Homo sapiens
ctttttaattattttaaaatat

SEQ ID NO: 6185424 - DNA, 16 bp, Homo sapiens
ctttttaattgttgtt

SEQ ID NO: 6185425 - DNA, 22 bp, Homo sapiens
ctttttaattgttgtttctttc

SEQ ID NO: 6185426 - DNA, 22 bp, Homo sapiens
ctttttacacttcacctccttc

SEQ ID NO: 6185427 - DNA, 13 bp, Homo sapiens
ctttttacacttt

SEQ ID NO: 6185428 - DNA, 19 bp, Homo sapiens
ctttttacagcattgtctt

SEQ ID NO: 6185429 - DNA, 21 bp, Homo sapiens
ctttttacagcattgtctttg

SEQ ID NO: 6185430 - DNA, 12 bp, Homo sapiens
ctttttacagtt

SEQ ID NO: 6185431 - DNA, 18 bp, Homo sapiens
ctttttacagttacttcc

SEQ ID NO: 6185432 - DNA, 19 bp, Homo sapiens
ctttttacataactgcctt

SEQ ID NO: 6185433 - DNA, 21 bp, Homo sapiens
ctttttacataactgccttga

SEQ ID NO: 6185434 - DNA, 11 bp, Homo sapiens
ctttttacatt

SEQ ID NO: 6185435 - DNA, 15 bp, Homo sapiens
ctttttacctttcat

SEQ ID NO: 6185436 - DNA, 17 bp, Homo sapiens
ctttttactattaacat

SEQ ID NO: 6185437 - DNA, 13 bp, Homo sapiens
ctttttactgttg

SEQ ID NO: 6185438 - DNA, 16 bp, Homo sapiens
ctttttagatgtattt

SEQ ID NO: 6185439 - DNA, 14 bp, Homo sapiens
ctttttagccagtg

SEQ ID NO: 6185440 - DNA, 21 bp, Homo sapiens
ctttttagtttacccggtttc

SEQ ID NO: 6185441 - DNA, 18 bp, Homo sapiens
ctttttataaaaagataa

SEQ ID NO: 6185442 - DNA, 19 bp, Homo sapiens
ctttttataggttttataa

SEQ ID NO: 6185443 - DNA, 20 bp, Homo sapiens
ctttttatatatatatataa

SEQ ID NO: 6185444 - DNA, 14 bp, Homo sapiens
ctttttatatttta

SEQ ID NO: 6185445 - DNA, 23 bp, Homo sapiens
ctttttatcccatttagtgtgaa

SEQ ID NO: 6185446 - DNA, 16 bp, Homo sapiens
ctgtagatgcagaaaa

SEQ ID NO: 6185447 - DNA, 18 bp, Homo sapiens
ctgtagatggtgacctgg

SEQ ID NO: 6185448 - DNA, 17 bp, Homo sapiens
ctgtagatgttctagga

SEQ ID NO: 6185449 - DNA, 19 bp, Homo sapiens
ctgtagatgttctaggata

SEQ ID NO: 6185450 - DNA, 19 bp, Homo sapiens
ctgtagattcatgcaagtg

SEQ ID NO: 6185451 - DNA, 13 bp, Homo sapiens
ctgtagattctgt

SEQ ID NO: 6185452 - DNA, 19 bp, Homo sapiens
ctgtagatttcagtagttt

SEQ ID NO: 6185453 - DNA, 17 bp, Homo sapiens
ctgtagcaaatttgttt

SEQ ID NO: 6185454 - DNA, 16 bp, Homo sapiens
ctgtagcaatatattt

SEQ ID NO: 6185455 - DNA, 21 bp, Homo sapiens
ctgtagcaatggccagagcct

SEQ ID NO: 6185456 - DNA, 20 bp, Homo sapiens
ctgtagcacggagtgttggg

SEQ ID NO: 6185457 - DNA, 18 bp, Homo sapiens
ctgtagcaggttctaggc

SEQ ID NO: 6185458 - DNA, 15 bp, Homo sapiens
ctgtagcatcttctg

SEQ ID NO: 6185459 - DNA, 17 bp, Homo sapiens
ctgtagcatcttctgga

SEQ ID NO: 6185460 - DNA, 18 bp, Homo sapiens
ctgtagcatcttctggag

SEQ ID NO: 6185461 - DNA, 23 bp, Homo sapiens
ctgtagccacagctgctgttctc

SEQ ID NO: 6185462 - DNA, 13 bp, Homo sapiens
ctgtagccacctc

SEQ ID NO: 6185463 - DNA, 16 bp, Homo sapiens
ctgtagccacctcctt

SEQ ID NO: 6185464 - DNA, 17 bp, Homo sapiens
ctgtagccacctccttg

SEQ ID NO: 6185465 - DNA, 21 bp, Homo sapiens
ctgtagccacctccttggcac

SEQ ID NO: 6185466 - DNA, 22 bp, Homo sapiens
ctgtagccacctccttggcacc

SEQ ID NO: 6185467 - DNA, 13 bp, Homo sapiens
ctgtagccatctg

SEQ ID NO: 6185468 - DNA, 15 bp, Homo sapiens
ctgtagccatggctc

SEQ ID NO: 6185469 - DNA, 20 bp, Homo sapiens
ctgtagccatggctcaggca

SEQ ID NO: 6185470 - DNA, 23 bp, Homo sapiens
ctgtagccatggctcaggcaagc

SEQ ID NO: 6185471 - DNA, 15 bp, Homo sapiens
ctgtagcccaggcca

SEQ ID NO: 6185472 - DNA, 14 bp, Homo sapiens
ctgtagccctggcc

SEQ ID NO: 6185473 - DNA, 14 bp, Homo sapiens
ctgtagcctggtct

SEQ ID NO: 6185474 - DNA, 18 bp, Homo sapiens
ctgtagcctggtctgtgc

SEQ ID NO: 6185475 - DNA, 18 bp, Homo sapiens
ctgtagccttagtgtcac

SEQ ID NO: 6185476 - DNA, 15 bp, Homo sapiens
ctgtagcgaccccag

SEQ ID NO: 6185477 - DNA, 17 bp, Homo sapiens
ctgtagcgaccccagac

SEQ ID NO: 6185478 - DNA, 16 bp, Homo sapiens
ctgtagctacactgta

SEQ ID NO: 6185479 - DNA, 22 bp, Homo sapiens
ctgtagctaggtatcttactct

SEQ ID NO: 6185480 - DNA, 22 bp, Homo sapiens
ctgtagctattagcggctcctc

SEQ ID NO: 6185481 - DNA, 20 bp, Homo sapiens
ctgtagctcaagtttaaaag

SEQ ID NO: 6185482 - DNA, 13 bp, Homo sapiens
ctgtagctcagtc

SEQ ID NO: 6185483 - DNA, 22 bp, Homo sapiens
ctgtagctcagtcatcaaagca

SEQ ID NO: 6185484 - DNA, 19 bp, Homo sapiens
ctgtagctcccgagctact

SEQ ID NO: 6185485 - DNA, 19 bp, Homo sapiens
ctgtagctccctcctccca

SEQ ID NO: 6185486 - DNA, 22 bp, Homo sapiens
ctgtagctccctcctcccatct

SEQ ID NO: 6185487 - DNA, 15 bp, Homo sapiens
ctgtagctctaaaat

SEQ ID NO: 6185488 - DNA, 18 bp, Homo sapiens
ctgtagcttatctgcccc

SEQ ID NO: 6185489 - DNA, 20 bp, Homo sapiens
ctgtagcttatctgcccctc

SEQ ID NO: 6185490 - DNA, 21 bp, Homo sapiens
ctgtagcttatctgcccctcc

SEQ ID NO: 6185491 - DNA, 16 bp, Homo sapiens
ctgtagcttctaatgt

SEQ ID NO: 6185492 - DNA, 18 bp, Homo sapiens
ctgtagcttgttccctgt

SEQ ID NO: 6185493 - DNA, 22 bp, Homo sapiens
ctgtagctttcctggtccctca

SEQ ID NO: 6185494 - DNA, 23 bp, Homo sapiens
ctgtaggaaacagaaaagagaag

SEQ ID NO: 6185495 - DNA, 21 bp, Homo sapiens
ctgtaggaaaccgacgaaaaa

SEQ ID NO: 6185496 - DNA, 18 bp, Homo sapiens
ctgtaggaaggtactgta

SEQ ID NO: 6185497 - DNA, 19 bp, Homo sapiens
ctgtaggaaggtactgtat

SEQ ID NO: 6185498 - DNA, 18 bp, Homo sapiens
ctgtaggaaggttaatgt

SEQ ID NO: 6185499 - DNA, 17 bp, Homo sapiens
ctgtaggactatataaa

SEQ ID NO: 6185500 - DNA, 19 bp, Homo sapiens
ctgtaggactcgcagtcag

SEQ ID NO: 6185501 - DNA, 22 bp, Homo sapiens
ctgtaggagtaaagataaaagg

SEQ ID NO: 6185502 - DNA, 18 bp, Homo sapiens
ctgtaggagttctatttt

SEQ ID NO: 6185503 - DNA, 19 bp, Homo sapiens
ctgtaggatctaaggctgt

SEQ ID NO: 6185504 - DNA, 17 bp, Homo sapiens
ctgtaggcagaggctgc

SEQ ID NO: 6185505 - DNA, 21 bp, Homo sapiens
ctgtagggaaaaaaatgcttc

SEQ ID NO: 6185506 - DNA, 23 bp, Homo sapiens
ctgtagggaaaaaaatgcttctt

SEQ ID NO: 6185507 - DNA, 19 bp, Homo sapiens
ctgtagggaaaccttggag

SEQ ID NO: 6185508 - DNA, 18 bp, Homo sapiens
ctgtagggaattcttctg

SEQ ID NO: 6185509 - DNA, 20 bp, Homo sapiens
ctgtagggagggcggcaggg

SEQ ID NO: 6185510 - DNA, 13 bp, Homo sapiens
ctgtagggccagg

SEQ ID NO: 6185511 - DNA, 21 bp, Homo sapiens
ctgtagggctggacctatgtc

SEQ ID NO: 6185512 - DNA, 22 bp, Homo sapiens
ctgtagggtttggacagaccca

SEQ ID NO: 6185513 - DNA, 19 bp, Homo sapiens
ctgtaggtatagaagatct

SEQ ID NO: 6185514 - DNA, 20 bp, Homo sapiens
ctgtaggtcaggaccatcag

SEQ ID NO: 6185515 - DNA, 18 bp, Homo sapiens
ctgtaggtgtctctgggc

SEQ ID NO: 6185516 - DNA, 20 bp, Homo sapiens
ctgtaggtgtctctgggcct

SEQ ID NO: 6185517 - DNA, 15 bp, Homo sapiens
ctgtaggtgttatgt

SEQ ID NO: 6185518 - DNA, 16 bp, Homo sapiens
ctgtaggtgttatgta

SEQ ID NO: 6185519 - DNA, 21 bp, Homo sapiens
ctgtaggtgttatgtattcct

SEQ ID NO: 6185520 - DNA, 16 bp, Homo sapiens
ctgtaggttgcacact

SEQ ID NO: 6185521 - DNA, 19 bp, Homo sapiens
ctgtaggttgcacactttg

SEQ ID NO: 6185522 - DNA, 22 bp, Homo sapiens
ctgtaggttgcttaaaagggac

SEQ ID NO: 6185523 - DNA, 22 bp, Homo sapiens
ctgtaggtttgtagtagccacc

SEQ ID NO: 6185524 - DNA, 20 bp, Homo sapiens
ctgtaggttttctgtgttta

SEQ ID NO: 6185525 - DNA, 20 bp, Homo sapiens
ctgtagtaaactatttatct

SEQ ID NO: 6185526 - DNA, 19 bp, Homo sapiens
ctgtagtaaataatgcttt

SEQ ID NO: 6185527 - DNA, 22 bp, Homo sapiens
ctgtagtaaataatgctttgaa

SEQ ID NO: 6185528 - DNA, 14 bp, Homo sapiens
ctgtagtaattgtt

SEQ ID NO: 6185529 - DNA, 19 bp, Homo sapiens
ctgtagtaatttattgtct

SEQ ID NO: 6185530 - DNA, 19 bp, Homo sapiens
ctgtagtagccctttctgt

SEQ ID NO: 6185531 - DNA, 21 bp, Homo sapiens
ctgtagtagccctttctgtgt

SEQ ID NO: 6185532 - DNA, 22 bp, Homo sapiens
ctgtagtcatcttaaatttcaa

SEQ ID NO: 6185533 - DNA, 16 bp, Homo sapiens
ctgtagtcatttacta

SEQ ID NO: 6185534 - DNA, 23 bp, Homo sapiens
ctgtagtcatttactaaacatat

SEQ ID NO: 6185535 - DNA, 23 bp, Homo sapiens
ctgtagtcccacttacttgggag

SEQ ID NO: 6185536 - DNA, 15 bp, Homo sapiens
ctgtagtcccagcta

SEQ ID NO: 6185537 - DNA, 18 bp, Homo sapiens
ctgtagtcccagctactc

SEQ ID NO: 6185538 - DNA, 20 bp, Homo sapiens
ctgtagtcctagccactcag

SEQ ID NO: 6185539 - DNA, 13 bp, Homo sapiens
ctgtagtcctttc

SEQ ID NO: 6185540 - DNA, 17 bp, Homo sapiens
ctgtagtcctttctgcc

SEQ ID NO: 6185541 - DNA, 15 bp, Homo sapiens
ctgtagtctcagcta

SEQ ID NO: 6185542 - DNA, 14 bp, Homo sapiens
ctgtagtctcagtt

SEQ ID NO: 6185543 - DNA, 18 bp, Homo sapiens
ctgtagtgaatcctctgt

SEQ ID NO: 6185544 - DNA, 17 bp, Homo sapiens
ctgtagtgagaaactga

SEQ ID NO: 6185545 - DNA, 22 bp, Homo sapiens
ctgtagtgagatagcattgtga

SEQ ID NO: 6185546 - DNA, 18 bp, Homo sapiens
ctgtagtgatggagttcc

SEQ ID NO: 6185547 - DNA, 13 bp, Homo sapiens
ctgtagtgcccct

SEQ ID NO: 6185548 - DNA, 24 bp, Homo sapiens
ctgtagtgcccctcccatggccca

SEQ ID NO: 6185549 - DNA, 22 bp, Homo sapiens
ctgtagtggcaaaaaagaacag

SEQ ID NO: 6185550 - DNA, 20 bp, Homo sapiens
ctgtagtgtagtcaggtgct

SEQ ID NO: 6185551 - DNA, 22 bp, Homo sapiens
ctgtagtgtagtcaggtgctca

SEQ ID NO: 6185552 - DNA, 13 bp, Homo sapiens
ctgtagtgttttg

SEQ ID NO: 6185553 - DNA, 20 bp, Homo sapiens
ctgtagttcctaatggattc

SEQ ID NO: 6185554 - DNA, 13 bp, Homo sapiens
ctgtagttctaag

SEQ ID NO: 6185555 - DNA, 20 bp, Homo sapiens
ctgtagttgacaattctgca

SEQ ID NO: 6185556 - DNA, 22 bp, Homo sapiens
ctgtagttgacaattctgcatg

SEQ ID NO: 6185557 - DNA, 17 bp, Homo sapiens
ctgtagtttagttctgt

SEQ ID NO: 6185558 - DNA, 13 bp, Homo sapiens
ctgtagtttatgg

SEQ ID NO: 6185559 - DNA, 22 bp, Homo sapiens
ctgtagttttattttatgttta

SEQ ID NO: 6185560 - DNA, 19 bp, Homo sapiens
ctgtagttttccctgcact

SEQ ID NO: 6185561 - DNA, 19 bp, Homo sapiens
ctgtataaaatcagccaat

SEQ ID NO: 6185562 - DNA, 21 bp, Homo sapiens
ctgtataaaatgcaaaataaa

SEQ ID NO: 6185563 - DNA, 14 bp, Homo sapiens
ctgtataaacagaa

SEQ ID NO: 6185564 - DNA, 20 bp, Homo sapiens
ctgtataaacattaaatgtc

SEQ ID NO: 6185565 - DNA, 14 bp, Homo sapiens
ctgtataaagcatg

SEQ ID NO: 6185566 - DNA, 15 bp, Homo sapiens
ctgtataaagcatgt

SEQ ID NO: 6185567 - DNA, 19 bp, Homo sapiens
ctgtataaaggtgtgctgt

SEQ ID NO: 6185568 - DNA, 14 bp, Homo sapiens
ctgtataaatagga

SEQ ID NO: 6185569 - DNA, 19 bp, Homo sapiens
ctgtataaataggagagga

SEQ ID NO: 6185570 - DNA, 21 bp, Homo sapiens
ctgtataaataggagaggatg

SEQ ID NO: 6185571 - DNA, 17 bp, Homo sapiens
ctgtataaatgtctatt

SEQ ID NO: 6185572 - DNA, 14 bp, Homo sapiens
ctgtataagcactg

SEQ ID NO: 6185573 - DNA, 19 bp, Homo sapiens
ctgtataagcactgaaaaa

SEQ ID NO: 6185574 - DNA, 20 bp, Homo sapiens
ctgtataaggtaataaaact

SEQ ID NO: 6185575 - DNA, 12 bp, Homo sapiens
ctgtataagtaa

SEQ ID NO: 6185576 - DNA, 17 bp, Homo sapiens
ctgtataagtaagaaaa

SEQ ID NO: 6185577 - DNA, 21 bp, Homo sapiens
ctgtataagtaagaaaatatt

SEQ ID NO: 6185578 - DNA, 14 bp, Homo sapiens
ctgtataagtagat

SEQ ID NO: 6185579 - DNA, 17 bp, Homo sapiens
ctgtataagtagatctg

SEQ ID NO: 6185580 - DNA, 20 bp, Homo sapiens
ctgtataagtagatctgctt

SEQ ID NO: 6185581 - DNA, 21 bp, Homo sapiens
ctgtataagtagatctgcttt

SEQ ID NO: 6185582 - DNA, 23 bp, Homo sapiens
ctgtataagtagatctgctttct

SEQ ID NO: 6185583 - DNA, 17 bp, Homo sapiens
ctgtataagttgaagga

SEQ ID NO: 6185584 - DNA, 19 bp, Homo sapiens
ctgtataagttgaaggaaa

SEQ ID NO: 6185585 - DNA, 13 bp, Homo sapiens
ctgtatacagtgc

SEQ ID NO: 6185586 - DNA, 22 bp, Homo sapiens
ctgtatacagtgcagagccttc

SEQ ID NO: 6185587 - DNA, 16 bp, Homo sapiens
ctgtatacgtttcaaa

SEQ ID NO: 6185588 - DNA, 15 bp, Homo sapiens
ctgtatactgaaggt

SEQ ID NO: 6185589 - DNA, 21 bp, Homo sapiens
ctgtatactgaaggtctgaca

SEQ ID NO: 6185590 - DNA, 13 bp, Homo sapiens
ctgtatactttag

SEQ ID NO: 6185591 - DNA, 16 bp, Homo sapiens
ctgtatactttagtat

SEQ ID NO: 6185592 - DNA, 17 bp, Homo sapiens
ctgtatagaaatctaaa

SEQ ID NO: 6185593 - DNA, 21 bp, Homo sapiens
ctgtatagacaggagaagaaa

SEQ ID NO: 6185594 - DNA, 16 bp, Homo sapiens
ctgtatagattagaga

SEQ ID NO: 6185595 - DNA, 20 bp, Homo sapiens
ctgtatagctgcttccagtg

SEQ ID NO: 6185596 - DNA, 20 bp, Homo sapiens
ctgtataggtagatccagat

SEQ ID NO: 6185597 - DNA, 21 bp, Homo sapiens
ctgtatagttaggatagcatt

SEQ ID NO: 6185598 - DNA, 15 bp, Homo sapiens
ctgtatataaaataa

SEQ ID NO: 6185599 - DNA, 14 bp, Homo sapiens
ctgtatataaacat

SEQ ID NO: 6185600 - DNA, 16 bp, Homo sapiens
ctgtatataaaggaaa

SEQ ID NO: 6185601 - DNA, 14 bp, Homo sapiens
ctgtatataaatgg

SEQ ID NO: 6185602 - DNA, 17 bp, Homo sapiens
ctgtatataagttgctg

SEQ ID NO: 6185603 - DNA, 18 bp, Homo sapiens
ctgtatataatactaaag

SEQ ID NO: 6185604 - DNA, 23 bp, Homo sapiens
ctgtatataatactaaagtgtct

SEQ ID NO: 6185605 - DNA, 15 bp, Homo sapiens
ctgtatatacatttc

SEQ ID NO: 6185606 - DNA, 13 bp, Homo sapiens
ctgtatatagatg

SEQ ID NO: 6185607 - DNA, 22 bp, Homo sapiens
ctgtatatagatgtctgtgtat

SEQ ID NO: 6185608 - DNA, 16 bp, Homo sapiens
ctgtatatagcccagc

SEQ ID NO: 6185609 - DNA, 14 bp, Homo sapiens
ctgtatatagtata

SEQ ID NO: 6185610 - DNA, 16 bp, Homo sapiens
ctgtatatatatatgt

SEQ ID NO: 6185611 - DNA, 18 bp, Homo sapiens
ctgtatatatatatgtgt

SEQ ID NO: 6185612 - DNA, 13 bp, Homo sapiens
ctgtatatatttt

SEQ ID NO: 6185613 - DNA, 20 bp, Homo sapiens
ctgtatatgattctctgtgg

SEQ ID NO: 6185614 - DNA, 22 bp, Homo sapiens
ctgtatatgattctctgtggtt

SEQ ID NO: 6185615 - DNA, 14 bp, Homo sapiens
ctgtatatgtattc

SEQ ID NO: 6185616 - DNA, 21 bp, Homo sapiens
ctgtatatgtattcccttgta

SEQ ID NO: 6185617 - DNA, 23 bp, Homo sapiens
ctgtatatgtattcccttgtatt

SEQ ID NO: 6185618 - DNA, 14 bp, Homo sapiens
ctgtatatgttgta

SEQ ID NO: 6185619 - DNA, 22 bp, Homo sapiens
ctgtatattacagatatttgtc

SEQ ID NO: 6185620 - DNA, 22 bp, Homo sapiens
ctgtatattatggtgtaatgca

SEQ ID NO: 6185621 - DNA, 19 bp, Homo sapiens
ctttttatctgatctgtga

SEQ ID NO: 6185622 - DNA, 20 bp, Homo sapiens
ctttttatcttgagtgttat

SEQ ID NO: 6185623 - DNA, 16 bp, Homo sapiens
ctttttattaaaatat

SEQ ID NO: 6185624 - DNA, 18 bp, Homo sapiens
ctttttattattttaagt

SEQ ID NO: 6185625 - DNA, 16 bp, Homo sapiens
ctttttattcctttta

SEQ ID NO: 6185626 - DNA, 19 bp, Homo sapiens
ctttttattccttttaaaa

SEQ ID NO: 6185627 - DNA, 13 bp, Homo sapiens
ctttttattgaat

SEQ ID NO: 6185628 - DNA, 15 bp, Homo sapiens
ctttttattgaatct

SEQ ID NO: 6185629 - DNA, 19 bp, Homo sapiens
ctttttattgatgtgcaaa

SEQ ID NO: 6185630 - DNA, 13 bp, Homo sapiens
ctttttattgcct

SEQ ID NO: 6185631 - DNA, 15 bp, Homo sapiens
ctttttattgccttc

SEQ ID NO: 6185632 - DNA, 16 bp, Homo sapiens
ctttttatttaaatgt

SEQ ID NO: 6185633 - DNA, 18 bp, Homo sapiens
ctttttatttaaatgtga

SEQ ID NO: 6185634 - DNA, 21 bp, Homo sapiens
ctttttatttaaatgtgaatt

SEQ ID NO: 6185635 - DNA, 20 bp, Homo sapiens
ctttttatttatatgtactg

SEQ ID NO: 6185636 - DNA, 23 bp, Homo sapiens
ctttttattttaaccagttattt

SEQ ID NO: 6185637 - DNA, 21 bp, Homo sapiens
ctttttattttttaattattg

SEQ ID NO: 6185638 - DNA, 21 bp, Homo sapiens
ctttttcaatggttgggacaa

SEQ ID NO: 6185639 - DNA, 18 bp, Homo sapiens
ctttttcaccctattttc

SEQ ID NO: 6185640 - DNA, 14 bp, Homo sapiens
ctttttcacgttta

SEQ ID NO: 6185641 - DNA, 15 bp, Homo sapiens
ctttttcataaactg

SEQ ID NO: 6185642 - DNA, 16 bp, Homo sapiens
ctttttcataattact

SEQ ID NO: 6185643 - DNA, 14 bp, Homo sapiens
ctttttcatagtaa

SEQ ID NO: 6185644 - DNA, 20 bp, Homo sapiens
ctttttcatccttctttcct

SEQ ID NO: 6185645 - DNA, 21 bp, Homo sapiens
ctttttcattattttattatg

SEQ ID NO: 6185646 - DNA, 15 bp, Homo sapiens
ctttttcattccctg

SEQ ID NO: 6185647 - DNA, 12 bp, Homo sapiens
ctttttcattta

SEQ ID NO: 6185648 - DNA, 15 bp, Homo sapiens
ctttttcattttgca

SEQ ID NO: 6185649 - DNA, 15 bp, Homo sapiens
ctttttccaaacaat

SEQ ID NO: 6185650 - DNA, 22 bp, Homo sapiens
ctttttccaactcagaaattca

SEQ ID NO: 6185651 - DNA, 12 bp, Homo sapiens
ctttttccacaa

SEQ ID NO: 6185652 - DNA, 23 bp, Homo sapiens
ctttttccagtgttctatttgct

SEQ ID NO: 6185653 - DNA, 15 bp, Homo sapiens
ctttttccatcattt

SEQ ID NO: 6185654 - DNA, 17 bp, Homo sapiens
ctttttccatcatttta

SEQ ID NO: 6185655 - DNA, 22 bp, Homo sapiens
ctttttcccatctggctttttc

SEQ ID NO: 6185656 - DNA, 16 bp, Homo sapiens
ctttttcccctgcaat

SEQ ID NO: 6185657 - DNA, 13 bp, Homo sapiens
ctttttcccttcc

SEQ ID NO: 6185658 - DNA, 18 bp, Homo sapiens
ctttttcccttccctcct

SEQ ID NO: 6185659 - DNA, 21 bp, Homo sapiens
ctttttccgtgccgtgtattt

SEQ ID NO: 6185660 - DNA, 13 bp, Homo sapiens
ctttttcctactc

SEQ ID NO: 6185661 - DNA, 22 bp, Homo sapiens
ctttttcctactccgttcctgg

SEQ ID NO: 6185662 - DNA, 23 bp, Homo sapiens
ctttttcctagcctgtttcttcc

SEQ ID NO: 6185663 - DNA, 12 bp, Homo sapiens
ctttttcctctc

SEQ ID NO: 6185664 - DNA, 20 bp, Homo sapiens
ctttttcctgcgtcccagcc

SEQ ID NO: 6185665 - DNA, 21 bp, Homo sapiens
ctttttcctgcgtcccagcct

SEQ ID NO: 6185666 - DNA, 16 bp, Homo sapiens
ctttttccttcctgag

SEQ ID NO: 6185667 - DNA, 18 bp, Homo sapiens
ctttttccttcctgccct

SEQ ID NO: 6185668 - DNA, 22 bp, Homo sapiens
ctttttccttcctgccctgtac

SEQ ID NO: 6185669 - DNA, 17 bp, Homo sapiens
ctttttccttgtcccca

SEQ ID NO: 6185670 - DNA, 16 bp, Homo sapiens
ctttttcctttataat

SEQ ID NO: 6185671 - DNA, 18 bp, Homo sapiens
ctttttcgccaaactgtc

SEQ ID NO: 6185672 - DNA, 19 bp, Homo sapiens
ctttttcgtataatcttgt

SEQ ID NO: 6185673 - DNA, 20 bp, Homo sapiens
ctttttctaaagtgttggtc

SEQ ID NO: 6185674 - DNA, 14 bp, Homo sapiens
ctttttctacatgt

SEQ ID NO: 6185675 - DNA, 19 bp, Homo sapiens
ctttttctcgagtccaaaa

SEQ ID NO: 6185676 - DNA, 21 bp, Homo sapiens
ctttttctcgagtccaaaatc

SEQ ID NO: 6185677 - DNA, 11 bp, Homo sapiens
ctttttctctc

SEQ ID NO: 6185678 - DNA, 13 bp, Homo sapiens
ctttttctcttct

SEQ ID NO: 6185679 - DNA, 19 bp, Homo sapiens
ctttttctgaactccattt

SEQ ID NO: 6185680 - DNA, 23 bp, Homo sapiens
ctttttctgaagcctctaacaaa

SEQ ID NO: 6185681 - DNA, 22 bp, Homo sapiens
ctttttctgattagctttgtgt

SEQ ID NO: 6185682 - DNA, 14 bp, Homo sapiens
ctttttctgcacta

SEQ ID NO: 6185683 - DNA, 13 bp, Homo sapiens
ctttttctggaaa

SEQ ID NO: 6185684 - DNA, 22 bp, Homo sapiens
ctttttctggactgaagcctgc

SEQ ID NO: 6185685 - DNA, 14 bp, Homo sapiens
ctttttctgtctct

SEQ ID NO: 6185686 - DNA, 16 bp, Homo sapiens
ctttttctgttgtaac

SEQ ID NO: 6185687 - DNA, 17 bp, Homo sapiens
ctttttctgttgtaact

SEQ ID NO: 6185688 - DNA, 18 bp, Homo sapiens
ctttttctgttgtaactt

SEQ ID NO: 6185689 - DNA, 14 bp, Homo sapiens
ctttttcttaagaa

SEQ ID NO: 6185690 - DNA, 13 bp, Homo sapiens
ctttttcttcact

SEQ ID NO: 6185691 - DNA, 13 bp, Homo sapiens
ctttttcttgggt

SEQ ID NO: 6185692 - DNA, 12 bp, Homo sapiens
ctttttctttat

SEQ ID NO: 6185693 - DNA, 13 bp, Homo sapiens
ctttttctttctt

SEQ ID NO: 6185694 - DNA, 16 bp, Homo sapiens
ctttttcttttgcttt

SEQ ID NO: 6185695 - DNA, 17 bp, Homo sapiens
ctttttcttttgtaagt

SEQ ID NO: 6185696 - DNA, 14 bp, Homo sapiens
ctttttctttttaa

SEQ ID NO: 6185697 - DNA, 16 bp, Homo sapiens
ctttttcttttttgag

SEQ ID NO: 6185698 - DNA, 16 bp, Homo sapiens
ctttttgaaagtaatt

SEQ ID NO: 6185699 - DNA, 17 bp, Homo sapiens
ctttttgaaatcacctg

SEQ ID NO: 6185700 - DNA, 22 bp, Homo sapiens
ctttttgaaatcacctggtatt

SEQ ID NO: 6185701 - DNA, 18 bp, Homo sapiens
ctttttgaaatcagcata

SEQ ID NO: 6185702 - DNA, 15 bp, Homo sapiens
ctttttgaaatgaaa

SEQ ID NO: 6185703 - DNA, 18 bp, Homo sapiens
ctttttgaaatgaaattt

SEQ ID NO: 6185704 - DNA, 22 bp, Homo sapiens
ctttttgaaatgaaatttaaac

SEQ ID NO: 6185705 - DNA, 16 bp, Homo sapiens
ctttttgaagtattta

SEQ ID NO: 6185706 - DNA, 15 bp, Homo sapiens
ctttttgaatcttta

SEQ ID NO: 6185707 - DNA, 24 bp, Homo sapiens
ctttttgaattaatctagaaaatg

SEQ ID NO: 6185708 - DNA, 17 bp, Homo sapiens
ctttttgaccagtttct

SEQ ID NO: 6185709 - DNA, 15 bp, Homo sapiens
ctttttgaggcaaaa

SEQ ID NO: 6185710 - DNA, 18 bp, Homo sapiens
ctttttgaggtggcactt

SEQ ID NO: 6185711 - DNA, 11 bp, Homo sapiens
ctttttgagta

SEQ ID NO: 6185712 - DNA, 20 bp, Homo sapiens
ctttttgagtaattttctga

SEQ ID NO: 6185713 - DNA, 21 bp, Homo sapiens
ctttttgagtaattttctgat

SEQ ID NO: 6185714 - DNA, 16 bp, Homo sapiens
ctttttgatgtataaa

SEQ ID NO: 6185715 - DNA, 20 bp, Homo sapiens
ctttttgatgtataaaactt

SEQ ID NO: 6185716 - DNA, 12 bp, Homo sapiens
ctttttgcagct

SEQ ID NO: 6185717 - DNA, 21 bp, Homo sapiens
ctttttgcaggggactgggcc

SEQ ID NO: 6185718 - DNA, 22 bp, Homo sapiens
ctttttgcaggggactgggcca

SEQ ID NO: 6185719 - DNA, 23 bp, Homo sapiens
ctttttgccagttttccctggaa

SEQ ID NO: 6185720 - DNA, 14 bp, Homo sapiens
ctttttgctctaaa

SEQ ID NO: 6185721 - DNA, 15 bp, Homo sapiens
ctttttgctctaaaa

SEQ ID NO: 6185722 - DNA, 13 bp, Homo sapiens
ctttttgctgtgt

SEQ ID NO: 6185723 - DNA, 15 bp, Homo sapiens
ctttttgcttctact

SEQ ID NO: 6185724 - DNA, 18 bp, Homo sapiens
ctttttgcttctactttc

SEQ ID NO: 6185725 - DNA, 18 bp, Homo sapiens
ctttttggaatctttgta

SEQ ID NO: 6185726 - DNA, 17 bp, Homo sapiens
ctttttggaattgtctt

SEQ ID NO: 6185727 - DNA, 23 bp, Homo sapiens
ctttttggactagccagaattct

SEQ ID NO: 6185728 - DNA, 22 bp, Homo sapiens
ctttttggctgacttcatctgg

SEQ ID NO: 6185729 - DNA, 19 bp, Homo sapiens
ctttttggtatggtaaaga

SEQ ID NO: 6185730 - DNA, 16 bp, Homo sapiens
ctttttggtggatgta

SEQ ID NO: 6185731 - DNA, 20 bp, Homo sapiens
ctttttggtttgccttttat

SEQ ID NO: 6185732 - DNA, 16 bp, Homo sapiens
ctttttgtaaatactg

SEQ ID NO: 6185733 - DNA, 18 bp, Homo sapiens
ctttttgtaaatactgct

SEQ ID NO: 6185734 - DNA, 22 bp, Homo sapiens
ctttttgtaaatgctgtaaata

SEQ ID NO: 6185735 - DNA, 11 bp, Homo sapiens
ctttttgtaac

SEQ ID NO: 6185736 - DNA, 15 bp, Homo sapiens
ctttttgtaatactt

SEQ ID NO: 6185737 - DNA, 18 bp, Homo sapiens
ctttttgtacttggaagt

SEQ ID NO: 6185738 - DNA, 13 bp, Homo sapiens
ctttttgtacttt

SEQ ID NO: 6185739 - DNA, 18 bp, Homo sapiens
ctttttgtataaaataga

SEQ ID NO: 6185740 - DNA, 12 bp, Homo sapiens
ctttttgtcaaa

SEQ ID NO: 6185741 - DNA, 13 bp, Homo sapiens
ctttttgtcatgt

SEQ ID NO: 6185742 - DNA, 15 bp, Homo sapiens
ctttttgtcatgtta

SEQ ID NO: 6185743 - DNA, 12 bp, Homo sapiens
ctttttgtgaat

SEQ ID NO: 6185744 - DNA, 15 bp, Homo sapiens
ctttttgtgagaaag

SEQ ID NO: 6185745 - DNA, 21 bp, Homo sapiens
ctttttgttatgcaaatgaga

SEQ ID NO: 6185746 - DNA, 11 bp, Homo sapiens
ctttttgttca

SEQ ID NO: 6185747 - DNA, 20 bp, Homo sapiens
ctttttgttccagagctgct

SEQ ID NO: 6185748 - DNA, 18 bp, Homo sapiens
ctttttgttgatgaggac

SEQ ID NO: 6185749 - DNA, 13 bp, Homo sapiens
ctttttgtttcac

SEQ ID NO: 6185750 - DNA, 17 bp, Homo sapiens
ctttttgtttcactgga

SEQ ID NO: 6185751 - DNA, 17 bp, Homo sapiens
ctttttgtttgcatcat

SEQ ID NO: 6185752 - DNA, 20 bp, Homo sapiens
ctttttgtttgcatcattta

SEQ ID NO: 6185753 - DNA, 21 bp, Homo sapiens
cttttttaaaataaaataagt

SEQ ID NO: 6185754 - DNA, 18 bp, Homo sapiens
cttttttaaagtaaactt

SEQ ID NO: 6185755 - DNA, 18 bp, Homo sapiens
cttttttaaataaacttt

SEQ ID NO: 6185756 - DNA, 19 bp, Homo sapiens
cttttttaaataaactttt

SEQ ID NO: 6185757 - DNA, 18 bp, Homo sapiens
cttttttaaatattttct

SEQ ID NO: 6185758 - DNA, 14 bp, Homo sapiens
cttttttaaattaa

SEQ ID NO: 6185759 - DNA, 23 bp, Homo sapiens
cttttttaaattaagacaaaaag

SEQ ID NO: 6185760 - DNA, 21 bp, Homo sapiens
cttttttaaattttcttcagt

SEQ ID NO: 6185761 - DNA, 10 bp, Homo sapiens
cttttttaac

SEQ ID NO: 6185762 - DNA, 22 bp, Homo sapiens
cttttttaattgaaagggacaa

SEQ ID NO: 6185763 - DNA, 20 bp, Homo sapiens
cttttttactcattgaaatg

SEQ ID NO: 6185764 - DNA, 15 bp, Homo sapiens
cttttttagaaaact

SEQ ID NO: 6185765 - DNA, 20 bp, Homo sapiens
cttttttaggctacagtgtc

SEQ ID NO: 6185766 - DNA, 20 bp, Homo sapiens
cttttttataaattataatg

SEQ ID NO: 6185767 - DNA, 15 bp, Homo sapiens
cttttttatagctta

SEQ ID NO: 6185768 - DNA, 18 bp, Homo sapiens
cttttttatagcttaact

SEQ ID NO: 6185769 - DNA, 15 bp, Homo sapiens
cttttttatatctct

SEQ ID NO: 6185770 - DNA, 19 bp, Homo sapiens
cttttttatcatgtgaaat

SEQ ID NO: 6185771 - DNA, 16 bp, Homo sapiens
cttttttatcatttct

SEQ ID NO: 6185772 - DNA, 12 bp, Homo sapiens
cttttttatctg

SEQ ID NO: 6185773 - DNA, 17 bp, Homo sapiens
cttttttatggcagagg

SEQ ID NO: 6185774 - DNA, 18 bp, Homo sapiens
cttttttatgtgccgtgt

SEQ ID NO: 6185775 - DNA, 13 bp, Homo sapiens
cttttttatgtta

SEQ ID NO: 6185776 - DNA, 19 bp, Homo sapiens
cttttttatgttggttgat

SEQ ID NO: 6185777 - DNA, 17 bp, Homo sapiens
cttttttattaatcact

SEQ ID NO: 6185778 - DNA, 17 bp, Homo sapiens
cttttttattgaataac

SEQ ID NO: 6185779 - DNA, 12 bp, Homo sapiens
cttttttcaaaa

SEQ ID NO: 6185780 - DNA, 13 bp, Homo sapiens
cttttttcaaaat

SEQ ID NO: 6185781 - DNA, 18 bp, Homo sapiens
cttttttcaaatattgaa

SEQ ID NO: 6185782 - DNA, 17 bp, Homo sapiens
cttttttcaatatgcaa

SEQ ID NO: 6185783 - DNA, 15 bp, Homo sapiens
cttttttcacaaatt

SEQ ID NO: 6185784 - DNA, 18 bp, Homo sapiens
cttttttcaggatgctat

SEQ ID NO: 6185785 - DNA, 14 bp, Homo sapiens
cttttttcatttct

SEQ ID NO: 6185786 - DNA, 23 bp, Homo sapiens
cttttttcctcctttctctgtat

SEQ ID NO: 6185787 - DNA, 16 bp, Homo sapiens
cttttttcctgtcaat

SEQ ID NO: 6185788 - DNA, 19 bp, Homo sapiens
cttttttcctttccacctt

SEQ ID NO: 6185789 - DNA, 16 bp, Homo sapiens
cttttttcctttcttc

SEQ ID NO: 6185790 - DNA, 19 bp, Homo sapiens
cttttttcggctaaaaaga

SEQ ID NO: 6185791 - DNA, 14 bp, Homo sapiens
cttttttctaaagt

SEQ ID NO: 6185792 - DNA, 19 bp, Homo sapiens
cttttttctcagtcctaat

SEQ ID NO: 6185793 - DNA, 11 bp, Homo sapiens
cttttttctct

SEQ ID NO: 6185794 - DNA, 22 bp, Homo sapiens
cttttttctctgatacagaaaa

SEQ ID NO: 6185795 - DNA, 13 bp, Homo sapiens
cttttttctgcct

SEQ ID NO: 6185796 - DNA, 15 bp, Homo sapiens
cttttttctgcctcc

SEQ ID NO: 6185797 - DNA, 14 bp, Homo sapiens
cttttttctgggtc

SEQ ID NO: 6185798 - DNA, 20 bp, Homo sapiens
cttttttcttaaagcaaagt

SEQ ID NO: 6185799 - DNA, 14 bp, Homo sapiens
cttttttcttgcta

SEQ ID NO: 6185800 - DNA, 18 bp, Homo sapiens
cttttttctttctttact

SEQ ID NO: 6185801 - DNA, 20 bp, Homo sapiens
cttttttgagacatgggatc

SEQ ID NO: 6185802 - DNA, 17 bp, Homo sapiens
cttttttgataaagttt

SEQ ID NO: 6185803 - DNA, 11 bp, Homo sapiens
cttttttgatt

SEQ ID NO: 6185804 - DNA, 14 bp, Homo sapiens
cttttttgcaataa

SEQ ID NO: 6185805 - DNA, 17 bp, Homo sapiens
cttttttgcaataagga

SEQ ID NO: 6185806 - DNA, 18 bp, Homo sapiens
cttttttgccacaaagaa

SEQ ID NO: 6185807 - DNA, 15 bp, Homo sapiens
cttttttggctgctg

SEQ ID NO: 6185808 - DNA, 16 bp, Homo sapiens
cttttttggctgctga

SEQ ID NO: 6185809 - DNA, 23 bp, Homo sapiens
cttttttggctgctgaaggctcg

SEQ ID NO: 6185810 - DNA, 23 bp, Homo sapiens
cttttttggctttagacactggc

SEQ ID NO: 6185811 - DNA, 20 bp, Homo sapiens
cttttttggggagtacctgt

SEQ ID NO: 6185812 - DNA, 13 bp, Homo sapiens
cttttttgtacag

SEQ ID NO: 6185813 - DNA, 11 bp, Homo sapiens
cttttttgtcc

SEQ ID NO: 6185814 - DNA, 12 bp, Homo sapiens
cttttttgtcta

SEQ ID NO: 6185815 - DNA, 21 bp, Homo sapiens
cttttttgtcttattgaaaaa

SEQ ID NO: 6185816 - DNA, 24 bp, Homo sapiens
cttttttgtgtatgtacttagctg

SEQ ID NO: 6185817 - DNA, 16 bp, Homo sapiens
cttttttgttgttttg

SEQ ID NO: 6185818 - DNA, 15 bp, Homo sapiens
cttttttgtttgaat

SEQ ID NO: 6185819 - DNA, 18 bp, Homo sapiens
cttttttgtttgaatgtt

SEQ ID NO: 6185820 - DNA, 17 bp, Homo sapiens
cttttttgtttgtttct

SEQ ID NO: 6185821 - DNA, 18 bp, Homo sapiens
cttttttgtttgtttctt

SEQ ID NO: 6185822 - DNA, 21 bp, Homo sapiens
ctttttttaaaaagttgatag

SEQ ID NO: 6185823 - DNA, 13 bp, Homo sapiens
ctttttttaaatt

SEQ ID NO: 6185824 - DNA, 19 bp, Homo sapiens
ctttttttaataatttcat

SEQ ID NO: 6185825 - DNA, 16 bp, Homo sapiens
ctttttttacatttca

SEQ ID NO: 6185826 - DNA, 16 bp, Homo sapiens
ctttttttagagaagt

SEQ ID NO: 6185827 - DNA, 22 bp, Homo sapiens
ctttttttataagcaaaaacgt

SEQ ID NO: 6185828 - DNA, 16 bp, Homo sapiens
ctttttttatgactgt

SEQ ID NO: 6185829 - DNA, 18 bp, Homo sapiens
ctttttttattaaacaga

SEQ ID NO: 6185830 - DNA, 13 bp, Homo sapiens
ctttttttcaatg

SEQ ID NO: 6185831 - DNA, 15 bp, Homo sapiens
ctttttttcaatgtg

SEQ ID NO: 6185832 - DNA, 13 bp, Homo sapiens
ctttttttcagtt

SEQ ID NO: 6185833 - DNA, 13 bp, Homo sapiens
ctttttttccttt

SEQ ID NO: 6185834 - DNA, 16 bp, Homo sapiens
ctttttttccttttta

SEQ ID NO: 6185835 - DNA, 15 bp, Homo sapiens
ctttttttctactgt

SEQ ID NO: 6185836 - DNA, 15 bp, Homo sapiens
ctttttttcttaaaa

SEQ ID NO: 6185837 - DNA, 14 bp, Homo sapiens
ctttttttgcttta

SEQ ID NO: 6185838 - DNA, 21 bp, Homo sapiens
ctttttttggaagttatttat

SEQ ID NO: 6185839 - DNA, 16 bp, Homo sapiens
ctttttttggcccagg

SEQ ID NO: 6185840 - DNA, 19 bp, Homo sapiens
ctttttttggtaaattttt

SEQ ID NO: 6185841 - DNA, 21 bp, Homo sapiens
ctttttttggtaaatttttga

SEQ ID NO: 6185842 - DNA, 23 bp, Homo sapiens
ctttttttggtataatgtttaaa

SEQ ID NO: 6185843 - DNA, 13 bp, Homo sapiens
ctttttttgtaga

SEQ ID NO: 6185844 - DNA, 21 bp, Homo sapiens
ctttttttgtatagttaacac

SEQ ID NO: 6185845 - DNA, 20 bp, Homo sapiens
ctttttttgtgactagaaat

SEQ ID NO: 6185846 - DNA, 22 bp, Homo sapiens
ctttttttgtgtgtatttgcta

SEQ ID NO: 6185847 - DNA, 12 bp, Homo sapiens
ctttttttgtta

SEQ ID NO: 6185848 - DNA, 14 bp, Homo sapiens
cttttttttaagtt

SEQ ID NO: 6185849 - DNA, 17 bp, Homo sapiens
cttttttttaatgtgct

SEQ ID NO: 6185850 - DNA, 13 bp, Homo sapiens
cttttttttcctt

SEQ ID NO: 6185851 - DNA, 14 bp, Homo sapiens
cttttttttccttt

SEQ ID NO: 6185852 - DNA, 15 bp, Homo sapiens
cttttttttcctttg

SEQ ID NO: 6185853 - DNA, 14 bp, Homo sapiens
cttttttttcttgg

SEQ ID NO: 6185854 - DNA, 15 bp, Homo sapiens
cttttttttctttaa

SEQ ID NO: 6185855 - DNA, 22 bp, Homo sapiens
cttttttttgacagcttcctgt

SEQ ID NO: 6185856 - DNA, 23 bp, Homo sapiens
cttttttttgacagcttcctgtc

SEQ ID NO: 6185857 - DNA, 15 bp, Homo sapiens
cttttttttgttttg

SEQ ID NO: 6185858 - DNA, 21 bp, Homo sapiens
ctttttttttaagttcttatg

SEQ ID NO: 6185859 - DNA, 23 bp, Homo sapiens
ctttttttttcacctgaaacact

SEQ ID NO: 6185860 - DNA, 13 bp, Homo sapiens
ctttttttttcct

SEQ ID NO: 6185861 - DNA, 21 bp, Homo sapiens
cttttttttttaagtgaaatt

SEQ ID NO: 6185862 - DNA, 17 bp, Homo sapiens
cttttttttttctgttg

SEQ ID NO: 6185863 - DNA, 16 bp, Homo sapiens
cttttttttttcttta

SEQ ID NO: 6185864 - DNA, 23 bp, Homo sapiens
cttttttttttctttataagaaa

SEQ ID NO: 6185865 - DNA, 17 bp, Homo sapiens
ctttttttttttctgcc

SEQ ID NO: 6185866 - DNA, 20 bp, Homo sapiens
ctttttttttttctgcctga

SEQ ID NO: 6185867 - DNA, 21 bp, Homo sapiens
ctttttttttttctgcctgag

SEQ ID NO: 6185868 - DNA, 18 bp, Homo sapiens
ctttttttttttgtttga

SEQ ID NO: 6185869 - DNA, 21 bp, Homo sapiens
cttttttttttttgagacaga

SEQ ID NO: 6185870 - DNA, 21 bp, Homo sapiens
cttttttttttttgctttgtt

SEQ ID NO: 6185871 - DNA, 22 bp, Homo sapiens
ctttttttttttttaaagacag

SEQ ID NO: 6185872 - DNA, 21 bp, Homo sapiens
ctttttttttttttaataaat

SEQ ID NO: 6185873 - DNA, 18 bp, Homo sapiens
cttttttttttttttaca

SEQ ID NO: 6185874 - DNA, 20 bp, Homo sapiens
cttttttttttttttacagt

SEQ ID NO: 6185875 - DNA, 23 bp, Homo sapiens
cttttttttttttttcagttttt

SEQ ID NO: 6185876 - DNA, 21 bp, Homo sapiens
ctttttttttttttttgacaa

SEQ ID NO: 6185877 - DNA, 22 bp, Homo sapiens
ctttttttttttttttgtgtag

SEQ ID NO: 6185878 - DNA, 22 bp, Homo sapiens
ctttttttttttttttttttga

SEQ ID NO: 6185879 - DNA, 17 bp, Homo sapiens
gaaaaaaaaaaaagaaa

SEQ ID NO: 6185880 - DNA, 18 bp, Homo sapiens
gaaaaaaaaaaaagaaaa

SEQ ID NO: 6185881 - DNA, 15 bp, Homo sapiens
gaaaaaaaaaaaagc

SEQ ID NO: 6185882 - DNA, 19 bp, Homo sapiens
gaaaaaaaaaaagaagaag

SEQ ID NO: 6185883 - DNA, 15 bp, Homo sapiens
gaaaaaaaaaacaaa

SEQ ID NO: 6185884 - DNA, 17 bp, Homo sapiens
gaaaaaaaaaacaaaaa

SEQ ID NO: 6185885 - DNA, 22 bp, Homo sapiens
gaaaaaaaaaagaaaaaggaaa

SEQ ID NO: 6185886 - DNA, 21 bp, Homo sapiens
gaaaaaaaaaatgattgtcta

SEQ ID NO: 6185887 - DNA, 16 bp, Homo sapiens
gaaaaaaaaaatgttg

SEQ ID NO: 6185888 - DNA, 20 bp, Homo sapiens
gaaaaaaaaaatgttgagaa

SEQ ID NO: 6185889 - DNA, 20 bp, Homo sapiens
gaaaaaaaaacacacaaaaa

SEQ ID NO: 6185890 - DNA, 18 bp, Homo sapiens
gaaaaaaaaagaaaaaag

SEQ ID NO: 6185891 - DNA, 19 bp, Homo sapiens
gaaaaaaaaagaataatga

SEQ ID NO: 6185892 - DNA, 13 bp, Homo sapiens
gaaaaaaaaagca

SEQ ID NO: 6185893 - DNA, 15 bp, Homo sapiens
gaaaaaaaaagcaaa

SEQ ID NO: 6185894 - DNA, 22 bp, Homo sapiens
gaaaaaaaaagcaaatcagaaa

SEQ ID NO: 6185895 - DNA, 16 bp, Homo sapiens
gaaaaaaaaagggggg

SEQ ID NO: 6185896 - DNA, 17 bp, Homo sapiens
gaaaaaaaaatatgtgt

SEQ ID NO: 6185897 - DNA, 13 bp, Homo sapiens
gaaaaaaaaatca

SEQ ID NO: 6185898 - DNA, 13 bp, Homo sapiens
gaaaaaaaaatgc

SEQ ID NO: 6185899 - DNA, 15 bp, Homo sapiens
gaaaaaaaaatgcca

SEQ ID NO: 6185900 - DNA, 20 bp, Homo sapiens
gaaaaaaaaatgccataata

SEQ ID NO: 6185901 - DNA, 18 bp, Homo sapiens
gaaaaaaaaatgttcatt

SEQ ID NO: 6185902 - DNA, 16 bp, Homo sapiens
gaaaaaaaacacaaaa

SEQ ID NO: 6185903 - DNA, 14 bp, Homo sapiens
gaaaaaaaacacac

SEQ ID NO: 6185904 - DNA, 16 bp, Homo sapiens
gaaaaaaaacagtgga

SEQ ID NO: 6185905 - DNA, 21 bp, Homo sapiens
gaaaaaaaacctgagatttat

SEQ ID NO: 6185906 - DNA, 15 bp, Homo sapiens
gaaaaaaaaccttgt

SEQ ID NO: 6185907 - DNA, 19 bp, Homo sapiens
gaaaaaaaaccttgtaaaa

SEQ ID NO: 6185908 - DNA, 22 bp, Homo sapiens
gaaaaaaaactgaagatgaaat

SEQ ID NO: 6185909 - DNA, 14 bp, Homo sapiens
gaaaaaaaagaaaa

SEQ ID NO: 6185910 - DNA, 15 bp, Homo sapiens
gaaaaaaaagaaaaa

SEQ ID NO: 6185911 - DNA, 21 bp, Homo sapiens
gaaaaaaaagaaaaaagtcct

SEQ ID NO: 6185912 - DNA, 17 bp, Homo sapiens
gaaaaaaaagtgtctca

SEQ ID NO: 6185913 - DNA, 15 bp, Homo sapiens
gaaaaaaaagttttt

SEQ ID NO: 6185914 - DNA, 16 bp, Homo sapiens
gaaaaaaaagttttta

SEQ ID NO: 6185915 - DNA, 19 bp, Homo sapiens
gaaaaaaaagtttttaatt

SEQ ID NO: 6185916 - DNA, 17 bp, Homo sapiens
gaaaaaaaatagatgtt

SEQ ID NO: 6185917 - DNA, 15 bp, Homo sapiens
gaaaaaaaatatata

SEQ ID NO: 6185918 - DNA, 14 bp, Homo sapiens
gaaaaaaaccaaag

SEQ ID NO: 6185919 - DNA, 16 bp, Homo sapiens
gaaaaaaaccacacaa

SEQ ID NO: 6185920 - DNA, 14 bp, Homo sapiens
gaaaaaaactgaag

SEQ ID NO: 6185921 - DNA, 19 bp, Homo sapiens
gaaaaaaactgggataact

SEQ ID NO: 6185922 - DNA, 19 bp, Homo sapiens
gaaaaaaacttggcacttt

SEQ ID NO: 6185923 - DNA, 10 bp, Homo sapiens
gaaaaaaaga

SEQ ID NO: 6185924 - DNA, 13 bp, Homo sapiens
gaaaaaaagaaaa

SEQ ID NO: 6185925 - DNA, 20 bp, Homo sapiens
gaaaaaaagtagtttgaatg

SEQ ID NO: 6185926 - DNA, 18 bp, Homo sapiens
gaaaaaaagtttgccaga

SEQ ID NO: 6185927 - DNA, 21 bp, Homo sapiens
gaaaaaaataaatttactgaa

SEQ ID NO: 6185928 - DNA, 17 bp, Homo sapiens
gaaaaaaataactattt

SEQ ID NO: 6185929 - DNA, 22 bp, Homo sapiens
gaaaaaaataattttaaaaatg

SEQ ID NO: 6185930 - DNA, 19 bp, Homo sapiens
gaaaaaaataattttatga

SEQ ID NO: 6185931 - DNA, 15 bp, Homo sapiens
gaaaaaaatcatcta

SEQ ID NO: 6185932 - DNA, 19 bp, Homo sapiens
gaaaaaaatcgtccaggga

SEQ ID NO: 6185933 - DNA, 15 bp, Homo sapiens
gaaaaaaatgaaaca

SEQ ID NO: 6185934 - DNA, 16 bp, Homo sapiens
gaaaaaaatggcatca

SEQ ID NO: 6185935 - DNA, 15 bp, Homo sapiens
gaaaaaaatgtattt

SEQ ID NO: 6185936 - DNA, 13 bp, Homo sapiens
gaaaaaaattgaa

SEQ ID NO: 6185937 - DNA, 15 bp, Homo sapiens
gaaaaaaattgaaat

SEQ ID NO: 6185938 - DNA, 11 bp, Homo sapiens
gaaaaaacaat

SEQ ID NO: 6185939 - DNA, 20 bp, Homo sapiens
gaaaaaaccgttcaaattct

SEQ ID NO: 6185940 - DNA, 21 bp, Homo sapiens
gaaaaaactttctctttgcca

SEQ ID NO: 6185941 - DNA, 20 bp, Homo sapiens
gaaaaaactttgctccaggc

SEQ ID NO: 6185942 - DNA, 11 bp, Homo sapiens
gaaaaaagaaa

SEQ ID NO: 6185943 - DNA, 19 bp, Homo sapiens
gaaaaaagaaaatggctaa

SEQ ID NO: 6185944 - DNA, 16 bp, Homo sapiens
gaaaaaagaaagaaaa

SEQ ID NO: 6185945 - DNA, 17 bp, Homo sapiens
gaaaaaagaaagaaaaa

SEQ ID NO: 6185946 - DNA, 13 bp, Homo sapiens
gaaaaaagaacca

SEQ ID NO: 6185947 - DNA, 19 bp, Homo sapiens
gaaaaaagaaccaaaactt

SEQ ID NO: 6185948 - DNA, 21 bp, Homo sapiens
gaaaaaagaagtgtccgagaa

SEQ ID NO: 6185949 - DNA, 14 bp, Homo sapiens
gaaaaaagaagttt

SEQ ID NO: 6185950 - DNA, 13 bp, Homo sapiens
gaaaaaagagaaa

SEQ ID NO: 6185951 - DNA, 17 bp, Homo sapiens
gaaaaaagagaaaagaa

SEQ ID NO: 6185952 - DNA, 13 bp, Homo sapiens
gaaaaaagagttt

SEQ ID NO: 6185953 - DNA, 16 bp, Homo sapiens
gaaaaaagatttttaa

SEQ ID NO: 6185954 - DNA, 21 bp, Homo sapiens
gaaaaaagatttttaaaatga

SEQ ID NO: 6185955 - DNA, 11 bp, Homo sapiens
gaaaaaagcac

SEQ ID NO: 6185956 - DNA, 22 bp, Homo sapiens
gaaaaaagcacatacattaaaa

SEQ ID NO: 6185957 - DNA, 11 bp, Homo sapiens
gaaaaaagctc

SEQ ID NO: 6185958 - DNA, 12 bp, Homo sapiens
gaaaaaagcttt

SEQ ID NO: 6185959 - DNA, 12 bp, Homo sapiens
gaaaaaaggagg

SEQ ID NO: 6185960 - DNA, 22 bp, Homo sapiens
gaaaaaagtagcaaatgtttac

SEQ ID NO: 6185961 - DNA, 19 bp, Homo sapiens
gaaaaaagtccttcagttt

SEQ ID NO: 6185962 - DNA, 18 bp, Homo sapiens
gaaaaaagtgcaacttga

SEQ ID NO: 6185963 - DNA, 23 bp, Homo sapiens
gaaaaaagttgtaggcgaatcat

SEQ ID NO: 6185964 - DNA, 21 bp, Homo sapiens
gaaaaaatatatgtatataca

SEQ ID NO: 6185965 - DNA, 11 bp, Homo sapiens
gaaaaaatcat

SEQ ID NO: 6185966 - DNA, 12 bp, Homo sapiens
gaaaaaatgata

SEQ ID NO: 6185967 - DNA, 12 bp, Homo sapiens
gaaaaaatggca

SEQ ID NO: 6185968 - DNA, 16 bp, Homo sapiens
gaaaaaatggcaagag

SEQ ID NO: 6185969 - DNA, 17 bp, Homo sapiens
gaaaaaatggcaagaga

SEQ ID NO: 6185970 - DNA, 17 bp, Homo sapiens
gaaaaaatggtagcatt

SEQ ID NO: 6185971 - DNA, 13 bp, Homo sapiens
gaaaaaattgaaa

SEQ ID NO: 6185972 - DNA, 14 bp, Homo sapiens
gaaaaaatttaaaa

SEQ ID NO: 6185973 - DNA, 20 bp, Homo sapiens
gaaaaaatttactttaaact

SEQ ID NO: 6185974 - DNA, 20 bp, Homo sapiens
gaaaaacaacaaataattta

SEQ ID NO: 6185975 - DNA, 16 bp, Homo sapiens
gaaaaacaagtttgct

SEQ ID NO: 6185976 - DNA, 14 bp, Homo sapiens
gaaaaacacaagca

SEQ ID NO: 6185977 - DNA, 17 bp, Homo sapiens
gaaaaacacaagcaaaa

SEQ ID NO: 6185978 - DNA, 23 bp, Homo sapiens
gaaaaacacatggggaaaaaaat

SEQ ID NO: 6185979 - DNA, 18 bp, Homo sapiens
gaaaaacacggcagctgt

SEQ ID NO: 6185980 - DNA, 21 bp, Homo sapiens
gaaaaacactgagaaaaagca

SEQ ID NO: 6185981 - DNA, 13 bp, Homo sapiens
ctgtatattccct

SEQ ID NO: 6185982 - DNA, 13 bp, Homo sapiens
ctgtatattgggc

SEQ ID NO: 6185983 - DNA, 16 bp, Homo sapiens
ctgtatattgggctca

SEQ ID NO: 6185984 - DNA, 21 bp, Homo sapiens
ctgtatattgggctcagagag

SEQ ID NO: 6185985 - DNA, 14 bp, Homo sapiens
ctgtatatttcttt

SEQ ID NO: 6185986 - DNA, 12 bp, Homo sapiens
ctgtatatttgt

SEQ ID NO: 6185987 - DNA, 16 bp, Homo sapiens
ctgtatatttgtaaag

SEQ ID NO: 6185988 - DNA, 20 bp, Homo sapiens
ctgtatatttgtaaagctat

SEQ ID NO: 6185989 - DNA, 15 bp, Homo sapiens
ctgtatatttgtatg

SEQ ID NO: 6185990 - DNA, 17 bp, Homo sapiens
ctgtatatttgtcatga

SEQ ID NO: 6185991 - DNA, 23 bp, Homo sapiens
ctgtatatttgtgatagcacttt

SEQ ID NO: 6185992 - DNA, 17 bp, Homo sapiens
ctgtatattttaagaag

SEQ ID NO: 6185993 - DNA, 15 bp, Homo sapiens
ctgtatattttgtag

SEQ ID NO: 6185994 - DNA, 22 bp, Homo sapiens
ctgtatattttgtagttaatat

SEQ ID NO: 6185995 - DNA, 15 bp, Homo sapiens
ctgtatcaaatctgt

SEQ ID NO: 6185996 - DNA, 19 bp, Homo sapiens
ctgtatcaacccagaaaca

SEQ ID NO: 6185997 - DNA, 15 bp, Homo sapiens
ctgtatcaagcccct

SEQ ID NO: 6185998 - DNA, 17 bp, Homo sapiens
ctgtatcaagcccctgt

SEQ ID NO: 6185999 - DNA, 22 bp, Homo sapiens
ctgtatcaataaaattctgtaa

SEQ ID NO: 6186000 - DNA, 23 bp, Homo sapiens
ctgtatcaataaaattctgtaat

SEQ ID NO: 6186001 - DNA, 14 bp, Homo sapiens
ctgtatcactgcct

SEQ ID NO: 6186002 - DNA, 20 bp, Homo sapiens
ctgtatcagtggatttccca

SEQ ID NO: 6186003 - DNA, 14 bp, Homo sapiens
ctgtatcatttctt

SEQ ID NO: 6186004 - DNA, 15 bp, Homo sapiens
ctgtatccaaataat

SEQ ID NO: 6186005 - DNA, 14 bp, Homo sapiens
ctgtatccatgtaa

SEQ ID NO: 6186006 - DNA, 14 bp, Homo sapiens
ctgtatccattcta

SEQ ID NO: 6186007 - DNA, 14 bp, Homo sapiens
ctgtatcccatgag

SEQ ID NO: 6186008 - DNA, 19 bp, Homo sapiens
ctgtatcccatgagcctca

SEQ ID NO: 6186009 - DNA, 20 bp, Homo sapiens
ctgtatcccatgagcctcag

SEQ ID NO: 6186010 - DNA, 21 bp, Homo sapiens
ctgtatcccatgagcctcagc

SEQ ID NO: 6186011 - DNA, 22 bp, Homo sapiens
ctgtatcccatgagcctcagca

SEQ ID NO: 6186012 - DNA, 16 bp, Homo sapiens
ctgtatccccagtgcc

SEQ ID NO: 6186013 - DNA, 18 bp, Homo sapiens
ctgtatccgtgaattgct

SEQ ID NO: 6186014 - DNA, 17 bp, Homo sapiens
ctgtatcctgaaaggca

SEQ ID NO: 6186015 - DNA, 20 bp, Homo sapiens
ctgtatctaaaaaataactg

SEQ ID NO: 6186016 - DNA, 14 bp, Homo sapiens
ctgtatctgtaatt

SEQ ID NO: 6186017 - DNA, 18 bp, Homo sapiens
ctgtatctgtgtagacta

SEQ ID NO: 6186018 - DNA, 19 bp, Homo sapiens
ctgtatgaaagattgtggg

SEQ ID NO: 6186019 - DNA, 20 bp, Homo sapiens
ctgtatgacccctggccaca

SEQ ID NO: 6186020 - DNA, 15 bp, Homo sapiens
ctgtatgatcaaatg

SEQ ID NO: 6186021 - DNA, 20 bp, Homo sapiens
ctgtatgatttaggcttcta

SEQ ID NO: 6186022 - DNA, 11 bp, Homo sapiens
ctgtatgcatc

SEQ ID NO: 6186023 - DNA, 17 bp, Homo sapiens
ctgtatgccttctgtat

SEQ ID NO: 6186024 - DNA, 22 bp, Homo sapiens
ctgtatgctggtagctagtgat

SEQ ID NO: 6186025 - DNA, 17 bp, Homo sapiens
ctgtatggcactctgta

SEQ ID NO: 6186026 - DNA, 23 bp, Homo sapiens
ctgtatggcacttattatgaggc

SEQ ID NO: 6186027 - DNA, 24 bp, Homo sapiens
ctgtatgtacttccagtatcctga

SEQ ID NO: 6186028 - DNA, 16 bp, Homo sapiens
ctgtatgtataaatta

SEQ ID NO: 6186029 - DNA, 13 bp, Homo sapiens
ctgtatgtcaaat

SEQ ID NO: 6186030 - DNA, 20 bp, Homo sapiens
ctgtatgtctcgtggtagga

SEQ ID NO: 6186031 - DNA, 16 bp, Homo sapiens
ctgtatgtcttaaaac

SEQ ID NO: 6186032 - DNA, 13 bp, Homo sapiens
ctgtatgtcttat

SEQ ID NO: 6186033 - DNA, 22 bp, Homo sapiens
ctgtatgtcttataagaaaaca

SEQ ID NO: 6186034 - DNA, 19 bp, Homo sapiens
ctgtatgtgacaacatttt

SEQ ID NO: 6186035 - DNA, 18 bp, Homo sapiens
ctgtatgtgctgtaattt

SEQ ID NO: 6186036 - DNA, 18 bp, Homo sapiens
ctgtatgttgtacaatca

SEQ ID NO: 6186037 - DNA, 20 bp, Homo sapiens
ctgtatgttgtacaatcaaa

SEQ ID NO: 6186038 - DNA, 15 bp, Homo sapiens
ctgtattaaatctta

SEQ ID NO: 6186039 - DNA, 15 bp, Homo sapiens
ctgtattaagtgact

SEQ ID NO: 6186040 - DNA, 23 bp, Homo sapiens
ctgtattaatccccatcattact

SEQ ID NO: 6186041 - DNA, 17 bp, Homo sapiens
ctgtattacagctttca

SEQ ID NO: 6186042 - DNA, 19 bp, Homo sapiens
ctgtattagtcacagagat

SEQ ID NO: 6186043 - DNA, 19 bp, Homo sapiens
ctgtattatcttaaaccca

SEQ ID NO: 6186044 - DNA, 15 bp, Homo sapiens
ctgtattcagacaga

SEQ ID NO: 6186045 - DNA, 20 bp, Homo sapiens
ctgtattcagatcgtattaa

SEQ ID NO: 6186046 - DNA, 22 bp, Homo sapiens
ctgtattcagatcgtattaatt

SEQ ID NO: 6186047 - DNA, 12 bp, Homo sapiens
ctgtattcagca

SEQ ID NO: 6186048 - DNA, 17 bp, Homo sapiens
ctgtattcatacagcac

SEQ ID NO: 6186049 - DNA, 18 bp, Homo sapiens
ctgtattcatacagcact

SEQ ID NO: 6186050 - DNA, 14 bp, Homo sapiens
ctgtattcccagct

SEQ ID NO: 6186051 - DNA, 16 bp, Homo sapiens
ctgtattcgtgcattt

SEQ ID NO: 6186052 - DNA, 18 bp, Homo sapiens
ctgtattctagtggctgt

SEQ ID NO: 6186053 - DNA, 21 bp, Homo sapiens
ctgtattctagtggctgttca

SEQ ID NO: 6186054 - DNA, 23 bp, Homo sapiens
ctgtattctagtggctgttcatg

SEQ ID NO: 6186055 - DNA, 13 bp, Homo sapiens
ctgtattctcaaa

SEQ ID NO: 6186056 - DNA, 21 bp, Homo sapiens
ctgtattctgcaacagcctgt

SEQ ID NO: 6186057 - DNA, 19 bp, Homo sapiens
ctgtattgaaaaaatattg

SEQ ID NO: 6186058 - DNA, 23 bp, Homo sapiens
ctgtattgaaaaaatattgttta

SEQ ID NO: 6186059 - DNA, 22 bp, Homo sapiens
ctgtattgaatattttattaaa

SEQ ID NO: 6186060 - DNA, 13 bp, Homo sapiens
ctgtattgaatca

SEQ ID NO: 6186061 - DNA, 21 bp, Homo sapiens
ctgtattgaatcatgtagtat

SEQ ID NO: 6186062 - DNA, 20 bp, Homo sapiens
ctgtattgattatataagca

SEQ ID NO: 6186063 - DNA, 14 bp, Homo sapiens
ctgtattgccccca

SEQ ID NO: 6186064 - DNA, 15 bp, Homo sapiens
ctgtattggcagcac

SEQ ID NO: 6186065 - DNA, 16 bp, Homo sapiens
ctgtattggcagcaca

SEQ ID NO: 6186066 - DNA, 17 bp, Homo sapiens
ctgtattggcagcacag

SEQ ID NO: 6186067 - DNA, 20 bp, Homo sapiens
ctgtattggcagcacagcta

SEQ ID NO: 6186068 - DNA, 14 bp, Homo sapiens
ctgtattgtaacta

SEQ ID NO: 6186069 - DNA, 14 bp, Homo sapiens
ctgtattgtctgaa

SEQ ID NO: 6186070 - DNA, 19 bp, Homo sapiens
ctgtattgttacagctgaa

SEQ ID NO: 6186071 - DNA, 23 bp, Homo sapiens
ctgtatttaattataaaaaatta

SEQ ID NO: 6186072 - DNA, 15 bp, Homo sapiens
ctgtatttaattttg

SEQ ID NO: 6186073 - DNA, 17 bp, Homo sapiens
ctgtatttatgtgtgag

SEQ ID NO: 6186074 - DNA, 18 bp, Homo sapiens
ctgtatttatgtgtgagg

SEQ ID NO: 6186075 - DNA, 13 bp, Homo sapiens
ctgtatttcagta

SEQ ID NO: 6186076 - DNA, 19 bp, Homo sapiens
ctgtatttcagtattttcc

SEQ ID NO: 6186077 - DNA, 19 bp, Homo sapiens
ctgtatttcatgtggctgt

SEQ ID NO: 6186078 - DNA, 14 bp, Homo sapiens
ctgtatttcattat

SEQ ID NO: 6186079 - DNA, 12 bp, Homo sapiens
ctgtatttccaa

SEQ ID NO: 6186080 - DNA, 22 bp, Homo sapiens
ctgtatttctaagaagttgttt

SEQ ID NO: 6186081 - DNA, 15 bp, Homo sapiens
ctgtatttctaggca

SEQ ID NO: 6186082 - DNA, 17 bp, Homo sapiens
ctgtatttctgtggaaa

SEQ ID NO: 6186083 - DNA, 21 bp, Homo sapiens
ctgtatttgaaagtgcctttg

SEQ ID NO: 6186084 - DNA, 20 bp, Homo sapiens
ctgtatttgaggaaactcat

SEQ ID NO: 6186085 - DNA, 22 bp, Homo sapiens
ctgtatttggtatatactttgc

SEQ ID NO: 6186086 - DNA, 19 bp, Homo sapiens
ctgtatttgtgactaattg

SEQ ID NO: 6186087 - DNA, 20 bp, Homo sapiens
ctgtatttgtgactaattgt

SEQ ID NO: 6186088 - DNA, 14 bp, Homo sapiens
ctgtatttgttaat

SEQ ID NO: 6186089 - DNA, 22 bp, Homo sapiens
ctgtattttaaaagaatgatta

SEQ ID NO: 6186090 - DNA, 20 bp, Homo sapiens
ctgtattttaacactttgta

SEQ ID NO: 6186091 - DNA, 23 bp, Homo sapiens
ctgtattttaacactttgtatta

SEQ ID NO: 6186092 - DNA, 14 bp, Homo sapiens
ctgtattttcaaag

SEQ ID NO: 6186093 - DNA, 11 bp, Homo sapiens
ctgtattttct

SEQ ID NO: 6186094 - DNA, 12 bp, Homo sapiens
ctgtattttctt

SEQ ID NO: 6186095 - DNA, 17 bp, Homo sapiens
ctgtattttctttcact

SEQ ID NO: 6186096 - DNA, 21 bp, Homo sapiens
ctgtattttcttttatatctg

SEQ ID NO: 6186097 - DNA, 20 bp, Homo sapiens
ctgtattttgtattgtttca

SEQ ID NO: 6186098 - DNA, 20 bp, Homo sapiens
ctgtatttttaaattctgct

SEQ ID NO: 6186099 - DNA, 14 bp, Homo sapiens
ctgtatttttacag

SEQ ID NO: 6186100 - DNA, 15 bp, Homo sapiens
ctgtatttttacagc

SEQ ID NO: 6186101 - DNA, 15 bp, Homo sapiens
ctgtatttttagaga

SEQ ID NO: 6186102 - DNA, 15 bp, Homo sapiens
ctgtatttttctaaa

SEQ ID NO: 6186103 - DNA, 14 bp, Homo sapiens
ctgtatttttgtta

SEQ ID NO: 6186104 - DNA, 23 bp, Homo sapiens
ctgtattttttcttgcattgaca

SEQ ID NO: 6186105 - DNA, 19 bp, Homo sapiens
ctgtattttttgtttgtat

SEQ ID NO: 6186106 - DNA, 18 bp, Homo sapiens
ctgtatttttttttctaa

SEQ ID NO: 6186107 - DNA, 18 bp, Homo sapiens
ctgtattttttttttcca

SEQ ID NO: 6186108 - DNA, 19 bp, Homo sapiens
ctgtcaaaacactgtggaa

SEQ ID NO: 6186109 - DNA, 22 bp, Homo sapiens
ctgtcaaaactactgacaggga

SEQ ID NO: 6186110 - DNA, 16 bp, Homo sapiens
ctgtcaaaataatttt

SEQ ID NO: 6186111 - DNA, 18 bp, Homo sapiens
ctgtcaaacaaagccaga

SEQ ID NO: 6186112 - DNA, 16 bp, Homo sapiens
ctgtcaaatccatgtg

SEQ ID NO: 6186113 - DNA, 13 bp, Homo sapiens
ctgtcaaatgaac

SEQ ID NO: 6186114 - DNA, 19 bp, Homo sapiens
ctgtcaaatgtttccttaa

SEQ ID NO: 6186115 - DNA, 22 bp, Homo sapiens
ctgtcaacctgaattaaagtct

SEQ ID NO: 6186116 - DNA, 16 bp, Homo sapiens
ctgtcaagcttcatta

SEQ ID NO: 6186117 - DNA, 19 bp, Homo sapiens
ctgtcaaggctgcttagaa

SEQ ID NO: 6186118 - DNA, 20 bp, Homo sapiens
ctgtcaagtcatgatggaga

SEQ ID NO: 6186119 - DNA, 21 bp, Homo sapiens
ctgtcaagttaacaaggaatg

SEQ ID NO: 6186120 - DNA, 18 bp, Homo sapiens
ctgtcaagtttttatacc

SEQ ID NO: 6186121 - DNA, 18 bp, Homo sapiens
ctgtcaataaatgacacc

SEQ ID NO: 6186122 - DNA, 21 bp, Homo sapiens
ctgtcaatatcgtacctgtcc

SEQ ID NO: 6186123 - DNA, 14 bp, Homo sapiens
ctgtcaatcacagt

SEQ ID NO: 6186124 - DNA, 19 bp, Homo sapiens
ctgtcaatgattattttca

SEQ ID NO: 6186125 - DNA, 20 bp, Homo sapiens
ctgtcaatgattattttcat

SEQ ID NO: 6186126 - DNA, 15 bp, Homo sapiens
ctgtcaatgggacct

SEQ ID NO: 6186127 - DNA, 16 bp, Homo sapiens
ctgtcaatggttatgg

SEQ ID NO: 6186128 - DNA, 16 bp, Homo sapiens
ctgtcaattacaggaa

SEQ ID NO: 6186129 - DNA, 18 bp, Homo sapiens
ctgtcaattacaggaagt

SEQ ID NO: 6186130 - DNA, 23 bp, Homo sapiens
ctgtcaattacaggaagtactgg

SEQ ID NO: 6186131 - DNA, 14 bp, Homo sapiens
ctgtcaattgtacg

SEQ ID NO: 6186132 - DNA, 12 bp, Homo sapiens
ctgtcacaataa

SEQ ID NO: 6186133 - DNA, 13 bp, Homo sapiens
ctgtcacaataaa

SEQ ID NO: 6186134 - DNA, 14 bp, Homo sapiens
ctgtcacaataaag

SEQ ID NO: 6186135 - DNA, 20 bp, Homo sapiens
ctgtcacaataaatggccag

SEQ ID NO: 6186136 - DNA, 22 bp, Homo sapiens
ctgtcacaataaatggccagtg

SEQ ID NO: 6186137 - DNA, 24 bp, Homo sapiens
ctgtcacaataaatggccagtgct

SEQ ID NO: 6186138 - DNA, 14 bp, Homo sapiens
ctgtcacacactgg

SEQ ID NO: 6186139 - DNA, 15 bp, Homo sapiens
ctgtcacacactgga

SEQ ID NO: 6186140 - DNA, 16 bp, Homo sapiens
ctgtcacacactggac

SEQ ID NO: 6186141 - DNA, 21 bp, Homo sapiens
ctgtcacacactggaccccac

SEQ ID NO: 6186142 - DNA, 15 bp, Homo sapiens
ctgtcacaccagcca

SEQ ID NO: 6186143 - DNA, 16 bp, Homo sapiens
ctgtcacaccagccat

SEQ ID NO: 6186144 - DNA, 14 bp, Homo sapiens
ctgtcacactaaac

SEQ ID NO: 6186145 - DNA, 15 bp, Homo sapiens
ctgtcacactggtgc

SEQ ID NO: 6186146 - DNA, 14 bp, Homo sapiens
ctgtcacaggctgg

SEQ ID NO: 6186147 - DNA, 19 bp, Homo sapiens
ctgtcacaggctgggtcaa

SEQ ID NO: 6186148 - DNA, 19 bp, Homo sapiens
ctgtcacatacaacttttt

SEQ ID NO: 6186149 - DNA, 13 bp, Homo sapiens
ctgtcaccaaatt

SEQ ID NO: 6186150 - DNA, 15 bp, Homo sapiens
ctgtcaccaaggaaa

SEQ ID NO: 6186151 - DNA, 19 bp, Homo sapiens
ctgtcaccacatcttgtct

SEQ ID NO: 6186152 - DNA, 21 bp, Homo sapiens
ctgtcaccacatcttgtcttt

SEQ ID NO: 6186153 - DNA, 22 bp, Homo sapiens
ctgtcaccactacagtaagctg

SEQ ID NO: 6186154 - DNA, 12 bp, Homo sapiens
ctgtcaccagag

SEQ ID NO: 6186155 - DNA, 13 bp, Homo sapiens
ctgtcaccagagc

SEQ ID NO: 6186156 - DNA, 15 bp, Homo sapiens
ctgtcaccagagctt

SEQ ID NO: 6186157 - DNA, 21 bp, Homo sapiens
ctgtcaccagagcttctctgg

SEQ ID NO: 6186158 - DNA, 19 bp, Homo sapiens
ctgtcacccacagaccgcc

SEQ ID NO: 6186159 - DNA, 18 bp, Homo sapiens
gaaaaacagaacatttct

SEQ ID NO: 6186160 - DNA, 14 bp, Homo sapiens
gaaaaacagacaaa

SEQ ID NO: 6186161 - DNA, 21 bp, Homo sapiens
gaaaaacagaggatgctgaag

SEQ ID NO: 6186162 - DNA, 13 bp, Homo sapiens
gaaaaacaggcac

SEQ ID NO: 6186163 - DNA, 15 bp, Homo sapiens
gaaaaacatcccaaa

SEQ ID NO: 6186164 - DNA, 19 bp, Homo sapiens
gaaaaacatcccaaacttt

SEQ ID NO: 6186165 - DNA, 15 bp, Homo sapiens
gaaaaacatctgaag

SEQ ID NO: 6186166 - DNA, 16 bp, Homo sapiens
gaaaaacatgcttaag

SEQ ID NO: 6186167 - DNA, 15 bp, Homo sapiens
gaaaaacatgtcatg

SEQ ID NO: 6186168 - DNA, 22 bp, Homo sapiens
gaaaaacatttaaactttttaa

SEQ ID NO: 6186169 - DNA, 18 bp, Homo sapiens
gaaaaaccaatgattcat

SEQ ID NO: 6186170 - DNA, 20 bp, Homo sapiens
gaaaaaccactcccagtccc

SEQ ID NO: 6186171 - DNA, 23 bp, Homo sapiens
gaaaaactaaactacagaaacct

SEQ ID NO: 6186172 - DNA, 19 bp, Homo sapiens
gaaaaactctttattttcc

SEQ ID NO: 6186173 - DNA, 17 bp, Homo sapiens
gaaaaactgagacaggc

SEQ ID NO: 6186174 - DNA, 20 bp, Homo sapiens
gaaaaactgatcaaaaataa

SEQ ID NO: 6186175 - DNA, 23 bp, Homo sapiens
gaaaaactgatcaaaaataaact

SEQ ID NO: 6186176 - DNA, 14 bp, Homo sapiens
gaaaaactgatttt

SEQ ID NO: 6186177 - DNA, 11 bp, Homo sapiens
gaaaaactgct

SEQ ID NO: 6186178 - DNA, 19 bp, Homo sapiens
gaaaaactggctctgattg

SEQ ID NO: 6186179 - DNA, 20 bp, Homo sapiens
gaaaaacttccatgaggcca

SEQ ID NO: 6186180 - DNA, 21 bp, Homo sapiens
gaaaaacttgctcccaggagg

SEQ ID NO: 6186181 - DNA, 11 bp, Homo sapiens
gaaaaagaaaa

SEQ ID NO: 6186182 - DNA, 16 bp, Homo sapiens
gaaaaagaaaaaatat

SEQ ID NO: 6186183 - DNA, 15 bp, Homo sapiens
gaaaaagaaattctg

SEQ ID NO: 6186184 - DNA, 18 bp, Homo sapiens
gaaaaagaaattctgtta

SEQ ID NO: 6186185 - DNA, 23 bp, Homo sapiens
gaaaaagaacatgcagtttgaaa

SEQ ID NO: 6186186 - DNA, 15 bp, Homo sapiens
gaaaaagaagaaaag

SEQ ID NO: 6186187 - DNA, 14 bp, Homo sapiens
gaaaaagaagaagg

SEQ ID NO: 6186188 - DNA, 22 bp, Homo sapiens
gaaaaagaatcggcagtatttt

SEQ ID NO: 6186189 - DNA, 18 bp, Homo sapiens
gaaaaagacaatagtatt

SEQ ID NO: 6186190 - DNA, 13 bp, Homo sapiens
gaaaaagacataa

SEQ ID NO: 6186191 - DNA, 17 bp, Homo sapiens
gaaaaagacataaaaca

SEQ ID NO: 6186192 - DNA, 19 bp, Homo sapiens
gaaaaagacgatgtttatg

SEQ ID NO: 6186193 - DNA, 9 bp, Homo sapiens
gaaaaagag

SEQ ID NO: 6186194 - DNA, 15 bp, Homo sapiens
gaaaaagagagagca

SEQ ID NO: 6186195 - DNA, 17 bp, Homo sapiens
gaaaaagatattttatt

SEQ ID NO: 6186196 - DNA, 22 bp, Homo sapiens
gaaaaagatattttatttctga

SEQ ID NO: 6186197 - DNA, 14 bp, Homo sapiens
gaaaaagatctttc

SEQ ID NO: 6186198 - DNA, 14 bp, Homo sapiens
gaaaaagatgtaca

SEQ ID NO: 6186199 - DNA, 17 bp, Homo sapiens
gaaaaagcacaagaagc

SEQ ID NO: 6186200 - DNA, 14 bp, Homo sapiens
gaaaaagcacagct

SEQ ID NO: 6186201 - DNA, 20 bp, Homo sapiens
gaaaaagcatgatgggaaaa

SEQ ID NO: 6186202 - DNA, 18 bp, Homo sapiens
gaaaaagcatgtacagtg

SEQ ID NO: 6186203 - DNA, 20 bp, Homo sapiens
gaaaaagcatgtacagtgtt

SEQ ID NO: 6186204 - DNA, 18 bp, Homo sapiens
gaaaaagcgctgtttcct

SEQ ID NO: 6186205 - DNA, 12 bp, Homo sapiens
gaaaaaggaaaa

SEQ ID NO: 6186206 - DNA, 13 bp, Homo sapiens
gaaaaaggaaaag

SEQ ID NO: 6186207 - DNA, 15 bp, Homo sapiens
gaaaaaggacaggca

SEQ ID NO: 6186208 - DNA, 12 bp, Homo sapiens
gaaaaaggagga

SEQ ID NO: 6186209 - DNA, 15 bp, Homo sapiens
gaaaaaggaggaaga

SEQ ID NO: 6186210 - DNA, 13 bp, Homo sapiens
gaaaaaggatgga

SEQ ID NO: 6186211 - DNA, 19 bp, Homo sapiens
gaaaaaggatggaagaaag

SEQ ID NO: 6186212 - DNA, 23 bp, Homo sapiens
gaaaaagtacaatgaactgcttt

SEQ ID NO: 6186213 - DNA, 15 bp, Homo sapiens
gaaaaagtaggctgc

SEQ ID NO: 6186214 - DNA, 18 bp, Homo sapiens
gaaaaagtatcatggaaa

SEQ ID NO: 6186215 - DNA, 16 bp, Homo sapiens
gaaaaagtcagctaca

SEQ ID NO: 6186216 - DNA, 20 bp, Homo sapiens
gaaaaagtgtacatgaagaa

SEQ ID NO: 6186217 - DNA, 21 bp, Homo sapiens
gaaaaagtgtacatgaagaat

SEQ ID NO: 6186218 - DNA, 16 bp, Homo sapiens
gaaaaagtgtttttac

SEQ ID NO: 6186219 - DNA, 18 bp, Homo sapiens
gaaaaagttaatgcttaa

SEQ ID NO: 6186220 - DNA, 14 bp, Homo sapiens
gaaaaataaaaacc

SEQ ID NO: 6186221 - DNA, 15 bp, Homo sapiens
gaaaaataaaaacca

SEQ ID NO: 6186222 - DNA, 14 bp, Homo sapiens
gaaaaataaaagtg

SEQ ID NO: 6186223 - DNA, 21 bp, Homo sapiens
gaaaaataaacaataagacat

SEQ ID NO: 6186224 - DNA, 15 bp, Homo sapiens
gaaaaataaaggaaa

SEQ ID NO: 6186225 - DNA, 12 bp, Homo sapiens
gaaaaataaatg

SEQ ID NO: 6186226 - DNA, 19 bp, Homo sapiens
gaaaaatagagcaaaatca

SEQ ID NO: 6186227 - DNA, 12 bp, Homo sapiens
gaaaaatagtaa

SEQ ID NO: 6186228 - DNA, 17 bp, Homo sapiens
gaaaaatagtgtctttg

SEQ ID NO: 6186229 - DNA, 12 bp, Homo sapiens
gaaaaatataaa

SEQ ID NO: 6186230 - DNA, 16 bp, Homo sapiens
gaaaaatatcttggcc

SEQ ID NO: 6186231 - DNA, 11 bp, Homo sapiens
gaaaaatatga

SEQ ID NO: 6186232 - DNA, 15 bp, Homo sapiens
gaaaaatatgtgaag

SEQ ID NO: 6186233 - DNA, 14 bp, Homo sapiens
gaaaaatattgcta

SEQ ID NO: 6186234 - DNA, 22 bp, Homo sapiens
gaaaaatattgctaaaagtgca

SEQ ID NO: 6186235 - DNA, 16 bp, Homo sapiens
gaaaaatatttaatgt

SEQ ID NO: 6186236 - DNA, 18 bp, Homo sapiens
gaaaaatatttattcatt

SEQ ID NO: 6186237 - DNA, 15 bp, Homo sapiens
gaaaaatcacttgat

SEQ ID NO: 6186238 - DNA, 21 bp, Homo sapiens
gaaaaatcacttgattcataa

SEQ ID NO: 6186239 - DNA, 13 bp, Homo sapiens
gaaaaatcagttt

SEQ ID NO: 6186240 - DNA, 18 bp, Homo sapiens
gaaaaatcctcttcctct

SEQ ID NO: 6186241 - DNA, 20 bp, Homo sapiens
gaaaaatcctcttcctctga

SEQ ID NO: 6186242 - DNA, 18 bp, Homo sapiens
gaaaaatctaaaatgtgt

SEQ ID NO: 6186243 - DNA, 20 bp, Homo sapiens
gaaaaatctaagtgatataa

SEQ ID NO: 6186244 - DNA, 17 bp, Homo sapiens
gaaaaatctcaattgaa

SEQ ID NO: 6186245 - DNA, 20 bp, Homo sapiens
gaaaaatctcaattgaaagc

SEQ ID NO: 6186246 - DNA, 22 bp, Homo sapiens
gaaaaatctcattatttcaaaa

SEQ ID NO: 6186247 - DNA, 13 bp, Homo sapiens
gaaaaatcttaag

SEQ ID NO: 6186248 - DNA, 11 bp, Homo sapiens
gaaaaatcttg

SEQ ID NO: 6186249 - DNA, 16 bp, Homo sapiens
gaaaaatcttgggcaa

SEQ ID NO: 6186250 - DNA, 22 bp, Homo sapiens
gaaaaatcttgtgctagaatac

SEQ ID NO: 6186251 - DNA, 15 bp, Homo sapiens
gaaaaatgaaagatg

SEQ ID NO: 6186252 - DNA, 22 bp, Homo sapiens
gaaaaatggatccccagtgaaa

SEQ ID NO: 6186253 - DNA, 12 bp, Homo sapiens
gaaaaatgggag

SEQ ID NO: 6186254 - DNA, 22 bp, Homo sapiens
gaaaaatgggtcttttatagga

SEQ ID NO: 6186255 - DNA, 16 bp, Homo sapiens
gaaaaatggttgatgg

SEQ ID NO: 6186256 - DNA, 12 bp, Homo sapiens
gaaaaatgtagg

SEQ ID NO: 6186257 - DNA, 17 bp, Homo sapiens
gaaaaatgtaggagact

SEQ ID NO: 6186258 - DNA, 13 bp, Homo sapiens
gaaaaatgtcact

SEQ ID NO: 6186259 - DNA, 13 bp, Homo sapiens
gaaaaatgtgtaa

SEQ ID NO: 6186260 - DNA, 14 bp, Homo sapiens
gaaaaatgtgtaat

SEQ ID NO: 6186261 - DNA, 20 bp, Homo sapiens
gaaaaatgtgtattttaaga

SEQ ID NO: 6186262 - DNA, 12 bp, Homo sapiens
gaaaaatgtttg

SEQ ID NO: 6186263 - DNA, 11 bp, Homo sapiens
gaaaaattaaa

SEQ ID NO: 6186264 - DNA, 14 bp, Homo sapiens
gaaaaattaacttt

SEQ ID NO: 6186265 - DNA, 16 bp, Homo sapiens
gaaaaattacagcttc

SEQ ID NO: 6186266 - DNA, 12 bp, Homo sapiens
gaaaaattatag

SEQ ID NO: 6186267 - DNA, 12 bp, Homo sapiens
gaaaaattatta

SEQ ID NO: 6186268 - DNA, 16 bp, Homo sapiens
gaaaaattattcccat

SEQ ID NO: 6186269 - DNA, 20 bp, Homo sapiens
gaaaaattcaatagtaatat

SEQ ID NO: 6186270 - DNA, 15 bp, Homo sapiens
gaaaaattgacaaaa

SEQ ID NO: 6186271 - DNA, 21 bp, Homo sapiens
gaaaaattgctgactgtagct

SEQ ID NO: 6186272 - DNA, 16 bp, Homo sapiens
gaaaaattgtagagtg

SEQ ID NO: 6186273 - DNA, 19 bp, Homo sapiens
gaaaaattgtttccaaagt

SEQ ID NO: 6186274 - DNA, 16 bp, Homo sapiens
gaaaaatttaagcatt

SEQ ID NO: 6186275 - DNA, 20 bp, Homo sapiens
gaaaaatttataagccaaag

SEQ ID NO: 6186276 - DNA, 21 bp, Homo sapiens
gaaaaatttctggcaaatatt

SEQ ID NO: 6186277 - DNA, 23 bp, Homo sapiens
gaaaaatttctggcaaatatttt

SEQ ID NO: 6186278 - DNA, 15 bp, Homo sapiens
gaaaaatttttatgt

SEQ ID NO: 6186279 - DNA, 13 bp, Homo sapiens
gaaaacaaaactg

SEQ ID NO: 6186280 - DNA, 14 bp, Homo sapiens
gaaaacaaagacat

SEQ ID NO: 6186281 - DNA, 15 bp, Homo sapiens
gaaaacaaagttcta

SEQ ID NO: 6186282 - DNA, 19 bp, Homo sapiens
gaaaacaaatatttcactt

SEQ ID NO: 6186283 - DNA, 23 bp, Homo sapiens
gaaaacaaatcttcaaggtgtaa

SEQ ID NO: 6186284 - DNA, 21 bp, Homo sapiens
gaaaacaacttggcatttcta

SEQ ID NO: 6186285 - DNA, 23 bp, Homo sapiens
gaaaacaacttggcatttctata

SEQ ID NO: 6186286 - DNA, 15 bp, Homo sapiens
gaaaacaagcgttta

SEQ ID NO: 6186287 - DNA, 18 bp, Homo sapiens
gaaaacaaggtttccata

SEQ ID NO: 6186288 - DNA, 14 bp, Homo sapiens
gaaaacaataattt

SEQ ID NO: 6186289 - DNA, 19 bp, Homo sapiens
gaaaacaatactaaataaa

SEQ ID NO: 6186290 - DNA, 19 bp, Homo sapiens
gaaaacaatattgtatact

SEQ ID NO: 6186291 - DNA, 16 bp, Homo sapiens
gaaaacaatggggctg

SEQ ID NO: 6186292 - DNA, 19 bp, Homo sapiens
gaaaacaatggggctggtt

SEQ ID NO: 6186293 - DNA, 20 bp, Homo sapiens
gaaaacaatggggctggttt

SEQ ID NO: 6186294 - DNA, 18 bp, Homo sapiens
gaaaacaattcaagctga

SEQ ID NO: 6186295 - DNA, 22 bp, Homo sapiens
gaaaacaattgttctgggtgat

SEQ ID NO: 6186296 - DNA, 14 bp, Homo sapiens
gaaaacaatttgca

SEQ ID NO: 6186297 - DNA, 24 bp, Homo sapiens
gaaaacaatttgcataatactaat

SEQ ID NO: 6186298 - DNA, 15 bp, Homo sapiens
gaaaacacactcaaa

SEQ ID NO: 6186299 - DNA, 18 bp, Homo sapiens
gaaaacacagcctccctg

SEQ ID NO: 6186300 - DNA, 15 bp, Homo sapiens
gaaaacacatttctg

SEQ ID NO: 6186301 - DNA, 20 bp, Homo sapiens
gaaaacaccaagagtacagg

SEQ ID NO: 6186302 - DNA, 22 bp, Homo sapiens
gaaaacaccatggagatgaaat

SEQ ID NO: 6186303 - DNA, 17 bp, Homo sapiens
gaaaacacccagggaac

SEQ ID NO: 6186304 - DNA, 15 bp, Homo sapiens
gaaaacacctttatt

SEQ ID NO: 6186305 - DNA, 22 bp, Homo sapiens
gaaaacacggccctcctgggaa

SEQ ID NO: 6186306 - DNA, 22 bp, Homo sapiens
gaaaacactaacaaaatttgaa

SEQ ID NO: 6186307 - DNA, 18 bp, Homo sapiens
gaaaacactgttctctgc

SEQ ID NO: 6186308 - DNA, 19 bp, Homo sapiens
gaaaacactgttctctgcc

SEQ ID NO: 6186309 - DNA, 20 bp, Homo sapiens
gaaaacactgttctctgccc

SEQ ID NO: 6186310 - DNA, 11 bp, Homo sapiens
gaaaacactta

SEQ ID NO: 6186311 - DNA, 12 bp, Homo sapiens
gaaaacagaaaa

SEQ ID NO: 6186312 - DNA, 12 bp, Homo sapiens
gaaaacagaaac

SEQ ID NO: 6186313 - DNA, 15 bp, Homo sapiens
gaaaacagaaattgg

SEQ ID NO: 6186314 - DNA, 17 bp, Homo sapiens
gaaaacagaagcaaagg

SEQ ID NO: 6186315 - DNA, 21 bp, Homo sapiens
gaaaacagaatcagtgttaaa

SEQ ID NO: 6186316 - DNA, 17 bp, Homo sapiens
gaaaacagactcaggtt

SEQ ID NO: 6186317 - DNA, 19 bp, Homo sapiens
gaaaacagagcctgcctaa

SEQ ID NO: 6186318 - DNA, 12 bp, Homo sapiens
gaaaacagatat

SEQ ID NO: 6186319 - DNA, 14 bp, Homo sapiens
gaaaacagatatta

SEQ ID NO: 6186320 - DNA, 19 bp, Homo sapiens
gaaaacaggaaaaaaactt

SEQ ID NO: 6186321 - DNA, 20 bp, Homo sapiens
gaaaacaggacttaaaatga

SEQ ID NO: 6186322 - DNA, 18 bp, Homo sapiens
gaaaacagggtccaggaa

SEQ ID NO: 6186323 - DNA, 19 bp, Homo sapiens
gaaaacagggtccaggaat

SEQ ID NO: 6186324 - DNA, 14 bp, Homo sapiens
gaaaacagggtctg

SEQ ID NO: 6186325 - DNA, 14 bp, Homo sapiens
gaaaacagtaacta

SEQ ID NO: 6186326 - DNA, 18 bp, Homo sapiens
gaaaacagtaactaagca

SEQ ID NO: 6186327 - DNA, 22 bp, Homo sapiens
gaaaacagtaactaagcacatt

SEQ ID NO: 6186328 - DNA, 14 bp, Homo sapiens
gaaaacagtacaga

SEQ ID NO: 6186329 - DNA, 19 bp, Homo sapiens
gaaaacagtcgatcaaggg

SEQ ID NO: 6186330 - DNA, 18 bp, Homo sapiens
gaaaacagtgaatcttat

SEQ ID NO: 6186331 - DNA, 15 bp, Homo sapiens
gaaaacataaaaatc

SEQ ID NO: 6186332 - DNA, 18 bp, Homo sapiens
gaaaacataatataagaa

SEQ ID NO: 6186333 - DNA, 22 bp, Homo sapiens
gaaaacatatattttattttca

SEQ ID NO: 6186334 - DNA, 16 bp, Homo sapiens
gaaaacatatgaaata

SEQ ID NO: 6186335 - DNA, 15 bp, Homo sapiens
gaaaacatgctacac

SEQ ID NO: 6186336 - DNA, 19 bp, Homo sapiens
gaaaacatgctacacactg

SEQ ID NO: 6186337 - DNA, 15 bp, Homo sapiens
gaaaacatgtaataa

SEQ ID NO: 6186338 - DNA, 12 bp, Homo sapiens
gaaaacatgtac

SEQ ID NO: 6186339 - DNA, 19 bp, Homo sapiens
gaaaacatgtatgtttgct

SEQ ID NO: 6186340 - DNA, 22 bp, Homo sapiens
ctgtcacccaggctgcagtgca

SEQ ID NO: 6186341 - DNA, 22 bp, Homo sapiens
ctgtcacccaggttggagtgca

SEQ ID NO: 6186342 - DNA, 19 bp, Homo sapiens
ctgtcacccgatcgccagc

SEQ ID NO: 6186343 - DNA, 20 bp, Homo sapiens
ctgtcaccctccaccgagcc

SEQ ID NO: 6186344 - DNA, 13 bp, Homo sapiens
ctgtcaccctgag

SEQ ID NO: 6186345 - DNA, 14 bp, Homo sapiens
ctgtcaccctgcag

SEQ ID NO: 6186346 - DNA, 21 bp, Homo sapiens
ctgtcaccctggccaccaccc

SEQ ID NO: 6186347 - DNA, 15 bp, Homo sapiens
ctgtcaccctggccc

SEQ ID NO: 6186348 - DNA, 16 bp, Homo sapiens
ctgtcaccctggcccc

SEQ ID NO: 6186349 - DNA, 19 bp, Homo sapiens
ctgtcaccctggccccaac

SEQ ID NO: 6186350 - DNA, 23 bp, Homo sapiens
ctgtcacctagaacgtgcatcct

SEQ ID NO: 6186351 - DNA, 13 bp, Homo sapiens
ctgtcacctctca

SEQ ID NO: 6186352 - DNA, 19 bp, Homo sapiens
ctgtcacctctcagctgct

SEQ ID NO: 6186353 - DNA, 16 bp, Homo sapiens
ctgtcacctctcccac

SEQ ID NO: 6186354 - DNA, 18 bp, Homo sapiens
ctgtcacctgctcacagg

SEQ ID NO: 6186355 - DNA, 16 bp, Homo sapiens
ctgtcacctggcctgc

SEQ ID NO: 6186356 - DNA, 16 bp, Homo sapiens
ctgtcacctgggaggg

SEQ ID NO: 6186357 - DNA, 19 bp, Homo sapiens
ctgtcacgcagccaccagg

SEQ ID NO: 6186358 - DNA, 24 bp, Homo sapiens
ctgtcacgctcatgtcctgtcctg

SEQ ID NO: 6186359 - DNA, 18 bp, Homo sapiens
ctgtcacgctctggtgca

SEQ ID NO: 6186360 - DNA, 18 bp, Homo sapiens
ctgtcacggaacagatct

SEQ ID NO: 6186361 - DNA, 19 bp, Homo sapiens
ctgtcacgttctggaacat

SEQ ID NO: 6186362 - DNA, 17 bp, Homo sapiens
ctgtcactaaatggcag

SEQ ID NO: 6186363 - DNA, 22 bp, Homo sapiens
ctgtcactaaatggcagtgaga

SEQ ID NO: 6186364 - DNA, 15 bp, Homo sapiens
ctgtcactactggtc

SEQ ID NO: 6186365 - DNA, 14 bp, Homo sapiens
ctgtcactcattgc

SEQ ID NO: 6186366 - DNA, 15 bp, Homo sapiens
ctgtcactccaggca

SEQ ID NO: 6186367 - DNA, 13 bp, Homo sapiens
ctgtcactgcagg

SEQ ID NO: 6186368 - DNA, 24 bp, Homo sapiens
ctgtcactgctctggactgtgtgg

SEQ ID NO: 6186369 - DNA, 20 bp, Homo sapiens
ctgtcactgcttgagggaga

SEQ ID NO: 6186370 - DNA, 16 bp, Homo sapiens
ctgtcactggcagagc

SEQ ID NO: 6186371 - DNA, 17 bp, Homo sapiens
ctgtcactggcagagca

SEQ ID NO: 6186372 - DNA, 21 bp, Homo sapiens
ctgtcactggcagagcacagc

SEQ ID NO: 6186373 - DNA, 23 bp, Homo sapiens
ctgtcactggcagagcacagccc

SEQ ID NO: 6186374 - DNA, 15 bp, Homo sapiens
ctgtcactggctggc

SEQ ID NO: 6186375 - DNA, 19 bp, Homo sapiens
ctgtcactggctggctcct

SEQ ID NO: 6186376 - DNA, 21 bp, Homo sapiens
ctgtcactggctggctcctag

SEQ ID NO: 6186377 - DNA, 10 bp, Homo sapiens
ctgtcactgt

SEQ ID NO: 6186378 - DNA, 11 bp, Homo sapiens
ctgtcactgtc

SEQ ID NO: 6186379 - DNA, 21 bp, Homo sapiens
ctgtcactgttggacgtcagc

SEQ ID NO: 6186380 - DNA, 20 bp, Homo sapiens
ctgtcactgtttctctgctg

SEQ ID NO: 6186381 - DNA, 17 bp, Homo sapiens
ctgtcacttcttcacct

SEQ ID NO: 6186382 - DNA, 23 bp, Homo sapiens
ctgtcacttcttcacctcttcca

SEQ ID NO: 6186383 - DNA, 18 bp, Homo sapiens
ctgtcacttgcacagagg

SEQ ID NO: 6186384 - DNA, 17 bp, Homo sapiens
ctgtcactttctctctt

SEQ ID NO: 6186385 - DNA, 19 bp, Homo sapiens
ctgtcactttgctctgggt

SEQ ID NO: 6186386 - DNA, 21 bp, Homo sapiens
ctgtcactttttttctttttc

SEQ ID NO: 6186387 - DNA, 15 bp, Homo sapiens
ctgtcagaagacact

SEQ ID NO: 6186388 - DNA, 21 bp, Homo sapiens
ctgtcagaagggggttgtggc

SEQ ID NO: 6186389 - DNA, 13 bp, Homo sapiens
ctgtcagaagttt

SEQ ID NO: 6186390 - DNA, 15 bp, Homo sapiens
ctgtcagaataaaga

SEQ ID NO: 6186391 - DNA, 19 bp, Homo sapiens
ctgtcagaataaagaacat

SEQ ID NO: 6186392 - DNA, 19 bp, Homo sapiens
ctgtcagaatcatgctgtt

SEQ ID NO: 6186393 - DNA, 21 bp, Homo sapiens
ctgtcagaatcatgctgttct

SEQ ID NO: 6186394 - DNA, 20 bp, Homo sapiens
ctgtcagacgttggtcccaa

SEQ ID NO: 6186395 - DNA, 18 bp, Homo sapiens
ctgtcagagaatatgacc

SEQ ID NO: 6186396 - DNA, 20 bp, Homo sapiens
ctgtcagagaatatgaccta

SEQ ID NO: 6186397 - DNA, 19 bp, Homo sapiens
ctgtcagagatctgggagg

SEQ ID NO: 6186398 - DNA, 21 bp, Homo sapiens
ctgtcagagctgttggcctcg

SEQ ID NO: 6186399 - DNA, 13 bp, Homo sapiens
ctgtcagaggcta

SEQ ID NO: 6186400 - DNA, 20 bp, Homo sapiens
ctgtcagataatcggtgcag

SEQ ID NO: 6186401 - DNA, 21 bp, Homo sapiens
ctgtcagataatcggtgcagc

SEQ ID NO: 6186402 - DNA, 13 bp, Homo sapiens
ctgtcagatccag

SEQ ID NO: 6186403 - DNA, 18 bp, Homo sapiens
ctgtcagatccaggagct

SEQ ID NO: 6186404 - DNA, 19 bp, Homo sapiens
ctgtcagatccaggagctc

SEQ ID NO: 6186405 - DNA, 24 bp, Homo sapiens
ctgtcagatccaggagctccagtg

SEQ ID NO: 6186406 - DNA, 16 bp, Homo sapiens
ctgtcagatgagaaca

SEQ ID NO: 6186407 - DNA, 19 bp, Homo sapiens
ctgtcagatgagaacaaag

SEQ ID NO: 6186408 - DNA, 22 bp, Homo sapiens
ctgtcagatgagaacaaagctg

SEQ ID NO: 6186409 - DNA, 23 bp, Homo sapiens
ctgtcagatgagaacaaagctgt

SEQ ID NO: 6186410 - DNA, 22 bp, Homo sapiens
ctgtcagatgggaagacatgaa

SEQ ID NO: 6186411 - DNA, 14 bp, Homo sapiens
ctgtcagattaaat

SEQ ID NO: 6186412 - DNA, 14 bp, Homo sapiens
ctgtcagcatctgg

SEQ ID NO: 6186413 - DNA, 15 bp, Homo sapiens
ctgtcagcatgaatt

SEQ ID NO: 6186414 - DNA, 22 bp, Homo sapiens
ctgtcagcatgaatttgtaatg

SEQ ID NO: 6186415 - DNA, 22 bp, Homo sapiens
ctgtcagccagccgccctgggc

SEQ ID NO: 6186416 - DNA, 15 bp, Homo sapiens
ctgtcagcctgactc

SEQ ID NO: 6186417 - DNA, 17 bp, Homo sapiens
ctgtcagcgcaggttta

SEQ ID NO: 6186418 - DNA, 21 bp, Homo sapiens
ctgtcagctcccctcggagaa

SEQ ID NO: 6186419 - DNA, 14 bp, Homo sapiens
ctgtcagcttccca

SEQ ID NO: 6186420 - DNA, 14 bp, Homo sapiens
ctgtcaggaagaaa

SEQ ID NO: 6186421 - DNA, 18 bp, Homo sapiens
ctgtcaggaagaaatcac

SEQ ID NO: 6186422 - DNA, 17 bp, Homo sapiens
ctgtcaggaagtaaaat

SEQ ID NO: 6186423 - DNA, 22 bp, Homo sapiens
ctgtcaggaagtaaaataaata

SEQ ID NO: 6186424 - DNA, 21 bp, Homo sapiens
ctgtcaggacaccagcctggt

SEQ ID NO: 6186425 - DNA, 22 bp, Homo sapiens
ctgtcaggattgcgagagatgt

SEQ ID NO: 6186426 - DNA, 21 bp, Homo sapiens
ctgtcaggcagtagcagctgt

SEQ ID NO: 6186427 - DNA, 22 bp, Homo sapiens
ctgtcaggcagtagcagctgtg

SEQ ID NO: 6186428 - DNA, 12 bp, Homo sapiens
ctgtcaggcctc

SEQ ID NO: 6186429 - DNA, 18 bp, Homo sapiens
ctgtcaggctctggccct

SEQ ID NO: 6186430 - DNA, 23 bp, Homo sapiens
ctgtcaggctctggcccttgcct

SEQ ID NO: 6186431 - DNA, 14 bp, Homo sapiens
ctgtcaggctggga

SEQ ID NO: 6186432 - DNA, 15 bp, Homo sapiens
ctgtcaggctgggac

SEQ ID NO: 6186433 - DNA, 12 bp, Homo sapiens
ctgtcagggagg

SEQ ID NO: 6186434 - DNA, 17 bp, Homo sapiens
ctgtcagggttggaaag

SEQ ID NO: 6186435 - DNA, 14 bp, Homo sapiens
ctgtcagtaaaact

SEQ ID NO: 6186436 - DNA, 13 bp, Homo sapiens
ctgtcagtcacag

SEQ ID NO: 6186437 - DNA, 14 bp, Homo sapiens
ctgtcagtcacagc

SEQ ID NO: 6186438 - DNA, 15 bp, Homo sapiens
ctgtcagtcacagcc

SEQ ID NO: 6186439 - DNA, 17 bp, Homo sapiens
ctgtcagtcacagccac

SEQ ID NO: 6186440 - DNA, 17 bp, Homo sapiens
ctgtcagtcatgcgtcc

SEQ ID NO: 6186441 - DNA, 15 bp, Homo sapiens
ctgtcagtctgaagc

SEQ ID NO: 6186442 - DNA, 21 bp, Homo sapiens
ctgtcagtgaggactctttcc

SEQ ID NO: 6186443 - DNA, 19 bp, Homo sapiens
ctgtcagtgcagcccgtgt

SEQ ID NO: 6186444 - DNA, 18 bp, Homo sapiens
ctgtcagtgccgccgcct

SEQ ID NO: 6186445 - DNA, 15 bp, Homo sapiens
ctgtcagtggggcag

SEQ ID NO: 6186446 - DNA, 20 bp, Homo sapiens
ctgtcagtgtcctcagggct

SEQ ID NO: 6186447 - DNA, 19 bp, Homo sapiens
ctgtcagtgtttgtatttg

SEQ ID NO: 6186448 - DNA, 14 bp, Homo sapiens
ctgtcagtgttttt

SEQ ID NO: 6186449 - DNA, 16 bp, Homo sapiens
ctgtcagtgtttttga

SEQ ID NO: 6186450 - DNA, 20 bp, Homo sapiens
ctgtcagttgtacttctgct

SEQ ID NO: 6186451 - DNA, 17 bp, Homo sapiens
ctgtcagtttgtgaagt

SEQ ID NO: 6186452 - DNA, 20 bp, Homo sapiens
ctgtcagtttgtgaagtgat

SEQ ID NO: 6186453 - DNA, 21 bp, Homo sapiens
ctgtcagtttgtgaagtgatt

SEQ ID NO: 6186454 - DNA, 19 bp, Homo sapiens
ctgtcataagaatgaataa

SEQ ID NO: 6186455 - DNA, 20 bp, Homo sapiens
ctgtcatagggattgtccct

SEQ ID NO: 6186456 - DNA, 16 bp, Homo sapiens
ctgtcatcaattaaag

SEQ ID NO: 6186457 - DNA, 17 bp, Homo sapiens
ctgtcatcccgctcctg

SEQ ID NO: 6186458 - DNA, 20 bp, Homo sapiens
ctgtcatcccgctcctgctg

SEQ ID NO: 6186459 - DNA, 23 bp, Homo sapiens
ctgtcatctaaagtcctggccct

SEQ ID NO: 6186460 - DNA, 15 bp, Homo sapiens
ctgtcatctagcccc

SEQ ID NO: 6186461 - DNA, 16 bp, Homo sapiens
ctgtcatctagcccct

SEQ ID NO: 6186462 - DNA, 17 bp, Homo sapiens
ctgtcatctagcccctt

SEQ ID NO: 6186463 - DNA, 18 bp, Homo sapiens
ctgtcatctagccccttc

SEQ ID NO: 6186464 - DNA, 16 bp, Homo sapiens
ctgtcatctctctggg

SEQ ID NO: 6186465 - DNA, 17 bp, Homo sapiens
ctgtcatctctctgggg

SEQ ID NO: 6186466 - DNA, 14 bp, Homo sapiens
ctgtcatctgaatt

SEQ ID NO: 6186467 - DNA, 17 bp, Homo sapiens
ctgtcatctgagaatga

SEQ ID NO: 6186468 - DNA, 12 bp, Homo sapiens
ctgtcatctgcc

SEQ ID NO: 6186469 - DNA, 13 bp, Homo sapiens
ctgtcatctgcca

SEQ ID NO: 6186470 - DNA, 14 bp, Homo sapiens
ctgtcatctgctgc

SEQ ID NO: 6186471 - DNA, 15 bp, Homo sapiens
ctgtcatctgtgcac

SEQ ID NO: 6186472 - DNA, 14 bp, Homo sapiens
ctgtcatctttctt

SEQ ID NO: 6186473 - DNA, 20 bp, Homo sapiens
ctgtcatgaaatcagcaaga

SEQ ID NO: 6186474 - DNA, 21 bp, Homo sapiens
ctgtcatgcccagcttggagt

SEQ ID NO: 6186475 - DNA, 17 bp, Homo sapiens
ctgtcatgcccccctca

SEQ ID NO: 6186476 - DNA, 18 bp, Homo sapiens
ctgtcatgcccccctcaa

SEQ ID NO: 6186477 - DNA, 16 bp, Homo sapiens
ctgtcatggaaaagcc

SEQ ID NO: 6186478 - DNA, 21 bp, Homo sapiens
ctgtcatggctctgaactgca

SEQ ID NO: 6186479 - DNA, 17 bp, Homo sapiens
ctgtcatggtgcaattt

SEQ ID NO: 6186480 - DNA, 19 bp, Homo sapiens
ctgtcatggtgcaatttgt

SEQ ID NO: 6186481 - DNA, 22 bp, Homo sapiens
ctgtcatggtgcaatttgtctt

SEQ ID NO: 6186482 - DNA, 17 bp, Homo sapiens
ctgtcattatattctaa

SEQ ID NO: 6186483 - DNA, 15 bp, Homo sapiens
ctgtcattatttcct

SEQ ID NO: 6186484 - DNA, 19 bp, Homo sapiens
ctgtcattcaaatgggtga

SEQ ID NO: 6186485 - DNA, 16 bp, Homo sapiens
ctgtcattcagaaaaa

SEQ ID NO: 6186486 - DNA, 13 bp, Homo sapiens
ctgtcattcagga

SEQ ID NO: 6186487 - DNA, 22 bp, Homo sapiens
ctgtcattcaggaccccaaccc

SEQ ID NO: 6186488 - DNA, 23 bp, Homo sapiens
ctgtcattcccaccaccctgagg

SEQ ID NO: 6186489 - DNA, 15 bp, Homo sapiens
ctgtcattgcacata

SEQ ID NO: 6186490 - DNA, 20 bp, Homo sapiens
ctgtcattgcccctccgatg

SEQ ID NO: 6186491 - DNA, 16 bp, Homo sapiens
ctgtcattgcttcttc

SEQ ID NO: 6186492 - DNA, 22 bp, Homo sapiens
ctgtcattggttacaaattttt

SEQ ID NO: 6186493 - DNA, 15 bp, Homo sapiens
ctgtcattgtccatg

SEQ ID NO: 6186494 - DNA, 12 bp, Homo sapiens
ctgtcatttctc

SEQ ID NO: 6186495 - DNA, 21 bp, Homo sapiens
ctgtcatttgagcagggctca

SEQ ID NO: 6186496 - DNA, 23 bp, Homo sapiens
ctgtcatttgagcagggctcagc

SEQ ID NO: 6186497 - DNA, 16 bp, Homo sapiens
ctgtcatttgttgtga

SEQ ID NO: 6186498 - DNA, 15 bp, Homo sapiens
ctgtcattttgcact

SEQ ID NO: 6186499 - DNA, 21 bp, Homo sapiens
ctgtcattttggcatctgcaa

SEQ ID NO: 6186500 - DNA, 16 bp, Homo sapiens
ctgtcattttttttct

SEQ ID NO: 6186501 - DNA, 22 bp, Homo sapiens
ctgtccaaaagcgccctcacta

SEQ ID NO: 6186502 - DNA, 22 bp, Homo sapiens
ctgtccaaacatttcatccgtg

SEQ ID NO: 6186503 - DNA, 17 bp, Homo sapiens
ctgtccaaaggaggctg

SEQ ID NO: 6186504 - DNA, 18 bp, Homo sapiens
ctgtccaaaggaggctgg

SEQ ID NO: 6186505 - DNA, 19 bp, Homo sapiens
ctgtccaaaggaggctggc

SEQ ID NO: 6186506 - DNA, 22 bp, Homo sapiens
ctgtccaaaggaggctggcagg

SEQ ID NO: 6186507 - DNA, 13 bp, Homo sapiens
ctgtccaaattta

SEQ ID NO: 6186508 - DNA, 19 bp, Homo sapiens
ctgtccaaatttaaaatgt

SEQ ID NO: 6186509 - DNA, 23 bp, Homo sapiens
ctgtccaaatttaaaatgtgtgc

SEQ ID NO: 6186510 - DNA, 14 bp, Homo sapiens
ctgtccaacatgtt

SEQ ID NO: 6186511 - DNA, 17 bp, Homo sapiens
ctgtccaaccagacttt

SEQ ID NO: 6186512 - DNA, 18 bp, Homo sapiens
ctgtccaacccctccccc

SEQ ID NO: 6186513 - DNA, 11 bp, Homo sapiens
ctgtccaagga

SEQ ID NO: 6186514 - DNA, 21 bp, Homo sapiens
ctgtccaagtgtttcttgtta

SEQ ID NO: 6186515 - DNA, 17 bp, Homo sapiens
ctgtccaatcacattca

SEQ ID NO: 6186516 - DNA, 18 bp, Homo sapiens
ctgtccaattccagagct

SEQ ID NO: 6186517 - DNA, 18 bp, Homo sapiens
gaaaacattacatgctca

SEQ ID NO: 6186518 - DNA, 17 bp, Homo sapiens
gaaaacattccatcctt

SEQ ID NO: 6186519 - DNA, 18 bp, Homo sapiens
gaaaacattgctttgtgg

SEQ ID NO: 6186520 - DNA, 16 bp, Homo sapiens
gaaaacattgcttttg

SEQ ID NO: 6186521 - DNA, 18 bp, Homo sapiens
gaaaacatttaacataat

SEQ ID NO: 6186522 - DNA, 18 bp, Homo sapiens
gaaaacatttcaagttta

SEQ ID NO: 6186523 - DNA, 14 bp, Homo sapiens
gaaaacattttatt

SEQ ID NO: 6186524 - DNA, 11 bp, Homo sapiens
gaaaaccaaaa

SEQ ID NO: 6186525 - DNA, 18 bp, Homo sapiens
gaaaaccaaaataaaaat

SEQ ID NO: 6186526 - DNA, 19 bp, Homo sapiens
gaaaaccaaaataaaaatt

SEQ ID NO: 6186527 - DNA, 22 bp, Homo sapiens
gaaaaccaaaataaaaattgaa

SEQ ID NO: 6186528 - DNA, 18 bp, Homo sapiens
gaaaaccaaaatgacatc

SEQ ID NO: 6186529 - DNA, 13 bp, Homo sapiens
gaaaaccaaacaa

SEQ ID NO: 6186530 - DNA, 19 bp, Homo sapiens
gaaaaccaaagggtgctag

SEQ ID NO: 6186531 - DNA, 15 bp, Homo sapiens
gaaaaccaacaccat

SEQ ID NO: 6186532 - DNA, 19 bp, Homo sapiens
gaaaaccaagccgtggctt

SEQ ID NO: 6186533 - DNA, 13 bp, Homo sapiens
gaaaaccacagtc

SEQ ID NO: 6186534 - DNA, 19 bp, Homo sapiens
gaaaaccacagtcagtgga

SEQ ID NO: 6186535 - DNA, 18 bp, Homo sapiens
gaaaaccaccccttagat

SEQ ID NO: 6186536 - DNA, 15 bp, Homo sapiens
gaaaaccagctcagc

SEQ ID NO: 6186537 - DNA, 15 bp, Homo sapiens
gaaaaccagtgggtc

SEQ ID NO: 6186538 - DNA, 18 bp, Homo sapiens
gaaaaccatctctgtgat

SEQ ID NO: 6186539 - DNA, 20 bp, Homo sapiens
gaaaaccatctggcctggcc

SEQ ID NO: 6186540 - DNA, 21 bp, Homo sapiens
gaaaaccatctggcctggcct

SEQ ID NO: 6186541 - DNA, 12 bp, Homo sapiens
gaaaacccagag

SEQ ID NO: 6186542 - DNA, 13 bp, Homo sapiens
gaaaacccagaga

SEQ ID NO: 6186543 - DNA, 22 bp, Homo sapiens
gaaaacccagagaggaatcaga

SEQ ID NO: 6186544 - DNA, 20 bp, Homo sapiens
gaaaacccccaaaccagata

SEQ ID NO: 6186545 - DNA, 14 bp, Homo sapiens
gaaaacccccagca

SEQ ID NO: 6186546 - DNA, 11 bp, Homo sapiens
gaaaacccctg

SEQ ID NO: 6186547 - DNA, 19 bp, Homo sapiens
gaaaacccgacaacatttc

SEQ ID NO: 6186548 - DNA, 14 bp, Homo sapiens
gaaaaccctaagtg

SEQ ID NO: 6186549 - DNA, 18 bp, Homo sapiens
gaaaaccctaagtgtgga

SEQ ID NO: 6186550 - DNA, 21 bp, Homo sapiens
gaaaaccctaagtgtggatgt

SEQ ID NO: 6186551 - DNA, 13 bp, Homo sapiens
gaaaacccttccc

SEQ ID NO: 6186552 - DNA, 20 bp, Homo sapiens
gaaaacccttgggccagaag

SEQ ID NO: 6186553 - DNA, 16 bp, Homo sapiens
gaaaaccgtaaagtgc

SEQ ID NO: 6186554 - DNA, 19 bp, Homo sapiens
gaaaaccgtaaagtgcctt

SEQ ID NO: 6186555 - DNA, 15 bp, Homo sapiens
gaaaacctagaaaac

SEQ ID NO: 6186556 - DNA, 23 bp, Homo sapiens
gaaaacctcacttgaaggcccag

SEQ ID NO: 6186557 - DNA, 23 bp, Homo sapiens
gaaaacctcagttggcctctgcc

SEQ ID NO: 6186558 - DNA, 13 bp, Homo sapiens
gaaaacctgttca

SEQ ID NO: 6186559 - DNA, 11 bp, Homo sapiens
gaaaacctttc

SEQ ID NO: 6186560 - DNA, 13 bp, Homo sapiens
gaaaacgaagctc

SEQ ID NO: 6186561 - DNA, 16 bp, Homo sapiens
gaaaacgaagctcatt

SEQ ID NO: 6186562 - DNA, 22 bp, Homo sapiens
gaaaacgggcagtctgctctgc

SEQ ID NO: 6186563 - DNA, 17 bp, Homo sapiens
gaaaacgtcttccttct

SEQ ID NO: 6186564 - DNA, 18 bp, Homo sapiens
gaaaacgtggctgcttca

SEQ ID NO: 6186565 - DNA, 20 bp, Homo sapiens
gaaaacgtggctgcttcaag

SEQ ID NO: 6186566 - DNA, 15 bp, Homo sapiens
gaaaacgttgacccc

SEQ ID NO: 6186567 - DNA, 20 bp, Homo sapiens
gaaaacgttgacccctttcc

SEQ ID NO: 6186568 - DNA, 22 bp, Homo sapiens
gaaaacgttgacccctttcccc

SEQ ID NO: 6186569 - DNA, 18 bp, Homo sapiens
gaaaacgttttattgtgt

SEQ ID NO: 6186570 - DNA, 18 bp, Homo sapiens
gaaaactaaggatttttc

SEQ ID NO: 6186571 - DNA, 17 bp, Homo sapiens
gaaaactaatgtactgt

SEQ ID NO: 6186572 - DNA, 18 bp, Homo sapiens
gaaaactaatgtactgta

SEQ ID NO: 6186573 - DNA, 20 bp, Homo sapiens
gaaaactaatgtactgtaca

SEQ ID NO: 6186574 - DNA, 17 bp, Homo sapiens
gaaaactacaaacgttt

SEQ ID NO: 6186575 - DNA, 19 bp, Homo sapiens
gaaaactacattttaacat

SEQ ID NO: 6186576 - DNA, 20 bp, Homo sapiens
gaaaactagagctctaagcc

SEQ ID NO: 6186577 - DNA, 13 bp, Homo sapiens
gaaaactatacaa

SEQ ID NO: 6186578 - DNA, 20 bp, Homo sapiens
gaaaactattaagatgagca

SEQ ID NO: 6186579 - DNA, 19 bp, Homo sapiens
gaaaactattgagccttgc

SEQ ID NO: 6186580 - DNA, 20 bp, Homo sapiens
gaaaactattgagccttgca

SEQ ID NO: 6186581 - DNA, 14 bp, Homo sapiens
gaaaactattttaa

SEQ ID NO: 6186582 - DNA, 18 bp, Homo sapiens
gaaaactcagaatgaaaa

SEQ ID NO: 6186583 - DNA, 16 bp, Homo sapiens
gaaaactgaaaatcta

SEQ ID NO: 6186584 - DNA, 16 bp, Homo sapiens
gaaaactgacagagga

SEQ ID NO: 6186585 - DNA, 16 bp, Homo sapiens
gaaaactgacatcaga

SEQ ID NO: 6186586 - DNA, 22 bp, Homo sapiens
gaaaactgacatcagatttctt

SEQ ID NO: 6186587 - DNA, 19 bp, Homo sapiens
gaaaactgccacaagcaca

SEQ ID NO: 6186588 - DNA, 21 bp, Homo sapiens
gaaaactgctgataaaatatg

SEQ ID NO: 6186589 - DNA, 19 bp, Homo sapiens
gaaaactggaaatctggat

SEQ ID NO: 6186590 - DNA, 16 bp, Homo sapiens
gaaaactgtaaataca

SEQ ID NO: 6186591 - DNA, 18 bp, Homo sapiens
gaaaactgtaaatatttt

SEQ ID NO: 6186592 - DNA, 18 bp, Homo sapiens
gaaaactgtgcaactttt

SEQ ID NO: 6186593 - DNA, 21 bp, Homo sapiens
gaaaactgtgcaactttttaa

SEQ ID NO: 6186594 - DNA, 22 bp, Homo sapiens
gaaaactgtgcaactttttaaa

SEQ ID NO: 6186595 - DNA, 11 bp, Homo sapiens
gaaaactgtta

SEQ ID NO: 6186596 - DNA, 22 bp, Homo sapiens
gaaaactgttctctttaaaata

SEQ ID NO: 6186597 - DNA, 14 bp, Homo sapiens
gaaaacttagccag

SEQ ID NO: 6186598 - DNA, 12 bp, Homo sapiens
gaaaacttagtt

SEQ ID NO: 6186599 - DNA, 13 bp, Homo sapiens
gaaaacttagttt

SEQ ID NO: 6186600 - DNA, 23 bp, Homo sapiens
gaaaacttatgacctcttccttt

SEQ ID NO: 6186601 - DNA, 10 bp, Homo sapiens
gaaaacttca

SEQ ID NO: 6186602 - DNA, 14 bp, Homo sapiens
gaaaacttcaaagc

SEQ ID NO: 6186603 - DNA, 21 bp, Homo sapiens
gaaaacttcactccaaagaga

SEQ ID NO: 6186604 - DNA, 22 bp, Homo sapiens
gaaaacttcgtaagaacatgtt

SEQ ID NO: 6186605 - DNA, 15 bp, Homo sapiens
gaaaacttgaatctg

SEQ ID NO: 6186606 - DNA, 16 bp, Homo sapiens
gaaaacttgaatctgt

SEQ ID NO: 6186607 - DNA, 19 bp, Homo sapiens
gaaaactttaaaaaatatt

SEQ ID NO: 6186608 - DNA, 15 bp, Homo sapiens
gaaaacttttctcag

SEQ ID NO: 6186609 - DNA, 23 bp, Homo sapiens
gaaaacttttgtaaattattgat

SEQ ID NO: 6186610 - DNA, 21 bp, Homo sapiens
gaaaacttttgttttttgggg

SEQ ID NO: 6186611 - DNA, 12 bp, Homo sapiens
gaaaagaaaaaa

SEQ ID NO: 6186612 - DNA, 18 bp, Homo sapiens
gaaaagaaaaaaaaaaga

SEQ ID NO: 6186613 - DNA, 16 bp, Homo sapiens
gaaaagaaaaaacaac

SEQ ID NO: 6186614 - DNA, 15 bp, Homo sapiens
gaaaagaaaaagaag

SEQ ID NO: 6186615 - DNA, 18 bp, Homo sapiens
gaaaagaaaaatgagcct

SEQ ID NO: 6186616 - DNA, 23 bp, Homo sapiens
gaaaagaaaaatgagcctggcaa

SEQ ID NO: 6186617 - DNA, 16 bp, Homo sapiens
gaaaagaaaacaaaaa

SEQ ID NO: 6186618 - DNA, 16 bp, Homo sapiens
gaaaagaaaacattta

SEQ ID NO: 6186619 - DNA, 22 bp, Homo sapiens
gaaaagaaaccccaaactcagg

SEQ ID NO: 6186620 - DNA, 14 bp, Homo sapiens
gaaaagaaactcta

SEQ ID NO: 6186621 - DNA, 15 bp, Homo sapiens
gaaaagaaagctaca

SEQ ID NO: 6186622 - DNA, 13 bp, Homo sapiens
gaaaagaaaggct

SEQ ID NO: 6186623 - DNA, 21 bp, Homo sapiens
gaaaagaaagtgttttatttt

SEQ ID NO: 6186624 - DNA, 15 bp, Homo sapiens
gaaaagaaataataa

SEQ ID NO: 6186625 - DNA, 13 bp, Homo sapiens
gaaaagaaatcta

SEQ ID NO: 6186626 - DNA, 22 bp, Homo sapiens
gaaaagaaatctatagaaagtg

SEQ ID NO: 6186627 - DNA, 23 bp, Homo sapiens
gaaaagaaatctatagaaagtgt

SEQ ID NO: 6186628 - DNA, 15 bp, Homo sapiens
gaaaagaaatgctaa

SEQ ID NO: 6186629 - DNA, 21 bp, Homo sapiens
gaaaagaaatggtatgtagag

SEQ ID NO: 6186630 - DNA, 12 bp, Homo sapiens
gaaaagaaattg

SEQ ID NO: 6186631 - DNA, 16 bp, Homo sapiens
gaaaagaacaaacaaa

SEQ ID NO: 6186632 - DNA, 19 bp, Homo sapiens
gaaaagaactgtttactgc

SEQ ID NO: 6186633 - DNA, 14 bp, Homo sapiens
gaaaagaagaaact

SEQ ID NO: 6186634 - DNA, 20 bp, Homo sapiens
gaaaagaagctgtcagaagt

SEQ ID NO: 6186635 - DNA, 22 bp, Homo sapiens
gaaaagaagctgtcagaagttt

SEQ ID NO: 6186636 - DNA, 14 bp, Homo sapiens
gaaaagaaggctgc

SEQ ID NO: 6186637 - DNA, 18 bp, Homo sapiens
gaaaagaatacagaaaga

SEQ ID NO: 6186638 - DNA, 14 bp, Homo sapiens
gaaaagaatagaag

SEQ ID NO: 6186639 - DNA, 22 bp, Homo sapiens
gaaaagaatccctgcagcctgg

SEQ ID NO: 6186640 - DNA, 18 bp, Homo sapiens
gaaaagaatgtacattac

SEQ ID NO: 6186641 - DNA, 22 bp, Homo sapiens
gaaaagaattgttgggggtttt

SEQ ID NO: 6186642 - DNA, 20 bp, Homo sapiens
gaaaagacaaacagtagaga

SEQ ID NO: 6186643 - DNA, 21 bp, Homo sapiens
gaaaagacacattttttagga

SEQ ID NO: 6186644 - DNA, 21 bp, Homo sapiens
gaaaagacagggtgggaggga

SEQ ID NO: 6186645 - DNA, 22 bp, Homo sapiens
gaaaagacagggtgggagggag

SEQ ID NO: 6186646 - DNA, 19 bp, Homo sapiens
gaaaagacattgaaagctc

SEQ ID NO: 6186647 - DNA, 20 bp, Homo sapiens
gaaaagacattgaaagctct

SEQ ID NO: 6186648 - DNA, 22 bp, Homo sapiens
gaaaagacattgaaagctctat

SEQ ID NO: 6186649 - DNA, 16 bp, Homo sapiens
gaaaagaccagggctt

SEQ ID NO: 6186650 - DNA, 18 bp, Homo sapiens
gaaaagacctacagacta

SEQ ID NO: 6186651 - DNA, 14 bp, Homo sapiens
gaaaagactccaaa

SEQ ID NO: 6186652 - DNA, 16 bp, Homo sapiens
gaaaagactccaaaga

SEQ ID NO: 6186653 - DNA, 20 bp, Homo sapiens
gaaaagactccaaagaaatg

SEQ ID NO: 6186654 - DNA, 12 bp, Homo sapiens
gaaaagactgac

SEQ ID NO: 6186655 - DNA, 20 bp, Homo sapiens
gaaaagactgtgggtgggga

SEQ ID NO: 6186656 - DNA, 14 bp, Homo sapiens
gaaaagagaaactt

SEQ ID NO: 6186657 - DNA, 14 bp, Homo sapiens
gaaaagagaagaag

SEQ ID NO: 6186658 - DNA, 15 bp, Homo sapiens
gaaaagagaagaaga

SEQ ID NO: 6186659 - DNA, 18 bp, Homo sapiens
gaaaagagagcagagaat

SEQ ID NO: 6186660 - DNA, 21 bp, Homo sapiens
gaaaagagagcagagaatata

SEQ ID NO: 6186661 - DNA, 14 bp, Homo sapiens
gaaaagagatggcc

SEQ ID NO: 6186662 - DNA, 14 bp, Homo sapiens
gaaaagagctggga

SEQ ID NO: 6186663 - DNA, 21 bp, Homo sapiens
gaaaagaggagtttcgaggta

SEQ ID NO: 6186664 - DNA, 21 bp, Homo sapiens
gaaaagaggtggattcctggg

SEQ ID NO: 6186665 - DNA, 15 bp, Homo sapiens
gaaaagagtatgtag

SEQ ID NO: 6186666 - DNA, 17 bp, Homo sapiens
gaaaagagtgagaacta

SEQ ID NO: 6186667 - DNA, 13 bp, Homo sapiens
gaaaagataaacc

SEQ ID NO: 6186668 - DNA, 20 bp, Homo sapiens
gaaaagatatgtattctaat

SEQ ID NO: 6186669 - DNA, 19 bp, Homo sapiens
gaaaagatcccaagatgga

SEQ ID NO: 6186670 - DNA, 16 bp, Homo sapiens
gaaaagatgagaggca

SEQ ID NO: 6186671 - DNA, 20 bp, Homo sapiens
gaaaagatgtacctggtgga

SEQ ID NO: 6186672 - DNA, 19 bp, Homo sapiens
gaaaagatgtagatttatt

SEQ ID NO: 6186673 - DNA, 23 bp, Homo sapiens
gaaaagattcttcttaaaagttt

SEQ ID NO: 6186674 - DNA, 13 bp, Homo sapiens
gaaaagattgcaa

SEQ ID NO: 6186675 - DNA, 16 bp, Homo sapiens
gaaaagattgcaaagg

SEQ ID NO: 6186676 - DNA, 14 bp, Homo sapiens
gaaaagatttaagc

SEQ ID NO: 6186677 - DNA, 17 bp, Homo sapiens
gaaaagattttaatcaa

SEQ ID NO: 6186678 - DNA, 21 bp, Homo sapiens
gaaaagattttatttatggaa

SEQ ID NO: 6186679 - DNA, 19 bp, Homo sapiens
gaaaagcaacttcatttga

SEQ ID NO: 6186680 - DNA, 12 bp, Homo sapiens
gaaaagcaatac

SEQ ID NO: 6186681 - DNA, 16 bp, Homo sapiens
gaaaagcacctgccga

SEQ ID NO: 6186682 - DNA, 16 bp, Homo sapiens
gaaaagcacttaaagt

SEQ ID NO: 6186683 - DNA, 18 bp, Homo sapiens
gaaaagcacttaaagttt

SEQ ID NO: 6186684 - DNA, 12 bp, Homo sapiens
gaaaagcacttt

SEQ ID NO: 6186685 - DNA, 14 bp, Homo sapiens
gaaaagcacttttg

SEQ ID NO: 6186686 - DNA, 20 bp, Homo sapiens
gaaaagcacttttgttattc

SEQ ID NO: 6186687 - DNA, 22 bp, Homo sapiens
gaaaagcagatggacttgaaaa

SEQ ID NO: 6186688 - DNA, 13 bp, Homo sapiens
gaaaagcagcctt

SEQ ID NO: 6186689 - DNA, 17 bp, Homo sapiens
gaaaagcagctctcccc

SEQ ID NO: 6186690 - DNA, 19 bp, Homo sapiens
gaaaagcagtcccattcat

SEQ ID NO: 6186691 - DNA, 19 bp, Homo sapiens
gaaaagcagttctggatgg

SEQ ID NO: 6186692 - DNA, 18 bp, Homo sapiens
gaaaagcatcagaaagag

SEQ ID NO: 6186693 - DNA, 23 bp, Homo sapiens
gaaaagcatcctgtctggcattt

SEQ ID NO: 6186694 - DNA, 12 bp, Homo sapiens
gaaaagccaaag

SEQ ID NO: 6186695 - DNA, 12 bp, Homo sapiens
gaaaagccaagc

SEQ ID NO: 6186696 - DNA, 20 bp, Homo sapiens
ctgtccacacccagctcagc

SEQ ID NO: 6186697 - DNA, 13 bp, Homo sapiens
ctgtccacagccc

SEQ ID NO: 6186698 - DNA, 16 bp, Homo sapiens
ctgtccacatccccag

SEQ ID NO: 6186699 - DNA, 18 bp, Homo sapiens
ctgtccacatccccagag

SEQ ID NO: 6186700 - DNA, 16 bp, Homo sapiens
ctgtccacatctgcct

SEQ ID NO: 6186701 - DNA, 18 bp, Homo sapiens
ctgtccacatctgcctcc

SEQ ID NO: 6186702 - DNA, 16 bp, Homo sapiens
ctgtccaccagcccat

SEQ ID NO: 6186703 - DNA, 13 bp, Homo sapiens
ctgtccaccagtt

SEQ ID NO: 6186704 - DNA, 22 bp, Homo sapiens
ctgtccacccgcccctgcccct

SEQ ID NO: 6186705 - DNA, 23 bp, Homo sapiens
ctgtccaccctgccaagactcct

SEQ ID NO: 6186706 - DNA, 15 bp, Homo sapiens
ctgtccacctcggcc

SEQ ID NO: 6186707 - DNA, 17 bp, Homo sapiens
ctgtccacctgtgctgc

SEQ ID NO: 6186708 - DNA, 20 bp, Homo sapiens
ctgtccacctgtgctgctgc

SEQ ID NO: 6186709 - DNA, 21 bp, Homo sapiens
ctgtccacctgtgctgctgca

SEQ ID NO: 6186710 - DNA, 16 bp, Homo sapiens
ctgtccacgtggagag

SEQ ID NO: 6186711 - DNA, 12 bp, Homo sapiens
ctgtccactctc

SEQ ID NO: 6186712 - DNA, 14 bp, Homo sapiens
ctgtccactctcgg

SEQ ID NO: 6186713 - DNA, 23 bp, Homo sapiens
ctgtccactctcggggcccttgg

SEQ ID NO: 6186714 - DNA, 15 bp, Homo sapiens
ctgtccacttctagc

SEQ ID NO: 6186715 - DNA, 17 bp, Homo sapiens
ctgtccagaaaaagaca

SEQ ID NO: 6186716 - DNA, 12 bp, Homo sapiens
ctgtccagacag

SEQ ID NO: 6186717 - DNA, 18 bp, Homo sapiens
ctgtccagagagagaagt

SEQ ID NO: 6186718 - DNA, 15 bp, Homo sapiens
ctgtccagagtctct

SEQ ID NO: 6186719 - DNA, 21 bp, Homo sapiens
ctgtccagcaggggtctccca

SEQ ID NO: 6186720 - DNA, 19 bp, Homo sapiens
ctgtccagcagtcacttcg

SEQ ID NO: 6186721 - DNA, 12 bp, Homo sapiens
ctgtccagcccc

SEQ ID NO: 6186722 - DNA, 14 bp, Homo sapiens
ctgtccagccccca

SEQ ID NO: 6186723 - DNA, 15 bp, Homo sapiens
ctgtccagcccccag

SEQ ID NO: 6186724 - DNA, 18 bp, Homo sapiens
ctgtccagcccccagtgc

SEQ ID NO: 6186725 - DNA, 22 bp, Homo sapiens
ctgtccagccgtgtgtgcatgt

SEQ ID NO: 6186726 - DNA, 13 bp, Homo sapiens
ctgtccagcctgg

SEQ ID NO: 6186727 - DNA, 20 bp, Homo sapiens
ctgtccagcgatcagccatg

SEQ ID NO: 6186728 - DNA, 21 bp, Homo sapiens
ctgtccagctccaacctgcaa

SEQ ID NO: 6186729 - DNA, 15 bp, Homo sapiens
ctgtccagctttccc

SEQ ID NO: 6186730 - DNA, 16 bp, Homo sapiens
ctgtccaggcactgag

SEQ ID NO: 6186731 - DNA, 19 bp, Homo sapiens
ctgtccaggcactgctgcc

SEQ ID NO: 6186732 - DNA, 22 bp, Homo sapiens
ctgtccaggcactgctgcccag

SEQ ID NO: 6186733 - DNA, 13 bp, Homo sapiens
ctgtccaggcagc

SEQ ID NO: 6186734 - DNA, 18 bp, Homo sapiens
ctgtccaggcagctccct

SEQ ID NO: 6186735 - DNA, 14 bp, Homo sapiens
ctgtccaggccact

SEQ ID NO: 6186736 - DNA, 14 bp, Homo sapiens
ctgtccaggccctt

SEQ ID NO: 6186737 - DNA, 13 bp, Homo sapiens
ctgtccagggccc

SEQ ID NO: 6186738 - DNA, 14 bp, Homo sapiens
ctgtccagggccca

SEQ ID NO: 6186739 - DNA, 13 bp, Homo sapiens
ctgtccagggctt

SEQ ID NO: 6186740 - DNA, 16 bp, Homo sapiens
ctgtccagggcttcag

SEQ ID NO: 6186741 - DNA, 18 bp, Homo sapiens
ctgtccagggcttcagat

SEQ ID NO: 6186742 - DNA, 17 bp, Homo sapiens
ctgtccaggttctgtct

SEQ ID NO: 6186743 - DNA, 15 bp, Homo sapiens
ctgtccagtgcccat

SEQ ID NO: 6186744 - DNA, 16 bp, Homo sapiens
ctgtccagtttccaaa

SEQ ID NO: 6186745 - DNA, 23 bp, Homo sapiens
ctgtccataaagtaattttgtga

SEQ ID NO: 6186746 - DNA, 18 bp, Homo sapiens
ctgtccatccgtctctgt

SEQ ID NO: 6186747 - DNA, 19 bp, Homo sapiens
ctgtccatccgtctctgtc

SEQ ID NO: 6186748 - DNA, 14 bp, Homo sapiens
ctgtccatcctcct

SEQ ID NO: 6186749 - DNA, 17 bp, Homo sapiens
ctgtccatcctcctctc

SEQ ID NO: 6186750 - DNA, 20 bp, Homo sapiens
ctgtccatcctcctctccat

SEQ ID NO: 6186751 - DNA, 21 bp, Homo sapiens
ctgtccatcctcctctccatg

SEQ ID NO: 6186752 - DNA, 12 bp, Homo sapiens
ctgtccatctgc

SEQ ID NO: 6186753 - DNA, 15 bp, Homo sapiens
ctgtccatctgcccg

SEQ ID NO: 6186754 - DNA, 18 bp, Homo sapiens
ctgtccatctgtctgtcc

SEQ ID NO: 6186755 - DNA, 21 bp, Homo sapiens
ctgtccatgtattcacacacc

SEQ ID NO: 6186756 - DNA, 22 bp, Homo sapiens
ctgtccatgtattcacacaccc

SEQ ID NO: 6186757 - DNA, 17 bp, Homo sapiens
ctgtccattgccacggc

SEQ ID NO: 6186758 - DNA, 13 bp, Homo sapiens
ctgtcccaagctc

SEQ ID NO: 6186759 - DNA, 23 bp, Homo sapiens
ctgtcccaatcttaccagatgct

SEQ ID NO: 6186760 - DNA, 16 bp, Homo sapiens
ctgtcccacaaaatat

SEQ ID NO: 6186761 - DNA, 21 bp, Homo sapiens
ctgtcccacaaaatatttcta

SEQ ID NO: 6186762 - DNA, 14 bp, Homo sapiens
ctgtcccaccaact

SEQ ID NO: 6186763 - DNA, 19 bp, Homo sapiens
ctgtcccaccaactctgca

SEQ ID NO: 6186764 - DNA, 16 bp, Homo sapiens
ctgtcccacccacaca

SEQ ID NO: 6186765 - DNA, 17 bp, Homo sapiens
ctgtcccacccctagcc

SEQ ID NO: 6186766 - DNA, 19 bp, Homo sapiens
ctgtcccacccctagccac

SEQ ID NO: 6186767 - DNA, 20 bp, Homo sapiens
ctgtcccacccctagccacc

SEQ ID NO: 6186768 - DNA, 21 bp, Homo sapiens
ctgtcccaccgggagcctccc

SEQ ID NO: 6186769 - DNA, 22 bp, Homo sapiens
ctgtcccaccgggagcctcccc

SEQ ID NO: 6186770 - DNA, 15 bp, Homo sapiens
ctgtcccacctcttc

SEQ ID NO: 6186771 - DNA, 12 bp, Homo sapiens
ctgtcccacctg

SEQ ID NO: 6186772 - DNA, 15 bp, Homo sapiens
ctgtcccacctggct

SEQ ID NO: 6186773 - DNA, 16 bp, Homo sapiens
ctgtcccacctggctc

SEQ ID NO: 6186774 - DNA, 18 bp, Homo sapiens
ctgtcccacctggctccc

SEQ ID NO: 6186775 - DNA, 20 bp, Homo sapiens
ctgtcccacctggctccccc

SEQ ID NO: 6186776 - DNA, 20 bp, Homo sapiens
ctgtcccactacatctggga

SEQ ID NO: 6186777 - DNA, 17 bp, Homo sapiens
ctgtcccactactgtag

SEQ ID NO: 6186778 - DNA, 12 bp, Homo sapiens
ctgtcccactgg

SEQ ID NO: 6186779 - DNA, 14 bp, Homo sapiens
ctgtcccactggct

SEQ ID NO: 6186780 - DNA, 20 bp, Homo sapiens
ctgtcccactggctcctccc

SEQ ID NO: 6186781 - DNA, 21 bp, Homo sapiens
ctgtcccactggctcctccca

SEQ ID NO: 6186782 - DNA, 21 bp, Homo sapiens
ctgtcccagagcttattggcc

SEQ ID NO: 6186783 - DNA, 22 bp, Homo sapiens
ctgtcccagagcttattggcca

SEQ ID NO: 6186784 - DNA, 22 bp, Homo sapiens
ctgtcccagccccggcaagcca

SEQ ID NO: 6186785 - DNA, 13 bp, Homo sapiens
ctgtcccaggact

SEQ ID NO: 6186786 - DNA, 21 bp, Homo sapiens
ctgtcccaggactcaccctcc

SEQ ID NO: 6186787 - DNA, 13 bp, Homo sapiens
ctgtcccaggagc

SEQ ID NO: 6186788 - DNA, 21 bp, Homo sapiens
ctgtcccaggatggtcccagc

SEQ ID NO: 6186789 - DNA, 22 bp, Homo sapiens
ctgtcccaggcagcgccactgt

SEQ ID NO: 6186790 - DNA, 15 bp, Homo sapiens
ctgtcccaggcatgc

SEQ ID NO: 6186791 - DNA, 20 bp, Homo sapiens
ctgtcccaggcatgcagctg

SEQ ID NO: 6186792 - DNA, 23 bp, Homo sapiens
ctgtcccaggcatgcagctgcct

SEQ ID NO: 6186793 - DNA, 12 bp, Homo sapiens
ctgtcccaggcc

SEQ ID NO: 6186794 - DNA, 19 bp, Homo sapiens
ctgtcccaggttatctggg

SEQ ID NO: 6186795 - DNA, 15 bp, Homo sapiens
ctgtcccatgcaggc

SEQ ID NO: 6186796 - DNA, 17 bp, Homo sapiens
ctgtcccatggacactc

SEQ ID NO: 6186797 - DNA, 18 bp, Homo sapiens
ctgtcccatgggctctgg

SEQ ID NO: 6186798 - DNA, 19 bp, Homo sapiens
ctgtcccatgggctctggc

SEQ ID NO: 6186799 - DNA, 15 bp, Homo sapiens
ctgtcccattctaga

SEQ ID NO: 6186800 - DNA, 16 bp, Homo sapiens
ctgtcccattctagat

SEQ ID NO: 6186801 - DNA, 17 bp, Homo sapiens
ctgtcccattctagatc

SEQ ID NO: 6186802 - DNA, 17 bp, Homo sapiens
ctgtcccattctccact

SEQ ID NO: 6186803 - DNA, 22 bp, Homo sapiens
ctgtcccattctccactcactg

SEQ ID NO: 6186804 - DNA, 14 bp, Homo sapiens
ctgtccccaaaatg

SEQ ID NO: 6186805 - DNA, 19 bp, Homo sapiens
ctgtccccaaacaggacag

SEQ ID NO: 6186806 - DNA, 22 bp, Homo sapiens
ctgtccccacctaagcctggtg

SEQ ID NO: 6186807 - DNA, 15 bp, Homo sapiens
ctgtccccacgaggg

SEQ ID NO: 6186808 - DNA, 14 bp, Homo sapiens
ctgtccccactgcc

SEQ ID NO: 6186809 - DNA, 16 bp, Homo sapiens
ctgtccccactgcccc

SEQ ID NO: 6186810 - DNA, 17 bp, Homo sapiens
ctgtccccactgcccca

SEQ ID NO: 6186811 - DNA, 15 bp, Homo sapiens
ctgtccccagccctg

SEQ ID NO: 6186812 - DNA, 20 bp, Homo sapiens
ctgtccccagccctgtcctg

SEQ ID NO: 6186813 - DNA, 13 bp, Homo sapiens
ctgtccccaggcc

SEQ ID NO: 6186814 - DNA, 17 bp, Homo sapiens
ctgtccccaggcccagc

SEQ ID NO: 6186815 - DNA, 17 bp, Homo sapiens
ctgtccccaggcctggc

SEQ ID NO: 6186816 - DNA, 15 bp, Homo sapiens
ctgtccccaggtcct

SEQ ID NO: 6186817 - DNA, 13 bp, Homo sapiens
ctgtccccagtcc

SEQ ID NO: 6186818 - DNA, 21 bp, Homo sapiens
ctgtccccagtccccagccct

SEQ ID NO: 6186819 - DNA, 23 bp, Homo sapiens
ctgtccccagtccccagccctgg

SEQ ID NO: 6186820 - DNA, 15 bp, Homo sapiens
ctgtcccccaacact

SEQ ID NO: 6186821 - DNA, 20 bp, Homo sapiens
ctgtcccccaacactgagca

SEQ ID NO: 6186822 - DNA, 21 bp, Homo sapiens
ctgtcccccacacccgtgtca

SEQ ID NO: 6186823 - DNA, 15 bp, Homo sapiens
ctgtcccccacgtgg

SEQ ID NO: 6186824 - DNA, 17 bp, Homo sapiens
ctgtcccccagctctgg

SEQ ID NO: 6186825 - DNA, 18 bp, Homo sapiens
ctgtcccccagctctggt

SEQ ID NO: 6186826 - DNA, 17 bp, Homo sapiens
ctgtccccctacccacc

SEQ ID NO: 6186827 - DNA, 18 bp, Homo sapiens
ctgtccccctacccaccg

SEQ ID NO: 6186828 - DNA, 15 bp, Homo sapiens
ctgtccccctctcgc

SEQ ID NO: 6186829 - DNA, 22 bp, Homo sapiens
ctgtccccctgagatcagagtc

SEQ ID NO: 6186830 - DNA, 22 bp, Homo sapiens
ctgtcccccttggaggagggct

SEQ ID NO: 6186831 - DNA, 17 bp, Homo sapiens
ctgtccccgcactgggc

SEQ ID NO: 6186832 - DNA, 23 bp, Homo sapiens
ctgtccccgcagccctggcaggg

SEQ ID NO: 6186833 - DNA, 23 bp, Homo sapiens
ctgtccccggcggggtgcctgct

SEQ ID NO: 6186834 - DNA, 17 bp, Homo sapiens
ctgtcccctcacagact

SEQ ID NO: 6186835 - DNA, 22 bp, Homo sapiens
ctgtcccctcacagactcttcc

SEQ ID NO: 6186836 - DNA, 12 bp, Homo sapiens
ctgtcccctcag

SEQ ID NO: 6186837 - DNA, 17 bp, Homo sapiens
ctgtcccctcagctcca

SEQ ID NO: 6186838 - DNA, 20 bp, Homo sapiens
ctgtcccctcagctccagac

SEQ ID NO: 6186839 - DNA, 16 bp, Homo sapiens
ctgtcccctccatctg

SEQ ID NO: 6186840 - DNA, 16 bp, Homo sapiens
ctgtcccctcctcgcc

SEQ ID NO: 6186841 - DNA, 15 bp, Homo sapiens
ctgtcccctctgtca

SEQ ID NO: 6186842 - DNA, 17 bp, Homo sapiens
ctgtcccctgcaagtgg

SEQ ID NO: 6186843 - DNA, 14 bp, Homo sapiens
ctgtcccctgctac

SEQ ID NO: 6186844 - DNA, 15 bp, Homo sapiens
ctgtcccctggggct

SEQ ID NO: 6186845 - DNA, 18 bp, Homo sapiens
ctgtcccctggggctggt

SEQ ID NO: 6186846 - DNA, 19 bp, Homo sapiens
ctgtcccctggggctggtg

SEQ ID NO: 6186847 - DNA, 14 bp, Homo sapiens
ctgtccccttctct

SEQ ID NO: 6186848 - DNA, 19 bp, Homo sapiens
ctgtccccttctctcatct

SEQ ID NO: 6186849 - DNA, 20 bp, Homo sapiens
ctgtccccttctctcatctc

SEQ ID NO: 6186850 - DNA, 21 bp, Homo sapiens
ctgtccccttctctcatctct

SEQ ID NO: 6186851 - DNA, 22 bp, Homo sapiens
ctgtccccttctctcatctctt

SEQ ID NO: 6186852 - DNA, 15 bp, Homo sapiens
ctgtccccttggcag

SEQ ID NO: 6186853 - DNA, 17 bp, Homo sapiens
ctgtcccggagctcagg

SEQ ID NO: 6186854 - DNA, 21 bp, Homo sapiens
ctgtcccggagctcaggccct

SEQ ID NO: 6186855 - DNA, 18 bp, Homo sapiens
ctgtcccggggtcctgtg

SEQ ID NO: 6186856 - DNA, 14 bp, Homo sapiens
ctgtccctaaacat

SEQ ID NO: 6186857 - DNA, 19 bp, Homo sapiens
ctgtccctaccactgagcc

SEQ ID NO: 6186858 - DNA, 21 bp, Homo sapiens
ctgtccctaccactgagccct

SEQ ID NO: 6186859 - DNA, 24 bp, Homo sapiens
ctgtccctaccactgagcccttgc

SEQ ID NO: 6186860 - DNA, 12 bp, Homo sapiens
ctgtccctaccc

SEQ ID NO: 6186861 - DNA, 13 bp, Homo sapiens
ctgtccctaccca

SEQ ID NO: 6186862 - DNA, 14 bp, Homo sapiens
ctgtccctacccac

SEQ ID NO: 6186863 - DNA, 18 bp, Homo sapiens
ctgtccctacccactctt

SEQ ID NO: 6186864 - DNA, 17 bp, Homo sapiens
ctgtccctagctcacac

SEQ ID NO: 6186865 - DNA, 16 bp, Homo sapiens
ctgtccctagggctct

SEQ ID NO: 6186866 - DNA, 24 bp, Homo sapiens
ctgtccctagggctctccaagcac

SEQ ID NO: 6186867 - DNA, 15 bp, Homo sapiens
ctgtccctcaaatga

SEQ ID NO: 6186868 - DNA, 16 bp, Homo sapiens
ctgtccctcacagcac

SEQ ID NO: 6186869 - DNA, 13 bp, Homo sapiens
ctgtccctccagg

SEQ ID NO: 6186870 - DNA, 16 bp, Homo sapiens
ctgtccctccaggccc

SEQ ID NO: 6186871 - DNA, 22 bp, Homo sapiens
ctgtccctccaggcccatctca

SEQ ID NO: 6186872 - DNA, 15 bp, Homo sapiens
ctgtccctcccacct

SEQ ID NO: 6186873 - DNA, 18 bp, Homo sapiens
ctgtccctcccacctctg

SEQ ID NO: 6186874 - DNA, 15 bp, Homo sapiens
ctgtccctcccactc

SEQ ID NO: 6186875 - DNA, 12 bp, Homo sapiens
gaaaagccagat

SEQ ID NO: 6186876 - DNA, 15 bp, Homo sapiens
gaaaagccatatcta

SEQ ID NO: 6186877 - DNA, 16 bp, Homo sapiens
gaaaagccatatctag

SEQ ID NO: 6186878 - DNA, 15 bp, Homo sapiens
gaaaagcccacaggc

SEQ ID NO: 6186879 - DNA, 14 bp, Homo sapiens
gaaaagcccacata

SEQ ID NO: 6186880 - DNA, 12 bp, Homo sapiens
gaaaagcccagt

SEQ ID NO: 6186881 - DNA, 23 bp, Homo sapiens
gaaaagcccccagttaatactcc

SEQ ID NO: 6186882 - DNA, 13 bp, Homo sapiens
gaaaagcctcagc

SEQ ID NO: 6186883 - DNA, 19 bp, Homo sapiens
gaaaagcctctgttttgat

SEQ ID NO: 6186884 - DNA, 17 bp, Homo sapiens
gaaaagcctgaactatt

SEQ ID NO: 6186885 - DNA, 13 bp, Homo sapiens
gaaaagcgcagag

SEQ ID NO: 6186886 - DNA, 20 bp, Homo sapiens
gaaaagcgcgttgtgtatat

SEQ ID NO: 6186887 - DNA, 17 bp, Homo sapiens
gaaaagcgtctttaaga

SEQ ID NO: 6186888 - DNA, 19 bp, Homo sapiens
gaaaagcgtctttaagaga

SEQ ID NO: 6186889 - DNA, 13 bp, Homo sapiens
gaaaagctaagag

SEQ ID NO: 6186890 - DNA, 16 bp, Homo sapiens
gaaaagctaagagaag

SEQ ID NO: 6186891 - DNA, 24 bp, Homo sapiens
gaaaagctagtgtacctcctctca

SEQ ID NO: 6186892 - DNA, 17 bp, Homo sapiens
gaaaagctattagccag

SEQ ID NO: 6186893 - DNA, 22 bp, Homo sapiens
gaaaagctattagccaggatca

SEQ ID NO: 6186894 - DNA, 18 bp, Homo sapiens
gaaaagctgcatttaaat

SEQ ID NO: 6186895 - DNA, 21 bp, Homo sapiens
gaaaagctgcatttaaatcaa

SEQ ID NO: 6186896 - DNA, 17 bp, Homo sapiens
gaaaagctgctgacagt

SEQ ID NO: 6186897 - DNA, 19 bp, Homo sapiens
gaaaagctgctgacagtgt

SEQ ID NO: 6186898 - DNA, 14 bp, Homo sapiens
gaaaagctgtacgc

SEQ ID NO: 6186899 - DNA, 18 bp, Homo sapiens
gaaaagcttcttaattaa

SEQ ID NO: 6186900 - DNA, 22 bp, Homo sapiens
gaaaagcttcttaattaatttg

SEQ ID NO: 6186901 - DNA, 23 bp, Homo sapiens
gaaaagcttcttaattaatttga

SEQ ID NO: 6186902 - DNA, 16 bp, Homo sapiens
gaaaagctttgtttgt

SEQ ID NO: 6186903 - DNA, 19 bp, Homo sapiens
gaaaaggaaaaaaagcaaa

SEQ ID NO: 6186904 - DNA, 15 bp, Homo sapiens
gaaaaggaaaagaaa

SEQ ID NO: 6186905 - DNA, 17 bp, Homo sapiens
gaaaaggaaaagaaaaa

SEQ ID NO: 6186906 - DNA, 18 bp, Homo sapiens
gaaaaggaaaagaaaaaa

SEQ ID NO: 6186907 - DNA, 22 bp, Homo sapiens
gaaaaggaagtttccagaaaag

SEQ ID NO: 6186908 - DNA, 17 bp, Homo sapiens
gaaaaggaatgcaagag

SEQ ID NO: 6186909 - DNA, 13 bp, Homo sapiens
gaaaaggatctaa

SEQ ID NO: 6186910 - DNA, 20 bp, Homo sapiens
gaaaaggatgatggaaaaat

SEQ ID NO: 6186911 - DNA, 12 bp, Homo sapiens
gaaaaggcaaaa

SEQ ID NO: 6186912 - DNA, 16 bp, Homo sapiens
gaaaaggcaaaagact

SEQ ID NO: 6186913 - DNA, 18 bp, Homo sapiens
gaaaaggcaaaagactgg

SEQ ID NO: 6186914 - DNA, 19 bp, Homo sapiens
gaaaaggcaaaagactggt

SEQ ID NO: 6186915 - DNA, 22 bp, Homo sapiens
gaaaaggcacccccgtcaagag

SEQ ID NO: 6186916 - DNA, 21 bp, Homo sapiens
gaaaaggcagcacgtggtttt

SEQ ID NO: 6186917 - DNA, 22 bp, Homo sapiens
gaaaaggcatggagacagcgaa

SEQ ID NO: 6186918 - DNA, 19 bp, Homo sapiens
gaaaaggcttgagtctgga

SEQ ID NO: 6186919 - DNA, 19 bp, Homo sapiens
gaaaagggaaatgtgactg

SEQ ID NO: 6186920 - DNA, 23 bp, Homo sapiens
gaaaagggaaatgtgactggttc

SEQ ID NO: 6186921 - DNA, 18 bp, Homo sapiens
gaaaagggaacaggaaaa

SEQ ID NO: 6186922 - DNA, 22 bp, Homo sapiens
gaaaagggagtttaaaaatggt

SEQ ID NO: 6186923 - DNA, 17 bp, Homo sapiens
gaaaagggatgatggga

SEQ ID NO: 6186924 - DNA, 17 bp, Homo sapiens
gaaaagggcactcccaa

SEQ ID NO: 6186925 - DNA, 19 bp, Homo sapiens
gaaaagggcagaggcaagg

SEQ ID NO: 6186926 - DNA, 16 bp, Homo sapiens
gaaaaggggagagaag

SEQ ID NO: 6186927 - DNA, 19 bp, Homo sapiens
gaaaagggtcttcttggca

SEQ ID NO: 6186928 - DNA, 17 bp, Homo sapiens
gaaaaggtaaggtgaag

SEQ ID NO: 6186929 - DNA, 14 bp, Homo sapiens
gaaaaggtacatgt

SEQ ID NO: 6186930 - DNA, 18 bp, Homo sapiens
gaaaaggtccaaaactgt

SEQ ID NO: 6186931 - DNA, 14 bp, Homo sapiens
gaaaaggtgtaaaa

SEQ ID NO: 6186932 - DNA, 20 bp, Homo sapiens
gaaaaggttcttactgcttg

SEQ ID NO: 6186933 - DNA, 15 bp, Homo sapiens
gaaaaggttgttgtt

SEQ ID NO: 6186934 - DNA, 17 bp, Homo sapiens
gaaaaggtttatgaaaa

SEQ ID NO: 6186935 - DNA, 17 bp, Homo sapiens
gaaaaggttttattttg

SEQ ID NO: 6186936 - DNA, 23 bp, Homo sapiens
gaaaagtaagggaataaattttt

SEQ ID NO: 6186937 - DNA, 14 bp, Homo sapiens
gaaaagtaattttg

SEQ ID NO: 6186938 - DNA, 19 bp, Homo sapiens
gaaaagtaattttgtcaca

SEQ ID NO: 6186939 - DNA, 16 bp, Homo sapiens
gaaaagtacatttaat

SEQ ID NO: 6186940 - DNA, 14 bp, Homo sapiens
gaaaagtagaatta

SEQ ID NO: 6186941 - DNA, 18 bp, Homo sapiens
gaaaagtagaattatatc

SEQ ID NO: 6186942 - DNA, 20 bp, Homo sapiens
gaaaagtagaattatatcta

SEQ ID NO: 6186943 - DNA, 22 bp, Homo sapiens
gaaaagtagaattatatctaat

SEQ ID NO: 6186944 - DNA, 14 bp, Homo sapiens
gaaaagtatgttag

SEQ ID NO: 6186945 - DNA, 12 bp, Homo sapiens
gaaaagtatttt

SEQ ID NO: 6186946 - DNA, 14 bp, Homo sapiens
gaaaagtattttga

SEQ ID NO: 6186947 - DNA, 23 bp, Homo sapiens
gaaaagtattttgaagtttacat

SEQ ID NO: 6186948 - DNA, 21 bp, Homo sapiens
gaaaagtcaaagtgttgctgt

SEQ ID NO: 6186949 - DNA, 16 bp, Homo sapiens
gaaaagtcacacagac

SEQ ID NO: 6186950 - DNA, 21 bp, Homo sapiens
gaaaagtcacacagacacaca

SEQ ID NO: 6186951 - DNA, 11 bp, Homo sapiens
gaaaagtcttc

SEQ ID NO: 6186952 - DNA, 14 bp, Homo sapiens
gaaaagtcttccta

SEQ ID NO: 6186953 - DNA, 16 bp, Homo sapiens
gaaaagtgaattgaag

SEQ ID NO: 6186954 - DNA, 19 bp, Homo sapiens
gaaaagtgatgtattttca

SEQ ID NO: 6186955 - DNA, 14 bp, Homo sapiens
gaaaagtgcaatgc

SEQ ID NO: 6186956 - DNA, 19 bp, Homo sapiens
gaaaagtgcatatttatcc

SEQ ID NO: 6186957 - DNA, 20 bp, Homo sapiens
gaaaagtgcatatttatcca

SEQ ID NO: 6186958 - DNA, 17 bp, Homo sapiens
gaaaagtgcctgagctg

SEQ ID NO: 6186959 - DNA, 20 bp, Homo sapiens
gaaaagtgcttagaaagtta

SEQ ID NO: 6186960 - DNA, 15 bp, Homo sapiens
gaaaagtgggctgca

SEQ ID NO: 6186961 - DNA, 18 bp, Homo sapiens
gaaaagtgggctgcagca

SEQ ID NO: 6186962 - DNA, 12 bp, Homo sapiens
gaaaagtgtcct

SEQ ID NO: 6186963 - DNA, 17 bp, Homo sapiens
gaaaagttaaactaaaa

SEQ ID NO: 6186964 - DNA, 13 bp, Homo sapiens
gaaaagttaacat

SEQ ID NO: 6186965 - DNA, 14 bp, Homo sapiens
gaaaagttagtatt

SEQ ID NO: 6186966 - DNA, 14 bp, Homo sapiens
gaaaagttatttat

SEQ ID NO: 6186967 - DNA, 14 bp, Homo sapiens
gaaaagttgcagat

SEQ ID NO: 6186968 - DNA, 16 bp, Homo sapiens
gaaaagttggaaggat

SEQ ID NO: 6186969 - DNA, 17 bp, Homo sapiens
gaaaagtttaacctaaa

SEQ ID NO: 6186970 - DNA, 21 bp, Homo sapiens
gaaaagtttaatattaaagcc

SEQ ID NO: 6186971 - DNA, 23 bp, Homo sapiens
gaaaagtttagtgtttctttatc

SEQ ID NO: 6186972 - DNA, 14 bp, Homo sapiens
gaaaagtttataaa

SEQ ID NO: 6186973 - DNA, 22 bp, Homo sapiens
gaaaagtttcctaggatgtcat

SEQ ID NO: 6186974 - DNA, 14 bp, Homo sapiens
gaaaagtttgtttt

SEQ ID NO: 6186975 - DNA, 17 bp, Homo sapiens
gaaaataaaaaaaagaa

SEQ ID NO: 6186976 - DNA, 17 bp, Homo sapiens
gaaaataaaaagagaaa

SEQ ID NO: 6186977 - DNA, 14 bp, Homo sapiens
gaaaataaaaagtt

SEQ ID NO: 6186978 - DNA, 16 bp, Homo sapiens
gaaaataaaaagttaa

SEQ ID NO: 6186979 - DNA, 17 bp, Homo sapiens
gaaaataaaaagttaaa

SEQ ID NO: 6186980 - DNA, 14 bp, Homo sapiens
gaaaataaaacaca

SEQ ID NO: 6186981 - DNA, 15 bp, Homo sapiens
gaaaataaaacacac

SEQ ID NO: 6186982 - DNA, 15 bp, Homo sapiens
gaaaataaaactaag

SEQ ID NO: 6186983 - DNA, 18 bp, Homo sapiens
gaaaataaaataaacgaa

SEQ ID NO: 6186984 - DNA, 23 bp, Homo sapiens
gaaaataaaatattcactctcca

SEQ ID NO: 6186985 - DNA, 13 bp, Homo sapiens
gaaaataaaatta

SEQ ID NO: 6186986 - DNA, 14 bp, Homo sapiens
gaaaataaaattaa

SEQ ID NO: 6186987 - DNA, 12 bp, Homo sapiens
gaaaataaagaa

SEQ ID NO: 6186988 - DNA, 20 bp, Homo sapiens
gaaaataaagacaaccatat

SEQ ID NO: 6186989 - DNA, 13 bp, Homo sapiens
gaaaataaagcta

SEQ ID NO: 6186990 - DNA, 20 bp, Homo sapiens
gaaaataaaggaaaatgact

SEQ ID NO: 6186991 - DNA, 21 bp, Homo sapiens
gaaaataaatcttagtgttca

SEQ ID NO: 6186992 - DNA, 14 bp, Homo sapiens
gaaaataaatttaa

SEQ ID NO: 6186993 - DNA, 19 bp, Homo sapiens
gaaaataaattttgaatgt

SEQ ID NO: 6186994 - DNA, 21 bp, Homo sapiens
gaaaataacaagagttttaac

SEQ ID NO: 6186995 - DNA, 15 bp, Homo sapiens
gaaaataactgaacc

SEQ ID NO: 6186996 - DNA, 16 bp, Homo sapiens
gaaaataactgaacca

SEQ ID NO: 6186997 - DNA, 20 bp, Homo sapiens
gaaaataactgaaccaaatt

SEQ ID NO: 6186998 - DNA, 16 bp, Homo sapiens
gaaaataagaaagaat

SEQ ID NO: 6186999 - DNA, 16 bp, Homo sapiens
gaaaataagacttctg

SEQ ID NO: 6187000 - DNA, 19 bp, Homo sapiens
gaaaataagagctcaggat

SEQ ID NO: 6187001 - DNA, 21 bp, Homo sapiens
gaaaataaggcacccatctgt

SEQ ID NO: 6187002 - DNA, 15 bp, Homo sapiens
gaaaataataaaaga

SEQ ID NO: 6187003 - DNA, 21 bp, Homo sapiens
gaaaataatattatttaaact

SEQ ID NO: 6187004 - DNA, 18 bp, Homo sapiens
gaaaataatcattcttat

SEQ ID NO: 6187005 - DNA, 23 bp, Homo sapiens
gaaaataatctggtgttcttgct

SEQ ID NO: 6187006 - DNA, 19 bp, Homo sapiens
gaaaataatgtaattgtaa

SEQ ID NO: 6187007 - DNA, 20 bp, Homo sapiens
gaaaataattgacaggcgaa

SEQ ID NO: 6187008 - DNA, 17 bp, Homo sapiens
gaaaataattgttccaa

SEQ ID NO: 6187009 - DNA, 19 bp, Homo sapiens
gaaaatacaacttaaataa

SEQ ID NO: 6187010 - DNA, 14 bp, Homo sapiens
gaaaatacaataaa

SEQ ID NO: 6187011 - DNA, 13 bp, Homo sapiens
gaaaatacattat

SEQ ID NO: 6187012 - DNA, 15 bp, Homo sapiens
gaaaataccagtgtt

SEQ ID NO: 6187013 - DNA, 16 bp, Homo sapiens
gaaaatacttaaatgt

SEQ ID NO: 6187014 - DNA, 18 bp, Homo sapiens
gaaaatagagatgagctt

SEQ ID NO: 6187015 - DNA, 13 bp, Homo sapiens
gaaaatagcagga

SEQ ID NO: 6187016 - DNA, 18 bp, Homo sapiens
gaaaatagcttttattga

SEQ ID NO: 6187017 - DNA, 15 bp, Homo sapiens
gaaaataggatttgc

SEQ ID NO: 6187018 - DNA, 20 bp, Homo sapiens
gaaaatagggtccttgaaac

SEQ ID NO: 6187019 - DNA, 18 bp, Homo sapiens
gaaaatagggtggacaga

SEQ ID NO: 6187020 - DNA, 22 bp, Homo sapiens
gaaaatagggtggacagaagct

SEQ ID NO: 6187021 - DNA, 20 bp, Homo sapiens
gaaaatagtaaatgctttgt

SEQ ID NO: 6187022 - DNA, 17 bp, Homo sapiens
gaaaatagtgtaagaac

SEQ ID NO: 6187023 - DNA, 23 bp, Homo sapiens
gaaaatagtttattttaaaacaa

SEQ ID NO: 6187024 - DNA, 13 bp, Homo sapiens
gaaaatataaatg

SEQ ID NO: 6187025 - DNA, 19 bp, Homo sapiens
gaaaatataaatgcatgat

SEQ ID NO: 6187026 - DNA, 22 bp, Homo sapiens
gaaaatataaatgcatgatttt

SEQ ID NO: 6187027 - DNA, 16 bp, Homo sapiens
gaaaatataatgatca

SEQ ID NO: 6187028 - DNA, 19 bp, Homo sapiens
gaaaatatacaagtaaatt

SEQ ID NO: 6187029 - DNA, 15 bp, Homo sapiens
gaaaatatactgtaa

SEQ ID NO: 6187030 - DNA, 16 bp, Homo sapiens
gaaaatatactgtaaa

SEQ ID NO: 6187031 - DNA, 21 bp, Homo sapiens
gaaaatatactgtaaagaaag

SEQ ID NO: 6187032 - DNA, 22 bp, Homo sapiens
gaaaatatatattatatacata

SEQ ID NO: 6187033 - DNA, 16 bp, Homo sapiens
gaaaatatatgtattt

SEQ ID NO: 6187034 - DNA, 17 bp, Homo sapiens
gaaaatatatgtatttt

SEQ ID NO: 6187035 - DNA, 13 bp, Homo sapiens
gaaaatatatttg

SEQ ID NO: 6187036 - DNA, 21 bp, Homo sapiens
gaaaatatctcttgtgctttt

SEQ ID NO: 6187037 - DNA, 22 bp, Homo sapiens
gaaaatatctgctcaaaacttt

SEQ ID NO: 6187038 - DNA, 13 bp, Homo sapiens
gaaaatatgatat

SEQ ID NO: 6187039 - DNA, 12 bp, Homo sapiens
gaaaatatgcat

SEQ ID NO: 6187040 - DNA, 15 bp, Homo sapiens
gaaaatatgcatcta

SEQ ID NO: 6187041 - DNA, 23 bp, Homo sapiens
gaaaatatgtccatatctaacca

SEQ ID NO: 6187042 - DNA, 19 bp, Homo sapiens
gaaaatatgtctgcaggtt

SEQ ID NO: 6187043 - DNA, 20 bp, Homo sapiens
gaaaatattctgattggtct

SEQ ID NO: 6187044 - DNA, 13 bp, Homo sapiens
gaaaatatttaaa

SEQ ID NO: 6187045 - DNA, 21 bp, Homo sapiens
gaaaatatttcctgacttgag

SEQ ID NO: 6187046 - DNA, 22 bp, Homo sapiens
gaaaatatttgcacacatttaa

SEQ ID NO: 6187047 - DNA, 18 bp, Homo sapiens
gaaaatatttgtatcaca

SEQ ID NO: 6187048 - DNA, 20 bp, Homo sapiens
gaaaatattttgtctaaaat

SEQ ID NO: 6187049 - DNA, 18 bp, Homo sapiens
gaaaatattttttatata

SEQ ID NO: 6187050 - DNA, 22 bp, Homo sapiens
gaaaatcaaaccgagcagggct

SEQ ID NO: 6187051 - DNA, 15 bp, Homo sapiens
gaaaatcaaatggta

SEQ ID NO: 6187052 - DNA, 15 bp, Homo sapiens
gaaaatcaactttta

SEQ ID NO: 6187053 - DNA, 14 bp, Homo sapiens
gaaaatcacttgaa

SEQ ID NO: 6187054 - DNA, 18 bp, Homo sapiens
gaaaatcactttgtctaa

SEQ ID NO: 6187055 - DNA, 14 bp, Homo sapiens
gaaaatcagcctgc

SEQ ID NO: 6187056 - DNA, 22 bp, Homo sapiens
gaaaatcagcctgctccagctg

SEQ ID NO: 6187057 - DNA, 15 bp, Homo sapiens
gaaaatcagtgacat

SEQ ID NO: 6187058 - DNA, 23 bp, Homo sapiens
gaaaatcagtgacatctgattgg

SEQ ID NO: 6187059 - DNA, 22 bp, Homo sapiens
gaaaatcagttatattctttaa

SEQ ID NO: 6187060 - DNA, 20 bp, Homo sapiens
gaaaatcatcaagaagggct

SEQ ID NO: 6187061 - DNA, 18 bp, Homo sapiens
gaaaatccagcgtgcacc

SEQ ID NO: 6187062 - DNA, 16 bp, Homo sapiens
gaaaatccaggtcatg

SEQ ID NO: 6187063 - DNA, 14 bp, Homo sapiens
gaaaatcctaccaa

SEQ ID NO: 6187064 - DNA, 16 bp, Homo sapiens
gaaaatcctatatctg

SEQ ID NO: 6187065 - DNA, 13 bp, Homo sapiens
gaaaatcctctgg

SEQ ID NO: 6187066 - DNA, 14 bp, Homo sapiens
gaaaatcctctggc

SEQ ID NO: 6187067 - DNA, 20 bp, Homo sapiens
gaaaatcctgaataaaccag

SEQ ID NO: 6187068 - DNA, 14 bp, Homo sapiens
gaaaatccttcagc

SEQ ID NO: 6187069 - DNA, 14 bp, Homo sapiens
gaaaatccttttaa

SEQ ID NO: 6187070 - DNA, 22 bp, Homo sapiens
gaaaatctagaggaaaagaaag

SEQ ID NO: 6187071 - DNA, 15 bp, Homo sapiens
gaaaatctatatttg

SEQ ID NO: 6187072 - DNA, 19 bp, Homo sapiens
gaaaatctatatttgtctt

SEQ ID NO: 6187073 - DNA, 23 bp, Homo sapiens
gaaaatctgaactctaagcagaa

SEQ ID NO: 6187074 - DNA, 20 bp, Homo sapiens
gaaaatctgaattggaatgc

SEQ ID NO: 6187075 - DNA, 19 bp, Homo sapiens
gaaaatcttataatttaaa

SEQ ID NO: 6187076 - DNA, 19 bp, Homo sapiens
gaaaatctttataaatgta

SEQ ID NO: 6187077 - DNA, 20 bp, Homo sapiens
gaaaatgaactgtatattat

SEQ ID NO: 6187078 - DNA, 17 bp, Homo sapiens
gaaaatgaagaaggaag

SEQ ID NO: 6187079 - DNA, 14 bp, Homo sapiens
gaaaatgaagggat

SEQ ID NO: 6187080 - DNA, 12 bp, Homo sapiens
gaaaatgaataa

SEQ ID NO: 6187081 - DNA, 13 bp, Homo sapiens
gaaaatgaataat

SEQ ID NO: 6187082 - DNA, 20 bp, Homo sapiens
gaaaatgaatatctattaat

SEQ ID NO: 6187083 - DNA, 13 bp, Homo sapiens
gaaaatgaatgga

SEQ ID NO: 6187084 - DNA, 21 bp, Homo sapiens
gaaaatgaatggacaaagctc

SEQ ID NO: 6187085 - DNA, 22 bp, Homo sapiens
gaaaatgaatggacaaagctca

SEQ ID NO: 6187086 - DNA, 23 bp, Homo sapiens
gaaaatgaattttgtatgctgaa

SEQ ID NO: 6187087 - DNA, 18 bp, Homo sapiens
gaaaatgacctcaaggaa

SEQ ID NO: 6187088 - DNA, 12 bp, Homo sapiens
gaaaatgactta

SEQ ID NO: 6187089 - DNA, 17 bp, Homo sapiens
gaaaatgacttatttct

SEQ ID NO: 6187090 - DNA, 20 bp, Homo sapiens
gaaaatgactttatttttct

SEQ ID NO: 6187091 - DNA, 23 bp, Homo sapiens
gaaaatgactttatttttctaag

SEQ ID NO: 6187092 - DNA, 15 bp, Homo sapiens
gaaaatgagaaagga

SEQ ID NO: 6187093 - DNA, 17 bp, Homo sapiens
gaaaatgagaaaggaca

SEQ ID NO: 6187094 - DNA, 20 bp, Homo sapiens
gaaaatgagaaaggacagag

SEQ ID NO: 6187095 - DNA, 24 bp, Homo sapiens
gaaaatgagaaaggacagagccag

SEQ ID NO: 6187096 - DNA, 15 bp, Homo sapiens
gaaaatgagaatctg

SEQ ID NO: 6187097 - DNA, 16 bp, Homo sapiens
gaaaatgagaatctgt

SEQ ID NO: 6187098 - DNA, 20 bp, Homo sapiens
gaaaatgagaggagaacagt

SEQ ID NO: 6187099 - DNA, 20 bp, Homo sapiens
gaaaatgagtatttggtcca

SEQ ID NO: 6187100 - DNA, 18 bp, Homo sapiens
gaaaatgagttgtgaaag

SEQ ID NO: 6187101 - DNA, 23 bp, Homo sapiens
gaaaatgagtttttatggggctg

SEQ ID NO: 6187102 - DNA, 17 bp, Homo sapiens
gaaaatgatacagcaga

SEQ ID NO: 6187103 - DNA, 21 bp, Homo sapiens
gaaaatgattcctggacatca

SEQ ID NO: 6187104 - DNA, 18 bp, Homo sapiens
gaaaatgcaacaacatgt

SEQ ID NO: 6187105 - DNA, 20 bp, Homo sapiens
gaaaatgcaacaacatgtat

SEQ ID NO: 6187106 - DNA, 12 bp, Homo sapiens
gaaaatgcattt

SEQ ID NO: 6187107 - DNA, 22 bp, Homo sapiens
gaaaatgcattttcttcagaat

SEQ ID NO: 6187108 - DNA, 22 bp, Homo sapiens
gaaaatgccacattttgcttta

SEQ ID NO: 6187109 - DNA, 22 bp, Homo sapiens
gaaaatgcctcaattcacatag

SEQ ID NO: 6187110 - DNA, 12 bp, Homo sapiens
gaaaatgcctgt

SEQ ID NO: 6187111 - DNA, 20 bp, Homo sapiens
gaaaatgctagaagaaaaca

SEQ ID NO: 6187112 - DNA, 23 bp, Homo sapiens
gaaaatgctgtattagtcacaga

SEQ ID NO: 6187113 - DNA, 14 bp, Homo sapiens
gaaaatgcttcttg

SEQ ID NO: 6187114 - DNA, 14 bp, Homo sapiens
gaaaatgctttctc

SEQ ID NO: 6187115 - DNA, 19 bp, Homo sapiens
gaaaatggaaaatatacaa

SEQ ID NO: 6187116 - DNA, 18 bp, Homo sapiens
gaaaatggaaagaaggaa

SEQ ID NO: 6187117 - DNA, 18 bp, Homo sapiens
gaaaatggaaccaggctt

SEQ ID NO: 6187118 - DNA, 19 bp, Homo sapiens
gaaaatggaagacctaagg

SEQ ID NO: 6187119 - DNA, 19 bp, Homo sapiens
gaaaatggaagtggcaata

SEQ ID NO: 6187120 - DNA, 22 bp, Homo sapiens
gaaaatggaattgcttctgtgt

SEQ ID NO: 6187121 - DNA, 13 bp, Homo sapiens
gaaaatggcagaa

SEQ ID NO: 6187122 - DNA, 15 bp, Homo sapiens
gaaaatggccatgca

SEQ ID NO: 6187123 - DNA, 17 bp, Homo sapiens
gaaaatggctaataaac

SEQ ID NO: 6187124 - DNA, 16 bp, Homo sapiens
gaaaatggctgaagaa

SEQ ID NO: 6187125 - DNA, 23 bp, Homo sapiens
gaaaatggctttctcagccaggc

SEQ ID NO: 6187126 - DNA, 23 bp, Homo sapiens
gaaaatgggatgtgctgttttct

SEQ ID NO: 6187127 - DNA, 18 bp, Homo sapiens
gaaaatggtccaggagaa

SEQ ID NO: 6187128 - DNA, 11 bp, Homo sapiens
gaaaatgtaaa

SEQ ID NO: 6187129 - DNA, 17 bp, Homo sapiens
gaaaatgtaagctgttt

SEQ ID NO: 6187130 - DNA, 13 bp, Homo sapiens
gaaaatgtacatg

SEQ ID NO: 6187131 - DNA, 17 bp, Homo sapiens
gaaaatgtatattttga

SEQ ID NO: 6187132 - DNA, 17 bp, Homo sapiens
gaaaatgtatccagagg

SEQ ID NO: 6187133 - DNA, 22 bp, Homo sapiens
gaaaatgtattcctttaaaata

SEQ ID NO: 6187134 - DNA, 17 bp, Homo sapiens
gaaaatgtattttgcct

SEQ ID NO: 6187135 - DNA, 12 bp, Homo sapiens
gaaaatgtcact

SEQ ID NO: 6187136 - DNA, 14 bp, Homo sapiens
gaaaatgtccagga

SEQ ID NO: 6187137 - DNA, 16 bp, Homo sapiens
gaaaatgtctcagtat

SEQ ID NO: 6187138 - DNA, 18 bp, Homo sapiens
gaaaatgtctcagtattt

SEQ ID NO: 6187139 - DNA, 18 bp, Homo sapiens
gaaaatgtgaccctccaa

SEQ ID NO: 6187140 - DNA, 22 bp, Homo sapiens
gaaaatgtgaccctccaaatgg

SEQ ID NO: 6187141 - DNA, 12 bp, Homo sapiens
gaaaatgtgtct

SEQ ID NO: 6187142 - DNA, 18 bp, Homo sapiens
gaaaatgtgtctgcaaca

SEQ ID NO: 6187143 - DNA, 12 bp, Homo sapiens
gaaaatgtgtgt

SEQ ID NO: 6187144 - DNA, 15 bp, Homo sapiens
gaaaatgttatttaa

SEQ ID NO: 6187145 - DNA, 14 bp, Homo sapiens
gaaaatgttcatca

SEQ ID NO: 6187146 - DNA, 19 bp, Homo sapiens
gaaaatgttcatgttcata

SEQ ID NO: 6187147 - DNA, 21 bp, Homo sapiens
gaaaatgttctgtttgctgtg

SEQ ID NO: 6187148 - DNA, 15 bp, Homo sapiens
gaaaatgttgagaat

SEQ ID NO: 6187149 - DNA, 17 bp, Homo sapiens
gaaaatgttgagaatcc

SEQ ID NO: 6187150 - DNA, 22 bp, Homo sapiens
gaaaatgttttacattccattt

SEQ ID NO: 6187151 - DNA, 13 bp, Homo sapiens
gaaaattaaaata

SEQ ID NO: 6187152 - DNA, 15 bp, Homo sapiens
gaaaattaattctaa

SEQ ID NO: 6187153 - DNA, 16 bp, Homo sapiens
gaaaattaattctaaa

SEQ ID NO: 6187154 - DNA, 18 bp, Homo sapiens
gaaaattaattctaaact

SEQ ID NO: 6187155 - DNA, 18 bp, Homo sapiens
gaaaattacaacagatat

SEQ ID NO: 6187156 - DNA, 14 bp, Homo sapiens
gaaaattagaagca

SEQ ID NO: 6187157 - DNA, 20 bp, Homo sapiens
gaaaattaggcctcaaatga

SEQ ID NO: 6187158 - DNA, 16 bp, Homo sapiens
gaaaattatttgcata

SEQ ID NO: 6187159 - DNA, 14 bp, Homo sapiens
gaaaattattttga

SEQ ID NO: 6187160 - DNA, 17 bp, Homo sapiens
gaaaattcaaaaagtgt

SEQ ID NO: 6187161 - DNA, 12 bp, Homo sapiens
gaaaattcaaca

SEQ ID NO: 6187162 - DNA, 13 bp, Homo sapiens
gaaaattcacaga

SEQ ID NO: 6187163 - DNA, 13 bp, Homo sapiens
gaaaattcactat

SEQ ID NO: 6187164 - DNA, 23 bp, Homo sapiens
gaaaattcagataatggtaattt

SEQ ID NO: 6187165 - DNA, 21 bp, Homo sapiens
gaaaattcatagtaagattga

SEQ ID NO: 6187166 - DNA, 14 bp, Homo sapiens
gaaaattcattttt

SEQ ID NO: 6187167 - DNA, 18 bp, Homo sapiens
gaaaattccagaaaggat

SEQ ID NO: 6187168 - DNA, 20 bp, Homo sapiens
gaaaattccagaaaggatat

SEQ ID NO: 6187169 - DNA, 13 bp, Homo sapiens
gaaaattccctgg

SEQ ID NO: 6187170 - DNA, 17 bp, Homo sapiens
gaaaattctcaagtgat

SEQ ID NO: 6187171 - DNA, 23 bp, Homo sapiens
gaaaattctctcaagacttctcc

SEQ ID NO: 6187172 - DNA, 17 bp, Homo sapiens
gaaaattctggaaggaa

SEQ ID NO: 6187173 - DNA, 13 bp, Homo sapiens
gaaaattctgtgc

SEQ ID NO: 6187174 - DNA, 12 bp, Homo sapiens
gaaaattctgtt

SEQ ID NO: 6187175 - DNA, 17 bp, Homo sapiens
gaaaattcttgagaagt

SEQ ID NO: 6187176 - DNA, 16 bp, Homo sapiens
gaaaattgaaagtatt

SEQ ID NO: 6187177 - DNA, 19 bp, Homo sapiens
gaaaattgaaataaagcta

SEQ ID NO: 6187178 - DNA, 20 bp, Homo sapiens
gaaaattgaatttaacaatg

SEQ ID NO: 6187179 - DNA, 22 bp, Homo sapiens
gaaaattgaatttaacaatgcg

SEQ ID NO: 6187180 - DNA, 21 bp, Homo sapiens
gaaaattgaggtttggaagag

SEQ ID NO: 6187181 - DNA, 15 bp, Homo sapiens
gaaaattgatatttt

SEQ ID NO: 6187182 - DNA, 12 bp, Homo sapiens
gaaaattgcact

SEQ ID NO: 6187183 - DNA, 14 bp, Homo sapiens
gaaaattgcactaa

SEQ ID NO: 6187184 - DNA, 13 bp, Homo sapiens
gaaaattgcatga

SEQ ID NO: 6187185 - DNA, 17 bp, Homo sapiens
gaaaattgcatgaaact

SEQ ID NO: 6187186 - DNA, 12 bp, Homo sapiens
gaaaattgcccc

SEQ ID NO: 6187187 - DNA, 14 bp, Homo sapiens
gaaaattgtatacc

SEQ ID NO: 6187188 - DNA, 12 bp, Homo sapiens
gaaaattgtctg

SEQ ID NO: 6187189 - DNA, 19 bp, Homo sapiens
gaaaatttaaaaattaaag

SEQ ID NO: 6187190 - DNA, 15 bp, Homo sapiens
gaaaatttaattatt

SEQ ID NO: 6187191 - DNA, 20 bp, Homo sapiens
gaaaatttagccctttaaaa

SEQ ID NO: 6187192 - DNA, 11 bp, Homo sapiens
gaaaatttata

SEQ ID NO: 6187193 - DNA, 13 bp, Homo sapiens
gaaaatttatata

SEQ ID NO: 6187194 - DNA, 18 bp, Homo sapiens
gaaaatttgaaaatgtcc

SEQ ID NO: 6187195 - DNA, 20 bp, Homo sapiens
gaaaattttaaaaatacata

SEQ ID NO: 6187196 - DNA, 23 bp, Homo sapiens
gaaaattttaagaagaaagattt

SEQ ID NO: 6187197 - DNA, 20 bp, Homo sapiens
gaaaattttatgtattttaa

SEQ ID NO: 6187198 - DNA, 13 bp, Homo sapiens
gaaaattttgcag

SEQ ID NO: 6187199 - DNA, 14 bp, Homo sapiens
gaaaattttgcaga

SEQ ID NO: 6187200 - DNA, 22 bp, Homo sapiens
gaaaattttgtaaaacaatgcc

SEQ ID NO: 6187201 - DNA, 15 bp, Homo sapiens
gaaaatttttacatt

SEQ ID NO: 6187202 - DNA, 18 bp, Homo sapiens
gaaaatttttacattcat

SEQ ID NO: 6187203 - DNA, 16 bp, Homo sapiens
gaaaatttttgtagta

SEQ ID NO: 6187204 - DNA, 15 bp, Homo sapiens
gaaaatttttgtctt

SEQ ID NO: 6187205 - DNA, 21 bp, Homo sapiens
gaaacaaaaaacaccaaaaat

SEQ ID NO: 6187206 - DNA, 15 bp, Homo sapiens
gaaacaaaaaatatt

SEQ ID NO: 6187207 - DNA, 14 bp, Homo sapiens
gaaacaaaaacact

SEQ ID NO: 6187208 - DNA, 19 bp, Homo sapiens
gaaacaaaaacactaaaaa

SEQ ID NO: 6187209 - DNA, 23 bp, Homo sapiens
gaaacaaaaacactaaaaataaa

SEQ ID NO: 6187210 - DNA, 18 bp, Homo sapiens
gaaacaaaaagagctttc

SEQ ID NO: 6187211 - DNA, 19 bp, Homo sapiens
gaaacaaaaattgtcttta

SEQ ID NO: 6187212 - DNA, 13 bp, Homo sapiens
gaaacaaaataca

SEQ ID NO: 6187213 - DNA, 15 bp, Homo sapiens
gaaacaaaatcctca

SEQ ID NO: 6187214 - DNA, 23 bp, Homo sapiens
gaaacaaacaaaagctgaacaca

SEQ ID NO: 6187215 - DNA, 12 bp, Homo sapiens
gaaacaaagaag

SEQ ID NO: 6187216 - DNA, 13 bp, Homo sapiens
gaaacaaagaagg

SEQ ID NO: 6187217 - DNA, 23 bp, Homo sapiens
gaaacaaagagttcaagaaataa

SEQ ID NO: 6187218 - DNA, 12 bp, Homo sapiens
gaaacaaagatg

SEQ ID NO: 6187219 - DNA, 14 bp, Homo sapiens
gaaacaaagcaaat

SEQ ID NO: 6187220 - DNA, 24 bp, Homo sapiens
gaaacaaagcatttgactttctgt

SEQ ID NO: 6187221 - DNA, 15 bp, Homo sapiens
gaaacaaagcttagc

SEQ ID NO: 6187222 - DNA, 22 bp, Homo sapiens
gaaacaaagcttagcaggagag

SEQ ID NO: 6187223 - DNA, 18 bp, Homo sapiens
gaaacaaagggttttctt

SEQ ID NO: 6187224 - DNA, 19 bp, Homo sapiens
gaaacaaagtggaaggaaa

SEQ ID NO: 6187225 - DNA, 21 bp, Homo sapiens
gaaacaaagtggaaggaaaga

SEQ ID NO: 6187226 - DNA, 17 bp, Homo sapiens
gaaacaaataatcacat

SEQ ID NO: 6187227 - DNA, 15 bp, Homo sapiens
gaaacaaataatttg

SEQ ID NO: 6187228 - DNA, 21 bp, Homo sapiens
gaaacaaataatttgaacttt

SEQ ID NO: 6187229 - DNA, 20 bp, Homo sapiens
gaaacaaatcataatgtatt

SEQ ID NO: 6187230 - DNA, 16 bp, Homo sapiens
gaaacaacaaaggaag

SEQ ID NO: 6187231 - DNA, 21 bp, Homo sapiens
gaaacaacagctttaaaagaa

SEQ ID NO: 6187232 - DNA, 16 bp, Homo sapiens
ctgtccctcccactcc

SEQ ID NO: 6187233 - DNA, 17 bp, Homo sapiens
ctgtccctcccactccc

SEQ ID NO: 6187234 - DNA, 21 bp, Homo sapiens
ctgtccctcccactccctggg

SEQ ID NO: 6187235 - DNA, 18 bp, Homo sapiens
ctgtccctcccttgctga

SEQ ID NO: 6187236 - DNA, 12 bp, Homo sapiens
ctgtccctccgg

SEQ ID NO: 6187237 - DNA, 13 bp, Homo sapiens
ctgtccctcctga

SEQ ID NO: 6187238 - DNA, 15 bp, Homo sapiens
ctgtccctcctgagg

SEQ ID NO: 6187239 - DNA, 14 bp, Homo sapiens
ctgtccctcctggt

SEQ ID NO: 6187240 - DNA, 22 bp, Homo sapiens
ctgtccctccttgagcaccagc

SEQ ID NO: 6187241 - DNA, 22 bp, Homo sapiens
ctgtccctctcagtgccttctc

SEQ ID NO: 6187242 - DNA, 13 bp, Homo sapiens
ctgtccctctcct

SEQ ID NO: 6187243 - DNA, 13 bp, Homo sapiens
ctgtccctctttg

SEQ ID NO: 6187244 - DNA, 16 bp, Homo sapiens
ctgtccctctttgcct

SEQ ID NO: 6187245 - DNA, 18 bp, Homo sapiens
ctgtccctctttgcctgt

SEQ ID NO: 6187246 - DNA, 22 bp, Homo sapiens
ctgtccctctttgcctgtgtga

SEQ ID NO: 6187247 - DNA, 18 bp, Homo sapiens
ctgtccctgcactgtgcc

SEQ ID NO: 6187248 - DNA, 12 bp, Homo sapiens
ctgtccctgccc

SEQ ID NO: 6187249 - DNA, 17 bp, Homo sapiens
ctgtccctgtagctcag

SEQ ID NO: 6187250 - DNA, 15 bp, Homo sapiens
ctgtccctgtcacca

SEQ ID NO: 6187251 - DNA, 13 bp, Homo sapiens
ctgtccctgtcag

SEQ ID NO: 6187252 - DNA, 16 bp, Homo sapiens
ctgtccctgtccctgc

SEQ ID NO: 6187253 - DNA, 20 bp, Homo sapiens
ctgtccctgtgggctcacac

SEQ ID NO: 6187254 - DNA, 22 bp, Homo sapiens
ctgtcccttacgtgagtcctgg

SEQ ID NO: 6187255 - DNA, 14 bp, Homo sapiens
ctgtcccttccact

SEQ ID NO: 6187256 - DNA, 19 bp, Homo sapiens
ctgtcccttgctgttttca

SEQ ID NO: 6187257 - DNA, 19 bp, Homo sapiens
ctgtcccttggaactcttg

SEQ ID NO: 6187258 - DNA, 20 bp, Homo sapiens
ctgtccctttgctcccggca

SEQ ID NO: 6187259 - DNA, 17 bp, Homo sapiens
ctgtccgacagtcaaga

SEQ ID NO: 6187260 - DNA, 15 bp, Homo sapiens
ctgtccgagctttga

SEQ ID NO: 6187261 - DNA, 16 bp, Homo sapiens
ctgtccgcctctgccc

SEQ ID NO: 6187262 - DNA, 19 bp, Homo sapiens
ctgtccgcctctgcccgca

SEQ ID NO: 6187263 - DNA, 20 bp, Homo sapiens
ctgtccgcctctgcccgcag

SEQ ID NO: 6187264 - DNA, 13 bp, Homo sapiens
ctgtccggcccag

SEQ ID NO: 6187265 - DNA, 14 bp, Homo sapiens
ctgtccggcccagt

SEQ ID NO: 6187266 - DNA, 22 bp, Homo sapiens
ctgtccgtagtatcagagatgt

SEQ ID NO: 6187267 - DNA, 16 bp, Homo sapiens
ctgtccgtctgtcctg

SEQ ID NO: 6187268 - DNA, 21 bp, Homo sapiens
ctgtccgtctgtcctgcgcct

SEQ ID NO: 6187269 - DNA, 15 bp, Homo sapiens
ctgtccgtggaaaat

SEQ ID NO: 6187270 - DNA, 14 bp, Homo sapiens
ctgtccgtgtgcct

SEQ ID NO: 6187271 - DNA, 15 bp, Homo sapiens
ctgtccgtgtgcctc

SEQ ID NO: 6187272 - DNA, 19 bp, Homo sapiens
ctgtccgtgtgcctcctgt

SEQ ID NO: 6187273 - DNA, 21 bp, Homo sapiens
ctgtccgttcacatgtgtggt

SEQ ID NO: 6187274 - DNA, 20 bp, Homo sapiens
ctgtcctaaaaataggggcc

SEQ ID NO: 6187275 - DNA, 20 bp, Homo sapiens
ctgtcctaaaccgtcccctc

SEQ ID NO: 6187276 - DNA, 22 bp, Homo sapiens
ctgtcctaaaccgtcccctcct

SEQ ID NO: 6187277 - DNA, 20 bp, Homo sapiens
ctgtcctaaggaaccttcct

SEQ ID NO: 6187278 - DNA, 20 bp, Homo sapiens
ctgtcctaccagttgcccta

SEQ ID NO: 6187279 - DNA, 21 bp, Homo sapiens
ctgtcctaccagttgccctag

SEQ ID NO: 6187280 - DNA, 19 bp, Homo sapiens
ctgtcctaccatcagctct

SEQ ID NO: 6187281 - DNA, 14 bp, Homo sapiens
ctgtcctacccgcc

SEQ ID NO: 6187282 - DNA, 20 bp, Homo sapiens
ctgtcctacctccactctct

SEQ ID NO: 6187283 - DNA, 18 bp, Homo sapiens
ctgtcctactctgtgtca

SEQ ID NO: 6187284 - DNA, 21 bp, Homo sapiens
ctgtcctactctgtgtcaggt

SEQ ID NO: 6187285 - DNA, 18 bp, Homo sapiens
ctgtcctacttctgactt

SEQ ID NO: 6187286 - DNA, 22 bp, Homo sapiens
ctgtcctacttctgactttact

SEQ ID NO: 6187287 - DNA, 23 bp, Homo sapiens
ctgtcctagccaggtctcctggg

SEQ ID NO: 6187288 - DNA, 20 bp, Homo sapiens
ctgtcctagtctcctttgaa

SEQ ID NO: 6187289 - DNA, 22 bp, Homo sapiens
ctgtcctatggagcctctgcag

SEQ ID NO: 6187290 - DNA, 14 bp, Homo sapiens
ctgtcctcaccctg

SEQ ID NO: 6187291 - DNA, 17 bp, Homo sapiens
ctgtcctcaccctgtgg

SEQ ID NO: 6187292 - DNA, 18 bp, Homo sapiens
ctgtcctcaccctgtggg

SEQ ID NO: 6187293 - DNA, 20 bp, Homo sapiens
ctgtcctcaccctgtgggac

SEQ ID NO: 6187294 - DNA, 14 bp, Homo sapiens
ctgtcctcaccgtc

SEQ ID NO: 6187295 - DNA, 15 bp, Homo sapiens
ctgtcctcaccgtct

SEQ ID NO: 6187296 - DNA, 13 bp, Homo sapiens
ctgtcctcactgc

SEQ ID NO: 6187297 - DNA, 14 bp, Homo sapiens
ctgtcctcactgct

SEQ ID NO: 6187298 - DNA, 21 bp, Homo sapiens
ctgtcctcagccttgccagag

SEQ ID NO: 6187299 - DNA, 17 bp, Homo sapiens
ctgtcctcagcttctta

SEQ ID NO: 6187300 - DNA, 12 bp, Homo sapiens
ctgtcctcaggt

SEQ ID NO: 6187301 - DNA, 19 bp, Homo sapiens
ctgtcctcaggtgaataac

SEQ ID NO: 6187302 - DNA, 15 bp, Homo sapiens
ctgtcctcaggtggc

SEQ ID NO: 6187303 - DNA, 15 bp, Homo sapiens
ctgtcctccaacacc

SEQ ID NO: 6187304 - DNA, 15 bp, Homo sapiens
ctgtcctccaagcca

SEQ ID NO: 6187305 - DNA, 13 bp, Homo sapiens
ctgtcctccagct

SEQ ID NO: 6187306 - DNA, 14 bp, Homo sapiens
ctgtcctccagctt

SEQ ID NO: 6187307 - DNA, 13 bp, Homo sapiens
ctgtcctcccaca

SEQ ID NO: 6187308 - DNA, 14 bp, Homo sapiens
ctgtcctcccacag

SEQ ID NO: 6187309 - DNA, 15 bp, Homo sapiens
ctgtcctcccacaga

SEQ ID NO: 6187310 - DNA, 19 bp, Homo sapiens
ctgtcctcccacagacctg

SEQ ID NO: 6187311 - DNA, 18 bp, Homo sapiens
ctgtcctcccatcccctc

SEQ ID NO: 6187312 - DNA, 15 bp, Homo sapiens
ctgtcctccctccac

SEQ ID NO: 6187313 - DNA, 15 bp, Homo sapiens
ctgtcctcctggcac

SEQ ID NO: 6187314 - DNA, 14 bp, Homo sapiens
ctgtcctccttcct

SEQ ID NO: 6187315 - DNA, 17 bp, Homo sapiens
ctgtcctccttcctggg

SEQ ID NO: 6187316 - DNA, 16 bp, Homo sapiens
ctgtcctcctttctta

SEQ ID NO: 6187317 - DNA, 23 bp, Homo sapiens
ctgtcctcgaattttatctgtgg

SEQ ID NO: 6187318 - DNA, 22 bp, Homo sapiens
ctgtcctctcagaactcctgtg

SEQ ID NO: 6187319 - DNA, 18 bp, Homo sapiens
ctgtcctctcatcccagt

SEQ ID NO: 6187320 - DNA, 19 bp, Homo sapiens
ctgtcctctcccctccagc

SEQ ID NO: 6187321 - DNA, 22 bp, Homo sapiens
ctgtcctctcccctccagcctt

SEQ ID NO: 6187322 - DNA, 17 bp, Homo sapiens
ctgtcctctcgagccca

SEQ ID NO: 6187323 - DNA, 20 bp, Homo sapiens
ctgtcctctctggctgggga

SEQ ID NO: 6187324 - DNA, 15 bp, Homo sapiens
ctgtcctctgctttg

SEQ ID NO: 6187325 - DNA, 21 bp, Homo sapiens
ctgtcctcttaagacactagt

SEQ ID NO: 6187326 - DNA, 15 bp, Homo sapiens
ctgtcctcttctgca

SEQ ID NO: 6187327 - DNA, 18 bp, Homo sapiens
ctgtcctcttggccatcc

SEQ ID NO: 6187328 - DNA, 13 bp, Homo sapiens
ctgtcctctttca

SEQ ID NO: 6187329 - DNA, 16 bp, Homo sapiens
ctgtcctctttcagaa

SEQ ID NO: 6187330 - DNA, 18 bp, Homo sapiens
ctgtcctctttcagctcc

SEQ ID NO: 6187331 - DNA, 20 bp, Homo sapiens
ctgtcctctttcagctcctg

SEQ ID NO: 6187332 - DNA, 12 bp, Homo sapiens
ctgtcctctttg

SEQ ID NO: 6187333 - DNA, 15 bp, Homo sapiens
ctgtcctgaaagcgg

SEQ ID NO: 6187334 - DNA, 17 bp, Homo sapiens
ctgtcctgaaagcggct

SEQ ID NO: 6187335 - DNA, 18 bp, Homo sapiens
ctgtcctgaaccgactga

SEQ ID NO: 6187336 - DNA, 15 bp, Homo sapiens
ctgtcctgaaggcct

SEQ ID NO: 6187337 - DNA, 20 bp, Homo sapiens
ctgtcctgacagcactcctc

SEQ ID NO: 6187338 - DNA, 18 bp, Homo sapiens
ctgtcctgacctgtctca

SEQ ID NO: 6187339 - DNA, 22 bp, Homo sapiens
ctgtcctgagccccctgcaccc

SEQ ID NO: 6187340 - DNA, 17 bp, Homo sapiens
ctgtcctgaggagccct

SEQ ID NO: 6187341 - DNA, 12 bp, Homo sapiens
ctgtcctgatct

SEQ ID NO: 6187342 - DNA, 19 bp, Homo sapiens
ctgtcctgatggtcagctc

SEQ ID NO: 6187343 - DNA, 15 bp, Homo sapiens
ctgtcctgcacaccc

SEQ ID NO: 6187344 - DNA, 16 bp, Homo sapiens
ctgtcctgcacaccct

SEQ ID NO: 6187345 - DNA, 19 bp, Homo sapiens
ctgtcctgcacaccctggg

SEQ ID NO: 6187346 - DNA, 21 bp, Homo sapiens
ctgtcctgcacaccctgggcc

SEQ ID NO: 6187347 - DNA, 15 bp, Homo sapiens
ctgtcctgcccgtga

SEQ ID NO: 6187348 - DNA, 12 bp, Homo sapiens
ctgtcctgccta

SEQ ID NO: 6187349 - DNA, 12 bp, Homo sapiens
ctgtcctgcctc

SEQ ID NO: 6187350 - DNA, 17 bp, Homo sapiens
ctgtcctgcctcctcat

SEQ ID NO: 6187351 - DNA, 14 bp, Homo sapiens
ctgtcctgcgttca

SEQ ID NO: 6187352 - DNA, 11 bp, Homo sapiens
ctgtcctgctc

SEQ ID NO: 6187353 - DNA, 12 bp, Homo sapiens
ctgtcctgctca

SEQ ID NO: 6187354 - DNA, 22 bp, Homo sapiens
ctgtcctgctcattatgccact

SEQ ID NO: 6187355 - DNA, 15 bp, Homo sapiens
ctgtcctgctgccct

SEQ ID NO: 6187356 - DNA, 12 bp, Homo sapiens
ctgtcctggaac

SEQ ID NO: 6187357 - DNA, 13 bp, Homo sapiens
ctgtcctggaacc

SEQ ID NO: 6187358 - DNA, 13 bp, Homo sapiens
ctgtcctggagct

SEQ ID NO: 6187359 - DNA, 23 bp, Homo sapiens
ctgtcctggcccgggagccgcag

SEQ ID NO: 6187360 - DNA, 14 bp, Homo sapiens
ctgtcctggctccc

SEQ ID NO: 6187361 - DNA, 15 bp, Homo sapiens
ctgtcctggctgtgc

SEQ ID NO: 6187362 - DNA, 11 bp, Homo sapiens
ctgtcctgggc

SEQ ID NO: 6187363 - DNA, 23 bp, Homo sapiens
ctgtcctgggcatgggtccaggg

SEQ ID NO: 6187364 - DNA, 18 bp, Homo sapiens
ctgtcctgggcgccctgg

SEQ ID NO: 6187365 - DNA, 21 bp, Homo sapiens
ctgtcctgggcgccctggaag

SEQ ID NO: 6187366 - DNA, 22 bp, Homo sapiens
ctgtcctgggggatgcaaataa

SEQ ID NO: 6187367 - DNA, 20 bp, Homo sapiens
ctgtcctggtacagcagggt

SEQ ID NO: 6187368 - DNA, 23 bp, Homo sapiens
ctgtcctggtcagttttcacaga

SEQ ID NO: 6187369 - DNA, 12 bp, Homo sapiens
ctgtcctggtgg

SEQ ID NO: 6187370 - DNA, 19 bp, Homo sapiens
ctgtcctggtggtattttc

SEQ ID NO: 6187371 - DNA, 21 bp, Homo sapiens
ctgtcctggtggtattttcaa

SEQ ID NO: 6187372 - DNA, 17 bp, Homo sapiens
ctgtcctggtgtcactt

SEQ ID NO: 6187373 - DNA, 14 bp, Homo sapiens
ctgtcctgtcatca

SEQ ID NO: 6187374 - DNA, 20 bp, Homo sapiens
ctgtcctgtcatcatcatgg

SEQ ID NO: 6187375 - DNA, 23 bp, Homo sapiens
ctgtcctgtcatcatcatggcca

SEQ ID NO: 6187376 - DNA, 20 bp, Homo sapiens
ctgtcctgtccggagcgacc

SEQ ID NO: 6187377 - DNA, 12 bp, Homo sapiens
ctgtcctgtcct

SEQ ID NO: 6187378 - DNA, 14 bp, Homo sapiens
ctgtcctgtcctgc

SEQ ID NO: 6187379 - DNA, 13 bp, Homo sapiens
ctgtcctgtgaat

SEQ ID NO: 6187380 - DNA, 20 bp, Homo sapiens
ctgtcctgtgaggtttccca

SEQ ID NO: 6187381 - DNA, 21 bp, Homo sapiens
ctgtcctgtgaggtttcccaa

SEQ ID NO: 6187382 - DNA, 21 bp, Homo sapiens
ctgtcctgtggcatgcaaaag

SEQ ID NO: 6187383 - DNA, 16 bp, Homo sapiens
ctgtcctgttgattaa

SEQ ID NO: 6187384 - DNA, 20 bp, Homo sapiens
ctgtcctgttttactggacc

SEQ ID NO: 6187385 - DNA, 18 bp, Homo sapiens
ctgtcctgttttcttagg

SEQ ID NO: 6187386 - DNA, 19 bp, Homo sapiens
ctgtcctgttttcttaggc

SEQ ID NO: 6187387 - DNA, 17 bp, Homo sapiens
ctgtccttaaagccatt

SEQ ID NO: 6187388 - DNA, 21 bp, Homo sapiens
ctgtccttaacccacctctcc

SEQ ID NO: 6187389 - DNA, 20 bp, Homo sapiens
ctgtccttactcagagctgc

SEQ ID NO: 6187390 - DNA, 14 bp, Homo sapiens
ctgtccttcagatg

SEQ ID NO: 6187391 - DNA, 16 bp, Homo sapiens
ctgtccttcagatgga

SEQ ID NO: 6187392 - DNA, 17 bp, Homo sapiens
ctgtccttcagatggaa

SEQ ID NO: 6187393 - DNA, 22 bp, Homo sapiens
ctgtccttcattccgttaggaa

SEQ ID NO: 6187394 - DNA, 12 bp, Homo sapiens
ctgtccttcccc

SEQ ID NO: 6187395 - DNA, 17 bp, Homo sapiens
ctgtccttcccccagca

SEQ ID NO: 6187396 - DNA, 15 bp, Homo sapiens
ctgtccttccccttc

SEQ ID NO: 6187397 - DNA, 20 bp, Homo sapiens
ctgtccttccccttccccgt

SEQ ID NO: 6187398 - DNA, 22 bp, Homo sapiens
ctgtccttctcaggctggcatc

SEQ ID NO: 6187399 - DNA, 15 bp, Homo sapiens
ctgtccttctctcac

SEQ ID NO: 6187400 - DNA, 20 bp, Homo sapiens
ctgtccttgaaggactaata

SEQ ID NO: 6187401 - DNA, 13 bp, Homo sapiens
ctgtccttgccct

SEQ ID NO: 6187402 - DNA, 19 bp, Homo sapiens
ctgtccttggcaactttct

SEQ ID NO: 6187403 - DNA, 23 bp, Homo sapiens
ctgtccttgttcatggagagctg

SEQ ID NO: 6187404 - DNA, 13 bp, Homo sapiens
ctgtcctttctag

SEQ ID NO: 6187405 - DNA, 22 bp, Homo sapiens
ctgtcctttctagagcactgcc

SEQ ID NO: 6187406 - DNA, 13 bp, Homo sapiens
ctgtcctttctcc

SEQ ID NO: 6187407 - DNA, 16 bp, Homo sapiens
ctgtcctttctccagg

SEQ ID NO: 6187408 - DNA, 15 bp, Homo sapiens
ctgtcctttcttgca

SEQ ID NO: 6187409 - DNA, 19 bp, Homo sapiens
ctgtccttttaggaatatg

SEQ ID NO: 6187410 - DNA, 19 bp, Homo sapiens
ctgtcctttttcctctcca

SEQ ID NO: 6187411 - DNA, 14 bp, Homo sapiens
gaaacaacattatt

SEQ ID NO: 6187412 - DNA, 19 bp, Homo sapiens
gaaacaacattattttaaa

SEQ ID NO: 6187413 - DNA, 16 bp, Homo sapiens
gaaacaacatttatat

SEQ ID NO: 6187414 - DNA, 16 bp, Homo sapiens
gaaacaacattttctt

SEQ ID NO: 6187415 - DNA, 16 bp, Homo sapiens
gaaacaaccatgtcat

SEQ ID NO: 6187416 - DNA, 17 bp, Homo sapiens
gaaacaacgttgctatt

SEQ ID NO: 6187417 - DNA, 14 bp, Homo sapiens
gaaacaactcatgt

SEQ ID NO: 6187418 - DNA, 17 bp, Homo sapiens
gaaacaactctttgaga

SEQ ID NO: 6187419 - DNA, 14 bp, Homo sapiens
gaaacaactgccaa

SEQ ID NO: 6187420 - DNA, 14 bp, Homo sapiens
gaaacaacttggaa

SEQ ID NO: 6187421 - DNA, 19 bp, Homo sapiens
gaaacaagacaagctcctc

SEQ ID NO: 6187422 - DNA, 17 bp, Homo sapiens
gaaacaagagaccaact

SEQ ID NO: 6187423 - DNA, 20 bp, Homo sapiens
gaaacaagagaccaactttt

SEQ ID NO: 6187424 - DNA, 22 bp, Homo sapiens
gaaacaagctgtgcaggcatgg

SEQ ID NO: 6187425 - DNA, 13 bp, Homo sapiens
gaaacaaggaagg

SEQ ID NO: 6187426 - DNA, 21 bp, Homo sapiens
gaaacaaggattctacctgaa

SEQ ID NO: 6187427 - DNA, 14 bp, Homo sapiens
gaaacaatactgtt

SEQ ID NO: 6187428 - DNA, 23 bp, Homo sapiens
gaaacaatgtggagtctccctct

SEQ ID NO: 6187429 - DNA, 14 bp, Homo sapiens
gaaacacaatattt

SEQ ID NO: 6187430 - DNA, 18 bp, Homo sapiens
gaaacacacaagcaacaa

SEQ ID NO: 6187431 - DNA, 19 bp, Homo sapiens
gaaacacacagtgaccaag

SEQ ID NO: 6187432 - DNA, 17 bp, Homo sapiens
gaaacacaccaggctgt

SEQ ID NO: 6187433 - DNA, 14 bp, Homo sapiens
gaaacacacgtgct

SEQ ID NO: 6187434 - DNA, 16 bp, Homo sapiens
gaaacacactgaggca

SEQ ID NO: 6187435 - DNA, 14 bp, Homo sapiens
gaaacacacttttg

SEQ ID NO: 6187436 - DNA, 21 bp, Homo sapiens
gaaacacagaactcagcctta

SEQ ID NO: 6187437 - DNA, 15 bp, Homo sapiens
gaaacacagagaagc

SEQ ID NO: 6187438 - DNA, 18 bp, Homo sapiens
gaaacacagcatgcattt

SEQ ID NO: 6187439 - DNA, 19 bp, Homo sapiens
gaaacacagcatgcattta

SEQ ID NO: 6187440 - DNA, 23 bp, Homo sapiens
gaaacacagcatgcatttagcat

SEQ ID NO: 6187441 - DNA, 15 bp, Homo sapiens
gaaacacagctgttc

SEQ ID NO: 6187442 - DNA, 22 bp, Homo sapiens
gaaacacagtcatgtgtcagct

SEQ ID NO: 6187443 - DNA, 19 bp, Homo sapiens
gaaacacataattaacact

SEQ ID NO: 6187444 - DNA, 19 bp, Homo sapiens
gaaacacatcaaataaact

SEQ ID NO: 6187445 - DNA, 14 bp, Homo sapiens
gaaacacatgccag

SEQ ID NO: 6187446 - DNA, 19 bp, Homo sapiens
gaaacaccacttaatcttc

SEQ ID NO: 6187447 - DNA, 19 bp, Homo sapiens
gaaacaccagtgttagctt

SEQ ID NO: 6187448 - DNA, 23 bp, Homo sapiens
gaaacaccattataaaaacactt

SEQ ID NO: 6187449 - DNA, 21 bp, Homo sapiens
gaaacacccctctgtctagga

SEQ ID NO: 6187450 - DNA, 22 bp, Homo sapiens
gaaacacccctctgtctaggac

SEQ ID NO: 6187451 - DNA, 18 bp, Homo sapiens
gaaacaccctcacactgg

SEQ ID NO: 6187452 - DNA, 22 bp, Homo sapiens
gaaacaccctcacactgggact

SEQ ID NO: 6187453 - DNA, 18 bp, Homo sapiens
gaaacaccgagtctctgt

SEQ ID NO: 6187454 - DNA, 15 bp, Homo sapiens
gaaacacgaaacttg

SEQ ID NO: 6187455 - DNA, 16 bp, Homo sapiens
gaaacacgaaacttgt

SEQ ID NO: 6187456 - DNA, 20 bp, Homo sapiens
gaaacacggagtttccattt

SEQ ID NO: 6187457 - DNA, 12 bp, Homo sapiens
gaaacactaaat

SEQ ID NO: 6187458 - DNA, 16 bp, Homo sapiens
gaaacactaaatgtta

SEQ ID NO: 6187459 - DNA, 17 bp, Homo sapiens
gaaacactaaatgttaa

SEQ ID NO: 6187460 - DNA, 18 bp, Homo sapiens
gaaacactaaatgttaaa

SEQ ID NO: 6187461 - DNA, 19 bp, Homo sapiens
gaaacactaaatgttaaag

SEQ ID NO: 6187462 - DNA, 23 bp, Homo sapiens
gaaacactaaatgttaaagatgt

SEQ ID NO: 6187463 - DNA, 14 bp, Homo sapiens
gaaacactaaggct

SEQ ID NO: 6187464 - DNA, 17 bp, Homo sapiens
gaaacactatttgtgac

SEQ ID NO: 6187465 - DNA, 23 bp, Homo sapiens
gaaacactatttgtgacttttta

SEQ ID NO: 6187466 - DNA, 14 bp, Homo sapiens
gaaacactccttgc

SEQ ID NO: 6187467 - DNA, 21 bp, Homo sapiens
gaaacactcgtgtgcatgaga

SEQ ID NO: 6187468 - DNA, 16 bp, Homo sapiens
gaaacactgaaaagaa

SEQ ID NO: 6187469 - DNA, 13 bp, Homo sapiens
gaaacactgactt

SEQ ID NO: 6187470 - DNA, 13 bp, Homo sapiens
gaaacactgcttc

SEQ ID NO: 6187471 - DNA, 13 bp, Homo sapiens
gaaacactggacc

SEQ ID NO: 6187472 - DNA, 14 bp, Homo sapiens
gaaacactggacct

SEQ ID NO: 6187473 - DNA, 22 bp, Homo sapiens
gaaacactgggcttctagaacc

SEQ ID NO: 6187474 - DNA, 15 bp, Homo sapiens
gaaacacttctattt

SEQ ID NO: 6187475 - DNA, 14 bp, Homo sapiens
gaaacactttctct

SEQ ID NO: 6187476 - DNA, 23 bp, Homo sapiens
gaaacactttcttgagcaccagg

SEQ ID NO: 6187477 - DNA, 22 bp, Homo sapiens
gaaacactttgaggacatttat

SEQ ID NO: 6187478 - DNA, 19 bp, Homo sapiens
gaaacactttgcctcctgt

SEQ ID NO: 6187479 - DNA, 13 bp, Homo sapiens
gaaacagaaaaat

SEQ ID NO: 6187480 - DNA, 16 bp, Homo sapiens
gaaacagaaaaataag

SEQ ID NO: 6187481 - DNA, 23 bp, Homo sapiens
gaaacagaagattacaaaagcaa

SEQ ID NO: 6187482 - DNA, 22 bp, Homo sapiens
gaaacagacttgtatattctat

SEQ ID NO: 6187483 - DNA, 16 bp, Homo sapiens
gaaacagagaaagaaa

SEQ ID NO: 6187484 - DNA, 21 bp, Homo sapiens
gaaacagagaaagaaaaggca

SEQ ID NO: 6187485 - DNA, 20 bp, Homo sapiens
gaaacagagaaccctgtggg

SEQ ID NO: 6187486 - DNA, 17 bp, Homo sapiens
gaaacagagacaggccc

SEQ ID NO: 6187487 - DNA, 13 bp, Homo sapiens
gaaacagagagag

SEQ ID NO: 6187488 - DNA, 15 bp, Homo sapiens
gaaacagagagagac

SEQ ID NO: 6187489 - DNA, 23 bp, Homo sapiens
gaaacagaggaccagcacactcc

SEQ ID NO: 6187490 - DNA, 12 bp, Homo sapiens
gaaacagaggct

SEQ ID NO: 6187491 - DNA, 14 bp, Homo sapiens
gaaacagaggtaaa

SEQ ID NO: 6187492 - DNA, 20 bp, Homo sapiens
gaaacagatctcctggcaaa

SEQ ID NO: 6187493 - DNA, 18 bp, Homo sapiens
gaaacagatgaaaagcct

SEQ ID NO: 6187494 - DNA, 17 bp, Homo sapiens
gaaacagatgataaata

SEQ ID NO: 6187495 - DNA, 21 bp, Homo sapiens
gaaacagattcaggccagccc

SEQ ID NO: 6187496 - DNA, 23 bp, Homo sapiens
gaaacagattcaggccagcccag

SEQ ID NO: 6187497 - DNA, 22 bp, Homo sapiens
gaaacagatttaagcaagacca

SEQ ID NO: 6187498 - DNA, 14 bp, Homo sapiens
gaaacagcagctga

SEQ ID NO: 6187499 - DNA, 11 bp, Homo sapiens
gaaacagcatg

SEQ ID NO: 6187500 - DNA, 14 bp, Homo sapiens
gaaacagcatgaat

SEQ ID NO: 6187501 - DNA, 15 bp, Homo sapiens
gaaacagcatgaata

SEQ ID NO: 6187502 - DNA, 21 bp, Homo sapiens
gaaacagccattgcggcccca

SEQ ID NO: 6187503 - DNA, 22 bp, Homo sapiens
gaaacagccattgcggccccag

SEQ ID NO: 6187504 - DNA, 15 bp, Homo sapiens
gaaacagctcagcca

SEQ ID NO: 6187505 - DNA, 15 bp, Homo sapiens
gaaacagctgcctta

SEQ ID NO: 6187506 - DNA, 21 bp, Homo sapiens
gaaacagctttcaagtgcctt

SEQ ID NO: 6187507 - DNA, 18 bp, Homo sapiens
gaaacagctttctgggta

SEQ ID NO: 6187508 - DNA, 22 bp, Homo sapiens
gaaacaggaccacaaaaatgaa

SEQ ID NO: 6187509 - DNA, 17 bp, Homo sapiens
gaaacaggatatgcttt

SEQ ID NO: 6187510 - DNA, 14 bp, Homo sapiens
gaaacaggcccaga

SEQ ID NO: 6187511 - DNA, 14 bp, Homo sapiens
gaaacaggccctct

SEQ ID NO: 6187512 - DNA, 12 bp, Homo sapiens
gaaacagggcag

SEQ ID NO: 6187513 - DNA, 13 bp, Homo sapiens
gaaacagggcagc

SEQ ID NO: 6187514 - DNA, 19 bp, Homo sapiens
gaaacaggtgtgtgtgaac

SEQ ID NO: 6187515 - DNA, 22 bp, Homo sapiens
gaaacaggttgggatgggatag

SEQ ID NO: 6187516 - DNA, 16 bp, Homo sapiens
gaaacagtattttctt

SEQ ID NO: 6187517 - DNA, 22 bp, Homo sapiens
gaaacagtattttcttcccaaa

SEQ ID NO: 6187518 - DNA, 18 bp, Homo sapiens
gaaacagtgggagccctg

SEQ ID NO: 6187519 - DNA, 20 bp, Homo sapiens
gaaacagtgtttgccctttg

SEQ ID NO: 6187520 - DNA, 22 bp, Homo sapiens
gaaacagttccattcaactgga

SEQ ID NO: 6187521 - DNA, 18 bp, Homo sapiens
gaaacagttctcactggg

SEQ ID NO: 6187522 - DNA, 21 bp, Homo sapiens
gaaacagttctcactgggaag

SEQ ID NO: 6187523 - DNA, 17 bp, Homo sapiens
gaaacagttgcatgtag

SEQ ID NO: 6187524 - DNA, 20 bp, Homo sapiens
gaaacagttgcatgtagtaa

SEQ ID NO: 6187525 - DNA, 17 bp, Homo sapiens
gaaacagttgctgtgaa

SEQ ID NO: 6187526 - DNA, 20 bp, Homo sapiens
gaaacagttggtaacttttg

SEQ ID NO: 6187527 - DNA, 18 bp, Homo sapiens
gaaacagtttcttgcttg

SEQ ID NO: 6187528 - DNA, 13 bp, Homo sapiens
gaaacataaataa

SEQ ID NO: 6187529 - DNA, 15 bp, Homo sapiens
gaaacataatttttt

SEQ ID NO: 6187530 - DNA, 19 bp, Homo sapiens
gaaacatagaaacatacac

SEQ ID NO: 6187531 - DNA, 17 bp, Homo sapiens
gaaacatagaaagacat

SEQ ID NO: 6187532 - DNA, 19 bp, Homo sapiens
gaaacatcagttactctga

SEQ ID NO: 6187533 - DNA, 16 bp, Homo sapiens
gaaacatctgatttct

SEQ ID NO: 6187534 - DNA, 14 bp, Homo sapiens
gaaacatgaaacaa

SEQ ID NO: 6187535 - DNA, 18 bp, Homo sapiens
gaaacatgggctgtgatt

SEQ ID NO: 6187536 - DNA, 20 bp, Homo sapiens
gaaacatggttgtaatatgc

SEQ ID NO: 6187537 - DNA, 16 bp, Homo sapiens
gaaacatgtgcccctg

SEQ ID NO: 6187538 - DNA, 17 bp, Homo sapiens
gaaacatgttgatttag

SEQ ID NO: 6187539 - DNA, 21 bp, Homo sapiens
gaaacatgttgccaaaatggt

SEQ ID NO: 6187540 - DNA, 22 bp, Homo sapiens
gaaacattcacacagggctctt

SEQ ID NO: 6187541 - DNA, 18 bp, Homo sapiens
gaaacattccgaagaggg

SEQ ID NO: 6187542 - DNA, 16 bp, Homo sapiens
gaaacattctttccta

SEQ ID NO: 6187543 - DNA, 16 bp, Homo sapiens
gaaacattgcttttaa

SEQ ID NO: 6187544 - DNA, 21 bp, Homo sapiens
gaaacattgcttttaaaacta

SEQ ID NO: 6187545 - DNA, 14 bp, Homo sapiens
gaaacattggaagc

SEQ ID NO: 6187546 - DNA, 19 bp, Homo sapiens
gaaacattggcataatttt

SEQ ID NO: 6187547 - DNA, 20 bp, Homo sapiens
gaaacattggcataattttt

SEQ ID NO: 6187548 - DNA, 17 bp, Homo sapiens
gaaacatttcctttgaa

SEQ ID NO: 6187549 - DNA, 13 bp, Homo sapiens
gaaacatttgaca

SEQ ID NO: 6187550 - DNA, 18 bp, Homo sapiens
gaaacatttgacacataa

SEQ ID NO: 6187551 - DNA, 23 bp, Homo sapiens
gaaacatttgacacataaaagta

SEQ ID NO: 6187552 - DNA, 13 bp, Homo sapiens
gaaacattttcat

SEQ ID NO: 6187553 - DNA, 13 bp, Homo sapiens
gaaacattttctt

SEQ ID NO: 6187554 - DNA, 19 bp, Homo sapiens
gaaacattttgatttcctc

SEQ ID NO: 6187555 - DNA, 13 bp, Homo sapiens
gaaaccaaaacat

SEQ ID NO: 6187556 - DNA, 15 bp, Homo sapiens
gaaaccaaagaagaa

SEQ ID NO: 6187557 - DNA, 16 bp, Homo sapiens
gaaaccaaagaagaaa

SEQ ID NO: 6187558 - DNA, 15 bp, Homo sapiens
gaaaccaaagccagg

SEQ ID NO: 6187559 - DNA, 17 bp, Homo sapiens
gaaaccaaagtctgccg

SEQ ID NO: 6187560 - DNA, 17 bp, Homo sapiens
gaaaccaacaagaacca

SEQ ID NO: 6187561 - DNA, 18 bp, Homo sapiens
gaaaccaagtcaggccag

SEQ ID NO: 6187562 - DNA, 20 bp, Homo sapiens
gaaaccaagtcaggccaggt

SEQ ID NO: 6187563 - DNA, 21 bp, Homo sapiens
gaaaccaagtcaggccaggtg

SEQ ID NO: 6187564 - DNA, 18 bp, Homo sapiens
gaaaccaagtgggctggt

SEQ ID NO: 6187565 - DNA, 18 bp, Homo sapiens
gaaaccaatcaagataaa

SEQ ID NO: 6187566 - DNA, 19 bp, Homo sapiens
gaaaccaattaagcagctt

SEQ ID NO: 6187567 - DNA, 18 bp, Homo sapiens
gaaaccacaaccttgcag

SEQ ID NO: 6187568 - DNA, 17 bp, Homo sapiens
gaaaccacacttcttga

SEQ ID NO: 6187569 - DNA, 15 bp, Homo sapiens
gaaaccacagctgct

SEQ ID NO: 6187570 - DNA, 18 bp, Homo sapiens
gaaaccacagctgctgga

SEQ ID NO: 6187571 - DNA, 17 bp, Homo sapiens
gaaaccacaggcccttg

SEQ ID NO: 6187572 - DNA, 22 bp, Homo sapiens
gaaaccacaggcccttggggtt

SEQ ID NO: 6187573 - DNA, 22 bp, Homo sapiens
gaaaccaccgtgaaccagaggg

SEQ ID NO: 6187574 - DNA, 19 bp, Homo sapiens
gaaaccaccttaaaacatt

SEQ ID NO: 6187575 - DNA, 18 bp, Homo sapiens
gaaaccagagtctgtatt

SEQ ID NO: 6187576 - DNA, 21 bp, Homo sapiens
gaaaccagcttccttcagaga

SEQ ID NO: 6187577 - DNA, 22 bp, Homo sapiens
gaaaccagcttccttcagagag

SEQ ID NO: 6187578 - DNA, 17 bp, Homo sapiens
gaaaccatcctctccct

SEQ ID NO: 6187579 - DNA, 14 bp, Homo sapiens
gaaaccatgacaaa

SEQ ID NO: 6187580 - DNA, 23 bp, Homo sapiens
gaaaccatgtagcagtgagtcat

SEQ ID NO: 6187581 - DNA, 21 bp, Homo sapiens
gaaaccattatgaagaagaga

SEQ ID NO: 6187582 - DNA, 17 bp, Homo sapiens
gaaaccattgttcagaa

SEQ ID NO: 6187583 - DNA, 17 bp, Homo sapiens
gaaacccaaagccctgg

SEQ ID NO: 6187584 - DNA, 20 bp, Homo sapiens
gaaacccaaagccctggtaa

SEQ ID NO: 6187585 - DNA, 13 bp, Homo sapiens
gaaacccaagctc

SEQ ID NO: 6187586 - DNA, 23 bp, Homo sapiens
gaaacccaagctcctcctcggaa

SEQ ID NO: 6187587 - DNA, 12 bp, Homo sapiens
gaaacccacagt

SEQ ID NO: 6187588 - DNA, 19 bp, Homo sapiens
ctgtcgagaaacagcctgt

SEQ ID NO: 6187589 - DNA, 21 bp, Homo sapiens
ctgtcgatgagactgtttatt

SEQ ID NO: 6187590 - DNA, 19 bp, Homo sapiens
ctgtcgattagactggaca

SEQ ID NO: 6187591 - DNA, 16 bp, Homo sapiens
ctgtcgcatctcagcg

SEQ ID NO: 6187592 - DNA, 15 bp, Homo sapiens
ctgtcgccacacgcc

SEQ ID NO: 6187593 - DNA, 15 bp, Homo sapiens
ctgtcgcccaggctg

SEQ ID NO: 6187594 - DNA, 13 bp, Homo sapiens
ctgtcgcccagtg

SEQ ID NO: 6187595 - DNA, 17 bp, Homo sapiens
ctgtcgccccaggccct

SEQ ID NO: 6187596 - DNA, 14 bp, Homo sapiens
ctgtcgcccctcct

SEQ ID NO: 6187597 - DNA, 14 bp, Homo sapiens
ctgtcgctgcctcc

SEQ ID NO: 6187598 - DNA, 15 bp, Homo sapiens
ctgtcgctgggctgt

SEQ ID NO: 6187599 - DNA, 14 bp, Homo sapiens
ctgtcggagaggct

SEQ ID NO: 6187600 - DNA, 15 bp, Homo sapiens
ctgtcggagaggctg

SEQ ID NO: 6187601 - DNA, 23 bp, Homo sapiens
ctgtcggagccctgtctcctctc

SEQ ID NO: 6187602 - DNA, 17 bp, Homo sapiens
ctgtcggaggaaagaca

SEQ ID NO: 6187603 - DNA, 17 bp, Homo sapiens
ctgtcggccacacccca

SEQ ID NO: 6187604 - DNA, 21 bp, Homo sapiens
ctgtcggccacaccccagact

SEQ ID NO: 6187605 - DNA, 22 bp, Homo sapiens
ctgtcggcgctgccccatctcc

SEQ ID NO: 6187606 - DNA, 23 bp, Homo sapiens
ctgtcggcgctgccccatctccc

SEQ ID NO: 6187607 - DNA, 13 bp, Homo sapiens
ctgtcgggaccac

SEQ ID NO: 6187608 - DNA, 18 bp, Homo sapiens
ctgtcgggggctgtggat

SEQ ID NO: 6187609 - DNA, 17 bp, Homo sapiens
ctgtcggggtcaagctg

SEQ ID NO: 6187610 - DNA, 20 bp, Homo sapiens
ctgtcgtctgactctgggtt

SEQ ID NO: 6187611 - DNA, 21 bp, Homo sapiens
ctgtcgtgatggggcaagggc

SEQ ID NO: 6187612 - DNA, 17 bp, Homo sapiens
ctgtcgtggtagcagat

SEQ ID NO: 6187613 - DNA, 16 bp, Homo sapiens
ctgtctaaagccttaa

SEQ ID NO: 6187614 - DNA, 18 bp, Homo sapiens
ctgtctaaagccttaact

SEQ ID NO: 6187615 - DNA, 19 bp, Homo sapiens
ctgtctaaagccttaacta

SEQ ID NO: 6187616 - DNA, 18 bp, Homo sapiens
ctgtctaaagtgggaaag

SEQ ID NO: 6187617 - DNA, 20 bp, Homo sapiens
ctgtctaacttggggaaggg

SEQ ID NO: 6187618 - DNA, 21 bp, Homo sapiens
ctgtctaagcaatacttagga

SEQ ID NO: 6187619 - DNA, 21 bp, Homo sapiens
ctgtctacagtagctgctacc

SEQ ID NO: 6187620 - DNA, 14 bp, Homo sapiens
ctgtctacatttct

SEQ ID NO: 6187621 - DNA, 20 bp, Homo sapiens
ctgtctacatttctgcagat

SEQ ID NO: 6187622 - DNA, 15 bp, Homo sapiens
ctgtctaccatctcc

SEQ ID NO: 6187623 - DNA, 15 bp, Homo sapiens
ctgtctactgtggtg

SEQ ID NO: 6187624 - DNA, 20 bp, Homo sapiens
ctgtctactgtggtgatctg

SEQ ID NO: 6187625 - DNA, 18 bp, Homo sapiens
ctgtctactttctcttgt

SEQ ID NO: 6187626 - DNA, 20 bp, Homo sapiens
ctgtctactttctcttgttt

SEQ ID NO: 6187627 - DNA, 17 bp, Homo sapiens
ctgtctagaatcctgct

SEQ ID NO: 6187628 - DNA, 21 bp, Homo sapiens
ctgtctagaatcctgctttac

SEQ ID NO: 6187629 - DNA, 13 bp, Homo sapiens
ctgtctagaatgt

SEQ ID NO: 6187630 - DNA, 15 bp, Homo sapiens
ctgtctagaatgtgg

SEQ ID NO: 6187631 - DNA, 16 bp, Homo sapiens
ctgtctagaatgtgga

SEQ ID NO: 6187632 - DNA, 13 bp, Homo sapiens
ctgtctagagagg

SEQ ID NO: 6187633 - DNA, 17 bp, Homo sapiens
ctgtctagagagggagg

SEQ ID NO: 6187634 - DNA, 23 bp, Homo sapiens
ctgtctagcacttccttgccagt

SEQ ID NO: 6187635 - DNA, 18 bp, Homo sapiens
ctgtctagcatgccaaca

SEQ ID NO: 6187636 - DNA, 21 bp, Homo sapiens
ctgtctagcatgccaacaaga

SEQ ID NO: 6187637 - DNA, 15 bp, Homo sapiens
ctgtctagccactcc

SEQ ID NO: 6187638 - DNA, 20 bp, Homo sapiens
ctgtctagccactccctccc

SEQ ID NO: 6187639 - DNA, 14 bp, Homo sapiens
ctgtctagccttag

SEQ ID NO: 6187640 - DNA, 18 bp, Homo sapiens
ctgtctaggaaggtgtga

SEQ ID NO: 6187641 - DNA, 18 bp, Homo sapiens
ctgtctaggactgcagtg

SEQ ID NO: 6187642 - DNA, 19 bp, Homo sapiens
ctgtctaggactgcagtgt

SEQ ID NO: 6187643 - DNA, 20 bp, Homo sapiens
ctgtctaggactgcagtgtg

SEQ ID NO: 6187644 - DNA, 21 bp, Homo sapiens
ctgtctaggtcagtacccacc

SEQ ID NO: 6187645 - DNA, 16 bp, Homo sapiens
ctgtctagtctctcct

SEQ ID NO: 6187646 - DNA, 16 bp, Homo sapiens
ctgtctatgcagcctg

SEQ ID NO: 6187647 - DNA, 21 bp, Homo sapiens
ctgtctatgcagcctgctctt

SEQ ID NO: 6187648 - DNA, 16 bp, Homo sapiens
ctgtctattgtcacat

SEQ ID NO: 6187649 - DNA, 15 bp, Homo sapiens
ctgtctatttctgct

SEQ ID NO: 6187650 - DNA, 16 bp, Homo sapiens
ctgtctatttctgctg

SEQ ID NO: 6187651 - DNA, 13 bp, Homo sapiens
ctgtctcaaaaaa

SEQ ID NO: 6187652 - DNA, 16 bp, Homo sapiens
ctgtctcaaaaaaaga

SEQ ID NO: 6187653 - DNA, 18 bp, Homo sapiens
ctgtctcaaaaaaagaaa

SEQ ID NO: 6187654 - DNA, 19 bp, Homo sapiens
ctgtctcaagagggcactg

SEQ ID NO: 6187655 - DNA, 14 bp, Homo sapiens
ctgtctcacctgga

SEQ ID NO: 6187656 - DNA, 20 bp, Homo sapiens
ctgtctcactcgttctgtta

SEQ ID NO: 6187657 - DNA, 23 bp, Homo sapiens
ctgtctcactttttacccagaac

SEQ ID NO: 6187658 - DNA, 14 bp, Homo sapiens
ctgtctcagacttt

SEQ ID NO: 6187659 - DNA, 20 bp, Homo sapiens
ctgtctcagacttttgtaca

SEQ ID NO: 6187660 - DNA, 14 bp, Homo sapiens
ctgtctcagattgg

SEQ ID NO: 6187661 - DNA, 16 bp, Homo sapiens
ctgtctcagcctcctg

SEQ ID NO: 6187662 - DNA, 17 bp, Homo sapiens
ctgtctcagcctcctga

SEQ ID NO: 6187663 - DNA, 15 bp, Homo sapiens
ctgtctcagtgattc

SEQ ID NO: 6187664 - DNA, 18 bp, Homo sapiens
ctgtctcatcacataaaa

SEQ ID NO: 6187665 - DNA, 17 bp, Homo sapiens
ctgtctcatccatcatc

SEQ ID NO: 6187666 - DNA, 19 bp, Homo sapiens
ctgtctcatccccaggggt

SEQ ID NO: 6187667 - DNA, 16 bp, Homo sapiens
ctgtctcatcctcctg

SEQ ID NO: 6187668 - DNA, 16 bp, Homo sapiens
ctgtctcatcttctga

SEQ ID NO: 6187669 - DNA, 15 bp, Homo sapiens
ctgtctccactgtgc

SEQ ID NO: 6187670 - DNA, 13 bp, Homo sapiens
ctgtctccagacc

SEQ ID NO: 6187671 - DNA, 16 bp, Homo sapiens
ctgtctccagaccccc

SEQ ID NO: 6187672 - DNA, 18 bp, Homo sapiens
ctgtctccagacccccac

SEQ ID NO: 6187673 - DNA, 19 bp, Homo sapiens
ctgtctccagacccccacc

SEQ ID NO: 6187674 - DNA, 13 bp, Homo sapiens
ctgtctccagctg

SEQ ID NO: 6187675 - DNA, 14 bp, Homo sapiens
ctgtctccagctgc

SEQ ID NO: 6187676 - DNA, 18 bp, Homo sapiens
ctgtctccagctgcctgg

SEQ ID NO: 6187677 - DNA, 19 bp, Homo sapiens
ctgtctccagctgcctggg

SEQ ID NO: 6187678 - DNA, 20 bp, Homo sapiens
ctgtctccagctgcctgggc

SEQ ID NO: 6187679 - DNA, 13 bp, Homo sapiens
ctgtctccaggca

SEQ ID NO: 6187680 - DNA, 15 bp, Homo sapiens
ctgtctccaggcagt

SEQ ID NO: 6187681 - DNA, 21 bp, Homo sapiens
ctgtctccatcgtctcatcct

SEQ ID NO: 6187682 - DNA, 16 bp, Homo sapiens
ctgtctccatgctgga

SEQ ID NO: 6187683 - DNA, 20 bp, Homo sapiens
ctgtctccatggccctgcaa

SEQ ID NO: 6187684 - DNA, 17 bp, Homo sapiens
ctgtctcccaccctttc

SEQ ID NO: 6187685 - DNA, 13 bp, Homo sapiens
ctgtctcccacgt

SEQ ID NO: 6187686 - DNA, 22 bp, Homo sapiens
ctgtctcccaggctggagtgca

SEQ ID NO: 6187687 - DNA, 19 bp, Homo sapiens
ctgtctcccagggacatgt

SEQ ID NO: 6187688 - DNA, 21 bp, Homo sapiens
ctgtctccctagggaattcct

SEQ ID NO: 6187689 - DNA, 22 bp, Homo sapiens
ctgtctccctccccaaatggct

SEQ ID NO: 6187690 - DNA, 13 bp, Homo sapiens
ctgtctccctcct

SEQ ID NO: 6187691 - DNA, 17 bp, Homo sapiens
ctgtctccctgaagagt

SEQ ID NO: 6187692 - DNA, 13 bp, Homo sapiens
ctgtctcccttct

SEQ ID NO: 6187693 - DNA, 14 bp, Homo sapiens
ctgtctcccttctc

SEQ ID NO: 6187694 - DNA, 15 bp, Homo sapiens
ctgtctcccttctct

SEQ ID NO: 6187695 - DNA, 13 bp, Homo sapiens
ctgtctcctagga

SEQ ID NO: 6187696 - DNA, 12 bp, Homo sapiens
ctgtctcctggc

SEQ ID NO: 6187697 - DNA, 18 bp, Homo sapiens
ctgtctcctggtctgtgc

SEQ ID NO: 6187698 - DNA, 15 bp, Homo sapiens
ctgtctccttcccac

SEQ ID NO: 6187699 - DNA, 22 bp, Homo sapiens
ctgtctcctttcaccccagggc

SEQ ID NO: 6187700 - DNA, 17 bp, Homo sapiens
ctgtctcgagcgccctg

SEQ ID NO: 6187701 - DNA, 14 bp, Homo sapiens
ctgtctcgatgcct

SEQ ID NO: 6187702 - DNA, 20 bp, Homo sapiens
ctgtctcgatgcctgattcg

SEQ ID NO: 6187703 - DNA, 17 bp, Homo sapiens
ctgtctcgccagaagac

SEQ ID NO: 6187704 - DNA, 15 bp, Homo sapiens
ctgtctcggcagagg

SEQ ID NO: 6187705 - DNA, 19 bp, Homo sapiens
ctgtctcgggctgaccctt

SEQ ID NO: 6187706 - DNA, 16 bp, Homo sapiens
ctgtctctaacttatt

SEQ ID NO: 6187707 - DNA, 20 bp, Homo sapiens
ctgtctctaacttattttat

SEQ ID NO: 6187708 - DNA, 20 bp, Homo sapiens
ctgtctctacaaaaaaaatc

SEQ ID NO: 6187709 - DNA, 22 bp, Homo sapiens
ctgtctctacaaaaaaaatcaa

SEQ ID NO: 6187710 - DNA, 17 bp, Homo sapiens
ctgtctctagaagtgcc

SEQ ID NO: 6187711 - DNA, 17 bp, Homo sapiens
ctgtctctagccacttt

SEQ ID NO: 6187712 - DNA, 20 bp, Homo sapiens
ctgtctctagccactttggt

SEQ ID NO: 6187713 - DNA, 19 bp, Homo sapiens
ctgtctctattagctgggt

SEQ ID NO: 6187714 - DNA, 17 bp, Homo sapiens
ctgtctctccagtgaaa

SEQ ID NO: 6187715 - DNA, 20 bp, Homo sapiens
ctgtctctccccctctgtct

SEQ ID NO: 6187716 - DNA, 17 bp, Homo sapiens
ctgtctctccctaccct

SEQ ID NO: 6187717 - DNA, 15 bp, Homo sapiens
ctgtctctcccttcc

SEQ ID NO: 6187718 - DNA, 15 bp, Homo sapiens
ctgtctctcctagcc

SEQ ID NO: 6187719 - DNA, 19 bp, Homo sapiens
ctgtctctcctagcccctc

SEQ ID NO: 6187720 - DNA, 15 bp, Homo sapiens
ctgtctctctccatg

SEQ ID NO: 6187721 - DNA, 20 bp, Homo sapiens
ctgtctctctctctttttct

SEQ ID NO: 6187722 - DNA, 22 bp, Homo sapiens
ctgtctctctcttctctctagg

SEQ ID NO: 6187723 - DNA, 12 bp, Homo sapiens
ctgtctctctgg

SEQ ID NO: 6187724 - DNA, 16 bp, Homo sapiens
ctgtctctctgggctg

SEQ ID NO: 6187725 - DNA, 20 bp, Homo sapiens
ctgtctctcttgctttgttc

SEQ ID NO: 6187726 - DNA, 21 bp, Homo sapiens
ctgtctctcttgctttgttct

SEQ ID NO: 6187727 - DNA, 18 bp, Homo sapiens
ctgtctctcttgtcacat

SEQ ID NO: 6187728 - DNA, 12 bp, Homo sapiens
ctgtctctgcat

SEQ ID NO: 6187729 - DNA, 13 bp, Homo sapiens
ctgtctctgcatc

SEQ ID NO: 6187730 - DNA, 17 bp, Homo sapiens
ctgtctctgcctgcggc

SEQ ID NO: 6187731 - DNA, 13 bp, Homo sapiens
ctgtctctgctct

SEQ ID NO: 6187732 - DNA, 20 bp, Homo sapiens
ctgtctctgctcttgcctgc

SEQ ID NO: 6187733 - DNA, 12 bp, Homo sapiens
ctgtctctgctt

SEQ ID NO: 6187734 - DNA, 13 bp, Homo sapiens
ctgtctctgcttg

SEQ ID NO: 6187735 - DNA, 13 bp, Homo sapiens
ctgtctctggagt

SEQ ID NO: 6187736 - DNA, 12 bp, Homo sapiens
ctgtctctggct

SEQ ID NO: 6187737 - DNA, 14 bp, Homo sapiens
ctgtctctggctac

SEQ ID NO: 6187738 - DNA, 15 bp, Homo sapiens
ctgtctctggctact

SEQ ID NO: 6187739 - DNA, 21 bp, Homo sapiens
ctgtctctggctactccctgg

SEQ ID NO: 6187740 - DNA, 14 bp, Homo sapiens
ctgtctctgtcatg

SEQ ID NO: 6187741 - DNA, 17 bp, Homo sapiens
ctgtctctgtccctcac

SEQ ID NO: 6187742 - DNA, 23 bp, Homo sapiens
ctgtctctgtggaaaagccatct

SEQ ID NO: 6187743 - DNA, 23 bp, Homo sapiens
ctgtctctgttcagatgtgcatt

SEQ ID NO: 6187744 - DNA, 15 bp, Homo sapiens
ctgtctcttccatat

SEQ ID NO: 6187745 - DNA, 19 bp, Homo sapiens
ctgtctcttcttaaccctg

SEQ ID NO: 6187746 - DNA, 21 bp, Homo sapiens
ctgtctcttgcataagcctca

SEQ ID NO: 6187747 - DNA, 17 bp, Homo sapiens
ctgtctcttgggaagca

SEQ ID NO: 6187748 - DNA, 20 bp, Homo sapiens
ctgtctcttgggaagcagtt

SEQ ID NO: 6187749 - DNA, 23 bp, Homo sapiens
ctgtctcttgggaagcagtttca

SEQ ID NO: 6187750 - DNA, 19 bp, Homo sapiens
ctgtctgaaaaagtgtttt

SEQ ID NO: 6187751 - DNA, 14 bp, Homo sapiens
ctgtctgaacaaaa

SEQ ID NO: 6187752 - DNA, 16 bp, Homo sapiens
ctgtctgaacaaaaac

SEQ ID NO: 6187753 - DNA, 23 bp, Homo sapiens
ctgtctgaagcccaaagcctgag

SEQ ID NO: 6187754 - DNA, 19 bp, Homo sapiens
ctgtctgaatgatcttgtg

SEQ ID NO: 6187755 - DNA, 21 bp, Homo sapiens
ctgtctgaatggtgcgtgaag

SEQ ID NO: 6187756 - DNA, 15 bp, Homo sapiens
ctgtctgaccagaga

SEQ ID NO: 6187757 - DNA, 21 bp, Homo sapiens
ctgtctgagccctgccctcac

SEQ ID NO: 6187758 - DNA, 24 bp, Homo sapiens
ctgtctgagccctgccctcactcc

SEQ ID NO: 6187759 - DNA, 18 bp, Homo sapiens
ctgtctgaggttgggaga

SEQ ID NO: 6187760 - DNA, 18 bp, Homo sapiens
ctgtctgagtagtggcca

SEQ ID NO: 6187761 - DNA, 14 bp, Homo sapiens
ctgtctgatagcac

SEQ ID NO: 6187762 - DNA, 21 bp, Homo sapiens
ctgtctgatctgtgctttcca

SEQ ID NO: 6187763 - DNA, 17 bp, Homo sapiens
ctgtctgattctatgcc

SEQ ID NO: 6187764 - DNA, 14 bp, Homo sapiens
ctgtctgattggct

SEQ ID NO: 6187765 - DNA, 15 bp, Homo sapiens
ctgtctgcacagagg

SEQ ID NO: 6187766 - DNA, 17 bp, Homo sapiens
ctgtctgcacagagggt

SEQ ID NO: 6187767 - DNA, 20 bp, Homo sapiens
gaaacccacagtttgagacc

SEQ ID NO: 6187768 - DNA, 15 bp, Homo sapiens
gaaacccacagtttt

SEQ ID NO: 6187769 - DNA, 16 bp, Homo sapiens
gaaacccacctctctg

SEQ ID NO: 6187770 - DNA, 20 bp, Homo sapiens
gaaacccacgacctgtcctg

SEQ ID NO: 6187771 - DNA, 13 bp, Homo sapiens
gaaacccagagat

SEQ ID NO: 6187772 - DNA, 22 bp, Homo sapiens
gaaacccataggcccacacaca

SEQ ID NO: 6187773 - DNA, 22 bp, Homo sapiens
gaaacccattaggcatgcctaa

SEQ ID NO: 6187774 - DNA, 17 bp, Homo sapiens
gaaaccccaagcagcat

SEQ ID NO: 6187775 - DNA, 17 bp, Homo sapiens
gaaaccccatctctact

SEQ ID NO: 6187776 - DNA, 15 bp, Homo sapiens
gaaacccccaggagg

SEQ ID NO: 6187777 - DNA, 18 bp, Homo sapiens
gaaaccccccaatgtctg

SEQ ID NO: 6187778 - DNA, 22 bp, Homo sapiens
gaaacccccttttcccttcagc

SEQ ID NO: 6187779 - DNA, 17 bp, Homo sapiens
gaaacccctgacacctt

SEQ ID NO: 6187780 - DNA, 16 bp, Homo sapiens
gaaacccgacagaggg

SEQ ID NO: 6187781 - DNA, 16 bp, Homo sapiens
gaaacccggtgcatct

SEQ ID NO: 6187782 - DNA, 23 bp, Homo sapiens
gaaacccggtgcatctggcacgt

SEQ ID NO: 6187783 - DNA, 22 bp, Homo sapiens
gaaacccgtctctactaaaaat

SEQ ID NO: 6187784 - DNA, 15 bp, Homo sapiens
gaaaccctatttccc

SEQ ID NO: 6187785 - DNA, 14 bp, Homo sapiens
gaaaccctgagcag

SEQ ID NO: 6187786 - DNA, 14 bp, Homo sapiens
gaaaccctgtctct

SEQ ID NO: 6187787 - DNA, 17 bp, Homo sapiens
gaaacccttgaaaagac

SEQ ID NO: 6187788 - DNA, 20 bp, Homo sapiens
gaaacccttgactgttatct

SEQ ID NO: 6187789 - DNA, 11 bp, Homo sapiens
gaaaccctttt

SEQ ID NO: 6187790 - DNA, 23 bp, Homo sapiens
gaaaccgtgtgtccagcattgaa

SEQ ID NO: 6187791 - DNA, 13 bp, Homo sapiens
gaaacctactgcc

SEQ ID NO: 6187792 - DNA, 19 bp, Homo sapiens
gaaacctactgcccaggca

SEQ ID NO: 6187793 - DNA, 21 bp, Homo sapiens
gaaacctactttttatgtgct

SEQ ID NO: 6187794 - DNA, 20 bp, Homo sapiens
gaaacctcagggctgtccca

SEQ ID NO: 6187795 - DNA, 19 bp, Homo sapiens
gaaacctccatcctgccag

SEQ ID NO: 6187796 - DNA, 23 bp, Homo sapiens
gaaacctccatcctgccaggagc

SEQ ID NO: 6187797 - DNA, 12 bp, Homo sapiens
gaaacctctgtt

SEQ ID NO: 6187798 - DNA, 15 bp, Homo sapiens
gaaacctgatgtcag

SEQ ID NO: 6187799 - DNA, 22 bp, Homo sapiens
gaaacctgccaaggagcatcct

SEQ ID NO: 6187800 - DNA, 17 bp, Homo sapiens
gaaacctgccctgcctg

SEQ ID NO: 6187801 - DNA, 20 bp, Homo sapiens
gaaacctgcctttgtatgtg

SEQ ID NO: 6187802 - DNA, 18 bp, Homo sapiens
gaaacctgcgtaactcca

SEQ ID NO: 6187803 - DNA, 18 bp, Homo sapiens
gaaacctggaaccagagg

SEQ ID NO: 6187804 - DNA, 18 bp, Homo sapiens
gaaacctgggctctggtt

SEQ ID NO: 6187805 - DNA, 18 bp, Homo sapiens
gaaacctgtatctttcta

SEQ ID NO: 6187806 - DNA, 16 bp, Homo sapiens
gaaacctgtgatttct

SEQ ID NO: 6187807 - DNA, 17 bp, Homo sapiens
gaaaccttattgtacct

SEQ ID NO: 6187808 - DNA, 20 bp, Homo sapiens
gaaaccttattgtacctctc

SEQ ID NO: 6187809 - DNA, 18 bp, Homo sapiens
gaaaccttcacccagcac

SEQ ID NO: 6187810 - DNA, 17 bp, Homo sapiens
gaaaccttccacccagt

SEQ ID NO: 6187811 - DNA, 14 bp, Homo sapiens
gaaaccttgaagtt

SEQ ID NO: 6187812 - DNA, 11 bp, Homo sapiens
gaaaccttgca

SEQ ID NO: 6187813 - DNA, 14 bp, Homo sapiens
gaaaccttgcagca

SEQ ID NO: 6187814 - DNA, 17 bp, Homo sapiens
gaaaccttgcagcattt

SEQ ID NO: 6187815 - DNA, 19 bp, Homo sapiens
gaaaccttgctctcctcat

SEQ ID NO: 6187816 - DNA, 12 bp, Homo sapiens
gaaaccttggag

SEQ ID NO: 6187817 - DNA, 17 bp, Homo sapiens
gaaaccttggtgtagtt

SEQ ID NO: 6187818 - DNA, 22 bp, Homo sapiens
gaaaccttggtgtagttgaact

SEQ ID NO: 6187819 - DNA, 16 bp, Homo sapiens
gaaaccttgtttgttt

SEQ ID NO: 6187820 - DNA, 17 bp, Homo sapiens
gaaacctttagggcagc

SEQ ID NO: 6187821 - DNA, 12 bp, Homo sapiens
gaaacctttcta

SEQ ID NO: 6187822 - DNA, 13 bp, Homo sapiens
gaaaccttttatt

SEQ ID NO: 6187823 - DNA, 14 bp, Homo sapiens
gaaaccttttattt

SEQ ID NO: 6187824 - DNA, 18 bp, Homo sapiens
gaaaccttttatttttat

SEQ ID NO: 6187825 - DNA, 19 bp, Homo sapiens
gaaaccttttttaagattt

SEQ ID NO: 6187826 - DNA, 20 bp, Homo sapiens
gaaaccttttttaagatttt

SEQ ID NO: 6187827 - DNA, 15 bp, Homo sapiens
gaaacgaaaaggaca

SEQ ID NO: 6187828 - DNA, 19 bp, Homo sapiens
gaaacgactcaaaatgaca

SEQ ID NO: 6187829 - DNA, 18 bp, Homo sapiens
gaaacgcacttacaagtg

SEQ ID NO: 6187830 - DNA, 22 bp, Homo sapiens
gaaacgcagattgggctggctc

SEQ ID NO: 6187831 - DNA, 22 bp, Homo sapiens
gaaacgcagttgtgtggcccag

SEQ ID NO: 6187832 - DNA, 19 bp, Homo sapiens
gaaacgccccgggcaaagg

SEQ ID NO: 6187833 - DNA, 13 bp, Homo sapiens
gaaacgctacctc

SEQ ID NO: 6187834 - DNA, 23 bp, Homo sapiens
gaaacgctacctctctgtccctt

SEQ ID NO: 6187835 - DNA, 13 bp, Homo sapiens
gaaacggacagct

SEQ ID NO: 6187836 - DNA, 17 bp, Homo sapiens
gaaacggtatcctccct

SEQ ID NO: 6187837 - DNA, 19 bp, Homo sapiens
gaaacgtacttaactgtgt

SEQ ID NO: 6187838 - DNA, 21 bp, Homo sapiens
gaaacgtatgtgtgcaggagc

SEQ ID NO: 6187839 - DNA, 21 bp, Homo sapiens
gaaacgtccatctctctccct

SEQ ID NO: 6187840 - DNA, 22 bp, Homo sapiens
gaaacgtccatctctctccctt

SEQ ID NO: 6187841 - DNA, 15 bp, Homo sapiens
gaaacgtctacgtat

SEQ ID NO: 6187842 - DNA, 20 bp, Homo sapiens
gaaacgtctacgtatgcatg

SEQ ID NO: 6187843 - DNA, 16 bp, Homo sapiens
gaaacgtctcccagat

SEQ ID NO: 6187844 - DNA, 15 bp, Homo sapiens
gaaacgtgccctctg

SEQ ID NO: 6187845 - DNA, 16 bp, Homo sapiens
gaaacgtgtcacactt

SEQ ID NO: 6187846 - DNA, 18 bp, Homo sapiens
gaaactaaaataaattaa

SEQ ID NO: 6187847 - DNA, 14 bp, Homo sapiens
gaaactaaacagaa

SEQ ID NO: 6187848 - DNA, 20 bp, Homo sapiens
gaaactaaactaaaatagtt

SEQ ID NO: 6187849 - DNA, 19 bp, Homo sapiens
gaaactaaagcaatagaaa

SEQ ID NO: 6187850 - DNA, 12 bp, Homo sapiens
gaaactaacaga

SEQ ID NO: 6187851 - DNA, 14 bp, Homo sapiens
gaaactaagccagg

SEQ ID NO: 6187852 - DNA, 16 bp, Homo sapiens
gaaactaataaaatat

SEQ ID NO: 6187853 - DNA, 17 bp, Homo sapiens
gaaactaataaaatatt

SEQ ID NO: 6187854 - DNA, 18 bp, Homo sapiens
gaaactaatcataagctg

SEQ ID NO: 6187855 - DNA, 20 bp, Homo sapiens
gaaactacaccacactaaaa

SEQ ID NO: 6187856 - DNA, 19 bp, Homo sapiens
gaaactactgcctttagaa

SEQ ID NO: 6187857 - DNA, 20 bp, Homo sapiens
gaaactactgcctttagaaa

SEQ ID NO: 6187858 - DNA, 22 bp, Homo sapiens
gaaactactgcctttagaaaat

SEQ ID NO: 6187859 - DNA, 21 bp, Homo sapiens
gaaactagaaagcagagattt

SEQ ID NO: 6187860 - DNA, 16 bp, Homo sapiens
gaaactagaaatctgt

SEQ ID NO: 6187861 - DNA, 18 bp, Homo sapiens
gaaactaggtctgatatt

SEQ ID NO: 6187862 - DNA, 20 bp, Homo sapiens
gaaactagtatctctggcct

SEQ ID NO: 6187863 - DNA, 15 bp, Homo sapiens
gaaactagtgtacat

SEQ ID NO: 6187864 - DNA, 18 bp, Homo sapiens
gaaactagttattttata

SEQ ID NO: 6187865 - DNA, 21 bp, Homo sapiens
gaaactatccttctctttcaa

SEQ ID NO: 6187866 - DNA, 24 bp, Homo sapiens
gaaactatgcacctataaatacta

SEQ ID NO: 6187867 - DNA, 14 bp, Homo sapiens
gaaactatgtgttt

SEQ ID NO: 6187868 - DNA, 18 bp, Homo sapiens
gaaactatgtgtttttct

SEQ ID NO: 6187869 - DNA, 19 bp, Homo sapiens
gaaactcaaaaccatctct

SEQ ID NO: 6187870 - DNA, 22 bp, Homo sapiens
gaaactcaaccatcaatggaaa

SEQ ID NO: 6187871 - DNA, 17 bp, Homo sapiens
gaaactcaaggaaaagt

SEQ ID NO: 6187872 - DNA, 17 bp, Homo sapiens
gaaactccacatctgcc

SEQ ID NO: 6187873 - DNA, 22 bp, Homo sapiens
gaaactccatctcaaaacaaaa

SEQ ID NO: 6187874 - DNA, 15 bp, Homo sapiens
gaaactcccacccta

SEQ ID NO: 6187875 - DNA, 17 bp, Homo sapiens
gaaactcccctgggggt

SEQ ID NO: 6187876 - DNA, 18 bp, Homo sapiens
gaaactccgaagaaaaga

SEQ ID NO: 6187877 - DNA, 18 bp, Homo sapiens
gaaactccgtcttagaag

SEQ ID NO: 6187878 - DNA, 22 bp, Homo sapiens
gaaactccgtcttagaagtgga

SEQ ID NO: 6187879 - DNA, 20 bp, Homo sapiens
gaaactcctggatccctttc

SEQ ID NO: 6187880 - DNA, 17 bp, Homo sapiens
gaaactcctgtttctcc

SEQ ID NO: 6187881 - DNA, 19 bp, Homo sapiens
gaaactccttttgctgtct

SEQ ID NO: 6187882 - DNA, 21 bp, Homo sapiens
gaaactccttttgctgtcttt

SEQ ID NO: 6187883 - DNA, 15 bp, Homo sapiens
gaaactctaccctga

SEQ ID NO: 6187884 - DNA, 22 bp, Homo sapiens
gaaactctagactgcaagaact

SEQ ID NO: 6187885 - DNA, 13 bp, Homo sapiens
gaaactctcattt

SEQ ID NO: 6187886 - DNA, 12 bp, Homo sapiens
gaaactctggag

SEQ ID NO: 6187887 - DNA, 16 bp, Homo sapiens
gaaactctggtgccgg

SEQ ID NO: 6187888 - DNA, 13 bp, Homo sapiens
gaaactctttcat

SEQ ID NO: 6187889 - DNA, 21 bp, Homo sapiens
gaaactctttcattcttctca

SEQ ID NO: 6187890 - DNA, 19 bp, Homo sapiens
gaaactctttttgggctcc

SEQ ID NO: 6187891 - DNA, 16 bp, Homo sapiens
gaaactgaaagtgttt

SEQ ID NO: 6187892 - DNA, 12 bp, Homo sapiens
gaaactgaacca

SEQ ID NO: 6187893 - DNA, 18 bp, Homo sapiens
gaaactgaaccaacagaa

SEQ ID NO: 6187894 - DNA, 14 bp, Homo sapiens
gaaactgaatgctc

SEQ ID NO: 6187895 - DNA, 23 bp, Homo sapiens
gaaactgagcgaaatccaagatg

SEQ ID NO: 6187896 - DNA, 14 bp, Homo sapiens
gaaactgaggccca

SEQ ID NO: 6187897 - DNA, 16 bp, Homo sapiens
gaaactgagtcctgtt

SEQ ID NO: 6187898 - DNA, 16 bp, Homo sapiens
gaaactgatttcttca

SEQ ID NO: 6187899 - DNA, 18 bp, Homo sapiens
gaaactgcagctgggaag

SEQ ID NO: 6187900 - DNA, 14 bp, Homo sapiens
gaaactgcattatt

SEQ ID NO: 6187901 - DNA, 15 bp, Homo sapiens
gaaactgccaagggt

SEQ ID NO: 6187902 - DNA, 21 bp, Homo sapiens
gaaactgcccactctgcaaga

SEQ ID NO: 6187903 - DNA, 22 bp, Homo sapiens
gaaactgcttacagtttatttt

SEQ ID NO: 6187904 - DNA, 19 bp, Homo sapiens
gaaactgctttatttttat

SEQ ID NO: 6187905 - DNA, 16 bp, Homo sapiens
gaaactggaagttatt

SEQ ID NO: 6187906 - DNA, 11 bp, Homo sapiens
gaaactggaat

SEQ ID NO: 6187907 - DNA, 22 bp, Homo sapiens
gaaactggaataagccttcgaa

SEQ ID NO: 6187908 - DNA, 13 bp, Homo sapiens
gaaactggattaa

SEQ ID NO: 6187909 - DNA, 20 bp, Homo sapiens
gaaactggattaaaacaatt

SEQ ID NO: 6187910 - DNA, 17 bp, Homo sapiens
gaaactggcaaagcaga

SEQ ID NO: 6187911 - DNA, 17 bp, Homo sapiens
gaaactggcactgaatt

SEQ ID NO: 6187912 - DNA, 16 bp, Homo sapiens
gaaactggccaggggt

SEQ ID NO: 6187913 - DNA, 14 bp, Homo sapiens
gaaactggccatgg

SEQ ID NO: 6187914 - DNA, 20 bp, Homo sapiens
gaaactggccatggcctgca

SEQ ID NO: 6187915 - DNA, 21 bp, Homo sapiens
gaaactggcgatctcccaggg

SEQ ID NO: 6187916 - DNA, 15 bp, Homo sapiens
gaaactgggaaactg

SEQ ID NO: 6187917 - DNA, 19 bp, Homo sapiens
gaaactgggtttctcatta

SEQ ID NO: 6187918 - DNA, 22 bp, Homo sapiens
gaaactggttctgtgttgaaat

SEQ ID NO: 6187919 - DNA, 18 bp, Homo sapiens
gaaactggttgtaaaaga

SEQ ID NO: 6187920 - DNA, 12 bp, Homo sapiens
gaaactggttta

SEQ ID NO: 6187921 - DNA, 20 bp, Homo sapiens
gaaactggtttataataaac

SEQ ID NO: 6187922 - DNA, 21 bp, Homo sapiens
gaaactgtaaaatgatactgt

SEQ ID NO: 6187923 - DNA, 22 bp, Homo sapiens
gaaactgtacatactgcagtgt

SEQ ID NO: 6187924 - DNA, 16 bp, Homo sapiens
gaaactgtatgattaa

SEQ ID NO: 6187925 - DNA, 20 bp, Homo sapiens
gaaactgtatgattaagcaa

SEQ ID NO: 6187926 - DNA, 12 bp, Homo sapiens
gaaactgtattt

SEQ ID NO: 6187927 - DNA, 12 bp, Homo sapiens
gaaactgtgaat

SEQ ID NO: 6187928 - DNA, 16 bp, Homo sapiens
gaaactgtgaatgctt

SEQ ID NO: 6187929 - DNA, 19 bp, Homo sapiens
gaaactgtgaatgcttctg

SEQ ID NO: 6187930 - DNA, 22 bp, Homo sapiens
gaaactgtgaatgcttctgatt

SEQ ID NO: 6187931 - DNA, 15 bp, Homo sapiens
gaaactgtttgatta

SEQ ID NO: 6187932 - DNA, 19 bp, Homo sapiens
gaaacttaaatgttattat

SEQ ID NO: 6187933 - DNA, 15 bp, Homo sapiens
gaaacttaagatgaa

SEQ ID NO: 6187934 - DNA, 20 bp, Homo sapiens
gaaacttaccaattgatgtt

SEQ ID NO: 6187935 - DNA, 22 bp, Homo sapiens
gaaacttaccaattgatgtttt

SEQ ID NO: 6187936 - DNA, 16 bp, Homo sapiens
gaaacttatcttacaa

SEQ ID NO: 6187937 - DNA, 21 bp, Homo sapiens
gaaacttatcttacaaagtgt

SEQ ID NO: 6187938 - DNA, 12 bp, Homo sapiens
gaaacttatttt

SEQ ID NO: 6187939 - DNA, 20 bp, Homo sapiens
gaaacttatttttttctgat

SEQ ID NO: 6187940 - DNA, 15 bp, Homo sapiens
gaaacttcagccctg

SEQ ID NO: 6187941 - DNA, 19 bp, Homo sapiens
gaaacttcagttgatcttc

SEQ ID NO: 6187942 - DNA, 18 bp, Homo sapiens
gaaacttcccaacttccc

SEQ ID NO: 6187943 - DNA, 22 bp, Homo sapiens
gaaacttcccaacttccctgtt

SEQ ID NO: 6187944 - DNA, 21 bp, Homo sapiens
gaaacttcctgccctctctgt

SEQ ID NO: 6187945 - DNA, 16 bp, Homo sapiens
ctgtctgccagccagc

SEQ ID NO: 6187946 - DNA, 20 bp, Homo sapiens
ctgtctgccagccagcagcc

SEQ ID NO: 6187947 - DNA, 17 bp, Homo sapiens
ctgtctgcggagccagc

SEQ ID NO: 6187948 - DNA, 18 bp, Homo sapiens
ctgtctgcgtctgctctt

SEQ ID NO: 6187949 - DNA, 12 bp, Homo sapiens
ctgtctgctcca

SEQ ID NO: 6187950 - DNA, 17 bp, Homo sapiens
ctgtctgctccagctct

SEQ ID NO: 6187951 - DNA, 19 bp, Homo sapiens
ctgtctgctccagctctgg

SEQ ID NO: 6187952 - DNA, 15 bp, Homo sapiens
ctgtctgctctgcat

SEQ ID NO: 6187953 - DNA, 14 bp, Homo sapiens
ctgtctgctgggct

SEQ ID NO: 6187954 - DNA, 18 bp, Homo sapiens
ctgtctgcttctctctct

SEQ ID NO: 6187955 - DNA, 12 bp, Homo sapiens
ctgtctgcttgc

SEQ ID NO: 6187956 - DNA, 23 bp, Homo sapiens
ctgtctggaagacgtggctctgg

SEQ ID NO: 6187957 - DNA, 20 bp, Homo sapiens
ctgtctggaggggagctctg

SEQ ID NO: 6187958 - DNA, 20 bp, Homo sapiens
ctgtctggatccttcccaag

SEQ ID NO: 6187959 - DNA, 15 bp, Homo sapiens
ctgtctggccaggcc

SEQ ID NO: 6187960 - DNA, 14 bp, Homo sapiens
ctgtctggccaggg

SEQ ID NO: 6187961 - DNA, 16 bp, Homo sapiens
ctgtctggcccccctg

SEQ ID NO: 6187962 - DNA, 21 bp, Homo sapiens
ctgtctggctcggacccaccc

SEQ ID NO: 6187963 - DNA, 16 bp, Homo sapiens
ctgtctggctgtacgt

SEQ ID NO: 6187964 - DNA, 13 bp, Homo sapiens
ctgtctgggatta

SEQ ID NO: 6187965 - DNA, 13 bp, Homo sapiens
ctgtctgggctca

SEQ ID NO: 6187966 - DNA, 17 bp, Homo sapiens
ctgtctgggctcagaca

SEQ ID NO: 6187967 - DNA, 20 bp, Homo sapiens
ctgtctggggccccatcagc

SEQ ID NO: 6187968 - DNA, 22 bp, Homo sapiens
ctgtctggggccccatcagctg

SEQ ID NO: 6187969 - DNA, 13 bp, Homo sapiens
ctgtctggggcct

SEQ ID NO: 6187970 - DNA, 21 bp, Homo sapiens
ctgtctgggtgctactgggga

SEQ ID NO: 6187971 - DNA, 22 bp, Homo sapiens
ctgtctgggtgctactggggaa

SEQ ID NO: 6187972 - DNA, 16 bp, Homo sapiens
ctgtctgggtggctca

SEQ ID NO: 6187973 - DNA, 17 bp, Homo sapiens
ctgtctggtgaggtggc

SEQ ID NO: 6187974 - DNA, 23 bp, Homo sapiens
ctgtctggtgaggtggcccaggc

SEQ ID NO: 6187975 - DNA, 13 bp, Homo sapiens
ctgtctggtggcc

SEQ ID NO: 6187976 - DNA, 15 bp, Homo sapiens
ctgtctggtggcccc

SEQ ID NO: 6187977 - DNA, 19 bp, Homo sapiens
ctgtctggtgtagctcctc

SEQ ID NO: 6187978 - DNA, 16 bp, Homo sapiens
ctgtctggttttaaca

SEQ ID NO: 6187979 - DNA, 14 bp, Homo sapiens
ctgtctgtacctaa

SEQ ID NO: 6187980 - DNA, 13 bp, Homo sapiens
ctgtctgtacttc

SEQ ID NO: 6187981 - DNA, 19 bp, Homo sapiens
ctgtctgtagagggccctg

SEQ ID NO: 6187982 - DNA, 20 bp, Homo sapiens
ctgtctgtagagggccctgg

SEQ ID NO: 6187983 - DNA, 23 bp, Homo sapiens
ctgtctgtatagtgtctgtattt

SEQ ID NO: 6187984 - DNA, 19 bp, Homo sapiens
ctgtctgtcaccagctatc

SEQ ID NO: 6187985 - DNA, 22 bp, Homo sapiens
ctgtctgtcaccagctatctgt

SEQ ID NO: 6187986 - DNA, 15 bp, Homo sapiens
ctgtctgtcatctgc

SEQ ID NO: 6187987 - DNA, 15 bp, Homo sapiens
ctgtctgtccaaccc

SEQ ID NO: 6187988 - DNA, 13 bp, Homo sapiens
ctgtctgtccctt

SEQ ID NO: 6187989 - DNA, 21 bp, Homo sapiens
ctgtctgtcccttttctttga

SEQ ID NO: 6187990 - DNA, 14 bp, Homo sapiens
ctgtctgtcctgga

SEQ ID NO: 6187991 - DNA, 20 bp, Homo sapiens
ctgtctgtccttctgaagtg

SEQ ID NO: 6187992 - DNA, 15 bp, Homo sapiens
ctgtctgtcgccctt

SEQ ID NO: 6187993 - DNA, 12 bp, Homo sapiens
ctgtctgtctcc

SEQ ID NO: 6187994 - DNA, 23 bp, Homo sapiens
ctgtctgtctctccccctctgtc

SEQ ID NO: 6187995 - DNA, 16 bp, Homo sapiens
ctgtctgtctggtcca

SEQ ID NO: 6187996 - DNA, 14 bp, Homo sapiens
ctgtctgtctgtcc

SEQ ID NO: 6187997 - DNA, 14 bp, Homo sapiens
ctgtctgtctgtct

SEQ ID NO: 6187998 - DNA, 14 bp, Homo sapiens
ctgtctgtctgtgg

SEQ ID NO: 6187999 - DNA, 16 bp, Homo sapiens
ctgtctgtcttctcct

SEQ ID NO: 6188000 - DNA, 17 bp, Homo sapiens
ctgtctgtgaagagcaa

SEQ ID NO: 6188001 - DNA, 12 bp, Homo sapiens
ctgtctgtgaat

SEQ ID NO: 6188002 - DNA, 14 bp, Homo sapiens
ctgtctgtgacctg

SEQ ID NO: 6188003 - DNA, 12 bp, Homo sapiens
ctgtctgtgcca

SEQ ID NO: 6188004 - DNA, 22 bp, Homo sapiens
ctgtctgtgccatggcccccca

SEQ ID NO: 6188005 - DNA, 15 bp, Homo sapiens
ctgtctgtgtccttg

SEQ ID NO: 6188006 - DNA, 19 bp, Homo sapiens
ctgtctgtgtgaggctccc

SEQ ID NO: 6188007 - DNA, 21 bp, Homo sapiens
ctgtctgtgtgaggctccctc

SEQ ID NO: 6188008 - DNA, 22 bp, Homo sapiens
ctgtctgtgtgaggctccctcc

SEQ ID NO: 6188009 - DNA, 15 bp, Homo sapiens
ctgtctgttacactg

SEQ ID NO: 6188010 - DNA, 17 bp, Homo sapiens
ctgtctgttatgatttc

SEQ ID NO: 6188011 - DNA, 15 bp, Homo sapiens
ctgtctgttcccagc

SEQ ID NO: 6188012 - DNA, 21 bp, Homo sapiens
ctgtctgttcccagcccctgc

SEQ ID NO: 6188013 - DNA, 18 bp, Homo sapiens
ctgtctgttgtattcatt

SEQ ID NO: 6188014 - DNA, 15 bp, Homo sapiens
ctgtcttaattaagt

SEQ ID NO: 6188015 - DNA, 14 bp, Homo sapiens
ctgtcttaattttc

SEQ ID NO: 6188016 - DNA, 21 bp, Homo sapiens
ctgtcttacctggcagcaaac

SEQ ID NO: 6188017 - DNA, 16 bp, Homo sapiens
ctgtcttagactgcta

SEQ ID NO: 6188018 - DNA, 22 bp, Homo sapiens
ctgtcttagtcataccatccat

SEQ ID NO: 6188019 - DNA, 16 bp, Homo sapiens
ctgtcttatcctccac

SEQ ID NO: 6188020 - DNA, 20 bp, Homo sapiens
ctgtcttatctgctataaac

SEQ ID NO: 6188021 - DNA, 19 bp, Homo sapiens
ctgtcttatggcgttgcag

SEQ ID NO: 6188022 - DNA, 19 bp, Homo sapiens
ctgtcttatggtccagaaa

SEQ ID NO: 6188023 - DNA, 15 bp, Homo sapiens
ctgtcttcaaccctg

SEQ ID NO: 6188024 - DNA, 15 bp, Homo sapiens
ctgtcttcaagggct

SEQ ID NO: 6188025 - DNA, 17 bp, Homo sapiens
ctgtcttcacctgattc

SEQ ID NO: 6188026 - DNA, 15 bp, Homo sapiens
ctgtcttcacctgcc

SEQ ID NO: 6188027 - DNA, 18 bp, Homo sapiens
ctgtcttcacctgccacc

SEQ ID NO: 6188028 - DNA, 21 bp, Homo sapiens
ctgtcttcacctgccaccaca

SEQ ID NO: 6188029 - DNA, 19 bp, Homo sapiens
ctgtcttcagcacattcca

SEQ ID NO: 6188030 - DNA, 20 bp, Homo sapiens
ctgtcttcaggctctgccca

SEQ ID NO: 6188031 - DNA, 18 bp, Homo sapiens
ctgtcttcagtaagccgt

SEQ ID NO: 6188032 - DNA, 15 bp, Homo sapiens
ctgtcttcagtctca

SEQ ID NO: 6188033 - DNA, 23 bp, Homo sapiens
ctgtcttcagtctcacagagaag

SEQ ID NO: 6188034 - DNA, 19 bp, Homo sapiens
ctgtcttcatagcagattt

SEQ ID NO: 6188035 - DNA, 17 bp, Homo sapiens
ctgtcttccaggcccag

SEQ ID NO: 6188036 - DNA, 11 bp, Homo sapiens
ctgtcttccca

SEQ ID NO: 6188037 - DNA, 13 bp, Homo sapiens
ctgtcttcccagg

SEQ ID NO: 6188038 - DNA, 14 bp, Homo sapiens
ctgtcttcccaggg

SEQ ID NO: 6188039 - DNA, 23 bp, Homo sapiens
ctgtcttcccagggtagcccgcc

SEQ ID NO: 6188040 - DNA, 11 bp, Homo sapiens
ctgtcttcctc

SEQ ID NO: 6188041 - DNA, 12 bp, Homo sapiens
ctgtcttcctct

SEQ ID NO: 6188042 - DNA, 15 bp, Homo sapiens
ctgtcttcctctgca

SEQ ID NO: 6188043 - DNA, 11 bp, Homo sapiens
ctgtcttcctt

SEQ ID NO: 6188044 - DNA, 13 bp, Homo sapiens
ctgtcttcctttg

SEQ ID NO: 6188045 - DNA, 19 bp, Homo sapiens
ctgtcttcctttgcttccc

SEQ ID NO: 6188046 - DNA, 17 bp, Homo sapiens
ctgtcttctcaggctct

SEQ ID NO: 6188047 - DNA, 13 bp, Homo sapiens
ctgtcttctccca

SEQ ID NO: 6188048 - DNA, 14 bp, Homo sapiens
ctgtcttctcccag

SEQ ID NO: 6188049 - DNA, 17 bp, Homo sapiens
ctgtcttctcccagagc

SEQ ID NO: 6188050 - DNA, 20 bp, Homo sapiens
ctgtcttctcccagagcaca

SEQ ID NO: 6188051 - DNA, 14 bp, Homo sapiens
ctgtcttctccctc

SEQ ID NO: 6188052 - DNA, 13 bp, Homo sapiens
ctgtcttctccta

SEQ ID NO: 6188053 - DNA, 13 bp, Homo sapiens
ctgtcttctctcc

SEQ ID NO: 6188054 - DNA, 22 bp, Homo sapiens
ctgtcttctctccacttctggt

SEQ ID NO: 6188055 - DNA, 16 bp, Homo sapiens
ctgtcttctggtctgt

SEQ ID NO: 6188056 - DNA, 19 bp, Homo sapiens
ctgtcttctgtatataaat

SEQ ID NO: 6188057 - DNA, 21 bp, Homo sapiens
ctgtcttctgtatataaatgg

SEQ ID NO: 6188058 - DNA, 13 bp, Homo sapiens
ctgtcttcttaat

SEQ ID NO: 6188059 - DNA, 12 bp, Homo sapiens
ctgtcttcttca

SEQ ID NO: 6188060 - DNA, 21 bp, Homo sapiens
ctgtcttcttcagggtcctga

SEQ ID NO: 6188061 - DNA, 23 bp, Homo sapiens
ctgtcttctttctccatggagcc

SEQ ID NO: 6188062 - DNA, 17 bp, Homo sapiens
ctgtcttctttctcctg

SEQ ID NO: 6188063 - DNA, 22 bp, Homo sapiens
ctgtcttctttctcctgtggtt

SEQ ID NO: 6188064 - DNA, 23 bp, Homo sapiens
ctgtcttctttctcctgtggttt

SEQ ID NO: 6188065 - DNA, 16 bp, Homo sapiens
ctgtcttgactgtcac

SEQ ID NO: 6188066 - DNA, 20 bp, Homo sapiens
ctgtcttgagagaaaagaaa

SEQ ID NO: 6188067 - DNA, 19 bp, Homo sapiens
ctgtcttgccagccagaag

SEQ ID NO: 6188068 - DNA, 23 bp, Homo sapiens
ctgtcttgcctttttcattattt

SEQ ID NO: 6188069 - DNA, 16 bp, Homo sapiens
ctgtcttggcctccca

SEQ ID NO: 6188070 - DNA, 18 bp, Homo sapiens
ctgtcttggcctcccaaa

SEQ ID NO: 6188071 - DNA, 15 bp, Homo sapiens
ctgtcttggtggatg

SEQ ID NO: 6188072 - DNA, 22 bp, Homo sapiens
ctgtcttggtggatgggccctg

SEQ ID NO: 6188073 - DNA, 23 bp, Homo sapiens
ctgtcttggtggatgggccctgc

SEQ ID NO: 6188074 - DNA, 12 bp, Homo sapiens
ctgtcttgtaat

SEQ ID NO: 6188075 - DNA, 13 bp, Homo sapiens
ctgtcttgtaata

SEQ ID NO: 6188076 - DNA, 20 bp, Homo sapiens
ctgtcttgtaatattttgta

SEQ ID NO: 6188077 - DNA, 21 bp, Homo sapiens
ctgtcttgttcattttgagta

SEQ ID NO: 6188078 - DNA, 18 bp, Homo sapiens
ctgtctttagaatcgctt

SEQ ID NO: 6188079 - DNA, 20 bp, Homo sapiens
ctgtctttagaatcgctttc

SEQ ID NO: 6188080 - DNA, 23 bp, Homo sapiens
ctgtctttagaatcgctttcctt

SEQ ID NO: 6188081 - DNA, 15 bp, Homo sapiens
ctgtctttatgattt

SEQ ID NO: 6188082 - DNA, 16 bp, Homo sapiens
ctgtctttcagataca

SEQ ID NO: 6188083 - DNA, 15 bp, Homo sapiens
ctgtctttcagcatt

SEQ ID NO: 6188084 - DNA, 22 bp, Homo sapiens
ctgtctttcagcattcagtccg

SEQ ID NO: 6188085 - DNA, 13 bp, Homo sapiens
ctgtctttccact

SEQ ID NO: 6188086 - DNA, 19 bp, Homo sapiens
ctgtctttcctaagacctg

SEQ ID NO: 6188087 - DNA, 13 bp, Homo sapiens
ctgtctttcctag

SEQ ID NO: 6188088 - DNA, 21 bp, Homo sapiens
ctgtctttctggccctttctg

SEQ ID NO: 6188089 - DNA, 14 bp, Homo sapiens
ctgtctttcttgct

SEQ ID NO: 6188090 - DNA, 18 bp, Homo sapiens
ctgtctttcttgctccct

SEQ ID NO: 6188091 - DNA, 20 bp, Homo sapiens
ctgtctttcttgctccctga

SEQ ID NO: 6188092 - DNA, 22 bp, Homo sapiens
ctgtctttcttgctccctgact

SEQ ID NO: 6188093 - DNA, 16 bp, Homo sapiens
ctgtctttgactgtga

SEQ ID NO: 6188094 - DNA, 14 bp, Homo sapiens
ctgtctttgcgggg

SEQ ID NO: 6188095 - DNA, 19 bp, Homo sapiens
ctgtctttgcggggcctgt

SEQ ID NO: 6188096 - DNA, 20 bp, Homo sapiens
ctgtctttgcggggcctgtc

SEQ ID NO: 6188097 - DNA, 23 bp, Homo sapiens
ctgtctttgcggggcctgtctca

SEQ ID NO: 6188098 - DNA, 19 bp, Homo sapiens
ctgtcttttctattaatca

SEQ ID NO: 6188099 - DNA, 14 bp, Homo sapiens
ctgtcttttctcct

SEQ ID NO: 6188100 - DNA, 21 bp, Homo sapiens
ctgtctttttccttcctgaga

SEQ ID NO: 6188101 - DNA, 16 bp, Homo sapiens
ctgtcttttttctctc

SEQ ID NO: 6188102 - DNA, 17 bp, Homo sapiens
ctgtcttttttctctct

SEQ ID NO: 6188103 - DNA, 18 bp, Homo sapiens
ctgtgaaaaaaaatttgt

SEQ ID NO: 6188104 - DNA, 14 bp, Homo sapiens
ctgtgaaaaacctg

SEQ ID NO: 6188105 - DNA, 20 bp, Homo sapiens
ctgtgaaaaatcagatgaat

SEQ ID NO: 6188106 - DNA, 22 bp, Homo sapiens
ctgtgaaaaatcagatgaattg

SEQ ID NO: 6188107 - DNA, 16 bp, Homo sapiens
ctgtgaaaactctggt

SEQ ID NO: 6188108 - DNA, 12 bp, Homo sapiens
ctgtgaaaatag

SEQ ID NO: 6188109 - DNA, 21 bp, Homo sapiens
ctgtgaaaattacacccatgc

SEQ ID NO: 6188110 - DNA, 23 bp, Homo sapiens
ctgtgaaaattacacccatgcac

SEQ ID NO: 6188111 - DNA, 23 bp, Homo sapiens
ctgtgaaaattgaccaagtgatg

SEQ ID NO: 6188112 - DNA, 17 bp, Homo sapiens
ctgtgaaagaaaataat

SEQ ID NO: 6188113 - DNA, 14 bp, Homo sapiens
ctgtgaaagcctta

SEQ ID NO: 6188114 - DNA, 13 bp, Homo sapiens
ctgtgaaagctgc

SEQ ID NO: 6188115 - DNA, 16 bp, Homo sapiens
ctgtgaaaggaaagag

SEQ ID NO: 6188116 - DNA, 22 bp, Homo sapiens
ctgtgaaaggaaagagggaggt

SEQ ID NO: 6188117 - DNA, 18 bp, Homo sapiens
ctgtgaaaggtaggaaac

SEQ ID NO: 6188118 - DNA, 17 bp, Homo sapiens
ctgtgaaagtatgtgat

SEQ ID NO: 6188119 - DNA, 19 bp, Homo sapiens
ctgtgaaagtatgtgatat

SEQ ID NO: 6188120 - DNA, 22 bp, Homo sapiens
ctgtgaaagtctcctgtatcat

SEQ ID NO: 6188121 - DNA, 12 bp, Homo sapiens
ctgtgaaatagt

SEQ ID NO: 6188122 - DNA, 16 bp, Homo sapiens
ctgtgaaatgctggca

SEQ ID NO: 6188123 - DNA, 16 bp, Homo sapiens
ctgtgaaattctcaga

SEQ ID NO: 6188124 - DNA, 17 bp, Homo sapiens
gaaacttcggttgcaga

SEQ ID NO: 6188125 - DNA, 15 bp, Homo sapiens
gaaacttctgtaagg

SEQ ID NO: 6188126 - DNA, 19 bp, Homo sapiens
gaaacttctgtaaggggca

SEQ ID NO: 6188127 - DNA, 17 bp, Homo sapiens
gaaacttgaactccagg

SEQ ID NO: 6188128 - DNA, 14 bp, Homo sapiens
gaaacttggccagt

SEQ ID NO: 6188129 - DNA, 18 bp, Homo sapiens
gaaacttggccagtttgt

SEQ ID NO: 6188130 - DNA, 12 bp, Homo sapiens
gaaacttggctc

SEQ ID NO: 6188131 - DNA, 15 bp, Homo sapiens
gaaacttggctggaa

SEQ ID NO: 6188132 - DNA, 16 bp, Homo sapiens
gaaacttggctggaat

SEQ ID NO: 6188133 - DNA, 17 bp, Homo sapiens
gaaacttggttcccaga

SEQ ID NO: 6188134 - DNA, 20 bp, Homo sapiens
gaaacttgtcacttgcatgt

SEQ ID NO: 6188135 - DNA, 14 bp, Homo sapiens
gaaacttgtgtaaa

SEQ ID NO: 6188136 - DNA, 20 bp, Homo sapiens
gaaacttgtgtaaatacaat

SEQ ID NO: 6188137 - DNA, 15 bp, Homo sapiens
gaaacttgttattgt

SEQ ID NO: 6188138 - DNA, 17 bp, Homo sapiens
gaaacttgttattgtga

SEQ ID NO: 6188139 - DNA, 18 bp, Homo sapiens
gaaacttgtttcactgaa

SEQ ID NO: 6188140 - DNA, 12 bp, Homo sapiens
gaaactttatac

SEQ ID NO: 6188141 - DNA, 17 bp, Homo sapiens
gaaactttatttaaatg

SEQ ID NO: 6188142 - DNA, 18 bp, Homo sapiens
gaaactttatttaaatgc

SEQ ID NO: 6188143 - DNA, 19 bp, Homo sapiens
gaaactttatttaaatgca

SEQ ID NO: 6188144 - DNA, 15 bp, Homo sapiens
gaaactttcctttaa

SEQ ID NO: 6188145 - DNA, 18 bp, Homo sapiens
gaaactttcctttaactc

SEQ ID NO: 6188146 - DNA, 18 bp, Homo sapiens
gaaactttgatctctgct

SEQ ID NO: 6188147 - DNA, 17 bp, Homo sapiens
gaaactttggaagtttt

SEQ ID NO: 6188148 - DNA, 12 bp, Homo sapiens
gaaacttttatc

SEQ ID NO: 6188149 - DNA, 11 bp, Homo sapiens
gaaacttttct

SEQ ID NO: 6188150 - DNA, 15 bp, Homo sapiens
gaaacttttctaaag

SEQ ID NO: 6188151 - DNA, 10 bp, Homo sapiens
gaaacttttg

SEQ ID NO: 6188152 - DNA, 13 bp, Homo sapiens
gaaacttttggaa

SEQ ID NO: 6188153 - DNA, 21 bp, Homo sapiens
gaaacttttgtaaagaaattt

SEQ ID NO: 6188154 - DNA, 19 bp, Homo sapiens
gaaactttttaataaagta

SEQ ID NO: 6188155 - DNA, 17 bp, Homo sapiens
gaaacttttttatttaa

SEQ ID NO: 6188156 - DNA, 18 bp, Homo sapiens
gaaacttttttatttaaa

SEQ ID NO: 6188157 - DNA, 23 bp, Homo sapiens
gaaacttttttcattttgaaaag

SEQ ID NO: 6188158 - DNA, 10 bp, Homo sapiens
gaaagaaaaa

SEQ ID NO: 6188159 - DNA, 15 bp, Homo sapiens
gaaagaaaagacaaa

SEQ ID NO: 6188160 - DNA, 16 bp, Homo sapiens
gaaagaaaagaccctg

SEQ ID NO: 6188161 - DNA, 18 bp, Homo sapiens
gaaagaaaaggaatgcaa

SEQ ID NO: 6188162 - DNA, 15 bp, Homo sapiens
gaaagaaaaggcaaa

SEQ ID NO: 6188163 - DNA, 21 bp, Homo sapiens
gaaagaaaataccaaggaaca

SEQ ID NO: 6188164 - DNA, 16 bp, Homo sapiens
gaaagaaaatatgcat

SEQ ID NO: 6188165 - DNA, 17 bp, Homo sapiens
gaaagaaaatatgcatc

SEQ ID NO: 6188166 - DNA, 18 bp, Homo sapiens
gaaagaaaatcaggctgg

SEQ ID NO: 6188167 - DNA, 22 bp, Homo sapiens
gaaagaaaatggaaagaaggaa

SEQ ID NO: 6188168 - DNA, 14 bp, Homo sapiens
gaaagaaactaaga

SEQ ID NO: 6188169 - DNA, 17 bp, Homo sapiens
gaaagaaagaagactgt

SEQ ID NO: 6188170 - DNA, 15 bp, Homo sapiens
gaaagaaagaggaaa

SEQ ID NO: 6188171 - DNA, 15 bp, Homo sapiens
gaaagaaagggaccc

SEQ ID NO: 6188172 - DNA, 18 bp, Homo sapiens
gaaagaaagtaaaaaagg

SEQ ID NO: 6188173 - DNA, 16 bp, Homo sapiens
gaaagaaagtacccag

SEQ ID NO: 6188174 - DNA, 23 bp, Homo sapiens
gaaagaaagttgcacggctgctg

SEQ ID NO: 6188175 - DNA, 20 bp, Homo sapiens
gaaagaaattgtttttctga

SEQ ID NO: 6188176 - DNA, 18 bp, Homo sapiens
gaaagaaatttgaaaaaa

SEQ ID NO: 6188177 - DNA, 20 bp, Homo sapiens
gaaagaacatggacttgtat

SEQ ID NO: 6188178 - DNA, 16 bp, Homo sapiens
gaaagaacggaagaag

SEQ ID NO: 6188179 - DNA, 20 bp, Homo sapiens
gaaagaactatcttcatctg

SEQ ID NO: 6188180 - DNA, 21 bp, Homo sapiens
gaaagaactatcttcatctga

SEQ ID NO: 6188181 - DNA, 11 bp, Homo sapiens
gaaagaactta

SEQ ID NO: 6188182 - DNA, 21 bp, Homo sapiens
gaaagaactttaaagctcagg

SEQ ID NO: 6188183 - DNA, 19 bp, Homo sapiens
gaaagaagacacagaacca

SEQ ID NO: 6188184 - DNA, 15 bp, Homo sapiens
gaaagaagagacagg

SEQ ID NO: 6188185 - DNA, 19 bp, Homo sapiens
gaaagaagagccggagcct

SEQ ID NO: 6188186 - DNA, 16 bp, Homo sapiens
gaaagaagcaagacac

SEQ ID NO: 6188187 - DNA, 14 bp, Homo sapiens
gaaagaagcactct

SEQ ID NO: 6188188 - DNA, 19 bp, Homo sapiens
gaaagaagcagttctcaca

SEQ ID NO: 6188189 - DNA, 12 bp, Homo sapiens
gaaagaagccat

SEQ ID NO: 6188190 - DNA, 14 bp, Homo sapiens
gaaagaaggaaaaa

SEQ ID NO: 6188191 - DNA, 11 bp, Homo sapiens
gaaagaaggag

SEQ ID NO: 6188192 - DNA, 17 bp, Homo sapiens
gaaagaagggggccctg

SEQ ID NO: 6188193 - DNA, 19 bp, Homo sapiens
gaaagaagggggccctgct

SEQ ID NO: 6188194 - DNA, 20 bp, Homo sapiens
gaaagaagtgtggggatttt

SEQ ID NO: 6188195 - DNA, 17 bp, Homo sapiens
gaaagaataaaatgttt

SEQ ID NO: 6188196 - DNA, 12 bp, Homo sapiens
gaaagaatagaa

SEQ ID NO: 6188197 - DNA, 13 bp, Homo sapiens
gaaagaatagaaa

SEQ ID NO: 6188198 - DNA, 19 bp, Homo sapiens
gaaagaatagaaagaaagt

SEQ ID NO: 6188199 - DNA, 18 bp, Homo sapiens
gaaagaatatatttattt

SEQ ID NO: 6188200 - DNA, 19 bp, Homo sapiens
gaaagaatgaaagagtaaa

SEQ ID NO: 6188201 - DNA, 18 bp, Homo sapiens
gaaagaatgagaaagaaa

SEQ ID NO: 6188202 - DNA, 21 bp, Homo sapiens
gaaagaattatttgccttctg

SEQ ID NO: 6188203 - DNA, 17 bp, Homo sapiens
gaaagacaaagaaggaa

SEQ ID NO: 6188204 - DNA, 13 bp, Homo sapiens
gaaagacactgcc

SEQ ID NO: 6188205 - DNA, 19 bp, Homo sapiens
gaaagacactgcctgggct

SEQ ID NO: 6188206 - DNA, 21 bp, Homo sapiens
gaaagacaggagtttatctat

SEQ ID NO: 6188207 - DNA, 12 bp, Homo sapiens
gaaagacagtaa

SEQ ID NO: 6188208 - DNA, 20 bp, Homo sapiens
gaaagacatcacatccctct

SEQ ID NO: 6188209 - DNA, 23 bp, Homo sapiens
gaaagacatccataaagaagcaa

SEQ ID NO: 6188210 - DNA, 13 bp, Homo sapiens
gaaagacatctgc

SEQ ID NO: 6188211 - DNA, 21 bp, Homo sapiens
gaaagacatctgcctgtaatt

SEQ ID NO: 6188212 - DNA, 14 bp, Homo sapiens
gaaagacatctttc

SEQ ID NO: 6188213 - DNA, 19 bp, Homo sapiens
gaaagacctgtgaggggaa

SEQ ID NO: 6188214 - DNA, 15 bp, Homo sapiens
gaaagacgcactttg

SEQ ID NO: 6188215 - DNA, 17 bp, Homo sapiens
gaaagacgcactttggc

SEQ ID NO: 6188216 - DNA, 21 bp, Homo sapiens
gaaagacggattgcattagaa

SEQ ID NO: 6188217 - DNA, 13 bp, Homo sapiens
gaaagactgaaag

SEQ ID NO: 6188218 - DNA, 19 bp, Homo sapiens
gaaagactgaagaaagtgt

SEQ ID NO: 6188219 - DNA, 14 bp, Homo sapiens
gaaagacttccaaa

SEQ ID NO: 6188220 - DNA, 21 bp, Homo sapiens
gaaagacttctcaaagagaat

SEQ ID NO: 6188221 - DNA, 22 bp, Homo sapiens
gaaagacttctctacccatctt

SEQ ID NO: 6188222 - DNA, 22 bp, Homo sapiens
gaaagagaaaatatatattttt

SEQ ID NO: 6188223 - DNA, 19 bp, Homo sapiens
gaaagagaaaatgctttct

SEQ ID NO: 6188224 - DNA, 19 bp, Homo sapiens
gaaagagaaacctgagtga

SEQ ID NO: 6188225 - DNA, 20 bp, Homo sapiens
gaaagagaaatgatgtgaaa

SEQ ID NO: 6188226 - DNA, 17 bp, Homo sapiens
gaaagagaacttccaga

SEQ ID NO: 6188227 - DNA, 11 bp, Homo sapiens
gaaagagaatg

SEQ ID NO: 6188228 - DNA, 18 bp, Homo sapiens
gaaagagaatgaactgtg

SEQ ID NO: 6188229 - DNA, 19 bp, Homo sapiens
gaaagagactgtggggagg

SEQ ID NO: 6188230 - DNA, 14 bp, Homo sapiens
gaaagagagaaaat

SEQ ID NO: 6188231 - DNA, 16 bp, Homo sapiens
gaaagagagaaaataa

SEQ ID NO: 6188232 - DNA, 17 bp, Homo sapiens
gaaagagagaaaataaa

SEQ ID NO: 6188233 - DNA, 20 bp, Homo sapiens
gaaagagagaaaataaaaag

SEQ ID NO: 6188234 - DNA, 22 bp, Homo sapiens
gaaagagagaaaataaaaagtt

SEQ ID NO: 6188235 - DNA, 19 bp, Homo sapiens
gaaagagagaagccagcca

SEQ ID NO: 6188236 - DNA, 11 bp, Homo sapiens
gaaagagagag

SEQ ID NO: 6188237 - DNA, 19 bp, Homo sapiens
gaaagagagagaattcttt

SEQ ID NO: 6188238 - DNA, 14 bp, Homo sapiens
gaaagagagagaga

SEQ ID NO: 6188239 - DNA, 23 bp, Homo sapiens
gaaagagagatgggccaggcaga

SEQ ID NO: 6188240 - DNA, 13 bp, Homo sapiens
gaaagagagcagg

SEQ ID NO: 6188241 - DNA, 14 bp, Homo sapiens
gaaagagcattatt

SEQ ID NO: 6188242 - DNA, 21 bp, Homo sapiens
gaaagagccttaatgtatttg

SEQ ID NO: 6188243 - DNA, 22 bp, Homo sapiens
gaaagagctaggaaccctggag

SEQ ID NO: 6188244 - DNA, 19 bp, Homo sapiens
gaaagagctgcctggatga

SEQ ID NO: 6188245 - DNA, 13 bp, Homo sapiens
gaaagaggaaccc

SEQ ID NO: 6188246 - DNA, 13 bp, Homo sapiens
gaaagaggaagca

SEQ ID NO: 6188247 - DNA, 19 bp, Homo sapiens
gaaagaggaataaaatgat

SEQ ID NO: 6188248 - DNA, 22 bp, Homo sapiens
gaaagaggaataaaatgattaa

SEQ ID NO: 6188249 - DNA, 11 bp, Homo sapiens
gaaagaggaga

SEQ ID NO: 6188250 - DNA, 15 bp, Homo sapiens
gaaagaggagaagga

SEQ ID NO: 6188251 - DNA, 23 bp, Homo sapiens
gaaagaggaggacccctgccttc

SEQ ID NO: 6188252 - DNA, 17 bp, Homo sapiens
gaaagaggagtgcttgt

SEQ ID NO: 6188253 - DNA, 16 bp, Homo sapiens
gaaagaggcaccagga

SEQ ID NO: 6188254 - DNA, 18 bp, Homo sapiens
gaaagaggcacccttcca

SEQ ID NO: 6188255 - DNA, 19 bp, Homo sapiens
gaaagaggcacccttccat

SEQ ID NO: 6188256 - DNA, 13 bp, Homo sapiens
gaaagagggagca

SEQ ID NO: 6188257 - DNA, 15 bp, Homo sapiens
gaaagagggtactag

SEQ ID NO: 6188258 - DNA, 17 bp, Homo sapiens
gaaagagggtcccaggg

SEQ ID NO: 6188259 - DNA, 20 bp, Homo sapiens
gaaagaggtaaaattctcta

SEQ ID NO: 6188260 - DNA, 14 bp, Homo sapiens
gaaagaggtctccc

SEQ ID NO: 6188261 - DNA, 17 bp, Homo sapiens
gaaagaggtctccccat

SEQ ID NO: 6188262 - DNA, 20 bp, Homo sapiens
gaaagaggtctccccatccc

SEQ ID NO: 6188263 - DNA, 21 bp, Homo sapiens
gaaagaggtgaaaatgaagaa

SEQ ID NO: 6188264 - DNA, 14 bp, Homo sapiens
gaaagaggtgaccc

SEQ ID NO: 6188265 - DNA, 20 bp, Homo sapiens
gaaagaggtgaccccagggc

SEQ ID NO: 6188266 - DNA, 20 bp, Homo sapiens
gaaagaggttttcacaaatg

SEQ ID NO: 6188267 - DNA, 20 bp, Homo sapiens
gaaagagtaaaaccaaaggt

SEQ ID NO: 6188268 - DNA, 15 bp, Homo sapiens
gaaagagtaaaggaa

SEQ ID NO: 6188269 - DNA, 21 bp, Homo sapiens
gaaagagtactcttgtttcct

SEQ ID NO: 6188270 - DNA, 16 bp, Homo sapiens
gaaagagtatgtacgt

SEQ ID NO: 6188271 - DNA, 17 bp, Homo sapiens
gaaagagtccattgttt

SEQ ID NO: 6188272 - DNA, 17 bp, Homo sapiens
gaaagagtcttcaacat

SEQ ID NO: 6188273 - DNA, 13 bp, Homo sapiens
gaaagataaatga

SEQ ID NO: 6188274 - DNA, 14 bp, Homo sapiens
gaaagataactagg

SEQ ID NO: 6188275 - DNA, 17 bp, Homo sapiens
gaaagataataaattga

SEQ ID NO: 6188276 - DNA, 15 bp, Homo sapiens
gaaagatacagacat

SEQ ID NO: 6188277 - DNA, 23 bp, Homo sapiens
gaaagatactaatagagtactta

SEQ ID NO: 6188278 - DNA, 11 bp, Homo sapiens
gaaagatatct

SEQ ID NO: 6188279 - DNA, 15 bp, Homo sapiens
gaaagatatctatga

SEQ ID NO: 6188280 - DNA, 18 bp, Homo sapiens
gaaagatatgtatatttt

SEQ ID NO: 6188281 - DNA, 21 bp, Homo sapiens
gaaagatatgtatatttttga

SEQ ID NO: 6188282 - DNA, 16 bp, Homo sapiens
gaaagatcaaaaggtt

SEQ ID NO: 6188283 - DNA, 15 bp, Homo sapiens
gaaagatccaccctc

SEQ ID NO: 6188284 - DNA, 14 bp, Homo sapiens
gaaagatcccaagt

SEQ ID NO: 6188285 - DNA, 18 bp, Homo sapiens
gaaagatctctgtcacat

SEQ ID NO: 6188286 - DNA, 17 bp, Homo sapiens
gaaagatgagcttttct

SEQ ID NO: 6188287 - DNA, 17 bp, Homo sapiens
gaaagatgatgctcagt

SEQ ID NO: 6188288 - DNA, 20 bp, Homo sapiens
gaaagatggaaattctgaaa

SEQ ID NO: 6188289 - DNA, 14 bp, Homo sapiens
gaaagatggataaa

SEQ ID NO: 6188290 - DNA, 13 bp, Homo sapiens
gaaagatggggag

SEQ ID NO: 6188291 - DNA, 14 bp, Homo sapiens
gaaagatggggagc

SEQ ID NO: 6188292 - DNA, 17 bp, Homo sapiens
gaaagatggtaatcttt

SEQ ID NO: 6188293 - DNA, 17 bp, Homo sapiens
gaaagatgtcccacagg

SEQ ID NO: 6188294 - DNA, 20 bp, Homo sapiens
gaaagatgtcccacagggac

SEQ ID NO: 6188295 - DNA, 19 bp, Homo sapiens
gaaagatgttaagcattta

SEQ ID NO: 6188296 - DNA, 20 bp, Homo sapiens
gaaagattatattttataag

SEQ ID NO: 6188297 - DNA, 15 bp, Homo sapiens
gaaagattgtaaact

SEQ ID NO: 6188298 - DNA, 16 bp, Homo sapiens
gaaagattgtaaacta

SEQ ID NO: 6188299 - DNA, 13 bp, Homo sapiens
gaaagatttaatg

SEQ ID NO: 6188300 - DNA, 15 bp, Homo sapiens
gaaagatttggaaaa

SEQ ID NO: 6188301 - DNA, 20 bp, Homo sapiens
gaaagatttggaaaattcac

SEQ ID NO: 6188302 - DNA, 20 bp, Homo sapiens
gaaagatttgttactgtatt

SEQ ID NO: 6188303 - DNA, 21 bp, Homo sapiens
gaaagatttgttactgtattt

SEQ ID NO: 6188304 - DNA, 17 bp, Homo sapiens
ctgtgaaattctcagag

SEQ ID NO: 6188305 - DNA, 20 bp, Homo sapiens
ctgtgaacaagcttcagtaa

SEQ ID NO: 6188306 - DNA, 19 bp, Homo sapiens
ctgtgaacagagagaccct

SEQ ID NO: 6188307 - DNA, 14 bp, Homo sapiens
ctgtgaacagcttg

SEQ ID NO: 6188308 - DNA, 18 bp, Homo sapiens
ctgtgaacagcttgctgt

SEQ ID NO: 6188309 - DNA, 15 bp, Homo sapiens
ctgtgaacatgcctc

SEQ ID NO: 6188310 - DNA, 22 bp, Homo sapiens
ctgtgaacatgcctcctcctgc

SEQ ID NO: 6188311 - DNA, 21 bp, Homo sapiens
ctgtgaaccaacccccatctc

SEQ ID NO: 6188312 - DNA, 14 bp, Homo sapiens
ctgtgaacccagga

SEQ ID NO: 6188313 - DNA, 17 bp, Homo sapiens
ctgtgaacccaggacaa

SEQ ID NO: 6188314 - DNA, 14 bp, Homo sapiens
ctgtgaacctggag

SEQ ID NO: 6188315 - DNA, 18 bp, Homo sapiens
ctgtgaacgatttagaaa

SEQ ID NO: 6188316 - DNA, 21 bp, Homo sapiens
ctgtgaactattttgaagaaa

SEQ ID NO: 6188317 - DNA, 15 bp, Homo sapiens
ctgtgaactgggcat

SEQ ID NO: 6188318 - DNA, 15 bp, Homo sapiens
ctgtgaactgtgtgt

SEQ ID NO: 6188319 - DNA, 15 bp, Homo sapiens
ctgtgaacttgatgt

SEQ ID NO: 6188320 - DNA, 19 bp, Homo sapiens
ctgtgaacttgatgttcct

SEQ ID NO: 6188321 - DNA, 22 bp, Homo sapiens
ctgtgaacttggggaacaaggg

SEQ ID NO: 6188322 - DNA, 23 bp, Homo sapiens
ctgtgaagaaccctgcagggccc

SEQ ID NO: 6188323 - DNA, 19 bp, Homo sapiens
ctgtgaagaagccctgttc

SEQ ID NO: 6188324 - DNA, 19 bp, Homo sapiens
ctgtgaagacccagcagga

SEQ ID NO: 6188325 - DNA, 20 bp, Homo sapiens
ctgtgaagacccagcaggaa

SEQ ID NO: 6188326 - DNA, 23 bp, Homo sapiens
ctgtgaagacccaggagagacag

SEQ ID NO: 6188327 - DNA, 15 bp, Homo sapiens
ctgtgaagagaatgt

SEQ ID NO: 6188328 - DNA, 23 bp, Homo sapiens
ctgtgaagagccggtggtgcccg

SEQ ID NO: 6188329 - DNA, 20 bp, Homo sapiens
ctgtgaagatctcactctgc

SEQ ID NO: 6188330 - DNA, 17 bp, Homo sapiens
ctgtgaagcctttatct

SEQ ID NO: 6188331 - DNA, 18 bp, Homo sapiens
ctgtgaaggagtaatggg

SEQ ID NO: 6188332 - DNA, 18 bp, Homo sapiens
ctgtgaagggtacagatt

SEQ ID NO: 6188333 - DNA, 23 bp, Homo sapiens
ctgtgaagtaacccctcctggct

SEQ ID NO: 6188334 - DNA, 16 bp, Homo sapiens
ctgtgaagtccttcac

SEQ ID NO: 6188335 - DNA, 24 bp, Homo sapiens
ctgtgaagtccttcacctcactga

SEQ ID NO: 6188336 - DNA, 17 bp, Homo sapiens
ctgtgaagtgagacctt

SEQ ID NO: 6188337 - DNA, 13 bp, Homo sapiens
ctgtgaagtgtta

SEQ ID NO: 6188338 - DNA, 21 bp, Homo sapiens
ctgtgaagttacatgcataaa

SEQ ID NO: 6188339 - DNA, 22 bp, Homo sapiens
ctgtgaagttacatgcataaaa

SEQ ID NO: 6188340 - DNA, 23 bp, Homo sapiens
ctgtgaagttacatgcataaaag

SEQ ID NO: 6188341 - DNA, 13 bp, Homo sapiens
ctgtgaatacaat

SEQ ID NO: 6188342 - DNA, 22 bp, Homo sapiens
ctgtgaatacaattaaaggtcc

SEQ ID NO: 6188343 - DNA, 22 bp, Homo sapiens
ctgtgaatatccagaaataaaa

SEQ ID NO: 6188344 - DNA, 15 bp, Homo sapiens
ctgtgaatatgagaa

SEQ ID NO: 6188345 - DNA, 16 bp, Homo sapiens
ctgtgaatatgagaaa

SEQ ID NO: 6188346 - DNA, 16 bp, Homo sapiens
ctgtgaatatgtgtaa

SEQ ID NO: 6188347 - DNA, 19 bp, Homo sapiens
ctgtgaatatgtgtaactt

SEQ ID NO: 6188348 - DNA, 18 bp, Homo sapiens
ctgtgaatcacctagggg

SEQ ID NO: 6188349 - DNA, 19 bp, Homo sapiens
ctgtgaatccatgggtctg

SEQ ID NO: 6188350 - DNA, 22 bp, Homo sapiens
ctgtgaatccatgggtctggct

SEQ ID NO: 6188351 - DNA, 18 bp, Homo sapiens
ctgtgaatcctggcaaga

SEQ ID NO: 6188352 - DNA, 21 bp, Homo sapiens
ctgtgaatcctggcaagaaag

SEQ ID NO: 6188353 - DNA, 15 bp, Homo sapiens
ctgtgaatgccactg

SEQ ID NO: 6188354 - DNA, 20 bp, Homo sapiens
ctgtgaatgccactgccttc

SEQ ID NO: 6188355 - DNA, 14 bp, Homo sapiens
ctgtgaatgctaag

SEQ ID NO: 6188356 - DNA, 14 bp, Homo sapiens
ctgtgaatgcttct

SEQ ID NO: 6188357 - DNA, 14 bp, Homo sapiens
ctgtgaatggaagc

SEQ ID NO: 6188358 - DNA, 22 bp, Homo sapiens
ctgtgaatggaggcagagacct

SEQ ID NO: 6188359 - DNA, 16 bp, Homo sapiens
ctgtgaatggctgtgc

SEQ ID NO: 6188360 - DNA, 18 bp, Homo sapiens
ctgtgaatggctgtgccc

SEQ ID NO: 6188361 - DNA, 19 bp, Homo sapiens
ctgtgaatggctgtgcccc

SEQ ID NO: 6188362 - DNA, 13 bp, Homo sapiens
ctgtgaattaagc

SEQ ID NO: 6188363 - DNA, 20 bp, Homo sapiens
ctgtgaattcattctggagg

SEQ ID NO: 6188364 - DNA, 21 bp, Homo sapiens
ctgtgaattcattctggaggg

SEQ ID NO: 6188365 - DNA, 15 bp, Homo sapiens
ctgtgaattgagctg

SEQ ID NO: 6188366 - DNA, 19 bp, Homo sapiens
ctgtgaattgagctgcaga

SEQ ID NO: 6188367 - DNA, 21 bp, Homo sapiens
ctgtgaattgtggctgttcac

SEQ ID NO: 6188368 - DNA, 12 bp, Homo sapiens
ctgtgaatttca

SEQ ID NO: 6188369 - DNA, 14 bp, Homo sapiens
ctgtgaatttcaaa

SEQ ID NO: 6188370 - DNA, 21 bp, Homo sapiens
ctgtgacaaaggatgaagaac

SEQ ID NO: 6188371 - DNA, 23 bp, Homo sapiens
ctgtgacaaaggatgaagaacac

SEQ ID NO: 6188372 - DNA, 19 bp, Homo sapiens
ctgtgacaaccctggcctc

SEQ ID NO: 6188373 - DNA, 20 bp, Homo sapiens
ctgtgacaaccctggcctca

SEQ ID NO: 6188374 - DNA, 22 bp, Homo sapiens
ctgtgacaagccaatgtgaatt

SEQ ID NO: 6188375 - DNA, 20 bp, Homo sapiens
ctgtgacaataagtttgaac

SEQ ID NO: 6188376 - DNA, 14 bp, Homo sapiens
ctgtgacaatgact

SEQ ID NO: 6188377 - DNA, 20 bp, Homo sapiens
ctgtgacaatgactaagcca

SEQ ID NO: 6188378 - DNA, 13 bp, Homo sapiens
ctgtgacacagac

SEQ ID NO: 6188379 - DNA, 22 bp, Homo sapiens
ctgtgacagactttggacagtg

SEQ ID NO: 6188380 - DNA, 15 bp, Homo sapiens
ctgtgacagcagctc

SEQ ID NO: 6188381 - DNA, 22 bp, Homo sapiens
ctgtgacagcagctctgtcccc

SEQ ID NO: 6188382 - DNA, 14 bp, Homo sapiens
ctgtgacaggaagc

SEQ ID NO: 6188383 - DNA, 17 bp, Homo sapiens
ctgtgacaggcagcaga

SEQ ID NO: 6188384 - DNA, 14 bp, Homo sapiens
ctgtgacagtgaaa

SEQ ID NO: 6188385 - DNA, 16 bp, Homo sapiens
ctgtgacatcagaagt

SEQ ID NO: 6188386 - DNA, 18 bp, Homo sapiens
ctgtgacatcctgcttct

SEQ ID NO: 6188387 - DNA, 21 bp, Homo sapiens
ctgtgacatggtgcctgagag

SEQ ID NO: 6188388 - DNA, 13 bp, Homo sapiens
ctgtgacatgtaa

SEQ ID NO: 6188389 - DNA, 19 bp, Homo sapiens
ctgtgacattgctggtcat

SEQ ID NO: 6188390 - DNA, 13 bp, Homo sapiens
ctgtgacatttat

SEQ ID NO: 6188391 - DNA, 16 bp, Homo sapiens
ctgtgacatttttccg

SEQ ID NO: 6188392 - DNA, 15 bp, Homo sapiens
ctgtgaccaaagcat

SEQ ID NO: 6188393 - DNA, 16 bp, Homo sapiens
ctgtgaccacaacatg

SEQ ID NO: 6188394 - DNA, 20 bp, Homo sapiens
ctgtgaccagcactgtctca

SEQ ID NO: 6188395 - DNA, 17 bp, Homo sapiens
ctgtgaccatttataat

SEQ ID NO: 6188396 - DNA, 19 bp, Homo sapiens
ctgtgaccatttataatgt

SEQ ID NO: 6188397 - DNA, 21 bp, Homo sapiens
ctgtgacccaagaactcctga

SEQ ID NO: 6188398 - DNA, 18 bp, Homo sapiens
ctgtgacccatctgtagt

SEQ ID NO: 6188399 - DNA, 14 bp, Homo sapiens
ctgtgaccccacct

SEQ ID NO: 6188400 - DNA, 17 bp, Homo sapiens
ctgtgaccccaccttga

SEQ ID NO: 6188401 - DNA, 15 bp, Homo sapiens
ctgtgacccccagct

SEQ ID NO: 6188402 - DNA, 16 bp, Homo sapiens
ctgtgacccctccttg

SEQ ID NO: 6188403 - DNA, 14 bp, Homo sapiens
ctgtgaccctctca

SEQ ID NO: 6188404 - DNA, 16 bp, Homo sapiens
ctgtgaccctctcact

SEQ ID NO: 6188405 - DNA, 21 bp, Homo sapiens
ctgtgaccctctcactttggt

SEQ ID NO: 6188406 - DNA, 23 bp, Homo sapiens
ctgtgaccctctttgctgaagaa

SEQ ID NO: 6188407 - DNA, 21 bp, Homo sapiens
ctgtgaccggggtcctgaggc

SEQ ID NO: 6188408 - DNA, 23 bp, Homo sapiens
ctgtgaccggggtcctgaggctg

SEQ ID NO: 6188409 - DNA, 15 bp, Homo sapiens
ctgtgacctaagaac

SEQ ID NO: 6188410 - DNA, 19 bp, Homo sapiens
ctgtgacctccgcctcctg

SEQ ID NO: 6188411 - DNA, 14 bp, Homo sapiens
ctgtgacctctgac

SEQ ID NO: 6188412 - DNA, 15 bp, Homo sapiens
ctgtgacctcttcaa

SEQ ID NO: 6188413 - DNA, 14 bp, Homo sapiens
ctgtgacctgcatc

SEQ ID NO: 6188414 - DNA, 22 bp, Homo sapiens
ctgtgacctgccccgcccagct

SEQ ID NO: 6188415 - DNA, 13 bp, Homo sapiens
ctgtgacctgctc

SEQ ID NO: 6188416 - DNA, 14 bp, Homo sapiens
ctgtgacctgctcc

SEQ ID NO: 6188417 - DNA, 21 bp, Homo sapiens
ctgtgacctgctgagctctga

SEQ ID NO: 6188418 - DNA, 22 bp, Homo sapiens
ctgtgacctgctgagctctgag

SEQ ID NO: 6188419 - DNA, 15 bp, Homo sapiens
ctgtgacctggtctg

SEQ ID NO: 6188420 - DNA, 23 bp, Homo sapiens
ctgtgacctggtctggtcaggca

SEQ ID NO: 6188421 - DNA, 14 bp, Homo sapiens
ctgtgacctgtcag

SEQ ID NO: 6188422 - DNA, 14 bp, Homo sapiens
ctgtgacctgtggg

SEQ ID NO: 6188423 - DNA, 18 bp, Homo sapiens
ctgtgaccttacagccat

SEQ ID NO: 6188424 - DNA, 17 bp, Homo sapiens
ctgtgacctttgtctag

SEQ ID NO: 6188425 - DNA, 16 bp, Homo sapiens
ctgtgacgcagacaga

SEQ ID NO: 6188426 - DNA, 23 bp, Homo sapiens
ctgtgacgcagccggagggaggc

SEQ ID NO: 6188427 - DNA, 15 bp, Homo sapiens
ctgtgactaggcata

SEQ ID NO: 6188428 - DNA, 17 bp, Homo sapiens
ctgtgactcattcccag

SEQ ID NO: 6188429 - DNA, 16 bp, Homo sapiens
ctgtgactctgggcag

SEQ ID NO: 6188430 - DNA, 19 bp, Homo sapiens
ctgtgactctgggcaggga

SEQ ID NO: 6188431 - DNA, 23 bp, Homo sapiens
ctgtgactcttagccctcaccac

SEQ ID NO: 6188432 - DNA, 14 bp, Homo sapiens
ctgtgactcttctc

SEQ ID NO: 6188433 - DNA, 16 bp, Homo sapiens
ctgtgactcttctctc

SEQ ID NO: 6188434 - DNA, 14 bp, Homo sapiens
ctgtgactcttttt

SEQ ID NO: 6188435 - DNA, 23 bp, Homo sapiens
ctgtgactggatcttctatcatt

SEQ ID NO: 6188436 - DNA, 17 bp, Homo sapiens
ctgtgacttcagctctg

SEQ ID NO: 6188437 - DNA, 22 bp, Homo sapiens
ctgtgacttcagctctgtttta

SEQ ID NO: 6188438 - DNA, 16 bp, Homo sapiens
ctgtgacttctccagg

SEQ ID NO: 6188439 - DNA, 16 bp, Homo sapiens
ctgtgagaaaggaaaa

SEQ ID NO: 6188440 - DNA, 23 bp, Homo sapiens
ctgtgagaacccagtttcccgtc

SEQ ID NO: 6188441 - DNA, 15 bp, Homo sapiens
ctgtgagaactgtga

SEQ ID NO: 6188442 - DNA, 16 bp, Homo sapiens
ctgtgagaagtttttg

SEQ ID NO: 6188443 - DNA, 22 bp, Homo sapiens
ctgtgagaatagtggaggaagg

SEQ ID NO: 6188444 - DNA, 14 bp, Homo sapiens
ctgtgagaccccca

SEQ ID NO: 6188445 - DNA, 15 bp, Homo sapiens
ctgtgagacccccac

SEQ ID NO: 6188446 - DNA, 23 bp, Homo sapiens
ctgtgagacccccacacctcagt

SEQ ID NO: 6188447 - DNA, 18 bp, Homo sapiens
ctgtgagacgaggcaggg

SEQ ID NO: 6188448 - DNA, 19 bp, Homo sapiens
ctgtgagacgaggcagggg

SEQ ID NO: 6188449 - DNA, 22 bp, Homo sapiens
ctgtgagacgaggcaggggctc

SEQ ID NO: 6188450 - DNA, 18 bp, Homo sapiens
ctgtgagactcgagaact

SEQ ID NO: 6188451 - DNA, 13 bp, Homo sapiens
ctgtgagagccac

SEQ ID NO: 6188452 - DNA, 16 bp, Homo sapiens
ctgtgagatccgtgaa

SEQ ID NO: 6188453 - DNA, 21 bp, Homo sapiens
ctgtgagatgctagaactccc

SEQ ID NO: 6188454 - DNA, 23 bp, Homo sapiens
ctgtgagatgctagaactccctt

SEQ ID NO: 6188455 - DNA, 13 bp, Homo sapiens
ctgtgagatgtgt

SEQ ID NO: 6188456 - DNA, 13 bp, Homo sapiens
ctgtgagattttg

SEQ ID NO: 6188457 - DNA, 13 bp, Homo sapiens
ctgtgagcaaagt

SEQ ID NO: 6188458 - DNA, 20 bp, Homo sapiens
ctgtgagcaagagccagggg

SEQ ID NO: 6188459 - DNA, 23 bp, Homo sapiens
ctgtgagcaaggagcacaagcca

SEQ ID NO: 6188460 - DNA, 16 bp, Homo sapiens
ctgtgagcacaaagaa

SEQ ID NO: 6188461 - DNA, 21 bp, Homo sapiens
ctgtgagcacaaagaagaaag

SEQ ID NO: 6188462 - DNA, 14 bp, Homo sapiens
ctgtgagcagcctc

SEQ ID NO: 6188463 - DNA, 20 bp, Homo sapiens
ctgtgagcagcctccactgt

SEQ ID NO: 6188464 - DNA, 21 bp, Homo sapiens
ctgtgagcagcctccactgtg

SEQ ID NO: 6188465 - DNA, 16 bp, Homo sapiens
ctgtgagcatcacagt

SEQ ID NO: 6188466 - DNA, 13 bp, Homo sapiens
ctgtgagcatcct

SEQ ID NO: 6188467 - DNA, 19 bp, Homo sapiens
ctgtgagcatccttcccag

SEQ ID NO: 6188468 - DNA, 17 bp, Homo sapiens
ctgtgagcatggggcca

SEQ ID NO: 6188469 - DNA, 18 bp, Homo sapiens
ctgtgagcatggggccag

SEQ ID NO: 6188470 - DNA, 19 bp, Homo sapiens
ctgtgagcatggggccagg

SEQ ID NO: 6188471 - DNA, 15 bp, Homo sapiens
ctgtgagccatgcct

SEQ ID NO: 6188472 - DNA, 17 bp, Homo sapiens
ctgtgagcccagctggg

SEQ ID NO: 6188473 - DNA, 14 bp, Homo sapiens
ctgtgagccccaca

SEQ ID NO: 6188474 - DNA, 16 bp, Homo sapiens
ctgtgagcccctggtc

SEQ ID NO: 6188475 - DNA, 12 bp, Homo sapiens
ctgtgagccttg

SEQ ID NO: 6188476 - DNA, 20 bp, Homo sapiens
ctgtgagctcccaggtgcag

SEQ ID NO: 6188477 - DNA, 20 bp, Homo sapiens
ctgtgaggaaagcacacagt

SEQ ID NO: 6188478 - DNA, 24 bp, Homo sapiens
ctgtgaggaagaggttgcagtgag

SEQ ID NO: 6188479 - DNA, 17 bp, Homo sapiens
ctgtgaggaatgctctg

SEQ ID NO: 6188480 - DNA, 16 bp, Homo sapiens
ctgtgaggacagggcc

SEQ ID NO: 6188481 - DNA, 13 bp, Homo sapiens
gaaagattttatt

SEQ ID NO: 6188482 - DNA, 23 bp, Homo sapiens
gaaagatttttactaatatatat

SEQ ID NO: 6188483 - DNA, 17 bp, Homo sapiens
gaaagcaaaaaataaaa

SEQ ID NO: 6188484 - DNA, 13 bp, Homo sapiens
gaaagcaaaaatg

SEQ ID NO: 6188485 - DNA, 14 bp, Homo sapiens
gaaagcaaaaatgc

SEQ ID NO: 6188486 - DNA, 14 bp, Homo sapiens
gaaagcaaaacatt

SEQ ID NO: 6188487 - DNA, 16 bp, Homo sapiens
gaaagcaaaacatttt

SEQ ID NO: 6188488 - DNA, 19 bp, Homo sapiens
gaaagcaaacatgtgcaga

SEQ ID NO: 6188489 - DNA, 19 bp, Homo sapiens
gaaagcaaatcagacacaa

SEQ ID NO: 6188490 - DNA, 22 bp, Homo sapiens
gaaagcaacaaagattgagaag

SEQ ID NO: 6188491 - DNA, 15 bp, Homo sapiens
gaaagcaaggactgc

SEQ ID NO: 6188492 - DNA, 19 bp, Homo sapiens
gaaagcacaaacttctgta

SEQ ID NO: 6188493 - DNA, 19 bp, Homo sapiens
gaaagcacaagactggccc

SEQ ID NO: 6188494 - DNA, 16 bp, Homo sapiens
gaaagcacaggagaca

SEQ ID NO: 6188495 - DNA, 18 bp, Homo sapiens
gaaagcaccgcagcatgt

SEQ ID NO: 6188496 - DNA, 21 bp, Homo sapiens
gaaagcactacaatcatggtc

SEQ ID NO: 6188497 - DNA, 21 bp, Homo sapiens
gaaagcactgcatgaataaaa

SEQ ID NO: 6188498 - DNA, 21 bp, Homo sapiens
gaaagcacttaaacagaagca

SEQ ID NO: 6188499 - DNA, 14 bp, Homo sapiens
gaaagcagaacagt

SEQ ID NO: 6188500 - DNA, 20 bp, Homo sapiens
gaaagcagagcctcctggga

SEQ ID NO: 6188501 - DNA, 21 bp, Homo sapiens
gaaagcagagcctcctgggaa

SEQ ID NO: 6188502 - DNA, 22 bp, Homo sapiens
gaaagcagagttttcattaaat

SEQ ID NO: 6188503 - DNA, 22 bp, Homo sapiens
gaaagcagcacacattgtgtta

SEQ ID NO: 6188504 - DNA, 14 bp, Homo sapiens
gaaagcagcagcta

SEQ ID NO: 6188505 - DNA, 21 bp, Homo sapiens
gaaagcagcgctagtggaggg

SEQ ID NO: 6188506 - DNA, 12 bp, Homo sapiens
gaaagcaggagc

SEQ ID NO: 6188507 - DNA, 22 bp, Homo sapiens
gaaagcaggagcagctgtgctg

SEQ ID NO: 6188508 - DNA, 13 bp, Homo sapiens
gaaagcaggggct

SEQ ID NO: 6188509 - DNA, 19 bp, Homo sapiens
gaaagcaggggctacaaga

SEQ ID NO: 6188510 - DNA, 20 bp, Homo sapiens
gaaagcagtcagcggagagg

SEQ ID NO: 6188511 - DNA, 18 bp, Homo sapiens
gaaagcagttgagacaag

SEQ ID NO: 6188512 - DNA, 18 bp, Homo sapiens
gaaagcataaagctcaaa

SEQ ID NO: 6188513 - DNA, 22 bp, Homo sapiens
gaaagcataaagctcaaatgaa

SEQ ID NO: 6188514 - DNA, 17 bp, Homo sapiens
gaaagcatatcccacca

SEQ ID NO: 6188515 - DNA, 15 bp, Homo sapiens
gaaagcatatgcagc

SEQ ID NO: 6188516 - DNA, 14 bp, Homo sapiens
gaaagcatattgac

SEQ ID NO: 6188517 - DNA, 18 bp, Homo sapiens
gaaagcatattgactttt

SEQ ID NO: 6188518 - DNA, 15 bp, Homo sapiens
gaaagcatcactgcc

SEQ ID NO: 6188519 - DNA, 21 bp, Homo sapiens
gaaagcatgcattgaaaaatt

SEQ ID NO: 6188520 - DNA, 22 bp, Homo sapiens
gaaagcatgtctctgcttccat

SEQ ID NO: 6188521 - DNA, 14 bp, Homo sapiens
gaaagcatttgaat

SEQ ID NO: 6188522 - DNA, 16 bp, Homo sapiens
gaaagcatttgaatgc

SEQ ID NO: 6188523 - DNA, 17 bp, Homo sapiens
gaaagcatttgaatgca

SEQ ID NO: 6188524 - DNA, 20 bp, Homo sapiens
gaaagcatttgaatgcattt

SEQ ID NO: 6188525 - DNA, 21 bp, Homo sapiens
gaaagcatttgaatgcatttt

SEQ ID NO: 6188526 - DNA, 18 bp, Homo sapiens
gaaagccacacggagagg

SEQ ID NO: 6188527 - DNA, 11 bp, Homo sapiens
gaaagccacat

SEQ ID NO: 6188528 - DNA, 13 bp, Homo sapiens
gaaagccacctct

SEQ ID NO: 6188529 - DNA, 14 bp, Homo sapiens
gaaagccacctctc

SEQ ID NO: 6188530 - DNA, 19 bp, Homo sapiens
gaaagccacgccctccctg

SEQ ID NO: 6188531 - DNA, 16 bp, Homo sapiens
gaaagccagaaggaaa

SEQ ID NO: 6188532 - DNA, 13 bp, Homo sapiens
gaaagccagcacc

SEQ ID NO: 6188533 - DNA, 20 bp, Homo sapiens
gaaagccagggtcctgagtg

SEQ ID NO: 6188534 - DNA, 19 bp, Homo sapiens
gaaagccagtcttaacatt

SEQ ID NO: 6188535 - DNA, 15 bp, Homo sapiens
gaaagccatattcca

SEQ ID NO: 6188536 - DNA, 15 bp, Homo sapiens
gaaagccatattttt

SEQ ID NO: 6188537 - DNA, 20 bp, Homo sapiens
gaaagcccacctgggctggg

SEQ ID NO: 6188538 - DNA, 18 bp, Homo sapiens
gaaagcccagactttagt

SEQ ID NO: 6188539 - DNA, 18 bp, Homo sapiens
gaaagccccagcactaac

SEQ ID NO: 6188540 - DNA, 20 bp, Homo sapiens
gaaagcccctcacctcagga

SEQ ID NO: 6188541 - DNA, 21 bp, Homo sapiens
gaaagcccctcacctcaggac

SEQ ID NO: 6188542 - DNA, 23 bp, Homo sapiens
gaaagcccctgcccctcctctcc

SEQ ID NO: 6188543 - DNA, 16 bp, Homo sapiens
gaaagcccgctagaag

SEQ ID NO: 6188544 - DNA, 14 bp, Homo sapiens
gaaagccctccccc

SEQ ID NO: 6188545 - DNA, 12 bp, Homo sapiens
gaaagcccttca

SEQ ID NO: 6188546 - DNA, 14 bp, Homo sapiens
gaaagccgggggag

SEQ ID NO: 6188547 - DNA, 21 bp, Homo sapiens
gaaagccgggggaggggccct

SEQ ID NO: 6188548 - DNA, 15 bp, Homo sapiens
gaaagcctcctgccc

SEQ ID NO: 6188549 - DNA, 16 bp, Homo sapiens
gaaagcctcctgcccc

SEQ ID NO: 6188550 - DNA, 19 bp, Homo sapiens
gaaagcctcctgccccctg

SEQ ID NO: 6188551 - DNA, 21 bp, Homo sapiens
gaaagcctcctgccccctgcc

SEQ ID NO: 6188552 - DNA, 22 bp, Homo sapiens
gaaagcctcctgccccctgcca

SEQ ID NO: 6188553 - DNA, 12 bp, Homo sapiens
gaaagcctgagt

SEQ ID NO: 6188554 - DNA, 18 bp, Homo sapiens
gaaagcctgttcccctca

SEQ ID NO: 6188555 - DNA, 21 bp, Homo sapiens
gaaagcctgttcccctcactg

SEQ ID NO: 6188556 - DNA, 18 bp, Homo sapiens
gaaagccttaagctgcag

SEQ ID NO: 6188557 - DNA, 23 bp, Homo sapiens
gaaagcctttcattttgctttaa

SEQ ID NO: 6188558 - DNA, 14 bp, Homo sapiens
gaaagcctttcctc

SEQ ID NO: 6188559 - DNA, 22 bp, Homo sapiens
gaaagcctttcctcggtctccc

SEQ ID NO: 6188560 - DNA, 14 bp, Homo sapiens
gaaagcgattcact

SEQ ID NO: 6188561 - DNA, 14 bp, Homo sapiens
gaaagcgcagatgc

SEQ ID NO: 6188562 - DNA, 17 bp, Homo sapiens
gaaagcggagttcctaa

SEQ ID NO: 6188563 - DNA, 14 bp, Homo sapiens
gaaagcgggcagcc

SEQ ID NO: 6188564 - DNA, 16 bp, Homo sapiens
gaaagcgtgtgagtga

SEQ ID NO: 6188565 - DNA, 19 bp, Homo sapiens
gaaagctaaagtttggttt

SEQ ID NO: 6188566 - DNA, 23 bp, Homo sapiens
gaaagctaagtcttgtctcattt

SEQ ID NO: 6188567 - DNA, 14 bp, Homo sapiens
gaaagctaatacaa

SEQ ID NO: 6188568 - DNA, 15 bp, Homo sapiens
gaaagctaatacaaa

SEQ ID NO: 6188569 - DNA, 19 bp, Homo sapiens
gaaagctaatactaatagc

SEQ ID NO: 6188570 - DNA, 16 bp, Homo sapiens
gaaagctagagatatg

SEQ ID NO: 6188571 - DNA, 15 bp, Homo sapiens
gaaagctatgaatgt

SEQ ID NO: 6188572 - DNA, 19 bp, Homo sapiens
gaaagctatgaatgttact

SEQ ID NO: 6188573 - DNA, 20 bp, Homo sapiens
gaaagctatgaatgttacta

SEQ ID NO: 6188574 - DNA, 18 bp, Homo sapiens
gaaagctcctagcagaga

SEQ ID NO: 6188575 - DNA, 20 bp, Homo sapiens
gaaagctcctagcagagaga

SEQ ID NO: 6188576 - DNA, 22 bp, Homo sapiens
gaaagctcctcgagggcaggga

SEQ ID NO: 6188577 - DNA, 12 bp, Homo sapiens
gaaagctctaga

SEQ ID NO: 6188578 - DNA, 15 bp, Homo sapiens
gaaagctgaatcctt

SEQ ID NO: 6188579 - DNA, 23 bp, Homo sapiens
gaaagctgaatccttccatttct

SEQ ID NO: 6188580 - DNA, 18 bp, Homo sapiens
gaaagctgacttggctgg

SEQ ID NO: 6188581 - DNA, 22 bp, Homo sapiens
gaaagctgacttggctggtgtg

SEQ ID NO: 6188582 - DNA, 17 bp, Homo sapiens
gaaagctgagaactcct

SEQ ID NO: 6188583 - DNA, 13 bp, Homo sapiens
gaaagctgagaag

SEQ ID NO: 6188584 - DNA, 13 bp, Homo sapiens
gaaagctgagacc

SEQ ID NO: 6188585 - DNA, 21 bp, Homo sapiens
gaaagctgagaccctcgccac

SEQ ID NO: 6188586 - DNA, 17 bp, Homo sapiens
gaaagctgcctggtata

SEQ ID NO: 6188587 - DNA, 21 bp, Homo sapiens
gaaagctgctgtgatcccagt

SEQ ID NO: 6188588 - DNA, 19 bp, Homo sapiens
gaaagctgcttctggggga

SEQ ID NO: 6188589 - DNA, 13 bp, Homo sapiens
gaaagctggactg

SEQ ID NO: 6188590 - DNA, 18 bp, Homo sapiens
gaaagctgggagcgtggg

SEQ ID NO: 6188591 - DNA, 21 bp, Homo sapiens
gaaagctggtaaactatttgt

SEQ ID NO: 6188592 - DNA, 15 bp, Homo sapiens
gaaagctgtgaaatt

SEQ ID NO: 6188593 - DNA, 22 bp, Homo sapiens
gaaagctgtgaaattgaagtcc

SEQ ID NO: 6188594 - DNA, 15 bp, Homo sapiens
gaaagctgtttcatt

SEQ ID NO: 6188595 - DNA, 17 bp, Homo sapiens
gaaagctgtttcatttg

SEQ ID NO: 6188596 - DNA, 19 bp, Homo sapiens
gaaagcttactgtttttga

SEQ ID NO: 6188597 - DNA, 22 bp, Homo sapiens
gaaagcttaggctgcttattgg

SEQ ID NO: 6188598 - DNA, 20 bp, Homo sapiens
gaaagcttcaaagtttatat

SEQ ID NO: 6188599 - DNA, 16 bp, Homo sapiens
gaaagcttcagtgctg

SEQ ID NO: 6188600 - DNA, 15 bp, Homo sapiens
gaaagcttccttcaa

SEQ ID NO: 6188601 - DNA, 23 bp, Homo sapiens
gaaagctttgaatactaaattat

SEQ ID NO: 6188602 - DNA, 14 bp, Homo sapiens
gaaagctttggaaa

SEQ ID NO: 6188603 - DNA, 14 bp, Homo sapiens
gaaagcttttaaaa

SEQ ID NO: 6188604 - DNA, 22 bp, Homo sapiens
gaaagcttttcagtgttcccaa

SEQ ID NO: 6188605 - DNA, 13 bp, Homo sapiens
gaaaggaaaaatt

SEQ ID NO: 6188606 - DNA, 16 bp, Homo sapiens
gaaaggaaaaccaggg

SEQ ID NO: 6188607 - DNA, 19 bp, Homo sapiens
gaaaggaaaagattcctgt

SEQ ID NO: 6188608 - DNA, 13 bp, Homo sapiens
gaaaggaaacctt

SEQ ID NO: 6188609 - DNA, 14 bp, Homo sapiens
gaaaggaaagaagg

SEQ ID NO: 6188610 - DNA, 15 bp, Homo sapiens
gaaaggaaagaagga

SEQ ID NO: 6188611 - DNA, 14 bp, Homo sapiens
gaaaggaaatagac

SEQ ID NO: 6188612 - DNA, 14 bp, Homo sapiens
gaaaggaacactgg

SEQ ID NO: 6188613 - DNA, 20 bp, Homo sapiens
gaaaggaacaggcttggagg

SEQ ID NO: 6188614 - DNA, 18 bp, Homo sapiens
gaaaggaactgcaataat

SEQ ID NO: 6188615 - DNA, 13 bp, Homo sapiens
gaaaggaagcaac

SEQ ID NO: 6188616 - DNA, 19 bp, Homo sapiens
gaaaggaagccttgctcat

SEQ ID NO: 6188617 - DNA, 22 bp, Homo sapiens
gaaaggaagctccactgtcacc

SEQ ID NO: 6188618 - DNA, 21 bp, Homo sapiens
gaaaggaagtgggactggcac

SEQ ID NO: 6188619 - DNA, 12 bp, Homo sapiens
gaaaggacagag

SEQ ID NO: 6188620 - DNA, 16 bp, Homo sapiens
gaaaggacagagccag

SEQ ID NO: 6188621 - DNA, 17 bp, Homo sapiens
gaaaggacagagccagc

SEQ ID NO: 6188622 - DNA, 17 bp, Homo sapiens
gaaaggacggctgagca

SEQ ID NO: 6188623 - DNA, 18 bp, Homo sapiens
gaaaggactgtgtgacct

SEQ ID NO: 6188624 - DNA, 11 bp, Homo sapiens
gaaaggagact

SEQ ID NO: 6188625 - DNA, 22 bp, Homo sapiens
gaaaggagagaacgggcgtcag

SEQ ID NO: 6188626 - DNA, 16 bp, Homo sapiens
gaaaggagatcattta

SEQ ID NO: 6188627 - DNA, 12 bp, Homo sapiens
gaaaggagatgt

SEQ ID NO: 6188628 - DNA, 22 bp, Homo sapiens
gaaaggagcctaggccaggtgc

SEQ ID NO: 6188629 - DNA, 20 bp, Homo sapiens
gaaaggaggaccagtcagga

SEQ ID NO: 6188630 - DNA, 21 bp, Homo sapiens
gaaaggaggaccagtcaggat

SEQ ID NO: 6188631 - DNA, 13 bp, Homo sapiens
gaaaggagggaaa

SEQ ID NO: 6188632 - DNA, 14 bp, Homo sapiens
gaaaggaggggaga

SEQ ID NO: 6188633 - DNA, 16 bp, Homo sapiens
gaaaggagtagaaaaa

SEQ ID NO: 6188634 - DNA, 18 bp, Homo sapiens
gaaaggagttattaaagt

SEQ ID NO: 6188635 - DNA, 18 bp, Homo sapiens
gaaaggatataaaaggat

SEQ ID NO: 6188636 - DNA, 17 bp, Homo sapiens
gaaaggatatttaagaa

SEQ ID NO: 6188637 - DNA, 20 bp, Homo sapiens
gaaaggatatttaagaaaat

SEQ ID NO: 6188638 - DNA, 22 bp, Homo sapiens
gaaaggatatttaagaaaatac

SEQ ID NO: 6188639 - DNA, 15 bp, Homo sapiens
gaaaggatgagcaga

SEQ ID NO: 6188640 - DNA, 16 bp, Homo sapiens
gaaaggatgagcagag

SEQ ID NO: 6188641 - DNA, 14 bp, Homo sapiens
gaaaggatgcttct

SEQ ID NO: 6188642 - DNA, 17 bp, Homo sapiens
gaaaggatgcttctgct

SEQ ID NO: 6188643 - DNA, 15 bp, Homo sapiens
gaaaggatggcagcc

SEQ ID NO: 6188644 - DNA, 17 bp, Homo sapiens
gaaaggatggcagcctc

SEQ ID NO: 6188645 - DNA, 20 bp, Homo sapiens
gaaaggatgtaaacagtgcc

SEQ ID NO: 6188646 - DNA, 22 bp, Homo sapiens
gaaaggattaagatacactcct

SEQ ID NO: 6188647 - DNA, 18 bp, Homo sapiens
gaaaggattcagtggagg

SEQ ID NO: 6188648 - DNA, 17 bp, Homo sapiens
gaaaggattttaccaaa

SEQ ID NO: 6188649 - DNA, 21 bp, Homo sapiens
gaaaggattttaccaaagcat

SEQ ID NO: 6188650 - DNA, 15 bp, Homo sapiens
gaaaggcacatattg

SEQ ID NO: 6188651 - DNA, 22 bp, Homo sapiens
gaaaggcagccctcacctctga

SEQ ID NO: 6188652 - DNA, 20 bp, Homo sapiens
gaaaggcaggaagggaagcg

SEQ ID NO: 6188653 - DNA, 20 bp, Homo sapiens
gaaaggcaggcctatttcat

SEQ ID NO: 6188654 - DNA, 16 bp, Homo sapiens
gaaaggcagggccctg

SEQ ID NO: 6188655 - DNA, 19 bp, Homo sapiens
gaaaggcagggccctgaaa

SEQ ID NO: 6188656 - DNA, 11 bp, Homo sapiens
gaaaggcatct

SEQ ID NO: 6188657 - DNA, 15 bp, Homo sapiens
gaaaggccagcactc

SEQ ID NO: 6188658 - DNA, 16 bp, Homo sapiens
gaaaggccagcactcg

SEQ ID NO: 6188659 - DNA, 23 bp, Homo sapiens
ctgtgaggacagggcccccacag

SEQ ID NO: 6188660 - DNA, 19 bp, Homo sapiens
ctgtgaggagccccatctg

SEQ ID NO: 6188661 - DNA, 17 bp, Homo sapiens
ctgtgaggcccctggac

SEQ ID NO: 6188662 - DNA, 14 bp, Homo sapiens
ctgtgaggcggcag

SEQ ID NO: 6188663 - DNA, 15 bp, Homo sapiens
ctgtgaggcggcagc

SEQ ID NO: 6188664 - DNA, 19 bp, Homo sapiens
ctgtgaggcggcagctggg

SEQ ID NO: 6188665 - DNA, 20 bp, Homo sapiens
ctgtgaggcgggtggctggt

SEQ ID NO: 6188666 - DNA, 15 bp, Homo sapiens
ctgtgaggctgtcct

SEQ ID NO: 6188667 - DNA, 16 bp, Homo sapiens
ctgtgaggcttgccca

SEQ ID NO: 6188668 - DNA, 15 bp, Homo sapiens
ctgtgagggagggga

SEQ ID NO: 6188669 - DNA, 17 bp, Homo sapiens
ctgtgagggagtgcaga

SEQ ID NO: 6188670 - DNA, 15 bp, Homo sapiens
ctgtgaggggaaggc

SEQ ID NO: 6188671 - DNA, 19 bp, Homo sapiens
ctgtgaggggcccctggcc

SEQ ID NO: 6188672 - DNA, 19 bp, Homo sapiens
ctgtgaggtgataggcaag

SEQ ID NO: 6188673 - DNA, 20 bp, Homo sapiens
ctgtgaggtgataggcaagg

SEQ ID NO: 6188674 - DNA, 17 bp, Homo sapiens
ctgtgaggtttcccaat

SEQ ID NO: 6188675 - DNA, 17 bp, Homo sapiens
ctgtgagtaaatattga

SEQ ID NO: 6188676 - DNA, 14 bp, Homo sapiens
ctgtgagtaggctg

SEQ ID NO: 6188677 - DNA, 18 bp, Homo sapiens
ctgtgagtctgtcctttc

SEQ ID NO: 6188678 - DNA, 22 bp, Homo sapiens
ctgtgagtgaaagttgccatta

SEQ ID NO: 6188679 - DNA, 13 bp, Homo sapiens
ctgtgagtgagtg

SEQ ID NO: 6188680 - DNA, 14 bp, Homo sapiens
ctgtgagtgcgtct

SEQ ID NO: 6188681 - DNA, 16 bp, Homo sapiens
ctgtgagtgcgtctga

SEQ ID NO: 6188682 - DNA, 15 bp, Homo sapiens
ctgtgagttctccct

SEQ ID NO: 6188683 - DNA, 17 bp, Homo sapiens
ctgtgagtttaaagcaa

SEQ ID NO: 6188684 - DNA, 14 bp, Homo sapiens
ctgtgataaaaaga

SEQ ID NO: 6188685 - DNA, 13 bp, Homo sapiens
ctgtgataacaga

SEQ ID NO: 6188686 - DNA, 23 bp, Homo sapiens
ctgtgatacagttttgagtaaaa

SEQ ID NO: 6188687 - DNA, 19 bp, Homo sapiens
ctgtgatagttcaccccct

SEQ ID NO: 6188688 - DNA, 16 bp, Homo sapiens
ctgtgatatgccatag

SEQ ID NO: 6188689 - DNA, 16 bp, Homo sapiens
ctgtgatatgtctgct

SEQ ID NO: 6188690 - DNA, 14 bp, Homo sapiens
ctgtgatattttac

SEQ ID NO: 6188691 - DNA, 20 bp, Homo sapiens
ctgtgatattttacttgaat

SEQ ID NO: 6188692 - DNA, 20 bp, Homo sapiens
ctgtgatcaatatttttata

SEQ ID NO: 6188693 - DNA, 23 bp, Homo sapiens
ctgtgatcaatatttttatatca

SEQ ID NO: 6188694 - DNA, 15 bp, Homo sapiens
ctgtgatcatttatt

SEQ ID NO: 6188695 - DNA, 21 bp, Homo sapiens
ctgtgatccaggaaagatgtc

SEQ ID NO: 6188696 - DNA, 22 bp, Homo sapiens
ctgtgatcccagtagaaaatat

SEQ ID NO: 6188697 - DNA, 18 bp, Homo sapiens
ctgtgatccttggtgctg

SEQ ID NO: 6188698 - DNA, 21 bp, Homo sapiens
ctgtgatccttggtgctgtgt

SEQ ID NO: 6188699 - DNA, 22 bp, Homo sapiens
ctgtgatccttggtgctgtgtg

SEQ ID NO: 6188700 - DNA, 23 bp, Homo sapiens
ctgtgatccttggtgctgtgtgc

SEQ ID NO: 6188701 - DNA, 14 bp, Homo sapiens
ctgtgatctaagca

SEQ ID NO: 6188702 - DNA, 16 bp, Homo sapiens
ctgtgatctaagcagt

SEQ ID NO: 6188703 - DNA, 20 bp, Homo sapiens
ctgtgatctagtccttgtct

SEQ ID NO: 6188704 - DNA, 17 bp, Homo sapiens
ctgtgatctctgctggg

SEQ ID NO: 6188705 - DNA, 22 bp, Homo sapiens
ctgtgatctgggtctctaatct

SEQ ID NO: 6188706 - DNA, 15 bp, Homo sapiens
ctgtgatcttaaaat

SEQ ID NO: 6188707 - DNA, 17 bp, Homo sapiens
ctgtgatcttatttttc

SEQ ID NO: 6188708 - DNA, 18 bp, Homo sapiens
ctgtgatcttatttttct

SEQ ID NO: 6188709 - DNA, 18 bp, Homo sapiens
ctgtgatcttttaaagtg

SEQ ID NO: 6188710 - DNA, 19 bp, Homo sapiens
ctgtgatgacattccctgc

SEQ ID NO: 6188711 - DNA, 18 bp, Homo sapiens
ctgtgatgagctgatctg

SEQ ID NO: 6188712 - DNA, 22 bp, Homo sapiens
ctgtgatgagctgatctgcgga

SEQ ID NO: 6188713 - DNA, 13 bp, Homo sapiens
ctgtgatgcatga

SEQ ID NO: 6188714 - DNA, 14 bp, Homo sapiens
ctgtgatgcatgag

SEQ ID NO: 6188715 - DNA, 15 bp, Homo sapiens
ctgtgatgcatgagc

SEQ ID NO: 6188716 - DNA, 16 bp, Homo sapiens
ctgtgatgccacacag

SEQ ID NO: 6188717 - DNA, 14 bp, Homo sapiens
ctgtgatgccctgc

SEQ ID NO: 6188718 - DNA, 20 bp, Homo sapiens
ctgtgatgccgtcctgctgg

SEQ ID NO: 6188719 - DNA, 21 bp, Homo sapiens
ctgtgatgccgtcctgctgga

SEQ ID NO: 6188720 - DNA, 24 bp, Homo sapiens
ctgtgatgccgtcctgctggagtg

SEQ ID NO: 6188721 - DNA, 14 bp, Homo sapiens
ctgtgatgctgtgt

SEQ ID NO: 6188722 - DNA, 17 bp, Homo sapiens
ctgtgatgctgtgtgcc

SEQ ID NO: 6188723 - DNA, 20 bp, Homo sapiens
ctgtgatgctgtgtgcccaa

SEQ ID NO: 6188724 - DNA, 21 bp, Homo sapiens
ctgtgatggatggacacaaaa

SEQ ID NO: 6188725 - DNA, 15 bp, Homo sapiens
ctgtgatggggccct

SEQ ID NO: 6188726 - DNA, 16 bp, Homo sapiens
ctgtgatggggccctg

SEQ ID NO: 6188727 - DNA, 17 bp, Homo sapiens
ctgtgatggggtgggca

SEQ ID NO: 6188728 - DNA, 18 bp, Homo sapiens
ctgtgatggggtgggcag

SEQ ID NO: 6188729 - DNA, 22 bp, Homo sapiens
ctgtgatggggtgggcagggct

SEQ ID NO: 6188730 - DNA, 19 bp, Homo sapiens
ctgtgatgtcacagtttgt

SEQ ID NO: 6188731 - DNA, 23 bp, Homo sapiens
ctgtgatgtcacagtttgttcag

SEQ ID NO: 6188732 - DNA, 23 bp, Homo sapiens
ctgtgatgtttgtgtatgtggga

SEQ ID NO: 6188733 - DNA, 14 bp, Homo sapiens
ctgtgattaattat

SEQ ID NO: 6188734 - DNA, 15 bp, Homo sapiens
ctgtgattaattatt

SEQ ID NO: 6188735 - DNA, 19 bp, Homo sapiens
ctgtgattaattattgaaa

SEQ ID NO: 6188736 - DNA, 19 bp, Homo sapiens
ctgtgattacatagatcag

SEQ ID NO: 6188737 - DNA, 20 bp, Homo sapiens
ctgtgattacatagatcagc

SEQ ID NO: 6188738 - DNA, 15 bp, Homo sapiens
ctgtgattactcttt

SEQ ID NO: 6188739 - DNA, 23 bp, Homo sapiens
ctgtgattactctttgctttgta

SEQ ID NO: 6188740 - DNA, 18 bp, Homo sapiens
ctgtgattactgcaatca

SEQ ID NO: 6188741 - DNA, 12 bp, Homo sapiens
ctgtgattagat

SEQ ID NO: 6188742 - DNA, 19 bp, Homo sapiens
ctgtgattagatcacatct

SEQ ID NO: 6188743 - DNA, 17 bp, Homo sapiens
ctgtgattaggtgaagg

SEQ ID NO: 6188744 - DNA, 13 bp, Homo sapiens
ctgtgattcagaa

SEQ ID NO: 6188745 - DNA, 13 bp, Homo sapiens
ctgtgattgctgc

SEQ ID NO: 6188746 - DNA, 19 bp, Homo sapiens
ctgtgattgggtgggattt

SEQ ID NO: 6188747 - DNA, 21 bp, Homo sapiens
ctgtgatttatttggagtgga

SEQ ID NO: 6188748 - DNA, 23 bp, Homo sapiens
ctgtgatttatttggagtggagg

SEQ ID NO: 6188749 - DNA, 13 bp, Homo sapiens
ctgtgatttctgg

SEQ ID NO: 6188750 - DNA, 15 bp, Homo sapiens
ctgtgatttctgtgc

SEQ ID NO: 6188751 - DNA, 14 bp, Homo sapiens
ctgtgatttcttct

SEQ ID NO: 6188752 - DNA, 14 bp, Homo sapiens
ctgtgattttaaga

SEQ ID NO: 6188753 - DNA, 19 bp, Homo sapiens
ctgtgattttgccctcctg

SEQ ID NO: 6188754 - DNA, 20 bp, Homo sapiens
ctgtgattttgccctcctgc

SEQ ID NO: 6188755 - DNA, 15 bp, Homo sapiens
ctgtgcaaaaaaatt

SEQ ID NO: 6188756 - DNA, 17 bp, Homo sapiens
ctgtgcaaaataaaatg

SEQ ID NO: 6188757 - DNA, 20 bp, Homo sapiens
ctgtgcaaaataaaatgagt

SEQ ID NO: 6188758 - DNA, 18 bp, Homo sapiens
ctgtgcaaacagtgtaag

SEQ ID NO: 6188759 - DNA, 18 bp, Homo sapiens
ctgtgcaacgccgtgggc

SEQ ID NO: 6188760 - DNA, 21 bp, Homo sapiens
ctgtgcaacgccgtgggctgc

SEQ ID NO: 6188761 - DNA, 15 bp, Homo sapiens
ctgtgcaatacttag

SEQ ID NO: 6188762 - DNA, 21 bp, Homo sapiens
ctgtgcaatagacacatacat

SEQ ID NO: 6188763 - DNA, 22 bp, Homo sapiens
ctgtgcaattactgcctgcaga

SEQ ID NO: 6188764 - DNA, 18 bp, Homo sapiens
ctgtgcacaaagtggcat

SEQ ID NO: 6188765 - DNA, 15 bp, Homo sapiens
ctgtgcacacacaca

SEQ ID NO: 6188766 - DNA, 17 bp, Homo sapiens
ctgtgcacaccccactc

SEQ ID NO: 6188767 - DNA, 14 bp, Homo sapiens
ctgtgcacactaag

SEQ ID NO: 6188768 - DNA, 18 bp, Homo sapiens
ctgtgcacactaagaaat

SEQ ID NO: 6188769 - DNA, 11 bp, Homo sapiens
ctgtgcacagc

SEQ ID NO: 6188770 - DNA, 21 bp, Homo sapiens
ctgtgcacatctgtgtcttgt

SEQ ID NO: 6188771 - DNA, 15 bp, Homo sapiens
ctgtgcacatgcctc

SEQ ID NO: 6188772 - DNA, 20 bp, Homo sapiens
ctgtgcacatgcctctgtag

SEQ ID NO: 6188773 - DNA, 14 bp, Homo sapiens
ctgtgcaccaagca

SEQ ID NO: 6188774 - DNA, 14 bp, Homo sapiens
ctgtgcacccgtgc

SEQ ID NO: 6188775 - DNA, 19 bp, Homo sapiens
ctgtgcacctaccccttgg

SEQ ID NO: 6188776 - DNA, 22 bp, Homo sapiens
ctgtgcacctaccccttggaaa

SEQ ID NO: 6188777 - DNA, 20 bp, Homo sapiens
ctgtgcacctattctgtagt

SEQ ID NO: 6188778 - DNA, 18 bp, Homo sapiens
ctgtgcaccttacattcc

SEQ ID NO: 6188779 - DNA, 15 bp, Homo sapiens
ctgtgcacggtggac

SEQ ID NO: 6188780 - DNA, 12 bp, Homo sapiens
ctgtgcactgcc

SEQ ID NO: 6188781 - DNA, 14 bp, Homo sapiens
ctgtgcactgccca

SEQ ID NO: 6188782 - DNA, 14 bp, Homo sapiens
ctgtgcactgccct

SEQ ID NO: 6188783 - DNA, 15 bp, Homo sapiens
ctgtgcactgccctg

SEQ ID NO: 6188784 - DNA, 16 bp, Homo sapiens
ctgtgcactgccctgt

SEQ ID NO: 6188785 - DNA, 23 bp, Homo sapiens
ctgtgcactgggcaggttcctgg

SEQ ID NO: 6188786 - DNA, 21 bp, Homo sapiens
ctgtgcacttagccatgatgg

SEQ ID NO: 6188787 - DNA, 19 bp, Homo sapiens
ctgtgcagaataatggaaa

SEQ ID NO: 6188788 - DNA, 15 bp, Homo sapiens
ctgtgcagacccagt

SEQ ID NO: 6188789 - DNA, 15 bp, Homo sapiens
ctgtgcagaccttac

SEQ ID NO: 6188790 - DNA, 15 bp, Homo sapiens
ctgtgcagatgagca

SEQ ID NO: 6188791 - DNA, 21 bp, Homo sapiens
ctgtgcagatgctttgcccag

SEQ ID NO: 6188792 - DNA, 14 bp, Homo sapiens
ctgtgcagcaccct

SEQ ID NO: 6188793 - DNA, 13 bp, Homo sapiens
ctgtgcagcagcc

SEQ ID NO: 6188794 - DNA, 15 bp, Homo sapiens
ctgtgcagcagccca

SEQ ID NO: 6188795 - DNA, 14 bp, Homo sapiens
ctgtgcagccccgc

SEQ ID NO: 6188796 - DNA, 19 bp, Homo sapiens
ctgtgcagccgctgagcga

SEQ ID NO: 6188797 - DNA, 22 bp, Homo sapiens
ctgtgcagccggggagctgagg

SEQ ID NO: 6188798 - DNA, 17 bp, Homo sapiens
ctgtgcagcgcagctgg

SEQ ID NO: 6188799 - DNA, 21 bp, Homo sapiens
ctgtgcagcgcagctggactc

SEQ ID NO: 6188800 - DNA, 12 bp, Homo sapiens
ctgtgcaggagc

SEQ ID NO: 6188801 - DNA, 18 bp, Homo sapiens
ctgtgcaggcccaggcag

SEQ ID NO: 6188802 - DNA, 20 bp, Homo sapiens
ctgtgcaggcccaggcaggc

SEQ ID NO: 6188803 - DNA, 14 bp, Homo sapiens
ctgtgcaggctgca

SEQ ID NO: 6188804 - DNA, 17 bp, Homo sapiens
ctgtgcaggctgcagtg

SEQ ID NO: 6188805 - DNA, 23 bp, Homo sapiens
ctgtgcagggataggaagtgccc

SEQ ID NO: 6188806 - DNA, 19 bp, Homo sapiens
ctgtgcagggcacagaagg

SEQ ID NO: 6188807 - DNA, 16 bp, Homo sapiens
ctgtgcagggccctct

SEQ ID NO: 6188808 - DNA, 12 bp, Homo sapiens
ctgtgcaggtgc

SEQ ID NO: 6188809 - DNA, 16 bp, Homo sapiens
ctgtgcaggttcccac

SEQ ID NO: 6188810 - DNA, 12 bp, Homo sapiens
ctgtgcagtaga

SEQ ID NO: 6188811 - DNA, 18 bp, Homo sapiens
ctgtgcagtagagagcct

SEQ ID NO: 6188812 - DNA, 18 bp, Homo sapiens
ctgtgcagtcactggagg

SEQ ID NO: 6188813 - DNA, 15 bp, Homo sapiens
ctgtgcagtcctggg

SEQ ID NO: 6188814 - DNA, 17 bp, Homo sapiens
ctgtgcagtcctgggtc

SEQ ID NO: 6188815 - DNA, 12 bp, Homo sapiens
ctgtgcagtgac

SEQ ID NO: 6188816 - DNA, 22 bp, Homo sapiens
ctgtgcatcaaccaggaagagt

SEQ ID NO: 6188817 - DNA, 15 bp, Homo sapiens
ctgtgcatctggcct

SEQ ID NO: 6188818 - DNA, 17 bp, Homo sapiens
ctgtgcatctggcctgg

SEQ ID NO: 6188819 - DNA, 23 bp, Homo sapiens
ctgtgcatctggcctgggggctg

SEQ ID NO: 6188820 - DNA, 14 bp, Homo sapiens
ctgtgcatgacctg

SEQ ID NO: 6188821 - DNA, 11 bp, Homo sapiens
ctgtgcatgtg

SEQ ID NO: 6188822 - DNA, 14 bp, Homo sapiens
ctgtgcattctcct

SEQ ID NO: 6188823 - DNA, 17 bp, Homo sapiens
ctgtgcattgtggctgt

SEQ ID NO: 6188824 - DNA, 19 bp, Homo sapiens
ctgtgcattgtggctgtca

SEQ ID NO: 6188825 - DNA, 13 bp, Homo sapiens
ctgtgccaaagca

SEQ ID NO: 6188826 - DNA, 19 bp, Homo sapiens
ctgtgccaaagcagctaca

SEQ ID NO: 6188827 - DNA, 18 bp, Homo sapiens
ctgtgccaaagcaggtca

SEQ ID NO: 6188828 - DNA, 12 bp, Homo sapiens
ctgtgccaacct

SEQ ID NO: 6188829 - DNA, 18 bp, Homo sapiens
ctgtgccaacctgatgcc

SEQ ID NO: 6188830 - DNA, 18 bp, Homo sapiens
ctgtgccaagatttaaaa

SEQ ID NO: 6188831 - DNA, 15 bp, Homo sapiens
ctgtgccaagggcag

SEQ ID NO: 6188832 - DNA, 22 bp, Homo sapiens
ctgtgccaatacagacaaagca

SEQ ID NO: 6188833 - DNA, 22 bp, Homo sapiens
ctgtgccacacttcgctcttga

SEQ ID NO: 6188834 - DNA, 17 bp, Homo sapiens
ctgtgccaccacccctc

SEQ ID NO: 6188835 - DNA, 21 bp, Homo sapiens
ctgtgccaccacccctccctc

SEQ ID NO: 6188836 - DNA, 13 bp, Homo sapiens
ctgtgccacccac

SEQ ID NO: 6188837 - DNA, 17 bp, Homo sapiens
ctgtgccaccccttcct

SEQ ID NO: 6188838 - DNA, 15 bp, Homo sapiens
gaaaggccagcagct

SEQ ID NO: 6188839 - DNA, 12 bp, Homo sapiens
gaaaggccagct

SEQ ID NO: 6188840 - DNA, 14 bp, Homo sapiens
gaaaggccagctgg

SEQ ID NO: 6188841 - DNA, 14 bp, Homo sapiens
gaaaggcctctgtg

SEQ ID NO: 6188842 - DNA, 23 bp, Homo sapiens
gaaaggcctgcttttgtgtccca

SEQ ID NO: 6188843 - DNA, 19 bp, Homo sapiens
gaaaggccttcagacacat

SEQ ID NO: 6188844 - DNA, 15 bp, Homo sapiens
gaaaggcctttaaaa

SEQ ID NO: 6188845 - DNA, 15 bp, Homo sapiens
gaaaggcgcccccgc

SEQ ID NO: 6188846 - DNA, 22 bp, Homo sapiens
gaaaggctaacaaattttaagt

SEQ ID NO: 6188847 - DNA, 19 bp, Homo sapiens
gaaaggctatcctgctgaa

SEQ ID NO: 6188848 - DNA, 14 bp, Homo sapiens
gaaaggctcagtct

SEQ ID NO: 6188849 - DNA, 22 bp, Homo sapiens
gaaaggctcagtctcaggagca

SEQ ID NO: 6188850 - DNA, 17 bp, Homo sapiens
gaaaggctccaggagca

SEQ ID NO: 6188851 - DNA, 19 bp, Homo sapiens
gaaaggctccaggagcagc

SEQ ID NO: 6188852 - DNA, 21 bp, Homo sapiens
gaaaggctccaggagcagcca

SEQ ID NO: 6188853 - DNA, 20 bp, Homo sapiens
gaaaggctgccgaggaccct

SEQ ID NO: 6188854 - DNA, 23 bp, Homo sapiens
gaaaggctgctgtactgaagtaa

SEQ ID NO: 6188855 - DNA, 22 bp, Homo sapiens
gaaaggctgttaaatacaggaa

SEQ ID NO: 6188856 - DNA, 15 bp, Homo sapiens
gaaaggcttggctgg

SEQ ID NO: 6188857 - DNA, 19 bp, Homo sapiens
gaaaggcttggctggtgta

SEQ ID NO: 6188858 - DNA, 14 bp, Homo sapiens
gaaagggaagcctg

SEQ ID NO: 6188859 - DNA, 17 bp, Homo sapiens
gaaagggaagcctgact

SEQ ID NO: 6188860 - DNA, 21 bp, Homo sapiens
gaaagggacccgaagcccagg

SEQ ID NO: 6188861 - DNA, 20 bp, Homo sapiens
gaaagggacgctacccggga

SEQ ID NO: 6188862 - DNA, 18 bp, Homo sapiens
gaaagggagacagccagg

SEQ ID NO: 6188863 - DNA, 17 bp, Homo sapiens
gaaagggagagaaaact

SEQ ID NO: 6188864 - DNA, 13 bp, Homo sapiens
gaaagggagaggg

SEQ ID NO: 6188865 - DNA, 17 bp, Homo sapiens
gaaagggagatgtcagg

SEQ ID NO: 6188866 - DNA, 21 bp, Homo sapiens
gaaagggagcccctcctctga

SEQ ID NO: 6188867 - DNA, 22 bp, Homo sapiens
gaaagggagcccctcctctgag

SEQ ID NO: 6188868 - DNA, 22 bp, Homo sapiens
gaaagggagctatcaggaacag

SEQ ID NO: 6188869 - DNA, 18 bp, Homo sapiens
gaaagggaggagaggaca

SEQ ID NO: 6188870 - DNA, 17 bp, Homo sapiens
gaaagggagggctctga

SEQ ID NO: 6188871 - DNA, 18 bp, Homo sapiens
gaaagggagggctctgag

SEQ ID NO: 6188872 - DNA, 21 bp, Homo sapiens
gaaagggagggctctgaggcg

SEQ ID NO: 6188873 - DNA, 19 bp, Homo sapiens
gaaagggatgaacttggcc

SEQ ID NO: 6188874 - DNA, 21 bp, Homo sapiens
gaaagggatggtaagttgaga

SEQ ID NO: 6188875 - DNA, 16 bp, Homo sapiens
gaaagggatggtcagg

SEQ ID NO: 6188876 - DNA, 18 bp, Homo sapiens
gaaagggatggtcaggcc

SEQ ID NO: 6188877 - DNA, 18 bp, Homo sapiens
gaaagggattgctgaggc

SEQ ID NO: 6188878 - DNA, 23 bp, Homo sapiens
gaaagggcaaagtagggcgtgtg

SEQ ID NO: 6188879 - DNA, 17 bp, Homo sapiens
gaaagggcaagaaggaa

SEQ ID NO: 6188880 - DNA, 12 bp, Homo sapiens
gaaagggcactt

SEQ ID NO: 6188881 - DNA, 16 bp, Homo sapiens
gaaagggcacttaatt

SEQ ID NO: 6188882 - DNA, 22 bp, Homo sapiens
gaaagggcacttaatttgtaaa

SEQ ID NO: 6188883 - DNA, 20 bp, Homo sapiens
gaaagggccctccttcctaa

SEQ ID NO: 6188884 - DNA, 13 bp, Homo sapiens
gaaagggcctggc

SEQ ID NO: 6188885 - DNA, 16 bp, Homo sapiens
gaaagggcctggccag

SEQ ID NO: 6188886 - DNA, 14 bp, Homo sapiens
gaaagggctggctc

SEQ ID NO: 6188887 - DNA, 15 bp, Homo sapiens
gaaagggctggctcc

SEQ ID NO: 6188888 - DNA, 15 bp, Homo sapiens
gaaaggggaaagaaa

SEQ ID NO: 6188889 - DNA, 18 bp, Homo sapiens
gaaaggggaaagaaaggg

SEQ ID NO: 6188890 - DNA, 17 bp, Homo sapiens
gaaaggggacaaggaag

SEQ ID NO: 6188891 - DNA, 18 bp, Homo sapiens
gaaaggggagagcctgct

SEQ ID NO: 6188892 - DNA, 20 bp, Homo sapiens
gaaaggggagagcctgctgg

SEQ ID NO: 6188893 - DNA, 16 bp, Homo sapiens
gaaaggggagcccact

SEQ ID NO: 6188894 - DNA, 17 bp, Homo sapiens
gaaaggggattacagtt

SEQ ID NO: 6188895 - DNA, 20 bp, Homo sapiens
gaaaggggcaggagctcaga

SEQ ID NO: 6188896 - DNA, 17 bp, Homo sapiens
gaaaggggggagctggg

SEQ ID NO: 6188897 - DNA, 14 bp, Homo sapiens
gaaaggggttgggg

SEQ ID NO: 6188898 - DNA, 21 bp, Homo sapiens
gaaaggggttggggtgacagt

SEQ ID NO: 6188899 - DNA, 21 bp, Homo sapiens
gaaagggtaatttcctttgct

SEQ ID NO: 6188900 - DNA, 23 bp, Homo sapiens
gaaagggtcaacggccctgttta

SEQ ID NO: 6188901 - DNA, 20 bp, Homo sapiens
gaaagggtctgataaacaca

SEQ ID NO: 6188902 - DNA, 23 bp, Homo sapiens
gaaagggtctgataaacacagag

SEQ ID NO: 6188903 - DNA, 17 bp, Homo sapiens
gaaagggtcttccttct

SEQ ID NO: 6188904 - DNA, 13 bp, Homo sapiens
gaaagggtgagac

SEQ ID NO: 6188905 - DNA, 16 bp, Homo sapiens
gaaagggtgctgcttc

SEQ ID NO: 6188906 - DNA, 23 bp, Homo sapiens
gaaagggtgtttttctgttttat

SEQ ID NO: 6188907 - DNA, 23 bp, Homo sapiens
gaaagggttaatcatatttgaaa

SEQ ID NO: 6188908 - DNA, 18 bp, Homo sapiens
gaaaggtactatatttgc

SEQ ID NO: 6188909 - DNA, 18 bp, Homo sapiens
gaaaggtaggaagagagg

SEQ ID NO: 6188910 - DNA, 19 bp, Homo sapiens
gaaaggtcctgtggggagc

SEQ ID NO: 6188911 - DNA, 22 bp, Homo sapiens
gaaaggtgagtttgagctgcct

SEQ ID NO: 6188912 - DNA, 23 bp, Homo sapiens
gaaaggtgccatggaagaggcta

SEQ ID NO: 6188913 - DNA, 16 bp, Homo sapiens
gaaaggtgccatgtct

SEQ ID NO: 6188914 - DNA, 22 bp, Homo sapiens
gaaaggtgctcaaagatgtact

SEQ ID NO: 6188915 - DNA, 19 bp, Homo sapiens
gaaaggtgctgatggccct

SEQ ID NO: 6188916 - DNA, 16 bp, Homo sapiens
gaaaggtgtgaacagc

SEQ ID NO: 6188917 - DNA, 17 bp, Homo sapiens
gaaaggtgtgaggagag

SEQ ID NO: 6188918 - DNA, 20 bp, Homo sapiens
gaaaggtgtgaggagagagg

SEQ ID NO: 6188919 - DNA, 22 bp, Homo sapiens
gaaaggttaaaaaagcgaggtg

SEQ ID NO: 6188920 - DNA, 20 bp, Homo sapiens
gaaaggttagagaataaatt

SEQ ID NO: 6188921 - DNA, 18 bp, Homo sapiens
gaaaggttgaggggctcc

SEQ ID NO: 6188922 - DNA, 20 bp, Homo sapiens
gaaaggtttggaaaactaac

SEQ ID NO: 6188923 - DNA, 23 bp, Homo sapiens
gaaaggtttggaaaactaactca

SEQ ID NO: 6188924 - DNA, 23 bp, Homo sapiens
gaaaggttttgtattttttaaaa

SEQ ID NO: 6188925 - DNA, 13 bp, Homo sapiens
gaaagtaaaacca

SEQ ID NO: 6188926 - DNA, 13 bp, Homo sapiens
gaaagtaaagttg

SEQ ID NO: 6188927 - DNA, 15 bp, Homo sapiens
gaaagtaatttcaag

SEQ ID NO: 6188928 - DNA, 21 bp, Homo sapiens
gaaagtaatttcaagaatgtt

SEQ ID NO: 6188929 - DNA, 22 bp, Homo sapiens
gaaagtaatttcaagaatgttt

SEQ ID NO: 6188930 - DNA, 19 bp, Homo sapiens
gaaagtacactctgctgtt

SEQ ID NO: 6188931 - DNA, 15 bp, Homo sapiens
gaaagtacccagcaa

SEQ ID NO: 6188932 - DNA, 22 bp, Homo sapiens
gaaagtacccagcaaatgggca

SEQ ID NO: 6188933 - DNA, 9 bp, Homo sapiens
gaaagtact

SEQ ID NO: 6188934 - DNA, 20 bp, Homo sapiens
gaaagtactgcatgatctta

SEQ ID NO: 6188935 - DNA, 21 bp, Homo sapiens
gaaagtacttctccaccctgc

SEQ ID NO: 6188936 - DNA, 16 bp, Homo sapiens
gaaagtagctgctagt

SEQ ID NO: 6188937 - DNA, 14 bp, Homo sapiens
gaaagtagctgtat

SEQ ID NO: 6188938 - DNA, 21 bp, Homo sapiens
gaaagtagggggctttctggg

SEQ ID NO: 6188939 - DNA, 14 bp, Homo sapiens
gaaagtatattttc

SEQ ID NO: 6188940 - DNA, 20 bp, Homo sapiens
gaaagtatattttcctccca

SEQ ID NO: 6188941 - DNA, 13 bp, Homo sapiens
gaaagtatctcta

SEQ ID NO: 6188942 - DNA, 19 bp, Homo sapiens
gaaagtatttactttttaa

SEQ ID NO: 6188943 - DNA, 21 bp, Homo sapiens
gaaagtcaaaaaattatttgc

SEQ ID NO: 6188944 - DNA, 16 bp, Homo sapiens
gaaagtcaaatttact

SEQ ID NO: 6188945 - DNA, 20 bp, Homo sapiens
gaaagtcaaatttactttaa

SEQ ID NO: 6188946 - DNA, 21 bp, Homo sapiens
gaaagtcagaatcagaagata

SEQ ID NO: 6188947 - DNA, 21 bp, Homo sapiens
gaaagtcaggctagctgtgct

SEQ ID NO: 6188948 - DNA, 16 bp, Homo sapiens
gaaagtccattgatgt

SEQ ID NO: 6188949 - DNA, 13 bp, Homo sapiens
gaaagtcccagat

SEQ ID NO: 6188950 - DNA, 21 bp, Homo sapiens
gaaagtctatctaatgacatg

SEQ ID NO: 6188951 - DNA, 19 bp, Homo sapiens
gaaagtctgaatctcccaa

SEQ ID NO: 6188952 - DNA, 13 bp, Homo sapiens
gaaagtctgtcct

SEQ ID NO: 6188953 - DNA, 14 bp, Homo sapiens
gaaagtctgtcctt

SEQ ID NO: 6188954 - DNA, 21 bp, Homo sapiens
gaaagtctgtggcccaagaga

SEQ ID NO: 6188955 - DNA, 13 bp, Homo sapiens
gaaagtctgtgtc

SEQ ID NO: 6188956 - DNA, 16 bp, Homo sapiens
gaaagtctgtgtccaa

SEQ ID NO: 6188957 - DNA, 19 bp, Homo sapiens
gaaagtcttgtgactagtg

SEQ ID NO: 6188958 - DNA, 20 bp, Homo sapiens
gaaagtcttgtgactagtgc

SEQ ID NO: 6188959 - DNA, 22 bp, Homo sapiens
gaaagtcttgtgactagtgctg

SEQ ID NO: 6188960 - DNA, 17 bp, Homo sapiens
gaaagtgaataaacttc

SEQ ID NO: 6188961 - DNA, 20 bp, Homo sapiens
gaaagtgaataaacttcagc

SEQ ID NO: 6188962 - DNA, 21 bp, Homo sapiens
gaaagtgaataaacttcagca

SEQ ID NO: 6188963 - DNA, 16 bp, Homo sapiens
gaaagtgaatttgaat

SEQ ID NO: 6188964 - DNA, 23 bp, Homo sapiens
gaaagtgaatttgaatgaaaaat

SEQ ID NO: 6188965 - DNA, 15 bp, Homo sapiens
gaaagtgactttaaa

SEQ ID NO: 6188966 - DNA, 18 bp, Homo sapiens
gaaagtgactttaaaaga

SEQ ID NO: 6188967 - DNA, 16 bp, Homo sapiens
gaaagtgagcagtgtt

SEQ ID NO: 6188968 - DNA, 22 bp, Homo sapiens
gaaagtgagcagtgttagctta

SEQ ID NO: 6188969 - DNA, 13 bp, Homo sapiens
gaaagtgaggaaa

SEQ ID NO: 6188970 - DNA, 20 bp, Homo sapiens
gaaagtgaggaaataaagtt

SEQ ID NO: 6188971 - DNA, 22 bp, Homo sapiens
gaaagtgatttctagaaagcct

SEQ ID NO: 6188972 - DNA, 20 bp, Homo sapiens
gaaagtgatttgtaatatga

SEQ ID NO: 6188973 - DNA, 21 bp, Homo sapiens
gaaagtgatttgtaatatgat

SEQ ID NO: 6188974 - DNA, 13 bp, Homo sapiens
gaaagtgatttta

SEQ ID NO: 6188975 - DNA, 20 bp, Homo sapiens
gaaagtgcaaagtgccctca

SEQ ID NO: 6188976 - DNA, 20 bp, Homo sapiens
gaaagtgcatttttgtaaat

SEQ ID NO: 6188977 - DNA, 18 bp, Homo sapiens
gaaagtgccaaaataaag

SEQ ID NO: 6188978 - DNA, 16 bp, Homo sapiens
gaaagtgccagaaagt

SEQ ID NO: 6188979 - DNA, 22 bp, Homo sapiens
gaaagtgcctttcaggatctat

SEQ ID NO: 6188980 - DNA, 23 bp, Homo sapiens
gaaagtgcctttgcagctcagaa

SEQ ID NO: 6188981 - DNA, 18 bp, Homo sapiens
gaaagtgcgttctcccag

SEQ ID NO: 6188982 - DNA, 21 bp, Homo sapiens
gaaagtggccatgccaccctg

SEQ ID NO: 6188983 - DNA, 17 bp, Homo sapiens
gaaagtgggcaaaagct

SEQ ID NO: 6188984 - DNA, 19 bp, Homo sapiens
gaaagtgggggtggaggac

SEQ ID NO: 6188985 - DNA, 22 bp, Homo sapiens
gaaagtgggttcactagagctg

SEQ ID NO: 6188986 - DNA, 19 bp, Homo sapiens
gaaagtggtcttaagaaat

SEQ ID NO: 6188987 - DNA, 16 bp, Homo sapiens
gaaagtgtaaaataga

SEQ ID NO: 6188988 - DNA, 17 bp, Homo sapiens
gaaagtgtaaaatagaa

SEQ ID NO: 6188989 - DNA, 12 bp, Homo sapiens
gaaagtgtaaag

SEQ ID NO: 6188990 - DNA, 13 bp, Homo sapiens
gaaagtgtaaagc

SEQ ID NO: 6188991 - DNA, 15 bp, Homo sapiens
gaaagtgtaaagcat

SEQ ID NO: 6188992 - DNA, 11 bp, Homo sapiens
gaaagtgtatt

SEQ ID NO: 6188993 - DNA, 17 bp, Homo sapiens
gaaagtgtcatcaattt

SEQ ID NO: 6188994 - DNA, 13 bp, Homo sapiens
gaaagtgtctctg

SEQ ID NO: 6188995 - DNA, 22 bp, Homo sapiens
gaaagtgtgaagacccaaaaca

SEQ ID NO: 6188996 - DNA, 23 bp, Homo sapiens
gaaagtgtgtgtagttttacttt

SEQ ID NO: 6188997 - DNA, 17 bp, Homo sapiens
gaaagtgtgtgtgttct

SEQ ID NO: 6188998 - DNA, 17 bp, Homo sapiens
gaaagtgttatttttca

SEQ ID NO: 6188999 - DNA, 14 bp, Homo sapiens
gaaagtgttcattg

SEQ ID NO: 6189000 - DNA, 15 bp, Homo sapiens
gaaagtgttcattgc

SEQ ID NO: 6189001 - DNA, 17 bp, Homo sapiens
gaaagtgttcattgcac

SEQ ID NO: 6189002 - DNA, 23 bp, Homo sapiens
gaaagtgttcattgcacaatata

SEQ ID NO: 6189003 - DNA, 15 bp, Homo sapiens
gaaagtgttctgtta

SEQ ID NO: 6189004 - DNA, 17 bp, Homo sapiens
gaaagtgttctgttaca

SEQ ID NO: 6189005 - DNA, 11 bp, Homo sapiens
gaaagtgtttt

SEQ ID NO: 6189006 - DNA, 20 bp, Homo sapiens
gaaagtgttttattttcaaa

SEQ ID NO: 6189007 - DNA, 14 bp, Homo sapiens
gaaagttactgtaa

SEQ ID NO: 6189008 - DNA, 16 bp, Homo sapiens
gaaagttactgtaaat

SEQ ID NO: 6189009 - DNA, 18 bp, Homo sapiens
gaaagttactgtaaatgc

SEQ ID NO: 6189010 - DNA, 20 bp, Homo sapiens
gaaagttagagattttacaa

SEQ ID NO: 6189011 - DNA, 21 bp, Homo sapiens
gaaagttagggggttcttatt

SEQ ID NO: 6189012 - DNA, 23 bp, Homo sapiens
gaaagttattgataagttcatac

SEQ ID NO: 6189013 - DNA, 10 bp, Homo sapiens
gaaagttcca

SEQ ID NO: 6189014 - DNA, 19 bp, Homo sapiens
ctgtgccaccccttcctca

SEQ ID NO: 6189015 - DNA, 20 bp, Homo sapiens
ctgtgccaccccttcctcag

SEQ ID NO: 6189016 - DNA, 17 bp, Homo sapiens
ctgtgccaccctgggct

SEQ ID NO: 6189017 - DNA, 12 bp, Homo sapiens
ctgtgccacctg

SEQ ID NO: 6189018 - DNA, 16 bp, Homo sapiens
ctgtgccacctgcaag

SEQ ID NO: 6189019 - DNA, 18 bp, Homo sapiens
ctgtgccacgctcctctg

SEQ ID NO: 6189020 - DNA, 13 bp, Homo sapiens
ctgtgccagagcc

SEQ ID NO: 6189021 - DNA, 14 bp, Homo sapiens
ctgtgccagagcct

SEQ ID NO: 6189022 - DNA, 19 bp, Homo sapiens
ctgtgccagagcctggggc

SEQ ID NO: 6189023 - DNA, 20 bp, Homo sapiens
ctgtgccagagcctggggct

SEQ ID NO: 6189024 - DNA, 22 bp, Homo sapiens
ctgtgccagaggaaggaaaagg

SEQ ID NO: 6189025 - DNA, 14 bp, Homo sapiens
ctgtgccagcccag

SEQ ID NO: 6189026 - DNA, 11 bp, Homo sapiens
ctgtgccagct

SEQ ID NO: 6189027 - DNA, 16 bp, Homo sapiens
ctgtgccagctcaggt

SEQ ID NO: 6189028 - DNA, 13 bp, Homo sapiens
ctgtgccagctgc

SEQ ID NO: 6189029 - DNA, 15 bp, Homo sapiens
ctgtgccagctgctt

SEQ ID NO: 6189030 - DNA, 21 bp, Homo sapiens
ctgtgccagctgcttctgccc

SEQ ID NO: 6189031 - DNA, 16 bp, Homo sapiens
ctgtgccaggctggga

SEQ ID NO: 6189032 - DNA, 19 bp, Homo sapiens
ctgtgccaggctgggaggc

SEQ ID NO: 6189033 - DNA, 17 bp, Homo sapiens
ctgtgccatctgtggga

SEQ ID NO: 6189034 - DNA, 15 bp, Homo sapiens
ctgtgccatgcccaa

SEQ ID NO: 6189035 - DNA, 22 bp, Homo sapiens
ctgtgccatgcccaaggcctag

SEQ ID NO: 6189036 - DNA, 15 bp, Homo sapiens
ctgtgccatgctggg

SEQ ID NO: 6189037 - DNA, 11 bp, Homo sapiens
ctgtgccatgg

SEQ ID NO: 6189038 - DNA, 15 bp, Homo sapiens
ctgtgccatggattt

SEQ ID NO: 6189039 - DNA, 16 bp, Homo sapiens
ctgtgccatggccccc

SEQ ID NO: 6189040 - DNA, 19 bp, Homo sapiens
ctgtgccatggccccccac

SEQ ID NO: 6189041 - DNA, 20 bp, Homo sapiens
ctgtgccatgttattcagct

SEQ ID NO: 6189042 - DNA, 21 bp, Homo sapiens
ctgtgccattttctgtaaaga

SEQ ID NO: 6189043 - DNA, 22 bp, Homo sapiens
ctgtgccattttgtattttact

SEQ ID NO: 6189044 - DNA, 18 bp, Homo sapiens
ctgtgcccacatcccagg

SEQ ID NO: 6189045 - DNA, 23 bp, Homo sapiens
ctgtgcccacatcccaggcttca

SEQ ID NO: 6189046 - DNA, 20 bp, Homo sapiens
ctgtgcccacccagggcccg

SEQ ID NO: 6189047 - DNA, 17 bp, Homo sapiens
ctgtgcccaccctccac

SEQ ID NO: 6189048 - DNA, 17 bp, Homo sapiens
ctgtgcccactccctat

SEQ ID NO: 6189049 - DNA, 11 bp, Homo sapiens
ctgtgcccagc

SEQ ID NO: 6189050 - DNA, 16 bp, Homo sapiens
ctgtgcccagcaggcc

SEQ ID NO: 6189051 - DNA, 18 bp, Homo sapiens
ctgtgcccagcaggccca

SEQ ID NO: 6189052 - DNA, 19 bp, Homo sapiens
ctgtgcccagcaggcccag

SEQ ID NO: 6189053 - DNA, 20 bp, Homo sapiens
ctgtgcccagcaggcccagc

SEQ ID NO: 6189054 - DNA, 23 bp, Homo sapiens
ctgtgcccagcaggcccagcatg

SEQ ID NO: 6189055 - DNA, 12 bp, Homo sapiens
ctgtgcccagct

SEQ ID NO: 6189056 - DNA, 14 bp, Homo sapiens
ctgtgcccagctca

SEQ ID NO: 6189057 - DNA, 19 bp, Homo sapiens
ctgtgcccagctcagtctt

SEQ ID NO: 6189058 - DNA, 23 bp, Homo sapiens
ctgtgcccatcatctctgccttt

SEQ ID NO: 6189059 - DNA, 15 bp, Homo sapiens
ctgtgcccatgggca

SEQ ID NO: 6189060 - DNA, 18 bp, Homo sapiens
ctgtgcccatgggcactg

SEQ ID NO: 6189061 - DNA, 11 bp, Homo sapiens
ctgtgccccac

SEQ ID NO: 6189062 - DNA, 14 bp, Homo sapiens
ctgtgccccaccac

SEQ ID NO: 6189063 - DNA, 16 bp, Homo sapiens
ctgtgccccagctgcc

SEQ ID NO: 6189064 - DNA, 17 bp, Homo sapiens
ctgtgccccagctgcca

SEQ ID NO: 6189065 - DNA, 20 bp, Homo sapiens
ctgtgccccagctgccaggc

SEQ ID NO: 6189066 - DNA, 17 bp, Homo sapiens
ctgtgccccatgcctgt

SEQ ID NO: 6189067 - DNA, 12 bp, Homo sapiens
ctgtgcccccag

SEQ ID NO: 6189068 - DNA, 16 bp, Homo sapiens
ctgtgcccccagcctc

SEQ ID NO: 6189069 - DNA, 17 bp, Homo sapiens
ctgtgcccccagcctca

SEQ ID NO: 6189070 - DNA, 19 bp, Homo sapiens
ctgtgcccccagcctcagc

SEQ ID NO: 6189071 - DNA, 22 bp, Homo sapiens
ctgtgcccccagcctcagccca

SEQ ID NO: 6189072 - DNA, 23 bp, Homo sapiens
ctgtgcccccagcctcagcccaa

SEQ ID NO: 6189073 - DNA, 20 bp, Homo sapiens
ctgtgcccccagggtcctgg

SEQ ID NO: 6189074 - DNA, 22 bp, Homo sapiens
ctgtgcccccagggtcctggga

SEQ ID NO: 6189075 - DNA, 17 bp, Homo sapiens
ctgtgcccccctcctcc

SEQ ID NO: 6189076 - DNA, 19 bp, Homo sapiens
ctgtgcccccctcctcccc

SEQ ID NO: 6189077 - DNA, 20 bp, Homo sapiens
ctgtgcccccctcctccccg

SEQ ID NO: 6189078 - DNA, 21 bp, Homo sapiens
ctgtgccccctcccaccctgc

SEQ ID NO: 6189079 - DNA, 15 bp, Homo sapiens
ctgtgccccctctgg

SEQ ID NO: 6189080 - DNA, 17 bp, Homo sapiens
ctgtgccccctctggtt

SEQ ID NO: 6189081 - DNA, 17 bp, Homo sapiens
ctgtgccccgaccccac

SEQ ID NO: 6189082 - DNA, 17 bp, Homo sapiens
ctgtgccccgcgggctt

SEQ ID NO: 6189083 - DNA, 16 bp, Homo sapiens
ctgtgcccctcagaga

SEQ ID NO: 6189084 - DNA, 15 bp, Homo sapiens
ctgtgcccctgatgc

SEQ ID NO: 6189085 - DNA, 23 bp, Homo sapiens
ctgtgccccttccgccactgggg

SEQ ID NO: 6189086 - DNA, 20 bp, Homo sapiens
ctgtgccccttctctttaat

SEQ ID NO: 6189087 - DNA, 23 bp, Homo sapiens
ctgtgcccgccctgggctgggcc

SEQ ID NO: 6189088 - DNA, 18 bp, Homo sapiens
ctgtgcccgctgcgctgc

SEQ ID NO: 6189089 - DNA, 20 bp, Homo sapiens
ctgtgcccgctgcgctgccc

SEQ ID NO: 6189090 - DNA, 18 bp, Homo sapiens
ctgtgcccggtgccatct

SEQ ID NO: 6189091 - DNA, 23 bp, Homo sapiens
ctgtgcccggtgccatcttccat

SEQ ID NO: 6189092 - DNA, 12 bp, Homo sapiens
ctgtgccctcac

SEQ ID NO: 6189093 - DNA, 18 bp, Homo sapiens
ctgtgccctcaccaccac

SEQ ID NO: 6189094 - DNA, 19 bp, Homo sapiens
ctgtgccctcaccaccaca

SEQ ID NO: 6189095 - DNA, 14 bp, Homo sapiens
ctgtgccctcaccc

SEQ ID NO: 6189096 - DNA, 17 bp, Homo sapiens
ctgtgccctccaaagag

SEQ ID NO: 6189097 - DNA, 20 bp, Homo sapiens
ctgtgccctctggattctct

SEQ ID NO: 6189098 - DNA, 15 bp, Homo sapiens
ctgtgccctgccttc

SEQ ID NO: 6189099 - DNA, 12 bp, Homo sapiens
ctgtgccctggt

SEQ ID NO: 6189100 - DNA, 15 bp, Homo sapiens
ctgtgccctggtgga

SEQ ID NO: 6189101 - DNA, 17 bp, Homo sapiens
ctgtgccctggtggaga

SEQ ID NO: 6189102 - DNA, 16 bp, Homo sapiens
ctgtgcccttgctggg

SEQ ID NO: 6189103 - DNA, 21 bp, Homo sapiens
ctgtgcccttgctgggtccag

SEQ ID NO: 6189104 - DNA, 14 bp, Homo sapiens
ctgtgccgcactct

SEQ ID NO: 6189105 - DNA, 17 bp, Homo sapiens
ctgtgccgcactctggc

SEQ ID NO: 6189106 - DNA, 18 bp, Homo sapiens
ctgtgcctaacaccagcg

SEQ ID NO: 6189107 - DNA, 15 bp, Homo sapiens
ctgtgcctaataaag

SEQ ID NO: 6189108 - DNA, 15 bp, Homo sapiens
ctgtgcctcagagac

SEQ ID NO: 6189109 - DNA, 22 bp, Homo sapiens
ctgtgcctcagagaccagggct

SEQ ID NO: 6189110 - DNA, 13 bp, Homo sapiens
ctgtgcctcaggc

SEQ ID NO: 6189111 - DNA, 18 bp, Homo sapiens
ctgtgcctcaggccaggg

SEQ ID NO: 6189112 - DNA, 20 bp, Homo sapiens
ctgtgcctcaggccagggct

SEQ ID NO: 6189113 - DNA, 21 bp, Homo sapiens
ctgtgcctcaggccagggctc

SEQ ID NO: 6189114 - DNA, 13 bp, Homo sapiens
ctgtgcctcagtg

SEQ ID NO: 6189115 - DNA, 22 bp, Homo sapiens
ctgtgcctccaggaccaggggc

SEQ ID NO: 6189116 - DNA, 14 bp, Homo sapiens
ctgtgcctcccagc

SEQ ID NO: 6189117 - DNA, 18 bp, Homo sapiens
ctgtgcctccccccagac

SEQ ID NO: 6189118 - DNA, 12 bp, Homo sapiens
ctgtgcctccct

SEQ ID NO: 6189119 - DNA, 17 bp, Homo sapiens
ctgtgcctcctccctcc

SEQ ID NO: 6189120 - DNA, 21 bp, Homo sapiens
ctgtgcctcctccctccctct

SEQ ID NO: 6189121 - DNA, 17 bp, Homo sapiens
ctgtgcctcgcatccta

SEQ ID NO: 6189122 - DNA, 22 bp, Homo sapiens
ctgtgcctcggcttttctcagc

SEQ ID NO: 6189123 - DNA, 16 bp, Homo sapiens
ctgtgcctctgggact

SEQ ID NO: 6189124 - DNA, 18 bp, Homo sapiens
ctgtgcctctgggactgg

SEQ ID NO: 6189125 - DNA, 15 bp, Homo sapiens
ctgtgcctgaatatt

SEQ ID NO: 6189126 - DNA, 13 bp, Homo sapiens
ctgtgcctgactc

SEQ ID NO: 6189127 - DNA, 12 bp, Homo sapiens
ctgtgcctgcca

SEQ ID NO: 6189128 - DNA, 19 bp, Homo sapiens
ctgtgcctgccatgggcca

SEQ ID NO: 6189129 - DNA, 22 bp, Homo sapiens
ctgtgcctgccatgggccagcc

SEQ ID NO: 6189130 - DNA, 18 bp, Homo sapiens
ctgtgcctgcctgggagt

SEQ ID NO: 6189131 - DNA, 14 bp, Homo sapiens
ctgtgcctgctaga

SEQ ID NO: 6189132 - DNA, 17 bp, Homo sapiens
ctgtgcctgctagagca

SEQ ID NO: 6189133 - DNA, 14 bp, Homo sapiens
ctgtgcctgctcag

SEQ ID NO: 6189134 - DNA, 19 bp, Homo sapiens
ctgtgcctgctcagcagcc

SEQ ID NO: 6189135 - DNA, 14 bp, Homo sapiens
ctgtgcctgctggg

SEQ ID NO: 6189136 - DNA, 13 bp, Homo sapiens
ctgtgcctggagc

SEQ ID NO: 6189137 - DNA, 15 bp, Homo sapiens
ctgtgcctggcccca

SEQ ID NO: 6189138 - DNA, 16 bp, Homo sapiens
ctgtgcctggccccag

SEQ ID NO: 6189139 - DNA, 14 bp, Homo sapiens
ctgtgcctggcctc

SEQ ID NO: 6189140 - DNA, 16 bp, Homo sapiens
ctgtgcctggctccct

SEQ ID NO: 6189141 - DNA, 18 bp, Homo sapiens
ctgtgcctggctccctga

SEQ ID NO: 6189142 - DNA, 19 bp, Homo sapiens
ctgtgcctgggcctagcac

SEQ ID NO: 6189143 - DNA, 18 bp, Homo sapiens
ctgtgcctgtctgtccaa

SEQ ID NO: 6189144 - DNA, 12 bp, Homo sapiens
ctgtgcctgtgt

SEQ ID NO: 6189145 - DNA, 18 bp, Homo sapiens
ctgtgccttccctttcta

SEQ ID NO: 6189146 - DNA, 20 bp, Homo sapiens
ctgtgccttgtcacgccaga

SEQ ID NO: 6189147 - DNA, 23 bp, Homo sapiens
ctgtgccttgttttttgtttgtt

SEQ ID NO: 6189148 - DNA, 18 bp, Homo sapiens
ctgtgcctttcctatcac

SEQ ID NO: 6189149 - DNA, 21 bp, Homo sapiens
ctgtgcctttgagtttcctca

SEQ ID NO: 6189150 - DNA, 12 bp, Homo sapiens
ctgtgcctttgg

SEQ ID NO: 6189151 - DNA, 16 bp, Homo sapiens
ctgtgccttttcccca

SEQ ID NO: 6189152 - DNA, 17 bp, Homo sapiens
ctgtgccttttttagct

SEQ ID NO: 6189153 - DNA, 20 bp, Homo sapiens
ctgtgccttttttatatctt

SEQ ID NO: 6189154 - DNA, 14 bp, Homo sapiens
ctgtgcgcccaggg

SEQ ID NO: 6189155 - DNA, 19 bp, Homo sapiens
ctgtgcgcgtggcgtggcc

SEQ ID NO: 6189156 - DNA, 14 bp, Homo sapiens
ctgtgcgctgacaa

SEQ ID NO: 6189157 - DNA, 15 bp, Homo sapiens
ctgtgcgtctgtttt

SEQ ID NO: 6189158 - DNA, 16 bp, Homo sapiens
ctgtgcgtggaaaaag

SEQ ID NO: 6189159 - DNA, 17 bp, Homo sapiens
ctgtgcgtggaaaaaga

SEQ ID NO: 6189160 - DNA, 22 bp, Homo sapiens
ctgtgcgtgtgtgtgtgtgtat

SEQ ID NO: 6189161 - DNA, 14 bp, Homo sapiens
ctgtgcgttccctt

SEQ ID NO: 6189162 - DNA, 15 bp, Homo sapiens
ctgtgcgttcccttc

SEQ ID NO: 6189163 - DNA, 16 bp, Homo sapiens
ctgtgcgttcccttca

SEQ ID NO: 6189164 - DNA, 14 bp, Homo sapiens
ctgtgcgttttaga

SEQ ID NO: 6189165 - DNA, 18 bp, Homo sapiens
ctgtgctaagtctttccc

SEQ ID NO: 6189166 - DNA, 20 bp, Homo sapiens
ctgtgctaagttgtcttaca

SEQ ID NO: 6189167 - DNA, 18 bp, Homo sapiens
ctgtgctaatcaaaactt

SEQ ID NO: 6189168 - DNA, 14 bp, Homo sapiens
ctgtgctacctcta

SEQ ID NO: 6189169 - DNA, 20 bp, Homo sapiens
ctgtgctacgtgtgaaatct

SEQ ID NO: 6189170 - DNA, 17 bp, Homo sapiens
ctgtgctactttgcctt

SEQ ID NO: 6189171 - DNA, 19 bp, Homo sapiens
ctgtgctagcaacacccaa

SEQ ID NO: 6189172 - DNA, 14 bp, Homo sapiens
ctgtgctagctttc

SEQ ID NO: 6189173 - DNA, 21 bp, Homo sapiens
ctgtgctagggaaacttcccg

SEQ ID NO: 6189174 - DNA, 21 bp, Homo sapiens
ctgtgctatcggcagatgatg

SEQ ID NO: 6189175 - DNA, 15 bp, Homo sapiens
ctgtgctatgaattt

SEQ ID NO: 6189176 - DNA, 19 bp, Homo sapiens
ctgtgctatggtgctctgt

SEQ ID NO: 6189177 - DNA, 21 bp, Homo sapiens
ctgtgctatttgtacaaataa

SEQ ID NO: 6189178 - DNA, 14 bp, Homo sapiens
ctgtgctcacccat

SEQ ID NO: 6189179 - DNA, 15 bp, Homo sapiens
ctgtgctcacccatt

SEQ ID NO: 6189180 - DNA, 15 bp, Homo sapiens
ctgtgctcaccctct

SEQ ID NO: 6189181 - DNA, 16 bp, Homo sapiens
ctgtgctcaccctctc

SEQ ID NO: 6189182 - DNA, 12 bp, Homo sapiens
ctgtgctcagcc

SEQ ID NO: 6189183 - DNA, 13 bp, Homo sapiens
ctgtgctcagccc

SEQ ID NO: 6189184 - DNA, 12 bp, Homo sapiens
ctgtgctcagga

SEQ ID NO: 6189185 - DNA, 17 bp, Homo sapiens
ctgtgctcaggactcag

SEQ ID NO: 6189186 - DNA, 19 bp, Homo sapiens
ctgtgctcaggactcagaa

SEQ ID NO: 6189187 - DNA, 23 bp, Homo sapiens
ctgtgctcaggactcagaagcct

SEQ ID NO: 6189188 - DNA, 15 bp, Homo sapiens
ctgtgctccacactc

SEQ ID NO: 6189189 - DNA, 17 bp, Homo sapiens
ctgtgctccacactcag

SEQ ID NO: 6189190 - DNA, 20 bp, Homo sapiens
ctgtgctccacactcagaaa

SEQ ID NO: 6189191 - DNA, 23 bp, Homo sapiens
ctgtgctccagcagtgctgggcc

SEQ ID NO: 6189192 - DNA, 19 bp, Homo sapiens
ctgtgctccatggctgcca

SEQ ID NO: 6189193 - DNA, 12 bp, Homo sapiens
ctgtgctcccac

SEQ ID NO: 6189194 - DNA, 20 bp, Homo sapiens
gaaagttccaaatgtttata

SEQ ID NO: 6189195 - DNA, 17 bp, Homo sapiens
gaaagttccttatgtat

SEQ ID NO: 6189196 - DNA, 13 bp, Homo sapiens
gaaagttctatta

SEQ ID NO: 6189197 - DNA, 20 bp, Homo sapiens
gaaagttctattatctgggt

SEQ ID NO: 6189198 - DNA, 13 bp, Homo sapiens
gaaagttctggaa

SEQ ID NO: 6189199 - DNA, 20 bp, Homo sapiens
gaaagttgacatgggtgggg

SEQ ID NO: 6189200 - DNA, 17 bp, Homo sapiens
gaaagttgcaaggcaaa

SEQ ID NO: 6189201 - DNA, 22 bp, Homo sapiens
gaaagttgcaaggcaaatgttt

SEQ ID NO: 6189202 - DNA, 18 bp, Homo sapiens
gaaagttgcacggctgct

SEQ ID NO: 6189203 - DNA, 19 bp, Homo sapiens
gaaagttgcacggctgctg

SEQ ID NO: 6189204 - DNA, 18 bp, Homo sapiens
gaaagttgcatttaatgt

SEQ ID NO: 6189205 - DNA, 21 bp, Homo sapiens
gaaagttgctaactgggaaga

SEQ ID NO: 6189206 - DNA, 13 bp, Homo sapiens
gaaagttgctttt

SEQ ID NO: 6189207 - DNA, 22 bp, Homo sapiens
gaaagttggacttgagaaagat

SEQ ID NO: 6189208 - DNA, 21 bp, Homo sapiens
gaaagttgggcccctgaggag

SEQ ID NO: 6189209 - DNA, 18 bp, Homo sapiens
gaaagttgtacatgaaat

SEQ ID NO: 6189210 - DNA, 16 bp, Homo sapiens
gaaagttgtacatgat

SEQ ID NO: 6189211 - DNA, 20 bp, Homo sapiens
gaaagtttccccaccagtga

SEQ ID NO: 6189212 - DNA, 14 bp, Homo sapiens
gaaagtttccttat

SEQ ID NO: 6189213 - DNA, 18 bp, Homo sapiens
gaaagtttgccaggagga

SEQ ID NO: 6189214 - DNA, 19 bp, Homo sapiens
gaaagtttgtaaaaatata

SEQ ID NO: 6189215 - DNA, 15 bp, Homo sapiens
gaaagttttattttc

SEQ ID NO: 6189216 - DNA, 13 bp, Homo sapiens
gaaagttttccag

SEQ ID NO: 6189217 - DNA, 17 bp, Homo sapiens
gaaagttttgtaaaaga

SEQ ID NO: 6189218 - DNA, 18 bp, Homo sapiens
gaaagttttgtaaaagaa

SEQ ID NO: 6189219 - DNA, 17 bp, Homo sapiens
gaaagtttttagaatgt

SEQ ID NO: 6189220 - DNA, 13 bp, Homo sapiens
gaaagtttttctg

SEQ ID NO: 6189221 - DNA, 18 bp, Homo sapiens
gaaataaaaaagtctcta

SEQ ID NO: 6189222 - DNA, 22 bp, Homo sapiens
gaaataaaaagcatgactattt

SEQ ID NO: 6189223 - DNA, 23 bp, Homo sapiens
gaaataaaaagcatgactatttc

SEQ ID NO: 6189224 - DNA, 21 bp, Homo sapiens
gaaataaaaatggcaaatgca

SEQ ID NO: 6189225 - DNA, 15 bp, Homo sapiens
gaaataaaaattatg

SEQ ID NO: 6189226 - DNA, 21 bp, Homo sapiens
gaaataaaactgtttttgaac

SEQ ID NO: 6189227 - DNA, 23 bp, Homo sapiens
gaaataaaaggaagccaaagagt

SEQ ID NO: 6189228 - DNA, 16 bp, Homo sapiens
gaaataaaatatatct

SEQ ID NO: 6189229 - DNA, 19 bp, Homo sapiens
gaaataaaatttgaaactg

SEQ ID NO: 6189230 - DNA, 21 bp, Homo sapiens
gaaataaaatttgataaacat

SEQ ID NO: 6189231 - DNA, 12 bp, Homo sapiens
gaaataaacact

SEQ ID NO: 6189232 - DNA, 13 bp, Homo sapiens
gaaataaaccatt

SEQ ID NO: 6189233 - DNA, 19 bp, Homo sapiens
gaaataaacctgcactgaa

SEQ ID NO: 6189234 - DNA, 22 bp, Homo sapiens
gaaataaacctggagatgatga

SEQ ID NO: 6189235 - DNA, 21 bp, Homo sapiens
gaaataaacgtcttaaatatt

SEQ ID NO: 6189236 - DNA, 18 bp, Homo sapiens
gaaataaactagggtttt

SEQ ID NO: 6189237 - DNA, 11 bp, Homo sapiens
gaaataaagcg

SEQ ID NO: 6189238 - DNA, 15 bp, Homo sapiens
gaaataaagggacca

SEQ ID NO: 6189239 - DNA, 20 bp, Homo sapiens
gaaataaagtaatttttata

SEQ ID NO: 6189240 - DNA, 18 bp, Homo sapiens
gaaataaagtaggaaaga

SEQ ID NO: 6189241 - DNA, 14 bp, Homo sapiens
gaaataaagtcaga

SEQ ID NO: 6189242 - DNA, 18 bp, Homo sapiens
gaaataaagttggtgaca

SEQ ID NO: 6189243 - DNA, 17 bp, Homo sapiens
gaaataaagtttgctta

SEQ ID NO: 6189244 - DNA, 21 bp, Homo sapiens
gaaataaatagctatatccat

SEQ ID NO: 6189245 - DNA, 23 bp, Homo sapiens
gaaataaatagctatatccatgt

SEQ ID NO: 6189246 - DNA, 14 bp, Homo sapiens
gaaataaatcacag

SEQ ID NO: 6189247 - DNA, 16 bp, Homo sapiens
gaaataaatgaaactt

SEQ ID NO: 6189248 - DNA, 20 bp, Homo sapiens
gaaataaatgtacctgatgt

SEQ ID NO: 6189249 - DNA, 15 bp, Homo sapiens
gaaataaatgtttca

SEQ ID NO: 6189250 - DNA, 17 bp, Homo sapiens
gaaataaattcctaaac

SEQ ID NO: 6189251 - DNA, 23 bp, Homo sapiens
gaaataaattggtgataagtgga

SEQ ID NO: 6189252 - DNA, 17 bp, Homo sapiens
gaaataacaaaatggac

SEQ ID NO: 6189253 - DNA, 18 bp, Homo sapiens
gaaataacaagtcgatga

SEQ ID NO: 6189254 - DNA, 17 bp, Homo sapiens
gaaataacaatgttaag

SEQ ID NO: 6189255 - DNA, 17 bp, Homo sapiens
gaaataacagaagaaaa

SEQ ID NO: 6189256 - DNA, 21 bp, Homo sapiens
gaaataacattgcactttata

SEQ ID NO: 6189257 - DNA, 16 bp, Homo sapiens
gaaataagtaaatgta

SEQ ID NO: 6189258 - DNA, 18 bp, Homo sapiens
gaaataagtagtgtcatt

SEQ ID NO: 6189259 - DNA, 18 bp, Homo sapiens
gaaataagtgccctctcc

SEQ ID NO: 6189260 - DNA, 21 bp, Homo sapiens
gaaataagtttttgtttcaca

SEQ ID NO: 6189261 - DNA, 12 bp, Homo sapiens
gaaataataaaa

SEQ ID NO: 6189262 - DNA, 19 bp, Homo sapiens
gaaataataaaaaatttca

SEQ ID NO: 6189263 - DNA, 15 bp, Homo sapiens
gaaataataaaatgc

SEQ ID NO: 6189264 - DNA, 17 bp, Homo sapiens
gaaataataaaatgcaa

SEQ ID NO: 6189265 - DNA, 19 bp, Homo sapiens
gaaataataaaatgcaaat

SEQ ID NO: 6189266 - DNA, 17 bp, Homo sapiens
gaaataataaatctggt

SEQ ID NO: 6189267 - DNA, 23 bp, Homo sapiens
gaaataataaattaacattatat

SEQ ID NO: 6189268 - DNA, 13 bp, Homo sapiens
gaaataataatat

SEQ ID NO: 6189269 - DNA, 24 bp, Homo sapiens
gaaataataccccaacagatgagc

SEQ ID NO: 6189270 - DNA, 16 bp, Homo sapiens
gaaataatagaaatgt

SEQ ID NO: 6189271 - DNA, 13 bp, Homo sapiens
gaaataatatgca

SEQ ID NO: 6189272 - DNA, 15 bp, Homo sapiens
gaaataatatgcatt

SEQ ID NO: 6189273 - DNA, 13 bp, Homo sapiens
gaaataatgggat

SEQ ID NO: 6189274 - DNA, 21 bp, Homo sapiens
gaaataatgggattagaaaca

SEQ ID NO: 6189275 - DNA, 12 bp, Homo sapiens
gaaataatgtgt

SEQ ID NO: 6189276 - DNA, 13 bp, Homo sapiens
gaaataatgtgta

SEQ ID NO: 6189277 - DNA, 19 bp, Homo sapiens
gaaataattgttgttctgt

SEQ ID NO: 6189278 - DNA, 20 bp, Homo sapiens
gaaataattgttgttctgtt

SEQ ID NO: 6189279 - DNA, 13 bp, Homo sapiens
gaaataatttgaa

SEQ ID NO: 6189280 - DNA, 14 bp, Homo sapiens
gaaataatttgaat

SEQ ID NO: 6189281 - DNA, 21 bp, Homo sapiens
gaaataatttgaatgtatttg

SEQ ID NO: 6189282 - DNA, 18 bp, Homo sapiens
gaaatacaaaaatactca

SEQ ID NO: 6189283 - DNA, 20 bp, Homo sapiens
gaaatacactacaaatgtta

SEQ ID NO: 6189284 - DNA, 16 bp, Homo sapiens
gaaatacagaagaaaa

SEQ ID NO: 6189285 - DNA, 17 bp, Homo sapiens
gaaatacagattttgat

SEQ ID NO: 6189286 - DNA, 22 bp, Homo sapiens
gaaatacagattttgatagcaa

SEQ ID NO: 6189287 - DNA, 23 bp, Homo sapiens
gaaatacagctaaggccttgcca

SEQ ID NO: 6189288 - DNA, 14 bp, Homo sapiens
gaaatacagctggc

SEQ ID NO: 6189289 - DNA, 15 bp, Homo sapiens
gaaatacagctggct

SEQ ID NO: 6189290 - DNA, 18 bp, Homo sapiens
gaaatacagttatttcat

SEQ ID NO: 6189291 - DNA, 19 bp, Homo sapiens
gaaatacagttctgctctg

SEQ ID NO: 6189292 - DNA, 14 bp, Homo sapiens
gaaatacataaaaa

SEQ ID NO: 6189293 - DNA, 15 bp, Homo sapiens
gaaatacattatgct

SEQ ID NO: 6189294 - DNA, 12 bp, Homo sapiens
gaaatacattta

SEQ ID NO: 6189295 - DNA, 17 bp, Homo sapiens
gaaataccaactgaagt

SEQ ID NO: 6189296 - DNA, 14 bp, Homo sapiens
gaaataccaggacc

SEQ ID NO: 6189297 - DNA, 15 bp, Homo sapiens
gaaataccaggacca

SEQ ID NO: 6189298 - DNA, 22 bp, Homo sapiens
gaaatacccatgttacttctct

SEQ ID NO: 6189299 - DNA, 12 bp, Homo sapiens
gaaatacctcat

SEQ ID NO: 6189300 - DNA, 17 bp, Homo sapiens
gaaatacctcatgttta

SEQ ID NO: 6189301 - DNA, 21 bp, Homo sapiens
gaaatacctcatgtttatgaa

SEQ ID NO: 6189302 - DNA, 19 bp, Homo sapiens
gaaatacctttgcctggat

SEQ ID NO: 6189303 - DNA, 16 bp, Homo sapiens
gaaatacctttgtagt

SEQ ID NO: 6189304 - DNA, 17 bp, Homo sapiens
gaaatacctttgtagtt

SEQ ID NO: 6189305 - DNA, 23 bp, Homo sapiens
gaaatacctttgtagttactcaa

SEQ ID NO: 6189306 - DNA, 22 bp, Homo sapiens
gaaatacgtttgtgtttctaga

SEQ ID NO: 6189307 - DNA, 15 bp, Homo sapiens
gaaatactaaaagca

SEQ ID NO: 6189308 - DNA, 18 bp, Homo sapiens
gaaatactaaaagcaaat

SEQ ID NO: 6189309 - DNA, 15 bp, Homo sapiens
gaaatactcatgtgc

SEQ ID NO: 6189310 - DNA, 17 bp, Homo sapiens
gaaatactcgtttttat

SEQ ID NO: 6189311 - DNA, 16 bp, Homo sapiens
gaaatactgagatgct

SEQ ID NO: 6189312 - DNA, 19 bp, Homo sapiens
gaaatactgccttggctag

SEQ ID NO: 6189313 - DNA, 19 bp, Homo sapiens
gaaatacttaacacgtgaa

SEQ ID NO: 6189314 - DNA, 20 bp, Homo sapiens
gaaatacttgacaacatttt

SEQ ID NO: 6189315 - DNA, 21 bp, Homo sapiens
gaaatactttatctgtgacca

SEQ ID NO: 6189316 - DNA, 19 bp, Homo sapiens
gaaatagaaaaaccctgcc

SEQ ID NO: 6189317 - DNA, 16 bp, Homo sapiens
gaaatagaaaaggaag

SEQ ID NO: 6189318 - DNA, 16 bp, Homo sapiens
gaaatagaaagaagcc

SEQ ID NO: 6189319 - DNA, 19 bp, Homo sapiens
gaaatagaaagaagccata

SEQ ID NO: 6189320 - DNA, 21 bp, Homo sapiens
gaaatagacaaaaagtatatt

SEQ ID NO: 6189321 - DNA, 18 bp, Homo sapiens
gaaatagacagtatattt

SEQ ID NO: 6189322 - DNA, 20 bp, Homo sapiens
gaaatagatatcctctcccc

SEQ ID NO: 6189323 - DNA, 23 bp, Homo sapiens
gaaatagccgaactccaggctgg

SEQ ID NO: 6189324 - DNA, 15 bp, Homo sapiens
gaaatagcggccctg

SEQ ID NO: 6189325 - DNA, 21 bp, Homo sapiens
gaaatagcttatgaaaagaat

SEQ ID NO: 6189326 - DNA, 15 bp, Homo sapiens
gaaataggaaacaag

SEQ ID NO: 6189327 - DNA, 19 bp, Homo sapiens
gaaataggatctccactgg

SEQ ID NO: 6189328 - DNA, 15 bp, Homo sapiens
gaaataggtatcaaa

SEQ ID NO: 6189329 - DNA, 19 bp, Homo sapiens
gaaatagtcatttgtgaat

SEQ ID NO: 6189330 - DNA, 20 bp, Homo sapiens
gaaatagtcatttgtgaatt

SEQ ID NO: 6189331 - DNA, 22 bp, Homo sapiens
gaaatagtctgattttaatgaa

SEQ ID NO: 6189332 - DNA, 17 bp, Homo sapiens
gaaatagtctgtgtgaa

SEQ ID NO: 6189333 - DNA, 21 bp, Homo sapiens
gaaatagttattttaatacct

SEQ ID NO: 6189334 - DNA, 18 bp, Homo sapiens
gaaatagttcaaagccaa

SEQ ID NO: 6189335 - DNA, 13 bp, Homo sapiens
gaaatagttctgt

SEQ ID NO: 6189336 - DNA, 23 bp, Homo sapiens
gaaatagttctgtgactaggaaa

SEQ ID NO: 6189337 - DNA, 16 bp, Homo sapiens
gaaatagttgtctgtg

SEQ ID NO: 6189338 - DNA, 19 bp, Homo sapiens
gaaatagttgtctgtgctt

SEQ ID NO: 6189339 - DNA, 18 bp, Homo sapiens
gaaatagtttccaagaaa

SEQ ID NO: 6189340 - DNA, 20 bp, Homo sapiens
gaaatagtttccaagaaatt

SEQ ID NO: 6189341 - DNA, 19 bp, Homo sapiens
gaaatataaaaataattaa

SEQ ID NO: 6189342 - DNA, 18 bp, Homo sapiens
gaaatataaacacattaa

SEQ ID NO: 6189343 - DNA, 15 bp, Homo sapiens
gaaatataaattatc

SEQ ID NO: 6189344 - DNA, 16 bp, Homo sapiens
gaaatataaattatct

SEQ ID NO: 6189345 - DNA, 20 bp, Homo sapiens
gaaatataaattatctgaat

SEQ ID NO: 6189346 - DNA, 14 bp, Homo sapiens
gaaatataataaaa

SEQ ID NO: 6189347 - DNA, 20 bp, Homo sapiens
gaaatataataaaatgtgtt

SEQ ID NO: 6189348 - DNA, 15 bp, Homo sapiens
gaaatataatgcaaa

SEQ ID NO: 6189349 - DNA, 16 bp, Homo sapiens
gaaatatacagtttga

SEQ ID NO: 6189350 - DNA, 21 bp, Homo sapiens
gaaatatacttttacaagtaa

SEQ ID NO: 6189351 - DNA, 20 bp, Homo sapiens
gaaatatagttgaaagtaaa

SEQ ID NO: 6189352 - DNA, 11 bp, Homo sapiens
gaaatatataa

SEQ ID NO: 6189353 - DNA, 21 bp, Homo sapiens
gaaatatataaaaatatatgt

SEQ ID NO: 6189354 - DNA, 22 bp, Homo sapiens
gaaatatatacgaacaaaacac

SEQ ID NO: 6189355 - DNA, 14 bp, Homo sapiens
gaaatatatattat

SEQ ID NO: 6189356 - DNA, 18 bp, Homo sapiens
gaaatatatattgtaaag

SEQ ID NO: 6189357 - DNA, 20 bp, Homo sapiens
gaaatatatattgtaaagaa

SEQ ID NO: 6189358 - DNA, 22 bp, Homo sapiens
gaaatatatggtctaatgttta

SEQ ID NO: 6189359 - DNA, 13 bp, Homo sapiens
gaaatatatgtga

SEQ ID NO: 6189360 - DNA, 16 bp, Homo sapiens
gaaatatattatgaaa

SEQ ID NO: 6189361 - DNA, 18 bp, Homo sapiens
gaaatatattatgaaaat

SEQ ID NO: 6189362 - DNA, 20 bp, Homo sapiens
gaaatatattatgaaaatta

SEQ ID NO: 6189363 - DNA, 13 bp, Homo sapiens
gaaatatatttgt

SEQ ID NO: 6189364 - DNA, 15 bp, Homo sapiens
gaaatatattttaaa

SEQ ID NO: 6189365 - DNA, 18 bp, Homo sapiens
gaaatatattttaaatgt

SEQ ID NO: 6189366 - DNA, 21 bp, Homo sapiens
gaaatatattttctctttttg

SEQ ID NO: 6189367 - DNA, 22 bp, Homo sapiens
gaaatatcagttactcagccct

SEQ ID NO: 6189368 - DNA, 20 bp, Homo sapiens
gaaatatcataatgtaatga

SEQ ID NO: 6189369 - DNA, 20 bp, Homo sapiens
gaaatatcccgggggtgggg

SEQ ID NO: 6189370 - DNA, 15 bp, Homo sapiens
gaaatatcctgcttg

SEQ ID NO: 6189371 - DNA, 13 bp, Homo sapiens
ctgtgctcccacg

SEQ ID NO: 6189372 - DNA, 18 bp, Homo sapiens
ctgtgctcccctgccaca

SEQ ID NO: 6189373 - DNA, 15 bp, Homo sapiens
ctgtgctccctcggt

SEQ ID NO: 6189374 - DNA, 19 bp, Homo sapiens
ctgtgctccgtgcctccac

SEQ ID NO: 6189375 - DNA, 22 bp, Homo sapiens
ctgtgctccgtgcctccaccac

SEQ ID NO: 6189376 - DNA, 15 bp, Homo sapiens
ctgtgctcctgccca

SEQ ID NO: 6189377 - DNA, 21 bp, Homo sapiens
ctgtgctcctgcccaggagca

SEQ ID NO: 6189378 - DNA, 21 bp, Homo sapiens
ctgtgctcggaggccatctcg

SEQ ID NO: 6189379 - DNA, 16 bp, Homo sapiens
ctgtgctctcaccagc

SEQ ID NO: 6189380 - DNA, 17 bp, Homo sapiens
ctgtgctctggacaggc

SEQ ID NO: 6189381 - DNA, 18 bp, Homo sapiens
ctgtgctctggacaggca

SEQ ID NO: 6189382 - DNA, 19 bp, Homo sapiens
ctgtgctctggacaggcat

SEQ ID NO: 6189383 - DNA, 12 bp, Homo sapiens
ctgtgctctggc

SEQ ID NO: 6189384 - DNA, 23 bp, Homo sapiens
ctgtgctctggggatttctggga

SEQ ID NO: 6189385 - DNA, 22 bp, Homo sapiens
ctgtgctctgggggtcccttgc

SEQ ID NO: 6189386 - DNA, 18 bp, Homo sapiens
ctgtgctcttcctctggt

SEQ ID NO: 6189387 - DNA, 19 bp, Homo sapiens
ctgtgctcttcctctggtt

SEQ ID NO: 6189388 - DNA, 15 bp, Homo sapiens
ctgtgctctttcatt

SEQ ID NO: 6189389 - DNA, 21 bp, Homo sapiens
ctgtgctcttttggtggggag

SEQ ID NO: 6189390 - DNA, 22 bp, Homo sapiens
ctgtgctcttttggtggggagc

SEQ ID NO: 6189391 - DNA, 21 bp, Homo sapiens
ctgtgctgacatggctctgga

SEQ ID NO: 6189392 - DNA, 14 bp, Homo sapiens
ctgtgctgaccctc

SEQ ID NO: 6189393 - DNA, 17 bp, Homo sapiens
ctgtgctgaccctcctg

SEQ ID NO: 6189394 - DNA, 12 bp, Homo sapiens
ctgtgctgagaa

SEQ ID NO: 6189395 - DNA, 13 bp, Homo sapiens
ctgtgctgagaag

SEQ ID NO: 6189396 - DNA, 14 bp, Homo sapiens
ctgtgctgagtctg

SEQ ID NO: 6189397 - DNA, 22 bp, Homo sapiens
ctgtgctgagtctgaaggctgg

SEQ ID NO: 6189398 - DNA, 14 bp, Homo sapiens
ctgtgctgatcctg

SEQ ID NO: 6189399 - DNA, 11 bp, Homo sapiens
ctgtgctgccc

SEQ ID NO: 6189400 - DNA, 20 bp, Homo sapiens
ctgtgctgcccgtcttcagc

SEQ ID NO: 6189401 - DNA, 22 bp, Homo sapiens
ctgtgctgcccgtcttcagcct

SEQ ID NO: 6189402 - DNA, 12 bp, Homo sapiens
ctgtgctgccct

SEQ ID NO: 6189403 - DNA, 13 bp, Homo sapiens
ctgtgctgccctg

SEQ ID NO: 6189404 - DNA, 17 bp, Homo sapiens
ctgtgctgccctgccca

SEQ ID NO: 6189405 - DNA, 21 bp, Homo sapiens
ctgtgctgccctgcccacctg

SEQ ID NO: 6189406 - DNA, 21 bp, Homo sapiens
ctgtgctgccctgctctgggg

SEQ ID NO: 6189407 - DNA, 18 bp, Homo sapiens
ctgtgctggaccagctgg

SEQ ID NO: 6189408 - DNA, 21 bp, Homo sapiens
ctgtgctggaccagctggcct

SEQ ID NO: 6189409 - DNA, 14 bp, Homo sapiens
ctgtgctggagcca

SEQ ID NO: 6189410 - DNA, 15 bp, Homo sapiens
ctgtgctggagccac

SEQ ID NO: 6189411 - DNA, 16 bp, Homo sapiens
ctgtgctggagccact

SEQ ID NO: 6189412 - DNA, 14 bp, Homo sapiens
ctgtgctggccagc

SEQ ID NO: 6189413 - DNA, 13 bp, Homo sapiens
ctgtgctggccat

SEQ ID NO: 6189414 - DNA, 14 bp, Homo sapiens
ctgtgctgggagaa

SEQ ID NO: 6189415 - DNA, 22 bp, Homo sapiens
ctgtgctgggtgagctcttcca

SEQ ID NO: 6189416 - DNA, 23 bp, Homo sapiens
ctgtgctgggtgccttgcatgca

SEQ ID NO: 6189417 - DNA, 12 bp, Homo sapiens
ctgtgctggtgt

SEQ ID NO: 6189418 - DNA, 18 bp, Homo sapiens
ctgtgctggtgtcctgac

SEQ ID NO: 6189419 - DNA, 20 bp, Homo sapiens
ctgtgctggtgtcctgacca

SEQ ID NO: 6189420 - DNA, 23 bp, Homo sapiens
ctgtgctggtgtcctgaccaccc

SEQ ID NO: 6189421 - DNA, 20 bp, Homo sapiens
ctgtgctgtactgagcactg

SEQ ID NO: 6189422 - DNA, 15 bp, Homo sapiens
ctgtgctgtattttg

SEQ ID NO: 6189423 - DNA, 16 bp, Homo sapiens
ctgtgctgtgcctgct

SEQ ID NO: 6189424 - DNA, 19 bp, Homo sapiens
ctgtgctgtgcctgctaga

SEQ ID NO: 6189425 - DNA, 14 bp, Homo sapiens
ctgtgctgtggaga

SEQ ID NO: 6189426 - DNA, 21 bp, Homo sapiens
ctgtgctgtggagagaagctg

SEQ ID NO: 6189427 - DNA, 13 bp, Homo sapiens
ctgtgctgtgttt

SEQ ID NO: 6189428 - DNA, 18 bp, Homo sapiens
ctgtgctgtgtttaatca

SEQ ID NO: 6189429 - DNA, 17 bp, Homo sapiens
ctgtgctgttgtctgcc

SEQ ID NO: 6189430 - DNA, 17 bp, Homo sapiens
ctgtgcttaatttaaat

SEQ ID NO: 6189431 - DNA, 18 bp, Homo sapiens
ctgtgcttacctgtgaca

SEQ ID NO: 6189432 - DNA, 14 bp, Homo sapiens
ctgtgcttcgagcc

SEQ ID NO: 6189433 - DNA, 23 bp, Homo sapiens
ctgtgcttctcttctttattgca

SEQ ID NO: 6189434 - DNA, 15 bp, Homo sapiens
ctgtgcttgctccta

SEQ ID NO: 6189435 - DNA, 22 bp, Homo sapiens
ctgtgcttgcttagagtgccca

SEQ ID NO: 6189436 - DNA, 23 bp, Homo sapiens
ctgtgcttgcttagagtgcccag

SEQ ID NO: 6189437 - DNA, 15 bp, Homo sapiens
ctgtgcttggaggcc

SEQ ID NO: 6189438 - DNA, 16 bp, Homo sapiens
ctgtgcttggaggcct

SEQ ID NO: 6189439 - DNA, 19 bp, Homo sapiens
ctgtgcttggaggcctcag

SEQ ID NO: 6189440 - DNA, 13 bp, Homo sapiens
ctgtgcttggcca

SEQ ID NO: 6189441 - DNA, 19 bp, Homo sapiens
ctgtgcttgttgaatgtca

SEQ ID NO: 6189442 - DNA, 21 bp, Homo sapiens
ctgtgctttcatgtttaagaa

SEQ ID NO: 6189443 - DNA, 17 bp, Homo sapiens
ctgtgctttccagctca

SEQ ID NO: 6189444 - DNA, 14 bp, Homo sapiens
ctgtgctttccctg

SEQ ID NO: 6189445 - DNA, 13 bp, Homo sapiens
ctgtgctttctat

SEQ ID NO: 6189446 - DNA, 15 bp, Homo sapiens
ctgtgctttctattg

SEQ ID NO: 6189447 - DNA, 16 bp, Homo sapiens
ctgtgctttctattgt

SEQ ID NO: 6189448 - DNA, 15 bp, Homo sapiens
ctgtgctttctgcat

SEQ ID NO: 6189449 - DNA, 18 bp, Homo sapiens
ctgtgctttgactcacct

SEQ ID NO: 6189450 - DNA, 21 bp, Homo sapiens
ctgtgctttgactcacctgtt

SEQ ID NO: 6189451 - DNA, 16 bp, Homo sapiens
ctgtgctttgagattt

SEQ ID NO: 6189452 - DNA, 23 bp, Homo sapiens
ctgtggaaaaataaaggaaattc

SEQ ID NO: 6189453 - DNA, 14 bp, Homo sapiens
ctgtggaaaaatat

SEQ ID NO: 6189454 - DNA, 18 bp, Homo sapiens
ctgtggaaaaatatttaa

SEQ ID NO: 6189455 - DNA, 14 bp, Homo sapiens
ctgtggaaagctag

SEQ ID NO: 6189456 - DNA, 14 bp, Homo sapiens
ctgtggaaagtgta

SEQ ID NO: 6189457 - DNA, 15 bp, Homo sapiens
ctgtggaaagtgtaa

SEQ ID NO: 6189458 - DNA, 16 bp, Homo sapiens
ctgtggaaagtgtaaa

SEQ ID NO: 6189459 - DNA, 18 bp, Homo sapiens
ctgtggaaagtgtaaagc

SEQ ID NO: 6189460 - DNA, 23 bp, Homo sapiens
ctgtggaaagtgtaaagcattcc

SEQ ID NO: 6189461 - DNA, 13 bp, Homo sapiens
ctgtggaacacta

SEQ ID NO: 6189462 - DNA, 18 bp, Homo sapiens
ctgtggaacataaaaagg

SEQ ID NO: 6189463 - DNA, 15 bp, Homo sapiens
ctgtggaaccaaagc

SEQ ID NO: 6189464 - DNA, 22 bp, Homo sapiens
ctgtggaactaataaatacata

SEQ ID NO: 6189465 - DNA, 15 bp, Homo sapiens
ctgtggaactgccac

SEQ ID NO: 6189466 - DNA, 16 bp, Homo sapiens
ctgtggaactgccacc

SEQ ID NO: 6189467 - DNA, 18 bp, Homo sapiens
ctgtggaactgccacctt

SEQ ID NO: 6189468 - DNA, 21 bp, Homo sapiens
ctgtggaactgccaccttggg

SEQ ID NO: 6189469 - DNA, 13 bp, Homo sapiens
ctgtggaagagat

SEQ ID NO: 6189470 - DNA, 12 bp, Homo sapiens
ctgtggaagcaa

SEQ ID NO: 6189471 - DNA, 14 bp, Homo sapiens
ctgtggaagcaagg

SEQ ID NO: 6189472 - DNA, 13 bp, Homo sapiens
ctgtggaagcatg

SEQ ID NO: 6189473 - DNA, 17 bp, Homo sapiens
ctgtggaagcatggctg

SEQ ID NO: 6189474 - DNA, 22 bp, Homo sapiens
ctgtggaagcatggctgtctgc

SEQ ID NO: 6189475 - DNA, 16 bp, Homo sapiens
ctgtggaagggactag

SEQ ID NO: 6189476 - DNA, 23 bp, Homo sapiens
ctgtggaagggccaatggagaaa

SEQ ID NO: 6189477 - DNA, 18 bp, Homo sapiens
ctgtggaagtccctcaga

SEQ ID NO: 6189478 - DNA, 11 bp, Homo sapiens
ctgtggaatat

SEQ ID NO: 6189479 - DNA, 13 bp, Homo sapiens
ctgtggaatgaag

SEQ ID NO: 6189480 - DNA, 22 bp, Homo sapiens
ctgtggacaccactgagctctg

SEQ ID NO: 6189481 - DNA, 23 bp, Homo sapiens
ctgtggaccatggagtggcagcc

SEQ ID NO: 6189482 - DNA, 23 bp, Homo sapiens
ctgtggaccctcgctctctgtct

SEQ ID NO: 6189483 - DNA, 21 bp, Homo sapiens
ctgtggaccgtggacaggccc

SEQ ID NO: 6189484 - DNA, 22 bp, Homo sapiens
ctgtggactgaccttgtaaaag

SEQ ID NO: 6189485 - DNA, 16 bp, Homo sapiens
ctgtggactgtcctga

SEQ ID NO: 6189486 - DNA, 19 bp, Homo sapiens
ctgtggactgtcctgagga

SEQ ID NO: 6189487 - DNA, 19 bp, Homo sapiens
ctgtggagacaatgtctgc

SEQ ID NO: 6189488 - DNA, 16 bp, Homo sapiens
ctgtggagacactgag

SEQ ID NO: 6189489 - DNA, 13 bp, Homo sapiens
ctgtggagacagc

SEQ ID NO: 6189490 - DNA, 14 bp, Homo sapiens
ctgtggagacagcc

SEQ ID NO: 6189491 - DNA, 19 bp, Homo sapiens
ctgtggagactgctcctga

SEQ ID NO: 6189492 - DNA, 17 bp, Homo sapiens
ctgtggagagtgagaat

SEQ ID NO: 6189493 - DNA, 22 bp, Homo sapiens
ctgtggagagtgagaataattg

SEQ ID NO: 6189494 - DNA, 23 bp, Homo sapiens
ctgtggagcaaaaggcagctcac

SEQ ID NO: 6189495 - DNA, 15 bp, Homo sapiens
ctgtggagcccgcac

SEQ ID NO: 6189496 - DNA, 23 bp, Homo sapiens
ctgtggagcgtccttgtccccgc

SEQ ID NO: 6189497 - DNA, 15 bp, Homo sapiens
ctgtggagctcagcc

SEQ ID NO: 6189498 - DNA, 17 bp, Homo sapiens
ctgtggagctccactgc

SEQ ID NO: 6189499 - DNA, 17 bp, Homo sapiens
ctgtggagctgccacag

SEQ ID NO: 6189500 - DNA, 19 bp, Homo sapiens
ctgtggagctgccacagag

SEQ ID NO: 6189501 - DNA, 21 bp, Homo sapiens
ctgtggaggaaggattgtaaa

SEQ ID NO: 6189502 - DNA, 19 bp, Homo sapiens
ctgtggaggccgagtctgt

SEQ ID NO: 6189503 - DNA, 20 bp, Homo sapiens
ctgtggaggccgagtctgtc

SEQ ID NO: 6189504 - DNA, 23 bp, Homo sapiens
ctgtggaggccgagtctgtcctg

SEQ ID NO: 6189505 - DNA, 12 bp, Homo sapiens
ctgtggaggcct

SEQ ID NO: 6189506 - DNA, 13 bp, Homo sapiens
ctgtggaggcctg

SEQ ID NO: 6189507 - DNA, 17 bp, Homo sapiens
ctgtggaggcctgatgc

SEQ ID NO: 6189508 - DNA, 22 bp, Homo sapiens
ctgtggaggcctgatgctgccc

SEQ ID NO: 6189509 - DNA, 20 bp, Homo sapiens
ctgtggagggagggcagctg

SEQ ID NO: 6189510 - DNA, 21 bp, Homo sapiens
ctgtggagggagggcagctgg

SEQ ID NO: 6189511 - DNA, 22 bp, Homo sapiens
ctgtggagggagggcagctggc

SEQ ID NO: 6189512 - DNA, 13 bp, Homo sapiens
ctgtggaggggct

SEQ ID NO: 6189513 - DNA, 21 bp, Homo sapiens
ctgtggaggggcttgggcctg

SEQ ID NO: 6189514 - DNA, 22 bp, Homo sapiens
ctgtggaggtacactcttatag

SEQ ID NO: 6189515 - DNA, 16 bp, Homo sapiens
ctgtggaggtgacctg

SEQ ID NO: 6189516 - DNA, 17 bp, Homo sapiens
ctgtggagttcctgctc

SEQ ID NO: 6189517 - DNA, 19 bp, Homo sapiens
ctgtggagttcctgctccg

SEQ ID NO: 6189518 - DNA, 11 bp, Homo sapiens
ctgtggataaa

SEQ ID NO: 6189519 - DNA, 17 bp, Homo sapiens
ctgtggataaaacatta

SEQ ID NO: 6189520 - DNA, 22 bp, Homo sapiens
ctgtggatacagtgcccaccgc

SEQ ID NO: 6189521 - DNA, 15 bp, Homo sapiens
ctgtggatcagagat

SEQ ID NO: 6189522 - DNA, 17 bp, Homo sapiens
ctgtggatgagccctca

SEQ ID NO: 6189523 - DNA, 20 bp, Homo sapiens
ctgtggatgagccctcagaa

SEQ ID NO: 6189524 - DNA, 17 bp, Homo sapiens
ctgtggatgataaaaca

SEQ ID NO: 6189525 - DNA, 14 bp, Homo sapiens
ctgtggatgctgct

SEQ ID NO: 6189526 - DNA, 21 bp, Homo sapiens
ctgtggatgctgctgcccctg

SEQ ID NO: 6189527 - DNA, 22 bp, Homo sapiens
ctgtggatgctgctgcccctgc

SEQ ID NO: 6189528 - DNA, 23 bp, Homo sapiens
ctgtggatgctgctgcccctgca

SEQ ID NO: 6189529 - DNA, 20 bp, Homo sapiens
ctgtggattcagcttctgtt

SEQ ID NO: 6189530 - DNA, 17 bp, Homo sapiens
ctgtggattccagcatt

SEQ ID NO: 6189531 - DNA, 12 bp, Homo sapiens
ctgtggcacaga

SEQ ID NO: 6189532 - DNA, 21 bp, Homo sapiens
ctgtggcacagacccccgtcc

SEQ ID NO: 6189533 - DNA, 14 bp, Homo sapiens
ctgtggcacagccc

SEQ ID NO: 6189534 - DNA, 17 bp, Homo sapiens
ctgtggcacagccctga

SEQ ID NO: 6189535 - DNA, 19 bp, Homo sapiens
ctgtggcacagccctgagt

SEQ ID NO: 6189536 - DNA, 15 bp, Homo sapiens
ctgtggcacttgcct

SEQ ID NO: 6189537 - DNA, 16 bp, Homo sapiens
ctgtggcacttgcctg

SEQ ID NO: 6189538 - DNA, 19 bp, Homo sapiens
ctgtggcagaaaagaggag

SEQ ID NO: 6189539 - DNA, 21 bp, Homo sapiens
ctgtggcagaaaagaggagac

SEQ ID NO: 6189540 - DNA, 20 bp, Homo sapiens
ctgtggcagaccgggggcca

SEQ ID NO: 6189541 - DNA, 15 bp, Homo sapiens
ctgtggcagcaggag

SEQ ID NO: 6189542 - DNA, 20 bp, Homo sapiens
ctgtggcagcaggagggact

SEQ ID NO: 6189543 - DNA, 22 bp, Homo sapiens
ctgtggcagccgtcccaggcca

SEQ ID NO: 6189544 - DNA, 15 bp, Homo sapiens
ctgtggcagctgccc

SEQ ID NO: 6189545 - DNA, 12 bp, Homo sapiens
ctgtggcaggag

SEQ ID NO: 6189546 - DNA, 22 bp, Homo sapiens
ctgtggcaggaggagctgcctc

SEQ ID NO: 6189547 - DNA, 16 bp, Homo sapiens
ctgtggcaggaggctt

SEQ ID NO: 6189548 - DNA, 17 bp, Homo sapiens
ctgtggcaggcagcgcc

SEQ ID NO: 6189549 - DNA, 16 bp, Homo sapiens
gaaatatctgtgaaat

SEQ ID NO: 6189550 - DNA, 20 bp, Homo sapiens
gaaatatctgtgaaatatca

SEQ ID NO: 6189551 - DNA, 20 bp, Homo sapiens
gaaatatctgtgaaggactt

SEQ ID NO: 6189552 - DNA, 19 bp, Homo sapiens
gaaatatcttcacttgtca

SEQ ID NO: 6189553 - DNA, 13 bp, Homo sapiens
gaaatatctttct

SEQ ID NO: 6189554 - DNA, 14 bp, Homo sapiens
gaaatatctttctc

SEQ ID NO: 6189555 - DNA, 14 bp, Homo sapiens
gaaatatgaaactc

SEQ ID NO: 6189556 - DNA, 17 bp, Homo sapiens
gaaatatgaaattccag

SEQ ID NO: 6189557 - DNA, 19 bp, Homo sapiens
gaaatatgcaacctgtgca

SEQ ID NO: 6189558 - DNA, 17 bp, Homo sapiens
gaaatatgcacaatagc

SEQ ID NO: 6189559 - DNA, 13 bp, Homo sapiens
gaaatatgcatct

SEQ ID NO: 6189560 - DNA, 18 bp, Homo sapiens
gaaatatgctcttttgtt

SEQ ID NO: 6189561 - DNA, 17 bp, Homo sapiens
gaaatatgtaatgcttc

SEQ ID NO: 6189562 - DNA, 22 bp, Homo sapiens
gaaatatgtagtattaaaagtt

SEQ ID NO: 6189563 - DNA, 16 bp, Homo sapiens
gaaatatgtattctgt

SEQ ID NO: 6189564 - DNA, 21 bp, Homo sapiens
gaaatatgtgagattttttat

SEQ ID NO: 6189565 - DNA, 22 bp, Homo sapiens
gaaatattaagcatgttttgtt

SEQ ID NO: 6189566 - DNA, 18 bp, Homo sapiens
gaaatattaatatgtact

SEQ ID NO: 6189567 - DNA, 20 bp, Homo sapiens
gaaatattaatatgtacttt

SEQ ID NO: 6189568 - DNA, 23 bp, Homo sapiens
gaaatattaatatgtacttttcc

SEQ ID NO: 6189569 - DNA, 23 bp, Homo sapiens
gaaatattataaatccaaagtaa

SEQ ID NO: 6189570 - DNA, 15 bp, Homo sapiens
gaaatattatgcaaa

SEQ ID NO: 6189571 - DNA, 13 bp, Homo sapiens
gaaatattatgtt

SEQ ID NO: 6189572 - DNA, 15 bp, Homo sapiens
gaaatattccctaga

SEQ ID NO: 6189573 - DNA, 19 bp, Homo sapiens
gaaatattggttgaaagtt

SEQ ID NO: 6189574 - DNA, 18 bp, Homo sapiens
gaaatattgtaaatgcta

SEQ ID NO: 6189575 - DNA, 22 bp, Homo sapiens
gaaatattgtaaatgctattat

SEQ ID NO: 6189576 - DNA, 13 bp, Homo sapiens
gaaatatttaagt

SEQ ID NO: 6189577 - DNA, 18 bp, Homo sapiens
gaaatatttgcttattta

SEQ ID NO: 6189578 - DNA, 22 bp, Homo sapiens
gaaatatttggatgttaaatta

SEQ ID NO: 6189579 - DNA, 20 bp, Homo sapiens
gaaatattttaaaatcagct

SEQ ID NO: 6189580 - DNA, 13 bp, Homo sapiens
gaaatattttaat

SEQ ID NO: 6189581 - DNA, 15 bp, Homo sapiens
gaaatattttgaata

SEQ ID NO: 6189582 - DNA, 19 bp, Homo sapiens
gaaatattttgataataaa

SEQ ID NO: 6189583 - DNA, 22 bp, Homo sapiens
gaaatattttgataataaattg

SEQ ID NO: 6189584 - DNA, 23 bp, Homo sapiens
gaaatattttgataataaattga

SEQ ID NO: 6189585 - DNA, 17 bp, Homo sapiens
gaaatcaaatatgcaaa

SEQ ID NO: 6189586 - DNA, 20 bp, Homo sapiens
gaaatcaaatatgcaaagca

SEQ ID NO: 6189587 - DNA, 16 bp, Homo sapiens
gaaatcaaccctctcc

SEQ ID NO: 6189588 - DNA, 23 bp, Homo sapiens
gaaatcaagtcatctatagttga

SEQ ID NO: 6189589 - DNA, 15 bp, Homo sapiens
gaaatcaatttaaag

SEQ ID NO: 6189590 - DNA, 21 bp, Homo sapiens
gaaatcacaatgagaaaaata

SEQ ID NO: 6189591 - DNA, 21 bp, Homo sapiens
gaaatcacaattttcctgtgg

SEQ ID NO: 6189592 - DNA, 16 bp, Homo sapiens
gaaatcacataacctt

SEQ ID NO: 6189593 - DNA, 17 bp, Homo sapiens
gaaatcaccgaaaacgt

SEQ ID NO: 6189594 - DNA, 12 bp, Homo sapiens
gaaatcactgtg

SEQ ID NO: 6189595 - DNA, 13 bp, Homo sapiens
gaaatcacttaaa

SEQ ID NO: 6189596 - DNA, 20 bp, Homo sapiens
gaaatcactttacctgcagg

SEQ ID NO: 6189597 - DNA, 14 bp, Homo sapiens
gaaatcagagctgg

SEQ ID NO: 6189598 - DNA, 23 bp, Homo sapiens
gaaatcagagctggcagcctcca

SEQ ID NO: 6189599 - DNA, 18 bp, Homo sapiens
gaaatcagcatgacaaaa

SEQ ID NO: 6189600 - DNA, 15 bp, Homo sapiens
gaaatcagccaagtt

SEQ ID NO: 6189601 - DNA, 16 bp, Homo sapiens
gaaatcagcccccagc

SEQ ID NO: 6189602 - DNA, 17 bp, Homo sapiens
gaaatcagcccccagcc

SEQ ID NO: 6189603 - DNA, 19 bp, Homo sapiens
gaaatcagtaaacactgtg

SEQ ID NO: 6189604 - DNA, 18 bp, Homo sapiens
gaaatcagtgaggtgaga

SEQ ID NO: 6189605 - DNA, 17 bp, Homo sapiens
gaaatcagtggtgttac

SEQ ID NO: 6189606 - DNA, 23 bp, Homo sapiens
gaaatcagtggtgttacattttc

SEQ ID NO: 6189607 - DNA, 19 bp, Homo sapiens
gaaatcagttgtgaataca

SEQ ID NO: 6189608 - DNA, 12 bp, Homo sapiens
gaaatcatatta

SEQ ID NO: 6189609 - DNA, 16 bp, Homo sapiens
gaaatcatatttggaa

SEQ ID NO: 6189610 - DNA, 18 bp, Homo sapiens
gaaatcatcgaaaattca

SEQ ID NO: 6189611 - DNA, 15 bp, Homo sapiens
gaaatcatgtgcata

SEQ ID NO: 6189612 - DNA, 20 bp, Homo sapiens
gaaatcattattgagtcacc

SEQ ID NO: 6189613 - DNA, 22 bp, Homo sapiens
gaaatcattattgagtcaccat

SEQ ID NO: 6189614 - DNA, 15 bp, Homo sapiens
gaaatcattgtagaa

SEQ ID NO: 6189615 - DNA, 20 bp, Homo sapiens
gaaatccagtttcccaccac

SEQ ID NO: 6189616 - DNA, 20 bp, Homo sapiens
gaaatccataaactaagaga

SEQ ID NO: 6189617 - DNA, 17 bp, Homo sapiens
gaaatccatccagaggc

SEQ ID NO: 6189618 - DNA, 16 bp, Homo sapiens
gaaatccattgtttaa

SEQ ID NO: 6189619 - DNA, 22 bp, Homo sapiens
gaaatccccccttcagaacaga

SEQ ID NO: 6189620 - DNA, 18 bp, Homo sapiens
gaaatccctgctcactgc

SEQ ID NO: 6189621 - DNA, 18 bp, Homo sapiens
gaaatccctgtttaatat

SEQ ID NO: 6189622 - DNA, 22 bp, Homo sapiens
gaaatccctgtttaatatttaa

SEQ ID NO: 6189623 - DNA, 14 bp, Homo sapiens
gaaatccctttctg

SEQ ID NO: 6189624 - DNA, 19 bp, Homo sapiens
gaaatccctttctgctagt

SEQ ID NO: 6189625 - DNA, 21 bp, Homo sapiens
gaaatcctagtttcctctcct

SEQ ID NO: 6189626 - DNA, 14 bp, Homo sapiens
gaaatcctgccctg

SEQ ID NO: 6189627 - DNA, 16 bp, Homo sapiens
gaaatcctgccctgga

SEQ ID NO: 6189628 - DNA, 14 bp, Homo sapiens
gaaatcctgttact

SEQ ID NO: 6189629 - DNA, 20 bp, Homo sapiens
gaaatctactgaattggctt

SEQ ID NO: 6189630 - DNA, 21 bp, Homo sapiens
gaaatctagttatttacagga

SEQ ID NO: 6189631 - DNA, 21 bp, Homo sapiens
gaaatctataaaactttctgt

SEQ ID NO: 6189632 - DNA, 19 bp, Homo sapiens
gaaatctatagaaagtgtt

SEQ ID NO: 6189633 - DNA, 12 bp, Homo sapiens
gaaatctcaccc

SEQ ID NO: 6189634 - DNA, 18 bp, Homo sapiens
gaaatctcccatgtgcat

SEQ ID NO: 6189635 - DNA, 19 bp, Homo sapiens
gaaatctcctaacaaaaga

SEQ ID NO: 6189636 - DNA, 15 bp, Homo sapiens
gaaatctctttgccc

SEQ ID NO: 6189637 - DNA, 13 bp, Homo sapiens
gaaatctgaaaaa

SEQ ID NO: 6189638 - DNA, 20 bp, Homo sapiens
gaaatctgaagccttttcct

SEQ ID NO: 6189639 - DNA, 17 bp, Homo sapiens
gaaatctgctagaaagt

SEQ ID NO: 6189640 - DNA, 13 bp, Homo sapiens
gaaatctggccca

SEQ ID NO: 6189641 - DNA, 19 bp, Homo sapiens
gaaatctgggatgtactgt

SEQ ID NO: 6189642 - DNA, 17 bp, Homo sapiens
gaaatctgtaaagccag

SEQ ID NO: 6189643 - DNA, 20 bp, Homo sapiens
gaaatctgtcaagagtagtt

SEQ ID NO: 6189644 - DNA, 17 bp, Homo sapiens
gaaatctgtgcaataaa

SEQ ID NO: 6189645 - DNA, 13 bp, Homo sapiens
gaaatctgtttgt

SEQ ID NO: 6189646 - DNA, 18 bp, Homo sapiens
gaaatcttggtgtaactt

SEQ ID NO: 6189647 - DNA, 15 bp, Homo sapiens
gaaatctttaaaaaa

SEQ ID NO: 6189648 - DNA, 23 bp, Homo sapiens
gaaatctttcaacttatttctga

SEQ ID NO: 6189649 - DNA, 15 bp, Homo sapiens
gaaatctttctggaa

SEQ ID NO: 6189650 - DNA, 19 bp, Homo sapiens
gaaatcttttacatttttc

SEQ ID NO: 6189651 - DNA, 11 bp, Homo sapiens
gaaatgaaaag

SEQ ID NO: 6189652 - DNA, 17 bp, Homo sapiens
gaaatgaaaatggctga

SEQ ID NO: 6189653 - DNA, 18 bp, Homo sapiens
gaaatgaaagcagggact

SEQ ID NO: 6189654 - DNA, 13 bp, Homo sapiens
gaaatgaaaggga

SEQ ID NO: 6189655 - DNA, 21 bp, Homo sapiens
gaaatgaaatattgtttccaa

SEQ ID NO: 6189656 - DNA, 13 bp, Homo sapiens
gaaatgaaatttt

SEQ ID NO: 6189657 - DNA, 16 bp, Homo sapiens
gaaatgaaattttacc

SEQ ID NO: 6189658 - DNA, 15 bp, Homo sapiens
gaaatgaacacaaat

SEQ ID NO: 6189659 - DNA, 13 bp, Homo sapiens
gaaatgaacattc

SEQ ID NO: 6189660 - DNA, 12 bp, Homo sapiens
gaaatgaacttt

SEQ ID NO: 6189661 - DNA, 19 bp, Homo sapiens
gaaatgaagcagaggaagg

SEQ ID NO: 6189662 - DNA, 13 bp, Homo sapiens
gaaatgaataatt

SEQ ID NO: 6189663 - DNA, 19 bp, Homo sapiens
gaaatgaataatttcccaa

SEQ ID NO: 6189664 - DNA, 14 bp, Homo sapiens
gaaatgaatttctc

SEQ ID NO: 6189665 - DNA, 19 bp, Homo sapiens
gaaatgacagtcaaaagat

SEQ ID NO: 6189666 - DNA, 14 bp, Homo sapiens
gaaatgacatttca

SEQ ID NO: 6189667 - DNA, 14 bp, Homo sapiens
gaaatgaccaatat

SEQ ID NO: 6189668 - DNA, 24 bp, Homo sapiens
gaaatgaccttcattctgagacca

SEQ ID NO: 6189669 - DNA, 13 bp, Homo sapiens
gaaatgactaatt

SEQ ID NO: 6189670 - DNA, 20 bp, Homo sapiens
gaaatgacttctccaggcag

SEQ ID NO: 6189671 - DNA, 11 bp, Homo sapiens
gaaatgagaaa

SEQ ID NO: 6189672 - DNA, 19 bp, Homo sapiens
gaaatgagaaggcagccac

SEQ ID NO: 6189673 - DNA, 16 bp, Homo sapiens
gaaatgagatcaggct

SEQ ID NO: 6189674 - DNA, 21 bp, Homo sapiens
gaaatgagatcccagagttat

SEQ ID NO: 6189675 - DNA, 11 bp, Homo sapiens
gaaatgagctc

SEQ ID NO: 6189676 - DNA, 17 bp, Homo sapiens
gaaatgaggcatgagtt

SEQ ID NO: 6189677 - DNA, 22 bp, Homo sapiens
gaaatgaggccatggactctgt

SEQ ID NO: 6189678 - DNA, 16 bp, Homo sapiens
gaaatgaggtctgttt

SEQ ID NO: 6189679 - DNA, 16 bp, Homo sapiens
gaaatgagtggccagc

SEQ ID NO: 6189680 - DNA, 17 bp, Homo sapiens
gaaatgataaagacttt

SEQ ID NO: 6189681 - DNA, 14 bp, Homo sapiens
gaaatgataaagat

SEQ ID NO: 6189682 - DNA, 14 bp, Homo sapiens
gaaatgatcagttt

SEQ ID NO: 6189683 - DNA, 22 bp, Homo sapiens
gaaatgattcaaattgctgctt

SEQ ID NO: 6189684 - DNA, 18 bp, Homo sapiens
gaaatgattcatctttca

SEQ ID NO: 6189685 - DNA, 20 bp, Homo sapiens
gaaatgattcatctttcaga

SEQ ID NO: 6189686 - DNA, 12 bp, Homo sapiens
gaaatgcaaggg

SEQ ID NO: 6189687 - DNA, 13 bp, Homo sapiens
gaaatgcacaatg

SEQ ID NO: 6189688 - DNA, 11 bp, Homo sapiens
gaaatgcagaa

SEQ ID NO: 6189689 - DNA, 23 bp, Homo sapiens
gaaatgcatccattcctcaggga

SEQ ID NO: 6189690 - DNA, 12 bp, Homo sapiens
gaaatgcattta

SEQ ID NO: 6189691 - DNA, 20 bp, Homo sapiens
gaaatgccaaaaatgtgcct

SEQ ID NO: 6189692 - DNA, 22 bp, Homo sapiens
gaaatgccaagactctatgctc

SEQ ID NO: 6189693 - DNA, 22 bp, Homo sapiens
gaaatgccactgggacagctgg

SEQ ID NO: 6189694 - DNA, 15 bp, Homo sapiens
gaaatgccagaaaca

SEQ ID NO: 6189695 - DNA, 15 bp, Homo sapiens
gaaatgccagatgaa

SEQ ID NO: 6189696 - DNA, 13 bp, Homo sapiens
gaaatgccccagt

SEQ ID NO: 6189697 - DNA, 18 bp, Homo sapiens
gaaatgcccccattctcc

SEQ ID NO: 6189698 - DNA, 17 bp, Homo sapiens
gaaatgcctaagaagat

SEQ ID NO: 6189699 - DNA, 17 bp, Homo sapiens
gaaatgccttactttgt

SEQ ID NO: 6189700 - DNA, 20 bp, Homo sapiens
gaaatgccttactttgtatg

SEQ ID NO: 6189701 - DNA, 17 bp, Homo sapiens
gaaatgcggtctggtct

SEQ ID NO: 6189702 - DNA, 15 bp, Homo sapiens
gaaatgctaaacttg

SEQ ID NO: 6189703 - DNA, 22 bp, Homo sapiens
gaaatgctaaacttggctgtat

SEQ ID NO: 6189704 - DNA, 15 bp, Homo sapiens
gaaatgctaacctgt

SEQ ID NO: 6189705 - DNA, 18 bp, Homo sapiens
gaaatgctcttttgcaca

SEQ ID NO: 6189706 - DNA, 14 bp, Homo sapiens
gaaatgctgaaaat

SEQ ID NO: 6189707 - DNA, 22 bp, Homo sapiens
gaaatgctgacccatgggcagg

SEQ ID NO: 6189708 - DNA, 18 bp, Homo sapiens
gaaatgctgatggataac

SEQ ID NO: 6189709 - DNA, 14 bp, Homo sapiens
gaaatgctgcagga

SEQ ID NO: 6189710 - DNA, 13 bp, Homo sapiens
gaaatgctgcctg

SEQ ID NO: 6189711 - DNA, 14 bp, Homo sapiens
gaaatgctgcctgc

SEQ ID NO: 6189712 - DNA, 17 bp, Homo sapiens
gaaatgctgctggccaa

SEQ ID NO: 6189713 - DNA, 19 bp, Homo sapiens
gaaatgctgggctgacggt

SEQ ID NO: 6189714 - DNA, 14 bp, Homo sapiens
gaaatgctgttggt

SEQ ID NO: 6189715 - DNA, 18 bp, Homo sapiens
gaaatgctgttggtgaga

SEQ ID NO: 6189716 - DNA, 21 bp, Homo sapiens
gaaatgctttgaggctttcta

SEQ ID NO: 6189717 - DNA, 16 bp, Homo sapiens
gaaatgcttttatatt

SEQ ID NO: 6189718 - DNA, 16 bp, Homo sapiens
gaaatggaaacacaca

SEQ ID NO: 6189719 - DNA, 19 bp, Homo sapiens
gaaatggaaacacacacag

SEQ ID NO: 6189720 - DNA, 15 bp, Homo sapiens
gaaatggaaagcaga

SEQ ID NO: 6189721 - DNA, 20 bp, Homo sapiens
gaaatggaatcagcttttaa

SEQ ID NO: 6189722 - DNA, 19 bp, Homo sapiens
gaaatggaatgtgcccctg

SEQ ID NO: 6189723 - DNA, 18 bp, Homo sapiens
gaaatggagaagctctgt

SEQ ID NO: 6189724 - DNA, 13 bp, Homo sapiens
gaaatggagggtg

SEQ ID NO: 6189725 - DNA, 15 bp, Homo sapiens
gaaatggagggtggg

SEQ ID NO: 6189726 - DNA, 22 bp, Homo sapiens
gaaatggccattgagctgtttc

SEQ ID NO: 6189727 - DNA, 20 bp, Homo sapiens
gaaatggcccatttaatgat

SEQ ID NO: 6189728 - DNA, 21 bp, Homo sapiens
ctgtggcaggcagcgccaagc

SEQ ID NO: 6189729 - DNA, 18 bp, Homo sapiens
ctgtggcaggccagctgt

SEQ ID NO: 6189730 - DNA, 19 bp, Homo sapiens
ctgtggcaggccagctgtg

SEQ ID NO: 6189731 - DNA, 20 bp, Homo sapiens
ctgtggcagtaaagagaaac

SEQ ID NO: 6189732 - DNA, 15 bp, Homo sapiens
ctgtggcataaattg

SEQ ID NO: 6189733 - DNA, 16 bp, Homo sapiens
ctgtggcattgaaatg

SEQ ID NO: 6189734 - DNA, 22 bp, Homo sapiens
ctgtggcattgttgatgctcac

SEQ ID NO: 6189735 - DNA, 13 bp, Homo sapiens
ctgtggcatttcc

SEQ ID NO: 6189736 - DNA, 16 bp, Homo sapiens
ctgtggccaagttctt

SEQ ID NO: 6189737 - DNA, 13 bp, Homo sapiens
ctgtggccagagc

SEQ ID NO: 6189738 - DNA, 15 bp, Homo sapiens
ctgtggccagagcac

SEQ ID NO: 6189739 - DNA, 18 bp, Homo sapiens
ctgtggccagagcacctc

SEQ ID NO: 6189740 - DNA, 20 bp, Homo sapiens
ctgtggccagagcacctcag

SEQ ID NO: 6189741 - DNA, 15 bp, Homo sapiens
ctgtggccagagctg

SEQ ID NO: 6189742 - DNA, 23 bp, Homo sapiens
ctgtggccagagctggaaggcag

SEQ ID NO: 6189743 - DNA, 12 bp, Homo sapiens
ctgtggccagcc

SEQ ID NO: 6189744 - DNA, 14 bp, Homo sapiens
ctgtggccagcctg

SEQ ID NO: 6189745 - DNA, 16 bp, Homo sapiens
ctgtggccagcctggc

SEQ ID NO: 6189746 - DNA, 18 bp, Homo sapiens
ctgtggccagcctggcat

SEQ ID NO: 6189747 - DNA, 23 bp, Homo sapiens
ctgtggccagctgcatctgtctg

SEQ ID NO: 6189748 - DNA, 12 bp, Homo sapiens
ctgtggccagga

SEQ ID NO: 6189749 - DNA, 14 bp, Homo sapiens
ctgtggccaggagc

SEQ ID NO: 6189750 - DNA, 15 bp, Homo sapiens
ctgtggccaggagcc

SEQ ID NO: 6189751 - DNA, 18 bp, Homo sapiens
ctgtggccaggagccctg

SEQ ID NO: 6189752 - DNA, 15 bp, Homo sapiens
ctgtggccaggaggt

SEQ ID NO: 6189753 - DNA, 12 bp, Homo sapiens
ctgtggccaggc

SEQ ID NO: 6189754 - DNA, 15 bp, Homo sapiens
ctgtggccagttgac

SEQ ID NO: 6189755 - DNA, 20 bp, Homo sapiens
ctgtggccatgaccctgcct

SEQ ID NO: 6189756 - DNA, 15 bp, Homo sapiens
ctgtggcccaagaga

SEQ ID NO: 6189757 - DNA, 15 bp, Homo sapiens
ctgtggccccaagag

SEQ ID NO: 6189758 - DNA, 17 bp, Homo sapiens
ctgtggccccaagaggg

SEQ ID NO: 6189759 - DNA, 16 bp, Homo sapiens
ctgtggccccaccctg

SEQ ID NO: 6189760 - DNA, 20 bp, Homo sapiens
ctgtggccccaccctgggcc

SEQ ID NO: 6189761 - DNA, 14 bp, Homo sapiens
ctgtggccccctgt

SEQ ID NO: 6189762 - DNA, 16 bp, Homo sapiens
ctgtggcccctcccct

SEQ ID NO: 6189763 - DNA, 19 bp, Homo sapiens
ctgtggcccctcccctgca

SEQ ID NO: 6189764 - DNA, 23 bp, Homo sapiens
ctgtggcccctccttctcccctc

SEQ ID NO: 6189765 - DNA, 14 bp, Homo sapiens
ctgtggccctctct

SEQ ID NO: 6189766 - DNA, 15 bp, Homo sapiens
ctgtggccctctctt

SEQ ID NO: 6189767 - DNA, 12 bp, Homo sapiens
ctgtggccctgc

SEQ ID NO: 6189768 - DNA, 14 bp, Homo sapiens
ctgtggccctggag

SEQ ID NO: 6189769 - DNA, 14 bp, Homo sapiens
ctgtggccctggca

SEQ ID NO: 6189770 - DNA, 13 bp, Homo sapiens
ctgtggccctgtc

SEQ ID NO: 6189771 - DNA, 14 bp, Homo sapiens
ctgtggccctgtcc

SEQ ID NO: 6189772 - DNA, 20 bp, Homo sapiens
ctgtggcccttctgtccacc

SEQ ID NO: 6189773 - DNA, 20 bp, Homo sapiens
ctgtggccgactctgcactc

SEQ ID NO: 6189774 - DNA, 21 bp, Homo sapiens
ctgtggccgactctgcactct

SEQ ID NO: 6189775 - DNA, 13 bp, Homo sapiens
ctgtggccgccat

SEQ ID NO: 6189776 - DNA, 20 bp, Homo sapiens
ctgtggccgccatctgcgca

SEQ ID NO: 6189777 - DNA, 18 bp, Homo sapiens
ctgtggccggtgccagct

SEQ ID NO: 6189778 - DNA, 22 bp, Homo sapiens
ctgtggccggtgccagctgccc

SEQ ID NO: 6189779 - DNA, 23 bp, Homo sapiens
ctgtggccggtgccagctgccct

SEQ ID NO: 6189780 - DNA, 18 bp, Homo sapiens
ctgtggccgtctcctccc

SEQ ID NO: 6189781 - DNA, 20 bp, Homo sapiens
ctgtggccgttatctggaag

SEQ ID NO: 6189782 - DNA, 12 bp, Homo sapiens
ctgtggcctcac

SEQ ID NO: 6189783 - DNA, 16 bp, Homo sapiens
ctgtggcctcacttcc

SEQ ID NO: 6189784 - DNA, 19 bp, Homo sapiens
ctgtggcctcacttccctg

SEQ ID NO: 6189785 - DNA, 21 bp, Homo sapiens
ctgtggcctcacttccctggg

SEQ ID NO: 6189786 - DNA, 14 bp, Homo sapiens
ctgtggcctcagga

SEQ ID NO: 6189787 - DNA, 19 bp, Homo sapiens
ctgtggcctccctgctcta

SEQ ID NO: 6189788 - DNA, 19 bp, Homo sapiens
ctgtggcctgaagaagcac

SEQ ID NO: 6189789 - DNA, 16 bp, Homo sapiens
ctgtggcctgcaggag

SEQ ID NO: 6189790 - DNA, 14 bp, Homo sapiens
ctgtggcctgccag

SEQ ID NO: 6189791 - DNA, 15 bp, Homo sapiens
ctgtggcctgctcat

SEQ ID NO: 6189792 - DNA, 11 bp, Homo sapiens
ctgtggcctgg

SEQ ID NO: 6189793 - DNA, 13 bp, Homo sapiens
ctgtggcctgggg

SEQ ID NO: 6189794 - DNA, 14 bp, Homo sapiens
ctgtggcctggggc

SEQ ID NO: 6189795 - DNA, 16 bp, Homo sapiens
ctgtggcctgtgtcca

SEQ ID NO: 6189796 - DNA, 22 bp, Homo sapiens
ctgtggcctgtgtccagcagct

SEQ ID NO: 6189797 - DNA, 17 bp, Homo sapiens
ctgtggcctgtgtccca

SEQ ID NO: 6189798 - DNA, 23 bp, Homo sapiens
ctgtggcctgtgtcccatgaccc

SEQ ID NO: 6189799 - DNA, 16 bp, Homo sapiens
ctgtggccttctcagc

SEQ ID NO: 6189800 - DNA, 18 bp, Homo sapiens
ctgtggccttctcagcct

SEQ ID NO: 6189801 - DNA, 17 bp, Homo sapiens
ctgtggccttgcccgcc

SEQ ID NO: 6189802 - DNA, 16 bp, Homo sapiens
ctgtggccttggccct

SEQ ID NO: 6189803 - DNA, 19 bp, Homo sapiens
ctgtggccttggccctgac

SEQ ID NO: 6189804 - DNA, 18 bp, Homo sapiens
ctgtggcgccgcgtggac

SEQ ID NO: 6189805 - DNA, 19 bp, Homo sapiens
ctgtggcgccgtctccagg

SEQ ID NO: 6189806 - DNA, 24 bp, Homo sapiens
ctgtggcgctgcagcagggcagga

SEQ ID NO: 6189807 - DNA, 17 bp, Homo sapiens
ctgtggcggtgcagtgg

SEQ ID NO: 6189808 - DNA, 14 bp, Homo sapiens
ctgtggcggtgcct

SEQ ID NO: 6189809 - DNA, 18 bp, Homo sapiens
ctgtggcgttctgctgcc

SEQ ID NO: 6189810 - DNA, 20 bp, Homo sapiens
ctgtggctaaacagatgtaa

SEQ ID NO: 6189811 - DNA, 13 bp, Homo sapiens
ctgtggctccctc

SEQ ID NO: 6189812 - DNA, 16 bp, Homo sapiens
ctgtggctccctcctc

SEQ ID NO: 6189813 - DNA, 18 bp, Homo sapiens
ctgtggctccctcctcct

SEQ ID NO: 6189814 - DNA, 14 bp, Homo sapiens
ctgtggctccctct

SEQ ID NO: 6189815 - DNA, 23 bp, Homo sapiens
ctgtggctccctctctcctggac

SEQ ID NO: 6189816 - DNA, 11 bp, Homo sapiens
ctgtggctcct

SEQ ID NO: 6189817 - DNA, 14 bp, Homo sapiens
ctgtggctctgcat

SEQ ID NO: 6189818 - DNA, 13 bp, Homo sapiens
ctgtggctctggg

SEQ ID NO: 6189819 - DNA, 15 bp, Homo sapiens
ctgtggctctgggtg

SEQ ID NO: 6189820 - DNA, 20 bp, Homo sapiens
ctgtggctgatttactaaca

SEQ ID NO: 6189821 - DNA, 22 bp, Homo sapiens
ctgtggctggaggagctggcct

SEQ ID NO: 6189822 - DNA, 14 bp, Homo sapiens
ctgtggctggctct

SEQ ID NO: 6189823 - DNA, 23 bp, Homo sapiens
ctgtggctggctctaccttcctg

SEQ ID NO: 6189824 - DNA, 12 bp, Homo sapiens
ctgtggctgggg

SEQ ID NO: 6189825 - DNA, 22 bp, Homo sapiens
ctgtggctggtactttctgtac

SEQ ID NO: 6189826 - DNA, 13 bp, Homo sapiens
ctgtggctgtgga

SEQ ID NO: 6189827 - DNA, 16 bp, Homo sapiens
ctgtgggaaagagcct

SEQ ID NO: 6189828 - DNA, 17 bp, Homo sapiens
ctgtgggaaagagccta

SEQ ID NO: 6189829 - DNA, 21 bp, Homo sapiens
ctgtgggaaatcccagggcaa

SEQ ID NO: 6189830 - DNA, 22 bp, Homo sapiens
ctgtgggaaatcccagggcaaa

SEQ ID NO: 6189831 - DNA, 21 bp, Homo sapiens
ctgtgggaacgagaggggaag

SEQ ID NO: 6189832 - DNA, 23 bp, Homo sapiens
ctgtgggaagagaagggaagcct

SEQ ID NO: 6189833 - DNA, 23 bp, Homo sapiens
ctgtgggaagatgaactttgtca

SEQ ID NO: 6189834 - DNA, 18 bp, Homo sapiens
ctgtgggaaggccagctg

SEQ ID NO: 6189835 - DNA, 12 bp, Homo sapiens
ctgtgggaccag

SEQ ID NO: 6189836 - DNA, 17 bp, Homo sapiens
ctgtgggaccccaggcc

SEQ ID NO: 6189837 - DNA, 18 bp, Homo sapiens
ctgtgggaccccaggccc

SEQ ID NO: 6189838 - DNA, 15 bp, Homo sapiens
ctgtgggaccgcctg

SEQ ID NO: 6189839 - DNA, 23 bp, Homo sapiens
ctgtgggaccgcctggccctccc

SEQ ID NO: 6189840 - DNA, 22 bp, Homo sapiens
ctgtgggactcagttgttctga

SEQ ID NO: 6189841 - DNA, 20 bp, Homo sapiens
ctgtgggactcatccttgcc

SEQ ID NO: 6189842 - DNA, 21 bp, Homo sapiens
ctgtgggactcatccttgccc

SEQ ID NO: 6189843 - DNA, 12 bp, Homo sapiens
ctgtgggactgg

SEQ ID NO: 6189844 - DNA, 16 bp, Homo sapiens
ctgtgggactggccca

SEQ ID NO: 6189845 - DNA, 21 bp, Homo sapiens
ctgtgggactggcccacccct

SEQ ID NO: 6189846 - DNA, 22 bp, Homo sapiens
ctgtgggactggcccacccctc

SEQ ID NO: 6189847 - DNA, 23 bp, Homo sapiens
ctgtgggactggcccacccctct

SEQ ID NO: 6189848 - DNA, 16 bp, Homo sapiens
ctgtgggagaagggac

SEQ ID NO: 6189849 - DNA, 16 bp, Homo sapiens
ctgtgggagagcgaag

SEQ ID NO: 6189850 - DNA, 13 bp, Homo sapiens
ctgtgggagcctc

SEQ ID NO: 6189851 - DNA, 14 bp, Homo sapiens
ctgtgggagcctcg

SEQ ID NO: 6189852 - DNA, 15 bp, Homo sapiens
ctgtgggagcctcgc

SEQ ID NO: 6189853 - DNA, 21 bp, Homo sapiens
ctgtgggagcctcgcaacccg

SEQ ID NO: 6189854 - DNA, 13 bp, Homo sapiens
ctgtgggagtcca

SEQ ID NO: 6189855 - DNA, 19 bp, Homo sapiens
ctgtgggagtccactttcc

SEQ ID NO: 6189856 - DNA, 15 bp, Homo sapiens
ctgtgggattctgat

SEQ ID NO: 6189857 - DNA, 18 bp, Homo sapiens
ctgtgggcaaaagagtgt

SEQ ID NO: 6189858 - DNA, 17 bp, Homo sapiens
ctgtgggcacaggtcag

SEQ ID NO: 6189859 - DNA, 22 bp, Homo sapiens
ctgtgggcacgctgtgggcagg

SEQ ID NO: 6189860 - DNA, 16 bp, Homo sapiens
ctgtgggcactggtgg

SEQ ID NO: 6189861 - DNA, 11 bp, Homo sapiens
ctgtgggcagc

SEQ ID NO: 6189862 - DNA, 13 bp, Homo sapiens
ctgtgggcagcac

SEQ ID NO: 6189863 - DNA, 15 bp, Homo sapiens
ctgtgggcagcaccc

SEQ ID NO: 6189864 - DNA, 16 bp, Homo sapiens
ctgtgggcagcaccct

SEQ ID NO: 6189865 - DNA, 21 bp, Homo sapiens
ctgtgggcagcaccctccccc

SEQ ID NO: 6189866 - DNA, 17 bp, Homo sapiens
ctgtgggcagctggctc

SEQ ID NO: 6189867 - DNA, 21 bp, Homo sapiens
ctgtgggcaggcaagcccttc

SEQ ID NO: 6189868 - DNA, 20 bp, Homo sapiens
ctgtgggcaggtgggagctt

SEQ ID NO: 6189869 - DNA, 17 bp, Homo sapiens
ctgtgggcatggccgct

SEQ ID NO: 6189870 - DNA, 15 bp, Homo sapiens
ctgtgggccagattg

SEQ ID NO: 6189871 - DNA, 19 bp, Homo sapiens
ctgtgggccaggagctcag

SEQ ID NO: 6189872 - DNA, 20 bp, Homo sapiens
ctgtgggccctaccctcctg

SEQ ID NO: 6189873 - DNA, 21 bp, Homo sapiens
ctgtgggccctaccctcctgc

SEQ ID NO: 6189874 - DNA, 11 bp, Homo sapiens
ctgtgggcctc

SEQ ID NO: 6189875 - DNA, 18 bp, Homo sapiens
ctgtgggcgagcatgggg

SEQ ID NO: 6189876 - DNA, 21 bp, Homo sapiens
ctgtgggcgagcatgggggct

SEQ ID NO: 6189877 - DNA, 18 bp, Homo sapiens
ctgtgggcggctcctggt

SEQ ID NO: 6189878 - DNA, 23 bp, Homo sapiens
ctgtgggctacatgctggggtca

SEQ ID NO: 6189879 - DNA, 17 bp, Homo sapiens
ctgtgggctcacaccgg

SEQ ID NO: 6189880 - DNA, 22 bp, Homo sapiens
ctgtgggctcacaccggcactg

SEQ ID NO: 6189881 - DNA, 18 bp, Homo sapiens
ctgtgggctcccttcctc

SEQ ID NO: 6189882 - DNA, 20 bp, Homo sapiens
ctgtgggctgcactctgtgc

SEQ ID NO: 6189883 - DNA, 15 bp, Homo sapiens
ctgtgggcttggcct

SEQ ID NO: 6189884 - DNA, 14 bp, Homo sapiens
ctgtggggaaaggg

SEQ ID NO: 6189885 - DNA, 19 bp, Homo sapiens
ctgtggggaacacagctac

SEQ ID NO: 6189886 - DNA, 22 bp, Homo sapiens
ctgtggggaacatggctggcct

SEQ ID NO: 6189887 - DNA, 23 bp, Homo sapiens
ctgtggggaacatggctggcctg

SEQ ID NO: 6189888 - DNA, 13 bp, Homo sapiens
ctgtggggactcc

SEQ ID NO: 6189889 - DNA, 19 bp, Homo sapiens
ctgtggggactccggctgt

SEQ ID NO: 6189890 - DNA, 23 bp, Homo sapiens
ctgtggggactccggctgtgctg

SEQ ID NO: 6189891 - DNA, 14 bp, Homo sapiens
ctgtggggactgaa

SEQ ID NO: 6189892 - DNA, 23 bp, Homo sapiens
ctgtggggactgaacctggaaga

SEQ ID NO: 6189893 - DNA, 22 bp, Homo sapiens
ctgtggggagctggtgggggca

SEQ ID NO: 6189894 - DNA, 21 bp, Homo sapiens
ctgtggggaggggttgttttg

SEQ ID NO: 6189895 - DNA, 13 bp, Homo sapiens
ctgtggggagggt

SEQ ID NO: 6189896 - DNA, 15 bp, Homo sapiens
ctgtggggagggtca

SEQ ID NO: 6189897 - DNA, 22 bp, Homo sapiens
ctgtggggagggtcatgtactt

SEQ ID NO: 6189898 - DNA, 23 bp, Homo sapiens
ctgtggggagggtcatgtacttc

SEQ ID NO: 6189899 - DNA, 20 bp, Homo sapiens
ctgtggggatctcaggggct

SEQ ID NO: 6189900 - DNA, 17 bp, Homo sapiens
ctgtggggcaggagtgc

SEQ ID NO: 6189901 - DNA, 18 bp, Homo sapiens
ctgtggggcaggagtgcc

SEQ ID NO: 6189902 - DNA, 23 bp, Homo sapiens
ctgtggggcaggagtgccaggac

SEQ ID NO: 6189903 - DNA, 19 bp, Homo sapiens
ctgtggggccttggttccc

SEQ ID NO: 6189904 - DNA, 14 bp, Homo sapiens
ctgtggggctacag

SEQ ID NO: 6189905 - DNA, 20 bp, Homo sapiens
ctgtggggctaggggctggg

SEQ ID NO: 6189906 - DNA, 13 bp, Homo sapiens
gaaatggccttcc

SEQ ID NO: 6189907 - DNA, 24 bp, Homo sapiens
gaaatggcgtctgctctggtggct

SEQ ID NO: 6189908 - DNA, 17 bp, Homo sapiens
gaaatggctatgaacag

SEQ ID NO: 6189909 - DNA, 16 bp, Homo sapiens
gaaatggctgaagtgc

SEQ ID NO: 6189910 - DNA, 13 bp, Homo sapiens
gaaatggctgggg

SEQ ID NO: 6189911 - DNA, 23 bp, Homo sapiens
gaaatggcttattaaactttgaa

SEQ ID NO: 6189912 - DNA, 17 bp, Homo sapiens
gaaatggcttgaagcca

SEQ ID NO: 6189913 - DNA, 17 bp, Homo sapiens
gaaatggcttttcccaa

SEQ ID NO: 6189914 - DNA, 16 bp, Homo sapiens
gaaatggcttttctta

SEQ ID NO: 6189915 - DNA, 17 bp, Homo sapiens
gaaatgggcagagcaga

SEQ ID NO: 6189916 - DNA, 18 bp, Homo sapiens
gaaatgggcagttctccc

SEQ ID NO: 6189917 - DNA, 19 bp, Homo sapiens
gaaatgggcatttatttta

SEQ ID NO: 6189918 - DNA, 13 bp, Homo sapiens
gaaatgggcctca

SEQ ID NO: 6189919 - DNA, 16 bp, Homo sapiens
gaaatgggcctgcctg

SEQ ID NO: 6189920 - DNA, 17 bp, Homo sapiens
gaaatgggcctgcctgc

SEQ ID NO: 6189921 - DNA, 18 bp, Homo sapiens
gaaatgggcctgcctgcc

SEQ ID NO: 6189922 - DNA, 21 bp, Homo sapiens
gaaatggggaactcccccaga

SEQ ID NO: 6189923 - DNA, 21 bp, Homo sapiens
gaaatggtactgtacagctgg

SEQ ID NO: 6189924 - DNA, 16 bp, Homo sapiens
gaaatggtatgtagag

SEQ ID NO: 6189925 - DNA, 21 bp, Homo sapiens
gaaatggtccgctttcctgga

SEQ ID NO: 6189926 - DNA, 22 bp, Homo sapiens
gaaatggtccgctttcctggag

SEQ ID NO: 6189927 - DNA, 17 bp, Homo sapiens
gaaatggttgtattaga

SEQ ID NO: 6189928 - DNA, 18 bp, Homo sapiens
gaaatggttgtattagat

SEQ ID NO: 6189929 - DNA, 15 bp, Homo sapiens
gaaatgtaaatgtta

SEQ ID NO: 6189930 - DNA, 13 bp, Homo sapiens
gaaatgtaatact

SEQ ID NO: 6189931 - DNA, 17 bp, Homo sapiens
gaaatgtaatactggaa

SEQ ID NO: 6189932 - DNA, 12 bp, Homo sapiens
gaaatgtacact

SEQ ID NO: 6189933 - DNA, 17 bp, Homo sapiens
gaaatgtacacttttta

SEQ ID NO: 6189934 - DNA, 16 bp, Homo sapiens
gaaatgtaccttcttt

SEQ ID NO: 6189935 - DNA, 18 bp, Homo sapiens
gaaatgtagatgatatgt

SEQ ID NO: 6189936 - DNA, 22 bp, Homo sapiens
gaaatgtagcacttacgtaaaa

SEQ ID NO: 6189937 - DNA, 16 bp, Homo sapiens
gaaatgtatcctgata

SEQ ID NO: 6189938 - DNA, 22 bp, Homo sapiens
gaaatgtatgtgtgtctatttt

SEQ ID NO: 6189939 - DNA, 21 bp, Homo sapiens
gaaatgtattcacctttcttt

SEQ ID NO: 6189940 - DNA, 23 bp, Homo sapiens
gaaatgtattttgaaaacactta

SEQ ID NO: 6189941 - DNA, 13 bp, Homo sapiens
gaaatgtcaattt

SEQ ID NO: 6189942 - DNA, 14 bp, Homo sapiens
gaaatgtcataaat

SEQ ID NO: 6189943 - DNA, 15 bp, Homo sapiens
gaaatgtcataaatt

SEQ ID NO: 6189944 - DNA, 17 bp, Homo sapiens
gaaatgtcatctaacca

SEQ ID NO: 6189945 - DNA, 22 bp, Homo sapiens
gaaatgtctatgttttctactc

SEQ ID NO: 6189946 - DNA, 19 bp, Homo sapiens
gaaatgtctgttccagctg

SEQ ID NO: 6189947 - DNA, 16 bp, Homo sapiens
gaaatgtctttctatt

SEQ ID NO: 6189948 - DNA, 17 bp, Homo sapiens
gaaatgtctttctattc

SEQ ID NO: 6189949 - DNA, 18 bp, Homo sapiens
gaaatgtgaagaggtctg

SEQ ID NO: 6189950 - DNA, 18 bp, Homo sapiens
gaaatgtgaagggtgggg

SEQ ID NO: 6189951 - DNA, 20 bp, Homo sapiens
gaaatgtgacttggccgggc

SEQ ID NO: 6189952 - DNA, 17 bp, Homo sapiens
gaaatgtggagaacatt

SEQ ID NO: 6189953 - DNA, 16 bp, Homo sapiens
gaaatgtggttttcct

SEQ ID NO: 6189954 - DNA, 19 bp, Homo sapiens
gaaatgtgtgtgatgtgac

SEQ ID NO: 6189955 - DNA, 22 bp, Homo sapiens
gaaatgttaaactgagacaata

SEQ ID NO: 6189956 - DNA, 16 bp, Homo sapiens
gaaatgttaagaaaga

SEQ ID NO: 6189957 - DNA, 23 bp, Homo sapiens
gaaatgttacaaaaataaactat

SEQ ID NO: 6189958 - DNA, 12 bp, Homo sapiens
gaaatgttataa

SEQ ID NO: 6189959 - DNA, 13 bp, Homo sapiens
gaaatgttataaa

SEQ ID NO: 6189960 - DNA, 22 bp, Homo sapiens
gaaatgttattttttaattatt

SEQ ID NO: 6189961 - DNA, 15 bp, Homo sapiens
gaaatgttctgtcaa

SEQ ID NO: 6189962 - DNA, 12 bp, Homo sapiens
gaaatgttctta

SEQ ID NO: 6189963 - DNA, 20 bp, Homo sapiens
gaaatgtttaataaagcttt

SEQ ID NO: 6189964 - DNA, 22 bp, Homo sapiens
gaaatgtttaataaagctttat

SEQ ID NO: 6189965 - DNA, 23 bp, Homo sapiens
gaaatgtttaataaagctttata

SEQ ID NO: 6189966 - DNA, 22 bp, Homo sapiens
gaaatgttttgtaaacatttat

SEQ ID NO: 6189967 - DNA, 21 bp, Homo sapiens
gaaatgtttttaataaaagaa

SEQ ID NO: 6189968 - DNA, 20 bp, Homo sapiens
gaaatgtttttgatttatca

SEQ ID NO: 6189969 - DNA, 13 bp, Homo sapiens
gaaattaaagttt

SEQ ID NO: 6189970 - DNA, 13 bp, Homo sapiens
gaaattaaataat

SEQ ID NO: 6189971 - DNA, 19 bp, Homo sapiens
gaaattaaataattttaca

SEQ ID NO: 6189972 - DNA, 19 bp, Homo sapiens
gaaattaacaagaactcat

SEQ ID NO: 6189973 - DNA, 23 bp, Homo sapiens
gaaattaacttaccctgtatatc

SEQ ID NO: 6189974 - DNA, 17 bp, Homo sapiens
gaaattaagaactgaat

SEQ ID NO: 6189975 - DNA, 15 bp, Homo sapiens
gaaattaagaagaaa

SEQ ID NO: 6189976 - DNA, 23 bp, Homo sapiens
gaaattaagactttatgtagttt

SEQ ID NO: 6189977 - DNA, 21 bp, Homo sapiens
gaaattaatatggcttcacca

SEQ ID NO: 6189978 - DNA, 23 bp, Homo sapiens
gaaattaatatggcttcaccaag

SEQ ID NO: 6189979 - DNA, 16 bp, Homo sapiens
gaaattaatgctgaga

SEQ ID NO: 6189980 - DNA, 22 bp, Homo sapiens
gaaattaatttgtgaatttgca

SEQ ID NO: 6189981 - DNA, 23 bp, Homo sapiens
gaaattacaagtttcagtaatag

SEQ ID NO: 6189982 - DNA, 23 bp, Homo sapiens
gaaattacccactgtcaggcctc

SEQ ID NO: 6189983 - DNA, 17 bp, Homo sapiens
gaaattacctgtggata

SEQ ID NO: 6189984 - DNA, 18 bp, Homo sapiens
gaaattacctgtggatat

SEQ ID NO: 6189985 - DNA, 19 bp, Homo sapiens
gaaattactacaaaatttg

SEQ ID NO: 6189986 - DNA, 16 bp, Homo sapiens
gaaattactgaaaaca

SEQ ID NO: 6189987 - DNA, 23 bp, Homo sapiens
gaaattactgcccacttgtcaag

SEQ ID NO: 6189988 - DNA, 24 bp, Homo sapiens
gaaattactggagccatgtctaca

SEQ ID NO: 6189989 - DNA, 15 bp, Homo sapiens
gaaattactttaaca

SEQ ID NO: 6189990 - DNA, 15 bp, Homo sapiens
gaaattagaagagcc

SEQ ID NO: 6189991 - DNA, 16 bp, Homo sapiens
gaaattagaagagcct

SEQ ID NO: 6189992 - DNA, 19 bp, Homo sapiens
gaaattagctgtgtgaaat

SEQ ID NO: 6189993 - DNA, 17 bp, Homo sapiens
gaaattaggttgaaaca

SEQ ID NO: 6189994 - DNA, 19 bp, Homo sapiens
gaaattaggttgaaacata

SEQ ID NO: 6189995 - DNA, 16 bp, Homo sapiens
gaaattagtattttga

SEQ ID NO: 6189996 - DNA, 14 bp, Homo sapiens
gaaattagtctttt

SEQ ID NO: 6189997 - DNA, 15 bp, Homo sapiens
gaaattagtcttttt

SEQ ID NO: 6189998 - DNA, 22 bp, Homo sapiens
gaaattagtgttttcattctgg

SEQ ID NO: 6189999 - DNA, 16 bp, Homo sapiens
gaaattataactatta

SEQ ID NO: 6190000 - DNA, 12 bp, Homo sapiens
gaaattatatat

SEQ ID NO: 6190001 - DNA, 14 bp, Homo sapiens
gaaattatctgcct

SEQ ID NO: 6190002 - DNA, 21 bp, Homo sapiens
gaaattatctttagttgaatt

SEQ ID NO: 6190003 - DNA, 21 bp, Homo sapiens
gaaattatgtcaaatggatgt

SEQ ID NO: 6190004 - DNA, 18 bp, Homo sapiens
gaaattattggtatattt

SEQ ID NO: 6190005 - DNA, 20 bp, Homo sapiens
gaaattattggtatatttgt

SEQ ID NO: 6190006 - DNA, 14 bp, Homo sapiens
gaaattattggttg

SEQ ID NO: 6190007 - DNA, 20 bp, Homo sapiens
gaaattattggttggtgtga

SEQ ID NO: 6190008 - DNA, 13 bp, Homo sapiens
gaaattatttaat

SEQ ID NO: 6190009 - DNA, 16 bp, Homo sapiens
gaaattatttaatatg

SEQ ID NO: 6190010 - DNA, 19 bp, Homo sapiens
gaaattatttaatatgcat

SEQ ID NO: 6190011 - DNA, 11 bp, Homo sapiens
gaaattatttt

SEQ ID NO: 6190012 - DNA, 16 bp, Homo sapiens
gaaattcaaagcataa

SEQ ID NO: 6190013 - DNA, 23 bp, Homo sapiens
gaaattcaaagcataaaactttg

SEQ ID NO: 6190014 - DNA, 21 bp, Homo sapiens
gaaattcaacctgtgtcttat

SEQ ID NO: 6190015 - DNA, 16 bp, Homo sapiens
gaaattcaattcatag

SEQ ID NO: 6190016 - DNA, 17 bp, Homo sapiens
gaaattcaattcataga

SEQ ID NO: 6190017 - DNA, 13 bp, Homo sapiens
gaaattcacactg

SEQ ID NO: 6190018 - DNA, 19 bp, Homo sapiens
gaaattcagaacagcctgc

SEQ ID NO: 6190019 - DNA, 16 bp, Homo sapiens
gaaattcattaaagaa

SEQ ID NO: 6190020 - DNA, 17 bp, Homo sapiens
gaaattcattaaagaaa

SEQ ID NO: 6190021 - DNA, 18 bp, Homo sapiens
gaaattcattaaagaaaa

SEQ ID NO: 6190022 - DNA, 15 bp, Homo sapiens
gaaattcatttgtgg

SEQ ID NO: 6190023 - DNA, 19 bp, Homo sapiens
gaaattccagcaataagaa

SEQ ID NO: 6190024 - DNA, 21 bp, Homo sapiens
gaaattccagcaataagaaat

SEQ ID NO: 6190025 - DNA, 19 bp, Homo sapiens
gaaattcccccacttggga

SEQ ID NO: 6190026 - DNA, 18 bp, Homo sapiens
gaaattccctggaccaga

SEQ ID NO: 6190027 - DNA, 14 bp, Homo sapiens
gaaattcctcagca

SEQ ID NO: 6190028 - DNA, 14 bp, Homo sapiens
gaaattccttccca

SEQ ID NO: 6190029 - DNA, 20 bp, Homo sapiens
gaaattccttgccccacagt

SEQ ID NO: 6190030 - DNA, 21 bp, Homo sapiens
gaaattccttgccccacagtt

SEQ ID NO: 6190031 - DNA, 20 bp, Homo sapiens
gaaattcgaaaacataaaga

SEQ ID NO: 6190032 - DNA, 16 bp, Homo sapiens
gaaattcgcatgttta

SEQ ID NO: 6190033 - DNA, 20 bp, Homo sapiens
gaaattcgcatgtttaatgt

SEQ ID NO: 6190034 - DNA, 19 bp, Homo sapiens
gaaattcgctgaaatactt

SEQ ID NO: 6190035 - DNA, 17 bp, Homo sapiens
gaaattcgtgtgttttt

SEQ ID NO: 6190036 - DNA, 19 bp, Homo sapiens
gaaattcgtgtgttttttt

SEQ ID NO: 6190037 - DNA, 19 bp, Homo sapiens
gaaattctataagagacaa

SEQ ID NO: 6190038 - DNA, 20 bp, Homo sapiens
gaaattctatttataataca

SEQ ID NO: 6190039 - DNA, 15 bp, Homo sapiens
gaaattctcaaaata

SEQ ID NO: 6190040 - DNA, 11 bp, Homo sapiens
gaaattctgaa

SEQ ID NO: 6190041 - DNA, 13 bp, Homo sapiens
gaaattctgaaaa

SEQ ID NO: 6190042 - DNA, 16 bp, Homo sapiens
gaaattctgaaaactg

SEQ ID NO: 6190043 - DNA, 14 bp, Homo sapiens
gaaattctgaattt

SEQ ID NO: 6190044 - DNA, 18 bp, Homo sapiens
gaaattctgaatttgcaa

SEQ ID NO: 6190045 - DNA, 13 bp, Homo sapiens
gaaattctgagtt

SEQ ID NO: 6190046 - DNA, 13 bp, Homo sapiens
gaaattctgctgc

SEQ ID NO: 6190047 - DNA, 17 bp, Homo sapiens
gaaattctgctgcttga

SEQ ID NO: 6190048 - DNA, 17 bp, Homo sapiens
gaaattctggcccagcc

SEQ ID NO: 6190049 - DNA, 12 bp, Homo sapiens
gaaattctgtgg

SEQ ID NO: 6190050 - DNA, 18 bp, Homo sapiens
gaaattctgttaaaatct

SEQ ID NO: 6190051 - DNA, 18 bp, Homo sapiens
gaaattctgtttttaaaa

SEQ ID NO: 6190052 - DNA, 21 bp, Homo sapiens
gaaattcttatttcccctttc

SEQ ID NO: 6190053 - DNA, 16 bp, Homo sapiens
gaaattcttccctggg

SEQ ID NO: 6190054 - DNA, 16 bp, Homo sapiens
gaaattcttgcactgt

SEQ ID NO: 6190055 - DNA, 17 bp, Homo sapiens
gaaattcttgcactgta

SEQ ID NO: 6190056 - DNA, 18 bp, Homo sapiens
gaaattctttatacattc

SEQ ID NO: 6190057 - DNA, 20 bp, Homo sapiens
gaaattctttatacattcta

SEQ ID NO: 6190058 - DNA, 23 bp, Homo sapiens
gaaattctttcccagtctgtcga

SEQ ID NO: 6190059 - DNA, 14 bp, Homo sapiens
gaaattgaaccttt

SEQ ID NO: 6190060 - DNA, 18 bp, Homo sapiens
gaaattgaagtgtcttct

SEQ ID NO: 6190061 - DNA, 17 bp, Homo sapiens
gaaattgaatactttga

SEQ ID NO: 6190062 - DNA, 22 bp, Homo sapiens
gaaattgaatgggggaggccca

SEQ ID NO: 6190063 - DNA, 21 bp, Homo sapiens
gaaattgacacaagtggacct

SEQ ID NO: 6190064 - DNA, 12 bp, Homo sapiens
gaaattgacaga

SEQ ID NO: 6190065 - DNA, 22 bp, Homo sapiens
gaaattgactgatgattttcct

SEQ ID NO: 6190066 - DNA, 22 bp, Homo sapiens
gaaattgattaaggctttcttt

SEQ ID NO: 6190067 - DNA, 12 bp, Homo sapiens
gaaattgattga

SEQ ID NO: 6190068 - DNA, 15 bp, Homo sapiens
gaaattgattttgaa

SEQ ID NO: 6190069 - DNA, 13 bp, Homo sapiens
gaaattgcaaaga

SEQ ID NO: 6190070 - DNA, 15 bp, Homo sapiens
gaaattgcaaagaaa

SEQ ID NO: 6190071 - DNA, 17 bp, Homo sapiens
gaaattgcaaagaaaat

SEQ ID NO: 6190072 - DNA, 13 bp, Homo sapiens
gaaattgcatact

SEQ ID NO: 6190073 - DNA, 15 bp, Homo sapiens
gaaattggaaaggac

SEQ ID NO: 6190074 - DNA, 19 bp, Homo sapiens
gaaattggaaaggactttg

SEQ ID NO: 6190075 - DNA, 17 bp, Homo sapiens
gaaattgggtgtgccct

SEQ ID NO: 6190076 - DNA, 18 bp, Homo sapiens
gaaattgggtgtgccctg

SEQ ID NO: 6190077 - DNA, 19 bp, Homo sapiens
gaaattgggtgtgccctgg

SEQ ID NO: 6190078 - DNA, 19 bp, Homo sapiens
gaaattgtatattgtaatt

SEQ ID NO: 6190079 - DNA, 12 bp, Homo sapiens
gaaattgtcctt

SEQ ID NO: 6190080 - DNA, 17 bp, Homo sapiens
gaaattgtccttgaagc

SEQ ID NO: 6190081 - DNA, 13 bp, Homo sapiens
gaaattgtgaact

SEQ ID NO: 6190082 - DNA, 14 bp, Homo sapiens
gaaattgtgccaaa

SEQ ID NO: 6190083 - DNA, 17 bp, Homo sapiens
gaaattgtgccaaagat

SEQ ID NO: 6190084 - DNA, 12 bp, Homo sapiens
ctgtggggctga

SEQ ID NO: 6190085 - DNA, 16 bp, Homo sapiens
ctgtggggctgggcac

SEQ ID NO: 6190086 - DNA, 23 bp, Homo sapiens
ctgtggggctgggcaccgtgtcc

SEQ ID NO: 6190087 - DNA, 21 bp, Homo sapiens
ctgtggggcttacagaaatga

SEQ ID NO: 6190088 - DNA, 20 bp, Homo sapiens
ctgtgggggaagagcacagc

SEQ ID NO: 6190089 - DNA, 18 bp, Homo sapiens
ctgtgggggactggctgg

SEQ ID NO: 6190090 - DNA, 20 bp, Homo sapiens
ctgtgggggaggtccctgcc

SEQ ID NO: 6190091 - DNA, 24 bp, Homo sapiens
ctgtgggggtgagggtcccatgtg

SEQ ID NO: 6190092 - DNA, 18 bp, Homo sapiens
ctgtggggtatacagcat

SEQ ID NO: 6190093 - DNA, 11 bp, Homo sapiens
ctgtggggtgg

SEQ ID NO: 6190094 - DNA, 21 bp, Homo sapiens
ctgtggggtggacctgggaca

SEQ ID NO: 6190095 - DNA, 13 bp, Homo sapiens
ctgtggggtggag

SEQ ID NO: 6190096 - DNA, 22 bp, Homo sapiens
ctgtggggtggagcactggact

SEQ ID NO: 6190097 - DNA, 23 bp, Homo sapiens
ctgtggggtggagcactggactc

SEQ ID NO: 6190098 - DNA, 13 bp, Homo sapiens
ctgtggggtgggc

SEQ ID NO: 6190099 - DNA, 16 bp, Homo sapiens
ctgtggggtgggctgg

SEQ ID NO: 6190100 - DNA, 17 bp, Homo sapiens
ctgtggggtgggctgga

SEQ ID NO: 6190101 - DNA, 19 bp, Homo sapiens
ctgtggggtgggctggagt

SEQ ID NO: 6190102 - DNA, 14 bp, Homo sapiens
ctgtggggtgtagg

SEQ ID NO: 6190103 - DNA, 23 bp, Homo sapiens
ctgtggggtgtgcacatctctgc

SEQ ID NO: 6190104 - DNA, 23 bp, Homo sapiens
ctgtgggtatcaggactgtgacc

SEQ ID NO: 6190105 - DNA, 19 bp, Homo sapiens
ctgtgggtccgataatatc

SEQ ID NO: 6190106 - DNA, 17 bp, Homo sapiens
ctgtgggtctccatcct

SEQ ID NO: 6190107 - DNA, 14 bp, Homo sapiens
ctgtgggtctctga

SEQ ID NO: 6190108 - DNA, 18 bp, Homo sapiens
ctgtgggtctctgaaggg

SEQ ID NO: 6190109 - DNA, 20 bp, Homo sapiens
ctgtgggtctctgaagggac

SEQ ID NO: 6190110 - DNA, 22 bp, Homo sapiens
ctgtgggtctgggagtcacaca

SEQ ID NO: 6190111 - DNA, 16 bp, Homo sapiens
ctgtgggtgatgggga

SEQ ID NO: 6190112 - DNA, 19 bp, Homo sapiens
ctgtgggtgatggggaggg

SEQ ID NO: 6190113 - DNA, 21 bp, Homo sapiens
ctgtgggtgatggggaggggc

SEQ ID NO: 6190114 - DNA, 13 bp, Homo sapiens
ctgtgggtgggga

SEQ ID NO: 6190115 - DNA, 15 bp, Homo sapiens
ctgtgggtggggaag

SEQ ID NO: 6190116 - DNA, 15 bp, Homo sapiens
ctgtgggtggggagg

SEQ ID NO: 6190117 - DNA, 16 bp, Homo sapiens
ctgtgggtggggaggc

SEQ ID NO: 6190118 - DNA, 19 bp, Homo sapiens
ctgtgggtggggaggccct

SEQ ID NO: 6190119 - DNA, 20 bp, Homo sapiens
ctgtgggtggggaggccctg

SEQ ID NO: 6190120 - DNA, 18 bp, Homo sapiens
ctgtgggtggggcttctc

SEQ ID NO: 6190121 - DNA, 22 bp, Homo sapiens
ctgtgggtttctaaagctgcca

SEQ ID NO: 6190122 - DNA, 20 bp, Homo sapiens
ctgtgggtttgggtgcctcc

SEQ ID NO: 6190123 - DNA, 18 bp, Homo sapiens
ctgtggtaaatgccacac

SEQ ID NO: 6190124 - DNA, 15 bp, Homo sapiens
ctgtggtagctccag

SEQ ID NO: 6190125 - DNA, 23 bp, Homo sapiens
ctgtggtagtactcctgcaaaat

SEQ ID NO: 6190126 - DNA, 22 bp, Homo sapiens
ctgtggtagtcctcccaagctg

SEQ ID NO: 6190127 - DNA, 22 bp, Homo sapiens
ctgtggtcacttatcctgacac

SEQ ID NO: 6190128 - DNA, 11 bp, Homo sapiens
ctgtggtcagg

SEQ ID NO: 6190129 - DNA, 13 bp, Homo sapiens
ctgtggtcaggcc

SEQ ID NO: 6190130 - DNA, 18 bp, Homo sapiens
ctgtggtcaggcccagcc

SEQ ID NO: 6190131 - DNA, 16 bp, Homo sapiens
ctgtggtcccacccag

SEQ ID NO: 6190132 - DNA, 18 bp, Homo sapiens
ctgtggtcccacccagga

SEQ ID NO: 6190133 - DNA, 12 bp, Homo sapiens
ctgtggtccctc

SEQ ID NO: 6190134 - DNA, 17 bp, Homo sapiens
ctgtggtctataaaata

SEQ ID NO: 6190135 - DNA, 19 bp, Homo sapiens
ctgtggtctataaaataaa

SEQ ID NO: 6190136 - DNA, 22 bp, Homo sapiens
ctgtggtctataaaataaactt

SEQ ID NO: 6190137 - DNA, 23 bp, Homo sapiens
ctgtggtctataaaataaacttc

SEQ ID NO: 6190138 - DNA, 21 bp, Homo sapiens
ctgtggtgaagtgtggctggt

SEQ ID NO: 6190139 - DNA, 17 bp, Homo sapiens
ctgtggtgacaggccca

SEQ ID NO: 6190140 - DNA, 18 bp, Homo sapiens
ctgtggtgactttggata

SEQ ID NO: 6190141 - DNA, 23 bp, Homo sapiens
ctgtggtgaggtcctgtcctggc

SEQ ID NO: 6190142 - DNA, 16 bp, Homo sapiens
ctgtggtgatgttgcc

SEQ ID NO: 6190143 - DNA, 14 bp, Homo sapiens
ctgtggtggcctgg

SEQ ID NO: 6190144 - DNA, 20 bp, Homo sapiens
ctgtggtggcctggtgcaca

SEQ ID NO: 6190145 - DNA, 14 bp, Homo sapiens
ctgtggtggctccc

SEQ ID NO: 6190146 - DNA, 17 bp, Homo sapiens
ctgtggtggctccccct

SEQ ID NO: 6190147 - DNA, 20 bp, Homo sapiens
ctgtggtgggaacattcgag

SEQ ID NO: 6190148 - DNA, 22 bp, Homo sapiens
ctgtggtgtctcttggggaagg

SEQ ID NO: 6190149 - DNA, 13 bp, Homo sapiens
ctgtggtgtctgc

SEQ ID NO: 6190150 - DNA, 15 bp, Homo sapiens
ctgtggtgtgtcccc

SEQ ID NO: 6190151 - DNA, 17 bp, Homo sapiens
ctgtggttacagtgcag

SEQ ID NO: 6190152 - DNA, 22 bp, Homo sapiens
ctgtggttacagtgcagacagg

SEQ ID NO: 6190153 - DNA, 19 bp, Homo sapiens
ctgtggttcactgcactgt

SEQ ID NO: 6190154 - DNA, 16 bp, Homo sapiens
ctgtggttcctctgct

SEQ ID NO: 6190155 - DNA, 15 bp, Homo sapiens
ctgtggttgcctgcc

SEQ ID NO: 6190156 - DNA, 17 bp, Homo sapiens
ctgtggttggctgggaa

SEQ ID NO: 6190157 - DNA, 18 bp, Homo sapiens
ctgtggttggctgggaaa

SEQ ID NO: 6190158 - DNA, 17 bp, Homo sapiens
ctgtggttgtggatggg

SEQ ID NO: 6190159 - DNA, 23 bp, Homo sapiens
ctgtggttgtggatgggaggctc

SEQ ID NO: 6190160 - DNA, 21 bp, Homo sapiens
ctgtggttgttttagctcctt

SEQ ID NO: 6190161 - DNA, 17 bp, Homo sapiens
ctgtggtttcagatgtg

SEQ ID NO: 6190162 - DNA, 18 bp, Homo sapiens
ctgtggtttcagatgtgc

SEQ ID NO: 6190163 - DNA, 16 bp, Homo sapiens
ctgtggtttggtttta

SEQ ID NO: 6190164 - DNA, 11 bp, Homo sapiens
ctgtggttttc

SEQ ID NO: 6190165 - DNA, 16 bp, Homo sapiens
ctgtggttttcccctc

SEQ ID NO: 6190166 - DNA, 21 bp, Homo sapiens
ctgtggttttcccctccctgg

SEQ ID NO: 6190167 - DNA, 23 bp, Homo sapiens
ctgtggttttcccctccctgggt

SEQ ID NO: 6190168 - DNA, 22 bp, Homo sapiens
ctgtggttttcttttgccatga

SEQ ID NO: 6190169 - DNA, 12 bp, Homo sapiens
ctgtgtaaagtt

SEQ ID NO: 6190170 - DNA, 14 bp, Homo sapiens
ctgtgtaaataaac

SEQ ID NO: 6190171 - DNA, 16 bp, Homo sapiens
ctgtgtaaatatatgt

SEQ ID NO: 6190172 - DNA, 17 bp, Homo sapiens
ctgtgtaaatatatgtc

SEQ ID NO: 6190173 - DNA, 19 bp, Homo sapiens
ctgtgtaaatgctccagca

SEQ ID NO: 6190174 - DNA, 15 bp, Homo sapiens
ctgtgtaacactgtt

SEQ ID NO: 6190175 - DNA, 13 bp, Homo sapiens
ctgtgtaacagct

SEQ ID NO: 6190176 - DNA, 19 bp, Homo sapiens
ctgtgtaacagctccttgg

SEQ ID NO: 6190177 - DNA, 16 bp, Homo sapiens
ctgtgtaacatctgcc

SEQ ID NO: 6190178 - DNA, 14 bp, Homo sapiens
ctgtgtaaccagca

SEQ ID NO: 6190179 - DNA, 21 bp, Homo sapiens
ctgtgtaaccagctcagtgtt

SEQ ID NO: 6190180 - DNA, 23 bp, Homo sapiens
ctgtgtaacctccacagtagcat

SEQ ID NO: 6190181 - DNA, 16 bp, Homo sapiens
ctgtgtaaccttgggt

SEQ ID NO: 6190182 - DNA, 11 bp, Homo sapiens
ctgtgtaactg

SEQ ID NO: 6190183 - DNA, 18 bp, Homo sapiens
ctgtgtaactttctctta

SEQ ID NO: 6190184 - DNA, 21 bp, Homo sapiens
ctgtgtaagaagctgtgaata

SEQ ID NO: 6190185 - DNA, 15 bp, Homo sapiens
ctgtgtaagctttta

SEQ ID NO: 6190186 - DNA, 17 bp, Homo sapiens
ctgtgtaatctctgatt

SEQ ID NO: 6190187 - DNA, 16 bp, Homo sapiens
ctgtgtacaaagaaat

SEQ ID NO: 6190188 - DNA, 22 bp, Homo sapiens
ctgtgtacataaagtcatcaaa

SEQ ID NO: 6190189 - DNA, 23 bp, Homo sapiens
ctgtgtacataactctgtaaaaa

SEQ ID NO: 6190190 - DNA, 20 bp, Homo sapiens
ctgtgtacataactgaaaat

SEQ ID NO: 6190191 - DNA, 17 bp, Homo sapiens
ctgtgtacatgtgtgca

SEQ ID NO: 6190192 - DNA, 22 bp, Homo sapiens
ctgtgtacatgtgtgcagagca

SEQ ID NO: 6190193 - DNA, 23 bp, Homo sapiens
ctgtgtacattttaaaggataat

SEQ ID NO: 6190194 - DNA, 19 bp, Homo sapiens
ctgtgtaccacttcctgag

SEQ ID NO: 6190195 - DNA, 16 bp, Homo sapiens
ctgtgtaccacttctg

SEQ ID NO: 6190196 - DNA, 22 bp, Homo sapiens
ctgtgtaccacttctgtgggca

SEQ ID NO: 6190197 - DNA, 15 bp, Homo sapiens
ctgtgtacccactcc

SEQ ID NO: 6190198 - DNA, 20 bp, Homo sapiens
ctgtgtacccactcctcact

SEQ ID NO: 6190199 - DNA, 21 bp, Homo sapiens
ctgtgtacctctagaatccca

SEQ ID NO: 6190200 - DNA, 18 bp, Homo sapiens
ctgtgtactgtatagaca

SEQ ID NO: 6190201 - DNA, 14 bp, Homo sapiens
ctgtgtactgtgtc

SEQ ID NO: 6190202 - DNA, 21 bp, Homo sapiens
ctgtgtagactcctgcttctt

SEQ ID NO: 6190203 - DNA, 20 bp, Homo sapiens
ctgtgtagagaatgtcactg

SEQ ID NO: 6190204 - DNA, 13 bp, Homo sapiens
ctgtgtagccgcc

SEQ ID NO: 6190205 - DNA, 17 bp, Homo sapiens
ctgtgtagccgccctga

SEQ ID NO: 6190206 - DNA, 18 bp, Homo sapiens
ctgtgtagccgccctgag

SEQ ID NO: 6190207 - DNA, 21 bp, Homo sapiens
ctgtgtagccgccctgagaga

SEQ ID NO: 6190208 - DNA, 17 bp, Homo sapiens
ctgtgtagctgtgacct

SEQ ID NO: 6190209 - DNA, 13 bp, Homo sapiens
ctgtgtagtattt

SEQ ID NO: 6190210 - DNA, 21 bp, Homo sapiens
ctgtgtagtatttatatttaa

SEQ ID NO: 6190211 - DNA, 21 bp, Homo sapiens
ctgtgtagttccctctgcctg

SEQ ID NO: 6190212 - DNA, 22 bp, Homo sapiens
ctgtgtagttccctctgcctgg

SEQ ID NO: 6190213 - DNA, 16 bp, Homo sapiens
ctgtgtataaaaaaga

SEQ ID NO: 6190214 - DNA, 16 bp, Homo sapiens
ctgtgtatacatatgt

SEQ ID NO: 6190215 - DNA, 21 bp, Homo sapiens
ctgtgtatacatatgtatgtg

SEQ ID NO: 6190216 - DNA, 13 bp, Homo sapiens
ctgtgtatagctt

SEQ ID NO: 6190217 - DNA, 15 bp, Homo sapiens
ctgtgtataggaatt

SEQ ID NO: 6190218 - DNA, 18 bp, Homo sapiens
ctgtgtataggaatttgt

SEQ ID NO: 6190219 - DNA, 13 bp, Homo sapiens
ctgtgtatatctc

SEQ ID NO: 6190220 - DNA, 14 bp, Homo sapiens
ctgtgtatatctct

SEQ ID NO: 6190221 - DNA, 17 bp, Homo sapiens
ctgtgtatatctcttgg

SEQ ID NO: 6190222 - DNA, 18 bp, Homo sapiens
ctgtgtatattatttggc

SEQ ID NO: 6190223 - DNA, 12 bp, Homo sapiens
ctgtgtatattt

SEQ ID NO: 6190224 - DNA, 15 bp, Homo sapiens
ctgtgtatatttgat

SEQ ID NO: 6190225 - DNA, 13 bp, Homo sapiens
ctgtgtatcatta

SEQ ID NO: 6190226 - DNA, 19 bp, Homo sapiens
ctgtgtatcattaaaatat

SEQ ID NO: 6190227 - DNA, 20 bp, Homo sapiens
ctgtgtatcattaaaatata

SEQ ID NO: 6190228 - DNA, 20 bp, Homo sapiens
ctgtgtatcttttttataac

SEQ ID NO: 6190229 - DNA, 19 bp, Homo sapiens
ctgtgtatggaaaaaccat

SEQ ID NO: 6190230 - DNA, 19 bp, Homo sapiens
ctgtgtatggtgacctctc

SEQ ID NO: 6190231 - DNA, 20 bp, Homo sapiens
ctgtgtatggtgacctctcc

SEQ ID NO: 6190232 - DNA, 13 bp, Homo sapiens
ctgtgtatgtaca

SEQ ID NO: 6190233 - DNA, 19 bp, Homo sapiens
ctgtgtatgttttatatca

SEQ ID NO: 6190234 - DNA, 17 bp, Homo sapiens
ctgtgtattaacatgca

SEQ ID NO: 6190235 - DNA, 16 bp, Homo sapiens
ctgtgtattcattgaa

SEQ ID NO: 6190236 - DNA, 11 bp, Homo sapiens
ctgtgtattta

SEQ ID NO: 6190237 - DNA, 20 bp, Homo sapiens
ctgtgtatttaattgtaaac

SEQ ID NO: 6190238 - DNA, 22 bp, Homo sapiens
ctgtgtatttaattgtaaactg

SEQ ID NO: 6190239 - DNA, 23 bp, Homo sapiens
ctgtgtatttatttaaaactctg

SEQ ID NO: 6190240 - DNA, 13 bp, Homo sapiens
ctgtgtatttctg

SEQ ID NO: 6190241 - DNA, 14 bp, Homo sapiens
ctgtgtatttctgt

SEQ ID NO: 6190242 - DNA, 23 bp, Homo sapiens
ctgtgtattttttaaagctacaa

SEQ ID NO: 6190243 - DNA, 17 bp, Homo sapiens
ctgtgtcacgagccctt

SEQ ID NO: 6190244 - DNA, 20 bp, Homo sapiens
ctgtgtcacgcaggctgagt

SEQ ID NO: 6190245 - DNA, 22 bp, Homo sapiens
ctgtgtcacgcaggctgagtgc

SEQ ID NO: 6190246 - DNA, 15 bp, Homo sapiens
ctgtgtcacgtgacc

SEQ ID NO: 6190247 - DNA, 17 bp, Homo sapiens
ctgtgtcacgtgaccct

SEQ ID NO: 6190248 - DNA, 22 bp, Homo sapiens
ctgtgtcacgtgaccctgtgcc

SEQ ID NO: 6190249 - DNA, 14 bp, Homo sapiens
ctgtgtcactggct

SEQ ID NO: 6190250 - DNA, 18 bp, Homo sapiens
ctgtgtcactggctgcct

SEQ ID NO: 6190251 - DNA, 20 bp, Homo sapiens
ctgtgtcactggctgcctcc

SEQ ID NO: 6190252 - DNA, 14 bp, Homo sapiens
ctgtgtcactgtcc

SEQ ID NO: 6190253 - DNA, 17 bp, Homo sapiens
ctgtgtcagaaaccctg

SEQ ID NO: 6190254 - DNA, 22 bp, Homo sapiens
ctgtgtcagaaaccctggtctc

SEQ ID NO: 6190255 - DNA, 14 bp, Homo sapiens
ctgtgtcagagccc

SEQ ID NO: 6190256 - DNA, 22 bp, Homo sapiens
ctgtgtcagagcccagcccagg

SEQ ID NO: 6190257 - DNA, 15 bp, Homo sapiens
ctgtgtcagagccta

SEQ ID NO: 6190258 - DNA, 21 bp, Homo sapiens
ctgtgtcagagcctaccttca

SEQ ID NO: 6190259 - DNA, 19 bp, Homo sapiens
ctgtgtcagcatagaagta

SEQ ID NO: 6190260 - DNA, 20 bp, Homo sapiens
ctgtgtcagcatagaagtaa

SEQ ID NO: 6190261 - DNA, 21 bp, Homo sapiens
gaaattgtgccaaagatagca

SEQ ID NO: 6190262 - DNA, 16 bp, Homo sapiens
gaaattgtgtgtgcaa

SEQ ID NO: 6190263 - DNA, 19 bp, Homo sapiens
gaaattgttacaatagaat

SEQ ID NO: 6190264 - DNA, 19 bp, Homo sapiens
gaaattgttgtatatcact

SEQ ID NO: 6190265 - DNA, 12 bp, Homo sapiens
gaaattgtttat

SEQ ID NO: 6190266 - DNA, 16 bp, Homo sapiens
gaaattgtttatgtgt

SEQ ID NO: 6190267 - DNA, 17 bp, Homo sapiens
gaaatttaaaaataaag

SEQ ID NO: 6190268 - DNA, 13 bp, Homo sapiens
gaaatttaaaaga

SEQ ID NO: 6190269 - DNA, 14 bp, Homo sapiens
gaaatttaaagcag

SEQ ID NO: 6190270 - DNA, 23 bp, Homo sapiens
gaaatttaaagcaggttcttgtt

SEQ ID NO: 6190271 - DNA, 13 bp, Homo sapiens
gaaatttaaataa

SEQ ID NO: 6190272 - DNA, 22 bp, Homo sapiens
gaaatttaactgcctaaaatgt

SEQ ID NO: 6190273 - DNA, 22 bp, Homo sapiens
gaaatttaattacaaacaataa

SEQ ID NO: 6190274 - DNA, 15 bp, Homo sapiens
gaaatttacaaatca

SEQ ID NO: 6190275 - DNA, 19 bp, Homo sapiens
gaaatttacacagtgagac

SEQ ID NO: 6190276 - DNA, 18 bp, Homo sapiens
gaaatttacagttactgc

SEQ ID NO: 6190277 - DNA, 20 bp, Homo sapiens
gaaatttacagttactgcct

SEQ ID NO: 6190278 - DNA, 14 bp, Homo sapiens
gaaatttagcattg

SEQ ID NO: 6190279 - DNA, 18 bp, Homo sapiens
gaaatttagcattgtagt

SEQ ID NO: 6190280 - DNA, 23 bp, Homo sapiens
gaaatttaggggtagaaaatgtt

SEQ ID NO: 6190281 - DNA, 14 bp, Homo sapiens
gaaatttataatat

SEQ ID NO: 6190282 - DNA, 17 bp, Homo sapiens
gaaatttatatgtcaga

SEQ ID NO: 6190283 - DNA, 22 bp, Homo sapiens
gaaatttatatgtcagagctgt

SEQ ID NO: 6190284 - DNA, 12 bp, Homo sapiens
gaaatttatgac

SEQ ID NO: 6190285 - DNA, 13 bp, Homo sapiens
gaaatttatgact

SEQ ID NO: 6190286 - DNA, 21 bp, Homo sapiens
gaaatttattagttaatatat

SEQ ID NO: 6190287 - DNA, 21 bp, Homo sapiens
gaaatttattgaggaaaaata

SEQ ID NO: 6190288 - DNA, 22 bp, Homo sapiens
gaaatttattgaggaaaaatat

SEQ ID NO: 6190289 - DNA, 19 bp, Homo sapiens
gaaatttatttccatctag

SEQ ID NO: 6190290 - DNA, 24 bp, Homo sapiens
gaaatttcaaagtatgtttcatta

SEQ ID NO: 6190291 - DNA, 22 bp, Homo sapiens
gaaatttcaataacctttcact

SEQ ID NO: 6190292 - DNA, 18 bp, Homo sapiens
gaaatttcacatagccca

SEQ ID NO: 6190293 - DNA, 11 bp, Homo sapiens
gaaatttcacg

SEQ ID NO: 6190294 - DNA, 13 bp, Homo sapiens
gaaatttccagag

SEQ ID NO: 6190295 - DNA, 19 bp, Homo sapiens
gaaatttcccacaccccag

SEQ ID NO: 6190296 - DNA, 20 bp, Homo sapiens
gaaatttcctaatttattct

SEQ ID NO: 6190297 - DNA, 16 bp, Homo sapiens
gaaatttgaattttgt

SEQ ID NO: 6190298 - DNA, 24 bp, Homo sapiens
gaaatttgaattttgtgttagaga

SEQ ID NO: 6190299 - DNA, 19 bp, Homo sapiens
gaaatttgcccctggcaaa

SEQ ID NO: 6190300 - DNA, 16 bp, Homo sapiens
gaaatttgcctctgtc

SEQ ID NO: 6190301 - DNA, 23 bp, Homo sapiens
gaaatttgggagagccatacata

SEQ ID NO: 6190302 - DNA, 17 bp, Homo sapiens
gaaatttgggtttttaa

SEQ ID NO: 6190303 - DNA, 22 bp, Homo sapiens
gaaattttaacctatgatattt

SEQ ID NO: 6190304 - DNA, 16 bp, Homo sapiens
gaaattttaccaagtt

SEQ ID NO: 6190305 - DNA, 22 bp, Homo sapiens
gaaattttagatattatcataa

SEQ ID NO: 6190306 - DNA, 16 bp, Homo sapiens
gaaattttatatgtaa

SEQ ID NO: 6190307 - DNA, 22 bp, Homo sapiens
gaaattttatatgtaaatgtgt

SEQ ID NO: 6190308 - DNA, 23 bp, Homo sapiens
gaaattttatatgtaaatgtgtt

SEQ ID NO: 6190309 - DNA, 14 bp, Homo sapiens
gaaattttatttag

SEQ ID NO: 6190310 - DNA, 20 bp, Homo sapiens
gaaattttatttattttaat

SEQ ID NO: 6190311 - DNA, 16 bp, Homo sapiens
gaaattttcttgattt

SEQ ID NO: 6190312 - DNA, 16 bp, Homo sapiens
gaaattttgcaaatat

SEQ ID NO: 6190313 - DNA, 17 bp, Homo sapiens
gaaattttgcaaatata

SEQ ID NO: 6190314 - DNA, 18 bp, Homo sapiens
gaaattttggtttttcaa

SEQ ID NO: 6190315 - DNA, 13 bp, Homo sapiens
gaaattttgtcca

SEQ ID NO: 6190316 - DNA, 17 bp, Homo sapiens
gaaatttttaaatcatt

SEQ ID NO: 6190317 - DNA, 20 bp, Homo sapiens
gaaatttttaaatcatttca

SEQ ID NO: 6190318 - DNA, 13 bp, Homo sapiens
gaaatttttatca

SEQ ID NO: 6190319 - DNA, 15 bp, Homo sapiens
gaaatttttcatatt

SEQ ID NO: 6190320 - DNA, 19 bp, Homo sapiens
gaaatttttcatattttaa

SEQ ID NO: 6190321 - DNA, 15 bp, Homo sapiens
gaaatttttccacac

SEQ ID NO: 6190322 - DNA, 22 bp, Homo sapiens
gaaatttttccacactatgtgt

SEQ ID NO: 6190323 - DNA, 20 bp, Homo sapiens
gaaatttttgatgcccagac

SEQ ID NO: 6190324 - DNA, 15 bp, Homo sapiens
gaaatttttgcatgt

SEQ ID NO: 6190325 - DNA, 16 bp, Homo sapiens
gaaatttttgcatgtt

SEQ ID NO: 6190326 - DNA, 13 bp, Homo sapiens
gaaatttttgtaa

SEQ ID NO: 6190327 - DNA, 14 bp, Homo sapiens
gaaatttttgtaaa

SEQ ID NO: 6190328 - DNA, 20 bp, Homo sapiens
gaaattttttagtatgttca

SEQ ID NO: 6190329 - DNA, 18 bp, Homo sapiens
gaacaaaaaaaccacaaa

SEQ ID NO: 6190330 - DNA, 19 bp, Homo sapiens
gaacaaaaaaaccacaaag

SEQ ID NO: 6190331 - DNA, 16 bp, Homo sapiens
gaacaaaaagaaatct

SEQ ID NO: 6190332 - DNA, 20 bp, Homo sapiens
gaacaaaaagaaatcttgtc

SEQ ID NO: 6190333 - DNA, 19 bp, Homo sapiens
gaacaaaaagtaatgtata

SEQ ID NO: 6190334 - DNA, 17 bp, Homo sapiens
gaacaaaaagttttttt

SEQ ID NO: 6190335 - DNA, 13 bp, Homo sapiens
gaacaaaagggtc

SEQ ID NO: 6190336 - DNA, 14 bp, Homo sapiens
gaacaaaagggtca

SEQ ID NO: 6190337 - DNA, 15 bp, Homo sapiens
gaacaaaatctgttg

SEQ ID NO: 6190338 - DNA, 14 bp, Homo sapiens
gaacaaaattattt

SEQ ID NO: 6190339 - DNA, 20 bp, Homo sapiens
gaacaaacaaaacttaaaag

SEQ ID NO: 6190340 - DNA, 23 bp, Homo sapiens
gaacaaacactgaatcatgttaa

SEQ ID NO: 6190341 - DNA, 12 bp, Homo sapiens
gaacaaactgat

SEQ ID NO: 6190342 - DNA, 14 bp, Homo sapiens
gaacaaactgatgc

SEQ ID NO: 6190343 - DNA, 18 bp, Homo sapiens
gaacaaagaaaaaaatat

SEQ ID NO: 6190344 - DNA, 13 bp, Homo sapiens
gaacaaagaaaag

SEQ ID NO: 6190345 - DNA, 16 bp, Homo sapiens
gaacaaagaaaatgtt

SEQ ID NO: 6190346 - DNA, 22 bp, Homo sapiens
gaacaaagaacggcatgtgaat

SEQ ID NO: 6190347 - DNA, 12 bp, Homo sapiens
gaacaaagacaa

SEQ ID NO: 6190348 - DNA, 13 bp, Homo sapiens
gaacaaagacaac

SEQ ID NO: 6190349 - DNA, 21 bp, Homo sapiens
gaacaaagagtgaaatattgt

SEQ ID NO: 6190350 - DNA, 16 bp, Homo sapiens
gaacaaagcagccacg

SEQ ID NO: 6190351 - DNA, 18 bp, Homo sapiens
gaacaaagctgttaaact

SEQ ID NO: 6190352 - DNA, 20 bp, Homo sapiens
gaacaaagctgttaaactgt

SEQ ID NO: 6190353 - DNA, 22 bp, Homo sapiens
gaacaaaggacagagtatgaac

SEQ ID NO: 6190354 - DNA, 20 bp, Homo sapiens
gaacaaagggattctccagg

SEQ ID NO: 6190355 - DNA, 20 bp, Homo sapiens
gaacaaagggccaaatagag

SEQ ID NO: 6190356 - DNA, 23 bp, Homo sapiens
gaacaaatatgattctcctctcc

SEQ ID NO: 6190357 - DNA, 22 bp, Homo sapiens
gaacaaatcacacctctgggct

SEQ ID NO: 6190358 - DNA, 22 bp, Homo sapiens
gaacaaatcttgggtgggtgaa

SEQ ID NO: 6190359 - DNA, 14 bp, Homo sapiens
gaacaaatgtctta

SEQ ID NO: 6190360 - DNA, 15 bp, Homo sapiens
gaacaaatgtcttaa

SEQ ID NO: 6190361 - DNA, 21 bp, Homo sapiens
gaacaaatgtgtttttctata

SEQ ID NO: 6190362 - DNA, 22 bp, Homo sapiens
gaacaaatgtgtttttctatat

SEQ ID NO: 6190363 - DNA, 18 bp, Homo sapiens
gaacaaatttacagagac

SEQ ID NO: 6190364 - DNA, 17 bp, Homo sapiens
gaacaaattttcacaat

SEQ ID NO: 6190365 - DNA, 14 bp, Homo sapiens
gaacaacaacaaca

SEQ ID NO: 6190366 - DNA, 14 bp, Homo sapiens
gaacaacaggcagg

SEQ ID NO: 6190367 - DNA, 18 bp, Homo sapiens
gaacaacaggcaggggcc

SEQ ID NO: 6190368 - DNA, 20 bp, Homo sapiens
gaacaacaggcaggggccca

SEQ ID NO: 6190369 - DNA, 21 bp, Homo sapiens
gaacaacaggcaggggcccac

SEQ ID NO: 6190370 - DNA, 22 bp, Homo sapiens
gaacaacaggcaggggcccact

SEQ ID NO: 6190371 - DNA, 15 bp, Homo sapiens
gaacaacagtagttt

SEQ ID NO: 6190372 - DNA, 16 bp, Homo sapiens
gaacaacataaaatta

SEQ ID NO: 6190373 - DNA, 17 bp, Homo sapiens
gaacaacataaaattaa

SEQ ID NO: 6190374 - DNA, 20 bp, Homo sapiens
gaacaacccaatctggctgg

SEQ ID NO: 6190375 - DNA, 20 bp, Homo sapiens
gaacaacctcggctcctgga

SEQ ID NO: 6190376 - DNA, 19 bp, Homo sapiens
gaacaactaggcttcagca

SEQ ID NO: 6190377 - DNA, 18 bp, Homo sapiens
gaacaactatttataaac

SEQ ID NO: 6190378 - DNA, 23 bp, Homo sapiens
gaacaactatttataaactagat

SEQ ID NO: 6190379 - DNA, 13 bp, Homo sapiens
gaacaactcgaat

SEQ ID NO: 6190380 - DNA, 13 bp, Homo sapiens
gaacaactgatac

SEQ ID NO: 6190381 - DNA, 13 bp, Homo sapiens
gaacaagaaagag

SEQ ID NO: 6190382 - DNA, 22 bp, Homo sapiens
gaacaagaaagagtaacactga

SEQ ID NO: 6190383 - DNA, 13 bp, Homo sapiens
gaacaagaaatgg

SEQ ID NO: 6190384 - DNA, 15 bp, Homo sapiens
gaacaagacagcctt

SEQ ID NO: 6190385 - DNA, 15 bp, Homo sapiens
gaacaagagaagcat

SEQ ID NO: 6190386 - DNA, 16 bp, Homo sapiens
gaacaagagaagcatt

SEQ ID NO: 6190387 - DNA, 17 bp, Homo sapiens
gaacaagcatgtctctc

SEQ ID NO: 6190388 - DNA, 19 bp, Homo sapiens
gaacaagctggcttctgtg

SEQ ID NO: 6190389 - DNA, 13 bp, Homo sapiens
gaacaagcttcag

SEQ ID NO: 6190390 - DNA, 18 bp, Homo sapiens
gaacaagcttcagtaagt

SEQ ID NO: 6190391 - DNA, 12 bp, Homo sapiens
gaacaaggaagg

SEQ ID NO: 6190392 - DNA, 17 bp, Homo sapiens
gaacaaggatgttttta

SEQ ID NO: 6190393 - DNA, 14 bp, Homo sapiens
gaacaaggcaaggc

SEQ ID NO: 6190394 - DNA, 17 bp, Homo sapiens
gaacaaggcaaggctgt

SEQ ID NO: 6190395 - DNA, 18 bp, Homo sapiens
gaacaaggcaaggctgtc

SEQ ID NO: 6190396 - DNA, 21 bp, Homo sapiens
gaacaaggcaaggctgtcaat

SEQ ID NO: 6190397 - DNA, 18 bp, Homo sapiens
gaacaagtaatgtattag

SEQ ID NO: 6190398 - DNA, 16 bp, Homo sapiens
gaacaagtcacagctg

SEQ ID NO: 6190399 - DNA, 18 bp, Homo sapiens
gaacaagtcacagctgca

SEQ ID NO: 6190400 - DNA, 19 bp, Homo sapiens
gaacaagtcacagctgcag

SEQ ID NO: 6190401 - DNA, 22 bp, Homo sapiens
gaacaagttgagctatgactta

SEQ ID NO: 6190402 - DNA, 19 bp, Homo sapiens
gaacaagttgtttcattga

SEQ ID NO: 6190403 - DNA, 12 bp, Homo sapiens
gaacaagtttta

SEQ ID NO: 6190404 - DNA, 18 bp, Homo sapiens
gaacaagttttggcagcc

SEQ ID NO: 6190405 - DNA, 17 bp, Homo sapiens
gaacaataatgagagca

SEQ ID NO: 6190406 - DNA, 14 bp, Homo sapiens
gaacaatcactatt

SEQ ID NO: 6190407 - DNA, 19 bp, Homo sapiens
gaacaatcactattcttaa

SEQ ID NO: 6190408 - DNA, 13 bp, Homo sapiens
gaacaatgaatgc

SEQ ID NO: 6190409 - DNA, 20 bp, Homo sapiens
gaacaatgccgcctgtcaat

SEQ ID NO: 6190410 - DNA, 22 bp, Homo sapiens
gaacaatgccgcctgtcaataa

SEQ ID NO: 6190411 - DNA, 17 bp, Homo sapiens
gaacaatgtatacaatg

SEQ ID NO: 6190412 - DNA, 21 bp, Homo sapiens
gaacaatgtgctatgtgaaga

SEQ ID NO: 6190413 - DNA, 18 bp, Homo sapiens
gaacaattacctgccaaa

SEQ ID NO: 6190414 - DNA, 20 bp, Homo sapiens
gaacaatttggcaattttgt

SEQ ID NO: 6190415 - DNA, 21 bp, Homo sapiens
gaacaattttttttaattggc

SEQ ID NO: 6190416 - DNA, 14 bp, Homo sapiens
gaacacaaatgtct

SEQ ID NO: 6190417 - DNA, 17 bp, Homo sapiens
gaacacaagccacgcct

SEQ ID NO: 6190418 - DNA, 21 bp, Homo sapiens
gaacacaagggatataaaatg

SEQ ID NO: 6190419 - DNA, 15 bp, Homo sapiens
gaacacacacacaca

SEQ ID NO: 6190420 - DNA, 12 bp, Homo sapiens
gaacacacacgc

SEQ ID NO: 6190421 - DNA, 14 bp, Homo sapiens
gaacacacacgcca

SEQ ID NO: 6190422 - DNA, 21 bp, Homo sapiens
gaacacacacgccagctcctc

SEQ ID NO: 6190423 - DNA, 21 bp, Homo sapiens
gaacacacagactttctgtga

SEQ ID NO: 6190424 - DNA, 20 bp, Homo sapiens
gaacacacccatcatctgac

SEQ ID NO: 6190425 - DNA, 14 bp, Homo sapiens
gaacacactgtgtc

SEQ ID NO: 6190426 - DNA, 16 bp, Homo sapiens
gaacacactgtgtcct

SEQ ID NO: 6190427 - DNA, 22 bp, Homo sapiens
gaacacactgtgtcctggtgct

SEQ ID NO: 6190428 - DNA, 15 bp, Homo sapiens
gaacacagaaagcct

SEQ ID NO: 6190429 - DNA, 18 bp, Homo sapiens
gaacacagaacaggaact

SEQ ID NO: 6190430 - DNA, 20 bp, Homo sapiens
gaacacagcagttctgcaga

SEQ ID NO: 6190431 - DNA, 22 bp, Homo sapiens
gaacacaggcaaagaggtgctg

SEQ ID NO: 6190432 - DNA, 13 bp, Homo sapiens
gaacacagggctg

SEQ ID NO: 6190433 - DNA, 12 bp, Homo sapiens
gaacacaggggc

SEQ ID NO: 6190434 - DNA, 22 bp, Homo sapiens
gaacacataaggacgtgtgtaa

SEQ ID NO: 6190435 - DNA, 17 bp, Homo sapiens
gaacacatgcacacaca

SEQ ID NO: 6190436 - DNA, 17 bp, Homo sapiens
gaacacatgtgtatgat

SEQ ID NO: 6190437 - DNA, 13 bp, Homo sapiens
gaacacattcctt

SEQ ID NO: 6190438 - DNA, 18 bp, Homo sapiens
gaacaccaagacttgaag

SEQ ID NO: 6190439 - DNA, 24 bp, Homo sapiens
ctgtgtcagcatctttgcccttct

SEQ ID NO: 6190440 - DNA, 19 bp, Homo sapiens
ctgtgtcaggtggggcagc

SEQ ID NO: 6190441 - DNA, 12 bp, Homo sapiens
ctgtgtcatctg

SEQ ID NO: 6190442 - DNA, 16 bp, Homo sapiens
ctgtgtcatctgtcag

SEQ ID NO: 6190443 - DNA, 14 bp, Homo sapiens
ctgtgtcatggtga

SEQ ID NO: 6190444 - DNA, 18 bp, Homo sapiens
ctgtgtcattagtccttt

SEQ ID NO: 6190445 - DNA, 16 bp, Homo sapiens
ctgtgtcatttcttca

SEQ ID NO: 6190446 - DNA, 18 bp, Homo sapiens
ctgtgtcatttcttcact

SEQ ID NO: 6190447 - DNA, 22 bp, Homo sapiens
ctgtgtcatttggctttccagt

SEQ ID NO: 6190448 - DNA, 16 bp, Homo sapiens
ctgtgtccaactccag

SEQ ID NO: 6190449 - DNA, 15 bp, Homo sapiens
ctgtgtccacagtga

SEQ ID NO: 6190450 - DNA, 14 bp, Homo sapiens
ctgtgtccagcagc

SEQ ID NO: 6190451 - DNA, 17 bp, Homo sapiens
ctgtgtccagcagctgc

SEQ ID NO: 6190452 - DNA, 12 bp, Homo sapiens
ctgtgtccatct

SEQ ID NO: 6190453 - DNA, 19 bp, Homo sapiens
ctgtgtccatgcgctcagg

SEQ ID NO: 6190454 - DNA, 21 bp, Homo sapiens
ctgtgtccatgcgctcagggc

SEQ ID NO: 6190455 - DNA, 23 bp, Homo sapiens
ctgtgtccatgcgctcagggcca

SEQ ID NO: 6190456 - DNA, 11 bp, Homo sapiens
ctgtgtcccag

SEQ ID NO: 6190457 - DNA, 14 bp, Homo sapiens
ctgtgtcccagcca

SEQ ID NO: 6190458 - DNA, 15 bp, Homo sapiens
ctgtgtcccagccac

SEQ ID NO: 6190459 - DNA, 22 bp, Homo sapiens
ctgtgtcccagccacgcagggc

SEQ ID NO: 6190460 - DNA, 22 bp, Homo sapiens
ctgtgtcccagtgtctggccca

SEQ ID NO: 6190461 - DNA, 17 bp, Homo sapiens
ctgtgtcccatgaccca

SEQ ID NO: 6190462 - DNA, 18 bp, Homo sapiens
ctgtgtcccatgtcccgt

SEQ ID NO: 6190463 - DNA, 20 bp, Homo sapiens
ctgtgtcccatgtcccgtgt

SEQ ID NO: 6190464 - DNA, 21 bp, Homo sapiens
ctgtgtcccccccagtgcagg

SEQ ID NO: 6190465 - DNA, 23 bp, Homo sapiens
ctgtgtcccccccagtgcaggga

SEQ ID NO: 6190466 - DNA, 21 bp, Homo sapiens
ctgtgtccccgatgctgacct

SEQ ID NO: 6190467 - DNA, 22 bp, Homo sapiens
ctgtgtccccgatgctgacctc

SEQ ID NO: 6190468 - DNA, 21 bp, Homo sapiens
ctgtgtccccgcgggcagtga

SEQ ID NO: 6190469 - DNA, 19 bp, Homo sapiens
ctgtgtcccctgacctgtc

SEQ ID NO: 6190470 - DNA, 20 bp, Homo sapiens
ctgtgtcccctgacctgtcc

SEQ ID NO: 6190471 - DNA, 16 bp, Homo sapiens
ctgtgtccctctctct

SEQ ID NO: 6190472 - DNA, 13 bp, Homo sapiens
ctgtgtccctgct

SEQ ID NO: 6190473 - DNA, 17 bp, Homo sapiens
ctgtgtccctgctgggg

SEQ ID NO: 6190474 - DNA, 17 bp, Homo sapiens
ctgtgtccgatgctgga

SEQ ID NO: 6190475 - DNA, 20 bp, Homo sapiens
ctgtgtccgctctctcatgt

SEQ ID NO: 6190476 - DNA, 19 bp, Homo sapiens
ctgtgtcctaaatgcaaag

SEQ ID NO: 6190477 - DNA, 21 bp, Homo sapiens
ctgtgtcctcgcactgcccag

SEQ ID NO: 6190478 - DNA, 19 bp, Homo sapiens
ctgtgtcctctccagcttt

SEQ ID NO: 6190479 - DNA, 19 bp, Homo sapiens
ctgtgtcctggtgctctct

SEQ ID NO: 6190480 - DNA, 17 bp, Homo sapiens
ctgtgtccttcctccac

SEQ ID NO: 6190481 - DNA, 16 bp, Homo sapiens
ctgtgtccttcggggg

SEQ ID NO: 6190482 - DNA, 22 bp, Homo sapiens
ctgtgtccttgtataaggagct

SEQ ID NO: 6190483 - DNA, 11 bp, Homo sapiens
ctgtgtctaaa

SEQ ID NO: 6190484 - DNA, 13 bp, Homo sapiens
ctgtgtctaaact

SEQ ID NO: 6190485 - DNA, 14 bp, Homo sapiens
ctgtgtctaaactg

SEQ ID NO: 6190486 - DNA, 16 bp, Homo sapiens
ctgtgtctaaatttct

SEQ ID NO: 6190487 - DNA, 17 bp, Homo sapiens
ctgtgtctaagattcta

SEQ ID NO: 6190488 - DNA, 18 bp, Homo sapiens
ctgtgtctaagattctag

SEQ ID NO: 6190489 - DNA, 19 bp, Homo sapiens
ctgtgtctaagattctaga

SEQ ID NO: 6190490 - DNA, 20 bp, Homo sapiens
ctgtgtctaagattctagat

SEQ ID NO: 6190491 - DNA, 21 bp, Homo sapiens
ctgtgtctaagattctagatc

SEQ ID NO: 6190492 - DNA, 16 bp, Homo sapiens
ctgtgtctatgaacta

SEQ ID NO: 6190493 - DNA, 17 bp, Homo sapiens
ctgtgtctcacagaggc

SEQ ID NO: 6190494 - DNA, 12 bp, Homo sapiens
ctgtgtctcatg

SEQ ID NO: 6190495 - DNA, 14 bp, Homo sapiens
ctgtgtctctgcca

SEQ ID NO: 6190496 - DNA, 12 bp, Homo sapiens
ctgtgtctctgt

SEQ ID NO: 6190497 - DNA, 18 bp, Homo sapiens
ctgtgtctctgtatatag

SEQ ID NO: 6190498 - DNA, 17 bp, Homo sapiens
ctgtgtctctgtttcct

SEQ ID NO: 6190499 - DNA, 19 bp, Homo sapiens
ctgtgtctctgtttcctga

SEQ ID NO: 6190500 - DNA, 16 bp, Homo sapiens
ctgtgtctgaatcatg

SEQ ID NO: 6190501 - DNA, 17 bp, Homo sapiens
ctgtgtctgaatcatgt

SEQ ID NO: 6190502 - DNA, 13 bp, Homo sapiens
ctgtgtctgagcc

SEQ ID NO: 6190503 - DNA, 18 bp, Homo sapiens
ctgtgtctgagcccaacc

SEQ ID NO: 6190504 - DNA, 18 bp, Homo sapiens
ctgtgtctgagtggcttc

SEQ ID NO: 6190505 - DNA, 13 bp, Homo sapiens
ctgtgtctgcacc

SEQ ID NO: 6190506 - DNA, 22 bp, Homo sapiens
ctgtgtctgcccaatgaataat

SEQ ID NO: 6190507 - DNA, 13 bp, Homo sapiens
ctgtgtctgctgt

SEQ ID NO: 6190508 - DNA, 20 bp, Homo sapiens
ctgtgtctggcgttctcaag

SEQ ID NO: 6190509 - DNA, 18 bp, Homo sapiens
ctgtgtctgtcacaggct

SEQ ID NO: 6190510 - DNA, 19 bp, Homo sapiens
ctgtgtctgtcacaggctg

SEQ ID NO: 6190511 - DNA, 20 bp, Homo sapiens
ctgtgtctgtcacaggctgg

SEQ ID NO: 6190512 - DNA, 17 bp, Homo sapiens
ctgtgtctgtcaccaca

SEQ ID NO: 6190513 - DNA, 13 bp, Homo sapiens
ctgtgtctgtgtt

SEQ ID NO: 6190514 - DNA, 22 bp, Homo sapiens
ctgtgtcttcacctcatttata

SEQ ID NO: 6190515 - DNA, 14 bp, Homo sapiens
ctgtgtcttcattt

SEQ ID NO: 6190516 - DNA, 14 bp, Homo sapiens
ctgtgtcttgcaat

SEQ ID NO: 6190517 - DNA, 23 bp, Homo sapiens
ctgtgtcttgcaatggcagcctt

SEQ ID NO: 6190518 - DNA, 21 bp, Homo sapiens
ctgtgtctttaaatgctgctt

SEQ ID NO: 6190519 - DNA, 11 bp, Homo sapiens
ctgtgtctttt

SEQ ID NO: 6190520 - DNA, 15 bp, Homo sapiens
ctgtgtctttttcgc

SEQ ID NO: 6190521 - DNA, 20 bp, Homo sapiens
ctgtgtcttttttcactaca

SEQ ID NO: 6190522 - DNA, 12 bp, Homo sapiens
ctgtgtgaaata

SEQ ID NO: 6190523 - DNA, 19 bp, Homo sapiens
ctgtgtgaaataccagtgt

SEQ ID NO: 6190524 - DNA, 14 bp, Homo sapiens
ctgtgtgaaatctt

SEQ ID NO: 6190525 - DNA, 15 bp, Homo sapiens
ctgtgtgaaatcttt

SEQ ID NO: 6190526 - DNA, 17 bp, Homo sapiens
ctgtgtgaaatctttca

SEQ ID NO: 6190527 - DNA, 21 bp, Homo sapiens
ctgtgtgaaatctttcaagtt

SEQ ID NO: 6190528 - DNA, 13 bp, Homo sapiens
ctgtgtgaactat

SEQ ID NO: 6190529 - DNA, 18 bp, Homo sapiens
ctgtgtgaagttacacaa

SEQ ID NO: 6190530 - DNA, 19 bp, Homo sapiens
ctgtgtgaatacctgctca

SEQ ID NO: 6190531 - DNA, 19 bp, Homo sapiens
ctgtgtgaatccaggaggc

SEQ ID NO: 6190532 - DNA, 18 bp, Homo sapiens
ctgtgtgaattcccaggt

SEQ ID NO: 6190533 - DNA, 17 bp, Homo sapiens
ctgtgtgaatttttcta

SEQ ID NO: 6190534 - DNA, 20 bp, Homo sapiens
ctgtgtgacatcacagggcc

SEQ ID NO: 6190535 - DNA, 23 bp, Homo sapiens
ctgtgtgacatcacagggcctca

SEQ ID NO: 6190536 - DNA, 17 bp, Homo sapiens
ctgtgtgaccagcggaa

SEQ ID NO: 6190537 - DNA, 18 bp, Homo sapiens
ctgtgtgaccagcggaaa

SEQ ID NO: 6190538 - DNA, 19 bp, Homo sapiens
ctgtgtgaccctgggcaag

SEQ ID NO: 6190539 - DNA, 18 bp, Homo sapiens
ctgtgtgactcaaaccaa

SEQ ID NO: 6190540 - DNA, 22 bp, Homo sapiens
ctgtgtgactggcaagaggcct

SEQ ID NO: 6190541 - DNA, 22 bp, Homo sapiens
ctgtgtgactttgaacacatct

SEQ ID NO: 6190542 - DNA, 15 bp, Homo sapiens
ctgtgtgagaccagg

SEQ ID NO: 6190543 - DNA, 16 bp, Homo sapiens
ctgtgtgagagagagg

SEQ ID NO: 6190544 - DNA, 14 bp, Homo sapiens
ctgtgtgagagggg

SEQ ID NO: 6190545 - DNA, 19 bp, Homo sapiens
ctgtgtgagcgtgtccaca

SEQ ID NO: 6190546 - DNA, 18 bp, Homo sapiens
ctgtgtgaggctgtgtct

SEQ ID NO: 6190547 - DNA, 15 bp, Homo sapiens
ctgtgtgagttgagt

SEQ ID NO: 6190548 - DNA, 15 bp, Homo sapiens
ctgtgtgatgaactt

SEQ ID NO: 6190549 - DNA, 18 bp, Homo sapiens
ctgtgtgatgaactttct

SEQ ID NO: 6190550 - DNA, 23 bp, Homo sapiens
ctgtgtgattgacagctttgctg

SEQ ID NO: 6190551 - DNA, 20 bp, Homo sapiens
ctgtgtgattttcatacagg

SEQ ID NO: 6190552 - DNA, 18 bp, Homo sapiens
ctgtgtgcaagtgtgtgc

SEQ ID NO: 6190553 - DNA, 15 bp, Homo sapiens
ctgtgtgcccaagtg

SEQ ID NO: 6190554 - DNA, 20 bp, Homo sapiens
ctgtgtgcccaagtgggcag

SEQ ID NO: 6190555 - DNA, 14 bp, Homo sapiens
ctgtgtgccccact

SEQ ID NO: 6190556 - DNA, 17 bp, Homo sapiens
ctgtgtgccccactcca

SEQ ID NO: 6190557 - DNA, 18 bp, Homo sapiens
ctgtgtgccccactccag

SEQ ID NO: 6190558 - DNA, 21 bp, Homo sapiens
ctgtgtgccccactccagcct

SEQ ID NO: 6190559 - DNA, 23 bp, Homo sapiens
ctgtgtgccccactccagcctgg

SEQ ID NO: 6190560 - DNA, 16 bp, Homo sapiens
ctgtgtgcctggggga

SEQ ID NO: 6190561 - DNA, 12 bp, Homo sapiens
ctgtgtgctact

SEQ ID NO: 6190562 - DNA, 15 bp, Homo sapiens
ctgtgtgctactaac

SEQ ID NO: 6190563 - DNA, 16 bp, Homo sapiens
ctgtgtgctactaaca

SEQ ID NO: 6190564 - DNA, 16 bp, Homo sapiens
ctgtgtgctcaggagc

SEQ ID NO: 6190565 - DNA, 21 bp, Homo sapiens
ctgtgtgctcaggagccctgg

SEQ ID NO: 6190566 - DNA, 15 bp, Homo sapiens
ctgtgtgcttggtct

SEQ ID NO: 6190567 - DNA, 16 bp, Homo sapiens
ctgtgtggactgtgat

SEQ ID NO: 6190568 - DNA, 22 bp, Homo sapiens
ctgtgtggagagggaatgtgaa

SEQ ID NO: 6190569 - DNA, 21 bp, Homo sapiens
ctgtgtggaggcctcagggag

SEQ ID NO: 6190570 - DNA, 22 bp, Homo sapiens
ctgtgtggagtatttttataat

SEQ ID NO: 6190571 - DNA, 19 bp, Homo sapiens
ctgtgtggatgctgagctg

SEQ ID NO: 6190572 - DNA, 21 bp, Homo sapiens
ctgtgtggcaaacatttaaaa

SEQ ID NO: 6190573 - DNA, 15 bp, Homo sapiens
ctgtgtggcagtctg

SEQ ID NO: 6190574 - DNA, 20 bp, Homo sapiens
ctgtgtggccaaccaggacc

SEQ ID NO: 6190575 - DNA, 23 bp, Homo sapiens
ctgtgtggccaaccaggacccag

SEQ ID NO: 6190576 - DNA, 11 bp, Homo sapiens
ctgtgtggccc

SEQ ID NO: 6190577 - DNA, 12 bp, Homo sapiens
ctgtgtggccct

SEQ ID NO: 6190578 - DNA, 13 bp, Homo sapiens
ctgtgtggccctg

SEQ ID NO: 6190579 - DNA, 17 bp, Homo sapiens
ctgtgtggccctggaca

SEQ ID NO: 6190580 - DNA, 19 bp, Homo sapiens
ctgtgtggccctggacaca

SEQ ID NO: 6190581 - DNA, 21 bp, Homo sapiens
ctgtgtggccctggacacagc

SEQ ID NO: 6190582 - DNA, 22 bp, Homo sapiens
ctgtgtggccctggacacagcc

SEQ ID NO: 6190583 - DNA, 13 bp, Homo sapiens
ctgtgtggctcct

SEQ ID NO: 6190584 - DNA, 16 bp, Homo sapiens
ctgtgtggctcctggg

SEQ ID NO: 6190585 - DNA, 16 bp, Homo sapiens
ctgtgtgggagggcga

SEQ ID NO: 6190586 - DNA, 19 bp, Homo sapiens
ctgtgtgggatacttagtg

SEQ ID NO: 6190587 - DNA, 14 bp, Homo sapiens
ctgtgtggggaggc

SEQ ID NO: 6190588 - DNA, 15 bp, Homo sapiens
ctgtgtggggaggca

SEQ ID NO: 6190589 - DNA, 16 bp, Homo sapiens
ctgtgtggggaggcag

SEQ ID NO: 6190590 - DNA, 17 bp, Homo sapiens
ctgtgtggggaggcagc

SEQ ID NO: 6190591 - DNA, 23 bp, Homo sapiens
ctgtgtggggaggcagctccaac

SEQ ID NO: 6190592 - DNA, 16 bp, Homo sapiens
ctgtgtggggagggtg

SEQ ID NO: 6190593 - DNA, 20 bp, Homo sapiens
ctgtgtggggttctcagtgc

SEQ ID NO: 6190594 - DNA, 22 bp, Homo sapiens
ctgtgtggggttctcagtgccg

SEQ ID NO: 6190595 - DNA, 17 bp, Homo sapiens
ctgtgtggtctccagct

SEQ ID NO: 6190596 - DNA, 19 bp, Homo sapiens
ctgtgtggtctccagctcc

SEQ ID NO: 6190597 - DNA, 19 bp, Homo sapiens
ctgtgtggtgcattcctga

SEQ ID NO: 6190598 - DNA, 18 bp, Homo sapiens
ctgtgtggtggagccagg

SEQ ID NO: 6190599 - DNA, 18 bp, Homo sapiens
ctgtgtgtaagctgactg

SEQ ID NO: 6190600 - DNA, 16 bp, Homo sapiens
ctgtgtgtagccagga

SEQ ID NO: 6190601 - DNA, 17 bp, Homo sapiens
ctgtgtgtaggctgggg

SEQ ID NO: 6190602 - DNA, 14 bp, Homo sapiens
ctgtgtgtatattg

SEQ ID NO: 6190603 - DNA, 14 bp, Homo sapiens
ctgtgtgtcagttt

SEQ ID NO: 6190604 - DNA, 17 bp, Homo sapiens
ctgtgtgtcagttttca

SEQ ID NO: 6190605 - DNA, 16 bp, Homo sapiens
ctgtgtgtcccaggca

SEQ ID NO: 6190606 - DNA, 18 bp, Homo sapiens
ctgtgtgtcccaggcagg

SEQ ID NO: 6190607 - DNA, 18 bp, Homo sapiens
ctgtgtgtctgatgtttg

SEQ ID NO: 6190608 - DNA, 15 bp, Homo sapiens
ctgtgtgtctgtcct

SEQ ID NO: 6190609 - DNA, 17 bp, Homo sapiens
ctgtgtgtgacccctcc

SEQ ID NO: 6190610 - DNA, 19 bp, Homo sapiens
ctgtgtgtgacccctcctg

SEQ ID NO: 6190611 - DNA, 20 bp, Homo sapiens
ctgtgtgtgagctaccgtgg

SEQ ID NO: 6190612 - DNA, 16 bp, Homo sapiens
ctgtgtgtgccctctg

SEQ ID NO: 6190613 - DNA, 14 bp, Homo sapiens
ctgtgtgtgtgaat

SEQ ID NO: 6190614 - DNA, 19 bp, Homo sapiens
ctgtgtgtgtggcgtggcc

SEQ ID NO: 6190615 - DNA, 15 bp, Homo sapiens
ctgtgtgtgtgtatg

SEQ ID NO: 6190616 - DNA, 21 bp, Homo sapiens
ctgtgtgtgtgtgtgtgcgtg

SEQ ID NO: 6190617 - DNA, 14 bp, Homo sapiens
gaacaccaagtaaa

SEQ ID NO: 6190618 - DNA, 16 bp, Homo sapiens
gaacaccaagtaaatc

SEQ ID NO: 6190619 - DNA, 23 bp, Homo sapiens
gaacaccaagtaaatctatctct

SEQ ID NO: 6190620 - DNA, 21 bp, Homo sapiens
gaacaccagagacctcaaatt

SEQ ID NO: 6190621 - DNA, 18 bp, Homo sapiens
gaacaccagcagcactgg

SEQ ID NO: 6190622 - DNA, 21 bp, Homo sapiens
gaacaccaggactttaatctt

SEQ ID NO: 6190623 - DNA, 16 bp, Homo sapiens
gaacaccattgaaggc

SEQ ID NO: 6190624 - DNA, 14 bp, Homo sapiens
gaacacccactggc

SEQ ID NO: 6190625 - DNA, 15 bp, Homo sapiens
gaacacccactggcc

SEQ ID NO: 6190626 - DNA, 17 bp, Homo sapiens
gaacacccactggccag

SEQ ID NO: 6190627 - DNA, 14 bp, Homo sapiens
gaacacccagcccc

SEQ ID NO: 6190628 - DNA, 16 bp, Homo sapiens
gaacacccagccccag

SEQ ID NO: 6190629 - DNA, 20 bp, Homo sapiens
gaacaccccataactacaga

SEQ ID NO: 6190630 - DNA, 22 bp, Homo sapiens
gaacaccccgctctggcagtag

SEQ ID NO: 6190631 - DNA, 15 bp, Homo sapiens
gaacacccggaaaga

SEQ ID NO: 6190632 - DNA, 19 bp, Homo sapiens
gaacacccggaaagactga

SEQ ID NO: 6190633 - DNA, 14 bp, Homo sapiens
gaacaccctcgaag

SEQ ID NO: 6190634 - DNA, 21 bp, Homo sapiens
gaacaccctggatgctgttga

SEQ ID NO: 6190635 - DNA, 13 bp, Homo sapiens
gaacacccttaga

SEQ ID NO: 6190636 - DNA, 23 bp, Homo sapiens
gaacacccttagaaaatgtgtcc

SEQ ID NO: 6190637 - DNA, 20 bp, Homo sapiens
gaacacctgacaacttctga

SEQ ID NO: 6190638 - DNA, 22 bp, Homo sapiens
gaacacctttgttttgcactga

SEQ ID NO: 6190639 - DNA, 15 bp, Homo sapiens
gaacacgattttcaa

SEQ ID NO: 6190640 - DNA, 19 bp, Homo sapiens
gaacacgcatgcctcagcc

SEQ ID NO: 6190641 - DNA, 14 bp, Homo sapiens
gaacacggccacat

SEQ ID NO: 6190642 - DNA, 14 bp, Homo sapiens
gaacacgtttttac

SEQ ID NO: 6190643 - DNA, 15 bp, Homo sapiens
gaacacgtttttaca

SEQ ID NO: 6190644 - DNA, 16 bp, Homo sapiens
gaacactaaagagcta

SEQ ID NO: 6190645 - DNA, 19 bp, Homo sapiens
gaacactaaagagctagga

SEQ ID NO: 6190646 - DNA, 15 bp, Homo sapiens
gaacactagacaagc

SEQ ID NO: 6190647 - DNA, 18 bp, Homo sapiens
gaacactagacaagccag

SEQ ID NO: 6190648 - DNA, 13 bp, Homo sapiens
gaacactagccag

SEQ ID NO: 6190649 - DNA, 16 bp, Homo sapiens
gaacactagtctgtgt

SEQ ID NO: 6190650 - DNA, 22 bp, Homo sapiens
gaacactatggttaaccctctc

SEQ ID NO: 6190651 - DNA, 13 bp, Homo sapiens
gaacactattttc

SEQ ID NO: 6190652 - DNA, 16 bp, Homo sapiens
gaacactattttcaga

SEQ ID NO: 6190653 - DNA, 17 bp, Homo sapiens
gaacactattttcagaa

SEQ ID NO: 6190654 - DNA, 18 bp, Homo sapiens
gaacactattttcagaat

SEQ ID NO: 6190655 - DNA, 17 bp, Homo sapiens
gaacactcatgctgaaa

SEQ ID NO: 6190656 - DNA, 16 bp, Homo sapiens
gaacactccttcacag

SEQ ID NO: 6190657 - DNA, 15 bp, Homo sapiens
gaacactctataaca

SEQ ID NO: 6190658 - DNA, 13 bp, Homo sapiens
gaacactctgaga

SEQ ID NO: 6190659 - DNA, 16 bp, Homo sapiens
gaacactcttttgctt

SEQ ID NO: 6190660 - DNA, 22 bp, Homo sapiens
gaacactgagaaagaggcaggg

SEQ ID NO: 6190661 - DNA, 13 bp, Homo sapiens
gaacactgccctc

SEQ ID NO: 6190662 - DNA, 21 bp, Homo sapiens
gaacactgccctcgcacggcc

SEQ ID NO: 6190663 - DNA, 16 bp, Homo sapiens
gaacactgcctctgag

SEQ ID NO: 6190664 - DNA, 22 bp, Homo sapiens
gaacactggacaacattttact

SEQ ID NO: 6190665 - DNA, 13 bp, Homo sapiens
gaacactggggac

SEQ ID NO: 6190666 - DNA, 22 bp, Homo sapiens
gaacactggggacttggcctct

SEQ ID NO: 6190667 - DNA, 16 bp, Homo sapiens
gaacactgggggaggg

SEQ ID NO: 6190668 - DNA, 20 bp, Homo sapiens
gaacactgtagctacatttt

SEQ ID NO: 6190669 - DNA, 17 bp, Homo sapiens
gaacacttagtgatcat

SEQ ID NO: 6190670 - DNA, 21 bp, Homo sapiens
gaacacttcagacacaggaaa

SEQ ID NO: 6190671 - DNA, 20 bp, Homo sapiens
gaacacttcagcctgtgcag

SEQ ID NO: 6190672 - DNA, 22 bp, Homo sapiens
gaacactttcagtttcaggagt

SEQ ID NO: 6190673 - DNA, 15 bp, Homo sapiens
gaacacttttaataa

SEQ ID NO: 6190674 - DNA, 21 bp, Homo sapiens
gaacagaaaacaacaaaagaa

SEQ ID NO: 6190675 - DNA, 16 bp, Homo sapiens
gaacagaaatatataa

SEQ ID NO: 6190676 - DNA, 13 bp, Homo sapiens
gaacagaagaaaa

SEQ ID NO: 6190677 - DNA, 14 bp, Homo sapiens
gaacagaatgtttt

SEQ ID NO: 6190678 - DNA, 17 bp, Homo sapiens
gaacagacaacagaagt

SEQ ID NO: 6190679 - DNA, 18 bp, Homo sapiens
gaacagacaacagaagtc

SEQ ID NO: 6190680 - DNA, 17 bp, Homo sapiens
gaacagacaggagaaat

SEQ ID NO: 6190681 - DNA, 19 bp, Homo sapiens
gaacagaccggagaggaca

SEQ ID NO: 6190682 - DNA, 19 bp, Homo sapiens
gaacagactggaagcacag

SEQ ID NO: 6190683 - DNA, 22 bp, Homo sapiens
gaacagagactctggaagcccc

SEQ ID NO: 6190684 - DNA, 23 bp, Homo sapiens
gaacagagcgggcctcttccctc

SEQ ID NO: 6190685 - DNA, 17 bp, Homo sapiens
gaacagaggcatttaaa

SEQ ID NO: 6190686 - DNA, 19 bp, Homo sapiens
gaacagagggccagagcta

SEQ ID NO: 6190687 - DNA, 13 bp, Homo sapiens
gaacagagtatat

SEQ ID NO: 6190688 - DNA, 17 bp, Homo sapiens
gaacagagtatatatgt

SEQ ID NO: 6190689 - DNA, 21 bp, Homo sapiens
gaacagagtatatatgtacag

SEQ ID NO: 6190690 - DNA, 19 bp, Homo sapiens
gaacagagtgcaacccagt

SEQ ID NO: 6190691 - DNA, 18 bp, Homo sapiens
gaacagatctccaaagct

SEQ ID NO: 6190692 - DNA, 19 bp, Homo sapiens
gaacagatgctgagccata

SEQ ID NO: 6190693 - DNA, 16 bp, Homo sapiens
gaacagatggctgtga

SEQ ID NO: 6190694 - DNA, 17 bp, Homo sapiens
gaacagatggctgtgaa

SEQ ID NO: 6190695 - DNA, 14 bp, Homo sapiens
gaacagatgtaaat

SEQ ID NO: 6190696 - DNA, 15 bp, Homo sapiens
gaacagatgtaaatc

SEQ ID NO: 6190697 - DNA, 12 bp, Homo sapiens
gaacagatttta

SEQ ID NO: 6190698 - DNA, 16 bp, Homo sapiens
gaacagcaggatgccc

SEQ ID NO: 6190699 - DNA, 17 bp, Homo sapiens
gaacagcaggatgccct

SEQ ID NO: 6190700 - DNA, 19 bp, Homo sapiens
gaacagcaggatgccctgt

SEQ ID NO: 6190701 - DNA, 20 bp, Homo sapiens
gaacagcaggatgccctgtt

SEQ ID NO: 6190702 - DNA, 17 bp, Homo sapiens
gaacagccaaagaaact

SEQ ID NO: 6190703 - DNA, 18 bp, Homo sapiens
gaacagccaaagaaactc

SEQ ID NO: 6190704 - DNA, 23 bp, Homo sapiens
gaacagccaaatgcatggtgcag

SEQ ID NO: 6190705 - DNA, 15 bp, Homo sapiens
gaacagccacaaaat

SEQ ID NO: 6190706 - DNA, 24 bp, Homo sapiens
gaacagccctcggcctccgaggct

SEQ ID NO: 6190707 - DNA, 22 bp, Homo sapiens
gaacagccctctctctcactcc

SEQ ID NO: 6190708 - DNA, 15 bp, Homo sapiens
gaacagcctgagccg

SEQ ID NO: 6190709 - DNA, 16 bp, Homo sapiens
gaacagcctgcctgtc

SEQ ID NO: 6190710 - DNA, 14 bp, Homo sapiens
gaacagccttagag

SEQ ID NO: 6190711 - DNA, 18 bp, Homo sapiens
gaacagccttagagctct

SEQ ID NO: 6190712 - DNA, 19 bp, Homo sapiens
gaacagctaacaataaagt

SEQ ID NO: 6190713 - DNA, 18 bp, Homo sapiens
gaacagctcatcttcaaa

SEQ ID NO: 6190714 - DNA, 18 bp, Homo sapiens
gaacagctcctcctcttg

SEQ ID NO: 6190715 - DNA, 22 bp, Homo sapiens
gaacagctcttcactcagccac

SEQ ID NO: 6190716 - DNA, 12 bp, Homo sapiens
gaacagctggtg

SEQ ID NO: 6190717 - DNA, 14 bp, Homo sapiens
gaacagctggtgcc

SEQ ID NO: 6190718 - DNA, 20 bp, Homo sapiens
gaacagctggtgtagctaca

SEQ ID NO: 6190719 - DNA, 13 bp, Homo sapiens
gaacagctgtgag

SEQ ID NO: 6190720 - DNA, 16 bp, Homo sapiens
gaacagctgtgtctgc

SEQ ID NO: 6190721 - DNA, 13 bp, Homo sapiens
gaacagctgttcc

SEQ ID NO: 6190722 - DNA, 19 bp, Homo sapiens
gaacagctgttcctgtgtt

SEQ ID NO: 6190723 - DNA, 22 bp, Homo sapiens
gaacagctgttgactctagtac

SEQ ID NO: 6190724 - DNA, 15 bp, Homo sapiens
gaacagcttcaggtt

SEQ ID NO: 6190725 - DNA, 17 bp, Homo sapiens
gaacagcttgccaggga

SEQ ID NO: 6190726 - DNA, 12 bp, Homo sapiens
gaacaggaaaga

SEQ ID NO: 6190727 - DNA, 18 bp, Homo sapiens
gaacaggaatccttactg

SEQ ID NO: 6190728 - DNA, 21 bp, Homo sapiens
gaacaggaatccttactgata

SEQ ID NO: 6190729 - DNA, 11 bp, Homo sapiens
gaacaggagac

SEQ ID NO: 6190730 - DNA, 17 bp, Homo sapiens
gaacaggaggaactggt

SEQ ID NO: 6190731 - DNA, 19 bp, Homo sapiens
gaacaggaggaactggtcc

SEQ ID NO: 6190732 - DNA, 20 bp, Homo sapiens
gaacaggaggtgtgaatgca

SEQ ID NO: 6190733 - DNA, 17 bp, Homo sapiens
gaacaggagtgactctg

SEQ ID NO: 6190734 - DNA, 19 bp, Homo sapiens
gaacaggagtgactctggc

SEQ ID NO: 6190735 - DNA, 20 bp, Homo sapiens
gaacaggagtgactctggct

SEQ ID NO: 6190736 - DNA, 15 bp, Homo sapiens
gaacaggctggttct

SEQ ID NO: 6190737 - DNA, 14 bp, Homo sapiens
gaacagggaccagc

SEQ ID NO: 6190738 - DNA, 15 bp, Homo sapiens
gaacagggaccagct

SEQ ID NO: 6190739 - DNA, 18 bp, Homo sapiens
gaacagggaccagctccc

SEQ ID NO: 6190740 - DNA, 20 bp, Homo sapiens
gaacagggacttgtttagag

SEQ ID NO: 6190741 - DNA, 16 bp, Homo sapiens
gaacagggcaaaatga

SEQ ID NO: 6190742 - DNA, 20 bp, Homo sapiens
gaacagggcccaggcctgga

SEQ ID NO: 6190743 - DNA, 14 bp, Homo sapiens
gaacaggtggatgt

SEQ ID NO: 6190744 - DNA, 16 bp, Homo sapiens
gaacaggtggttttta

SEQ ID NO: 6190745 - DNA, 16 bp, Homo sapiens
gaacaggtgttcctcc

SEQ ID NO: 6190746 - DNA, 21 bp, Homo sapiens
gaacaggttcttaaaaaggaa

SEQ ID NO: 6190747 - DNA, 15 bp, Homo sapiens
gaacagtaaaatcca

SEQ ID NO: 6190748 - DNA, 21 bp, Homo sapiens
gaacagtaaagaaagcagaat

SEQ ID NO: 6190749 - DNA, 22 bp, Homo sapiens
gaacagtaacatagctgtgatt

SEQ ID NO: 6190750 - DNA, 19 bp, Homo sapiens
gaacagtattgggcaggag

SEQ ID NO: 6190751 - DNA, 21 bp, Homo sapiens
gaacagtattgggcaggagga

SEQ ID NO: 6190752 - DNA, 19 bp, Homo sapiens
gaacagtcacccttctggg

SEQ ID NO: 6190753 - DNA, 19 bp, Homo sapiens
gaacagtcacgcctgaaac

SEQ ID NO: 6190754 - DNA, 22 bp, Homo sapiens
gaacagtcacgcctgaaacttt

SEQ ID NO: 6190755 - DNA, 17 bp, Homo sapiens
gaacagtcatgtatgca

SEQ ID NO: 6190756 - DNA, 20 bp, Homo sapiens
gaacagtcatgtatgcaagt

SEQ ID NO: 6190757 - DNA, 16 bp, Homo sapiens
gaacagtgattaccag

SEQ ID NO: 6190758 - DNA, 17 bp, Homo sapiens
gaacagtggctgggtgg

SEQ ID NO: 6190759 - DNA, 15 bp, Homo sapiens
gaacagtggttgcct

SEQ ID NO: 6190760 - DNA, 17 bp, Homo sapiens
gaacagtgtgcaaggca

SEQ ID NO: 6190761 - DNA, 21 bp, Homo sapiens
gaacagtgttgaaattggaaa

SEQ ID NO: 6190762 - DNA, 17 bp, Homo sapiens
gaacagtgtttcccata

SEQ ID NO: 6190763 - DNA, 21 bp, Homo sapiens
gaacagttaagcagccgccac

SEQ ID NO: 6190764 - DNA, 22 bp, Homo sapiens
gaacagttgtgtttgaagcaca

SEQ ID NO: 6190765 - DNA, 15 bp, Homo sapiens
gaacagtttggatgt

SEQ ID NO: 6190766 - DNA, 23 bp, Homo sapiens
gaacagtttggggactcaggacc

SEQ ID NO: 6190767 - DNA, 18 bp, Homo sapiens
gaacataaaccctccaag

SEQ ID NO: 6190768 - DNA, 22 bp, Homo sapiens
gaacataacttctcatgtatat

SEQ ID NO: 6190769 - DNA, 16 bp, Homo sapiens
gaacataattcttatt

SEQ ID NO: 6190770 - DNA, 13 bp, Homo sapiens
gaacatacaaatg

SEQ ID NO: 6190771 - DNA, 23 bp, Homo sapiens
gaacatacaaatgcatctttgat

SEQ ID NO: 6190772 - DNA, 22 bp, Homo sapiens
gaacataccccttacaaatgaa

SEQ ID NO: 6190773 - DNA, 17 bp, Homo sapiens
gaacataggaattttgt

SEQ ID NO: 6190774 - DNA, 16 bp, Homo sapiens
gaacatagttttcacc

SEQ ID NO: 6190775 - DNA, 21 bp, Homo sapiens
gaacatatcatttgtgaagaa

SEQ ID NO: 6190776 - DNA, 18 bp, Homo sapiens
gaacatatgcacagggga

SEQ ID NO: 6190777 - DNA, 15 bp, Homo sapiens
gaacatatgttgcaa

SEQ ID NO: 6190778 - DNA, 16 bp, Homo sapiens
gaacatcccgcttctg

SEQ ID NO: 6190779 - DNA, 15 bp, Homo sapiens
gaacatccctgccag

SEQ ID NO: 6190780 - DNA, 21 bp, Homo sapiens
gaacatccgttgaatgagtgt

SEQ ID NO: 6190781 - DNA, 13 bp, Homo sapiens
gaacatcctgctg

SEQ ID NO: 6190782 - DNA, 22 bp, Homo sapiens
gaacatccttaaatgtctaaca

SEQ ID NO: 6190783 - DNA, 19 bp, Homo sapiens
gaacatccttccttcccac

SEQ ID NO: 6190784 - DNA, 19 bp, Homo sapiens
gaacatcctttgcagggca

SEQ ID NO: 6190785 - DNA, 22 bp, Homo sapiens
gaacatcctttgcagggcagcc

SEQ ID NO: 6190786 - DNA, 23 bp, Homo sapiens
gaacatcctttgcagggcagccc

SEQ ID NO: 6190787 - DNA, 22 bp, Homo sapiens
gaacatctcactttgccccagt

SEQ ID NO: 6190788 - DNA, 17 bp, Homo sapiens
gaacatctctgttattt

SEQ ID NO: 6190789 - DNA, 17 bp, Homo sapiens
gaacatctgagtcctgg

SEQ ID NO: 6190790 - DNA, 18 bp, Homo sapiens
gaacatcttcatataaac

SEQ ID NO: 6190791 - DNA, 20 bp, Homo sapiens
gaacatctttgacactctgc

SEQ ID NO: 6190792 - DNA, 23 bp, Homo sapiens
gaacatgaaaacagaaaacggtt

SEQ ID NO: 6190793 - DNA, 15 bp, Homo sapiens
gaacatgattttaca

SEQ ID NO: 6190794 - DNA, 14 bp, Homo sapiens
ctgtgtgttaaaat

SEQ ID NO: 6190795 - DNA, 12 bp, Homo sapiens
ctgtgtgttagt

SEQ ID NO: 6190796 - DNA, 18 bp, Homo sapiens
ctgtgtgttagttcccaa

SEQ ID NO: 6190797 - DNA, 15 bp, Homo sapiens
ctgtgtgttcttttg

SEQ ID NO: 6190798 - DNA, 18 bp, Homo sapiens
ctgtgtgttcttttgata

SEQ ID NO: 6190799 - DNA, 19 bp, Homo sapiens
ctgtgtgttcttttgatac

SEQ ID NO: 6190800 - DNA, 15 bp, Homo sapiens
ctgtgtgttgacact

SEQ ID NO: 6190801 - DNA, 22 bp, Homo sapiens
ctgtgtgttgccacaggacaca

SEQ ID NO: 6190802 - DNA, 19 bp, Homo sapiens
ctgtgtgttgccaggcagg

SEQ ID NO: 6190803 - DNA, 20 bp, Homo sapiens
ctgtgtgtttatgtgtgtgt

SEQ ID NO: 6190804 - DNA, 14 bp, Homo sapiens
ctgtgtgtttgaca

SEQ ID NO: 6190805 - DNA, 19 bp, Homo sapiens
ctgtgtgtttgacatgtga

SEQ ID NO: 6190806 - DNA, 22 bp, Homo sapiens
ctgtgtgtttgtgtgtatctgt

SEQ ID NO: 6190807 - DNA, 15 bp, Homo sapiens
ctgtgtgttttccca

SEQ ID NO: 6190808 - DNA, 16 bp, Homo sapiens
ctgtgttaaaatggtt

SEQ ID NO: 6190809 - DNA, 14 bp, Homo sapiens
ctgtgttaaaattt

SEQ ID NO: 6190810 - DNA, 15 bp, Homo sapiens
ctgtgttaagaggac

SEQ ID NO: 6190811 - DNA, 15 bp, Homo sapiens
ctgtgttaattgcgt

SEQ ID NO: 6190812 - DNA, 23 bp, Homo sapiens
ctgtgttaattgcgtagaggcta

SEQ ID NO: 6190813 - DNA, 21 bp, Homo sapiens
ctgtgttaatttaagttttga

SEQ ID NO: 6190814 - DNA, 21 bp, Homo sapiens
ctgtgttactaatgatcactc

SEQ ID NO: 6190815 - DNA, 22 bp, Homo sapiens
ctgtgttactaatgatcactct

SEQ ID NO: 6190816 - DNA, 20 bp, Homo sapiens
ctgtgttagtgtctgtccat

SEQ ID NO: 6190817 - DNA, 16 bp, Homo sapiens
ctgtgttatgaaaata

SEQ ID NO: 6190818 - DNA, 21 bp, Homo sapiens
ctgtgttattatagagcagaa

SEQ ID NO: 6190819 - DNA, 23 bp, Homo sapiens
ctgtgttcatttggtgttcctgg

SEQ ID NO: 6190820 - DNA, 18 bp, Homo sapiens
ctgtgttcgggggagcag

SEQ ID NO: 6190821 - DNA, 17 bp, Homo sapiens
ctgtgttctaacttatt

SEQ ID NO: 6190822 - DNA, 14 bp, Homo sapiens
ctgtgttctgggct

SEQ ID NO: 6190823 - DNA, 18 bp, Homo sapiens
ctgtgttctgggctgggg

SEQ ID NO: 6190824 - DNA, 14 bp, Homo sapiens
ctgtgttcttgctg

SEQ ID NO: 6190825 - DNA, 15 bp, Homo sapiens
ctgtgttcttgctga

SEQ ID NO: 6190826 - DNA, 14 bp, Homo sapiens
ctgtgttctttccc

SEQ ID NO: 6190827 - DNA, 11 bp, Homo sapiens
ctgtgttgaaa

SEQ ID NO: 6190828 - DNA, 18 bp, Homo sapiens
ctgtgttgaaatatagtt

SEQ ID NO: 6190829 - DNA, 22 bp, Homo sapiens
ctgtgttgactgctgctcccca

SEQ ID NO: 6190830 - DNA, 14 bp, Homo sapiens
ctgtgttgccaagc

SEQ ID NO: 6190831 - DNA, 13 bp, Homo sapiens
ctgtgttgccaca

SEQ ID NO: 6190832 - DNA, 23 bp, Homo sapiens
ctgtgttgccacagtagaactgt

SEQ ID NO: 6190833 - DNA, 13 bp, Homo sapiens
ctgtgttgcccag

SEQ ID NO: 6190834 - DNA, 19 bp, Homo sapiens
ctgtgttgcccaggctggt

SEQ ID NO: 6190835 - DNA, 14 bp, Homo sapiens
ctgtgttgctgttt

SEQ ID NO: 6190836 - DNA, 17 bp, Homo sapiens
ctgtgttgctgtttaga

SEQ ID NO: 6190837 - DNA, 14 bp, Homo sapiens
ctgtgttgggcaag

SEQ ID NO: 6190838 - DNA, 19 bp, Homo sapiens
ctgtgttggggggcaaggt

SEQ ID NO: 6190839 - DNA, 21 bp, Homo sapiens
ctgtgttgtaccaaaattcat

SEQ ID NO: 6190840 - DNA, 13 bp, Homo sapiens
ctgtgttgtatta

SEQ ID NO: 6190841 - DNA, 19 bp, Homo sapiens
ctgtgttgtattaacaaaa

SEQ ID NO: 6190842 - DNA, 16 bp, Homo sapiens
ctgtgttgtcccatct

SEQ ID NO: 6190843 - DNA, 19 bp, Homo sapiens
ctgtgttgtctctagagca

SEQ ID NO: 6190844 - DNA, 14 bp, Homo sapiens
ctgtgttgttcata

SEQ ID NO: 6190845 - DNA, 23 bp, Homo sapiens
ctgtgttgttgcttcttgtgaag

SEQ ID NO: 6190846 - DNA, 13 bp, Homo sapiens
ctgtgtttaaaaa

SEQ ID NO: 6190847 - DNA, 19 bp, Homo sapiens
ctgtgtttaaaaagtaagt

SEQ ID NO: 6190848 - DNA, 20 bp, Homo sapiens
ctgtgtttaactgctgcagg

SEQ ID NO: 6190849 - DNA, 14 bp, Homo sapiens
ctgtgtttacagac

SEQ ID NO: 6190850 - DNA, 20 bp, Homo sapiens
ctgtgtttacagacagaaga

SEQ ID NO: 6190851 - DNA, 13 bp, Homo sapiens
ctgtgtttagttg

SEQ ID NO: 6190852 - DNA, 17 bp, Homo sapiens
ctgtgtttataaaatat

SEQ ID NO: 6190853 - DNA, 16 bp, Homo sapiens
ctgtgtttcaaacctg

SEQ ID NO: 6190854 - DNA, 19 bp, Homo sapiens
ctgtgtttcaagtggggct

SEQ ID NO: 6190855 - DNA, 21 bp, Homo sapiens
ctgtgtttcacttaatgtttc

SEQ ID NO: 6190856 - DNA, 18 bp, Homo sapiens
ctgtgtttccctgcctct

SEQ ID NO: 6190857 - DNA, 23 bp, Homo sapiens
ctgtgtttcgcattaagcacaca

SEQ ID NO: 6190858 - DNA, 23 bp, Homo sapiens
ctgtgtttctagttgcattttca

SEQ ID NO: 6190859 - DNA, 13 bp, Homo sapiens
ctgtgtttctgga

SEQ ID NO: 6190860 - DNA, 17 bp, Homo sapiens
ctgtgtttctgtgctcc

SEQ ID NO: 6190861 - DNA, 13 bp, Homo sapiens
ctgtgtttcttgc

SEQ ID NO: 6190862 - DNA, 15 bp, Homo sapiens
ctgtgtttgaagttt

SEQ ID NO: 6190863 - DNA, 22 bp, Homo sapiens
ctgtgtttgatatttgtgtaaa

SEQ ID NO: 6190864 - DNA, 19 bp, Homo sapiens
ctgtgtttgatttgtctca

SEQ ID NO: 6190865 - DNA, 16 bp, Homo sapiens
ctgtgtttggctttca

SEQ ID NO: 6190866 - DNA, 18 bp, Homo sapiens
ctgtgtttggctttcagg

SEQ ID NO: 6190867 - DNA, 17 bp, Homo sapiens
ctgtgtttgtcctgggt

SEQ ID NO: 6190868 - DNA, 13 bp, Homo sapiens
ctgtgttttaata

SEQ ID NO: 6190869 - DNA, 17 bp, Homo sapiens
ctgtgttttcacgcagg

SEQ ID NO: 6190870 - DNA, 20 bp, Homo sapiens
ctgtgttttcagactgcctg

SEQ ID NO: 6190871 - DNA, 22 bp, Homo sapiens
ctgtgttttgaatggtgttgta

SEQ ID NO: 6190872 - DNA, 21 bp, Homo sapiens
ctgtgtttttttttttttccc

SEQ ID NO: 6190873 - DNA, 19 bp, Homo sapiens
ctgttaaaaaagaaatctg

SEQ ID NO: 6190874 - DNA, 20 bp, Homo sapiens
ctgttaaaagatgaaaatat

SEQ ID NO: 6190875 - DNA, 15 bp, Homo sapiens
ctgttaaaatacata

SEQ ID NO: 6190876 - DNA, 15 bp, Homo sapiens
ctgttaaaatcagga

SEQ ID NO: 6190877 - DNA, 19 bp, Homo sapiens
ctgttaaaatctattctgt

SEQ ID NO: 6190878 - DNA, 11 bp, Homo sapiens
ctgttaaaatg

SEQ ID NO: 6190879 - DNA, 17 bp, Homo sapiens
ctgttaaaatgtacact

SEQ ID NO: 6190880 - DNA, 13 bp, Homo sapiens
ctgttaaacagta

SEQ ID NO: 6190881 - DNA, 12 bp, Homo sapiens
ctgttaaactgt

SEQ ID NO: 6190882 - DNA, 17 bp, Homo sapiens
ctgttaaaggtcatatg

SEQ ID NO: 6190883 - DNA, 11 bp, Homo sapiens
ctgttaaatac

SEQ ID NO: 6190884 - DNA, 20 bp, Homo sapiens
ctgttaaattgctgtgtatc

SEQ ID NO: 6190885 - DNA, 15 bp, Homo sapiens
ctgttaaattttctc

SEQ ID NO: 6190886 - DNA, 13 bp, Homo sapiens
ctgttaaccattt

SEQ ID NO: 6190887 - DNA, 18 bp, Homo sapiens
ctgttaacgtcatctcag

SEQ ID NO: 6190888 - DNA, 21 bp, Homo sapiens
ctgttaactagtgtttctgca

SEQ ID NO: 6190889 - DNA, 13 bp, Homo sapiens
ctgttaactgaat

SEQ ID NO: 6190890 - DNA, 18 bp, Homo sapiens
ctgttaactgaataccac

SEQ ID NO: 6190891 - DNA, 19 bp, Homo sapiens
ctgttaactgaataccact

SEQ ID NO: 6190892 - DNA, 15 bp, Homo sapiens
ctgttaacttattca

SEQ ID NO: 6190893 - DNA, 13 bp, Homo sapiens
ctgttaagaaagg

SEQ ID NO: 6190894 - DNA, 22 bp, Homo sapiens
ctgttaagaaaggatataaaag

SEQ ID NO: 6190895 - DNA, 23 bp, Homo sapiens
ctgttaagaaaggatataaaagg

SEQ ID NO: 6190896 - DNA, 18 bp, Homo sapiens
ctgttaagaataataaaa

SEQ ID NO: 6190897 - DNA, 23 bp, Homo sapiens
ctgttaaggacccttttaagcat

SEQ ID NO: 6190898 - DNA, 21 bp, Homo sapiens
ctgttaaggcatccacttcac

SEQ ID NO: 6190899 - DNA, 17 bp, Homo sapiens
ctgttaagggaagctga

SEQ ID NO: 6190900 - DNA, 17 bp, Homo sapiens
ctgttaaggttgaactt

SEQ ID NO: 6190901 - DNA, 19 bp, Homo sapiens
ctgttaaggttgaactttg

SEQ ID NO: 6190902 - DNA, 20 bp, Homo sapiens
ctgttaagtaaaatgtcata

SEQ ID NO: 6190903 - DNA, 14 bp, Homo sapiens
ctgttaagtctgag

SEQ ID NO: 6190904 - DNA, 20 bp, Homo sapiens
ctgttaatcatgggttcctc

SEQ ID NO: 6190905 - DNA, 20 bp, Homo sapiens
ctgttaatgcattctttctt

SEQ ID NO: 6190906 - DNA, 19 bp, Homo sapiens
ctgttaatgtatttgttca

SEQ ID NO: 6190907 - DNA, 13 bp, Homo sapiens
ctgttacaaaaga

SEQ ID NO: 6190908 - DNA, 17 bp, Homo sapiens
ctgttacaaaagaaaaa

SEQ ID NO: 6190909 - DNA, 13 bp, Homo sapiens
ctgttacaaaatg

SEQ ID NO: 6190910 - DNA, 22 bp, Homo sapiens
ctgttacaacttgtatttccaa

SEQ ID NO: 6190911 - DNA, 19 bp, Homo sapiens
ctgttacacgtgcctgtag

SEQ ID NO: 6190912 - DNA, 14 bp, Homo sapiens
ctgttacactgggc

SEQ ID NO: 6190913 - DNA, 16 bp, Homo sapiens
ctgttacactgggctg

SEQ ID NO: 6190914 - DNA, 17 bp, Homo sapiens
ctgttacagactgaaag

SEQ ID NO: 6190915 - DNA, 20 bp, Homo sapiens
ctgttacagtaatgtcataa

SEQ ID NO: 6190916 - DNA, 21 bp, Homo sapiens
ctgttacataacaagaaaatc

SEQ ID NO: 6190917 - DNA, 23 bp, Homo sapiens
ctgttacataacaagaaaatcaa

SEQ ID NO: 6190918 - DNA, 18 bp, Homo sapiens
ctgttaccaaatctcagt

SEQ ID NO: 6190919 - DNA, 22 bp, Homo sapiens
ctgttaccattggaaatttcac

SEQ ID NO: 6190920 - DNA, 18 bp, Homo sapiens
ctgttacccagagaatat

SEQ ID NO: 6190921 - DNA, 22 bp, Homo sapiens
ctgttacccagggtggagtgca

SEQ ID NO: 6190922 - DNA, 16 bp, Homo sapiens
ctgttaccgcctgtct

SEQ ID NO: 6190923 - DNA, 17 bp, Homo sapiens
ctgttacctgtcttgct

SEQ ID NO: 6190924 - DNA, 19 bp, Homo sapiens
ctgttactattatctgtgc

SEQ ID NO: 6190925 - DNA, 20 bp, Homo sapiens
ctgttactcaatgtgtgccg

SEQ ID NO: 6190926 - DNA, 15 bp, Homo sapiens
ctgttactccaaaaa

SEQ ID NO: 6190927 - DNA, 24 bp, Homo sapiens
ctgttactccattactgtgatttc

SEQ ID NO: 6190928 - DNA, 23 bp, Homo sapiens
ctgttactctaaatagaaatata

SEQ ID NO: 6190929 - DNA, 17 bp, Homo sapiens
ctgttactgcttctctt

SEQ ID NO: 6190930 - DNA, 21 bp, Homo sapiens
ctgttacttgaaataccagtg

SEQ ID NO: 6190931 - DNA, 12 bp, Homo sapiens
ctgttacttttt

SEQ ID NO: 6190932 - DNA, 17 bp, Homo sapiens
ctgttagaacactattt

SEQ ID NO: 6190933 - DNA, 22 bp, Homo sapiens
ctgttagaacactattttcaga

SEQ ID NO: 6190934 - DNA, 15 bp, Homo sapiens
ctgttagaatatgtt

SEQ ID NO: 6190935 - DNA, 20 bp, Homo sapiens
ctgttagatgctactaagaa

SEQ ID NO: 6190936 - DNA, 13 bp, Homo sapiens
ctgttagcactgt

SEQ ID NO: 6190937 - DNA, 17 bp, Homo sapiens
ctgttagcactgttgat

SEQ ID NO: 6190938 - DNA, 14 bp, Homo sapiens
ctgttagcagagtc

SEQ ID NO: 6190939 - DNA, 19 bp, Homo sapiens
ctgttagcagagtctgtct

SEQ ID NO: 6190940 - DNA, 12 bp, Homo sapiens
ctgttagccagg

SEQ ID NO: 6190941 - DNA, 23 bp, Homo sapiens
ctgttagctccctgtggggcagg

SEQ ID NO: 6190942 - DNA, 13 bp, Homo sapiens
ctgttagctttcc

SEQ ID NO: 6190943 - DNA, 23 bp, Homo sapiens
ctgttagctttccaaggaagcag

SEQ ID NO: 6190944 - DNA, 19 bp, Homo sapiens
ctgttagctttttaaaaca

SEQ ID NO: 6190945 - DNA, 21 bp, Homo sapiens
ctgttagctttttaaaacatt

SEQ ID NO: 6190946 - DNA, 15 bp, Homo sapiens
ctgttaggaacagca

SEQ ID NO: 6190947 - DNA, 17 bp, Homo sapiens
ctgttaggaacagcagt

SEQ ID NO: 6190948 - DNA, 18 bp, Homo sapiens
ctgttaggagaagctgca

SEQ ID NO: 6190949 - DNA, 18 bp, Homo sapiens
ctgttaggccaactgcct

SEQ ID NO: 6190950 - DNA, 20 bp, Homo sapiens
ctgttaggccaactgcctcc

SEQ ID NO: 6190951 - DNA, 22 bp, Homo sapiens
ctgttaggccaactgcctcctt

SEQ ID NO: 6190952 - DNA, 19 bp, Homo sapiens
ctgttagggacatttccaa

SEQ ID NO: 6190953 - DNA, 23 bp, Homo sapiens
ctgttagggacatttccaagctg

SEQ ID NO: 6190954 - DNA, 19 bp, Homo sapiens
ctgttaggggccaataaaa

SEQ ID NO: 6190955 - DNA, 22 bp, Homo sapiens
ctgttaggggccaataaaatgt

SEQ ID NO: 6190956 - DNA, 23 bp, Homo sapiens
ctgttaggggccaataaaatgta

SEQ ID NO: 6190957 - DNA, 12 bp, Homo sapiens
ctgttagtaaat

SEQ ID NO: 6190958 - DNA, 18 bp, Homo sapiens
ctgttagtagcagaaata

SEQ ID NO: 6190959 - DNA, 17 bp, Homo sapiens
ctgttagtattaactat

SEQ ID NO: 6190960 - DNA, 17 bp, Homo sapiens
ctgttagtattgattca

SEQ ID NO: 6190961 - DNA, 13 bp, Homo sapiens
ctgttagtcattt

SEQ ID NO: 6190962 - DNA, 14 bp, Homo sapiens
ctgttagtcatttg

SEQ ID NO: 6190963 - DNA, 15 bp, Homo sapiens
ctgttagtcatttgc

SEQ ID NO: 6190964 - DNA, 21 bp, Homo sapiens
ctgttagtgacagagcccagc

SEQ ID NO: 6190965 - DNA, 13 bp, Homo sapiens
ctgttataaattt

SEQ ID NO: 6190966 - DNA, 17 bp, Homo sapiens
ctgttataaattttgta

SEQ ID NO: 6190967 - DNA, 23 bp, Homo sapiens
ctgttataaattttgtacatttt

SEQ ID NO: 6190968 - DNA, 17 bp, Homo sapiens
ctgttatatctaaattt

SEQ ID NO: 6190969 - DNA, 19 bp, Homo sapiens
ctgttatcaaaactttctt

SEQ ID NO: 6190970 - DNA, 18 bp, Homo sapiens
ctgttatcaaactgctgt

SEQ ID NO: 6190971 - DNA, 21 bp, Homo sapiens
ctgttatcattttttcctgtt

SEQ ID NO: 6190972 - DNA, 23 bp, Homo sapiens
gaacatgcagttcattattttgt

SEQ ID NO: 6190973 - DNA, 22 bp, Homo sapiens
gaacatgcagtttgaaattctg

SEQ ID NO: 6190974 - DNA, 17 bp, Homo sapiens
gaacatgcataagaaat

SEQ ID NO: 6190975 - DNA, 20 bp, Homo sapiens
gaacatgccctcagctaagc

SEQ ID NO: 6190976 - DNA, 21 bp, Homo sapiens
gaacatgcctcctcctgccct

SEQ ID NO: 6190977 - DNA, 19 bp, Homo sapiens
gaacatgcctgattttaaa

SEQ ID NO: 6190978 - DNA, 22 bp, Homo sapiens
gaacatgctggaaataaaacag

SEQ ID NO: 6190979 - DNA, 17 bp, Homo sapiens
gaacatggaattttata

SEQ ID NO: 6190980 - DNA, 17 bp, Homo sapiens
gaacatggacttgtata

SEQ ID NO: 6190981 - DNA, 15 bp, Homo sapiens
gaacatggagagcta

SEQ ID NO: 6190982 - DNA, 19 bp, Homo sapiens
gaacatggcctaagggcca

SEQ ID NO: 6190983 - DNA, 23 bp, Homo sapiens
gaacatggctagcctttcttgta

SEQ ID NO: 6190984 - DNA, 14 bp, Homo sapiens
gaacatggctggcc

SEQ ID NO: 6190985 - DNA, 15 bp, Homo sapiens
gaacatggctggcct

SEQ ID NO: 6190986 - DNA, 20 bp, Homo sapiens
gaacatgggggaacaatgag

SEQ ID NO: 6190987 - DNA, 22 bp, Homo sapiens
gaacatggtgtgtgtctctgac

SEQ ID NO: 6190988 - DNA, 18 bp, Homo sapiens
gaacatggtttgactcat

SEQ ID NO: 6190989 - DNA, 16 bp, Homo sapiens
gaacatgtaaaatgtt

SEQ ID NO: 6190990 - DNA, 20 bp, Homo sapiens
gaacatgtcggagtagaaat

SEQ ID NO: 6190991 - DNA, 19 bp, Homo sapiens
gaacatgtgagaggtttga

SEQ ID NO: 6190992 - DNA, 13 bp, Homo sapiens
gaacatgtgcttc

SEQ ID NO: 6190993 - DNA, 14 bp, Homo sapiens
gaacatgtgcttca

SEQ ID NO: 6190994 - DNA, 19 bp, Homo sapiens
gaacatgtgggaggaagaa

SEQ ID NO: 6190995 - DNA, 21 bp, Homo sapiens
gaacatgtgttttcatcattt

SEQ ID NO: 6190996 - DNA, 23 bp, Homo sapiens
gaacatgtgttttcatcatttca

SEQ ID NO: 6190997 - DNA, 18 bp, Homo sapiens
gaacatgttacgtgtgca

SEQ ID NO: 6190998 - DNA, 23 bp, Homo sapiens
gaacatgtttacaggtttgaatt

SEQ ID NO: 6190999 - DNA, 14 bp, Homo sapiens
gaacattaggaatt

SEQ ID NO: 6191000 - DNA, 15 bp, Homo sapiens
gaacattaggaattg

SEQ ID NO: 6191001 - DNA, 21 bp, Homo sapiens
gaacattaggaattgtttata

SEQ ID NO: 6191002 - DNA, 21 bp, Homo sapiens
gaacattatcacaattccaga

SEQ ID NO: 6191003 - DNA, 18 bp, Homo sapiens
gaacattattcatctctc

SEQ ID NO: 6191004 - DNA, 15 bp, Homo sapiens
gaacattcacttttg

SEQ ID NO: 6191005 - DNA, 16 bp, Homo sapiens
gaacattcacttttgt

SEQ ID NO: 6191006 - DNA, 17 bp, Homo sapiens
gaacattcagctctgga

SEQ ID NO: 6191007 - DNA, 18 bp, Homo sapiens
gaacattccctggaattg

SEQ ID NO: 6191008 - DNA, 15 bp, Homo sapiens
gaacattctggatct

SEQ ID NO: 6191009 - DNA, 21 bp, Homo sapiens
gaacattgcatataacttata

SEQ ID NO: 6191010 - DNA, 17 bp, Homo sapiens
gaacattgccttcctcg

SEQ ID NO: 6191011 - DNA, 12 bp, Homo sapiens
gaacattggaat

SEQ ID NO: 6191012 - DNA, 19 bp, Homo sapiens
gaacattggagctgactgt

SEQ ID NO: 6191013 - DNA, 15 bp, Homo sapiens
gaacattgttctgaa

SEQ ID NO: 6191014 - DNA, 14 bp, Homo sapiens
gaacatttaaaatt

SEQ ID NO: 6191015 - DNA, 18 bp, Homo sapiens
gaacatttagtaccctgc

SEQ ID NO: 6191016 - DNA, 19 bp, Homo sapiens
gaacatttagtaccctgca

SEQ ID NO: 6191017 - DNA, 21 bp, Homo sapiens
gaacatttagtaccctgcagg

SEQ ID NO: 6191018 - DNA, 14 bp, Homo sapiens
gaacatttatatca

SEQ ID NO: 6191019 - DNA, 16 bp, Homo sapiens
gaacatttattttatg

SEQ ID NO: 6191020 - DNA, 21 bp, Homo sapiens
gaacatttattttatgagaaa

SEQ ID NO: 6191021 - DNA, 12 bp, Homo sapiens
gaacatttctca

SEQ ID NO: 6191022 - DNA, 16 bp, Homo sapiens
gaacatttctcatgtg

SEQ ID NO: 6191023 - DNA, 18 bp, Homo sapiens
gaacatttctcatgtgct

SEQ ID NO: 6191024 - DNA, 13 bp, Homo sapiens
gaacatttgcttt

SEQ ID NO: 6191025 - DNA, 18 bp, Homo sapiens
gaacatttgggagactga

SEQ ID NO: 6191026 - DNA, 12 bp, Homo sapiens
gaacattttact

SEQ ID NO: 6191027 - DNA, 15 bp, Homo sapiens
gaacattttactgtt

SEQ ID NO: 6191028 - DNA, 19 bp, Homo sapiens
gaacattttactgttgtac

SEQ ID NO: 6191029 - DNA, 15 bp, Homo sapiens
gaaccaaaaagagca

SEQ ID NO: 6191030 - DNA, 19 bp, Homo sapiens
gaaccaaaaatagaaatta

SEQ ID NO: 6191031 - DNA, 23 bp, Homo sapiens
gaaccaaaaatcccaccttccca

SEQ ID NO: 6191032 - DNA, 13 bp, Homo sapiens
gaaccaaaacttc

SEQ ID NO: 6191033 - DNA, 16 bp, Homo sapiens
gaaccaaaagatgcct

SEQ ID NO: 6191034 - DNA, 18 bp, Homo sapiens
gaaccaaaagatgccttg

SEQ ID NO: 6191035 - DNA, 13 bp, Homo sapiens
gaaccaaagctca

SEQ ID NO: 6191036 - DNA, 24 bp, Homo sapiens
gaaccaacaacctcaactgcctac

SEQ ID NO: 6191037 - DNA, 19 bp, Homo sapiens
gaaccaacaaggaaacttt

SEQ ID NO: 6191038 - DNA, 15 bp, Homo sapiens
gaaccaactgcctta

SEQ ID NO: 6191039 - DNA, 16 bp, Homo sapiens
gaaccaagatgtaaaa

SEQ ID NO: 6191040 - DNA, 15 bp, Homo sapiens
gaaccaagcttcaga

SEQ ID NO: 6191041 - DNA, 20 bp, Homo sapiens
gaaccaagcttcagagccta

SEQ ID NO: 6191042 - DNA, 23 bp, Homo sapiens
gaaccaagcttcagagcctagcc

SEQ ID NO: 6191043 - DNA, 15 bp, Homo sapiens
gaaccaaggcagcct

SEQ ID NO: 6191044 - DNA, 16 bp, Homo sapiens
gaaccaaggcagcctc

SEQ ID NO: 6191045 - DNA, 23 bp, Homo sapiens
gaaccaaggcagcctccagagcc

SEQ ID NO: 6191046 - DNA, 14 bp, Homo sapiens
gaaccaagggccct

SEQ ID NO: 6191047 - DNA, 17 bp, Homo sapiens
gaaccaagggccctcac

SEQ ID NO: 6191048 - DNA, 22 bp, Homo sapiens
gaaccaaggttttgaaatccca

SEQ ID NO: 6191049 - DNA, 23 bp, Homo sapiens
gaaccaagtggaccttgagacca

SEQ ID NO: 6191050 - DNA, 13 bp, Homo sapiens
gaaccaatagaaa

SEQ ID NO: 6191051 - DNA, 15 bp, Homo sapiens
gaaccacaagactgc

SEQ ID NO: 6191052 - DNA, 19 bp, Homo sapiens
gaaccacaagagatcagca

SEQ ID NO: 6191053 - DNA, 18 bp, Homo sapiens
gaaccacaagtgaatctt

SEQ ID NO: 6191054 - DNA, 16 bp, Homo sapiens
gaaccacagcagacac

SEQ ID NO: 6191055 - DNA, 22 bp, Homo sapiens
gaaccacagcggaggagctccg

SEQ ID NO: 6191056 - DNA, 18 bp, Homo sapiens
gaaccacagggccagagg

SEQ ID NO: 6191057 - DNA, 13 bp, Homo sapiens
gaaccacagtcat

SEQ ID NO: 6191058 - DNA, 21 bp, Homo sapiens
gaaccacatcttgctctgctg

SEQ ID NO: 6191059 - DNA, 16 bp, Homo sapiens
gaaccaccacacccag

SEQ ID NO: 6191060 - DNA, 21 bp, Homo sapiens
gaaccaccacacccagcccac

SEQ ID NO: 6191061 - DNA, 22 bp, Homo sapiens
gaaccaccacacccagcccact

SEQ ID NO: 6191062 - DNA, 15 bp, Homo sapiens
gaaccaccactgcct

SEQ ID NO: 6191063 - DNA, 15 bp, Homo sapiens
gaaccaccagcgttc

SEQ ID NO: 6191064 - DNA, 22 bp, Homo sapiens
gaaccaccagcgttcccttctc

SEQ ID NO: 6191065 - DNA, 15 bp, Homo sapiens
gaaccaccctttatt

SEQ ID NO: 6191066 - DNA, 22 bp, Homo sapiens
gaaccacggtgaaagtgctgct

SEQ ID NO: 6191067 - DNA, 12 bp, Homo sapiens
gaaccactgctt

SEQ ID NO: 6191068 - DNA, 21 bp, Homo sapiens
gaaccactgtgtactggagcc

SEQ ID NO: 6191069 - DNA, 16 bp, Homo sapiens
gaaccacttcctgcta

SEQ ID NO: 6191070 - DNA, 18 bp, Homo sapiens
gaaccacttgtagatttg

SEQ ID NO: 6191071 - DNA, 15 bp, Homo sapiens
gaaccactttcttat

SEQ ID NO: 6191072 - DNA, 19 bp, Homo sapiens
gaaccagagccatggactc

SEQ ID NO: 6191073 - DNA, 22 bp, Homo sapiens
gaaccagagggggcgtgcctgc

SEQ ID NO: 6191074 - DNA, 13 bp, Homo sapiens
gaaccagcactcc

SEQ ID NO: 6191075 - DNA, 23 bp, Homo sapiens
gaaccagcactccatcactgaga

SEQ ID NO: 6191076 - DNA, 14 bp, Homo sapiens
gaaccagcactccc

SEQ ID NO: 6191077 - DNA, 21 bp, Homo sapiens
gaaccagcactcccagggccc

SEQ ID NO: 6191078 - DNA, 22 bp, Homo sapiens
gaaccagcactcccagggcccg

SEQ ID NO: 6191079 - DNA, 23 bp, Homo sapiens
gaaccagcactcccagggcccga

SEQ ID NO: 6191080 - DNA, 15 bp, Homo sapiens
gaaccagcagaacag

SEQ ID NO: 6191081 - DNA, 20 bp, Homo sapiens
gaaccagcagaagccagagg

SEQ ID NO: 6191082 - DNA, 21 bp, Homo sapiens
gaaccagccaaccatcatgtg

SEQ ID NO: 6191083 - DNA, 17 bp, Homo sapiens
gaaccagcccagcctgc

SEQ ID NO: 6191084 - DNA, 18 bp, Homo sapiens
gaaccagcccagcctgcc

SEQ ID NO: 6191085 - DNA, 14 bp, Homo sapiens
gaaccagccctcca

SEQ ID NO: 6191086 - DNA, 15 bp, Homo sapiens
gaaccagccctccag

SEQ ID NO: 6191087 - DNA, 15 bp, Homo sapiens
gaaccagctcatctc

SEQ ID NO: 6191088 - DNA, 19 bp, Homo sapiens
gaaccagctcatctccaag

SEQ ID NO: 6191089 - DNA, 21 bp, Homo sapiens
gaaccaggaaatggaacccca

SEQ ID NO: 6191090 - DNA, 17 bp, Homo sapiens
gaaccaggagaagggct

SEQ ID NO: 6191091 - DNA, 23 bp, Homo sapiens
gaaccaggagaagggctggggcc

SEQ ID NO: 6191092 - DNA, 13 bp, Homo sapiens
gaaccaggagctg

SEQ ID NO: 6191093 - DNA, 18 bp, Homo sapiens
gaaccaggaggcctggga

SEQ ID NO: 6191094 - DNA, 20 bp, Homo sapiens
gaaccaggaggcctgggaga

SEQ ID NO: 6191095 - DNA, 22 bp, Homo sapiens
gaaccaggagggtaacagaaga

SEQ ID NO: 6191096 - DNA, 12 bp, Homo sapiens
gaaccaggccag

SEQ ID NO: 6191097 - DNA, 15 bp, Homo sapiens
gaaccaggccttctg

SEQ ID NO: 6191098 - DNA, 16 bp, Homo sapiens
gaaccaggccttctga

SEQ ID NO: 6191099 - DNA, 16 bp, Homo sapiens
gaaccaggctgctgca

SEQ ID NO: 6191100 - DNA, 19 bp, Homo sapiens
gaaccaggcttgcctggga

SEQ ID NO: 6191101 - DNA, 16 bp, Homo sapiens
gaaccagggaggagag

SEQ ID NO: 6191102 - DNA, 18 bp, Homo sapiens
gaaccagggctcttctca

SEQ ID NO: 6191103 - DNA, 16 bp, Homo sapiens
gaaccagtacctcagt

SEQ ID NO: 6191104 - DNA, 19 bp, Homo sapiens
gaaccagtccctctgagtg

SEQ ID NO: 6191105 - DNA, 20 bp, Homo sapiens
gaaccagtccctctgagtga

SEQ ID NO: 6191106 - DNA, 17 bp, Homo sapiens
gaaccagtcctgctgcc

SEQ ID NO: 6191107 - DNA, 20 bp, Homo sapiens
gaaccagtcctgctgcctgg

SEQ ID NO: 6191108 - DNA, 21 bp, Homo sapiens
gaaccagtcctgctgcctgga

SEQ ID NO: 6191109 - DNA, 20 bp, Homo sapiens
gaaccagtctcctcactctg

SEQ ID NO: 6191110 - DNA, 19 bp, Homo sapiens
gaaccagtcttttgaaaga

SEQ ID NO: 6191111 - DNA, 22 bp, Homo sapiens
gaaccagtgtaactggctgctc

SEQ ID NO: 6191112 - DNA, 17 bp, Homo sapiens
gaaccagttaagagaca

SEQ ID NO: 6191113 - DNA, 14 bp, Homo sapiens
gaaccataaaatgt

SEQ ID NO: 6191114 - DNA, 18 bp, Homo sapiens
gaaccataaaatgtccag

SEQ ID NO: 6191115 - DNA, 19 bp, Homo sapiens
gaaccataggactgtggca

SEQ ID NO: 6191116 - DNA, 12 bp, Homo sapiens
gaaccatcagaa

SEQ ID NO: 6191117 - DNA, 23 bp, Homo sapiens
gaaccatgctcttgttctgttcc

SEQ ID NO: 6191118 - DNA, 13 bp, Homo sapiens
gaaccatggcacc

SEQ ID NO: 6191119 - DNA, 22 bp, Homo sapiens
gaaccatggtcggaaaacatgc

SEQ ID NO: 6191120 - DNA, 18 bp, Homo sapiens
gaaccatggtgaagtgct

SEQ ID NO: 6191121 - DNA, 18 bp, Homo sapiens
gaaccattatactttata

SEQ ID NO: 6191122 - DNA, 23 bp, Homo sapiens
gaaccattatactttatatctgt

SEQ ID NO: 6191123 - DNA, 13 bp, Homo sapiens
gaaccattgttct

SEQ ID NO: 6191124 - DNA, 19 bp, Homo sapiens
gaaccatttaagagactct

SEQ ID NO: 6191125 - DNA, 16 bp, Homo sapiens
gaaccatttcacccag

SEQ ID NO: 6191126 - DNA, 19 bp, Homo sapiens
gaaccatttgcaatatgga

SEQ ID NO: 6191127 - DNA, 21 bp, Homo sapiens
gaacccaaagagacagctctt

SEQ ID NO: 6191128 - DNA, 17 bp, Homo sapiens
gaacccaacagtccctt

SEQ ID NO: 6191129 - DNA, 12 bp, Homo sapiens
gaacccaatttt

SEQ ID NO: 6191130 - DNA, 20 bp, Homo sapiens
gaacccacataaaagcccca

SEQ ID NO: 6191131 - DNA, 17 bp, Homo sapiens
gaacccaccctctccac

SEQ ID NO: 6191132 - DNA, 12 bp, Homo sapiens
gaacccacctgc

SEQ ID NO: 6191133 - DNA, 15 bp, Homo sapiens
gaacccacctgctga

SEQ ID NO: 6191134 - DNA, 13 bp, Homo sapiens
gaacccagactca

SEQ ID NO: 6191135 - DNA, 16 bp, Homo sapiens
gaacccagactcagac

SEQ ID NO: 6191136 - DNA, 17 bp, Homo sapiens
gaacccagactcagaca

SEQ ID NO: 6191137 - DNA, 19 bp, Homo sapiens
gaacccagactcagacatt

SEQ ID NO: 6191138 - DNA, 15 bp, Homo sapiens
gaacccagagtcagg

SEQ ID NO: 6191139 - DNA, 16 bp, Homo sapiens
gaacccagagtcagga

SEQ ID NO: 6191140 - DNA, 19 bp, Homo sapiens
gaacccagcagttctgtta

SEQ ID NO: 6191141 - DNA, 17 bp, Homo sapiens
gaacccagccagagttt

SEQ ID NO: 6191142 - DNA, 17 bp, Homo sapiens
gaacccagcccaccccc

SEQ ID NO: 6191143 - DNA, 14 bp, Homo sapiens
gaacccagccctgg

SEQ ID NO: 6191144 - DNA, 13 bp, Homo sapiens
gaacccaggacaa

SEQ ID NO: 6191145 - DNA, 15 bp, Homo sapiens
gaacccaggacgctt

SEQ ID NO: 6191146 - DNA, 16 bp, Homo sapiens
gaacccaggaggtgga

SEQ ID NO: 6191147 - DNA, 17 bp, Homo sapiens
gaacccaggcagctggc

SEQ ID NO: 6191148 - DNA, 17 bp, Homo sapiens
gaacccagggctctgcc

SEQ ID NO: 6191149 - DNA, 19 bp, Homo sapiens
gaacccatattttaaattc

SEQ ID NO: 6191150 - DNA, 19 bp, Homo sapiens
ctgttatccatattacgtt

SEQ ID NO: 6191151 - DNA, 13 bp, Homo sapiens
ctgttatccatgg

SEQ ID NO: 6191152 - DNA, 19 bp, Homo sapiens
ctgttatccctgcctggtc

SEQ ID NO: 6191153 - DNA, 17 bp, Homo sapiens
ctgttatcctatttaga

SEQ ID NO: 6191154 - DNA, 19 bp, Homo sapiens
ctgttatccttaaggcata

SEQ ID NO: 6191155 - DNA, 14 bp, Homo sapiens
ctgttatctgtctt

SEQ ID NO: 6191156 - DNA, 15 bp, Homo sapiens
ctgttatctgtcttt

SEQ ID NO: 6191157 - DNA, 20 bp, Homo sapiens
ctgttatctgtctttatgat

SEQ ID NO: 6191158 - DNA, 22 bp, Homo sapiens
ctgttatctgtctttatgattt

SEQ ID NO: 6191159 - DNA, 17 bp, Homo sapiens
ctgttatcttgtgtatg

SEQ ID NO: 6191160 - DNA, 14 bp, Homo sapiens
ctgttatgattctg

SEQ ID NO: 6191161 - DNA, 20 bp, Homo sapiens
ctgttatgatttccttcaat

SEQ ID NO: 6191162 - DNA, 17 bp, Homo sapiens
ctgttatgcaagcacaa

SEQ ID NO: 6191163 - DNA, 16 bp, Homo sapiens
ctgttatgccaaacag

SEQ ID NO: 6191164 - DNA, 14 bp, Homo sapiens
ctgttatgctgtga

SEQ ID NO: 6191165 - DNA, 14 bp, Homo sapiens
ctgttatgctgttt

SEQ ID NO: 6191166 - DNA, 18 bp, Homo sapiens
ctgttatgctgtttccta

SEQ ID NO: 6191167 - DNA, 13 bp, Homo sapiens
ctgttatgtactg

SEQ ID NO: 6191168 - DNA, 14 bp, Homo sapiens
ctgttatgtactgt

SEQ ID NO: 6191169 - DNA, 13 bp, Homo sapiens
ctgttatgtatga

SEQ ID NO: 6191170 - DNA, 14 bp, Homo sapiens
ctgttatgtccaga

SEQ ID NO: 6191171 - DNA, 15 bp, Homo sapiens
ctgttatgtgagaac

SEQ ID NO: 6191172 - DNA, 17 bp, Homo sapiens
ctgttatgtgagaacat

SEQ ID NO: 6191173 - DNA, 19 bp, Homo sapiens
ctgttattatatttgacat

SEQ ID NO: 6191174 - DNA, 18 bp, Homo sapiens
ctgttattcaaatttgat

SEQ ID NO: 6191175 - DNA, 20 bp, Homo sapiens
ctgttattgaaaatatattt

SEQ ID NO: 6191176 - DNA, 13 bp, Homo sapiens
ctgttatttaatt

SEQ ID NO: 6191177 - DNA, 14 bp, Homo sapiens
ctgttatttataat

SEQ ID NO: 6191178 - DNA, 21 bp, Homo sapiens
ctgttatttatcaatttttcc

SEQ ID NO: 6191179 - DNA, 19 bp, Homo sapiens
ctgttatttattattaatt

SEQ ID NO: 6191180 - DNA, 22 bp, Homo sapiens
ctgttatttcttccctgctttg

SEQ ID NO: 6191181 - DNA, 16 bp, Homo sapiens
ctgttattttcagcat

SEQ ID NO: 6191182 - DNA, 12 bp, Homo sapiens
ctgttattttta

SEQ ID NO: 6191183 - DNA, 14 bp, Homo sapiens
ctgttatttttaag

SEQ ID NO: 6191184 - DNA, 21 bp, Homo sapiens
ctgttattttttatttccaca

SEQ ID NO: 6191185 - DNA, 20 bp, Homo sapiens
ctgttcaaacccagtcttgt

SEQ ID NO: 6191186 - DNA, 23 bp, Homo sapiens
ctgttcaaagtactaaaactaga

SEQ ID NO: 6191187 - DNA, 12 bp, Homo sapiens
ctgttcaagagc

SEQ ID NO: 6191188 - DNA, 15 bp, Homo sapiens
ctgttcaagcaaaaa

SEQ ID NO: 6191189 - DNA, 12 bp, Homo sapiens
ctgttcaaggaa

SEQ ID NO: 6191190 - DNA, 17 bp, Homo sapiens
ctgttcaaggcccctga

SEQ ID NO: 6191191 - DNA, 16 bp, Homo sapiens
ctgttcaagtgtcccc

SEQ ID NO: 6191192 - DNA, 22 bp, Homo sapiens
ctgttcacaaactacctctgga

SEQ ID NO: 6191193 - DNA, 20 bp, Homo sapiens
ctgttcacactgcagagact

SEQ ID NO: 6191194 - DNA, 20 bp, Homo sapiens
ctgttcacagaaaaagcatg

SEQ ID NO: 6191195 - DNA, 19 bp, Homo sapiens
ctgttcacagccagactgg

SEQ ID NO: 6191196 - DNA, 20 bp, Homo sapiens
ctgttcacagcttttcttga

SEQ ID NO: 6191197 - DNA, 14 bp, Homo sapiens
ctgttcacccacag

SEQ ID NO: 6191198 - DNA, 18 bp, Homo sapiens
ctgttcacccacagggct

SEQ ID NO: 6191199 - DNA, 20 bp, Homo sapiens
ctgttcacgtgactcctcaa

SEQ ID NO: 6191200 - DNA, 23 bp, Homo sapiens
ctgttcacgtgttttccatccca

SEQ ID NO: 6191201 - DNA, 15 bp, Homo sapiens
ctgttcactcactct

SEQ ID NO: 6191202 - DNA, 15 bp, Homo sapiens
ctgttcactctactt

SEQ ID NO: 6191203 - DNA, 16 bp, Homo sapiens
ctgttcacttttcctc

SEQ ID NO: 6191204 - DNA, 13 bp, Homo sapiens
ctgttcagaggca

SEQ ID NO: 6191205 - DNA, 13 bp, Homo sapiens
ctgttcagcattc

SEQ ID NO: 6191206 - DNA, 20 bp, Homo sapiens
ctgttcagcggagctgactg

SEQ ID NO: 6191207 - DNA, 17 bp, Homo sapiens
ctgttcagcgttttgca

SEQ ID NO: 6191208 - DNA, 16 bp, Homo sapiens
ctgttcagctccagct

SEQ ID NO: 6191209 - DNA, 18 bp, Homo sapiens
ctgttcagctccagctca

SEQ ID NO: 6191210 - DNA, 18 bp, Homo sapiens
ctgttcagctggttgagg

SEQ ID NO: 6191211 - DNA, 21 bp, Homo sapiens
ctgttcagctggttgaggttt

SEQ ID NO: 6191212 - DNA, 14 bp, Homo sapiens
ctgttcagcttttc

SEQ ID NO: 6191213 - DNA, 22 bp, Homo sapiens
ctgttcaggagtccaaaccttc

SEQ ID NO: 6191214 - DNA, 16 bp, Homo sapiens
ctgttcagtaataaaa

SEQ ID NO: 6191215 - DNA, 12 bp, Homo sapiens
ctgttcagtact

SEQ ID NO: 6191216 - DNA, 20 bp, Homo sapiens
ctgttcagtgctttttcctt

SEQ ID NO: 6191217 - DNA, 20 bp, Homo sapiens
ctgttcagtgtcccgggccc

SEQ ID NO: 6191218 - DNA, 18 bp, Homo sapiens
ctgttcagttaagttctt

SEQ ID NO: 6191219 - DNA, 15 bp, Homo sapiens
ctgttcagttacaga

SEQ ID NO: 6191220 - DNA, 17 bp, Homo sapiens
ctgttcatacactaacc

SEQ ID NO: 6191221 - DNA, 14 bp, Homo sapiens
ctgttcatacagtt

SEQ ID NO: 6191222 - DNA, 21 bp, Homo sapiens
ctgttcatacggggtggctga

SEQ ID NO: 6191223 - DNA, 19 bp, Homo sapiens
ctgttcatcaccagtctgt

SEQ ID NO: 6191224 - DNA, 18 bp, Homo sapiens
ctgttcatctctttgtcc

SEQ ID NO: 6191225 - DNA, 20 bp, Homo sapiens
ctgttcatctctttgtcctg

SEQ ID NO: 6191226 - DNA, 16 bp, Homo sapiens
ctgttcatcttgtaca

SEQ ID NO: 6191227 - DNA, 17 bp, Homo sapiens
ctgttcatgctccaaga

SEQ ID NO: 6191228 - DNA, 14 bp, Homo sapiens
ctgttcatggcaga

SEQ ID NO: 6191229 - DNA, 16 bp, Homo sapiens
ctgttcatgtgcctct

SEQ ID NO: 6191230 - DNA, 18 bp, Homo sapiens
ctgttcatgtgcctctgc

SEQ ID NO: 6191231 - DNA, 16 bp, Homo sapiens
ctgttcattcctccag

SEQ ID NO: 6191232 - DNA, 22 bp, Homo sapiens
ctgttcattcctccaggtattc

SEQ ID NO: 6191233 - DNA, 19 bp, Homo sapiens
ctgttcatttctaaattta

SEQ ID NO: 6191234 - DNA, 14 bp, Homo sapiens
ctgttcatttgaaa

SEQ ID NO: 6191235 - DNA, 19 bp, Homo sapiens
ctgttccaaagccagtgaa

SEQ ID NO: 6191236 - DNA, 17 bp, Homo sapiens
ctgttccaacctcctgc

SEQ ID NO: 6191237 - DNA, 23 bp, Homo sapiens
ctgttccaacctcctgctctggg

SEQ ID NO: 6191238 - DNA, 14 bp, Homo sapiens
ctgttccaagtgtg

SEQ ID NO: 6191239 - DNA, 16 bp, Homo sapiens
ctgttccaagtgtgtg

SEQ ID NO: 6191240 - DNA, 21 bp, Homo sapiens
ctgttccaagtgtgtgtgcaa

SEQ ID NO: 6191241 - DNA, 18 bp, Homo sapiens
ctgttccaatgaaaaaat

SEQ ID NO: 6191242 - DNA, 21 bp, Homo sapiens
ctgttccacaaagcagtggct

SEQ ID NO: 6191243 - DNA, 22 bp, Homo sapiens
ctgttccacacccaatgctgct

SEQ ID NO: 6191244 - DNA, 18 bp, Homo sapiens
ctgttccaccaaatacaa

SEQ ID NO: 6191245 - DNA, 17 bp, Homo sapiens
ctgttccacttctctag

SEQ ID NO: 6191246 - DNA, 11 bp, Homo sapiens
ctgttccagac

SEQ ID NO: 6191247 - DNA, 13 bp, Homo sapiens
ctgttccagactc

SEQ ID NO: 6191248 - DNA, 14 bp, Homo sapiens
ctgttccagactca

SEQ ID NO: 6191249 - DNA, 17 bp, Homo sapiens
ctgttccagcctgccct

SEQ ID NO: 6191250 - DNA, 23 bp, Homo sapiens
ctgttccagcctgccctcttcat

SEQ ID NO: 6191251 - DNA, 15 bp, Homo sapiens
ctgttccaggccctc

SEQ ID NO: 6191252 - DNA, 17 bp, Homo sapiens
ctgttccaggccctcca

SEQ ID NO: 6191253 - DNA, 21 bp, Homo sapiens
ctgttccaggtttcttccacc

SEQ ID NO: 6191254 - DNA, 20 bp, Homo sapiens
ctgttccataggaaggctgt

SEQ ID NO: 6191255 - DNA, 13 bp, Homo sapiens
ctgttcccaagga

SEQ ID NO: 6191256 - DNA, 17 bp, Homo sapiens
ctgttcccacctgctgg

SEQ ID NO: 6191257 - DNA, 23 bp, Homo sapiens
ctgttcccagcaaagttttcaga

SEQ ID NO: 6191258 - DNA, 12 bp, Homo sapiens
ctgttcccagcc

SEQ ID NO: 6191259 - DNA, 14 bp, Homo sapiens
ctgttcccagcccc

SEQ ID NO: 6191260 - DNA, 15 bp, Homo sapiens
ctgttcccagcccct

SEQ ID NO: 6191261 - DNA, 23 bp, Homo sapiens
ctgttcccagcccctcctccctc

SEQ ID NO: 6191262 - DNA, 16 bp, Homo sapiens
ctgttcccagcccctg

SEQ ID NO: 6191263 - DNA, 18 bp, Homo sapiens
ctgttcccagcccctgca

SEQ ID NO: 6191264 - DNA, 20 bp, Homo sapiens
ctgttcccagcccctgcaga

SEQ ID NO: 6191265 - DNA, 18 bp, Homo sapiens
ctgttcccattcttgcat

SEQ ID NO: 6191266 - DNA, 23 bp, Homo sapiens
ctgttccccaaaacatgcaccct

SEQ ID NO: 6191267 - DNA, 16 bp, Homo sapiens
ctgttccccaaatggc

SEQ ID NO: 6191268 - DNA, 19 bp, Homo sapiens
ctgttccccacaggtcctc

SEQ ID NO: 6191269 - DNA, 14 bp, Homo sapiens
ctgttccccaccca

SEQ ID NO: 6191270 - DNA, 15 bp, Homo sapiens
ctgttccccacccag

SEQ ID NO: 6191271 - DNA, 20 bp, Homo sapiens
ctgttccccaccgccctgcc

SEQ ID NO: 6191272 - DNA, 21 bp, Homo sapiens
ctgttccccaccgccctgcct

SEQ ID NO: 6191273 - DNA, 13 bp, Homo sapiens
ctgttccccagag

SEQ ID NO: 6191274 - DNA, 23 bp, Homo sapiens
ctgttcccccgctggcagccacc

SEQ ID NO: 6191275 - DNA, 12 bp, Homo sapiens
ctgttccccctg

SEQ ID NO: 6191276 - DNA, 16 bp, Homo sapiens
ctgttccccctgtgca

SEQ ID NO: 6191277 - DNA, 17 bp, Homo sapiens
ctgttccccctgtgcag

SEQ ID NO: 6191278 - DNA, 17 bp, Homo sapiens
ctgttcccctcacccaa

SEQ ID NO: 6191279 - DNA, 14 bp, Homo sapiens
ctgttcccctcact

SEQ ID NO: 6191280 - DNA, 17 bp, Homo sapiens
ctgttcccctcactgga

SEQ ID NO: 6191281 - DNA, 16 bp, Homo sapiens
ctgttcccctccccct

SEQ ID NO: 6191282 - DNA, 14 bp, Homo sapiens
ctgttcccctctcc

SEQ ID NO: 6191283 - DNA, 17 bp, Homo sapiens
ctgttcccctgtcctgt

SEQ ID NO: 6191284 - DNA, 14 bp, Homo sapiens
ctgttccccttggt

SEQ ID NO: 6191285 - DNA, 12 bp, Homo sapiens
ctgttccctaga

SEQ ID NO: 6191286 - DNA, 19 bp, Homo sapiens
ctgttccctagagagaata

SEQ ID NO: 6191287 - DNA, 15 bp, Homo sapiens
ctgttccctccaagg

SEQ ID NO: 6191288 - DNA, 16 bp, Homo sapiens
ctgttccctccaggca

SEQ ID NO: 6191289 - DNA, 17 bp, Homo sapiens
ctgttccctcctggtcc

SEQ ID NO: 6191290 - DNA, 14 bp, Homo sapiens
ctgttccctctgct

SEQ ID NO: 6191291 - DNA, 17 bp, Homo sapiens
ctgttccctctgctcct

SEQ ID NO: 6191292 - DNA, 19 bp, Homo sapiens
ctgttccctctgctcctgg

SEQ ID NO: 6191293 - DNA, 16 bp, Homo sapiens
ctgttccctctggctt

SEQ ID NO: 6191294 - DNA, 19 bp, Homo sapiens
ctgttccctctggcttccc

SEQ ID NO: 6191295 - DNA, 14 bp, Homo sapiens
ctgttccctgagga

SEQ ID NO: 6191296 - DNA, 15 bp, Homo sapiens
ctgttccctgaggac

SEQ ID NO: 6191297 - DNA, 18 bp, Homo sapiens
ctgttccctgctgggtgg

SEQ ID NO: 6191298 - DNA, 21 bp, Homo sapiens
ctgttccctggagtcagggtg

SEQ ID NO: 6191299 - DNA, 15 bp, Homo sapiens
ctgttccctgggctg

SEQ ID NO: 6191300 - DNA, 12 bp, Homo sapiens
ctgttcccttcc

SEQ ID NO: 6191301 - DNA, 15 bp, Homo sapiens
ctgttcccttcctca

SEQ ID NO: 6191302 - DNA, 15 bp, Homo sapiens
ctgttcccttcctct

SEQ ID NO: 6191303 - DNA, 22 bp, Homo sapiens
ctgttcccttcctctgtgccac

SEQ ID NO: 6191304 - DNA, 13 bp, Homo sapiens
ctgttcccttgca

SEQ ID NO: 6191305 - DNA, 18 bp, Homo sapiens
ctgttcccttgtggcttg

SEQ ID NO: 6191306 - DNA, 16 bp, Homo sapiens
ctgttccctttgcctt

SEQ ID NO: 6191307 - DNA, 17 bp, Homo sapiens
ctgttccctttgcctta

SEQ ID NO: 6191308 - DNA, 23 bp, Homo sapiens
ctgttccctttgccttaaacctg

SEQ ID NO: 6191309 - DNA, 13 bp, Homo sapiens
ctgttccgcctca

SEQ ID NO: 6191310 - DNA, 15 bp, Homo sapiens
ctgttcctcccccat

SEQ ID NO: 6191311 - DNA, 24 bp, Homo sapiens
ctgttcctgactgttctcttactg

SEQ ID NO: 6191312 - DNA, 22 bp, Homo sapiens
ctgttcctgatttttcatatgt

SEQ ID NO: 6191313 - DNA, 17 bp, Homo sapiens
ctgttcctgccttctct

SEQ ID NO: 6191314 - DNA, 12 bp, Homo sapiens
ctgttcctgctg

SEQ ID NO: 6191315 - DNA, 14 bp, Homo sapiens
ctgttcctgctgct

SEQ ID NO: 6191316 - DNA, 21 bp, Homo sapiens
ctgttcctggctcagcctcaa

SEQ ID NO: 6191317 - DNA, 12 bp, Homo sapiens
ctgttcctgtgt

SEQ ID NO: 6191318 - DNA, 16 bp, Homo sapiens
ctgttccttagacctt

SEQ ID NO: 6191319 - DNA, 18 bp, Homo sapiens
ctgttccttcacatcctg

SEQ ID NO: 6191320 - DNA, 14 bp, Homo sapiens
ctgttccttcctgc

SEQ ID NO: 6191321 - DNA, 15 bp, Homo sapiens
ctgttccttcctgca

SEQ ID NO: 6191322 - DNA, 16 bp, Homo sapiens
ctgttccttgaatctg

SEQ ID NO: 6191323 - DNA, 15 bp, Homo sapiens
ctgttccttgtactc

SEQ ID NO: 6191324 - DNA, 23 bp, Homo sapiens
ctgttccttgtactcttaggata

SEQ ID NO: 6191325 - DNA, 19 bp, Homo sapiens
ctgttcctttctctgggct

SEQ ID NO: 6191326 - DNA, 17 bp, Homo sapiens
ctgttccttttctctcc

SEQ ID NO: 6191327 - DNA, 18 bp, Homo sapiens
ctgttcctttttgtaaat

SEQ ID NO: 6191328 - DNA, 18 bp, Homo sapiens
ctgttcgaagttcatttt

SEQ ID NO: 6191329 - DNA, 18 bp, Homo sapiens
ctgttcggaaggggttcc

SEQ ID NO: 6191330 - DNA, 21 bp, Homo sapiens
gaacccatcactgtgtctcat

SEQ ID NO: 6191331 - DNA, 23 bp, Homo sapiens
gaacccatcactgtgtctcatgg

SEQ ID NO: 6191332 - DNA, 15 bp, Homo sapiens
gaaccccaactccca

SEQ ID NO: 6191333 - DNA, 18 bp, Homo sapiens
gaaccccagacctctgaa

SEQ ID NO: 6191334 - DNA, 17 bp, Homo sapiens
gaaccccagaggcagag

SEQ ID NO: 6191335 - DNA, 15 bp, Homo sapiens
gaaccccatgggctt

SEQ ID NO: 6191336 - DNA, 19 bp, Homo sapiens
gaaccccatgggcttggac

SEQ ID NO: 6191337 - DNA, 21 bp, Homo sapiens
gaacccccacaaccccctcca

SEQ ID NO: 6191338 - DNA, 12 bp, Homo sapiens
gaacccccaggt

SEQ ID NO: 6191339 - DNA, 16 bp, Homo sapiens
gaaccccccactccct

SEQ ID NO: 6191340 - DNA, 20 bp, Homo sapiens
gaaccccccactccctgcca

SEQ ID NO: 6191341 - DNA, 18 bp, Homo sapiens
gaaccccccccccccgcc

SEQ ID NO: 6191342 - DNA, 23 bp, Homo sapiens
gaaccccccgcccatgctgtccg

SEQ ID NO: 6191343 - DNA, 21 bp, Homo sapiens
gaacccccctcccacccaccg

SEQ ID NO: 6191344 - DNA, 15 bp, Homo sapiens
gaacccccctcccca

SEQ ID NO: 6191345 - DNA, 21 bp, Homo sapiens
gaacccccctccccaaggaag

SEQ ID NO: 6191346 - DNA, 17 bp, Homo sapiens
gaaccccgagctggggg

SEQ ID NO: 6191347 - DNA, 14 bp, Homo sapiens
gaaccccgcagccc

SEQ ID NO: 6191348 - DNA, 16 bp, Homo sapiens
gaaccccgggcccggg

SEQ ID NO: 6191349 - DNA, 23 bp, Homo sapiens
gaaccccgggcccgggcccccgc

SEQ ID NO: 6191350 - DNA, 21 bp, Homo sapiens
gaacccctacatgaaacagaa

SEQ ID NO: 6191351 - DNA, 19 bp, Homo sapiens
gaacccctagaaaggagag

SEQ ID NO: 6191352 - DNA, 15 bp, Homo sapiens
gaacccctcccctcc

SEQ ID NO: 6191353 - DNA, 17 bp, Homo sapiens
gaacccctctgtcttca

SEQ ID NO: 6191354 - DNA, 15 bp, Homo sapiens
gaacccctggccagc

SEQ ID NO: 6191355 - DNA, 20 bp, Homo sapiens
gaacccctggccagctctga

SEQ ID NO: 6191356 - DNA, 14 bp, Homo sapiens
gaacccctggctcc

SEQ ID NO: 6191357 - DNA, 22 bp, Homo sapiens
gaacccctggctccaggccagg

SEQ ID NO: 6191358 - DNA, 19 bp, Homo sapiens
gaacccctggctccttcac

SEQ ID NO: 6191359 - DNA, 21 bp, Homo sapiens
gaacccctggctccttcacca

SEQ ID NO: 6191360 - DNA, 10 bp, Homo sapiens
gaacccctgt

SEQ ID NO: 6191361 - DNA, 13 bp, Homo sapiens
gaacccctgtgtc

SEQ ID NO: 6191362 - DNA, 14 bp, Homo sapiens
gaacccctttccca

SEQ ID NO: 6191363 - DNA, 20 bp, Homo sapiens
gaacccgggagcggaggttg

SEQ ID NO: 6191364 - DNA, 16 bp, Homo sapiens
gaacccgggggacaga

SEQ ID NO: 6191365 - DNA, 18 bp, Homo sapiens
gaacccggtcccaggccg

SEQ ID NO: 6191366 - DNA, 17 bp, Homo sapiens
gaaccctaaagcaaatc

SEQ ID NO: 6191367 - DNA, 22 bp, Homo sapiens
gaaccctaaagcagtaaaataa

SEQ ID NO: 6191368 - DNA, 17 bp, Homo sapiens
gaaccctatttaaaact

SEQ ID NO: 6191369 - DNA, 11 bp, Homo sapiens
gaaccctcagg

SEQ ID NO: 6191370 - DNA, 15 bp, Homo sapiens
gaaccctcctccttt

SEQ ID NO: 6191371 - DNA, 12 bp, Homo sapiens
gaaccctctggg

SEQ ID NO: 6191372 - DNA, 22 bp, Homo sapiens
gaaccctcttgccatcctgatg

SEQ ID NO: 6191373 - DNA, 24 bp, Homo sapiens
gaaccctcttgccatcctgatgga

SEQ ID NO: 6191374 - DNA, 14 bp, Homo sapiens
gaaccctgagcagg

SEQ ID NO: 6191375 - DNA, 22 bp, Homo sapiens
gaaccctgccatggaactgttt

SEQ ID NO: 6191376 - DNA, 16 bp, Homo sapiens
gaaccctgcccactcc

SEQ ID NO: 6191377 - DNA, 16 bp, Homo sapiens
gaaccctgcctcttgt

SEQ ID NO: 6191378 - DNA, 20 bp, Homo sapiens
gaaccctggagacagaagtc

SEQ ID NO: 6191379 - DNA, 12 bp, Homo sapiens
gaaccctggagg

SEQ ID NO: 6191380 - DNA, 16 bp, Homo sapiens
gaaccctggaggtaaa

SEQ ID NO: 6191381 - DNA, 22 bp, Homo sapiens
gaaccctggtgaggaagctcca

SEQ ID NO: 6191382 - DNA, 13 bp, Homo sapiens
gaaccctgtgctg

SEQ ID NO: 6191383 - DNA, 17 bp, Homo sapiens
gaaccctgtgctggtgt

SEQ ID NO: 6191384 - DNA, 13 bp, Homo sapiens
gaacccttcctgc

SEQ ID NO: 6191385 - DNA, 20 bp, Homo sapiens
gaacccttggcttgcccacg

SEQ ID NO: 6191386 - DNA, 18 bp, Homo sapiens
gaacccttttaaagttga

SEQ ID NO: 6191387 - DNA, 17 bp, Homo sapiens
gaacccttttggccccc

SEQ ID NO: 6191388 - DNA, 23 bp, Homo sapiens
gaacccttttggcccccgagctg

SEQ ID NO: 6191389 - DNA, 14 bp, Homo sapiens
gaaccgaaaggcca

SEQ ID NO: 6191390 - DNA, 15 bp, Homo sapiens
gaaccgactgaccct

SEQ ID NO: 6191391 - DNA, 12 bp, Homo sapiens
gaaccgaggcag

SEQ ID NO: 6191392 - DNA, 15 bp, Homo sapiens
gaaccgaggcaggga

SEQ ID NO: 6191393 - DNA, 15 bp, Homo sapiens
gaaccgcacagctca

SEQ ID NO: 6191394 - DNA, 13 bp, Homo sapiens
gaaccgcaggaag

SEQ ID NO: 6191395 - DNA, 14 bp, Homo sapiens
gaaccgcaggaagc

SEQ ID NO: 6191396 - DNA, 16 bp, Homo sapiens
gaaccggctcccaccc

SEQ ID NO: 6191397 - DNA, 18 bp, Homo sapiens
gaaccggctcccaccctc

SEQ ID NO: 6191398 - DNA, 21 bp, Homo sapiens
gaaccggtcccagcctgggct

SEQ ID NO: 6191399 - DNA, 15 bp, Homo sapiens
gaaccgtgaggaggg

SEQ ID NO: 6191400 - DNA, 17 bp, Homo sapiens
gaaccgtgtccagcaca

SEQ ID NO: 6191401 - DNA, 18 bp, Homo sapiens
gaaccgtgtccagcacag

SEQ ID NO: 6191402 - DNA, 17 bp, Homo sapiens
gaaccgttttgaagcta

SEQ ID NO: 6191403 - DNA, 22 bp, Homo sapiens
gaacctaataagtgctactttg

SEQ ID NO: 6191404 - DNA, 14 bp, Homo sapiens
gaacctaattgaaa

SEQ ID NO: 6191405 - DNA, 15 bp, Homo sapiens
gaacctaattgaaat

SEQ ID NO: 6191406 - DNA, 21 bp, Homo sapiens
gaacctacaaaagcttgtgta

SEQ ID NO: 6191407 - DNA, 21 bp, Homo sapiens
gaacctacagactccatctct

SEQ ID NO: 6191408 - DNA, 15 bp, Homo sapiens
gaacctaccttcatt

SEQ ID NO: 6191409 - DNA, 22 bp, Homo sapiens
gaacctactgaggagcaaagca

SEQ ID NO: 6191410 - DNA, 13 bp, Homo sapiens
gaacctaggagga

SEQ ID NO: 6191411 - DNA, 19 bp, Homo sapiens
gaacctagtactctctgct

SEQ ID NO: 6191412 - DNA, 19 bp, Homo sapiens
gaacctattttcatttgta

SEQ ID NO: 6191413 - DNA, 19 bp, Homo sapiens
gaacctcaaactaggagga

SEQ ID NO: 6191414 - DNA, 21 bp, Homo sapiens
gaacctcaaactaggaggaaa

SEQ ID NO: 6191415 - DNA, 21 bp, Homo sapiens
gaacctcaccccgaggccctg

SEQ ID NO: 6191416 - DNA, 11 bp, Homo sapiens
gaacctcacct

SEQ ID NO: 6191417 - DNA, 17 bp, Homo sapiens
gaacctcacgcacctcc

SEQ ID NO: 6191418 - DNA, 18 bp, Homo sapiens
gaacctcacgcacctccc

SEQ ID NO: 6191419 - DNA, 19 bp, Homo sapiens
gaacctcacgcacctccca

SEQ ID NO: 6191420 - DNA, 16 bp, Homo sapiens
gaacctcactcttgcc

SEQ ID NO: 6191421 - DNA, 17 bp, Homo sapiens
gaacctcactcttgcca

SEQ ID NO: 6191422 - DNA, 18 bp, Homo sapiens
gaacctcactcttgccaa

SEQ ID NO: 6191423 - DNA, 15 bp, Homo sapiens
gaacctcagattctt

SEQ ID NO: 6191424 - DNA, 15 bp, Homo sapiens
gaacctcagcctggc

SEQ ID NO: 6191425 - DNA, 14 bp, Homo sapiens
gaacctcaggcttc

SEQ ID NO: 6191426 - DNA, 12 bp, Homo sapiens
gaacctcagttt

SEQ ID NO: 6191427 - DNA, 15 bp, Homo sapiens
gaacctcagtttcct

SEQ ID NO: 6191428 - DNA, 16 bp, Homo sapiens
gaacctcattctggtt

SEQ ID NO: 6191429 - DNA, 17 bp, Homo sapiens
gaacctcattgctacca

SEQ ID NO: 6191430 - DNA, 14 bp, Homo sapiens
gaacctcatttgtc

SEQ ID NO: 6191431 - DNA, 18 bp, Homo sapiens
gaacctcccagaggtcca

SEQ ID NO: 6191432 - DNA, 19 bp, Homo sapiens
gaacctcccagaggtccag

SEQ ID NO: 6191433 - DNA, 21 bp, Homo sapiens
gaacctcccagaggtccagcc

SEQ ID NO: 6191434 - DNA, 22 bp, Homo sapiens
gaacctcccagaggtccagccc

SEQ ID NO: 6191435 - DNA, 15 bp, Homo sapiens
gaacctccccagcct

SEQ ID NO: 6191436 - DNA, 15 bp, Homo sapiens
gaacctccctgggcc

SEQ ID NO: 6191437 - DNA, 15 bp, Homo sapiens
gaacctcctatttta

SEQ ID NO: 6191438 - DNA, 15 bp, Homo sapiens
gaacctcctctgtga

SEQ ID NO: 6191439 - DNA, 13 bp, Homo sapiens
gaacctcctttct

SEQ ID NO: 6191440 - DNA, 17 bp, Homo sapiens
gaacctcgaagctgttc

SEQ ID NO: 6191441 - DNA, 22 bp, Homo sapiens
gaacctcgagtactgtgggcaa

SEQ ID NO: 6191442 - DNA, 20 bp, Homo sapiens
gaacctcgttgacatgcaca

SEQ ID NO: 6191443 - DNA, 20 bp, Homo sapiens
gaacctctaagtgctgctgt

SEQ ID NO: 6191444 - DNA, 16 bp, Homo sapiens
gaacctctcgccatga

SEQ ID NO: 6191445 - DNA, 11 bp, Homo sapiens
gaacctgaccc

SEQ ID NO: 6191446 - DNA, 12 bp, Homo sapiens
gaacctgacccc

SEQ ID NO: 6191447 - DNA, 18 bp, Homo sapiens
gaacctgagctattttcc

SEQ ID NO: 6191448 - DNA, 22 bp, Homo sapiens
gaacctgagctattttcctctg

SEQ ID NO: 6191449 - DNA, 22 bp, Homo sapiens
gaacctgagttcccgggagctg

SEQ ID NO: 6191450 - DNA, 22 bp, Homo sapiens
gaacctgatacctgcctgggac

SEQ ID NO: 6191451 - DNA, 13 bp, Homo sapiens
gaacctgcaagcc

SEQ ID NO: 6191452 - DNA, 15 bp, Homo sapiens
gaacctgcacacagg

SEQ ID NO: 6191453 - DNA, 17 bp, Homo sapiens
gaacctgcacacgagca

SEQ ID NO: 6191454 - DNA, 16 bp, Homo sapiens
gaacctgcatttaaga

SEQ ID NO: 6191455 - DNA, 17 bp, Homo sapiens
gaacctgcgcaccccgt

SEQ ID NO: 6191456 - DNA, 16 bp, Homo sapiens
gaacctggaacttggg

SEQ ID NO: 6191457 - DNA, 12 bp, Homo sapiens
gaacctggacca

SEQ ID NO: 6191458 - DNA, 16 bp, Homo sapiens
gaacctggaccccagc

SEQ ID NO: 6191459 - DNA, 21 bp, Homo sapiens
gaacctggagggctggaatct

SEQ ID NO: 6191460 - DNA, 13 bp, Homo sapiens
gaacctggagggg

SEQ ID NO: 6191461 - DNA, 13 bp, Homo sapiens
gaacctggcaggc

SEQ ID NO: 6191462 - DNA, 14 bp, Homo sapiens
gaacctggcaggcc

SEQ ID NO: 6191463 - DNA, 19 bp, Homo sapiens
gaacctggcaggccctgcc

SEQ ID NO: 6191464 - DNA, 22 bp, Homo sapiens
gaacctggcaggccctgcccag

SEQ ID NO: 6191465 - DNA, 11 bp, Homo sapiens
gaacctggcct

SEQ ID NO: 6191466 - DNA, 13 bp, Homo sapiens
gaacctggccttc

SEQ ID NO: 6191467 - DNA, 20 bp, Homo sapiens
gaacctggtggctggaggca

SEQ ID NO: 6191468 - DNA, 15 bp, Homo sapiens
gaacctgtagagcta

SEQ ID NO: 6191469 - DNA, 16 bp, Homo sapiens
gaacctgtccaacatg

SEQ ID NO: 6191470 - DNA, 12 bp, Homo sapiens
gaacctgtctcc

SEQ ID NO: 6191471 - DNA, 21 bp, Homo sapiens
gaacctgtctccattgtgtga

SEQ ID NO: 6191472 - DNA, 17 bp, Homo sapiens
gaacctgtgagctgcac

SEQ ID NO: 6191473 - DNA, 19 bp, Homo sapiens
gaacctgtgagctgcacca

SEQ ID NO: 6191474 - DNA, 14 bp, Homo sapiens
gaacctgtgaggaa

SEQ ID NO: 6191475 - DNA, 17 bp, Homo sapiens
gaacctgtgaggaagag

SEQ ID NO: 6191476 - DNA, 12 bp, Homo sapiens
gaacctgtgagt

SEQ ID NO: 6191477 - DNA, 20 bp, Homo sapiens
gaacctgttagtctccccac

SEQ ID NO: 6191478 - DNA, 15 bp, Homo sapiens
gaaccttaaggaaga

SEQ ID NO: 6191479 - DNA, 20 bp, Homo sapiens
gaaccttaatgacaacactt

SEQ ID NO: 6191480 - DNA, 21 bp, Homo sapiens
gaaccttaatgacaacactta

SEQ ID NO: 6191481 - DNA, 20 bp, Homo sapiens
gaaccttactggcactgtgg

SEQ ID NO: 6191482 - DNA, 15 bp, Homo sapiens
gaaccttccttcctg

SEQ ID NO: 6191483 - DNA, 17 bp, Homo sapiens
gaaccttctagaacctg

SEQ ID NO: 6191484 - DNA, 15 bp, Homo sapiens
gaaccttctcccttc

SEQ ID NO: 6191485 - DNA, 22 bp, Homo sapiens
gaaccttgaagaagtggctgcc

SEQ ID NO: 6191486 - DNA, 16 bp, Homo sapiens
gaaccttgctgtcctg

SEQ ID NO: 6191487 - DNA, 16 bp, Homo sapiens
gaaccttggcctgggc

SEQ ID NO: 6191488 - DNA, 21 bp, Homo sapiens
gaaccttggtaaattgtaaac

SEQ ID NO: 6191489 - DNA, 19 bp, Homo sapiens
gaaccttgtagaggagcag

SEQ ID NO: 6191490 - DNA, 17 bp, Homo sapiens
gaaccttgtcccagcca

SEQ ID NO: 6191491 - DNA, 13 bp, Homo sapiens
gaaccttgttatt

SEQ ID NO: 6191492 - DNA, 18 bp, Homo sapiens
gaaccttgttatttctca

SEQ ID NO: 6191493 - DNA, 12 bp, Homo sapiens
gaacctttgtca

SEQ ID NO: 6191494 - DNA, 20 bp, Homo sapiens
gaacctttgtgccctatcac

SEQ ID NO: 6191495 - DNA, 16 bp, Homo sapiens
gaacgaaaatgaaagc

SEQ ID NO: 6191496 - DNA, 14 bp, Homo sapiens
gaacgagaggggaa

SEQ ID NO: 6191497 - DNA, 16 bp, Homo sapiens
gaacgagcagcccagg

SEQ ID NO: 6191498 - DNA, 16 bp, Homo sapiens
gaacgagcctggaagc

SEQ ID NO: 6191499 - DNA, 19 bp, Homo sapiens
gaacgaggtttatattttc

SEQ ID NO: 6191500 - DNA, 18 bp, Homo sapiens
gaacgcacaacatgcaca

SEQ ID NO: 6191501 - DNA, 13 bp, Homo sapiens
gaacgcaccccac

SEQ ID NO: 6191502 - DNA, 20 bp, Homo sapiens
gaacgcaccccactgggaga

SEQ ID NO: 6191503 - DNA, 15 bp, Homo sapiens
gaacgcagaagaaag

SEQ ID NO: 6191504 - DNA, 21 bp, Homo sapiens
gaacgcagccctagagcctgc

SEQ ID NO: 6191505 - DNA, 22 bp, Homo sapiens
gaacgcagccctagagcctgcc

SEQ ID NO: 6191506 - DNA, 20 bp, Homo sapiens
gaacgcagttgattccttga

SEQ ID NO: 6191507 - DNA, 13 bp, Homo sapiens
gaacgcatgcagg

SEQ ID NO: 6191508 - DNA, 13 bp, Homo sapiens
gaacgccagggac

SEQ ID NO: 6191509 - DNA, 18 bp, Homo sapiens
gaacgcccccccccaccc

SEQ ID NO: 6191510 - DNA, 15 bp, Homo sapiens
ctgttcgttcaaaag

SEQ ID NO: 6191511 - DNA, 12 bp, Homo sapiens
ctgttctaaagc

SEQ ID NO: 6191512 - DNA, 16 bp, Homo sapiens
ctgttctaacatgtaa

SEQ ID NO: 6191513 - DNA, 12 bp, Homo sapiens
ctgttctaaggg

SEQ ID NO: 6191514 - DNA, 23 bp, Homo sapiens
ctgttctactcttaatgatgtta

SEQ ID NO: 6191515 - DNA, 20 bp, Homo sapiens
ctgttctatgcctttagtca

SEQ ID NO: 6191516 - DNA, 18 bp, Homo sapiens
ctgttctatgcttcctcg

SEQ ID NO: 6191517 - DNA, 17 bp, Homo sapiens
ctgttctcaaagcagaa

SEQ ID NO: 6191518 - DNA, 14 bp, Homo sapiens
ctgttctcaaatgc

SEQ ID NO: 6191519 - DNA, 15 bp, Homo sapiens
ctgttctcaatcatt

SEQ ID NO: 6191520 - DNA, 16 bp, Homo sapiens
ctgttctcaatcattg

SEQ ID NO: 6191521 - DNA, 12 bp, Homo sapiens
ctgttctcagag

SEQ ID NO: 6191522 - DNA, 17 bp, Homo sapiens
ctgttctcagagctcca

SEQ ID NO: 6191523 - DNA, 19 bp, Homo sapiens
ctgttctcagagctccaca

SEQ ID NO: 6191524 - DNA, 20 bp, Homo sapiens
ctgttctcagagctccacag

SEQ ID NO: 6191525 - DNA, 21 bp, Homo sapiens
ctgttctcagagctccacaga

SEQ ID NO: 6191526 - DNA, 20 bp, Homo sapiens
ctgttctcattcctgttctt

SEQ ID NO: 6191527 - DNA, 16 bp, Homo sapiens
ctgttctcatttgatc

SEQ ID NO: 6191528 - DNA, 13 bp, Homo sapiens
ctgttctccagat

SEQ ID NO: 6191529 - DNA, 23 bp, Homo sapiens
ctgttctccaggcttcacagtct

SEQ ID NO: 6191530 - DNA, 16 bp, Homo sapiens
ctgttctcccttcggt

SEQ ID NO: 6191531 - DNA, 17 bp, Homo sapiens
ctgttctccctttctct

SEQ ID NO: 6191532 - DNA, 18 bp, Homo sapiens
ctgttctccctttctctc

SEQ ID NO: 6191533 - DNA, 20 bp, Homo sapiens
ctgttctccctttctctctc

SEQ ID NO: 6191534 - DNA, 18 bp, Homo sapiens
ctgttctcgaactcctga

SEQ ID NO: 6191535 - DNA, 14 bp, Homo sapiens
ctgttctctcccct

SEQ ID NO: 6191536 - DNA, 16 bp, Homo sapiens
ctgttctctgccctcc

SEQ ID NO: 6191537 - DNA, 17 bp, Homo sapiens
ctgttctctgccctcca

SEQ ID NO: 6191538 - DNA, 20 bp, Homo sapiens
ctgttctctgccctccaaga

SEQ ID NO: 6191539 - DNA, 12 bp, Homo sapiens
ctgttctctgct

SEQ ID NO: 6191540 - DNA, 13 bp, Homo sapiens
ctgttctctgctg

SEQ ID NO: 6191541 - DNA, 14 bp, Homo sapiens
ctgttctctgctga

SEQ ID NO: 6191542 - DNA, 13 bp, Homo sapiens
ctgttctctgctt

SEQ ID NO: 6191543 - DNA, 23 bp, Homo sapiens
ctgttctcttcacaccaaggaag

SEQ ID NO: 6191544 - DNA, 19 bp, Homo sapiens
ctgttctgaaaggagacat

SEQ ID NO: 6191545 - DNA, 20 bp, Homo sapiens
ctgttctgaaattaggaaag

SEQ ID NO: 6191546 - DNA, 11 bp, Homo sapiens
ctgttctgagc

SEQ ID NO: 6191547 - DNA, 18 bp, Homo sapiens
ctgttctgatattaattt

SEQ ID NO: 6191548 - DNA, 20 bp, Homo sapiens
ctgttctgatattaatttat

SEQ ID NO: 6191549 - DNA, 21 bp, Homo sapiens
ctgttctgcacaataaacata

SEQ ID NO: 6191550 - DNA, 13 bp, Homo sapiens
ctgttctgcactg

SEQ ID NO: 6191551 - DNA, 14 bp, Homo sapiens
ctgttctgcactga

SEQ ID NO: 6191552 - DNA, 15 bp, Homo sapiens
ctgttctgcactgaa

SEQ ID NO: 6191553 - DNA, 16 bp, Homo sapiens
ctgttctgcactgaaa

SEQ ID NO: 6191554 - DNA, 14 bp, Homo sapiens
ctgttctgcagaca

SEQ ID NO: 6191555 - DNA, 16 bp, Homo sapiens
ctgttctgccccctca

SEQ ID NO: 6191556 - DNA, 18 bp, Homo sapiens
ctgttctgccccctcagg

SEQ ID NO: 6191557 - DNA, 14 bp, Homo sapiens
ctgttctgctggga

SEQ ID NO: 6191558 - DNA, 13 bp, Homo sapiens
ctgttctggagct

SEQ ID NO: 6191559 - DNA, 17 bp, Homo sapiens
ctgttctggagctgctg

SEQ ID NO: 6191560 - DNA, 18 bp, Homo sapiens
ctgttctggagctgctgt

SEQ ID NO: 6191561 - DNA, 22 bp, Homo sapiens
ctgttctggaggaaagggagga

SEQ ID NO: 6191562 - DNA, 15 bp, Homo sapiens
ctgttctgggactcc

SEQ ID NO: 6191563 - DNA, 14 bp, Homo sapiens
ctgttctgggggac

SEQ ID NO: 6191564 - DNA, 20 bp, Homo sapiens
ctgttctgggggacagagaa

SEQ ID NO: 6191565 - DNA, 14 bp, Homo sapiens
ctgttctggtagct

SEQ ID NO: 6191566 - DNA, 20 bp, Homo sapiens
ctgttctggtatttcccctg

SEQ ID NO: 6191567 - DNA, 17 bp, Homo sapiens
ctgttctggtggcccca

SEQ ID NO: 6191568 - DNA, 14 bp, Homo sapiens
ctgttctgtagctt

SEQ ID NO: 6191569 - DNA, 17 bp, Homo sapiens
ctgttctgtagctttct

SEQ ID NO: 6191570 - DNA, 18 bp, Homo sapiens
ctgttctgtagctttctg

SEQ ID NO: 6191571 - DNA, 19 bp, Homo sapiens
ctgttctgtagctttctgg

SEQ ID NO: 6191572 - DNA, 13 bp, Homo sapiens
ctgttctgtagga

SEQ ID NO: 6191573 - DNA, 19 bp, Homo sapiens
ctgttctgtaggagagact

SEQ ID NO: 6191574 - DNA, 12 bp, Homo sapiens
ctgttctgtgac

SEQ ID NO: 6191575 - DNA, 21 bp, Homo sapiens
ctgttctgtggaaagtgtaaa

SEQ ID NO: 6191576 - DNA, 23 bp, Homo sapiens
ctgttctgtggaaagtgtaaagc

SEQ ID NO: 6191577 - DNA, 13 bp, Homo sapiens
ctgttctgtgtac

SEQ ID NO: 6191578 - DNA, 16 bp, Homo sapiens
ctgttctgtgtacata

SEQ ID NO: 6191579 - DNA, 20 bp, Homo sapiens
ctgttctgtgtacataaagt

SEQ ID NO: 6191580 - DNA, 22 bp, Homo sapiens
ctgttctgtgtacataaagtca

SEQ ID NO: 6191581 - DNA, 15 bp, Homo sapiens
ctgttctgtgtgggt

SEQ ID NO: 6191582 - DNA, 21 bp, Homo sapiens
ctgttctgtgtgggtctgggg

SEQ ID NO: 6191583 - DNA, 14 bp, Homo sapiens
ctgttctgtttcaa

SEQ ID NO: 6191584 - DNA, 17 bp, Homo sapiens
ctgttctgtttcctgtg

SEQ ID NO: 6191585 - DNA, 21 bp, Homo sapiens
ctgttctgtttcctgtgtctc

SEQ ID NO: 6191586 - DNA, 17 bp, Homo sapiens
ctgttctgttttgcctg

SEQ ID NO: 6191587 - DNA, 15 bp, Homo sapiens
ctgttcttagagtgt

SEQ ID NO: 6191588 - DNA, 16 bp, Homo sapiens
ctgttcttagagtgta

SEQ ID NO: 6191589 - DNA, 19 bp, Homo sapiens
ctgttcttagagtgtagct

SEQ ID NO: 6191590 - DNA, 21 bp, Homo sapiens
ctgttcttagagtgtagctgt

SEQ ID NO: 6191591 - DNA, 16 bp, Homo sapiens
ctgttcttagctcaat

SEQ ID NO: 6191592 - DNA, 19 bp, Homo sapiens
ctgttcttagctcaatgag

SEQ ID NO: 6191593 - DNA, 21 bp, Homo sapiens
ctgttcttagctcaatgagca

SEQ ID NO: 6191594 - DNA, 21 bp, Homo sapiens
ctgttcttagtgacacacact

SEQ ID NO: 6191595 - DNA, 17 bp, Homo sapiens
ctgttcttcacttctgg

SEQ ID NO: 6191596 - DNA, 15 bp, Homo sapiens
ctgttcttcatctgc

SEQ ID NO: 6191597 - DNA, 22 bp, Homo sapiens
ctgttcttcctcagccagcctc

SEQ ID NO: 6191598 - DNA, 15 bp, Homo sapiens
ctgttcttcctccag

SEQ ID NO: 6191599 - DNA, 20 bp, Homo sapiens
ctgttcttcctccagctgca

SEQ ID NO: 6191600 - DNA, 12 bp, Homo sapiens
ctgttcttcctg

SEQ ID NO: 6191601 - DNA, 22 bp, Homo sapiens
ctgttcttgaaagccaagtgtt

SEQ ID NO: 6191602 - DNA, 12 bp, Homo sapiens
ctgttcttgaag

SEQ ID NO: 6191603 - DNA, 20 bp, Homo sapiens
ctgttcttgaggtctctttt

SEQ ID NO: 6191604 - DNA, 11 bp, Homo sapiens
ctgttcttgct

SEQ ID NO: 6191605 - DNA, 14 bp, Homo sapiens
ctgttcttgctgct

SEQ ID NO: 6191606 - DNA, 15 bp, Homo sapiens
ctgttcttgctgcta

SEQ ID NO: 6191607 - DNA, 18 bp, Homo sapiens
ctgttcttgctgctagaa

SEQ ID NO: 6191608 - DNA, 20 bp, Homo sapiens
ctgttcttgctgctagaact

SEQ ID NO: 6191609 - DNA, 18 bp, Homo sapiens
ctgttcttgggcctcagg

SEQ ID NO: 6191610 - DNA, 22 bp, Homo sapiens
ctgttcttggtaactgattacc

SEQ ID NO: 6191611 - DNA, 18 bp, Homo sapiens
ctgttctttaagactttt

SEQ ID NO: 6191612 - DNA, 16 bp, Homo sapiens
ctgttctttaatttat

SEQ ID NO: 6191613 - DNA, 19 bp, Homo sapiens
ctgttctttcatactacat

SEQ ID NO: 6191614 - DNA, 19 bp, Homo sapiens
ctgttctttccaaagtaca

SEQ ID NO: 6191615 - DNA, 13 bp, Homo sapiens
ctgttctttctgg

SEQ ID NO: 6191616 - DNA, 15 bp, Homo sapiens
ctgttctttgcagtg

SEQ ID NO: 6191617 - DNA, 14 bp, Homo sapiens
ctgttcttttgcat

SEQ ID NO: 6191618 - DNA, 12 bp, Homo sapiens
ctgttgaaaatt

SEQ ID NO: 6191619 - DNA, 14 bp, Homo sapiens
ctgttgaaaattat

SEQ ID NO: 6191620 - DNA, 20 bp, Homo sapiens
ctgttgaaacacacgtgctg

SEQ ID NO: 6191621 - DNA, 23 bp, Homo sapiens
ctgttgaaacttacactgtttca

SEQ ID NO: 6191622 - DNA, 18 bp, Homo sapiens
ctgttgaaagcaaaaatg

SEQ ID NO: 6191623 - DNA, 21 bp, Homo sapiens
ctgttgaagatttgaggactt

SEQ ID NO: 6191624 - DNA, 17 bp, Homo sapiens
ctgttgaagtgcatgtt

SEQ ID NO: 6191625 - DNA, 15 bp, Homo sapiens
ctgttgaatatttag

SEQ ID NO: 6191626 - DNA, 18 bp, Homo sapiens
ctgttgaatgcctgtccc

SEQ ID NO: 6191627 - DNA, 19 bp, Homo sapiens
ctgttgaattggtgaataa

SEQ ID NO: 6191628 - DNA, 23 bp, Homo sapiens
ctgttgaattttgttctctggga

SEQ ID NO: 6191629 - DNA, 18 bp, Homo sapiens
ctgttgacatcagcctgc

SEQ ID NO: 6191630 - DNA, 23 bp, Homo sapiens
ctgttgacatccaagcttccttt

SEQ ID NO: 6191631 - DNA, 14 bp, Homo sapiens
ctgttgaccaggca

SEQ ID NO: 6191632 - DNA, 17 bp, Homo sapiens
ctgttgaccaggcacct

SEQ ID NO: 6191633 - DNA, 17 bp, Homo sapiens
ctgttgacgaagtctct

SEQ ID NO: 6191634 - DNA, 19 bp, Homo sapiens
ctgttgactctagtactgt

SEQ ID NO: 6191635 - DNA, 19 bp, Homo sapiens
ctgttgagatggtaacaga

SEQ ID NO: 6191636 - DNA, 19 bp, Homo sapiens
ctgttgagatgtgctttgc

SEQ ID NO: 6191637 - DNA, 20 bp, Homo sapiens
ctgttgagccccagtgctgg

SEQ ID NO: 6191638 - DNA, 16 bp, Homo sapiens
ctgttgaggcatcaaa

SEQ ID NO: 6191639 - DNA, 17 bp, Homo sapiens
ctgttgaggtggctgta

SEQ ID NO: 6191640 - DNA, 22 bp, Homo sapiens
ctgttgaggtgggtgggcctga

SEQ ID NO: 6191641 - DNA, 16 bp, Homo sapiens
ctgttgagtatttgct

SEQ ID NO: 6191642 - DNA, 23 bp, Homo sapiens
ctgttgagtgcaacaagagcaaa

SEQ ID NO: 6191643 - DNA, 16 bp, Homo sapiens
ctgttgagttggacac

SEQ ID NO: 6191644 - DNA, 18 bp, Homo sapiens
ctgttgataaatccatca

SEQ ID NO: 6191645 - DNA, 15 bp, Homo sapiens
ctgttgatacaaacc

SEQ ID NO: 6191646 - DNA, 17 bp, Homo sapiens
ctgttgatcccacttca

SEQ ID NO: 6191647 - DNA, 19 bp, Homo sapiens
ctgttgatcccacttcact

SEQ ID NO: 6191648 - DNA, 14 bp, Homo sapiens
ctgttgatcccctc

SEQ ID NO: 6191649 - DNA, 21 bp, Homo sapiens
ctgttgatcccctctctgtgg

SEQ ID NO: 6191650 - DNA, 21 bp, Homo sapiens
ctgttgatcgtcacgctcgca

SEQ ID NO: 6191651 - DNA, 20 bp, Homo sapiens
ctgttgatctacccgtgcct

SEQ ID NO: 6191652 - DNA, 14 bp, Homo sapiens
ctgttgatctatgg

SEQ ID NO: 6191653 - DNA, 14 bp, Homo sapiens
ctgttgatgtatct

SEQ ID NO: 6191654 - DNA, 22 bp, Homo sapiens
ctgttgatgtatctgagttgcc

SEQ ID NO: 6191655 - DNA, 18 bp, Homo sapiens
ctgttgattatcttcagc

SEQ ID NO: 6191656 - DNA, 23 bp, Homo sapiens
ctgttgattatcttcagcccagg

SEQ ID NO: 6191657 - DNA, 21 bp, Homo sapiens
ctgttgattccactgaaacct

SEQ ID NO: 6191658 - DNA, 15 bp, Homo sapiens
ctgttgattctttca

SEQ ID NO: 6191659 - DNA, 19 bp, Homo sapiens
ctgttgattgctaaatgta

SEQ ID NO: 6191660 - DNA, 16 bp, Homo sapiens
ctgttgcaagcccctc

SEQ ID NO: 6191661 - DNA, 22 bp, Homo sapiens
ctgttgcaattaggattttgat

SEQ ID NO: 6191662 - DNA, 17 bp, Homo sapiens
ctgttgcacccagccct

SEQ ID NO: 6191663 - DNA, 18 bp, Homo sapiens
ctgttgcacccagccctg

SEQ ID NO: 6191664 - DNA, 21 bp, Homo sapiens
ctgttgcacccagccctggtc

SEQ ID NO: 6191665 - DNA, 23 bp, Homo sapiens
ctgttgcacccagccctggtctc

SEQ ID NO: 6191666 - DNA, 20 bp, Homo sapiens
ctgttgcacgtgtgtttttc

SEQ ID NO: 6191667 - DNA, 15 bp, Homo sapiens
ctgttgcacttttga

SEQ ID NO: 6191668 - DNA, 18 bp, Homo sapiens
ctgttgcacttttgaatg

SEQ ID NO: 6191669 - DNA, 22 bp, Homo sapiens
ctgttgcagcttgtgctgagcc

SEQ ID NO: 6191670 - DNA, 19 bp, Homo sapiens
ctgttgcaggcagtgtctt

SEQ ID NO: 6191671 - DNA, 21 bp, Homo sapiens
ctgttgcaggtgtccgggggt

SEQ ID NO: 6191672 - DNA, 12 bp, Homo sapiens
ctgttgcagtgg

SEQ ID NO: 6191673 - DNA, 16 bp, Homo sapiens
ctgttgcatagaattc

SEQ ID NO: 6191674 - DNA, 12 bp, Homo sapiens
ctgttgcatggg

SEQ ID NO: 6191675 - DNA, 16 bp, Homo sapiens
ctgttgcatttacttt

SEQ ID NO: 6191676 - DNA, 13 bp, Homo sapiens
ctgttgccagact

SEQ ID NO: 6191677 - DNA, 17 bp, Homo sapiens
ctgttgccagagatgga

SEQ ID NO: 6191678 - DNA, 15 bp, Homo sapiens
ctgttgccatagccc

SEQ ID NO: 6191679 - DNA, 17 bp, Homo sapiens
ctgttgccatggattca

SEQ ID NO: 6191680 - DNA, 17 bp, Homo sapiens
ctgttgcccaggctggc

SEQ ID NO: 6191681 - DNA, 20 bp, Homo sapiens
ctgttgcccaggctggcctg

SEQ ID NO: 6191682 - DNA, 13 bp, Homo sapiens
ctgttgcccccca

SEQ ID NO: 6191683 - DNA, 19 bp, Homo sapiens
ctgttgcccgccctccacc

SEQ ID NO: 6191684 - DNA, 21 bp, Homo sapiens
ctgttgccctttctgtaccat

SEQ ID NO: 6191685 - DNA, 16 bp, Homo sapiens
ctgttgcccttttcct

SEQ ID NO: 6191686 - DNA, 23 bp, Homo sapiens
ctgttgcccttttccttgactat

SEQ ID NO: 6191687 - DNA, 18 bp, Homo sapiens
ctgttgcctaattggaaa

SEQ ID NO: 6191688 - DNA, 14 bp, Homo sapiens
ctgttgcctcatct

SEQ ID NO: 6191689 - DNA, 19 bp, Homo sapiens
gaacgccctcatgctcagc

SEQ ID NO: 6191690 - DNA, 20 bp, Homo sapiens
gaacgccctggtaaggctgg

SEQ ID NO: 6191691 - DNA, 14 bp, Homo sapiens
gaacgccctgtgtc

SEQ ID NO: 6191692 - DNA, 19 bp, Homo sapiens
gaacgccctgtgtccacag

SEQ ID NO: 6191693 - DNA, 20 bp, Homo sapiens
gaacgcggtgtgtaacactg

SEQ ID NO: 6191694 - DNA, 17 bp, Homo sapiens
gaacgcgtgtgtgcctg

SEQ ID NO: 6191695 - DNA, 18 bp, Homo sapiens
gaacgcgtgtgtgcctga

SEQ ID NO: 6191696 - DNA, 15 bp, Homo sapiens
gaacgcgttgaaatt

SEQ ID NO: 6191697 - DNA, 21 bp, Homo sapiens
gaacgctgtgatgctgtgtgc

SEQ ID NO: 6191698 - DNA, 23 bp, Homo sapiens
gaacgctgtgatgctgtgtgccc

SEQ ID NO: 6191699 - DNA, 20 bp, Homo sapiens
gaacgcttcgggaaaatatt

SEQ ID NO: 6191700 - DNA, 19 bp, Homo sapiens
gaacggaacgttggacttt

SEQ ID NO: 6191701 - DNA, 21 bp, Homo sapiens
gaacgggcagccacaggactg

SEQ ID NO: 6191702 - DNA, 22 bp, Homo sapiens
gaacgggcagcctgggcctggg

SEQ ID NO: 6191703 - DNA, 22 bp, Homo sapiens
gaacgggcatgggcctctctgg

SEQ ID NO: 6191704 - DNA, 23 bp, Homo sapiens
gaacgggcatgggcctctctggg

SEQ ID NO: 6191705 - DNA, 19 bp, Homo sapiens
gaacggggctcttctcatt

SEQ ID NO: 6191706 - DNA, 17 bp, Homo sapiens
gaacggtaaatttctgt

SEQ ID NO: 6191707 - DNA, 18 bp, Homo sapiens
gaacggtgaaggtgacag

SEQ ID NO: 6191708 - DNA, 20 bp, Homo sapiens
gaacggtggaggcagaggtg

SEQ ID NO: 6191709 - DNA, 21 bp, Homo sapiens
gaacgtatgtgctcttataaa

SEQ ID NO: 6191710 - DNA, 21 bp, Homo sapiens
gaacgtatttctccagaccca

SEQ ID NO: 6191711 - DNA, 14 bp, Homo sapiens
gaacgtgactgccc

SEQ ID NO: 6191712 - DNA, 13 bp, Homo sapiens
gaacgtgccagca

SEQ ID NO: 6191713 - DNA, 13 bp, Homo sapiens
gaacgtgcttctt

SEQ ID NO: 6191714 - DNA, 18 bp, Homo sapiens
gaacgtgcttctttgtaa

SEQ ID NO: 6191715 - DNA, 23 bp, Homo sapiens
gaacgtgggagttcagctgcttc

SEQ ID NO: 6191716 - DNA, 19 bp, Homo sapiens
gaacgtggtctgattttga

SEQ ID NO: 6191717 - DNA, 15 bp, Homo sapiens
gaacgtgtgtccagg

SEQ ID NO: 6191718 - DNA, 15 bp, Homo sapiens
gaacgttgccacacc

SEQ ID NO: 6191719 - DNA, 23 bp, Homo sapiens
gaacgtttagctgacaaaatact

SEQ ID NO: 6191720 - DNA, 15 bp, Homo sapiens
gaacgttttcttctt

SEQ ID NO: 6191721 - DNA, 22 bp, Homo sapiens
gaacgttttcttctttccctgg

SEQ ID NO: 6191722 - DNA, 19 bp, Homo sapiens
gaacgttttttcctcagtg

SEQ ID NO: 6191723 - DNA, 16 bp, Homo sapiens
gaactaaaatgttcta

SEQ ID NO: 6191724 - DNA, 17 bp, Homo sapiens
gaactaaactttcacac

SEQ ID NO: 6191725 - DNA, 12 bp, Homo sapiens
gaactaaagaag

SEQ ID NO: 6191726 - DNA, 15 bp, Homo sapiens
gaactaaagctggag

SEQ ID NO: 6191727 - DNA, 16 bp, Homo sapiens
gaactaaatatgcaat

SEQ ID NO: 6191728 - DNA, 15 bp, Homo sapiens
gaactaaatttttca

SEQ ID NO: 6191729 - DNA, 17 bp, Homo sapiens
gaactaaatttttcata

SEQ ID NO: 6191730 - DNA, 16 bp, Homo sapiens
gaactaacagaggaga

SEQ ID NO: 6191731 - DNA, 18 bp, Homo sapiens
gaactaacagaggagaaa

SEQ ID NO: 6191732 - DNA, 18 bp, Homo sapiens
gaactaagttttttactt

SEQ ID NO: 6191733 - DNA, 12 bp, Homo sapiens
gaactaatatat

SEQ ID NO: 6191734 - DNA, 15 bp, Homo sapiens
gaactaatatatgaa

SEQ ID NO: 6191735 - DNA, 19 bp, Homo sapiens
gaactaatgacaagtgact

SEQ ID NO: 6191736 - DNA, 22 bp, Homo sapiens
gaactaatgataatcccaccac

SEQ ID NO: 6191737 - DNA, 14 bp, Homo sapiens
gaactaattcattt

SEQ ID NO: 6191738 - DNA, 15 bp, Homo sapiens
gaactaccaaaatga

SEQ ID NO: 6191739 - DNA, 24 bp, Homo sapiens
gaactacgtgacctctgcaagaca

SEQ ID NO: 6191740 - DNA, 14 bp, Homo sapiens
gaactactgaggat

SEQ ID NO: 6191741 - DNA, 21 bp, Homo sapiens
gaactactgtactttgccatt

SEQ ID NO: 6191742 - DNA, 23 bp, Homo sapiens
gaactactttgaaaacaattcag

SEQ ID NO: 6191743 - DNA, 18 bp, Homo sapiens
gaactagagactctgtga

SEQ ID NO: 6191744 - DNA, 23 bp, Homo sapiens
gaactagagactctgtgatctaa

SEQ ID NO: 6191745 - DNA, 23 bp, Homo sapiens
gaactagaggtgttacagaggac

SEQ ID NO: 6191746 - DNA, 17 bp, Homo sapiens
gaactagattataagcc

SEQ ID NO: 6191747 - DNA, 23 bp, Homo sapiens
gaactagccaccaactcttgcag

SEQ ID NO: 6191748 - DNA, 21 bp, Homo sapiens
gaactaggagtcttcactgct

SEQ ID NO: 6191749 - DNA, 16 bp, Homo sapiens
gaactagggaagctca

SEQ ID NO: 6191750 - DNA, 16 bp, Homo sapiens
gaactagggcacccct

SEQ ID NO: 6191751 - DNA, 20 bp, Homo sapiens
gaactagtctacttcttaaa

SEQ ID NO: 6191752 - DNA, 19 bp, Homo sapiens
gaactagtggtggctctga

SEQ ID NO: 6191753 - DNA, 19 bp, Homo sapiens
gaactataaacttaaagct

SEQ ID NO: 6191754 - DNA, 15 bp, Homo sapiens
gaactatagtaactt

SEQ ID NO: 6191755 - DNA, 23 bp, Homo sapiens
gaactatatttaataccaccaac

SEQ ID NO: 6191756 - DNA, 18 bp, Homo sapiens
gaactatgaggagcctct

SEQ ID NO: 6191757 - DNA, 17 bp, Homo sapiens
gaactatgggagcctca

SEQ ID NO: 6191758 - DNA, 18 bp, Homo sapiens
gaactattccccagcagg

SEQ ID NO: 6191759 - DNA, 16 bp, Homo sapiens
gaactattttaaataa

SEQ ID NO: 6191760 - DNA, 17 bp, Homo sapiens
gaactattttaaataaa

SEQ ID NO: 6191761 - DNA, 22 bp, Homo sapiens
gaactattttcaaagacttaag

SEQ ID NO: 6191762 - DNA, 17 bp, Homo sapiens
gaactcaaaaggagaac

SEQ ID NO: 6191763 - DNA, 23 bp, Homo sapiens
gaactcaaaaggagaactgtgct

SEQ ID NO: 6191764 - DNA, 19 bp, Homo sapiens
gaactcaaatggggccaga

SEQ ID NO: 6191765 - DNA, 20 bp, Homo sapiens
gaactcaaatggggccagat

SEQ ID NO: 6191766 - DNA, 22 bp, Homo sapiens
gaactcaaatggggccagatcc

SEQ ID NO: 6191767 - DNA, 16 bp, Homo sapiens
gaactcaaggtggctg

SEQ ID NO: 6191768 - DNA, 20 bp, Homo sapiens
gaactcaatatatagttagc

SEQ ID NO: 6191769 - DNA, 19 bp, Homo sapiens
gaactcaatctaaattaaa

SEQ ID NO: 6191770 - DNA, 21 bp, Homo sapiens
gaactcaatctccagggctcc

SEQ ID NO: 6191771 - DNA, 17 bp, Homo sapiens
gaactcaatgcatgatg

SEQ ID NO: 6191772 - DNA, 20 bp, Homo sapiens
gaactcaatgcatgatgact

SEQ ID NO: 6191773 - DNA, 18 bp, Homo sapiens
gaactcacattggcaagt

SEQ ID NO: 6191774 - DNA, 16 bp, Homo sapiens
gaactcaccgctcacc

SEQ ID NO: 6191775 - DNA, 16 bp, Homo sapiens
gaactcacctggggct

SEQ ID NO: 6191776 - DNA, 16 bp, Homo sapiens
gaactcactctgggct

SEQ ID NO: 6191777 - DNA, 17 bp, Homo sapiens
gaactcactctgggctg

SEQ ID NO: 6191778 - DNA, 18 bp, Homo sapiens
gaactcactctgggctgt

SEQ ID NO: 6191779 - DNA, 14 bp, Homo sapiens
gaactcagaagaga

SEQ ID NO: 6191780 - DNA, 15 bp, Homo sapiens
gaactcagaagagaa

SEQ ID NO: 6191781 - DNA, 13 bp, Homo sapiens
gaactcagagccc

SEQ ID NO: 6191782 - DNA, 16 bp, Homo sapiens
gaactcagagcccctc

SEQ ID NO: 6191783 - DNA, 13 bp, Homo sapiens
gaactcagatcca

SEQ ID NO: 6191784 - DNA, 15 bp, Homo sapiens
gaactcagatccagg

SEQ ID NO: 6191785 - DNA, 19 bp, Homo sapiens
gaactcagcacattcggga

SEQ ID NO: 6191786 - DNA, 17 bp, Homo sapiens
gaactcagcagttgaca

SEQ ID NO: 6191787 - DNA, 21 bp, Homo sapiens
gaactcagcagttgacatcca

SEQ ID NO: 6191788 - DNA, 21 bp, Homo sapiens
gaactcagctgtctgtggctt

SEQ ID NO: 6191789 - DNA, 23 bp, Homo sapiens
gaactcagtagctgaacctgtct

SEQ ID NO: 6191790 - DNA, 16 bp, Homo sapiens
gaactcatcactgtgg

SEQ ID NO: 6191791 - DNA, 20 bp, Homo sapiens
gaactcatctaggtaaatta

SEQ ID NO: 6191792 - DNA, 22 bp, Homo sapiens
gaactcatctaggtaaattaca

SEQ ID NO: 6191793 - DNA, 14 bp, Homo sapiens
gaactcattcctgc

SEQ ID NO: 6191794 - DNA, 16 bp, Homo sapiens
gaactcattcctgcct

SEQ ID NO: 6191795 - DNA, 22 bp, Homo sapiens
gaactcattcctgcctgtctcc

SEQ ID NO: 6191796 - DNA, 13 bp, Homo sapiens
gaactcattctct

SEQ ID NO: 6191797 - DNA, 12 bp, Homo sapiens
gaactccactct

SEQ ID NO: 6191798 - DNA, 22 bp, Homo sapiens
gaactccagctggtgcccccag

SEQ ID NO: 6191799 - DNA, 16 bp, Homo sapiens
gaactccaggctgggc

SEQ ID NO: 6191800 - DNA, 19 bp, Homo sapiens
gaactccatacagcctcta

SEQ ID NO: 6191801 - DNA, 20 bp, Homo sapiens
gaactcccaagaacagcagg

SEQ ID NO: 6191802 - DNA, 11 bp, Homo sapiens
gaactcccagc

SEQ ID NO: 6191803 - DNA, 19 bp, Homo sapiens
gaactcccagcaacacaag

SEQ ID NO: 6191804 - DNA, 14 bp, Homo sapiens
gaactccccagggc

SEQ ID NO: 6191805 - DNA, 21 bp, Homo sapiens
gaactccccagggcctccagg

SEQ ID NO: 6191806 - DNA, 14 bp, Homo sapiens
gaactcccttctcc

SEQ ID NO: 6191807 - DNA, 15 bp, Homo sapiens
gaactcccttctccc

SEQ ID NO: 6191808 - DNA, 15 bp, Homo sapiens
gaactccctttcaac

SEQ ID NO: 6191809 - DNA, 18 bp, Homo sapiens
gaactccgctggatgggg

SEQ ID NO: 6191810 - DNA, 23 bp, Homo sapiens
gaactcctaaacctttgcccctg

SEQ ID NO: 6191811 - DNA, 18 bp, Homo sapiens
gaactcctaaataaacta

SEQ ID NO: 6191812 - DNA, 20 bp, Homo sapiens
gaactcctcaagggcagaga

SEQ ID NO: 6191813 - DNA, 14 bp, Homo sapiens
gaactcctcccacc

SEQ ID NO: 6191814 - DNA, 13 bp, Homo sapiens
gaactcctgaaat

SEQ ID NO: 6191815 - DNA, 23 bp, Homo sapiens
gaactcctgacctcaagtgattc

SEQ ID NO: 6191816 - DNA, 15 bp, Homo sapiens
gaactcctgacctcg

SEQ ID NO: 6191817 - DNA, 11 bp, Homo sapiens
gaactcctgcc

SEQ ID NO: 6191818 - DNA, 13 bp, Homo sapiens
gaactcctggcct

SEQ ID NO: 6191819 - DNA, 11 bp, Homo sapiens
gaactcctggg

SEQ ID NO: 6191820 - DNA, 20 bp, Homo sapiens
gaactcctgggctcaagcag

SEQ ID NO: 6191821 - DNA, 19 bp, Homo sapiens
gaactcctgtcttctttct

SEQ ID NO: 6191822 - DNA, 21 bp, Homo sapiens
gaactcctgtgtgtggaaggc

SEQ ID NO: 6191823 - DNA, 17 bp, Homo sapiens
gaactccttccccactt

SEQ ID NO: 6191824 - DNA, 20 bp, Homo sapiens
gaactccttggcctagccca

SEQ ID NO: 6191825 - DNA, 22 bp, Homo sapiens
gaactcgaagcccttccagtgg

SEQ ID NO: 6191826 - DNA, 12 bp, Homo sapiens
gaactcgatgca

SEQ ID NO: 6191827 - DNA, 15 bp, Homo sapiens
gaactcgatgcactg

SEQ ID NO: 6191828 - DNA, 17 bp, Homo sapiens
gaactcgcgctcagtaa

SEQ ID NO: 6191829 - DNA, 15 bp, Homo sapiens
gaactcgctcagaag

SEQ ID NO: 6191830 - DNA, 17 bp, Homo sapiens
gaactcgggattacaga

SEQ ID NO: 6191831 - DNA, 16 bp, Homo sapiens
gaactcgttaaagcaa

SEQ ID NO: 6191832 - DNA, 16 bp, Homo sapiens
gaactctaaccagtgt

SEQ ID NO: 6191833 - DNA, 19 bp, Homo sapiens
gaactctagagagccttaa

SEQ ID NO: 6191834 - DNA, 12 bp, Homo sapiens
gaactctatttt

SEQ ID NO: 6191835 - DNA, 17 bp, Homo sapiens
gaactctcaaaagtcta

SEQ ID NO: 6191836 - DNA, 22 bp, Homo sapiens
gaactctcaaaagtctattttt

SEQ ID NO: 6191837 - DNA, 18 bp, Homo sapiens
gaactctcagaaataaat

SEQ ID NO: 6191838 - DNA, 12 bp, Homo sapiens
gaactctcagga

SEQ ID NO: 6191839 - DNA, 14 bp, Homo sapiens
gaactctcccctcc

SEQ ID NO: 6191840 - DNA, 14 bp, Homo sapiens
gaactctcctcttt

SEQ ID NO: 6191841 - DNA, 16 bp, Homo sapiens
gaactctcctcttttt

SEQ ID NO: 6191842 - DNA, 21 bp, Homo sapiens
gaactctctagttccctcagt

SEQ ID NO: 6191843 - DNA, 18 bp, Homo sapiens
gaactctctccctggtct

SEQ ID NO: 6191844 - DNA, 16 bp, Homo sapiens
gaactctctgcctgta

SEQ ID NO: 6191845 - DNA, 11 bp, Homo sapiens
gaactctgaca

SEQ ID NO: 6191846 - DNA, 13 bp, Homo sapiens
gaactctgacaag

SEQ ID NO: 6191847 - DNA, 16 bp, Homo sapiens
gaactctgcaactgaa

SEQ ID NO: 6191848 - DNA, 15 bp, Homo sapiens
gaactctgcaggcag

SEQ ID NO: 6191849 - DNA, 16 bp, Homo sapiens
gaactctgcctgccct

SEQ ID NO: 6191850 - DNA, 17 bp, Homo sapiens
gaactctggcttccagg

SEQ ID NO: 6191851 - DNA, 20 bp, Homo sapiens
gaactctggcttccaggtat

SEQ ID NO: 6191852 - DNA, 13 bp, Homo sapiens
gaactctggcttt

SEQ ID NO: 6191853 - DNA, 22 bp, Homo sapiens
gaactctgggctcaagcaatcc

SEQ ID NO: 6191854 - DNA, 13 bp, Homo sapiens
gaactctgttccc

SEQ ID NO: 6191855 - DNA, 16 bp, Homo sapiens
gaactctgttccccca

SEQ ID NO: 6191856 - DNA, 19 bp, Homo sapiens
gaactctgttcccccaccc

SEQ ID NO: 6191857 - DNA, 22 bp, Homo sapiens
gaactcttaaatactttttcag

SEQ ID NO: 6191858 - DNA, 22 bp, Homo sapiens
gaactcttcctccaaggacaga

SEQ ID NO: 6191859 - DNA, 16 bp, Homo sapiens
gaactcttcctcctcc

SEQ ID NO: 6191860 - DNA, 14 bp, Homo sapiens
gaactcttctcatt

SEQ ID NO: 6191861 - DNA, 19 bp, Homo sapiens
gaactcttctcattacttg

SEQ ID NO: 6191862 - DNA, 15 bp, Homo sapiens
gaactcttgacagct

SEQ ID NO: 6191863 - DNA, 13 bp, Homo sapiens
gaactctttcccc

SEQ ID NO: 6191864 - DNA, 14 bp, Homo sapiens
gaactctttcccca

SEQ ID NO: 6191865 - DNA, 17 bp, Homo sapiens
gaactctttccccagct

SEQ ID NO: 6191866 - DNA, 15 bp, Homo sapiens
gaactgaaaaccagt

SEQ ID NO: 6191867 - DNA, 13 bp, Homo sapiens
ctgttgcctcctc

SEQ ID NO: 6191868 - DNA, 15 bp, Homo sapiens
ctgttgcctcctctc

SEQ ID NO: 6191869 - DNA, 20 bp, Homo sapiens
ctgttgcctcctctctccct

SEQ ID NO: 6191870 - DNA, 23 bp, Homo sapiens
ctgttgcctcctctctccctgcc

SEQ ID NO: 6191871 - DNA, 13 bp, Homo sapiens
ctgttgcctttta

SEQ ID NO: 6191872 - DNA, 21 bp, Homo sapiens
ctgttgcgacgcgggcttctg

SEQ ID NO: 6191873 - DNA, 18 bp, Homo sapiens
ctgttgcgctcccgcatt

SEQ ID NO: 6191874 - DNA, 18 bp, Homo sapiens
ctgttgcgtgacactctc

SEQ ID NO: 6191875 - DNA, 23 bp, Homo sapiens
ctgttgcgtgacactctccttgc

SEQ ID NO: 6191876 - DNA, 23 bp, Homo sapiens
ctgttgctatagagcctacctgt

SEQ ID NO: 6191877 - DNA, 15 bp, Homo sapiens
ctgttgctatttgta

SEQ ID NO: 6191878 - DNA, 11 bp, Homo sapiens
ctgttgctcaa

SEQ ID NO: 6191879 - DNA, 14 bp, Homo sapiens
ctgttgctgatttt

SEQ ID NO: 6191880 - DNA, 18 bp, Homo sapiens
ctgttgctggactgagga

SEQ ID NO: 6191881 - DNA, 19 bp, Homo sapiens
ctgttgctggactgaggac

SEQ ID NO: 6191882 - DNA, 14 bp, Homo sapiens
ctgttgctggaggg

SEQ ID NO: 6191883 - DNA, 15 bp, Homo sapiens
ctgttgctggagggg

SEQ ID NO: 6191884 - DNA, 17 bp, Homo sapiens
ctgttgctggaggggct

SEQ ID NO: 6191885 - DNA, 11 bp, Homo sapiens
ctgttgctggt

SEQ ID NO: 6191886 - DNA, 21 bp, Homo sapiens
ctgttgctggtgtactctagg

SEQ ID NO: 6191887 - DNA, 23 bp, Homo sapiens
ctgttgctggtgtactctaggac

SEQ ID NO: 6191888 - DNA, 20 bp, Homo sapiens
ctgttgctgtgtttaatttg

SEQ ID NO: 6191889 - DNA, 14 bp, Homo sapiens
ctgttgctgttggc

SEQ ID NO: 6191890 - DNA, 15 bp, Homo sapiens
ctgttgctgttggca

SEQ ID NO: 6191891 - DNA, 16 bp, Homo sapiens
ctgttgcttacaattt

SEQ ID NO: 6191892 - DNA, 15 bp, Homo sapiens
ctgttgcttgaatag

SEQ ID NO: 6191893 - DNA, 22 bp, Homo sapiens
ctgttgctttaatatgagcttc

SEQ ID NO: 6191894 - DNA, 19 bp, Homo sapiens
ctgttgctttgaaaaatct

SEQ ID NO: 6191895 - DNA, 12 bp, Homo sapiens
ctgttgcttttt

SEQ ID NO: 6191896 - DNA, 13 bp, Homo sapiens
ctgttggaagaaa

SEQ ID NO: 6191897 - DNA, 16 bp, Homo sapiens
ctgttggaagttcact

SEQ ID NO: 6191898 - DNA, 15 bp, Homo sapiens
ctgttggacagctgc

SEQ ID NO: 6191899 - DNA, 19 bp, Homo sapiens
ctgttggacagctgcttgt

SEQ ID NO: 6191900 - DNA, 20 bp, Homo sapiens
ctgttggacagctgcttgtg

SEQ ID NO: 6191901 - DNA, 20 bp, Homo sapiens
ctgttggacccgctctggac

SEQ ID NO: 6191902 - DNA, 15 bp, Homo sapiens
ctgttggagaaagaa

SEQ ID NO: 6191903 - DNA, 23 bp, Homo sapiens
ctgttggaggaccccgagggctg

SEQ ID NO: 6191904 - DNA, 18 bp, Homo sapiens
ctgttggattccatgcta

SEQ ID NO: 6191905 - DNA, 23 bp, Homo sapiens
ctgttggcactcacagacctgga

SEQ ID NO: 6191906 - DNA, 16 bp, Homo sapiens
ctgttggcagctctag

SEQ ID NO: 6191907 - DNA, 20 bp, Homo sapiens
ctgttggcaggcccactccc

SEQ ID NO: 6191908 - DNA, 21 bp, Homo sapiens
ctgttggcctcgcctgggccc

SEQ ID NO: 6191909 - DNA, 22 bp, Homo sapiens
ctgttggcctcgcctgggccca

SEQ ID NO: 6191910 - DNA, 13 bp, Homo sapiens
ctgttggcctgtg

SEQ ID NO: 6191911 - DNA, 17 bp, Homo sapiens
ctgttggcctgtgggcc

SEQ ID NO: 6191912 - DNA, 13 bp, Homo sapiens
ctgttggctgctg

SEQ ID NO: 6191913 - DNA, 14 bp, Homo sapiens
ctgttggctggggg

SEQ ID NO: 6191914 - DNA, 19 bp, Homo sapiens
ctgttggctgggggcctca

SEQ ID NO: 6191915 - DNA, 22 bp, Homo sapiens
ctgttggctgggggcctcagtg

SEQ ID NO: 6191916 - DNA, 17 bp, Homo sapiens
ctgttgggagaaagcaa

SEQ ID NO: 6191917 - DNA, 20 bp, Homo sapiens
ctgttgggagaaagcaatac

SEQ ID NO: 6191918 - DNA, 12 bp, Homo sapiens
ctgttgggagag

SEQ ID NO: 6191919 - DNA, 20 bp, Homo sapiens
ctgttgggagagggcgcagg

SEQ ID NO: 6191920 - DNA, 22 bp, Homo sapiens
ctgttgggagagggcgcaggcc

SEQ ID NO: 6191921 - DNA, 16 bp, Homo sapiens
ctgttgggccaggagc

SEQ ID NO: 6191922 - DNA, 20 bp, Homo sapiens
ctgttgggccaggagcctcc

SEQ ID NO: 6191923 - DNA, 12 bp, Homo sapiens
ctgttgggctga

SEQ ID NO: 6191924 - DNA, 16 bp, Homo sapiens
ctgttgggctgaaccc

SEQ ID NO: 6191925 - DNA, 16 bp, Homo sapiens
ctgttgggggcttcag

SEQ ID NO: 6191926 - DNA, 21 bp, Homo sapiens
ctgttgggggcttcaggtctc

SEQ ID NO: 6191927 - DNA, 18 bp, Homo sapiens
ctgttgggtttttgctgt

SEQ ID NO: 6191928 - DNA, 14 bp, Homo sapiens
ctgttggtcagagg

SEQ ID NO: 6191929 - DNA, 16 bp, Homo sapiens
ctgttggtctacagaa

SEQ ID NO: 6191930 - DNA, 17 bp, Homo sapiens
ctgttggtctacagaaa

SEQ ID NO: 6191931 - DNA, 14 bp, Homo sapiens
ctgttggtctgcct

SEQ ID NO: 6191932 - DNA, 21 bp, Homo sapiens
ctgttggtcttaactaatgta

SEQ ID NO: 6191933 - DNA, 15 bp, Homo sapiens
ctgttggttcaaact

SEQ ID NO: 6191934 - DNA, 16 bp, Homo sapiens
ctgttggttcatccag

SEQ ID NO: 6191935 - DNA, 14 bp, Homo sapiens
ctgttggttccaag

SEQ ID NO: 6191936 - DNA, 20 bp, Homo sapiens
ctgttggttccaagccctgg

SEQ ID NO: 6191937 - DNA, 18 bp, Homo sapiens
ctgttggttctgattagg

SEQ ID NO: 6191938 - DNA, 17 bp, Homo sapiens
ctgttggtttcatttga

SEQ ID NO: 6191939 - DNA, 14 bp, Homo sapiens
ctgttgtaaatgac

SEQ ID NO: 6191940 - DNA, 11 bp, Homo sapiens
ctgttgtaact

SEQ ID NO: 6191941 - DNA, 22 bp, Homo sapiens
ctgttgtaactaggctcagaga

SEQ ID NO: 6191942 - DNA, 12 bp, Homo sapiens
ctgttgtaactt

SEQ ID NO: 6191943 - DNA, 21 bp, Homo sapiens
ctgttgtaacttatgtagata

SEQ ID NO: 6191944 - DNA, 21 bp, Homo sapiens
ctgttgtaatatcagttacag

SEQ ID NO: 6191945 - DNA, 22 bp, Homo sapiens
ctgttgtaatttaatgactttt

SEQ ID NO: 6191946 - DNA, 11 bp, Homo sapiens
ctgttgtacaa

SEQ ID NO: 6191947 - DNA, 17 bp, Homo sapiens
ctgttgtacaatcatgt

SEQ ID NO: 6191948 - DNA, 20 bp, Homo sapiens
ctgttgtacaatcatgttct

SEQ ID NO: 6191949 - DNA, 16 bp, Homo sapiens
ctgttgtacacagtct

SEQ ID NO: 6191950 - DNA, 13 bp, Homo sapiens
ctgttgtacattt

SEQ ID NO: 6191951 - DNA, 15 bp, Homo sapiens
ctgttgtacatttat

SEQ ID NO: 6191952 - DNA, 22 bp, Homo sapiens
ctgttgtacatttatgatttaa

SEQ ID NO: 6191953 - DNA, 18 bp, Homo sapiens
ctgttgtagaaattctta

SEQ ID NO: 6191954 - DNA, 15 bp, Homo sapiens
ctgttgtagaagaca

SEQ ID NO: 6191955 - DNA, 12 bp, Homo sapiens
ctgttgtcattg

SEQ ID NO: 6191956 - DNA, 16 bp, Homo sapiens
ctgttgtcattgcttt

SEQ ID NO: 6191957 - DNA, 17 bp, Homo sapiens
ctgttgtcattgcttta

SEQ ID NO: 6191958 - DNA, 17 bp, Homo sapiens
ctgttgtccctctgcta

SEQ ID NO: 6191959 - DNA, 16 bp, Homo sapiens
ctgttgtcctatggga

SEQ ID NO: 6191960 - DNA, 12 bp, Homo sapiens
ctgttgtcctga

SEQ ID NO: 6191961 - DNA, 18 bp, Homo sapiens
ctgttgtccttaaaattc

SEQ ID NO: 6191962 - DNA, 17 bp, Homo sapiens
ctgttgtctcttctcct

SEQ ID NO: 6191963 - DNA, 14 bp, Homo sapiens
ctgttgtctgcgcc

SEQ ID NO: 6191964 - DNA, 18 bp, Homo sapiens
ctgttgtgagctttgaag

SEQ ID NO: 6191965 - DNA, 23 bp, Homo sapiens
ctgttgtgcagtgtgcctgtcac

SEQ ID NO: 6191966 - DNA, 15 bp, Homo sapiens
ctgttgtgccacaga

SEQ ID NO: 6191967 - DNA, 22 bp, Homo sapiens
ctgttgtggaaagtagctgcta

SEQ ID NO: 6191968 - DNA, 14 bp, Homo sapiens
ctgttgtgggcgct

SEQ ID NO: 6191969 - DNA, 13 bp, Homo sapiens
ctgttgttactgg

SEQ ID NO: 6191970 - DNA, 15 bp, Homo sapiens
ctgttgttatgatgt

SEQ ID NO: 6191971 - DNA, 17 bp, Homo sapiens
ctgttgttatgatgtgc

SEQ ID NO: 6191972 - DNA, 23 bp, Homo sapiens
ctgttgttatgatgtgcttaaca

SEQ ID NO: 6191973 - DNA, 15 bp, Homo sapiens
ctgttgttcagaagt

SEQ ID NO: 6191974 - DNA, 12 bp, Homo sapiens
ctgttgttccat

SEQ ID NO: 6191975 - DNA, 20 bp, Homo sapiens
ctgttgttccattttatgca

SEQ ID NO: 6191976 - DNA, 23 bp, Homo sapiens
ctgttgttgttaatgaaaatgtc

SEQ ID NO: 6191977 - DNA, 16 bp, Homo sapiens
ctgttgtttctataaa

SEQ ID NO: 6191978 - DNA, 17 bp, Homo sapiens
ctgttgtttctataaat

SEQ ID NO: 6191979 - DNA, 21 bp, Homo sapiens
ctgttgtttctataaatgact

SEQ ID NO: 6191980 - DNA, 23 bp, Homo sapiens
ctgttgtttctataaatgactat

SEQ ID NO: 6191981 - DNA, 19 bp, Homo sapiens
ctgttgtttggttcaggga

SEQ ID NO: 6191982 - DNA, 22 bp, Homo sapiens
ctgtttaaaaaaagtatatatt

SEQ ID NO: 6191983 - DNA, 16 bp, Homo sapiens
ctgtttaaaaaaccac

SEQ ID NO: 6191984 - DNA, 19 bp, Homo sapiens
ctgtttaaatatttcaaga

SEQ ID NO: 6191985 - DNA, 21 bp, Homo sapiens
ctgtttaaattgctcacagtt

SEQ ID NO: 6191986 - DNA, 22 bp, Homo sapiens
ctgtttaacgtgaggtttcagt

SEQ ID NO: 6191987 - DNA, 19 bp, Homo sapiens
ctgtttaactccctagtta

SEQ ID NO: 6191988 - DNA, 13 bp, Homo sapiens
ctgtttaagaaaa

SEQ ID NO: 6191989 - DNA, 20 bp, Homo sapiens
ctgtttaagaaaagtatttt

SEQ ID NO: 6191990 - DNA, 14 bp, Homo sapiens
ctgtttaagagaca

SEQ ID NO: 6191991 - DNA, 16 bp, Homo sapiens
ctgtttaatatttaaa

SEQ ID NO: 6191992 - DNA, 18 bp, Homo sapiens
ctgtttaatatttaaaca

SEQ ID NO: 6191993 - DNA, 17 bp, Homo sapiens
ctgtttacaagaaaaaa

SEQ ID NO: 6191994 - DNA, 18 bp, Homo sapiens
ctgtttacaagaaaaaat

SEQ ID NO: 6191995 - DNA, 14 bp, Homo sapiens
ctgtttacagacaa

SEQ ID NO: 6191996 - DNA, 17 bp, Homo sapiens
ctgtttaccctccctgt

SEQ ID NO: 6191997 - DNA, 19 bp, Homo sapiens
ctgtttaccctccctgtcc

SEQ ID NO: 6191998 - DNA, 16 bp, Homo sapiens
ctgtttaccgcccacc

SEQ ID NO: 6191999 - DNA, 22 bp, Homo sapiens
ctgtttactcccttctgtagtt

SEQ ID NO: 6192000 - DNA, 14 bp, Homo sapiens
ctgtttactgacat

SEQ ID NO: 6192001 - DNA, 15 bp, Homo sapiens
ctgtttactgcaagg

SEQ ID NO: 6192002 - DNA, 13 bp, Homo sapiens
ctgtttactgctt

SEQ ID NO: 6192003 - DNA, 15 bp, Homo sapiens
ctgtttactggttct

SEQ ID NO: 6192004 - DNA, 13 bp, Homo sapiens
ctgtttagaacac

SEQ ID NO: 6192005 - DNA, 20 bp, Homo sapiens
ctgtttagagtaaataaact

SEQ ID NO: 6192006 - DNA, 21 bp, Homo sapiens
ctgtttagagtaaataaactg

SEQ ID NO: 6192007 - DNA, 12 bp, Homo sapiens
ctgtttagataa

SEQ ID NO: 6192008 - DNA, 17 bp, Homo sapiens
ctgtttagataatacac

SEQ ID NO: 6192009 - DNA, 21 bp, Homo sapiens
ctgtttagcagaactcattct

SEQ ID NO: 6192010 - DNA, 23 bp, Homo sapiens
ctgtttagcttcctccagaggag

SEQ ID NO: 6192011 - DNA, 20 bp, Homo sapiens
ctgtttagtagcagtgattg

SEQ ID NO: 6192012 - DNA, 18 bp, Homo sapiens
ctgtttataatctgaaga

SEQ ID NO: 6192013 - DNA, 19 bp, Homo sapiens
ctgtttataatctgaagat

SEQ ID NO: 6192014 - DNA, 13 bp, Homo sapiens
ctgtttataatga

SEQ ID NO: 6192015 - DNA, 16 bp, Homo sapiens
ctgtttataatgaaga

SEQ ID NO: 6192016 - DNA, 17 bp, Homo sapiens
ctgtttataatgaagaa

SEQ ID NO: 6192017 - DNA, 15 bp, Homo sapiens
ctgtttatacttgag

SEQ ID NO: 6192018 - DNA, 10 bp, Homo sapiens
ctgtttatat

SEQ ID NO: 6192019 - DNA, 21 bp, Homo sapiens
ctgtttatataattttgcagc

SEQ ID NO: 6192020 - DNA, 19 bp, Homo sapiens
ctgtttatatattgaaagt

SEQ ID NO: 6192021 - DNA, 14 bp, Homo sapiens
ctgtttatatcttc

SEQ ID NO: 6192022 - DNA, 13 bp, Homo sapiens
ctgtttatggaaa

SEQ ID NO: 6192023 - DNA, 15 bp, Homo sapiens
ctgtttatggcctca

SEQ ID NO: 6192024 - DNA, 19 bp, Homo sapiens
ctgtttatggcctcagctg

SEQ ID NO: 6192025 - DNA, 22 bp, Homo sapiens
ctgtttatggcctcagctgcct

SEQ ID NO: 6192026 - DNA, 20 bp, Homo sapiens
ctgtttatgggtttcttcca

SEQ ID NO: 6192027 - DNA, 22 bp, Homo sapiens
ctgtttattaaagtacaaccat

SEQ ID NO: 6192028 - DNA, 14 bp, Homo sapiens
ctgtttattaatct

SEQ ID NO: 6192029 - DNA, 18 bp, Homo sapiens
ctgtttattaatcttagt

SEQ ID NO: 6192030 - DNA, 13 bp, Homo sapiens
ctgtttattactt

SEQ ID NO: 6192031 - DNA, 18 bp, Homo sapiens
ctgtttattacttccatg

SEQ ID NO: 6192032 - DNA, 19 bp, Homo sapiens
ctgtttattacttccatga

SEQ ID NO: 6192033 - DNA, 21 bp, Homo sapiens
ctgtttattcatatgcatatt

SEQ ID NO: 6192034 - DNA, 20 bp, Homo sapiens
ctgtttattctctgctgcat

SEQ ID NO: 6192035 - DNA, 20 bp, Homo sapiens
ctgtttattctgggaaatgt

SEQ ID NO: 6192036 - DNA, 18 bp, Homo sapiens
ctgtttattcttccagaa

SEQ ID NO: 6192037 - DNA, 19 bp, Homo sapiens
ctgtttattcttccagaat

SEQ ID NO: 6192038 - DNA, 23 bp, Homo sapiens
ctgtttattcttccagaatgctg

SEQ ID NO: 6192039 - DNA, 12 bp, Homo sapiens
ctgtttattgcc

SEQ ID NO: 6192040 - DNA, 15 bp, Homo sapiens
ctgtttattgccatt

SEQ ID NO: 6192041 - DNA, 21 bp, Homo sapiens
ctgtttatttaaggatggatg

SEQ ID NO: 6192042 - DNA, 18 bp, Homo sapiens
ctgtttatttttaaattt

SEQ ID NO: 6192043 - DNA, 12 bp, Homo sapiens
ctgtttcaaaca

SEQ ID NO: 6192044 - DNA, 13 bp, Homo sapiens
ctgtttcaaatgt

SEQ ID NO: 6192045 - DNA, 22 bp, Homo sapiens
ctgtttcaagccctcctcccca

SEQ ID NO: 6192046 - DNA, 13 bp, Homo sapiens
gaactgaaaagag

SEQ ID NO: 6192047 - DNA, 14 bp, Homo sapiens
gaactgaaaagaga

SEQ ID NO: 6192048 - DNA, 17 bp, Homo sapiens
gaactgaaacttttcta

SEQ ID NO: 6192049 - DNA, 13 bp, Homo sapiens
gaactgaaataaa

SEQ ID NO: 6192050 - DNA, 21 bp, Homo sapiens
gaactgaaataaaaaattatg

SEQ ID NO: 6192051 - DNA, 13 bp, Homo sapiens
gaactgaaatcat

SEQ ID NO: 6192052 - DNA, 19 bp, Homo sapiens
gaactgaacgtcctgcagc

SEQ ID NO: 6192053 - DNA, 15 bp, Homo sapiens
gaactgaactgtaac

SEQ ID NO: 6192054 - DNA, 14 bp, Homo sapiens
gaactgaagcagag

SEQ ID NO: 6192055 - DNA, 17 bp, Homo sapiens
gaactgaccctcaggca

SEQ ID NO: 6192056 - DNA, 17 bp, Homo sapiens
gaactgactttctcccc

SEQ ID NO: 6192057 - DNA, 16 bp, Homo sapiens
gaactgagaaggcagg

SEQ ID NO: 6192058 - DNA, 15 bp, Homo sapiens
gaactgagcatctcc

SEQ ID NO: 6192059 - DNA, 22 bp, Homo sapiens
gaactgagccaaacacactgta

SEQ ID NO: 6192060 - DNA, 15 bp, Homo sapiens
gaactgagccccagc

SEQ ID NO: 6192061 - DNA, 23 bp, Homo sapiens
gaactgagccccagcgggctggc

SEQ ID NO: 6192062 - DNA, 17 bp, Homo sapiens
gaactgagctgggcagg

SEQ ID NO: 6192063 - DNA, 14 bp, Homo sapiens
gaactgagcttgga

SEQ ID NO: 6192064 - DNA, 15 bp, Homo sapiens
gaactgagcttggaa

SEQ ID NO: 6192065 - DNA, 16 bp, Homo sapiens
gaactgagcttggaag

SEQ ID NO: 6192066 - DNA, 22 bp, Homo sapiens
gaactgaggagatgaccaggga

SEQ ID NO: 6192067 - DNA, 17 bp, Homo sapiens
gaactgaggccctgtga

SEQ ID NO: 6192068 - DNA, 13 bp, Homo sapiens
gaactgaggcctt

SEQ ID NO: 6192069 - DNA, 16 bp, Homo sapiens
gaactgagggcaaggg

SEQ ID NO: 6192070 - DNA, 13 bp, Homo sapiens
gaactgagtcacg

SEQ ID NO: 6192071 - DNA, 14 bp, Homo sapiens
gaactgatacatct

SEQ ID NO: 6192072 - DNA, 15 bp, Homo sapiens
gaactgatacatctg

SEQ ID NO: 6192073 - DNA, 19 bp, Homo sapiens
gaactgatagttactgttg

SEQ ID NO: 6192074 - DNA, 22 bp, Homo sapiens
gaactgatcatgtttatgagaa

SEQ ID NO: 6192075 - DNA, 19 bp, Homo sapiens
gaactgatgtagaaggcag

SEQ ID NO: 6192076 - DNA, 20 bp, Homo sapiens
gaactgattgctcccaggat

SEQ ID NO: 6192077 - DNA, 21 bp, Homo sapiens
gaactgattttacaaattaat

SEQ ID NO: 6192078 - DNA, 13 bp, Homo sapiens
gaactgcaaagct

SEQ ID NO: 6192079 - DNA, 16 bp, Homo sapiens
gaactgcaactccagc

SEQ ID NO: 6192080 - DNA, 18 bp, Homo sapiens
gaactgcaactccagcgt

SEQ ID NO: 6192081 - DNA, 19 bp, Homo sapiens
gaactgcacaatgaccagc

SEQ ID NO: 6192082 - DNA, 22 bp, Homo sapiens
gaactgcacaatgaccagcagg

SEQ ID NO: 6192083 - DNA, 23 bp, Homo sapiens
gaactgcacaatgaccagcagga

SEQ ID NO: 6192084 - DNA, 18 bp, Homo sapiens
gaactgcacatgaagaaa

SEQ ID NO: 6192085 - DNA, 20 bp, Homo sapiens
gaactgcacatgaagaaata

SEQ ID NO: 6192086 - DNA, 18 bp, Homo sapiens
gaactgcacgttctatat

SEQ ID NO: 6192087 - DNA, 12 bp, Homo sapiens
gaactgcacttt

SEQ ID NO: 6192088 - DNA, 13 bp, Homo sapiens
gaactgcactttt

SEQ ID NO: 6192089 - DNA, 16 bp, Homo sapiens
gaactgcagacctcac

SEQ ID NO: 6192090 - DNA, 19 bp, Homo sapiens
gaactgcagacctcactgt

SEQ ID NO: 6192091 - DNA, 16 bp, Homo sapiens
gaactgcagacctgtc

SEQ ID NO: 6192092 - DNA, 18 bp, Homo sapiens
gaactgcagacctgtcct

SEQ ID NO: 6192093 - DNA, 21 bp, Homo sapiens
gaactgcagatagcccaggag

SEQ ID NO: 6192094 - DNA, 23 bp, Homo sapiens
gaactgcagatagcccaggagca

SEQ ID NO: 6192095 - DNA, 12 bp, Homo sapiens
gaactgcagtga

SEQ ID NO: 6192096 - DNA, 15 bp, Homo sapiens
gaactgcatggggag

SEQ ID NO: 6192097 - DNA, 14 bp, Homo sapiens
gaactgccaagaaa

SEQ ID NO: 6192098 - DNA, 15 bp, Homo sapiens
gaactgccaagaaaa

SEQ ID NO: 6192099 - DNA, 17 bp, Homo sapiens
gaactgccaccttgggt

SEQ ID NO: 6192100 - DNA, 20 bp, Homo sapiens
gaactgccattattttctgt

SEQ ID NO: 6192101 - DNA, 15 bp, Homo sapiens
gaactgcccccactg

SEQ ID NO: 6192102 - DNA, 16 bp, Homo sapiens
gaactgcccttgctgc

SEQ ID NO: 6192103 - DNA, 18 bp, Homo sapiens
gaactgcccttgctgccc

SEQ ID NO: 6192104 - DNA, 17 bp, Homo sapiens
gaactgcctctttcctg

SEQ ID NO: 6192105 - DNA, 14 bp, Homo sapiens
gaactgcctgggcc

SEQ ID NO: 6192106 - DNA, 21 bp, Homo sapiens
gaactgcctttggcagagttc

SEQ ID NO: 6192107 - DNA, 17 bp, Homo sapiens
gaactgctctactttga

SEQ ID NO: 6192108 - DNA, 14 bp, Homo sapiens
gaactgctgccact

SEQ ID NO: 6192109 - DNA, 12 bp, Homo sapiens
gaactgctgctg

SEQ ID NO: 6192110 - DNA, 13 bp, Homo sapiens
gaactgctgctgg

SEQ ID NO: 6192111 - DNA, 14 bp, Homo sapiens
gaactgctgctggt

SEQ ID NO: 6192112 - DNA, 12 bp, Homo sapiens
gaactgctgggg

SEQ ID NO: 6192113 - DNA, 13 bp, Homo sapiens
gaactgctggggc

SEQ ID NO: 6192114 - DNA, 17 bp, Homo sapiens
gaactgcttactagccc

SEQ ID NO: 6192115 - DNA, 16 bp, Homo sapiens
gaactgcttgcatttc

SEQ ID NO: 6192116 - DNA, 21 bp, Homo sapiens
gaactgctttatcccacggaa

SEQ ID NO: 6192117 - DNA, 16 bp, Homo sapiens
gaactgctttctttcg

SEQ ID NO: 6192118 - DNA, 15 bp, Homo sapiens
gaactggaacacaca

SEQ ID NO: 6192119 - DNA, 16 bp, Homo sapiens
gaactggaagaaagca

SEQ ID NO: 6192120 - DNA, 14 bp, Homo sapiens
gaactggaataata

SEQ ID NO: 6192121 - DNA, 15 bp, Homo sapiens
gaactggacacaata

SEQ ID NO: 6192122 - DNA, 23 bp, Homo sapiens
gaactggacacaataggtctttc

SEQ ID NO: 6192123 - DNA, 17 bp, Homo sapiens
gaactggagccatgggc

SEQ ID NO: 6192124 - DNA, 14 bp, Homo sapiens
gaactggagggtga

SEQ ID NO: 6192125 - DNA, 18 bp, Homo sapiens
gaactggcaattgtctat

SEQ ID NO: 6192126 - DNA, 16 bp, Homo sapiens
gaactggcaggagcct

SEQ ID NO: 6192127 - DNA, 16 bp, Homo sapiens
gaactggccccagctc

SEQ ID NO: 6192128 - DNA, 21 bp, Homo sapiens
gaactggctcctttgcctctg

SEQ ID NO: 6192129 - DNA, 11 bp, Homo sapiens
gaactggctgc

SEQ ID NO: 6192130 - DNA, 15 bp, Homo sapiens
gaactggctgggccc

SEQ ID NO: 6192131 - DNA, 19 bp, Homo sapiens
gaactggctgggcccctgg

SEQ ID NO: 6192132 - DNA, 15 bp, Homo sapiens
gaactggctgtgaag

SEQ ID NO: 6192133 - DNA, 19 bp, Homo sapiens
gaactgggaaaacagtgaa

SEQ ID NO: 6192134 - DNA, 16 bp, Homo sapiens
gaactgggaagatgct

SEQ ID NO: 6192135 - DNA, 18 bp, Homo sapiens
gaactgggaagatgctgg

SEQ ID NO: 6192136 - DNA, 20 bp, Homo sapiens
gaactgggaagatgctggcc

SEQ ID NO: 6192137 - DNA, 21 bp, Homo sapiens
gaactgggaagatgctggccc

SEQ ID NO: 6192138 - DNA, 23 bp, Homo sapiens
gaactgggagtccagggagggag

SEQ ID NO: 6192139 - DNA, 22 bp, Homo sapiens
gaactgggcacagattgaagaa

SEQ ID NO: 6192140 - DNA, 19 bp, Homo sapiens
gaactgggcatatttctaa

SEQ ID NO: 6192141 - DNA, 15 bp, Homo sapiens
gaactgggctgggcc

SEQ ID NO: 6192142 - DNA, 21 bp, Homo sapiens
gaactggggctttgccttgca

SEQ ID NO: 6192143 - DNA, 22 bp, Homo sapiens
gaactggggctttgccttgcag

SEQ ID NO: 6192144 - DNA, 17 bp, Homo sapiens
gaactgggggctagcca

SEQ ID NO: 6192145 - DNA, 22 bp, Homo sapiens
gaactgggtatgaggctggggc

SEQ ID NO: 6192146 - DNA, 22 bp, Homo sapiens
gaactgggttctttggaagcag

SEQ ID NO: 6192147 - DNA, 15 bp, Homo sapiens
gaactggtagaaaaa

SEQ ID NO: 6192148 - DNA, 18 bp, Homo sapiens
gaactggtccaggccagg

SEQ ID NO: 6192149 - DNA, 14 bp, Homo sapiens
gaactggtcttcct

SEQ ID NO: 6192150 - DNA, 23 bp, Homo sapiens
gaactggttcaagagacactgct

SEQ ID NO: 6192151 - DNA, 18 bp, Homo sapiens
gaactgtagatgatgtat

SEQ ID NO: 6192152 - DNA, 18 bp, Homo sapiens
gaactgtatattattgct

SEQ ID NO: 6192153 - DNA, 18 bp, Homo sapiens
gaactgtattattgcaat

SEQ ID NO: 6192154 - DNA, 14 bp, Homo sapiens
gaactgtccagaga

SEQ ID NO: 6192155 - DNA, 16 bp, Homo sapiens
gaactgtccagagagc

SEQ ID NO: 6192156 - DNA, 17 bp, Homo sapiens
gaactgtccagagagca

SEQ ID NO: 6192157 - DNA, 17 bp, Homo sapiens
gaactgtcccacaaaat

SEQ ID NO: 6192158 - DNA, 14 bp, Homo sapiens
gaactgtcccagct

SEQ ID NO: 6192159 - DNA, 13 bp, Homo sapiens
gaactgtccgtga

SEQ ID NO: 6192160 - DNA, 20 bp, Homo sapiens
gaactgtcggaggaaagaca

SEQ ID NO: 6192161 - DNA, 17 bp, Homo sapiens
gaactgtctctcatgaa

SEQ ID NO: 6192162 - DNA, 21 bp, Homo sapiens
gaactgtctctcatgaacctc

SEQ ID NO: 6192163 - DNA, 23 bp, Homo sapiens
gaactgtctgaatattctagaac

SEQ ID NO: 6192164 - DNA, 13 bp, Homo sapiens
gaactgtcttggc

SEQ ID NO: 6192165 - DNA, 13 bp, Homo sapiens
gaactgtgacagg

SEQ ID NO: 6192166 - DNA, 15 bp, Homo sapiens
gaactgtgacaggaa

SEQ ID NO: 6192167 - DNA, 22 bp, Homo sapiens
gaactgtgcatagtgctgggat

SEQ ID NO: 6192168 - DNA, 18 bp, Homo sapiens
gaactgtgcatcaaccag

SEQ ID NO: 6192169 - DNA, 23 bp, Homo sapiens
gaactgtgcatcaaccaggaaga

SEQ ID NO: 6192170 - DNA, 17 bp, Homo sapiens
gaactgtgcctttgagt

SEQ ID NO: 6192171 - DNA, 11 bp, Homo sapiens
gaactgtgctc

SEQ ID NO: 6192172 - DNA, 16 bp, Homo sapiens
gaactgtgtatttatt

SEQ ID NO: 6192173 - DNA, 20 bp, Homo sapiens
gaactgtgtatttatttaaa

SEQ ID NO: 6192174 - DNA, 23 bp, Homo sapiens
gaactgtgtatttatttaaaact

SEQ ID NO: 6192175 - DNA, 14 bp, Homo sapiens
gaactgtgtgtaat

SEQ ID NO: 6192176 - DNA, 17 bp, Homo sapiens
gaactgtgtgtgaatct

SEQ ID NO: 6192177 - DNA, 21 bp, Homo sapiens
gaactgttacaacttgtattt

SEQ ID NO: 6192178 - DNA, 15 bp, Homo sapiens
gaactgttagatgct

SEQ ID NO: 6192179 - DNA, 23 bp, Homo sapiens
gaactgttcacactgcagagact

SEQ ID NO: 6192180 - DNA, 19 bp, Homo sapiens
gaactgttgcctaattgga

SEQ ID NO: 6192181 - DNA, 14 bp, Homo sapiens
gaactgttggttat

SEQ ID NO: 6192182 - DNA, 20 bp, Homo sapiens
gaactgttgtataaatttat

SEQ ID NO: 6192183 - DNA, 19 bp, Homo sapiens
gaactgttgtttacttgtt

SEQ ID NO: 6192184 - DNA, 15 bp, Homo sapiens
gaacttaaaacatat

SEQ ID NO: 6192185 - DNA, 16 bp, Homo sapiens
gaacttaaatgccccc

SEQ ID NO: 6192186 - DNA, 19 bp, Homo sapiens
gaacttaaatgcccccctc

SEQ ID NO: 6192187 - DNA, 20 bp, Homo sapiens
gaacttaaattatgttttaa

SEQ ID NO: 6192188 - DNA, 21 bp, Homo sapiens
gaacttacaaagggtctatct

SEQ ID NO: 6192189 - DNA, 22 bp, Homo sapiens
gaacttacatactaggtgcctt

SEQ ID NO: 6192190 - DNA, 22 bp, Homo sapiens
gaacttagccatttttcaaagc

SEQ ID NO: 6192191 - DNA, 20 bp, Homo sapiens
gaacttatcctaaaacaaat

SEQ ID NO: 6192192 - DNA, 14 bp, Homo sapiens
gaacttcaaaatgt

SEQ ID NO: 6192193 - DNA, 17 bp, Homo sapiens
gaacttcacctgcaaag

SEQ ID NO: 6192194 - DNA, 18 bp, Homo sapiens
gaacttcagaaagacttg

SEQ ID NO: 6192195 - DNA, 17 bp, Homo sapiens
gaacttcagcattgtaa

SEQ ID NO: 6192196 - DNA, 19 bp, Homo sapiens
gaacttcagcattgtaatt

SEQ ID NO: 6192197 - DNA, 23 bp, Homo sapiens
gaacttcaggtgtgactctagca

SEQ ID NO: 6192198 - DNA, 15 bp, Homo sapiens
gaacttcatgggcct

SEQ ID NO: 6192199 - DNA, 22 bp, Homo sapiens
gaacttccagatcctggaaatc

SEQ ID NO: 6192200 - DNA, 13 bp, Homo sapiens
gaacttccctccc

SEQ ID NO: 6192201 - DNA, 23 bp, Homo sapiens
gaacttcgcatcaaaagacaatt

SEQ ID NO: 6192202 - DNA, 14 bp, Homo sapiens
gaacttctaatata

SEQ ID NO: 6192203 - DNA, 15 bp, Homo sapiens
gaacttctaatatat

SEQ ID NO: 6192204 - DNA, 23 bp, Homo sapiens
gaacttctcgtagatgctgccta

SEQ ID NO: 6192205 - DNA, 19 bp, Homo sapiens
gaacttgaaaaaaaaaaac

SEQ ID NO: 6192206 - DNA, 17 bp, Homo sapiens
gaacttgaaagttttct

SEQ ID NO: 6192207 - DNA, 22 bp, Homo sapiens
gaacttgaaatatcctgcttga

SEQ ID NO: 6192208 - DNA, 12 bp, Homo sapiens
gaacttgaacaa

SEQ ID NO: 6192209 - DNA, 13 bp, Homo sapiens
gaacttgaacaaa

SEQ ID NO: 6192210 - DNA, 15 bp, Homo sapiens
gaacttgaactgatt

SEQ ID NO: 6192211 - DNA, 15 bp, Homo sapiens
gaacttgaccctgag

SEQ ID NO: 6192212 - DNA, 15 bp, Homo sapiens
gaacttgaggacaca

SEQ ID NO: 6192213 - DNA, 13 bp, Homo sapiens
gaacttgatggct

SEQ ID NO: 6192214 - DNA, 14 bp, Homo sapiens
gaacttgatgttcc

SEQ ID NO: 6192215 - DNA, 21 bp, Homo sapiens
gaacttgatgttcctgggatg

SEQ ID NO: 6192216 - DNA, 17 bp, Homo sapiens
gaacttgatttgcatgg

SEQ ID NO: 6192217 - DNA, 13 bp, Homo sapiens
gaacttgatttta

SEQ ID NO: 6192218 - DNA, 17 bp, Homo sapiens
gaacttgcctgcctttc

SEQ ID NO: 6192219 - DNA, 12 bp, Homo sapiens
gaacttgctgcc

SEQ ID NO: 6192220 - DNA, 13 bp, Homo sapiens
gaacttgctgcct

SEQ ID NO: 6192221 - DNA, 14 bp, Homo sapiens
gaacttgctgctgc

SEQ ID NO: 6192222 - DNA, 17 bp, Homo sapiens
gaacttgctgctgcctt

SEQ ID NO: 6192223 - DNA, 21 bp, Homo sapiens
gaacttgctgctgccttcaca

SEQ ID NO: 6192224 - DNA, 15 bp, Homo sapiens
gaacttgctgctgtc

SEQ ID NO: 6192225 - DNA, 16 bp, Homo sapiens
gaacttgctgctgtgc

SEQ ID NO: 6192226 - DNA, 19 bp, Homo sapiens
ctgtttcaatgacctgtat

SEQ ID NO: 6192227 - DNA, 17 bp, Homo sapiens
ctgtttcactaatactt

SEQ ID NO: 6192228 - DNA, 19 bp, Homo sapiens
ctgtttcactaatacttac

SEQ ID NO: 6192229 - DNA, 16 bp, Homo sapiens
ctgtttcacttgctct

SEQ ID NO: 6192230 - DNA, 14 bp, Homo sapiens
ctgtttcagaccag

SEQ ID NO: 6192231 - DNA, 21 bp, Homo sapiens
ctgtttcagctaaatgcaggg

SEQ ID NO: 6192232 - DNA, 20 bp, Homo sapiens
ctgtttcatagttttctaaa

SEQ ID NO: 6192233 - DNA, 21 bp, Homo sapiens
ctgtttcatagttttctaaat

SEQ ID NO: 6192234 - DNA, 19 bp, Homo sapiens
ctgtttcatctcagctttt

SEQ ID NO: 6192235 - DNA, 17 bp, Homo sapiens
ctgtttcatgagcccaa

SEQ ID NO: 6192236 - DNA, 21 bp, Homo sapiens
ctgtttcatgggccccttcaa

SEQ ID NO: 6192237 - DNA, 12 bp, Homo sapiens
ctgtttcatttg

SEQ ID NO: 6192238 - DNA, 23 bp, Homo sapiens
ctgtttccaatgccaattcatct

SEQ ID NO: 6192239 - DNA, 13 bp, Homo sapiens
ctgtttccagggt

SEQ ID NO: 6192240 - DNA, 18 bp, Homo sapiens
ctgtttccagttgttact

SEQ ID NO: 6192241 - DNA, 12 bp, Homo sapiens
ctgtttcccagc

SEQ ID NO: 6192242 - DNA, 15 bp, Homo sapiens
ctgtttcccctcaga

SEQ ID NO: 6192243 - DNA, 19 bp, Homo sapiens
ctgtttcccttcccttcca

SEQ ID NO: 6192244 - DNA, 21 bp, Homo sapiens
ctgtttcccttcccttccact

SEQ ID NO: 6192245 - DNA, 15 bp, Homo sapiens
ctgtttcctgaaata

SEQ ID NO: 6192246 - DNA, 14 bp, Homo sapiens
ctgtttcctgacag

SEQ ID NO: 6192247 - DNA, 23 bp, Homo sapiens
ctgtttcctgacagatgcctggt

SEQ ID NO: 6192248 - DNA, 19 bp, Homo sapiens
ctgtttcctgacattgtct

SEQ ID NO: 6192249 - DNA, 14 bp, Homo sapiens
ctgtttcctgctgc

SEQ ID NO: 6192250 - DNA, 15 bp, Homo sapiens
ctgtttcctgctgct

SEQ ID NO: 6192251 - DNA, 20 bp, Homo sapiens
ctgtttcctggcctcagagc

SEQ ID NO: 6192252 - DNA, 18 bp, Homo sapiens
ctgtttcctgtgtctcca

SEQ ID NO: 6192253 - DNA, 15 bp, Homo sapiens
ctgtttcctgttctc

SEQ ID NO: 6192254 - DNA, 20 bp, Homo sapiens
ctgtttcctgttctcttgta

SEQ ID NO: 6192255 - DNA, 13 bp, Homo sapiens
ctgtttcctttta

SEQ ID NO: 6192256 - DNA, 15 bp, Homo sapiens
ctgtttccttttatg

SEQ ID NO: 6192257 - DNA, 20 bp, Homo sapiens
ctgtttcgcatccaccgcca

SEQ ID NO: 6192258 - DNA, 11 bp, Homo sapiens
ctgtttctaag

SEQ ID NO: 6192259 - DNA, 16 bp, Homo sapiens
ctgtttctaggctgtt

SEQ ID NO: 6192260 - DNA, 21 bp, Homo sapiens
ctgtttctatgtccaaacctg

SEQ ID NO: 6192261 - DNA, 20 bp, Homo sapiens
ctgtttctattctctcctca

SEQ ID NO: 6192262 - DNA, 18 bp, Homo sapiens
ctgtttctcagtctcaca

SEQ ID NO: 6192263 - DNA, 22 bp, Homo sapiens
ctgtttctcctccattcatgtt

SEQ ID NO: 6192264 - DNA, 22 bp, Homo sapiens
ctgtttctcgttgtcacaccca

SEQ ID NO: 6192265 - DNA, 17 bp, Homo sapiens
ctgtttctctgctgtca

SEQ ID NO: 6192266 - DNA, 20 bp, Homo sapiens
ctgtttctcttgagctggcc

SEQ ID NO: 6192267 - DNA, 20 bp, Homo sapiens
ctgtttctctttccttggct

SEQ ID NO: 6192268 - DNA, 12 bp, Homo sapiens
ctgtttctgaaa

SEQ ID NO: 6192269 - DNA, 16 bp, Homo sapiens
ctgtttctgaaaagaa

SEQ ID NO: 6192270 - DNA, 16 bp, Homo sapiens
ctgtttctgcttattt

SEQ ID NO: 6192271 - DNA, 15 bp, Homo sapiens
ctgtttctgtagaaa

SEQ ID NO: 6192272 - DNA, 14 bp, Homo sapiens
ctgtttctgtttat

SEQ ID NO: 6192273 - DNA, 18 bp, Homo sapiens
ctgtttcttcctttctgt

SEQ ID NO: 6192274 - DNA, 15 bp, Homo sapiens
ctgtttcttgcttgt

SEQ ID NO: 6192275 - DNA, 17 bp, Homo sapiens
ctgtttcttgtctgtta

SEQ ID NO: 6192276 - DNA, 12 bp, Homo sapiens
ctgtttgaaact

SEQ ID NO: 6192277 - DNA, 14 bp, Homo sapiens
ctgtttgaaagtaa

SEQ ID NO: 6192278 - DNA, 18 bp, Homo sapiens
ctgtttgaaagtaaaaac

SEQ ID NO: 6192279 - DNA, 13 bp, Homo sapiens
ctgtttgaatttt

SEQ ID NO: 6192280 - DNA, 12 bp, Homo sapiens
ctgtttgacaaa

SEQ ID NO: 6192281 - DNA, 16 bp, Homo sapiens
ctgtttgacttctcaa

SEQ ID NO: 6192282 - DNA, 21 bp, Homo sapiens
ctgtttgaggaaagcaagaat

SEQ ID NO: 6192283 - DNA, 23 bp, Homo sapiens
ctgtttgaggatatattttcact

SEQ ID NO: 6192284 - DNA, 10 bp, Homo sapiens
ctgtttgatg

SEQ ID NO: 6192285 - DNA, 20 bp, Homo sapiens
ctgtttgatgctatttatgc

SEQ ID NO: 6192286 - DNA, 12 bp, Homo sapiens
ctgtttgatgta

SEQ ID NO: 6192287 - DNA, 18 bp, Homo sapiens
ctgtttgatgtatgtgtg

SEQ ID NO: 6192288 - DNA, 19 bp, Homo sapiens
ctgtttgatgtatgtgtga

SEQ ID NO: 6192289 - DNA, 20 bp, Homo sapiens
ctgtttgatgtatgtgtgaa

SEQ ID NO: 6192290 - DNA, 21 bp, Homo sapiens
ctgtttgcaatcacacgtggt

SEQ ID NO: 6192291 - DNA, 13 bp, Homo sapiens
ctgtttgcatgag

SEQ ID NO: 6192292 - DNA, 17 bp, Homo sapiens
ctgtttgccaagctgaa

SEQ ID NO: 6192293 - DNA, 15 bp, Homo sapiens
ctgtttgccttggct

SEQ ID NO: 6192294 - DNA, 23 bp, Homo sapiens
ctgtttgctcaaaattgcttcta

SEQ ID NO: 6192295 - DNA, 16 bp, Homo sapiens
ctgtttgctcacccag

SEQ ID NO: 6192296 - DNA, 19 bp, Homo sapiens
ctgtttgctcacccaggac

SEQ ID NO: 6192297 - DNA, 21 bp, Homo sapiens
ctgtttgctcacccaggacct

SEQ ID NO: 6192298 - DNA, 22 bp, Homo sapiens
ctgtttgctcacccaggacctc

SEQ ID NO: 6192299 - DNA, 16 bp, Homo sapiens
ctgtttgctgatggtc

SEQ ID NO: 6192300 - DNA, 11 bp, Homo sapiens
ctgtttggaaa

SEQ ID NO: 6192301 - DNA, 23 bp, Homo sapiens
ctgtttggaaataaatcttccta

SEQ ID NO: 6192302 - DNA, 23 bp, Homo sapiens
ctgtttggaaattgattttgaac

SEQ ID NO: 6192303 - DNA, 12 bp, Homo sapiens
ctgtttggcact

SEQ ID NO: 6192304 - DNA, 13 bp, Homo sapiens
ctgtttggcactt

SEQ ID NO: 6192305 - DNA, 15 bp, Homo sapiens
ctgtttggcacttgt

SEQ ID NO: 6192306 - DNA, 14 bp, Homo sapiens
ctgtttggcctctc

SEQ ID NO: 6192307 - DNA, 22 bp, Homo sapiens
ctgtttggcctttcttggggag

SEQ ID NO: 6192308 - DNA, 15 bp, Homo sapiens
ctgtttggcttataa

SEQ ID NO: 6192309 - DNA, 22 bp, Homo sapiens
ctgtttgggagactgtgctctc

SEQ ID NO: 6192310 - DNA, 20 bp, Homo sapiens
ctgtttgggaggctggagtg

SEQ ID NO: 6192311 - DNA, 21 bp, Homo sapiens
ctgtttgggcaggagtcacca

SEQ ID NO: 6192312 - DNA, 21 bp, Homo sapiens
ctgtttgggttgttggtctgt

SEQ ID NO: 6192313 - DNA, 22 bp, Homo sapiens
ctgtttgggttgttggtctgtg

SEQ ID NO: 6192314 - DNA, 18 bp, Homo sapiens
ctgtttggtcgagtcttt

SEQ ID NO: 6192315 - DNA, 22 bp, Homo sapiens
ctgtttggtcgagtctttgtgt

SEQ ID NO: 6192316 - DNA, 18 bp, Homo sapiens
ctgtttggtgaggacctg

SEQ ID NO: 6192317 - DNA, 23 bp, Homo sapiens
ctgtttggtgaggacctgcggcc

SEQ ID NO: 6192318 - DNA, 22 bp, Homo sapiens
ctgtttggtgtaggtaaatcta

SEQ ID NO: 6192319 - DNA, 21 bp, Homo sapiens
ctgtttggtttgtttataatg

SEQ ID NO: 6192320 - DNA, 12 bp, Homo sapiens
ctgtttgtaaat

SEQ ID NO: 6192321 - DNA, 19 bp, Homo sapiens
ctgtttgtaaattatttgc

SEQ ID NO: 6192322 - DNA, 21 bp, Homo sapiens
ctgtttgtaaattatttgcta

SEQ ID NO: 6192323 - DNA, 22 bp, Homo sapiens
ctgtttgtaaattatttgctaa

SEQ ID NO: 6192324 - DNA, 14 bp, Homo sapiens
ctgtttgtacaaac

SEQ ID NO: 6192325 - DNA, 17 bp, Homo sapiens
ctgtttgtacaaactat

SEQ ID NO: 6192326 - DNA, 20 bp, Homo sapiens
ctgtttgtagccacaagcct

SEQ ID NO: 6192327 - DNA, 17 bp, Homo sapiens
ctgtttgtagtgaaata

SEQ ID NO: 6192328 - DNA, 14 bp, Homo sapiens
ctgtttgtatattt

SEQ ID NO: 6192329 - DNA, 15 bp, Homo sapiens
ctgtttgtatatttg

SEQ ID NO: 6192330 - DNA, 14 bp, Homo sapiens
ctgtttgtgggact

SEQ ID NO: 6192331 - DNA, 18 bp, Homo sapiens
ctgtttgtggggtgacgg

SEQ ID NO: 6192332 - DNA, 13 bp, Homo sapiens
ctgtttgttacta

SEQ ID NO: 6192333 - DNA, 14 bp, Homo sapiens
ctgtttgtttcaag

SEQ ID NO: 6192334 - DNA, 15 bp, Homo sapiens
ctgtttgtttcaaga

SEQ ID NO: 6192335 - DNA, 21 bp, Homo sapiens
ctgtttgtttctgaaagggac

SEQ ID NO: 6192336 - DNA, 19 bp, Homo sapiens
ctgtttgtttggctgtcca

SEQ ID NO: 6192337 - DNA, 20 bp, Homo sapiens
ctgtttgtttggctgtccag

SEQ ID NO: 6192338 - DNA, 23 bp, Homo sapiens
ctgtttgtttttaaaaagcaaat

SEQ ID NO: 6192339 - DNA, 24 bp, Homo sapiens
ctgtttgtttttaaaaagcaaatc

SEQ ID NO: 6192340 - DNA, 24 bp, Homo sapiens
ctgttttaaaaacaaagaaataaa

SEQ ID NO: 6192341 - DNA, 21 bp, Homo sapiens
ctgttttaaaactttaagaaa

SEQ ID NO: 6192342 - DNA, 23 bp, Homo sapiens
ctgttttaaaatgtgaggcaata

SEQ ID NO: 6192343 - DNA, 14 bp, Homo sapiens
ctgttttaaattgc

SEQ ID NO: 6192344 - DNA, 22 bp, Homo sapiens
ctgttttaaatttatttcaaaa

SEQ ID NO: 6192345 - DNA, 15 bp, Homo sapiens
ctgttttaagaaatc

SEQ ID NO: 6192346 - DNA, 22 bp, Homo sapiens
ctgttttaagaaatctggccca

SEQ ID NO: 6192347 - DNA, 14 bp, Homo sapiens
ctgttttaagttct

SEQ ID NO: 6192348 - DNA, 22 bp, Homo sapiens
ctgttttacaaaaaagaaaaga

SEQ ID NO: 6192349 - DNA, 14 bp, Homo sapiens
ctgttttacaagtt

SEQ ID NO: 6192350 - DNA, 16 bp, Homo sapiens
ctgttttacagctgcc

SEQ ID NO: 6192351 - DNA, 13 bp, Homo sapiens
ctgttttactgct

SEQ ID NO: 6192352 - DNA, 15 bp, Homo sapiens
ctgttttactgcttt

SEQ ID NO: 6192353 - DNA, 14 bp, Homo sapiens
ctgttttactgttt

SEQ ID NO: 6192354 - DNA, 15 bp, Homo sapiens
ctgttttagctgagg

SEQ ID NO: 6192355 - DNA, 16 bp, Homo sapiens
ctgttttagtgccagg

SEQ ID NO: 6192356 - DNA, 17 bp, Homo sapiens
ctgttttagtgccaggc

SEQ ID NO: 6192357 - DNA, 15 bp, Homo sapiens
ctgttttagtttctg

SEQ ID NO: 6192358 - DNA, 16 bp, Homo sapiens
ctgttttagtttctga

SEQ ID NO: 6192359 - DNA, 14 bp, Homo sapiens
ctgttttatactgt

SEQ ID NO: 6192360 - DNA, 20 bp, Homo sapiens
ctgttttatctccatacttt

SEQ ID NO: 6192361 - DNA, 22 bp, Homo sapiens
ctgttttatctccatactttgg

SEQ ID NO: 6192362 - DNA, 13 bp, Homo sapiens
ctgttttatgact

SEQ ID NO: 6192363 - DNA, 17 bp, Homo sapiens
ctgttttatgttgatct

SEQ ID NO: 6192364 - DNA, 21 bp, Homo sapiens
ctgttttattttaattcagtt

SEQ ID NO: 6192365 - DNA, 13 bp, Homo sapiens
ctgttttcaataa

SEQ ID NO: 6192366 - DNA, 15 bp, Homo sapiens
ctgttttcaataaca

SEQ ID NO: 6192367 - DNA, 21 bp, Homo sapiens
ctgttttcaataacaaagcac

SEQ ID NO: 6192368 - DNA, 16 bp, Homo sapiens
ctgttttcccacgagg

SEQ ID NO: 6192369 - DNA, 13 bp, Homo sapiens
ctgttttccccca

SEQ ID NO: 6192370 - DNA, 17 bp, Homo sapiens
ctgttttcccccagcaa

SEQ ID NO: 6192371 - DNA, 17 bp, Homo sapiens
ctgttttccctctgctg

SEQ ID NO: 6192372 - DNA, 16 bp, Homo sapiens
ctgttttcctcccttc

SEQ ID NO: 6192373 - DNA, 13 bp, Homo sapiens
ctgttttccttct

SEQ ID NO: 6192374 - DNA, 14 bp, Homo sapiens
ctgttttccttctt

SEQ ID NO: 6192375 - DNA, 19 bp, Homo sapiens
ctgttttcgtaccttccca

SEQ ID NO: 6192376 - DNA, 20 bp, Homo sapiens
ctgttttcgtaccttcccac

SEQ ID NO: 6192377 - DNA, 20 bp, Homo sapiens
ctgttttctagtgtatcaaa

SEQ ID NO: 6192378 - DNA, 21 bp, Homo sapiens
ctgttttctctcggctcccca

SEQ ID NO: 6192379 - DNA, 15 bp, Homo sapiens
ctgttttctctctgt

SEQ ID NO: 6192380 - DNA, 13 bp, Homo sapiens
ctgttttctcttg

SEQ ID NO: 6192381 - DNA, 12 bp, Homo sapiens
ctgttttctgaa

SEQ ID NO: 6192382 - DNA, 13 bp, Homo sapiens
ctgttttctgaaa

SEQ ID NO: 6192383 - DNA, 15 bp, Homo sapiens
ctgttttctgaaaca

SEQ ID NO: 6192384 - DNA, 13 bp, Homo sapiens
ctgttttctgagc

SEQ ID NO: 6192385 - DNA, 17 bp, Homo sapiens
ctgttttctgagcccgg

SEQ ID NO: 6192386 - DNA, 13 bp, Homo sapiens
ctgttttctgctg

SEQ ID NO: 6192387 - DNA, 11 bp, Homo sapiens
ctgttttctgg

SEQ ID NO: 6192388 - DNA, 13 bp, Homo sapiens
ctgttttctgtaa

SEQ ID NO: 6192389 - DNA, 19 bp, Homo sapiens
ctgttttctgtaaattcat

SEQ ID NO: 6192390 - DNA, 14 bp, Homo sapiens
ctgttttctgtttc

SEQ ID NO: 6192391 - DNA, 19 bp, Homo sapiens
ctgttttctgtttgtaaat

SEQ ID NO: 6192392 - DNA, 14 bp, Homo sapiens
ctgttttcttaggc

SEQ ID NO: 6192393 - DNA, 12 bp, Homo sapiens
ctgttttcttct

SEQ ID NO: 6192394 - DNA, 14 bp, Homo sapiens
ctgttttgaaaagt

SEQ ID NO: 6192395 - DNA, 18 bp, Homo sapiens
ctgttttgaagctgggct

SEQ ID NO: 6192396 - DNA, 14 bp, Homo sapiens
ctgttttgaggaat

SEQ ID NO: 6192397 - DNA, 19 bp, Homo sapiens
ctgttttgagttttgtagc

SEQ ID NO: 6192398 - DNA, 23 bp, Homo sapiens
ctgttttgagttttgtagcagtg

SEQ ID NO: 6192399 - DNA, 14 bp, Homo sapiens
ctgttttgcttttg

SEQ ID NO: 6192400 - DNA, 13 bp, Homo sapiens
ctgttttggatga

SEQ ID NO: 6192401 - DNA, 16 bp, Homo sapiens
ctgttttggatgaatg

SEQ ID NO: 6192402 - DNA, 18 bp, Homo sapiens
ctgttttggatgaatgca

SEQ ID NO: 6192403 - DNA, 17 bp, Homo sapiens
ctgttttggatgttgct

SEQ ID NO: 6192404 - DNA, 18 bp, Homo sapiens
ctgttttggatgttgcta

SEQ ID NO: 6192405 - DNA, 20 bp, Homo sapiens
ctgttttggatgttgctata

SEQ ID NO: 6192406 - DNA, 23 bp, Homo sapiens
gaacttgctgggtggttctctgg

SEQ ID NO: 6192407 - DNA, 19 bp, Homo sapiens
gaacttggaaagaaatgcc

SEQ ID NO: 6192408 - DNA, 13 bp, Homo sapiens
gaacttggcgctg

SEQ ID NO: 6192409 - DNA, 13 bp, Homo sapiens
gaacttgggaggg

SEQ ID NO: 6192410 - DNA, 17 bp, Homo sapiens
gaacttggggaacaagg

SEQ ID NO: 6192411 - DNA, 22 bp, Homo sapiens
gaacttggggagttaagacctg

SEQ ID NO: 6192412 - DNA, 16 bp, Homo sapiens
gaacttggtagttcat

SEQ ID NO: 6192413 - DNA, 15 bp, Homo sapiens
gaacttgtagccaga

SEQ ID NO: 6192414 - DNA, 17 bp, Homo sapiens
gaacttgtagctgtaaa

SEQ ID NO: 6192415 - DNA, 22 bp, Homo sapiens
gaacttgtctggctttggcact

SEQ ID NO: 6192416 - DNA, 21 bp, Homo sapiens
gaacttgttaacctttctaac

SEQ ID NO: 6192417 - DNA, 22 bp, Homo sapiens
gaacttgttacttgcagcattc

SEQ ID NO: 6192418 - DNA, 16 bp, Homo sapiens
gaacttgttgctgatt

SEQ ID NO: 6192419 - DNA, 20 bp, Homo sapiens
gaactttagtgaaacataat

SEQ ID NO: 6192420 - DNA, 22 bp, Homo sapiens
gaactttagtttgcctgcagtt

SEQ ID NO: 6192421 - DNA, 22 bp, Homo sapiens
gaactttattttggattgtgga

SEQ ID NO: 6192422 - DNA, 12 bp, Homo sapiens
gaactttcattt

SEQ ID NO: 6192423 - DNA, 18 bp, Homo sapiens
gaactttcggagcctgcc

SEQ ID NO: 6192424 - DNA, 20 bp, Homo sapiens
gaactttcggagcctgcctc

SEQ ID NO: 6192425 - DNA, 23 bp, Homo sapiens
gaactttctcttcatactttttt

SEQ ID NO: 6192426 - DNA, 14 bp, Homo sapiens
gaactttctgcttt

SEQ ID NO: 6192427 - DNA, 21 bp, Homo sapiens
gaactttctgttccctatgga

SEQ ID NO: 6192428 - DNA, 14 bp, Homo sapiens
gaactttgaaggac

SEQ ID NO: 6192429 - DNA, 18 bp, Homo sapiens
gaactttgcacacttcaa

SEQ ID NO: 6192430 - DNA, 16 bp, Homo sapiens
gaactttgcagcatac

SEQ ID NO: 6192431 - DNA, 16 bp, Homo sapiens
gaactttgccaaaaaa

SEQ ID NO: 6192432 - DNA, 17 bp, Homo sapiens
gaactttgccttaagtt

SEQ ID NO: 6192433 - DNA, 11 bp, Homo sapiens
gaactttggga

SEQ ID NO: 6192434 - DNA, 16 bp, Homo sapiens
gaactttgtcagtgtt

SEQ ID NO: 6192435 - DNA, 18 bp, Homo sapiens
gaactttgtgccagcgct

SEQ ID NO: 6192436 - DNA, 18 bp, Homo sapiens
gaactttgtttccagaaa

SEQ ID NO: 6192437 - DNA, 17 bp, Homo sapiens
gaacttttaaactgcag

SEQ ID NO: 6192438 - DNA, 20 bp, Homo sapiens
gaacttttaaactgcagttt

SEQ ID NO: 6192439 - DNA, 19 bp, Homo sapiens
gaacttttacagaatgcat

SEQ ID NO: 6192440 - DNA, 20 bp, Homo sapiens
gaacttttacagaatgcatt

SEQ ID NO: 6192441 - DNA, 20 bp, Homo sapiens
gaacttttgtaatttgaatt

SEQ ID NO: 6192442 - DNA, 21 bp, Homo sapiens
gaacttttgtactgaattttt

SEQ ID NO: 6192443 - DNA, 15 bp, Homo sapiens
gaactttttaaagaa

SEQ ID NO: 6192444 - DNA, 16 bp, Homo sapiens
gaactttttattgatt

SEQ ID NO: 6192445 - DNA, 15 bp, Homo sapiens
gaactttttcttttc

SEQ ID NO: 6192446 - DNA, 18 bp, Homo sapiens
gaacttttttaaataaac

SEQ ID NO: 6192447 - DNA, 21 bp, Homo sapiens
gaacttttttaaataaacttt

SEQ ID NO: 6192448 - DNA, 22 bp, Homo sapiens
gaacttttttaaataaactttt

SEQ ID NO: 6192449 - DNA, 11 bp, Homo sapiens
gaagaaaaaaa

SEQ ID NO: 6192450 - DNA, 18 bp, Homo sapiens
gaagaaaaaaaataacac

SEQ ID NO: 6192451 - DNA, 15 bp, Homo sapiens
gaagaaaaaactgaa

SEQ ID NO: 6192452 - DNA, 13 bp, Homo sapiens
gaagaaaaaatac

SEQ ID NO: 6192453 - DNA, 13 bp, Homo sapiens
gaagaaaaaattt

SEQ ID NO: 6192454 - DNA, 13 bp, Homo sapiens
gaagaaaaactca

SEQ ID NO: 6192455 - DNA, 14 bp, Homo sapiens
gaagaaaaagaagc

SEQ ID NO: 6192456 - DNA, 18 bp, Homo sapiens
gaagaaaaaggaaacaag

SEQ ID NO: 6192457 - DNA, 14 bp, Homo sapiens
gaagaaaaatgttt

SEQ ID NO: 6192458 - DNA, 13 bp, Homo sapiens
gaagaaaacacaa

SEQ ID NO: 6192459 - DNA, 18 bp, Homo sapiens
gaagaaaacactgttatc

SEQ ID NO: 6192460 - DNA, 19 bp, Homo sapiens
gaagaaaacactgttatca

SEQ ID NO: 6192461 - DNA, 18 bp, Homo sapiens
gaagaaaacatatatttt

SEQ ID NO: 6192462 - DNA, 15 bp, Homo sapiens
gaagaaaacccgagg

SEQ ID NO: 6192463 - DNA, 13 bp, Homo sapiens
gaagaaaacctgt

SEQ ID NO: 6192464 - DNA, 15 bp, Homo sapiens
gaagaaaacttttgt

SEQ ID NO: 6192465 - DNA, 9 bp, Homo sapiens
gaagaaaag

SEQ ID NO: 6192466 - DNA, 17 bp, Homo sapiens
gaagaaaagcactggga

SEQ ID NO: 6192467 - DNA, 21 bp, Homo sapiens
gaagaaaaggggagcacaagg

SEQ ID NO: 6192468 - DNA, 15 bp, Homo sapiens
gaagaaaaggtacat

SEQ ID NO: 6192469 - DNA, 13 bp, Homo sapiens
gaagaaaatactt

SEQ ID NO: 6192470 - DNA, 19 bp, Homo sapiens
gaagaaaatacttaaatgt

SEQ ID NO: 6192471 - DNA, 15 bp, Homo sapiens
gaagaaaatagaatt

SEQ ID NO: 6192472 - DNA, 15 bp, Homo sapiens
gaagaaaatggaatt

SEQ ID NO: 6192473 - DNA, 22 bp, Homo sapiens
gaagaaaattggactggtgaaa

SEQ ID NO: 6192474 - DNA, 12 bp, Homo sapiens
gaagaaaatttg

SEQ ID NO: 6192475 - DNA, 20 bp, Homo sapiens
gaagaaacaaggttttcagt

SEQ ID NO: 6192476 - DNA, 18 bp, Homo sapiens
gaagaaacacagcatgca

SEQ ID NO: 6192477 - DNA, 19 bp, Homo sapiens
gaagaaacacagcatgcat

SEQ ID NO: 6192478 - DNA, 15 bp, Homo sapiens
gaagaaacagatctc

SEQ ID NO: 6192479 - DNA, 15 bp, Homo sapiens
gaagaaaccccaagc

SEQ ID NO: 6192480 - DNA, 19 bp, Homo sapiens
gaagaaaccccaagcagca

SEQ ID NO: 6192481 - DNA, 17 bp, Homo sapiens
gaagaaactcagattta

SEQ ID NO: 6192482 - DNA, 15 bp, Homo sapiens
gaagaaactcctgga

SEQ ID NO: 6192483 - DNA, 18 bp, Homo sapiens
gaagaaactttctggtgc

SEQ ID NO: 6192484 - DNA, 16 bp, Homo sapiens
gaagaaagaacggaag

SEQ ID NO: 6192485 - DNA, 14 bp, Homo sapiens
gaagaaagaagaca

SEQ ID NO: 6192486 - DNA, 17 bp, Homo sapiens
gaagaaagaagcactct

SEQ ID NO: 6192487 - DNA, 17 bp, Homo sapiens
gaagaaagaggtgaccc

SEQ ID NO: 6192488 - DNA, 22 bp, Homo sapiens
gaagaaagatttaaagtatttt

SEQ ID NO: 6192489 - DNA, 19 bp, Homo sapiens
gaagaaagcaaaaaataaa

SEQ ID NO: 6192490 - DNA, 13 bp, Homo sapiens
gaagaaagccaga

SEQ ID NO: 6192491 - DNA, 12 bp, Homo sapiens
gaagaaagcctg

SEQ ID NO: 6192492 - DNA, 18 bp, Homo sapiens
gaagaaaggccatcagag

SEQ ID NO: 6192493 - DNA, 21 bp, Homo sapiens
gaagaaagggtgtttttctgt

SEQ ID NO: 6192494 - DNA, 16 bp, Homo sapiens
gaagaaagtgttcaaa

SEQ ID NO: 6192495 - DNA, 14 bp, Homo sapiens
gaagaaataaatga

SEQ ID NO: 6192496 - DNA, 17 bp, Homo sapiens
gaagaaatactgcactt

SEQ ID NO: 6192497 - DNA, 16 bp, Homo sapiens
gaagaaatagcagagc

SEQ ID NO: 6192498 - DNA, 20 bp, Homo sapiens
gaagaaatatgaaattccag

SEQ ID NO: 6192499 - DNA, 14 bp, Homo sapiens
gaagaaatatgagc

SEQ ID NO: 6192500 - DNA, 21 bp, Homo sapiens
gaagaaatccataacaccccc

SEQ ID NO: 6192501 - DNA, 13 bp, Homo sapiens
gaagaaatgaaat

SEQ ID NO: 6192502 - DNA, 17 bp, Homo sapiens
gaagaaatgacattttg

SEQ ID NO: 6192503 - DNA, 20 bp, Homo sapiens
gaagaaattcaggtacagaa

SEQ ID NO: 6192504 - DNA, 14 bp, Homo sapiens
gaagaaattcctgt

SEQ ID NO: 6192505 - DNA, 15 bp, Homo sapiens
gaagaacaaaaggct

SEQ ID NO: 6192506 - DNA, 13 bp, Homo sapiens
gaagaacacagca

SEQ ID NO: 6192507 - DNA, 21 bp, Homo sapiens
gaagaacacagcatgtgccaa

SEQ ID NO: 6192508 - DNA, 18 bp, Homo sapiens
gaagaacaccctctaaat

SEQ ID NO: 6192509 - DNA, 13 bp, Homo sapiens
gaagaacagcaga

SEQ ID NO: 6192510 - DNA, 16 bp, Homo sapiens
gaagaacagccccggg

SEQ ID NO: 6192511 - DNA, 20 bp, Homo sapiens
gaagaacagctgttcctgtg

SEQ ID NO: 6192512 - DNA, 19 bp, Homo sapiens
gaagaacaggcctctccat

SEQ ID NO: 6192513 - DNA, 22 bp, Homo sapiens
gaagaacatctttatggtaaag

SEQ ID NO: 6192514 - DNA, 19 bp, Homo sapiens
gaagaacatgattttacaa

SEQ ID NO: 6192515 - DNA, 13 bp, Homo sapiens
gaagaaccagccc

SEQ ID NO: 6192516 - DNA, 15 bp, Homo sapiens
gaagaaccagcccag

SEQ ID NO: 6192517 - DNA, 17 bp, Homo sapiens
gaagaaccagcccagcc

SEQ ID NO: 6192518 - DNA, 18 bp, Homo sapiens
gaagaaccagcccagcct

SEQ ID NO: 6192519 - DNA, 19 bp, Homo sapiens
gaagaaccagcccagcctg

SEQ ID NO: 6192520 - DNA, 13 bp, Homo sapiens
gaagaaccaggca

SEQ ID NO: 6192521 - DNA, 22 bp, Homo sapiens
gaagaaccagtccccccaccct

SEQ ID NO: 6192522 - DNA, 16 bp, Homo sapiens
gaagaaccgcattttg

SEQ ID NO: 6192523 - DNA, 22 bp, Homo sapiens
gaagaacctgtagaagatgacc

SEQ ID NO: 6192524 - DNA, 13 bp, Homo sapiens
gaagaacggggct

SEQ ID NO: 6192525 - DNA, 20 bp, Homo sapiens
gaagaacggggctcttctca

SEQ ID NO: 6192526 - DNA, 22 bp, Homo sapiens
gaagaacggggctcttctcatt

SEQ ID NO: 6192527 - DNA, 23 bp, Homo sapiens
gaagaacggggctcttctcattt

SEQ ID NO: 6192528 - DNA, 13 bp, Homo sapiens
gaagaactaataa

SEQ ID NO: 6192529 - DNA, 18 bp, Homo sapiens
gaagaactagtagaagaa

SEQ ID NO: 6192530 - DNA, 19 bp, Homo sapiens
gaagaactgcaggccctgg

SEQ ID NO: 6192531 - DNA, 18 bp, Homo sapiens
gaagaactgcatggggag

SEQ ID NO: 6192532 - DNA, 21 bp, Homo sapiens
gaagaactttgccttaagttt

SEQ ID NO: 6192533 - DNA, 14 bp, Homo sapiens
gaagaagaaaagag

SEQ ID NO: 6192534 - DNA, 17 bp, Homo sapiens
gaagaagaaatctttct

SEQ ID NO: 6192535 - DNA, 20 bp, Homo sapiens
gaagaagaaccaggcatgga

SEQ ID NO: 6192536 - DNA, 19 bp, Homo sapiens
gaagaagagaagctgctga

SEQ ID NO: 6192537 - DNA, 20 bp, Homo sapiens
gaagaagaggcctagcctga

SEQ ID NO: 6192538 - DNA, 14 bp, Homo sapiens
gaagaagagggaga

SEQ ID NO: 6192539 - DNA, 13 bp, Homo sapiens
gaagaagcagaga

SEQ ID NO: 6192540 - DNA, 15 bp, Homo sapiens
gaagaagcagagaga

SEQ ID NO: 6192541 - DNA, 21 bp, Homo sapiens
gaagaagccatcaattttaac

SEQ ID NO: 6192542 - DNA, 13 bp, Homo sapiens
gaagaagccctgt

SEQ ID NO: 6192543 - DNA, 14 bp, Homo sapiens
gaagaagctggcta

SEQ ID NO: 6192544 - DNA, 11 bp, Homo sapiens
gaagaaggaaa

SEQ ID NO: 6192545 - DNA, 17 bp, Homo sapiens
gaagaaggaaacggaag

SEQ ID NO: 6192546 - DNA, 17 bp, Homo sapiens
gaagaaggactgaagaa

SEQ ID NO: 6192547 - DNA, 23 bp, Homo sapiens
gaagaaggagcagaataaatgtt

SEQ ID NO: 6192548 - DNA, 20 bp, Homo sapiens
gaagaaggagctcaactaaa

SEQ ID NO: 6192549 - DNA, 23 bp, Homo sapiens
gaagaaggaggaatgctggactg

SEQ ID NO: 6192550 - DNA, 12 bp, Homo sapiens
gaagaaggcaag

SEQ ID NO: 6192551 - DNA, 15 bp, Homo sapiens
gaagaaggcaaggct

SEQ ID NO: 6192552 - DNA, 18 bp, Homo sapiens
gaagaaggcccgggagga

SEQ ID NO: 6192553 - DNA, 14 bp, Homo sapiens
gaagaagggaagcc

SEQ ID NO: 6192554 - DNA, 15 bp, Homo sapiens
gaagaagggaagcct

SEQ ID NO: 6192555 - DNA, 22 bp, Homo sapiens
gaagaagggaagccttttgcaa

SEQ ID NO: 6192556 - DNA, 23 bp, Homo sapiens
gaagaagggaagccttttgcaaa

SEQ ID NO: 6192557 - DNA, 17 bp, Homo sapiens
gaagaagggagaagaaa

SEQ ID NO: 6192558 - DNA, 18 bp, Homo sapiens
gaagaagggagaagaaag

SEQ ID NO: 6192559 - DNA, 18 bp, Homo sapiens
gaagaagggccaccctga

SEQ ID NO: 6192560 - DNA, 15 bp, Homo sapiens
gaagaaggggccatc

SEQ ID NO: 6192561 - DNA, 16 bp, Homo sapiens
gaagaaggtgggagga

SEQ ID NO: 6192562 - DNA, 21 bp, Homo sapiens
gaagaagtcactgaacaaaac

SEQ ID NO: 6192563 - DNA, 16 bp, Homo sapiens
gaagaagtgggagcag

SEQ ID NO: 6192564 - DNA, 17 bp, Homo sapiens
gaagaagtgggagcagc

SEQ ID NO: 6192565 - DNA, 18 bp, Homo sapiens
gaagaagtgggagcagct

SEQ ID NO: 6192566 - DNA, 20 bp, Homo sapiens
gaagaagtgggagcagcttc

SEQ ID NO: 6192567 - DNA, 21 bp, Homo sapiens
gaagaagtgggagcagcttct

SEQ ID NO: 6192568 - DNA, 14 bp, Homo sapiens
gaagaagtggtact

SEQ ID NO: 6192569 - DNA, 21 bp, Homo sapiens
gaagaagtggtactagtgtgg

SEQ ID NO: 6192570 - DNA, 12 bp, Homo sapiens
gaagaagttttt

SEQ ID NO: 6192571 - DNA, 17 bp, Homo sapiens
gaagaataaaaaagaag

SEQ ID NO: 6192572 - DNA, 18 bp, Homo sapiens
gaagaatacaaacatatt

SEQ ID NO: 6192573 - DNA, 19 bp, Homo sapiens
gaagaatacaaacatattt

SEQ ID NO: 6192574 - DNA, 14 bp, Homo sapiens
gaagaatacatcag

SEQ ID NO: 6192575 - DNA, 18 bp, Homo sapiens
gaagaatacccaggaaga

SEQ ID NO: 6192576 - DNA, 23 bp, Homo sapiens
gaagaatagcctattgtctttca

SEQ ID NO: 6192577 - DNA, 13 bp, Homo sapiens
gaagaatattcta

SEQ ID NO: 6192578 - DNA, 13 bp, Homo sapiens
gaagaatattgtt

SEQ ID NO: 6192579 - DNA, 20 bp, Homo sapiens
gaagaatattgttcctaagt

SEQ ID NO: 6192580 - DNA, 17 bp, Homo sapiens
gaagaatccacaaggac

SEQ ID NO: 6192581 - DNA, 17 bp, Homo sapiens
gaagaatccagtattat

SEQ ID NO: 6192582 - DNA, 19 bp, Homo sapiens
gaagaatccttttgtagaa

SEQ ID NO: 6192583 - DNA, 15 bp, Homo sapiens
gaagaatctgcccct

SEQ ID NO: 6192584 - DNA, 20 bp, Homo sapiens
gaagaatctgtttcccagca

SEQ ID NO: 6192585 - DNA, 13 bp, Homo sapiens
gaagaatcttcct

SEQ ID NO: 6192586 - DNA, 14 bp, Homo sapiens
ctgttttgggcctc

SEQ ID NO: 6192587 - DNA, 16 bp, Homo sapiens
ctgttttgggcctcca

SEQ ID NO: 6192588 - DNA, 17 bp, Homo sapiens
ctgttttgggcctccat

SEQ ID NO: 6192589 - DNA, 23 bp, Homo sapiens
ctgttttggggctttcccaggag

SEQ ID NO: 6192590 - DNA, 14 bp, Homo sapiens
ctgttttggtcccc

SEQ ID NO: 6192591 - DNA, 22 bp, Homo sapiens
ctgttttggtcccctccctcgt

SEQ ID NO: 6192592 - DNA, 19 bp, Homo sapiens
ctgttttgtatatgatcta

SEQ ID NO: 6192593 - DNA, 23 bp, Homo sapiens
ctgttttgtcctttgagaaagaa

SEQ ID NO: 6192594 - DNA, 15 bp, Homo sapiens
ctgttttgtgagaac

SEQ ID NO: 6192595 - DNA, 20 bp, Homo sapiens
ctgttttgtggtttggaata

SEQ ID NO: 6192596 - DNA, 12 bp, Homo sapiens
ctgttttgtgta

SEQ ID NO: 6192597 - DNA, 17 bp, Homo sapiens
ctgttttgtgtatattg

SEQ ID NO: 6192598 - DNA, 16 bp, Homo sapiens
ctgttttgtgtctggt

SEQ ID NO: 6192599 - DNA, 18 bp, Homo sapiens
ctgttttgtgtctggtgc

SEQ ID NO: 6192600 - DNA, 15 bp, Homo sapiens
ctgttttgttaatat

SEQ ID NO: 6192601 - DNA, 14 bp, Homo sapiens
ctgttttgttgaca

SEQ ID NO: 6192602 - DNA, 16 bp, Homo sapiens
ctgttttgttgacatt

SEQ ID NO: 6192603 - DNA, 21 bp, Homo sapiens
ctgttttgtttggcaaggaaa

SEQ ID NO: 6192604 - DNA, 22 bp, Homo sapiens
ctgttttgttttgttttttaaa

SEQ ID NO: 6192605 - DNA, 16 bp, Homo sapiens
ctgtttttaaaaatta

SEQ ID NO: 6192606 - DNA, 13 bp, Homo sapiens
ctgtttttaacat

SEQ ID NO: 6192607 - DNA, 16 bp, Homo sapiens
ctgtttttaagctgtt

SEQ ID NO: 6192608 - DNA, 17 bp, Homo sapiens
ctgtttttaagctgttt

SEQ ID NO: 6192609 - DNA, 23 bp, Homo sapiens
ctgtttttaagctgtttccatag

SEQ ID NO: 6192610 - DNA, 15 bp, Homo sapiens
ctgtttttacccata

SEQ ID NO: 6192611 - DNA, 22 bp, Homo sapiens
ctgtttttacccatatcccctc

SEQ ID NO: 6192612 - DNA, 21 bp, Homo sapiens
ctgtttttagagcttccaaat

SEQ ID NO: 6192613 - DNA, 14 bp, Homo sapiens
ctgtttttagtgct

SEQ ID NO: 6192614 - DNA, 16 bp, Homo sapiens
ctgtttttagtgctga

SEQ ID NO: 6192615 - DNA, 19 bp, Homo sapiens
ctgtttttattccttccat

SEQ ID NO: 6192616 - DNA, 15 bp, Homo sapiens
ctgtttttcacattt

SEQ ID NO: 6192617 - DNA, 17 bp, Homo sapiens
ctgtttttcagggaggt

SEQ ID NO: 6192618 - DNA, 21 bp, Homo sapiens
ctgtttttcagggaggtggct

SEQ ID NO: 6192619 - DNA, 13 bp, Homo sapiens
ctgtttttccggt

SEQ ID NO: 6192620 - DNA, 18 bp, Homo sapiens
ctgtttttcctatttggt

SEQ ID NO: 6192621 - DNA, 17 bp, Homo sapiens
ctgtttttcggacagtt

SEQ ID NO: 6192622 - DNA, 22 bp, Homo sapiens
ctgtttttcggacagtttattt

SEQ ID NO: 6192623 - DNA, 13 bp, Homo sapiens
ctgtttttctcaa

SEQ ID NO: 6192624 - DNA, 21 bp, Homo sapiens
ctgtttttctctaatgcttga

SEQ ID NO: 6192625 - DNA, 23 bp, Homo sapiens
ctgtttttctctaatgcttgatt

SEQ ID NO: 6192626 - DNA, 15 bp, Homo sapiens
ctgtttttctgggtg

SEQ ID NO: 6192627 - DNA, 17 bp, Homo sapiens
ctgtttttcttctgaaa

SEQ ID NO: 6192628 - DNA, 14 bp, Homo sapiens
ctgtttttcttgtc

SEQ ID NO: 6192629 - DNA, 14 bp, Homo sapiens
ctgtttttgctatt

SEQ ID NO: 6192630 - DNA, 12 bp, Homo sapiens
ctgtttttgtat

SEQ ID NO: 6192631 - DNA, 21 bp, Homo sapiens
ctgttttttaaaacctgcgac

SEQ ID NO: 6192632 - DNA, 19 bp, Homo sapiens
ctgttttttaaactaggaa

SEQ ID NO: 6192633 - DNA, 17 bp, Homo sapiens
ctgttttttcctgagct

SEQ ID NO: 6192634 - DNA, 18 bp, Homo sapiens
ctgttttttggcttgctt

SEQ ID NO: 6192635 - DNA, 14 bp, Homo sapiens
ctgtttttttccca

SEQ ID NO: 6192636 - DNA, 17 bp, Homo sapiens
ctgttttttttgcaggg

SEQ ID NO: 6192637 - DNA, 16 bp, Homo sapiens
ctgtttttttttcatt

SEQ ID NO: 6192638 - DNA, 22 bp, Homo sapiens
ctgtttttttttttttaaataa

SEQ ID NO: 6192639 - DNA, 22 bp, Homo sapiens
cttaaaaaaaaaaaaaagcttt

SEQ ID NO: 6192640 - DNA, 19 bp, Homo sapiens
cttaaaaaaaactctttaa

SEQ ID NO: 6192641 - DNA, 21 bp, Homo sapiens
cttaaaaaaacacggaagcac

SEQ ID NO: 6192642 - DNA, 21 bp, Homo sapiens
cttaaaaaaataaaatatttt

SEQ ID NO: 6192643 - DNA, 14 bp, Homo sapiens
cttaaaaaactgca

SEQ ID NO: 6192644 - DNA, 12 bp, Homo sapiens
cttaaaaaactt

SEQ ID NO: 6192645 - DNA, 16 bp, Homo sapiens
cttaaaaaataataca

SEQ ID NO: 6192646 - DNA, 15 bp, Homo sapiens
cttaaaaaattgaaa

SEQ ID NO: 6192647 - DNA, 12 bp, Homo sapiens
cttaaaaacaac

SEQ ID NO: 6192648 - DNA, 15 bp, Homo sapiens
cttaaaaactgaaaa

SEQ ID NO: 6192649 - DNA, 12 bp, Homo sapiens
cttaaaaactgt

SEQ ID NO: 6192650 - DNA, 15 bp, Homo sapiens
cttaaaaactgtgta

SEQ ID NO: 6192651 - DNA, 20 bp, Homo sapiens
cttaaaaactgtgtatcatt

SEQ ID NO: 6192652 - DNA, 21 bp, Homo sapiens
cttaaaaactgtgtatcatta

SEQ ID NO: 6192653 - DNA, 14 bp, Homo sapiens
cttaaaaagacact

SEQ ID NO: 6192654 - DNA, 19 bp, Homo sapiens
cttaaaaagaccatgcatt

SEQ ID NO: 6192655 - DNA, 19 bp, Homo sapiens
cttaaaaagcatcattaca

SEQ ID NO: 6192656 - DNA, 13 bp, Homo sapiens
cttaaaaaggaac

SEQ ID NO: 6192657 - DNA, 14 bp, Homo sapiens
cttaaaaagtaact

SEQ ID NO: 6192658 - DNA, 16 bp, Homo sapiens
cttaaaaagtaattgt

SEQ ID NO: 6192659 - DNA, 20 bp, Homo sapiens
cttaaaaatacttaataaat

SEQ ID NO: 6192660 - DNA, 17 bp, Homo sapiens
cttaaaaatatatttcc

SEQ ID NO: 6192661 - DNA, 15 bp, Homo sapiens
cttaaaaatatgtga

SEQ ID NO: 6192662 - DNA, 13 bp, Homo sapiens
cttaaaaatcaca

SEQ ID NO: 6192663 - DNA, 21 bp, Homo sapiens
cttaaaaatcacactgtaaat

SEQ ID NO: 6192664 - DNA, 12 bp, Homo sapiens
cttaaaaatgca

SEQ ID NO: 6192665 - DNA, 14 bp, Homo sapiens
cttaaaaatgcatt

SEQ ID NO: 6192666 - DNA, 18 bp, Homo sapiens
cttaaaaatgcatttaag

SEQ ID NO: 6192667 - DNA, 23 bp, Homo sapiens
cttaaaaatgcatttaagttgta

SEQ ID NO: 6192668 - DNA, 20 bp, Homo sapiens
cttaaaaatgccaaaaacaa

SEQ ID NO: 6192669 - DNA, 13 bp, Homo sapiens
cttaaaaatggtt

SEQ ID NO: 6192670 - DNA, 21 bp, Homo sapiens
cttaaaaatggtttaaatggt

SEQ ID NO: 6192671 - DNA, 18 bp, Homo sapiens
cttaaaaatgtaaatatt

SEQ ID NO: 6192672 - DNA, 22 bp, Homo sapiens
cttaaaaatgttttttcatgtg

SEQ ID NO: 6192673 - DNA, 21 bp, Homo sapiens
cttaaaaattaaattggaaag

SEQ ID NO: 6192674 - DNA, 20 bp, Homo sapiens
cttaaaaattaatagtttta

SEQ ID NO: 6192675 - DNA, 12 bp, Homo sapiens
cttaaaaattta

SEQ ID NO: 6192676 - DNA, 15 bp, Homo sapiens
cttaaaaatttatta

SEQ ID NO: 6192677 - DNA, 16 bp, Homo sapiens
cttaaaacaaaaggaa

SEQ ID NO: 6192678 - DNA, 22 bp, Homo sapiens
cttaaaacaaaaggaaagaaac

SEQ ID NO: 6192679 - DNA, 12 bp, Homo sapiens
cttaaaacaagg

SEQ ID NO: 6192680 - DNA, 20 bp, Homo sapiens
cttaaaacaaggcttaaaag

SEQ ID NO: 6192681 - DNA, 15 bp, Homo sapiens
cttaaaacacatgat

SEQ ID NO: 6192682 - DNA, 11 bp, Homo sapiens
cttaaaacact

SEQ ID NO: 6192683 - DNA, 14 bp, Homo sapiens
cttaaaacagctgt

SEQ ID NO: 6192684 - DNA, 16 bp, Homo sapiens
cttaaaaccaatcaat

SEQ ID NO: 6192685 - DNA, 21 bp, Homo sapiens
cttaaaaccaatcaataatag

SEQ ID NO: 6192686 - DNA, 12 bp, Homo sapiens
cttaaaaccaga

SEQ ID NO: 6192687 - DNA, 18 bp, Homo sapiens
cttaaaaccagagaatct

SEQ ID NO: 6192688 - DNA, 20 bp, Homo sapiens
cttaaaaccagagaatctta

SEQ ID NO: 6192689 - DNA, 15 bp, Homo sapiens
cttaaaacctgcttt

SEQ ID NO: 6192690 - DNA, 12 bp, Homo sapiens
cttaaaactagg

SEQ ID NO: 6192691 - DNA, 22 bp, Homo sapiens
cttaaaactaggcatttgtaaa

SEQ ID NO: 6192692 - DNA, 12 bp, Homo sapiens
cttaaaactcct

SEQ ID NO: 6192693 - DNA, 20 bp, Homo sapiens
cttaaaactttattaaaaga

SEQ ID NO: 6192694 - DNA, 12 bp, Homo sapiens
cttaaaactttg

SEQ ID NO: 6192695 - DNA, 13 bp, Homo sapiens
cttaaaagaacat

SEQ ID NO: 6192696 - DNA, 18 bp, Homo sapiens
cttaaaagaggaaaatga

SEQ ID NO: 6192697 - DNA, 14 bp, Homo sapiens
cttaaaagcatttt

SEQ ID NO: 6192698 - DNA, 22 bp, Homo sapiens
cttaaaagcatttttattatat

SEQ ID NO: 6192699 - DNA, 13 bp, Homo sapiens
cttaaaagccatc

SEQ ID NO: 6192700 - DNA, 21 bp, Homo sapiens
cttaaaagccatcatgtaaat

SEQ ID NO: 6192701 - DNA, 21 bp, Homo sapiens
cttaaaagctatcttcatgta

SEQ ID NO: 6192702 - DNA, 24 bp, Homo sapiens
cttaaaagctatcttcatgtaaat

SEQ ID NO: 6192703 - DNA, 14 bp, Homo sapiens
cttaaaaggggccc

SEQ ID NO: 6192704 - DNA, 22 bp, Homo sapiens
cttaaaagtaataaagagaaat

SEQ ID NO: 6192705 - DNA, 13 bp, Homo sapiens
cttaaaagtactt

SEQ ID NO: 6192706 - DNA, 16 bp, Homo sapiens
cttaaaagtactttaa

SEQ ID NO: 6192707 - DNA, 23 bp, Homo sapiens
cttaaaataaaacactgtttccc

SEQ ID NO: 6192708 - DNA, 23 bp, Homo sapiens
cttaaaataaacagttgtgaacc

SEQ ID NO: 6192709 - DNA, 19 bp, Homo sapiens
cttaaaataaagttaaact

SEQ ID NO: 6192710 - DNA, 13 bp, Homo sapiens
cttaaaataagca

SEQ ID NO: 6192711 - DNA, 15 bp, Homo sapiens
cttaaaataagcagg

SEQ ID NO: 6192712 - DNA, 16 bp, Homo sapiens
cttaaaataatgattt

SEQ ID NO: 6192713 - DNA, 20 bp, Homo sapiens
cttaaaataattaaataaat

SEQ ID NO: 6192714 - DNA, 21 bp, Homo sapiens
cttaaaataattaaataaatg

SEQ ID NO: 6192715 - DNA, 23 bp, Homo sapiens
cttaaaataattaaataaatgaa

SEQ ID NO: 6192716 - DNA, 14 bp, Homo sapiens
cttaaaatacaaga

SEQ ID NO: 6192717 - DNA, 13 bp, Homo sapiens
cttaaaatagaaa

SEQ ID NO: 6192718 - DNA, 11 bp, Homo sapiens
cttaaaatatc

SEQ ID NO: 6192719 - DNA, 20 bp, Homo sapiens
cttaaaatattcctgcattt

SEQ ID NO: 6192720 - DNA, 13 bp, Homo sapiens
cttaaaatatttt

SEQ ID NO: 6192721 - DNA, 15 bp, Homo sapiens
cttaaaatctctaat

SEQ ID NO: 6192722 - DNA, 11 bp, Homo sapiens
cttaaaatgat

SEQ ID NO: 6192723 - DNA, 13 bp, Homo sapiens
cttaaaatgcaag

SEQ ID NO: 6192724 - DNA, 22 bp, Homo sapiens
cttaaaatgcaatatttgtaag

SEQ ID NO: 6192725 - DNA, 12 bp, Homo sapiens
cttaaaatgcat

SEQ ID NO: 6192726 - DNA, 19 bp, Homo sapiens
cttaaaatgcattgaaaga

SEQ ID NO: 6192727 - DNA, 14 bp, Homo sapiens
cttaaaatggaatt

SEQ ID NO: 6192728 - DNA, 19 bp, Homo sapiens
cttaaaattaagttgaaaa

SEQ ID NO: 6192729 - DNA, 21 bp, Homo sapiens
cttaaaattagtgagattaaa

SEQ ID NO: 6192730 - DNA, 18 bp, Homo sapiens
cttaaaattcaagaaaat

SEQ ID NO: 6192731 - DNA, 21 bp, Homo sapiens
cttaaaattgatattatatta

SEQ ID NO: 6192732 - DNA, 21 bp, Homo sapiens
cttaaaattggtaattgaatg

SEQ ID NO: 6192733 - DNA, 16 bp, Homo sapiens
cttaaaattggttaat

SEQ ID NO: 6192734 - DNA, 13 bp, Homo sapiens
cttaaaatttgaa

SEQ ID NO: 6192735 - DNA, 14 bp, Homo sapiens
cttaaaatttgaaa

SEQ ID NO: 6192736 - DNA, 16 bp, Homo sapiens
cttaaaatttgaaaca

SEQ ID NO: 6192737 - DNA, 21 bp, Homo sapiens
cttaaaatttttttctttcga

SEQ ID NO: 6192738 - DNA, 12 bp, Homo sapiens
cttaaacaaaaa

SEQ ID NO: 6192739 - DNA, 16 bp, Homo sapiens
cttaaacaaaaaacta

SEQ ID NO: 6192740 - DNA, 20 bp, Homo sapiens
cttaaacaaaaactttccat

SEQ ID NO: 6192741 - DNA, 13 bp, Homo sapiens
cttaaacaaaaat

SEQ ID NO: 6192742 - DNA, 14 bp, Homo sapiens
cttaaacaaatgta

SEQ ID NO: 6192743 - DNA, 18 bp, Homo sapiens
cttaaacaacacctcctc

SEQ ID NO: 6192744 - DNA, 13 bp, Homo sapiens
cttaaacaatgta

SEQ ID NO: 6192745 - DNA, 16 bp, Homo sapiens
cttaaacaatgtataa

SEQ ID NO: 6192746 - DNA, 14 bp, Homo sapiens
cttaaacagggcat

SEQ ID NO: 6192747 - DNA, 20 bp, Homo sapiens
cttaaacataataaatcaca

SEQ ID NO: 6192748 - DNA, 19 bp, Homo sapiens
cttaaacatttccctgctg

SEQ ID NO: 6192749 - DNA, 16 bp, Homo sapiens
cttaaacccacataaa

SEQ ID NO: 6192750 - DNA, 23 bp, Homo sapiens
cttaaacccatacaatgtatgta

SEQ ID NO: 6192751 - DNA, 15 bp, Homo sapiens
cttaaacctgtgctt

SEQ ID NO: 6192752 - DNA, 19 bp, Homo sapiens
cttaaacctgtgctttcat

SEQ ID NO: 6192753 - DNA, 23 bp, Homo sapiens
cttaaaccttcagttatgatttt

SEQ ID NO: 6192754 - DNA, 19 bp, Homo sapiens
cttaaacgaagagttccct

SEQ ID NO: 6192755 - DNA, 17 bp, Homo sapiens
cttaaactaaataatga

SEQ ID NO: 6192756 - DNA, 19 bp, Homo sapiens
cttaaactctcttcttcca

SEQ ID NO: 6192757 - DNA, 21 bp, Homo sapiens
cttaaactctggacactctat

SEQ ID NO: 6192758 - DNA, 15 bp, Homo sapiens
cttaaactgtacaga

SEQ ID NO: 6192759 - DNA, 14 bp, Homo sapiens
cttaaactgtgtgg

SEQ ID NO: 6192760 - DNA, 19 bp, Homo sapiens
cttaaacttccaaagcttc

SEQ ID NO: 6192761 - DNA, 14 bp, Homo sapiens
cttaaacttcctta

SEQ ID NO: 6192762 - DNA, 18 bp, Homo sapiens
cttaaacttgcacatttg

SEQ ID NO: 6192763 - DNA, 14 bp, Homo sapiens
cttaaactttgtca

SEQ ID NO: 6192764 - DNA, 19 bp, Homo sapiens
cttaaactttgtcacttct

SEQ ID NO: 6192765 - DNA, 18 bp, Homo sapiens
cttaaagaaaacccaccc

SEQ ID NO: 6192766 - DNA, 14 bp, Homo sapiens
gaagaatcttcctg

SEQ ID NO: 6192767 - DNA, 15 bp, Homo sapiens
gaagaatcttcctgg

SEQ ID NO: 6192768 - DNA, 16 bp, Homo sapiens
gaagaatgaaagctgt

SEQ ID NO: 6192769 - DNA, 20 bp, Homo sapiens
gaagaatgcacaagaatgga

SEQ ID NO: 6192770 - DNA, 15 bp, Homo sapiens
gaagaatggagagga

SEQ ID NO: 6192771 - DNA, 13 bp, Homo sapiens
gaagaatggccat

SEQ ID NO: 6192772 - DNA, 17 bp, Homo sapiens
gaagaatggctttcaat

SEQ ID NO: 6192773 - DNA, 18 bp, Homo sapiens
gaagaatgggctgcagaa

SEQ ID NO: 6192774 - DNA, 18 bp, Homo sapiens
gaagaatgtgtttcaaac

SEQ ID NO: 6192775 - DNA, 19 bp, Homo sapiens
gaagaatgtgtttcaaact

SEQ ID NO: 6192776 - DNA, 19 bp, Homo sapiens
gaagaatgttagagtaatg

SEQ ID NO: 6192777 - DNA, 14 bp, Homo sapiens
gaagaatgtttctg

SEQ ID NO: 6192778 - DNA, 22 bp, Homo sapiens
gaagaattattcagtgaatttg

SEQ ID NO: 6192779 - DNA, 13 bp, Homo sapiens
gaagaattatttt

SEQ ID NO: 6192780 - DNA, 17 bp, Homo sapiens
gaagaattgaaaagttt

SEQ ID NO: 6192781 - DNA, 18 bp, Homo sapiens
gaagaattgaaaagtttt

SEQ ID NO: 6192782 - DNA, 20 bp, Homo sapiens
gaagaattgaacccaggagg

SEQ ID NO: 6192783 - DNA, 16 bp, Homo sapiens
gaagaattgccaatct

SEQ ID NO: 6192784 - DNA, 19 bp, Homo sapiens
gaagaattgccaatcttgt

SEQ ID NO: 6192785 - DNA, 14 bp, Homo sapiens
gaagaatttaatgg

SEQ ID NO: 6192786 - DNA, 17 bp, Homo sapiens
gaagaatttaatggact

SEQ ID NO: 6192787 - DNA, 23 bp, Homo sapiens
gaagaatttaatggactgtgaat

SEQ ID NO: 6192788 - DNA, 18 bp, Homo sapiens
gaagaatttagatcttat

SEQ ID NO: 6192789 - DNA, 15 bp, Homo sapiens
gaagaatttattaca

SEQ ID NO: 6192790 - DNA, 13 bp, Homo sapiens
gaagaatttgaag

SEQ ID NO: 6192791 - DNA, 13 bp, Homo sapiens
gaagaatttgtta

SEQ ID NO: 6192792 - DNA, 13 bp, Homo sapiens
gaagaattttaaa

SEQ ID NO: 6192793 - DNA, 23 bp, Homo sapiens
gaagaattttaaaaatgaatcct

SEQ ID NO: 6192794 - DNA, 19 bp, Homo sapiens
gaagaattttatttttctg

SEQ ID NO: 6192795 - DNA, 12 bp, Homo sapiens
gaagaattttga

SEQ ID NO: 6192796 - DNA, 21 bp, Homo sapiens
gaagaattttttctcattctg

SEQ ID NO: 6192797 - DNA, 14 bp, Homo sapiens
gaagacaaaaatac

SEQ ID NO: 6192798 - DNA, 17 bp, Homo sapiens
gaagacaaaaatactct

SEQ ID NO: 6192799 - DNA, 20 bp, Homo sapiens
gaagacaaaattgtaagcca

SEQ ID NO: 6192800 - DNA, 22 bp, Homo sapiens
gaagacaaaattgtaagccaga

SEQ ID NO: 6192801 - DNA, 20 bp, Homo sapiens
gaagacaaaccactgtacat

SEQ ID NO: 6192802 - DNA, 12 bp, Homo sapiens
gaagacaaactt

SEQ ID NO: 6192803 - DNA, 16 bp, Homo sapiens
gaagacaaaggcccaa

SEQ ID NO: 6192804 - DNA, 13 bp, Homo sapiens
gaagacaaagtct

SEQ ID NO: 6192805 - DNA, 16 bp, Homo sapiens
gaagacaaatacacat

SEQ ID NO: 6192806 - DNA, 18 bp, Homo sapiens
gaagacaaatacacatac

SEQ ID NO: 6192807 - DNA, 17 bp, Homo sapiens
gaagacaacagaaagag

SEQ ID NO: 6192808 - DNA, 16 bp, Homo sapiens
gaagacaatgacttac

SEQ ID NO: 6192809 - DNA, 14 bp, Homo sapiens
gaagacaattgaca

SEQ ID NO: 6192810 - DNA, 18 bp, Homo sapiens
gaagacaatttgatacat

SEQ ID NO: 6192811 - DNA, 19 bp, Homo sapiens
gaagacaatttgatacata

SEQ ID NO: 6192812 - DNA, 12 bp, Homo sapiens
gaagacacacag

SEQ ID NO: 6192813 - DNA, 14 bp, Homo sapiens
gaagacacacagcc

SEQ ID NO: 6192814 - DNA, 23 bp, Homo sapiens
gaagacacacagccaacgttcat

SEQ ID NO: 6192815 - DNA, 12 bp, Homo sapiens
gaagacacagac

SEQ ID NO: 6192816 - DNA, 14 bp, Homo sapiens
gaagacaccagagc

SEQ ID NO: 6192817 - DNA, 22 bp, Homo sapiens
gaagacaccagagcagatgcag

SEQ ID NO: 6192818 - DNA, 13 bp, Homo sapiens
gaagacacctgca

SEQ ID NO: 6192819 - DNA, 24 bp, Homo sapiens
gaagacacgtgtttttgtatcttt

SEQ ID NO: 6192820 - DNA, 21 bp, Homo sapiens
gaagacactacagaggattct

SEQ ID NO: 6192821 - DNA, 21 bp, Homo sapiens
gaagacactgtgcaggcccag

SEQ ID NO: 6192822 - DNA, 13 bp, Homo sapiens
gaagacagagaaa

SEQ ID NO: 6192823 - DNA, 18 bp, Homo sapiens
gaagacagagacctcctg

SEQ ID NO: 6192824 - DNA, 21 bp, Homo sapiens
gaagacagagacctcctgcct

SEQ ID NO: 6192825 - DNA, 15 bp, Homo sapiens
gaagacagagatggc

SEQ ID NO: 6192826 - DNA, 21 bp, Homo sapiens
gaagacagagatggcagagcc

SEQ ID NO: 6192827 - DNA, 12 bp, Homo sapiens
gaagacagctct

SEQ ID NO: 6192828 - DNA, 14 bp, Homo sapiens
gaagacagctctta

SEQ ID NO: 6192829 - DNA, 18 bp, Homo sapiens
gaagacaggcacaaaatg

SEQ ID NO: 6192830 - DNA, 10 bp, Homo sapiens
gaagacagtg

SEQ ID NO: 6192831 - DNA, 13 bp, Homo sapiens
gaagacataaaac

SEQ ID NO: 6192832 - DNA, 15 bp, Homo sapiens
gaagacataaaactt

SEQ ID NO: 6192833 - DNA, 15 bp, Homo sapiens
gaagacatatattat

SEQ ID NO: 6192834 - DNA, 21 bp, Homo sapiens
gaagacatatattatatatag

SEQ ID NO: 6192835 - DNA, 15 bp, Homo sapiens
gaagacatggagact

SEQ ID NO: 6192836 - DNA, 22 bp, Homo sapiens
gaagacatggggaggaaggaca

SEQ ID NO: 6192837 - DNA, 12 bp, Homo sapiens
gaagacatgttt

SEQ ID NO: 6192838 - DNA, 14 bp, Homo sapiens
gaagacattctggt

SEQ ID NO: 6192839 - DNA, 21 bp, Homo sapiens
gaagacatttctgctctcagc

SEQ ID NO: 6192840 - DNA, 14 bp, Homo sapiens
gaagacatttcttt

SEQ ID NO: 6192841 - DNA, 23 bp, Homo sapiens
gaagacatttcttttctttttac

SEQ ID NO: 6192842 - DNA, 14 bp, Homo sapiens
gaagacattttgtt

SEQ ID NO: 6192843 - DNA, 19 bp, Homo sapiens
gaagacattttttgctata

SEQ ID NO: 6192844 - DNA, 21 bp, Homo sapiens
gaagacattttttgctataat

SEQ ID NO: 6192845 - DNA, 14 bp, Homo sapiens
gaagaccaaaatta

SEQ ID NO: 6192846 - DNA, 21 bp, Homo sapiens
gaagaccaaatgatagaactg

SEQ ID NO: 6192847 - DNA, 14 bp, Homo sapiens
gaagaccaaggcct

SEQ ID NO: 6192848 - DNA, 11 bp, Homo sapiens
gaagaccaatc

SEQ ID NO: 6192849 - DNA, 14 bp, Homo sapiens
gaagaccacatcca

SEQ ID NO: 6192850 - DNA, 22 bp, Homo sapiens
gaagaccacatccacacacgca

SEQ ID NO: 6192851 - DNA, 20 bp, Homo sapiens
gaagaccagctttgcagtga

SEQ ID NO: 6192852 - DNA, 18 bp, Homo sapiens
gaagaccagtcacagcca

SEQ ID NO: 6192853 - DNA, 22 bp, Homo sapiens
gaagaccagtcacagccatttc

SEQ ID NO: 6192854 - DNA, 20 bp, Homo sapiens
gaagacccattccttcccag

SEQ ID NO: 6192855 - DNA, 14 bp, Homo sapiens
gaagaccccaccca

SEQ ID NO: 6192856 - DNA, 15 bp, Homo sapiens
gaagaccccacccaa

SEQ ID NO: 6192857 - DNA, 16 bp, Homo sapiens
gaagaccccacccaag

SEQ ID NO: 6192858 - DNA, 16 bp, Homo sapiens
gaagacccctgcccaa

SEQ ID NO: 6192859 - DNA, 15 bp, Homo sapiens
gaagaccctttcaga

SEQ ID NO: 6192860 - DNA, 21 bp, Homo sapiens
gaagaccctttgttgaaaaat

SEQ ID NO: 6192861 - DNA, 18 bp, Homo sapiens
gaagacctaaccagggcc

SEQ ID NO: 6192862 - DNA, 23 bp, Homo sapiens
gaagacctaaccagggccagaag

SEQ ID NO: 6192863 - DNA, 17 bp, Homo sapiens
gaagacctagctatgtt

SEQ ID NO: 6192864 - DNA, 14 bp, Homo sapiens
gaagacctgagaat

SEQ ID NO: 6192865 - DNA, 23 bp, Homo sapiens
gaagaccttctagtgagcctggg

SEQ ID NO: 6192866 - DNA, 21 bp, Homo sapiens
gaagacctttttctgcactat

SEQ ID NO: 6192867 - DNA, 21 bp, Homo sapiens
gaagacgccgtctccatggca

SEQ ID NO: 6192868 - DNA, 15 bp, Homo sapiens
gaagacggaaaacaa

SEQ ID NO: 6192869 - DNA, 23 bp, Homo sapiens
gaagacgggaggggaggcattga

SEQ ID NO: 6192870 - DNA, 16 bp, Homo sapiens
gaagacgttttcttta

SEQ ID NO: 6192871 - DNA, 16 bp, Homo sapiens
gaagactacttttaga

SEQ ID NO: 6192872 - DNA, 23 bp, Homo sapiens
gaagactatcttactatttcaca

SEQ ID NO: 6192873 - DNA, 15 bp, Homo sapiens
gaagactccagaaat

SEQ ID NO: 6192874 - DNA, 13 bp, Homo sapiens
gaagactccctga

SEQ ID NO: 6192875 - DNA, 19 bp, Homo sapiens
gaagactccctgatcccag

SEQ ID NO: 6192876 - DNA, 23 bp, Homo sapiens
gaagactccctgatcccagacct

SEQ ID NO: 6192877 - DNA, 17 bp, Homo sapiens
gaagactcctaggccct

SEQ ID NO: 6192878 - DNA, 13 bp, Homo sapiens
gaagactctacca

SEQ ID NO: 6192879 - DNA, 23 bp, Homo sapiens
gaagactctaccagactgtgtat

SEQ ID NO: 6192880 - DNA, 22 bp, Homo sapiens
gaagactctccactgacctggt

SEQ ID NO: 6192881 - DNA, 15 bp, Homo sapiens
gaagactgagaactt

SEQ ID NO: 6192882 - DNA, 19 bp, Homo sapiens
gaagactgctaaatgcact

SEQ ID NO: 6192883 - DNA, 13 bp, Homo sapiens
gaagactgctatc

SEQ ID NO: 6192884 - DNA, 23 bp, Homo sapiens
gaagactgctcccggcccgcctg

SEQ ID NO: 6192885 - DNA, 12 bp, Homo sapiens
gaagactggaga

SEQ ID NO: 6192886 - DNA, 15 bp, Homo sapiens
gaagactggagaaat

SEQ ID NO: 6192887 - DNA, 17 bp, Homo sapiens
gaagactgtgcagaaga

SEQ ID NO: 6192888 - DNA, 13 bp, Homo sapiens
gaagactgtggct

SEQ ID NO: 6192889 - DNA, 19 bp, Homo sapiens
gaagactgttgtgctccat

SEQ ID NO: 6192890 - DNA, 18 bp, Homo sapiens
gaagacttaactggccca

SEQ ID NO: 6192891 - DNA, 19 bp, Homo sapiens
gaagacttaactggcccag

SEQ ID NO: 6192892 - DNA, 21 bp, Homo sapiens
gaagacttaactggcccagaa

SEQ ID NO: 6192893 - DNA, 23 bp, Homo sapiens
gaagacttaactggcccagaagc

SEQ ID NO: 6192894 - DNA, 20 bp, Homo sapiens
gaagacttacagcaaatcct

SEQ ID NO: 6192895 - DNA, 19 bp, Homo sapiens
gaagacttagatctgagcc

SEQ ID NO: 6192896 - DNA, 15 bp, Homo sapiens
gaagacttcaatatt

SEQ ID NO: 6192897 - DNA, 20 bp, Homo sapiens
gaagacttcaatattaaatg

SEQ ID NO: 6192898 - DNA, 14 bp, Homo sapiens
gaagacttccagct

SEQ ID NO: 6192899 - DNA, 19 bp, Homo sapiens
gaagacttccagctttctc

SEQ ID NO: 6192900 - DNA, 13 bp, Homo sapiens
gaagacttcctct

SEQ ID NO: 6192901 - DNA, 16 bp, Homo sapiens
gaagacttctagcaga

SEQ ID NO: 6192902 - DNA, 15 bp, Homo sapiens
gaagacttggcccag

SEQ ID NO: 6192903 - DNA, 20 bp, Homo sapiens
gaagactttaaaccacctag

SEQ ID NO: 6192904 - DNA, 13 bp, Homo sapiens
gaagactttggaa

SEQ ID NO: 6192905 - DNA, 17 bp, Homo sapiens
gaagactttggaaagag

SEQ ID NO: 6192906 - DNA, 17 bp, Homo sapiens
gaagactttgtgactgt

SEQ ID NO: 6192907 - DNA, 17 bp, Homo sapiens
gaagagaaaaaggctga

SEQ ID NO: 6192908 - DNA, 12 bp, Homo sapiens
gaagagaaaatg

SEQ ID NO: 6192909 - DNA, 14 bp, Homo sapiens
gaagagaaaggaca

SEQ ID NO: 6192910 - DNA, 15 bp, Homo sapiens
gaagagaaatacagc

SEQ ID NO: 6192911 - DNA, 16 bp, Homo sapiens
gaagagaaatacagct

SEQ ID NO: 6192912 - DNA, 19 bp, Homo sapiens
gaagagaaatacagctggc

SEQ ID NO: 6192913 - DNA, 20 bp, Homo sapiens
gaagagaaatacagctggct

SEQ ID NO: 6192914 - DNA, 21 bp, Homo sapiens
gaagagaacctcaaactagga

SEQ ID NO: 6192915 - DNA, 21 bp, Homo sapiens
gaagagaagaaatagcagagc

SEQ ID NO: 6192916 - DNA, 19 bp, Homo sapiens
gaagagaagagggcccagc

SEQ ID NO: 6192917 - DNA, 12 bp, Homo sapiens
gaagagaagctg

SEQ ID NO: 6192918 - DNA, 21 bp, Homo sapiens
gaagagaagctgagaagaagc

SEQ ID NO: 6192919 - DNA, 14 bp, Homo sapiens
gaagagaagctgct

SEQ ID NO: 6192920 - DNA, 15 bp, Homo sapiens
gaagagaagctgctg

SEQ ID NO: 6192921 - DNA, 12 bp, Homo sapiens
gaagagaaggag

SEQ ID NO: 6192922 - DNA, 19 bp, Homo sapiens
gaagagaatgcacaaacag

SEQ ID NO: 6192923 - DNA, 18 bp, Homo sapiens
gaagagaatgtattctgt

SEQ ID NO: 6192924 - DNA, 20 bp, Homo sapiens
gaagagacaaagtgggtgtg

SEQ ID NO: 6192925 - DNA, 23 bp, Homo sapiens
gaagagacagagacaagtaattt

SEQ ID NO: 6192926 - DNA, 11 bp, Homo sapiens
gaagagaccac

SEQ ID NO: 6192927 - DNA, 15 bp, Homo sapiens
gaagagaccacagca

SEQ ID NO: 6192928 - DNA, 13 bp, Homo sapiens
gaagagagaaaca

SEQ ID NO: 6192929 - DNA, 14 bp, Homo sapiens
gaagagagaacttt

SEQ ID NO: 6192930 - DNA, 14 bp, Homo sapiens
gaagagagagaccc

SEQ ID NO: 6192931 - DNA, 14 bp, Homo sapiens
gaagagagaggcct

SEQ ID NO: 6192932 - DNA, 17 bp, Homo sapiens
gaagagagaggcctggg

SEQ ID NO: 6192933 - DNA, 16 bp, Homo sapiens
gaagagagatcaaatg

SEQ ID NO: 6192934 - DNA, 12 bp, Homo sapiens
gaagagagccag

SEQ ID NO: 6192935 - DNA, 13 bp, Homo sapiens
gaagagaggagag

SEQ ID NO: 6192936 - DNA, 13 bp, Homo sapiens
gaagagaggagtt

SEQ ID NO: 6192937 - DNA, 15 bp, Homo sapiens
gaagagaggagttca

SEQ ID NO: 6192938 - DNA, 23 bp, Homo sapiens
gaagagaggcacctgctggaaac

SEQ ID NO: 6192939 - DNA, 13 bp, Homo sapiens
gaagagagggctg

SEQ ID NO: 6192940 - DNA, 14 bp, Homo sapiens
gaagagagggctga

SEQ ID NO: 6192941 - DNA, 15 bp, Homo sapiens
gaagagaggggaaga

SEQ ID NO: 6192942 - DNA, 16 bp, Homo sapiens
gaagagaggggaagaa

SEQ ID NO: 6192943 - DNA, 18 bp, Homo sapiens
gaagagaggggaagaatt

SEQ ID NO: 6192944 - DNA, 19 bp, Homo sapiens
gaagagaggggaagaattt

SEQ ID NO: 6192945 - DNA, 20 bp, Homo sapiens
gaagagagttccgggaaaca

SEQ ID NO: 6192946 - DNA, 15 bp, Homo sapiens
gaagagatccaaaga

SEQ ID NO: 6192947 - DNA, 17 bp, Homo sapiens
cttaaagaaaattgcat

SEQ ID NO: 6192948 - DNA, 19 bp, Homo sapiens
cttaaagaaaattgcatga

SEQ ID NO: 6192949 - DNA, 22 bp, Homo sapiens
cttaaagaaacagctttcaagt

SEQ ID NO: 6192950 - DNA, 15 bp, Homo sapiens
cttaaagaattcaaa

SEQ ID NO: 6192951 - DNA, 23 bp, Homo sapiens
cttaaagaattcaaattttatct

SEQ ID NO: 6192952 - DNA, 13 bp, Homo sapiens
cttaaagaatttg

SEQ ID NO: 6192953 - DNA, 14 bp, Homo sapiens
cttaaagacaaatt

SEQ ID NO: 6192954 - DNA, 22 bp, Homo sapiens
cttaaagagggacaggctgaag

SEQ ID NO: 6192955 - DNA, 19 bp, Homo sapiens
cttaaagatttatcaaatc

SEQ ID NO: 6192956 - DNA, 16 bp, Homo sapiens
cttaaagcaataagtt

SEQ ID NO: 6192957 - DNA, 16 bp, Homo sapiens
cttaaagctactgtag

SEQ ID NO: 6192958 - DNA, 14 bp, Homo sapiens
cttaaagctgaatt

SEQ ID NO: 6192959 - DNA, 13 bp, Homo sapiens
cttaaaggaaaag

SEQ ID NO: 6192960 - DNA, 17 bp, Homo sapiens
cttaaaggaaaagtcaa

SEQ ID NO: 6192961 - DNA, 19 bp, Homo sapiens
cttaaaggaaaagtcaaca

SEQ ID NO: 6192962 - DNA, 22 bp, Homo sapiens
cttaaaggaaaagtcaacatct

SEQ ID NO: 6192963 - DNA, 17 bp, Homo sapiens
cttaaaggacaggagga

SEQ ID NO: 6192964 - DNA, 18 bp, Homo sapiens
cttaaaggccgtcatttc

SEQ ID NO: 6192965 - DNA, 19 bp, Homo sapiens
cttaaaggccgtcatttca

SEQ ID NO: 6192966 - DNA, 15 bp, Homo sapiens
cttaaaggcctggaa

SEQ ID NO: 6192967 - DNA, 22 bp, Homo sapiens
cttaaagggcccaatgaattat

SEQ ID NO: 6192968 - DNA, 13 bp, Homo sapiens
cttaaaggggaga

SEQ ID NO: 6192969 - DNA, 16 bp, Homo sapiens
cttaaaggtgtcttcc

SEQ ID NO: 6192970 - DNA, 15 bp, Homo sapiens
cttaaagtgaaggaa

SEQ ID NO: 6192971 - DNA, 17 bp, Homo sapiens
cttaaagtgaaggaaat

SEQ ID NO: 6192972 - DNA, 17 bp, Homo sapiens
cttaaagtggctttcaa

SEQ ID NO: 6192973 - DNA, 11 bp, Homo sapiens
cttaaagttga

SEQ ID NO: 6192974 - DNA, 22 bp, Homo sapiens
cttaaagttgaatttattggct

SEQ ID NO: 6192975 - DNA, 15 bp, Homo sapiens
cttaaagtttaaagt

SEQ ID NO: 6192976 - DNA, 18 bp, Homo sapiens
cttaaagtttaaagttgc

SEQ ID NO: 6192977 - DNA, 19 bp, Homo sapiens
cttaaagtttaaagttgca

SEQ ID NO: 6192978 - DNA, 18 bp, Homo sapiens
cttaaagttttttatata

SEQ ID NO: 6192979 - DNA, 23 bp, Homo sapiens
cttaaataaatcaagaatcattg

SEQ ID NO: 6192980 - DNA, 14 bp, Homo sapiens
cttaaataaattca

SEQ ID NO: 6192981 - DNA, 16 bp, Homo sapiens
cttaaataaattcaaa

SEQ ID NO: 6192982 - DNA, 13 bp, Homo sapiens
cttaaataagaaa

SEQ ID NO: 6192983 - DNA, 16 bp, Homo sapiens
cttaaataagaaactt

SEQ ID NO: 6192984 - DNA, 17 bp, Homo sapiens
cttaaataagaaacttt

SEQ ID NO: 6192985 - DNA, 13 bp, Homo sapiens
cttaaataataaa

SEQ ID NO: 6192986 - DNA, 19 bp, Homo sapiens
cttaaataatgcttcagat

SEQ ID NO: 6192987 - DNA, 21 bp, Homo sapiens
cttaaataatgcttcagatat

SEQ ID NO: 6192988 - DNA, 19 bp, Homo sapiens
cttaaataatgtgaaactg

SEQ ID NO: 6192989 - DNA, 15 bp, Homo sapiens
cttaaataatttaag

SEQ ID NO: 6192990 - DNA, 21 bp, Homo sapiens
cttaaatacactgaattgaat

SEQ ID NO: 6192991 - DNA, 22 bp, Homo sapiens
cttaaatacactgaattgaatc

SEQ ID NO: 6192992 - DNA, 12 bp, Homo sapiens
cttaaatacaga

SEQ ID NO: 6192993 - DNA, 16 bp, Homo sapiens
cttaaatacagataat

SEQ ID NO: 6192994 - DNA, 22 bp, Homo sapiens
cttaaatacagataattcattt

SEQ ID NO: 6192995 - DNA, 14 bp, Homo sapiens
cttaaatagcatct

SEQ ID NO: 6192996 - DNA, 22 bp, Homo sapiens
cttaaatagcatctgctcttct

SEQ ID NO: 6192997 - DNA, 19 bp, Homo sapiens
cttaaatagctttgagatt

SEQ ID NO: 6192998 - DNA, 22 bp, Homo sapiens
cttaaataggaaagtttcttca

SEQ ID NO: 6192999 - DNA, 20 bp, Homo sapiens
cttaaatatatgatttatat

SEQ ID NO: 6193000 - DNA, 13 bp, Homo sapiens
cttaaatatcaat

SEQ ID NO: 6193001 - DNA, 18 bp, Homo sapiens
cttaaatatcaatcattt

SEQ ID NO: 6193002 - DNA, 15 bp, Homo sapiens
cttaaatatctttta

SEQ ID NO: 6193003 - DNA, 22 bp, Homo sapiens
cttaaatatcttttatgtttga

SEQ ID NO: 6193004 - DNA, 22 bp, Homo sapiens
cttaaatattgaataagtattc

SEQ ID NO: 6193005 - DNA, 22 bp, Homo sapiens
cttaaatattgtaatatgacag

SEQ ID NO: 6193006 - DNA, 21 bp, Homo sapiens
cttaaatcatagctgtctgac

SEQ ID NO: 6193007 - DNA, 16 bp, Homo sapiens
cttaaatcatttggtt

SEQ ID NO: 6193008 - DNA, 22 bp, Homo sapiens
cttaaatcatttggttaaatca

SEQ ID NO: 6193009 - DNA, 12 bp, Homo sapiens
cttaaatcttaa

SEQ ID NO: 6193010 - DNA, 21 bp, Homo sapiens
cttaaatgaaagcatgtggca

SEQ ID NO: 6193011 - DNA, 23 bp, Homo sapiens
cttaaatgaactactgctatttt

SEQ ID NO: 6193012 - DNA, 17 bp, Homo sapiens
cttaaatgagttactta

SEQ ID NO: 6193013 - DNA, 19 bp, Homo sapiens
cttaaatgagttacttaga

SEQ ID NO: 6193014 - DNA, 22 bp, Homo sapiens
cttaaatgcaaccatttgaaac

SEQ ID NO: 6193015 - DNA, 18 bp, Homo sapiens
cttaaatgcccccctccc

SEQ ID NO: 6193016 - DNA, 18 bp, Homo sapiens
cttaaatgctcattttct

SEQ ID NO: 6193017 - DNA, 19 bp, Homo sapiens
cttaaatggaattattttg

SEQ ID NO: 6193018 - DNA, 17 bp, Homo sapiens
cttaaatgtgaattact

SEQ ID NO: 6193019 - DNA, 19 bp, Homo sapiens
cttaaatgtgaattactaa

SEQ ID NO: 6193020 - DNA, 18 bp, Homo sapiens
cttaaatgttaatgagaa

SEQ ID NO: 6193021 - DNA, 19 bp, Homo sapiens
cttaaatgttaatgagaaa

SEQ ID NO: 6193022 - DNA, 17 bp, Homo sapiens
cttaaatgttatgtata

SEQ ID NO: 6193023 - DNA, 16 bp, Homo sapiens
cttaaatgttattatc

SEQ ID NO: 6193024 - DNA, 22 bp, Homo sapiens
cttaaatgtttatactgtattt

SEQ ID NO: 6193025 - DNA, 15 bp, Homo sapiens
cttaaatgttttcat

SEQ ID NO: 6193026 - DNA, 16 bp, Homo sapiens
cttaaatgttttcatt

SEQ ID NO: 6193027 - DNA, 17 bp, Homo sapiens
cttaaattaaacaattt

SEQ ID NO: 6193028 - DNA, 20 bp, Homo sapiens
cttaaattatatatttattt

SEQ ID NO: 6193029 - DNA, 16 bp, Homo sapiens
cttaaattcatttcta

SEQ ID NO: 6193030 - DNA, 23 bp, Homo sapiens
cttaaattcatttctagactcaa

SEQ ID NO: 6193031 - DNA, 18 bp, Homo sapiens
cttaaattcctactccct

SEQ ID NO: 6193032 - DNA, 20 bp, Homo sapiens
cttaaattcctcaacagtgt

SEQ ID NO: 6193033 - DNA, 21 bp, Homo sapiens
cttaaattgcttttgttgtga

SEQ ID NO: 6193034 - DNA, 23 bp, Homo sapiens
cttaaattgtgggcaaaagagaa

SEQ ID NO: 6193035 - DNA, 12 bp, Homo sapiens
cttaaatttcag

SEQ ID NO: 6193036 - DNA, 14 bp, Homo sapiens
cttaaatttcagaa

SEQ ID NO: 6193037 - DNA, 18 bp, Homo sapiens
cttaaatttcttatgtga

SEQ ID NO: 6193038 - DNA, 23 bp, Homo sapiens
cttaaatttcttggcaaatttta

SEQ ID NO: 6193039 - DNA, 14 bp, Homo sapiens
cttaaatttgaatc

SEQ ID NO: 6193040 - DNA, 21 bp, Homo sapiens
cttaaatttgatttacatata

SEQ ID NO: 6193041 - DNA, 21 bp, Homo sapiens
cttaaatttggtttgttaatt

SEQ ID NO: 6193042 - DNA, 15 bp, Homo sapiens
cttaaatttgtttaa

SEQ ID NO: 6193043 - DNA, 16 bp, Homo sapiens
cttaaattttaattta

SEQ ID NO: 6193044 - DNA, 23 bp, Homo sapiens
cttaacaaaccctcgtttctgat

SEQ ID NO: 6193045 - DNA, 23 bp, Homo sapiens
cttaacaaatacattcaaattct

SEQ ID NO: 6193046 - DNA, 16 bp, Homo sapiens
cttaacaacagcttct

SEQ ID NO: 6193047 - DNA, 14 bp, Homo sapiens
cttaacaatgcaac

SEQ ID NO: 6193048 - DNA, 19 bp, Homo sapiens
cttaacaatgcaactttta

SEQ ID NO: 6193049 - DNA, 23 bp, Homo sapiens
cttaacaatttctgtccttcaga

SEQ ID NO: 6193050 - DNA, 17 bp, Homo sapiens
cttaacacactggccat

SEQ ID NO: 6193051 - DNA, 17 bp, Homo sapiens
cttaacacagccttcct

SEQ ID NO: 6193052 - DNA, 19 bp, Homo sapiens
cttaacacagccttccttc

SEQ ID NO: 6193053 - DNA, 13 bp, Homo sapiens
cttaacacttaca

SEQ ID NO: 6193054 - DNA, 22 bp, Homo sapiens
cttaacagatctttactcttga

SEQ ID NO: 6193055 - DNA, 16 bp, Homo sapiens
cttaacagctgtatta

SEQ ID NO: 6193056 - DNA, 15 bp, Homo sapiens
cttaacaggctgatt

SEQ ID NO: 6193057 - DNA, 15 bp, Homo sapiens
cttaacagttgcttt

SEQ ID NO: 6193058 - DNA, 16 bp, Homo sapiens
cttaacataaacttgt

SEQ ID NO: 6193059 - DNA, 17 bp, Homo sapiens
cttaacataaacttgta

SEQ ID NO: 6193060 - DNA, 19 bp, Homo sapiens
cttaacatagccaaaatgt

SEQ ID NO: 6193061 - DNA, 17 bp, Homo sapiens
cttaacatatttactaa

SEQ ID NO: 6193062 - DNA, 13 bp, Homo sapiens
cttaacatgctgt

SEQ ID NO: 6193063 - DNA, 15 bp, Homo sapiens
cttaacatgctgtgt

SEQ ID NO: 6193064 - DNA, 17 bp, Homo sapiens
cttaacatgctgtgtaa

SEQ ID NO: 6193065 - DNA, 21 bp, Homo sapiens
cttaacatgctgtgtaagctg

SEQ ID NO: 6193066 - DNA, 14 bp, Homo sapiens
cttaacattctgta

SEQ ID NO: 6193067 - DNA, 17 bp, Homo sapiens
cttaacatttctctcca

SEQ ID NO: 6193068 - DNA, 21 bp, Homo sapiens
cttaaccaccgcatatgcatg

SEQ ID NO: 6193069 - DNA, 20 bp, Homo sapiens
cttaaccagcacatttctcc

SEQ ID NO: 6193070 - DNA, 14 bp, Homo sapiens
cttaaccagtctct

SEQ ID NO: 6193071 - DNA, 14 bp, Homo sapiens
cttaaccagttgtg

SEQ ID NO: 6193072 - DNA, 18 bp, Homo sapiens
cttaaccagttgtggtgt

SEQ ID NO: 6193073 - DNA, 17 bp, Homo sapiens
cttaacccacctctcct

SEQ ID NO: 6193074 - DNA, 15 bp, Homo sapiens
cttaacccagtgtcc

SEQ ID NO: 6193075 - DNA, 21 bp, Homo sapiens
cttaaccccgggatgcaaggt

SEQ ID NO: 6193076 - DNA, 20 bp, Homo sapiens
cttaacccctaagactgcct

SEQ ID NO: 6193077 - DNA, 21 bp, Homo sapiens
cttaacccctaagactgcctt

SEQ ID NO: 6193078 - DNA, 13 bp, Homo sapiens
cttaaccctgaac

SEQ ID NO: 6193079 - DNA, 13 bp, Homo sapiens
cttaaccctgtgc

SEQ ID NO: 6193080 - DNA, 19 bp, Homo sapiens
cttaaccctgtgctgtcag

SEQ ID NO: 6193081 - DNA, 14 bp, Homo sapiens
cttaacctcaggga

SEQ ID NO: 6193082 - DNA, 14 bp, Homo sapiens
cttaacctgctttt

SEQ ID NO: 6193083 - DNA, 18 bp, Homo sapiens
cttaaccttaaccttaaa

SEQ ID NO: 6193084 - DNA, 18 bp, Homo sapiens
cttaacctttccgctgtc

SEQ ID NO: 6193085 - DNA, 16 bp, Homo sapiens
cttaacgaataaaggt

SEQ ID NO: 6193086 - DNA, 16 bp, Homo sapiens
cttaacggaccaaagc

SEQ ID NO: 6193087 - DNA, 20 bp, Homo sapiens
cttaacggaccaaagcaaga

SEQ ID NO: 6193088 - DNA, 14 bp, Homo sapiens
cttaacggctccag

SEQ ID NO: 6193089 - DNA, 23 bp, Homo sapiens
cttaacgttctataaatgaatgt

SEQ ID NO: 6193090 - DNA, 16 bp, Homo sapiens
cttaacgttttcttaa

SEQ ID NO: 6193091 - DNA, 17 bp, Homo sapiens
cttaacgttttcttaaa

SEQ ID NO: 6193092 - DNA, 20 bp, Homo sapiens
cttaactaaatgataaatgt

SEQ ID NO: 6193093 - DNA, 17 bp, Homo sapiens
cttaactaagactcccg

SEQ ID NO: 6193094 - DNA, 15 bp, Homo sapiens
cttaactaatgtaaa

SEQ ID NO: 6193095 - DNA, 17 bp, Homo sapiens
cttaactaatgtaaata

SEQ ID NO: 6193096 - DNA, 17 bp, Homo sapiens
cttaactatcaccagtg

SEQ ID NO: 6193097 - DNA, 20 bp, Homo sapiens
cttaactatcaccagtgcat

SEQ ID NO: 6193098 - DNA, 17 bp, Homo sapiens
cttaactatctgttccc

SEQ ID NO: 6193099 - DNA, 12 bp, Homo sapiens
cttaactatgag

SEQ ID NO: 6193100 - DNA, 17 bp, Homo sapiens
cttaactcatctgttat

SEQ ID NO: 6193101 - DNA, 21 bp, Homo sapiens
cttaactcattgcaacctcca

SEQ ID NO: 6193102 - DNA, 13 bp, Homo sapiens
cttaactccaaga

SEQ ID NO: 6193103 - DNA, 18 bp, Homo sapiens
cttaactctaaccctgtg

SEQ ID NO: 6193104 - DNA, 16 bp, Homo sapiens
cttaactctgcaggaa

SEQ ID NO: 6193105 - DNA, 11 bp, Homo sapiens
cttaactgaag

SEQ ID NO: 6193106 - DNA, 14 bp, Homo sapiens
cttaactgaagaaa

SEQ ID NO: 6193107 - DNA, 22 bp, Homo sapiens
cttaactgatgacattccacca

SEQ ID NO: 6193108 - DNA, 19 bp, Homo sapiens
cttaactgcatttttagac

SEQ ID NO: 6193109 - DNA, 12 bp, Homo sapiens
cttaactggccc

SEQ ID NO: 6193110 - DNA, 15 bp, Homo sapiens
cttaactggccctcg

SEQ ID NO: 6193111 - DNA, 16 bp, Homo sapiens
cttaactggccctcgg

SEQ ID NO: 6193112 - DNA, 18 bp, Homo sapiens
cttaactggccctcgggc

SEQ ID NO: 6193113 - DNA, 14 bp, Homo sapiens
cttaactgtatttc

SEQ ID NO: 6193114 - DNA, 17 bp, Homo sapiens
cttaactgtatttcagt

SEQ ID NO: 6193115 - DNA, 20 bp, Homo sapiens
cttaactgtatttcagtatt

SEQ ID NO: 6193116 - DNA, 20 bp, Homo sapiens
cttaactgtccagtccagtg

SEQ ID NO: 6193117 - DNA, 23 bp, Homo sapiens
cttaactgtccagtccagtgatg

SEQ ID NO: 6193118 - DNA, 11 bp, Homo sapiens
cttaactgtgt

SEQ ID NO: 6193119 - DNA, 20 bp, Homo sapiens
cttaactgtgtgaagaaatg

SEQ ID NO: 6193120 - DNA, 12 bp, Homo sapiens
cttaactgttca

SEQ ID NO: 6193121 - DNA, 15 bp, Homo sapiens
cttaactgttgttga

SEQ ID NO: 6193122 - DNA, 14 bp, Homo sapiens
cttaacttaaaaga

SEQ ID NO: 6193123 - DNA, 17 bp, Homo sapiens
cttaacttaaaagaaca

SEQ ID NO: 6193124 - DNA, 18 bp, Homo sapiens
cttaacttattacctcag

SEQ ID NO: 6193125 - DNA, 22 bp, Homo sapiens
gaagagatcccaggaggtgcag

SEQ ID NO: 6193126 - DNA, 18 bp, Homo sapiens
gaagagatgggcttgttt

SEQ ID NO: 6193127 - DNA, 22 bp, Homo sapiens
gaagagatgtggcaaagtgctg

SEQ ID NO: 6193128 - DNA, 18 bp, Homo sapiens
gaagagatttttcatgat

SEQ ID NO: 6193129 - DNA, 13 bp, Homo sapiens
gaagagcaaaaat

SEQ ID NO: 6193130 - DNA, 21 bp, Homo sapiens
gaagagcaaaaatatcccttc

SEQ ID NO: 6193131 - DNA, 15 bp, Homo sapiens
gaagagcacagagcc

SEQ ID NO: 6193132 - DNA, 16 bp, Homo sapiens
gaagagcacagagccc

SEQ ID NO: 6193133 - DNA, 20 bp, Homo sapiens
gaagagcacagccctcccgc

SEQ ID NO: 6193134 - DNA, 14 bp, Homo sapiens
gaagagcagagctg

SEQ ID NO: 6193135 - DNA, 18 bp, Homo sapiens
gaagagcagcacctcctc

SEQ ID NO: 6193136 - DNA, 13 bp, Homo sapiens
gaagagcagcctg

SEQ ID NO: 6193137 - DNA, 14 bp, Homo sapiens
gaagagcagcctga

SEQ ID NO: 6193138 - DNA, 15 bp, Homo sapiens
gaagagcaggcacat

SEQ ID NO: 6193139 - DNA, 18 bp, Homo sapiens
gaagagcaggcacatgga

SEQ ID NO: 6193140 - DNA, 19 bp, Homo sapiens
gaagagcaggccagcccgg

SEQ ID NO: 6193141 - DNA, 10 bp, Homo sapiens
gaagagccac

SEQ ID NO: 6193142 - DNA, 12 bp, Homo sapiens
gaagagccacag

SEQ ID NO: 6193143 - DNA, 14 bp, Homo sapiens
gaagagccacctgc

SEQ ID NO: 6193144 - DNA, 22 bp, Homo sapiens
gaagagccacctgcaagatgga

SEQ ID NO: 6193145 - DNA, 17 bp, Homo sapiens
gaagagcccagtctgtt

SEQ ID NO: 6193146 - DNA, 21 bp, Homo sapiens
gaagagcccgccgtctgcagg

SEQ ID NO: 6193147 - DNA, 20 bp, Homo sapiens
gaagagccctgagctcaggc

SEQ ID NO: 6193148 - DNA, 23 bp, Homo sapiens
gaagagccctgagctcaggctga

SEQ ID NO: 6193149 - DNA, 17 bp, Homo sapiens
gaagagcctgaagctgg

SEQ ID NO: 6193150 - DNA, 16 bp, Homo sapiens
gaagagccttcacatg

SEQ ID NO: 6193151 - DNA, 21 bp, Homo sapiens
gaagagccttcacatgaaatt

SEQ ID NO: 6193152 - DNA, 15 bp, Homo sapiens
gaagagccttccacc

SEQ ID NO: 6193153 - DNA, 19 bp, Homo sapiens
gaagagccttccacccagg

SEQ ID NO: 6193154 - DNA, 19 bp, Homo sapiens
gaagagctatggcccagaa

SEQ ID NO: 6193155 - DNA, 20 bp, Homo sapiens
gaagagctatggcccagaaa

SEQ ID NO: 6193156 - DNA, 20 bp, Homo sapiens
gaagagctcaagggacaagg

SEQ ID NO: 6193157 - DNA, 21 bp, Homo sapiens
gaagagctcaagggacaagga

SEQ ID NO: 6193158 - DNA, 22 bp, Homo sapiens
gaagagctcccctccacagctg

SEQ ID NO: 6193159 - DNA, 12 bp, Homo sapiens
gaagagctcttc

SEQ ID NO: 6193160 - DNA, 21 bp, Homo sapiens
gaagagctcttcggtttctga

SEQ ID NO: 6193161 - DNA, 11 bp, Homo sapiens
gaagagctgag

SEQ ID NO: 6193162 - DNA, 23 bp, Homo sapiens
gaagagctgagtactcaggccac

SEQ ID NO: 6193163 - DNA, 13 bp, Homo sapiens
gaagagctgttca

SEQ ID NO: 6193164 - DNA, 20 bp, Homo sapiens
gaagagctgttcacagccag

SEQ ID NO: 6193165 - DNA, 14 bp, Homo sapiens
gaagagcttgcaca

SEQ ID NO: 6193166 - DNA, 16 bp, Homo sapiens
gaagagcttgctttga

SEQ ID NO: 6193167 - DNA, 22 bp, Homo sapiens
gaagagcttgtgtcctgtcctt

SEQ ID NO: 6193168 - DNA, 14 bp, Homo sapiens
gaagaggaaaatga

SEQ ID NO: 6193169 - DNA, 14 bp, Homo sapiens
gaagaggaacagtg

SEQ ID NO: 6193170 - DNA, 12 bp, Homo sapiens
gaagaggaacca

SEQ ID NO: 6193171 - DNA, 17 bp, Homo sapiens
gaagaggaactgggcct

SEQ ID NO: 6193172 - DNA, 21 bp, Homo sapiens
gaagaggaagaaattcaggta

SEQ ID NO: 6193173 - DNA, 16 bp, Homo sapiens
gaagaggaccagagga

SEQ ID NO: 6193174 - DNA, 16 bp, Homo sapiens
gaagaggactgtgtga

SEQ ID NO: 6193175 - DNA, 17 bp, Homo sapiens
gaagaggactgtgtgag

SEQ ID NO: 6193176 - DNA, 18 bp, Homo sapiens
gaagaggactgtgtgaga

SEQ ID NO: 6193177 - DNA, 12 bp, Homo sapiens
gaagaggagatg

SEQ ID NO: 6193178 - DNA, 13 bp, Homo sapiens
gaagaggagatgt

SEQ ID NO: 6193179 - DNA, 23 bp, Homo sapiens
gaagaggagatgtgatcaggccc

SEQ ID NO: 6193180 - DNA, 15 bp, Homo sapiens
gaagaggagccctca

SEQ ID NO: 6193181 - DNA, 16 bp, Homo sapiens
gaagaggagcctcaga

SEQ ID NO: 6193182 - DNA, 22 bp, Homo sapiens
gaaggaaggctccatctccagt

SEQ ID NO: 6193183 - DNA, 14 bp, Homo sapiens
gaaggaaggctctc

SEQ ID NO: 6193184 - DNA, 14 bp, Homo sapiens
gaaggaagggcaga

SEQ ID NO: 6193185 - DNA, 14 bp, Homo sapiens
gaaggaataagcat

SEQ ID NO: 6193186 - DNA, 17 bp, Homo sapiens
gaaggaatagccagaga

SEQ ID NO: 6193187 - DNA, 18 bp, Homo sapiens
gaaggaatagccagagag

SEQ ID NO: 6193188 - DNA, 19 bp, Homo sapiens
gaaggaatagccagagagg

SEQ ID NO: 6193189 - DNA, 23 bp, Homo sapiens
gaaggaatagccagagaggagca

SEQ ID NO: 6193190 - DNA, 20 bp, Homo sapiens
gaaggaatatatggcagagt

SEQ ID NO: 6193191 - DNA, 23 bp, Homo sapiens
gaaggaatcaaattttgccagag

SEQ ID NO: 6193192 - DNA, 20 bp, Homo sapiens
gaaggaatcattccagtgct

SEQ ID NO: 6193193 - DNA, 17 bp, Homo sapiens
gaaggaatctgtgcaga

SEQ ID NO: 6193194 - DNA, 18 bp, Homo sapiens
gaaggaatttgattgctt

SEQ ID NO: 6193195 - DNA, 16 bp, Homo sapiens
gaaggacaaggctaga

SEQ ID NO: 6193196 - DNA, 14 bp, Homo sapiens
gaaggacacagcag

SEQ ID NO: 6193197 - DNA, 18 bp, Homo sapiens
gaaggacacagcagtatt

SEQ ID NO: 6193198 - DNA, 19 bp, Homo sapiens
gaaggacacagcagtattg

SEQ ID NO: 6193199 - DNA, 15 bp, Homo sapiens
gaaggacagactggc

SEQ ID NO: 6193200 - DNA, 14 bp, Homo sapiens
gaaggacagctgtg

SEQ ID NO: 6193201 - DNA, 20 bp, Homo sapiens
gaaggacaggaccctcagga

SEQ ID NO: 6193202 - DNA, 19 bp, Homo sapiens
gaaggacaggtctctgaga

SEQ ID NO: 6193203 - DNA, 19 bp, Homo sapiens
gaaggacagtccctgctgg

SEQ ID NO: 6193204 - DNA, 22 bp, Homo sapiens
gaaggacagtccctgctgggga

SEQ ID NO: 6193205 - DNA, 20 bp, Homo sapiens
gaaggacattgcggacagcc

SEQ ID NO: 6193206 - DNA, 21 bp, Homo sapiens
gaaggacattgcggacagcca

SEQ ID NO: 6193207 - DNA, 23 bp, Homo sapiens
gaaggaccaacccatgccctgcc

SEQ ID NO: 6193208 - DNA, 20 bp, Homo sapiens
gaaggaccacattttatatt

SEQ ID NO: 6193209 - DNA, 19 bp, Homo sapiens
gaaggaccaggctggggcc

SEQ ID NO: 6193210 - DNA, 21 bp, Homo sapiens
gaaggaccaggctggggccag

SEQ ID NO: 6193211 - DNA, 17 bp, Homo sapiens
gaaggaccccctccccc

SEQ ID NO: 6193212 - DNA, 17 bp, Homo sapiens
gaaggacccctcaccac

SEQ ID NO: 6193213 - DNA, 21 bp, Homo sapiens
gaaggacccctcaccaccccc

SEQ ID NO: 6193214 - DNA, 23 bp, Homo sapiens
gaaggacccggaggggcctggca

SEQ ID NO: 6193215 - DNA, 16 bp, Homo sapiens
gaaggaccctggctct

SEQ ID NO: 6193216 - DNA, 19 bp, Homo sapiens
gaaggacctccccctgtgt

SEQ ID NO: 6193217 - DNA, 23 bp, Homo sapiens
gaaggacctccccctgtgtggcc

SEQ ID NO: 6193218 - DNA, 21 bp, Homo sapiens
gaaggacctgagctggccagg

SEQ ID NO: 6193219 - DNA, 16 bp, Homo sapiens
gaaggaccttcactct

SEQ ID NO: 6193220 - DNA, 20 bp, Homo sapiens
gaaggacggcaaggctgagg

SEQ ID NO: 6193221 - DNA, 14 bp, Homo sapiens
gaaggacggtgcca

SEQ ID NO: 6193222 - DNA, 20 bp, Homo sapiens
gaaggactaatagaaaagta

SEQ ID NO: 6193223 - DNA, 14 bp, Homo sapiens
gaaggactgaagaa

SEQ ID NO: 6193224 - DNA, 20 bp, Homo sapiens
gaaggactggattggccaaa

SEQ ID NO: 6193225 - DNA, 19 bp, Homo sapiens
gaaggactgtgacaggcag

SEQ ID NO: 6193226 - DNA, 13 bp, Homo sapiens
gaaggacttcctg

SEQ ID NO: 6193227 - DNA, 21 bp, Homo sapiens
gaaggagaaaggagccggacc

SEQ ID NO: 6193228 - DNA, 17 bp, Homo sapiens
gaaggagaagtaagagg

SEQ ID NO: 6193229 - DNA, 22 bp, Homo sapiens
gaaggagaatcatcaggaccct

SEQ ID NO: 6193230 - DNA, 14 bp, Homo sapiens
gaaggagacacaga

SEQ ID NO: 6193231 - DNA, 17 bp, Homo sapiens
gaaggagacacagatgt

SEQ ID NO: 6193232 - DNA, 19 bp, Homo sapiens
gaaggagacaccaagctca

SEQ ID NO: 6193233 - DNA, 22 bp, Homo sapiens
gaaggagacagcagcacccacc

SEQ ID NO: 6193234 - DNA, 12 bp, Homo sapiens
gaaggagacagg

SEQ ID NO: 6193235 - DNA, 13 bp, Homo sapiens
gaaggagacagga

SEQ ID NO: 6193236 - DNA, 15 bp, Homo sapiens
gaaggagacaggcag

SEQ ID NO: 6193237 - DNA, 17 bp, Homo sapiens
gaaggagactcacctct

SEQ ID NO: 6193238 - DNA, 20 bp, Homo sapiens
gaaggagagaaggggaggag

SEQ ID NO: 6193239 - DNA, 17 bp, Homo sapiens
gaaggagagagtctttt

SEQ ID NO: 6193240 - DNA, 19 bp, Homo sapiens
gaaggagagagtcttttaa

SEQ ID NO: 6193241 - DNA, 23 bp, Homo sapiens
gaaggagagatgacccctacccc

SEQ ID NO: 6193242 - DNA, 16 bp, Homo sapiens
gaaggagagcccaggc

SEQ ID NO: 6193243 - DNA, 15 bp, Homo sapiens
gaaggagagcctgct

SEQ ID NO: 6193244 - DNA, 14 bp, Homo sapiens
gaaggagaggagtg

SEQ ID NO: 6193245 - DNA, 13 bp, Homo sapiens
gaaggagaggctc

SEQ ID NO: 6193246 - DNA, 13 bp, Homo sapiens
gaaggagagggag

SEQ ID NO: 6193247 - DNA, 16 bp, Homo sapiens
gaaggagatcagggca

SEQ ID NO: 6193248 - DNA, 20 bp, Homo sapiens
gaaggagatgagtgggcttc

SEQ ID NO: 6193249 - DNA, 14 bp, Homo sapiens
gaaggagattccac

SEQ ID NO: 6193250 - DNA, 16 bp, Homo sapiens
gaaggagccagctccc

SEQ ID NO: 6193251 - DNA, 21 bp, Homo sapiens
gaaggagccccattcctggga

SEQ ID NO: 6193252 - DNA, 22 bp, Homo sapiens
gaaggagccccattcctgggaa

SEQ ID NO: 6193253 - DNA, 13 bp, Homo sapiens
gaaggagcccctg

SEQ ID NO: 6193254 - DNA, 22 bp, Homo sapiens
gaaggagcctgcggctgctggc

SEQ ID NO: 6193255 - DNA, 20 bp, Homo sapiens
gaaggagcggcgccctggac

SEQ ID NO: 6193256 - DNA, 22 bp, Homo sapiens
gaaggagcggcgccctggactt

SEQ ID NO: 6193257 - DNA, 23 bp, Homo sapiens
gaaggagcggcgccctggacttg

SEQ ID NO: 6193258 - DNA, 21 bp, Homo sapiens
gaaggagctcccaggaggggc

SEQ ID NO: 6193259 - DNA, 12 bp, Homo sapiens
gaaggagctgag

SEQ ID NO: 6193260 - DNA, 12 bp, Homo sapiens
gaaggagctgcc

SEQ ID NO: 6193261 - DNA, 14 bp, Homo sapiens
gaaggagctgcctg

SEQ ID NO: 6193262 - DNA, 15 bp, Homo sapiens
gaaggagctgcctgg

SEQ ID NO: 6193263 - DNA, 12 bp, Homo sapiens
gaaggaggaagg

SEQ ID NO: 6193264 - DNA, 18 bp, Homo sapiens
gaaggaggaagggactgg

SEQ ID NO: 6193265 - DNA, 21 bp, Homo sapiens
gaaggaggaagggactggtcc

SEQ ID NO: 6193266 - DNA, 13 bp, Homo sapiens
gaaggaggaccca

SEQ ID NO: 6193267 - DNA, 14 bp, Homo sapiens
gaaggaggacccag

SEQ ID NO: 6193268 - DNA, 18 bp, Homo sapiens
gaaggaggacccaggaca

SEQ ID NO: 6193269 - DNA, 14 bp, Homo sapiens
gaaggaggagacag

SEQ ID NO: 6193270 - DNA, 20 bp, Homo sapiens
gaaggaggagagagagggga

SEQ ID NO: 6193271 - DNA, 20 bp, Homo sapiens
gaaggaggccaaccagcccg

SEQ ID NO: 6193272 - DNA, 12 bp, Homo sapiens
gaaggaggccac

SEQ ID NO: 6193273 - DNA, 16 bp, Homo sapiens
gaaggaggccacctcc

SEQ ID NO: 6193274 - DNA, 17 bp, Homo sapiens
gaaggaggccacctcct

SEQ ID NO: 6193275 - DNA, 21 bp, Homo sapiens
gaaggaggctatgctcagggg

SEQ ID NO: 6193276 - DNA, 16 bp, Homo sapiens
gaaggagggacttggc

SEQ ID NO: 6193277 - DNA, 19 bp, Homo sapiens
gaaggagggagctgctcag

SEQ ID NO: 6193278 - DNA, 12 bp, Homo sapiens
gaaggagggatg

SEQ ID NO: 6193279 - DNA, 18 bp, Homo sapiens
gaaggaggggaagctgca

SEQ ID NO: 6193280 - DNA, 22 bp, Homo sapiens
gaaggagtgccataccttctcc

SEQ ID NO: 6193281 - DNA, 18 bp, Homo sapiens
gaaggagttacagggaag

SEQ ID NO: 6193282 - DNA, 13 bp, Homo sapiens
gaaggagtttaaa

SEQ ID NO: 6193283 - DNA, 13 bp, Homo sapiens
gaaggagttttat

SEQ ID NO: 6193284 - DNA, 17 bp, Homo sapiens
gaaggataaagccactt

SEQ ID NO: 6193285 - DNA, 21 bp, Homo sapiens
gaaggatacaaaagcatgtga

SEQ ID NO: 6193286 - DNA, 10 bp, Homo sapiens
gaaggatcct

SEQ ID NO: 6193287 - DNA, 20 bp, Homo sapiens
gaaggatcctggaaccactg

SEQ ID NO: 6193288 - DNA, 15 bp, Homo sapiens
gaaggatctgctgag

SEQ ID NO: 6193289 - DNA, 22 bp, Homo sapiens
gaaggatctgtttttaaaaatc

SEQ ID NO: 6193290 - DNA, 13 bp, Homo sapiens
gaaggatgaacag

SEQ ID NO: 6193291 - DNA, 16 bp, Homo sapiens
gaaggatgagcattta

SEQ ID NO: 6193292 - DNA, 21 bp, Homo sapiens
gaaggatgatgtctttttatt

SEQ ID NO: 6193293 - DNA, 16 bp, Homo sapiens
gaaggatgccaagaag

SEQ ID NO: 6193294 - DNA, 22 bp, Homo sapiens
gaaggatgggaaaaactgcagt

SEQ ID NO: 6193295 - DNA, 23 bp, Homo sapiens
gaaggatgggatgggttccagag

SEQ ID NO: 6193296 - DNA, 22 bp, Homo sapiens
gaaggatgggggctcctggcag

SEQ ID NO: 6193297 - DNA, 16 bp, Homo sapiens
gaaggatgtacatttc

SEQ ID NO: 6193298 - DNA, 22 bp, Homo sapiens
gaaggattcagtcataaagagg

SEQ ID NO: 6193299 - DNA, 21 bp, Homo sapiens
gaaggattcttttttcaatgt

SEQ ID NO: 6193300 - DNA, 20 bp, Homo sapiens
gaaggattgcatcctgctgg

SEQ ID NO: 6193301 - DNA, 21 bp, Homo sapiens
gaaggattgcatcctgctggg

SEQ ID NO: 6193302 - DNA, 12 bp, Homo sapiens
gaaggattttaa

SEQ ID NO: 6193303 - DNA, 20 bp, Homo sapiens
gaaggcaaactgaggcagca

SEQ ID NO: 6193304 - DNA, 15 bp, Homo sapiens
gaaggcaaagcacga

SEQ ID NO: 6193305 - DNA, 18 bp, Homo sapiens
gaaggcaaagcccctgga

SEQ ID NO: 6193306 - DNA, 13 bp, Homo sapiens
gaaggcaaaggca

SEQ ID NO: 6193307 - DNA, 19 bp, Homo sapiens
gaaggcaaaggcagaggaa

SEQ ID NO: 6193308 - DNA, 20 bp, Homo sapiens
gaaggcaaagtttacagatg

SEQ ID NO: 6193309 - DNA, 15 bp, Homo sapiens
cttagcgctctggac

SEQ ID NO: 6193310 - DNA, 16 bp, Homo sapiens
cttagcgctctggaca

SEQ ID NO: 6193311 - DNA, 17 bp, Homo sapiens
cttagcgtcaagacatt

SEQ ID NO: 6193312 - DNA, 19 bp, Homo sapiens
cttagcgtcaagacatttg

SEQ ID NO: 6193313 - DNA, 23 bp, Homo sapiens
cttagcgtcaagacatttgctga

SEQ ID NO: 6193314 - DNA, 14 bp, Homo sapiens
cttagctactgtat

SEQ ID NO: 6193315 - DNA, 22 bp, Homo sapiens
cttagctactgtatgcaaagtc

SEQ ID NO: 6193316 - DNA, 13 bp, Homo sapiens
cttagctatattt

SEQ ID NO: 6193317 - DNA, 14 bp, Homo sapiens
cttagctatcagaa

SEQ ID NO: 6193318 - DNA, 17 bp, Homo sapiens
cttagctatccttggct

SEQ ID NO: 6193319 - DNA, 20 bp, Homo sapiens
cttagctcaatgagcatgtt

SEQ ID NO: 6193320 - DNA, 12 bp, Homo sapiens
cttagctcaggt

SEQ ID NO: 6193321 - DNA, 15 bp, Homo sapiens
cttagctcaggtgcc

SEQ ID NO: 6193322 - DNA, 16 bp, Homo sapiens
cttagctcaggtgcct

SEQ ID NO: 6193323 - DNA, 17 bp, Homo sapiens
cttagctccctcccgca

SEQ ID NO: 6193324 - DNA, 21 bp, Homo sapiens
cttagctccctcccgcacccc

SEQ ID NO: 6193325 - DNA, 19 bp, Homo sapiens
cttagctcggttctcccaa

SEQ ID NO: 6193326 - DNA, 19 bp, Homo sapiens
cttagctctgccctggaac

SEQ ID NO: 6193327 - DNA, 20 bp, Homo sapiens
cttagctctgccctggaacc

SEQ ID NO: 6193328 - DNA, 14 bp, Homo sapiens
cttagctctggacg

SEQ ID NO: 6193329 - DNA, 11 bp, Homo sapiens
cttagctgagt

SEQ ID NO: 6193330 - DNA, 14 bp, Homo sapiens
cttagctgatgtct

SEQ ID NO: 6193331 - DNA, 14 bp, Homo sapiens
cttagctgccaagt

SEQ ID NO: 6193332 - DNA, 12 bp, Homo sapiens
cttagctgccag

SEQ ID NO: 6193333 - DNA, 14 bp, Homo sapiens
cttagctgccagtg

SEQ ID NO: 6193334 - DNA, 12 bp, Homo sapiens
cttagctggcca

SEQ ID NO: 6193335 - DNA, 14 bp, Homo sapiens
cttagctgtctgct

SEQ ID NO: 6193336 - DNA, 17 bp, Homo sapiens
cttagctgtctgctcag

SEQ ID NO: 6193337 - DNA, 16 bp, Homo sapiens
cttagcttagacctca

SEQ ID NO: 6193338 - DNA, 17 bp, Homo sapiens
cttagcttagacctcag

SEQ ID NO: 6193339 - DNA, 21 bp, Homo sapiens
cttagcttagacctcagcctg

SEQ ID NO: 6193340 - DNA, 22 bp, Homo sapiens
cttagcttagacctcagcctgt

SEQ ID NO: 6193341 - DNA, 20 bp, Homo sapiens
cttagcttatctttctttcc

SEQ ID NO: 6193342 - DNA, 21 bp, Homo sapiens
cttagcttatctttctttcca

SEQ ID NO: 6193343 - DNA, 19 bp, Homo sapiens
cttagcttattgatcccac

SEQ ID NO: 6193344 - DNA, 21 bp, Homo sapiens
cttagcttgcacatgaatgca

SEQ ID NO: 6193345 - DNA, 14 bp, Homo sapiens
cttagctttacatt

SEQ ID NO: 6193346 - DNA, 16 bp, Homo sapiens
cttagctttagaaaca

SEQ ID NO: 6193347 - DNA, 13 bp, Homo sapiens
cttagctttattt

SEQ ID NO: 6193348 - DNA, 17 bp, Homo sapiens
cttagctttccacagga

SEQ ID NO: 6193349 - DNA, 18 bp, Homo sapiens
cttagctttccctgtgcc

SEQ ID NO: 6193350 - DNA, 20 bp, Homo sapiens
cttagctttccctgtgccac

SEQ ID NO: 6193351 - DNA, 22 bp, Homo sapiens
cttagctttccctgtgccactt

SEQ ID NO: 6193352 - DNA, 16 bp, Homo sapiens
cttagctttctcaggg

SEQ ID NO: 6193353 - DNA, 13 bp, Homo sapiens
cttagctttctgg

SEQ ID NO: 6193354 - DNA, 13 bp, Homo sapiens
cttagctttgaaa

SEQ ID NO: 6193355 - DNA, 15 bp, Homo sapiens
cttagctttgaaact

SEQ ID NO: 6193356 - DNA, 19 bp, Homo sapiens
cttagcttttagcctggct

SEQ ID NO: 6193357 - DNA, 15 bp, Homo sapiens
cttagcttttctgca

SEQ ID NO: 6193358 - DNA, 20 bp, Homo sapiens
cttagcttttgatgtctcca

SEQ ID NO: 6193359 - DNA, 18 bp, Homo sapiens
cttaggaaaatgcttctg

SEQ ID NO: 6193360 - DNA, 15 bp, Homo sapiens
cttaggaacagctct

SEQ ID NO: 6193361 - DNA, 23 bp, Homo sapiens
cttaggaaccttctcccttcttg

SEQ ID NO: 6193362 - DNA, 15 bp, Homo sapiens
cttaggaagaatttt

SEQ ID NO: 6193363 - DNA, 16 bp, Homo sapiens
cttaggaatactgttt

SEQ ID NO: 6193364 - DNA, 23 bp, Homo sapiens
cttaggactacattttgctctgt

SEQ ID NO: 6193365 - DNA, 22 bp, Homo sapiens
cttaggagatttaccacttttt

SEQ ID NO: 6193366 - DNA, 18 bp, Homo sapiens
cttaggagcaagaagaaa

SEQ ID NO: 6193367 - DNA, 19 bp, Homo sapiens
cttaggagcaagaagaaaa

SEQ ID NO: 6193368 - DNA, 14 bp, Homo sapiens
cttaggatgtctgt

SEQ ID NO: 6193369 - DNA, 23 bp, Homo sapiens
cttaggcaatggtgaactgtcat

SEQ ID NO: 6193370 - DNA, 21 bp, Homo sapiens
cttaggcactgagggatctga

SEQ ID NO: 6193371 - DNA, 19 bp, Homo sapiens
cttaggcatgactgtagaa

SEQ ID NO: 6193372 - DNA, 22 bp, Homo sapiens
cttaggcatgtaggaccctgca

SEQ ID NO: 6193373 - DNA, 17 bp, Homo sapiens
cttaggcattatttaat

SEQ ID NO: 6193374 - DNA, 22 bp, Homo sapiens
cttaggcattatttaatgtttg

SEQ ID NO: 6193375 - DNA, 23 bp, Homo sapiens
cttaggccttcctctctccagat

SEQ ID NO: 6193376 - DNA, 21 bp, Homo sapiens
cttaggctactgtaatgctgc

SEQ ID NO: 6193377 - DNA, 22 bp, Homo sapiens
cttaggctactgtaatgctgcc

SEQ ID NO: 6193378 - DNA, 19 bp, Homo sapiens
cttaggcttggctgccctg

SEQ ID NO: 6193379 - DNA, 16 bp, Homo sapiens
cttaggctttgtatga

SEQ ID NO: 6193380 - DNA, 12 bp, Homo sapiens
cttagggaaaga

SEQ ID NO: 6193381 - DNA, 14 bp, Homo sapiens
cttagggaagaaaa

SEQ ID NO: 6193382 - DNA, 15 bp, Homo sapiens
cttagggaagaaaaa

SEQ ID NO: 6193383 - DNA, 17 bp, Homo sapiens
cttagggaagctggcct

SEQ ID NO: 6193384 - DNA, 21 bp, Homo sapiens
cttagggaaggatacaaaagc

SEQ ID NO: 6193385 - DNA, 18 bp, Homo sapiens
cttagggacaggacccca

SEQ ID NO: 6193386 - DNA, 21 bp, Homo sapiens
cttagggacaggaccccagct

SEQ ID NO: 6193387 - DNA, 22 bp, Homo sapiens
cttagggacaggaccccagctc

SEQ ID NO: 6193388 - DNA, 23 bp, Homo sapiens
cttagggacaggaccccagctct

SEQ ID NO: 6193389 - DNA, 23 bp, Homo sapiens
cttagggactacccatagacatg

SEQ ID NO: 6193390 - DNA, 15 bp, Homo sapiens
cttagggcaccaggg

SEQ ID NO: 6193391 - DNA, 13 bp, Homo sapiens
cttagggcactgg

SEQ ID NO: 6193392 - DNA, 17 bp, Homo sapiens
cttagggcactgggctg

SEQ ID NO: 6193393 - DNA, 18 bp, Homo sapiens
cttagggccctggaggcg

SEQ ID NO: 6193394 - DNA, 20 bp, Homo sapiens
cttaggggaaccctgtccct

SEQ ID NO: 6193395 - DNA, 18 bp, Homo sapiens
cttaggggaatgttttcg

SEQ ID NO: 6193396 - DNA, 19 bp, Homo sapiens
cttagggtacagcccaggc

SEQ ID NO: 6193397 - DNA, 20 bp, Homo sapiens
cttagggtacagcccaggcg

SEQ ID NO: 6193398 - DNA, 13 bp, Homo sapiens
cttagggtctcag

SEQ ID NO: 6193399 - DNA, 20 bp, Homo sapiens
cttagggtggctttaattgt

SEQ ID NO: 6193400 - DNA, 19 bp, Homo sapiens
cttagggtttgcagagtgg

SEQ ID NO: 6193401 - DNA, 23 bp, Homo sapiens
cttaggtaatttggaagaaaact

SEQ ID NO: 6193402 - DNA, 18 bp, Homo sapiens
cttaggtacttattccag

SEQ ID NO: 6193403 - DNA, 23 bp, Homo sapiens
cttaggtcctcacttctgtctcc

SEQ ID NO: 6193404 - DNA, 15 bp, Homo sapiens
cttaggtctcatgga

SEQ ID NO: 6193405 - DNA, 13 bp, Homo sapiens
cttaggtcttcct

SEQ ID NO: 6193406 - DNA, 17 bp, Homo sapiens
cttaggtcttcctgtgg

SEQ ID NO: 6193407 - DNA, 22 bp, Homo sapiens
cttaggtcttcctgtggctccc

SEQ ID NO: 6193408 - DNA, 22 bp, Homo sapiens
cttaggtgagacagttgcccga

SEQ ID NO: 6193409 - DNA, 21 bp, Homo sapiens
cttaggtggcaagctgtgact

SEQ ID NO: 6193410 - DNA, 22 bp, Homo sapiens
cttaggtgtgattataaaatca

SEQ ID NO: 6193411 - DNA, 21 bp, Homo sapiens
cttaggttgtagcagaaagga

SEQ ID NO: 6193412 - DNA, 13 bp, Homo sapiens
cttaggtttactg

SEQ ID NO: 6193413 - DNA, 16 bp, Homo sapiens
cttaggtttactgtga

SEQ ID NO: 6193414 - DNA, 18 bp, Homo sapiens
cttaggtttactgtgaag

SEQ ID NO: 6193415 - DNA, 21 bp, Homo sapiens
cttaggtttactgtgaagaga

SEQ ID NO: 6193416 - DNA, 14 bp, Homo sapiens
cttaggtttccacg

SEQ ID NO: 6193417 - DNA, 20 bp, Homo sapiens
cttagtaaaatttatttcat

SEQ ID NO: 6193418 - DNA, 18 bp, Homo sapiens
cttagtaaattcctaatt

SEQ ID NO: 6193419 - DNA, 23 bp, Homo sapiens
cttagtaagcggctcaagcccag

SEQ ID NO: 6193420 - DNA, 12 bp, Homo sapiens
cttagtaagtat

SEQ ID NO: 6193421 - DNA, 21 bp, Homo sapiens
cttagtaatgctacgtgtgat

SEQ ID NO: 6193422 - DNA, 23 bp, Homo sapiens
cttagtaatgctacgtgtgattt

SEQ ID NO: 6193423 - DNA, 16 bp, Homo sapiens
cttagtacatgctctg

SEQ ID NO: 6193424 - DNA, 20 bp, Homo sapiens
cttagtacatgctctgtcca

SEQ ID NO: 6193425 - DNA, 17 bp, Homo sapiens
cttagtacggctgctgc

SEQ ID NO: 6193426 - DNA, 14 bp, Homo sapiens
cttagtactgagtt

SEQ ID NO: 6193427 - DNA, 13 bp, Homo sapiens
cttagtaggtcct

SEQ ID NO: 6193428 - DNA, 20 bp, Homo sapiens
cttagtaggtcctcaataaa

SEQ ID NO: 6193429 - DNA, 17 bp, Homo sapiens
cttagtagtttttacaa

SEQ ID NO: 6193430 - DNA, 15 bp, Homo sapiens
cttagtatcagtcat

SEQ ID NO: 6193431 - DNA, 13 bp, Homo sapiens
cttagtatctcat

SEQ ID NO: 6193432 - DNA, 17 bp, Homo sapiens
cttagtatctcatcaac

SEQ ID NO: 6193433 - DNA, 19 bp, Homo sapiens
cttagtatctcatcaacaa

SEQ ID NO: 6193434 - DNA, 22 bp, Homo sapiens
cttagtatctcatcaacaaaga

SEQ ID NO: 6193435 - DNA, 16 bp, Homo sapiens
cttagtatttctcagg

SEQ ID NO: 6193436 - DNA, 18 bp, Homo sapiens
cttagtatttctcaggaa

SEQ ID NO: 6193437 - DNA, 21 bp, Homo sapiens
cttagtcactgagacagcccg

SEQ ID NO: 6193438 - DNA, 14 bp, Homo sapiens
cttagtcactgcct

SEQ ID NO: 6193439 - DNA, 16 bp, Homo sapiens
cttagtcactgcctgc

SEQ ID NO: 6193440 - DNA, 13 bp, Homo sapiens
cttagtccacaag

SEQ ID NO: 6193441 - DNA, 13 bp, Homo sapiens
cttagtcccaagc

SEQ ID NO: 6193442 - DNA, 19 bp, Homo sapiens
cttagtcccacagggaaat

SEQ ID NO: 6193443 - DNA, 17 bp, Homo sapiens
cttagtcctccctgctc

SEQ ID NO: 6193444 - DNA, 21 bp, Homo sapiens
cttagtcctccctgctcagct

SEQ ID NO: 6193445 - DNA, 11 bp, Homo sapiens
cttagtcctgg

SEQ ID NO: 6193446 - DNA, 14 bp, Homo sapiens
cttagtcctgggag

SEQ ID NO: 6193447 - DNA, 23 bp, Homo sapiens
cttagtcgaatgttagattcctc

SEQ ID NO: 6193448 - DNA, 13 bp, Homo sapiens
cttagtctcagtt

SEQ ID NO: 6193449 - DNA, 16 bp, Homo sapiens
cttagtcttctcatag

SEQ ID NO: 6193450 - DNA, 20 bp, Homo sapiens
cttagtcttctcatagcatt

SEQ ID NO: 6193451 - DNA, 17 bp, Homo sapiens
cttagtgaaattacttc

SEQ ID NO: 6193452 - DNA, 15 bp, Homo sapiens
cttagtgacttagtt

SEQ ID NO: 6193453 - DNA, 13 bp, Homo sapiens
cttagtgagcagt

SEQ ID NO: 6193454 - DNA, 16 bp, Homo sapiens
cttagtgagcagtgag

SEQ ID NO: 6193455 - DNA, 20 bp, Homo sapiens
cttagtgatcatttaaaaag

SEQ ID NO: 6193456 - DNA, 21 bp, Homo sapiens
cttagtgattgagactcaaaa

SEQ ID NO: 6193457 - DNA, 20 bp, Homo sapiens
cttagtgccaggagggcaca

SEQ ID NO: 6193458 - DNA, 19 bp, Homo sapiens
cttagtgcggacaagtttt

SEQ ID NO: 6193459 - DNA, 22 bp, Homo sapiens
cttagtgcggacaagttttaat

SEQ ID NO: 6193460 - DNA, 15 bp, Homo sapiens
cttagtgctatgtgt

SEQ ID NO: 6193461 - DNA, 13 bp, Homo sapiens
cttagtggctttt

SEQ ID NO: 6193462 - DNA, 16 bp, Homo sapiens
cttagtggtatgtctc

SEQ ID NO: 6193463 - DNA, 14 bp, Homo sapiens
cttagtgtctcgtg

SEQ ID NO: 6193464 - DNA, 14 bp, Homo sapiens
cttagtgttcaaaa

SEQ ID NO: 6193465 - DNA, 16 bp, Homo sapiens
cttagtgtttctgtgc

SEQ ID NO: 6193466 - DNA, 17 bp, Homo sapiens
cttagtgtttctgtgca

SEQ ID NO: 6193467 - DNA, 21 bp, Homo sapiens
cttagttaagtcatccacagc

SEQ ID NO: 6193468 - DNA, 16 bp, Homo sapiens
cttagttacatttcta

SEQ ID NO: 6193469 - DNA, 22 bp, Homo sapiens
cttagttcacctaccctgagtg

SEQ ID NO: 6193470 - DNA, 19 bp, Homo sapiens
cttagttctgtatataaat

SEQ ID NO: 6193471 - DNA, 13 bp, Homo sapiens
cttagttcttgaa

SEQ ID NO: 6193472 - DNA, 15 bp, Homo sapiens
cttagttcttgaatt

SEQ ID NO: 6193473 - DNA, 20 bp, Homo sapiens
cttagttcttgaattgttat

SEQ ID NO: 6193474 - DNA, 15 bp, Homo sapiens
cttagtttattgtgg

SEQ ID NO: 6193475 - DNA, 20 bp, Homo sapiens
cttagtttcaaagtgtctca

SEQ ID NO: 6193476 - DNA, 20 bp, Homo sapiens
cttagtttcagagaccttaa

SEQ ID NO: 6193477 - DNA, 22 bp, Homo sapiens
cttagtttcagctgaccagaag

SEQ ID NO: 6193478 - DNA, 22 bp, Homo sapiens
cttagtttgtgaattgattttg

SEQ ID NO: 6193479 - DNA, 22 bp, Homo sapiens
cttagtttgtgatgtaaggcac

SEQ ID NO: 6193480 - DNA, 16 bp, Homo sapiens
cttagttttgttccaa

SEQ ID NO: 6193481 - DNA, 14 bp, Homo sapiens
cttagtttttaaaa

SEQ ID NO: 6193482 - DNA, 17 bp, Homo sapiens
cttagtttttaaaaagg

SEQ ID NO: 6193483 - DNA, 18 bp, Homo sapiens
cttagtttttaaaaaggc

SEQ ID NO: 6193484 - DNA, 17 bp, Homo sapiens
cttagtttttaccttgt

SEQ ID NO: 6193485 - DNA, 17 bp, Homo sapiens
cttagttttttttaaaa

SEQ ID NO: 6193486 - DNA, 21 bp, Homo sapiens
cttataaaaataaagggaaga

SEQ ID NO: 6193487 - DNA, 23 bp, Homo sapiens
gaaggcaacacctgtggataaaa

SEQ ID NO: 6193488 - DNA, 16 bp, Homo sapiens
gaaggcaaccattttt

SEQ ID NO: 6193489 - DNA, 23 bp, Homo sapiens
gaaggcaagagggggtggagggg

SEQ ID NO: 6193490 - DNA, 11 bp, Homo sapiens
gaaggcaagat

SEQ ID NO: 6193491 - DNA, 14 bp, Homo sapiens
gaaggcaagccagg

SEQ ID NO: 6193492 - DNA, 17 bp, Homo sapiens
gaaggcaagctggcagg

SEQ ID NO: 6193493 - DNA, 15 bp, Homo sapiens
gaaggcaaggccctg

SEQ ID NO: 6193494 - DNA, 19 bp, Homo sapiens
gaaggcaaggccctgccct

SEQ ID NO: 6193495 - DNA, 20 bp, Homo sapiens
gaaggcaataccaacctgaa

SEQ ID NO: 6193496 - DNA, 22 bp, Homo sapiens
gaaggcaataccaacctgaaag

SEQ ID NO: 6193497 - DNA, 22 bp, Homo sapiens
gaaggcacacagagattctgga

SEQ ID NO: 6193498 - DNA, 16 bp, Homo sapiens
gaaggcacactgagca

SEQ ID NO: 6193499 - DNA, 14 bp, Homo sapiens
gaaggcacctgctc

SEQ ID NO: 6193500 - DNA, 15 bp, Homo sapiens
gaaggcagaaagcaa

SEQ ID NO: 6193501 - DNA, 18 bp, Homo sapiens
gaaggcagaaagcaaaat

SEQ ID NO: 6193502 - DNA, 14 bp, Homo sapiens
gaaggcagacagca

SEQ ID NO: 6193503 - DNA, 22 bp, Homo sapiens
gaaggcagagaaagggacaatg

SEQ ID NO: 6193504 - DNA, 18 bp, Homo sapiens
gaaggcagagaaatctaa

SEQ ID NO: 6193505 - DNA, 19 bp, Homo sapiens
gaaggcagaggctggcacc

SEQ ID NO: 6193506 - DNA, 14 bp, Homo sapiens
gaaggcagcattcc

SEQ ID NO: 6193507 - DNA, 13 bp, Homo sapiens
gaaggcagctgct

SEQ ID NO: 6193508 - DNA, 21 bp, Homo sapiens
gaaggcaggagccttcctttc

SEQ ID NO: 6193509 - DNA, 21 bp, Homo sapiens
gaaggcaggagttgggggcag

SEQ ID NO: 6193510 - DNA, 14 bp, Homo sapiens
gaaggcaggcaggg

SEQ ID NO: 6193511 - DNA, 15 bp, Homo sapiens
gaaggcaggcagggc

SEQ ID NO: 6193512 - DNA, 22 bp, Homo sapiens
gaaggcaggcagggctctcctg

SEQ ID NO: 6193513 - DNA, 23 bp, Homo sapiens
gaaggcaggcctccgtcttccca

SEQ ID NO: 6193514 - DNA, 20 bp, Homo sapiens
gaaggcagggaatgcctgga

SEQ ID NO: 6193515 - DNA, 22 bp, Homo sapiens
gaaggcagggaatgcctggagg

SEQ ID NO: 6193516 - DNA, 14 bp, Homo sapiens
gaaggcagggagga

SEQ ID NO: 6193517 - DNA, 16 bp, Homo sapiens
gaaggcagggaggagg

SEQ ID NO: 6193518 - DNA, 17 bp, Homo sapiens
gaaggcagggaggaggc

SEQ ID NO: 6193519 - DNA, 18 bp, Homo sapiens
gaaggcagggagggcctg

SEQ ID NO: 6193520 - DNA, 22 bp, Homo sapiens
gaaggcagggagggcctgggcc

SEQ ID NO: 6193521 - DNA, 23 bp, Homo sapiens
gaaggcagggagggcctgggccc

SEQ ID NO: 6193522 - DNA, 15 bp, Homo sapiens
gaaggcagggcagag

SEQ ID NO: 6193523 - DNA, 14 bp, Homo sapiens
gaaggcagggctcc

SEQ ID NO: 6193524 - DNA, 15 bp, Homo sapiens
gaaggcagggctcct

SEQ ID NO: 6193525 - DNA, 23 bp, Homo sapiens
gaaggcagggctcctccctggag

SEQ ID NO: 6193526 - DNA, 14 bp, Homo sapiens
gaaggcatgagaaa

SEQ ID NO: 6193527 - DNA, 18 bp, Homo sapiens
gaaggcattgtcctgtga

SEQ ID NO: 6193528 - DNA, 23 bp, Homo sapiens
gaaggcatttgcagggtcctctt

SEQ ID NO: 6193529 - DNA, 16 bp, Homo sapiens
gaaggccacctgcagg

SEQ ID NO: 6193530 - DNA, 17 bp, Homo sapiens
gaaggccacctgcaggt

SEQ ID NO: 6193531 - DNA, 15 bp, Homo sapiens
gaaggccacttgtgt

SEQ ID NO: 6193532 - DNA, 16 bp, Homo sapiens
gaaggccagaaaaggc

SEQ ID NO: 6193533 - DNA, 19 bp, Homo sapiens
gaaggccagaaaaggcagc

SEQ ID NO: 6193534 - DNA, 21 bp, Homo sapiens
gaaggccagaaaaggcagcca

SEQ ID NO: 6193535 - DNA, 21 bp, Homo sapiens
gaaggccagagagggaaaagg

SEQ ID NO: 6193536 - DNA, 12 bp, Homo sapiens
gaaggccagccc

SEQ ID NO: 6193537 - DNA, 21 bp, Homo sapiens
gaaggccagccctccctggct

SEQ ID NO: 6193538 - DNA, 22 bp, Homo sapiens
gaaggccagctgccccagccag

SEQ ID NO: 6193539 - DNA, 14 bp, Homo sapiens
gaaggccaggcctc

SEQ ID NO: 6193540 - DNA, 22 bp, Homo sapiens
gaaggccatcatctctgtaaac

SEQ ID NO: 6193541 - DNA, 19 bp, Homo sapiens
gaaggccatggggcagcct

SEQ ID NO: 6193542 - DNA, 23 bp, Homo sapiens
gaaggccatggggcagcctccag

SEQ ID NO: 6193543 - DNA, 23 bp, Homo sapiens
gaaggcccaagagcagagtctgg

SEQ ID NO: 6193544 - DNA, 22 bp, Homo sapiens
gaaggcccagcaccaccctcct

SEQ ID NO: 6193545 - DNA, 12 bp, Homo sapiens
gaaggcccatga

SEQ ID NO: 6193546 - DNA, 16 bp, Homo sapiens
gaaggccccagagaga

SEQ ID NO: 6193547 - DNA, 22 bp, Homo sapiens
gaaggccccagagagaccctgc

SEQ ID NO: 6193548 - DNA, 15 bp, Homo sapiens
gaaggccccgcccag

SEQ ID NO: 6193549 - DNA, 17 bp, Homo sapiens
gaaggccccgcccaggc

SEQ ID NO: 6193550 - DNA, 22 bp, Homo sapiens
gaaggcccctctgtggagcgcc

SEQ ID NO: 6193551 - DNA, 13 bp, Homo sapiens
gaaggccccttcc

SEQ ID NO: 6193552 - DNA, 17 bp, Homo sapiens
gaaggccccttccctgg

SEQ ID NO: 6193553 - DNA, 16 bp, Homo sapiens
gaaggcccgaggaggc

SEQ ID NO: 6193554 - DNA, 17 bp, Homo sapiens
gaaggcccgaggaggcc

SEQ ID NO: 6193555 - DNA, 21 bp, Homo sapiens
gaaggcccgaggaggccgact

SEQ ID NO: 6193556 - DNA, 16 bp, Homo sapiens
gaaggccctgtgccct

SEQ ID NO: 6193557 - DNA, 18 bp, Homo sapiens
gaaggccgagaagcaaga

SEQ ID NO: 6193558 - DNA, 21 bp, Homo sapiens
gaaggccgctgccccagcccc

SEQ ID NO: 6193559 - DNA, 17 bp, Homo sapiens
gaaggcctaggctagga

SEQ ID NO: 6193560 - DNA, 19 bp, Homo sapiens
gaaggcctcactcaagcct

SEQ ID NO: 6193561 - DNA, 14 bp, Homo sapiens
gaaggcctcccctg

SEQ ID NO: 6193562 - DNA, 20 bp, Homo sapiens
gaaggcctccctagccagca

SEQ ID NO: 6193563 - DNA, 18 bp, Homo sapiens
gaaggcctcgcaggaaga

SEQ ID NO: 6193564 - DNA, 18 bp, Homo sapiens
gaaggcctcttgtgctca

SEQ ID NO: 6193565 - DNA, 17 bp, Homo sapiens
gaaggcctgagggaagc

SEQ ID NO: 6193566 - DNA, 16 bp, Homo sapiens
gaaggcctgcccccct

SEQ ID NO: 6193567 - DNA, 18 bp, Homo sapiens
gaaggcctgccccccttc

SEQ ID NO: 6193568 - DNA, 22 bp, Homo sapiens
gaaggcctggctggaagagggt

SEQ ID NO: 6193569 - DNA, 15 bp, Homo sapiens
gaaggcctggtcagc

SEQ ID NO: 6193570 - DNA, 19 bp, Homo sapiens
gaaggccttacagaaaatt

SEQ ID NO: 6193571 - DNA, 18 bp, Homo sapiens
gaaggcgctgggtgcctg

SEQ ID NO: 6193572 - DNA, 14 bp, Homo sapiens
gaaggcggcaggca

SEQ ID NO: 6193573 - DNA, 17 bp, Homo sapiens
gaaggcggcaggcagag

SEQ ID NO: 6193574 - DNA, 18 bp, Homo sapiens
gaaggcggcaggcagaga

SEQ ID NO: 6193575 - DNA, 20 bp, Homo sapiens
gaaggcggcaggcagagaag

SEQ ID NO: 6193576 - DNA, 15 bp, Homo sapiens
gaaggcgggctgagg

SEQ ID NO: 6193577 - DNA, 13 bp, Homo sapiens
gaaggcgtgcaag

SEQ ID NO: 6193578 - DNA, 21 bp, Homo sapiens
gaaggcgtgcaaggggctcag

SEQ ID NO: 6193579 - DNA, 16 bp, Homo sapiens
gaaggcgtgggggaca

SEQ ID NO: 6193580 - DNA, 22 bp, Homo sapiens
gaaggctaaagaagacacacag

SEQ ID NO: 6193581 - DNA, 20 bp, Homo sapiens
gaaggctaagcatggcctgg

SEQ ID NO: 6193582 - DNA, 17 bp, Homo sapiens
gaaggctactggcatta

SEQ ID NO: 6193583 - DNA, 15 bp, Homo sapiens
gaaggctatggggat

SEQ ID NO: 6193584 - DNA, 21 bp, Homo sapiens
gaaggctcatttacttgaaat

SEQ ID NO: 6193585 - DNA, 18 bp, Homo sapiens
gaaggctctatctgctgg

SEQ ID NO: 6193586 - DNA, 20 bp, Homo sapiens
gaaggctctcgggtggggga

SEQ ID NO: 6193587 - DNA, 22 bp, Homo sapiens
gaaggctgaactcttcagaaca

SEQ ID NO: 6193588 - DNA, 13 bp, Homo sapiens
gaaggctgccaac

SEQ ID NO: 6193589 - DNA, 13 bp, Homo sapiens
gaaggctgcccct

SEQ ID NO: 6193590 - DNA, 19 bp, Homo sapiens
gaaggctgcctaaggagga

SEQ ID NO: 6193591 - DNA, 13 bp, Homo sapiens
gaaggctgctgtg

SEQ ID NO: 6193592 - DNA, 15 bp, Homo sapiens
gaaggctggagaagg

SEQ ID NO: 6193593 - DNA, 14 bp, Homo sapiens
gaaggctggcatga

SEQ ID NO: 6193594 - DNA, 18 bp, Homo sapiens
gaaggctggcatgatcca

SEQ ID NO: 6193595 - DNA, 15 bp, Homo sapiens
gaaggctggctgagt

SEQ ID NO: 6193596 - DNA, 13 bp, Homo sapiens
gaaggctggctgg

SEQ ID NO: 6193597 - DNA, 14 bp, Homo sapiens
gaaggctggggcca

SEQ ID NO: 6193598 - DNA, 15 bp, Homo sapiens
gaaggctggggccag

SEQ ID NO: 6193599 - DNA, 16 bp, Homo sapiens
gaaggctggggccagt

SEQ ID NO: 6193600 - DNA, 16 bp, Homo sapiens
gaaggcttaagaactg

SEQ ID NO: 6193601 - DNA, 23 bp, Homo sapiens
gaaggcttaattgactgaaatta

SEQ ID NO: 6193602 - DNA, 13 bp, Homo sapiens
gaaggcttcactc

SEQ ID NO: 6193603 - DNA, 16 bp, Homo sapiens
gaaggcttcctccagc

SEQ ID NO: 6193604 - DNA, 13 bp, Homo sapiens
gaaggcttctctc

SEQ ID NO: 6193605 - DNA, 23 bp, Homo sapiens
gaaggcttctctccacagtgttg

SEQ ID NO: 6193606 - DNA, 15 bp, Homo sapiens
gaaggcttgggattt

SEQ ID NO: 6193607 - DNA, 24 bp, Homo sapiens
gaaggctttcagggcctccagccc

SEQ ID NO: 6193608 - DNA, 18 bp, Homo sapiens
gaagggaaagcgggcagc

SEQ ID NO: 6193609 - DNA, 20 bp, Homo sapiens
gaagggaaagcgggcagccc

SEQ ID NO: 6193610 - DNA, 16 bp, Homo sapiens
gaagggaaatcaattt

SEQ ID NO: 6193611 - DNA, 23 bp, Homo sapiens
gaagggaaattgtttatgtgtta

SEQ ID NO: 6193612 - DNA, 17 bp, Homo sapiens
gaagggaacagcctgag

SEQ ID NO: 6193613 - DNA, 15 bp, Homo sapiens
gaagggaaccagccc

SEQ ID NO: 6193614 - DNA, 16 bp, Homo sapiens
gaagggaaccagccct

SEQ ID NO: 6193615 - DNA, 22 bp, Homo sapiens
gaagggaaccagccctccagag

SEQ ID NO: 6193616 - DNA, 18 bp, Homo sapiens
gaagggaagaaggggcca

SEQ ID NO: 6193617 - DNA, 20 bp, Homo sapiens
gaagggaagaaggggccatc

SEQ ID NO: 6193618 - DNA, 12 bp, Homo sapiens
gaagggaagcct

SEQ ID NO: 6193619 - DNA, 23 bp, Homo sapiens
gaagggaagcgtatatacttaag

SEQ ID NO: 6193620 - DNA, 18 bp, Homo sapiens
gaagggaattgtttttat

SEQ ID NO: 6193621 - DNA, 14 bp, Homo sapiens
gaagggacagctgc

SEQ ID NO: 6193622 - DNA, 15 bp, Homo sapiens
gaagggaccaaggca

SEQ ID NO: 6193623 - DNA, 16 bp, Homo sapiens
gaagggacggctgtgg

SEQ ID NO: 6193624 - DNA, 14 bp, Homo sapiens
gaagggactggtcc

SEQ ID NO: 6193625 - DNA, 15 bp, Homo sapiens
gaagggactggtcca

SEQ ID NO: 6193626 - DNA, 16 bp, Homo sapiens
gaagggactggtccag

SEQ ID NO: 6193627 - DNA, 18 bp, Homo sapiens
gaagggactggtccaggc

SEQ ID NO: 6193628 - DNA, 15 bp, Homo sapiens
gaagggacttttatt

SEQ ID NO: 6193629 - DNA, 23 bp, Homo sapiens
gaagggagaagacactgcagtga

SEQ ID NO: 6193630 - DNA, 21 bp, Homo sapiens
gaagggagaaggatctagaat

SEQ ID NO: 6193631 - DNA, 13 bp, Homo sapiens
gaagggagagggc

SEQ ID NO: 6193632 - DNA, 18 bp, Homo sapiens
gaagggagagggcctctg

SEQ ID NO: 6193633 - DNA, 23 bp, Homo sapiens
gaagggagagggcctctgcctgg

SEQ ID NO: 6193634 - DNA, 23 bp, Homo sapiens
gaagggagagttctttgctgccc

SEQ ID NO: 6193635 - DNA, 16 bp, Homo sapiens
gaagggagcagcacac

SEQ ID NO: 6193636 - DNA, 12 bp, Homo sapiens
gaagggagccaa

SEQ ID NO: 6193637 - DNA, 22 bp, Homo sapiens
gaagggagccaagggatggaca

SEQ ID NO: 6193638 - DNA, 16 bp, Homo sapiens
gaagggaggcctgagg

SEQ ID NO: 6193639 - DNA, 15 bp, Homo sapiens
gaagggagggcagag

SEQ ID NO: 6193640 - DNA, 15 bp, Homo sapiens
gaagggaggggaagg

SEQ ID NO: 6193641 - DNA, 17 bp, Homo sapiens
gaagggaggggaagggg

SEQ ID NO: 6193642 - DNA, 17 bp, Homo sapiens
gaagggagggggctggc

SEQ ID NO: 6193643 - DNA, 13 bp, Homo sapiens
gaagggagggtgg

SEQ ID NO: 6193644 - DNA, 18 bp, Homo sapiens
gaagggagggtggccagc

SEQ ID NO: 6193645 - DNA, 15 bp, Homo sapiens
gaagggataatttat

SEQ ID NO: 6193646 - DNA, 18 bp, Homo sapiens
gaagggatatgtgaaaca

SEQ ID NO: 6193647 - DNA, 15 bp, Homo sapiens
gaagggatccctaac

SEQ ID NO: 6193648 - DNA, 12 bp, Homo sapiens
gaagggatgggg

SEQ ID NO: 6193649 - DNA, 15 bp, Homo sapiens
gaagggatgggggaa

SEQ ID NO: 6193650 - DNA, 14 bp, Homo sapiens
gaagggcaagaaat

SEQ ID NO: 6193651 - DNA, 13 bp, Homo sapiens
gaagggcaagttt

SEQ ID NO: 6193652 - DNA, 11 bp, Homo sapiens
gaagggcaccg

SEQ ID NO: 6193653 - DNA, 15 bp, Homo sapiens
gaagggcaccgagaa

SEQ ID NO: 6193654 - DNA, 17 bp, Homo sapiens
gaagggcactatatttt

SEQ ID NO: 6193655 - DNA, 13 bp, Homo sapiens
gaagggcagcccc

SEQ ID NO: 6193656 - DNA, 12 bp, Homo sapiens
gaagggcaggag

SEQ ID NO: 6193657 - DNA, 11 bp, Homo sapiens
gaagggcaggc

SEQ ID NO: 6193658 - DNA, 21 bp, Homo sapiens
gaagggcataaaacagctttg

SEQ ID NO: 6193659 - DNA, 18 bp, Homo sapiens
gaagggcatcatgcatct

SEQ ID NO: 6193660 - DNA, 17 bp, Homo sapiens
gaagggcatgcacgggc

SEQ ID NO: 6193661 - DNA, 14 bp, Homo sapiens
gaagggccaccctg

SEQ ID NO: 6193662 - DNA, 17 bp, Homo sapiens
gaagggccaccctgctg

SEQ ID NO: 6193663 - DNA, 18 bp, Homo sapiens
gaagggccaccctgctgc

SEQ ID NO: 6193664 - DNA, 10 bp, Homo sapiens
gaagggccag

SEQ ID NO: 6193665 - DNA, 18 bp, Homo sapiens
gaagggccagagccaggg

SEQ ID NO: 6193666 - DNA, 15 bp, Homo sapiens
cttataaaacagagt

SEQ ID NO: 6193667 - DNA, 20 bp, Homo sapiens
cttataaaacagagtaatct

SEQ ID NO: 6193668 - DNA, 18 bp, Homo sapiens
cttataaaatcctgtgca

SEQ ID NO: 6193669 - DNA, 15 bp, Homo sapiens
cttataaacaaatga

SEQ ID NO: 6193670 - DNA, 17 bp, Homo sapiens
cttataaacagataatg

SEQ ID NO: 6193671 - DNA, 23 bp, Homo sapiens
cttataaacatttaaagacaaag

SEQ ID NO: 6193672 - DNA, 17 bp, Homo sapiens
cttataaaccaatctta

SEQ ID NO: 6193673 - DNA, 20 bp, Homo sapiens
cttataaaccttgtcaataa

SEQ ID NO: 6193674 - DNA, 22 bp, Homo sapiens
cttataaactatttttttctta

SEQ ID NO: 6193675 - DNA, 19 bp, Homo sapiens
cttataaagtggacttctg

SEQ ID NO: 6193676 - DNA, 12 bp, Homo sapiens
cttataaatatg

SEQ ID NO: 6193677 - DNA, 21 bp, Homo sapiens
cttataaatcatattgatgaa

SEQ ID NO: 6193678 - DNA, 22 bp, Homo sapiens
cttataaatcatattgatgaaa

SEQ ID NO: 6193679 - DNA, 16 bp, Homo sapiens
cttataaatgtgtatt

SEQ ID NO: 6193680 - DNA, 23 bp, Homo sapiens
cttataaatgtgtattctggctg

SEQ ID NO: 6193681 - DNA, 23 bp, Homo sapiens
cttataaattctgttagctgctc

SEQ ID NO: 6193682 - DNA, 21 bp, Homo sapiens
cttataacctagttaaagaaa

SEQ ID NO: 6193683 - DNA, 22 bp, Homo sapiens
cttataacctagttaaagaaag

SEQ ID NO: 6193684 - DNA, 13 bp, Homo sapiens
cttataactgttt

SEQ ID NO: 6193685 - DNA, 17 bp, Homo sapiens
cttataactgttttaga

SEQ ID NO: 6193686 - DNA, 22 bp, Homo sapiens
cttataacttgtaagtctgatt

SEQ ID NO: 6193687 - DNA, 19 bp, Homo sapiens
cttataagaaaacatgtaa

SEQ ID NO: 6193688 - DNA, 22 bp, Homo sapiens
cttataagaagaagagaggcat

SEQ ID NO: 6193689 - DNA, 12 bp, Homo sapiens
cttataagaatt

SEQ ID NO: 6193690 - DNA, 16 bp, Homo sapiens
cttataagaattaatc

SEQ ID NO: 6193691 - DNA, 15 bp, Homo sapiens
cttataagcaacatg

SEQ ID NO: 6193692 - DNA, 20 bp, Homo sapiens
cttataataaaggactgtaa

SEQ ID NO: 6193693 - DNA, 23 bp, Homo sapiens
cttataatgtgtgttgtgtgagc

SEQ ID NO: 6193694 - DNA, 19 bp, Homo sapiens
cttataattacaatgcaca

SEQ ID NO: 6193695 - DNA, 13 bp, Homo sapiens
cttataatttaaa

SEQ ID NO: 6193696 - DNA, 13 bp, Homo sapiens
cttataatttcca

SEQ ID NO: 6193697 - DNA, 22 bp, Homo sapiens
cttatacaacagcaaaccctga

SEQ ID NO: 6193698 - DNA, 12 bp, Homo sapiens
cttatacacatt

SEQ ID NO: 6193699 - DNA, 17 bp, Homo sapiens
cttatacatcacttcct

SEQ ID NO: 6193700 - DNA, 21 bp, Homo sapiens
cttatacatcacttcctgttt

SEQ ID NO: 6193701 - DNA, 13 bp, Homo sapiens
cttataccaaagg

SEQ ID NO: 6193702 - DNA, 17 bp, Homo sapiens
cttataccaaagggaaa

SEQ ID NO: 6193703 - DNA, 15 bp, Homo sapiens
cttatacctctctca

SEQ ID NO: 6193704 - DNA, 14 bp, Homo sapiens
cttataccttctga

SEQ ID NO: 6193705 - DNA, 16 bp, Homo sapiens
cttatacgagtaatat

SEQ ID NO: 6193706 - DNA, 14 bp, Homo sapiens
cttatactgaaaaa

SEQ ID NO: 6193707 - DNA, 15 bp, Homo sapiens
cttatactgtacaat

SEQ ID NO: 6193708 - DNA, 19 bp, Homo sapiens
cttatagaagcttcagcag

SEQ ID NO: 6193709 - DNA, 13 bp, Homo sapiens
cttatagaataaa

SEQ ID NO: 6193710 - DNA, 16 bp, Homo sapiens
cttatagaataaaagc

SEQ ID NO: 6193711 - DNA, 13 bp, Homo sapiens
cttatagaatatt

SEQ ID NO: 6193712 - DNA, 15 bp, Homo sapiens
cttatagaatattta

SEQ ID NO: 6193713 - DNA, 14 bp, Homo sapiens
cttatagacaacat

SEQ ID NO: 6193714 - DNA, 19 bp, Homo sapiens
cttatagacacttgctccc

SEQ ID NO: 6193715 - DNA, 14 bp, Homo sapiens
cttatagagcacaa

SEQ ID NO: 6193716 - DNA, 15 bp, Homo sapiens
cttatagcactttga

SEQ ID NO: 6193717 - DNA, 17 bp, Homo sapiens
cttataggcctgtccct

SEQ ID NO: 6193718 - DNA, 18 bp, Homo sapiens
cttataggcctgtccctt

SEQ ID NO: 6193719 - DNA, 21 bp, Homo sapiens
cttataggtaacgtgattgat

SEQ ID NO: 6193720 - DNA, 19 bp, Homo sapiens
cttatagttaatattttgt

SEQ ID NO: 6193721 - DNA, 14 bp, Homo sapiens
cttatagttactgt

SEQ ID NO: 6193722 - DNA, 17 bp, Homo sapiens
cttatagtttgggcttc

SEQ ID NO: 6193723 - DNA, 20 bp, Homo sapiens
cttatagtttgggcttcagc

SEQ ID NO: 6193724 - DNA, 23 bp, Homo sapiens
cttatatacaatgcttctttcct

SEQ ID NO: 6193725 - DNA, 21 bp, Homo sapiens
cttatatagcagcaaaaatat

SEQ ID NO: 6193726 - DNA, 18 bp, Homo sapiens
cttatatagtattcattt

SEQ ID NO: 6193727 - DNA, 19 bp, Homo sapiens
cttatatagtttactattt

SEQ ID NO: 6193728 - DNA, 22 bp, Homo sapiens
cttatatatgcacttaatttgt

SEQ ID NO: 6193729 - DNA, 14 bp, Homo sapiens
cttatatatgtgaa

SEQ ID NO: 6193730 - DNA, 15 bp, Homo sapiens
cttatatatttgaaa

SEQ ID NO: 6193731 - DNA, 20 bp, Homo sapiens
cttatatatttgatacatat

SEQ ID NO: 6193732 - DNA, 14 bp, Homo sapiens
cttatatctgaaga

SEQ ID NO: 6193733 - DNA, 14 bp, Homo sapiens
cttatatgcaggct

SEQ ID NO: 6193734 - DNA, 13 bp, Homo sapiens
cttatatgccaag

SEQ ID NO: 6193735 - DNA, 14 bp, Homo sapiens
cttatatgtacttt

SEQ ID NO: 6193736 - DNA, 20 bp, Homo sapiens
cttatattaatagtaatttg

SEQ ID NO: 6193737 - DNA, 16 bp, Homo sapiens
cttatattattttctg

SEQ ID NO: 6193738 - DNA, 18 bp, Homo sapiens
cttatattattttctgta

SEQ ID NO: 6193739 - DNA, 21 bp, Homo sapiens
cttatattcaaccatggactt

SEQ ID NO: 6193740 - DNA, 23 bp, Homo sapiens
cttatattcatctattttctcag

SEQ ID NO: 6193741 - DNA, 14 bp, Homo sapiens
cttatattggtttg

SEQ ID NO: 6193742 - DNA, 18 bp, Homo sapiens
cttatattggtttgcaca

SEQ ID NO: 6193743 - DNA, 20 bp, Homo sapiens
cttatattggtttgcacaag

SEQ ID NO: 6193744 - DNA, 18 bp, Homo sapiens
cttatattggtttttcca

SEQ ID NO: 6193745 - DNA, 17 bp, Homo sapiens
cttatattgtaagaaat

SEQ ID NO: 6193746 - DNA, 20 bp, Homo sapiens
cttatatttacaacacttta

SEQ ID NO: 6193747 - DNA, 14 bp, Homo sapiens
cttatatttacaat

SEQ ID NO: 6193748 - DNA, 20 bp, Homo sapiens
cttatatttgacattcttca

SEQ ID NO: 6193749 - DNA, 20 bp, Homo sapiens
cttatattttataatcagaa

SEQ ID NO: 6193750 - DNA, 20 bp, Homo sapiens
cttatattttcagcaaagaa

SEQ ID NO: 6193751 - DNA, 15 bp, Homo sapiens
cttatattttcgtat

SEQ ID NO: 6193752 - DNA, 20 bp, Homo sapiens
cttatattttcgtatgaaaa

SEQ ID NO: 6193753 - DNA, 15 bp, Homo sapiens
cttatattttgattt

SEQ ID NO: 6193754 - DNA, 19 bp, Homo sapiens
cttatattttgattttaca

SEQ ID NO: 6193755 - DNA, 19 bp, Homo sapiens
cttatatttttaataaaag

SEQ ID NO: 6193756 - DNA, 13 bp, Homo sapiens
cttatcaaatcat

SEQ ID NO: 6193757 - DNA, 14 bp, Homo sapiens
cttatcaaatcatt

SEQ ID NO: 6193758 - DNA, 15 bp, Homo sapiens
cttatcaattgcaaa

SEQ ID NO: 6193759 - DNA, 23 bp, Homo sapiens
cttatcacaaaaaagaaaatgaa

SEQ ID NO: 6193760 - DNA, 15 bp, Homo sapiens
cttatcacacttgca

SEQ ID NO: 6193761 - DNA, 22 bp, Homo sapiens
cttatcaccacagtaagttcct

SEQ ID NO: 6193762 - DNA, 23 bp, Homo sapiens
cttatcaccacagtaagttccta

SEQ ID NO: 6193763 - DNA, 22 bp, Homo sapiens
cttatcaccagctgcctcttct

SEQ ID NO: 6193764 - DNA, 21 bp, Homo sapiens
cttatcacccccttgttgtaa

SEQ ID NO: 6193765 - DNA, 18 bp, Homo sapiens
cttatcactgacacaaaa

SEQ ID NO: 6193766 - DNA, 22 bp, Homo sapiens
cttatcactggcgcagacttca

SEQ ID NO: 6193767 - DNA, 12 bp, Homo sapiens
cttatcagagct

SEQ ID NO: 6193768 - DNA, 12 bp, Homo sapiens
cttatcagaggc

SEQ ID NO: 6193769 - DNA, 21 bp, Homo sapiens
cttatcagcagcaacaactgt

SEQ ID NO: 6193770 - DNA, 12 bp, Homo sapiens
cttatcatcagc

SEQ ID NO: 6193771 - DNA, 15 bp, Homo sapiens
cttatcatggtctca

SEQ ID NO: 6193772 - DNA, 21 bp, Homo sapiens
cttatcatttttgtataaaaa

SEQ ID NO: 6193773 - DNA, 20 bp, Homo sapiens
cttatccacgagagcgcagc

SEQ ID NO: 6193774 - DNA, 20 bp, Homo sapiens
cttatcccccccagcctggc

SEQ ID NO: 6193775 - DNA, 15 bp, Homo sapiens
cttatccctgcccat

SEQ ID NO: 6193776 - DNA, 22 bp, Homo sapiens
cttatccctgcccatttcatat

SEQ ID NO: 6193777 - DNA, 16 bp, Homo sapiens
cttatcccttcttttt

SEQ ID NO: 6193778 - DNA, 17 bp, Homo sapiens
cttatcccttctttttc

SEQ ID NO: 6193779 - DNA, 21 bp, Homo sapiens
cttatcctaaaacaaatagtt

SEQ ID NO: 6193780 - DNA, 20 bp, Homo sapiens
cttatcctacagtacaatca

SEQ ID NO: 6193781 - DNA, 21 bp, Homo sapiens
cttatcctagcacatgcttca

SEQ ID NO: 6193782 - DNA, 14 bp, Homo sapiens
cttatcctagcctt

SEQ ID NO: 6193783 - DNA, 18 bp, Homo sapiens
cttatcctagcctttggg

SEQ ID NO: 6193784 - DNA, 12 bp, Homo sapiens
cttatcctccct

SEQ ID NO: 6193785 - DNA, 14 bp, Homo sapiens
cttatcctccctgt

SEQ ID NO: 6193786 - DNA, 16 bp, Homo sapiens
cttatcctccctgtaa

SEQ ID NO: 6193787 - DNA, 20 bp, Homo sapiens
cttatcctctctctcttcta

SEQ ID NO: 6193788 - DNA, 15 bp, Homo sapiens
cttatccttaatatt

SEQ ID NO: 6193789 - DNA, 22 bp, Homo sapiens
cttatccttgggccataattat

SEQ ID NO: 6193790 - DNA, 20 bp, Homo sapiens
cttatctagctgcatatctt

SEQ ID NO: 6193791 - DNA, 20 bp, Homo sapiens
cttatctcagatatttgcac

SEQ ID NO: 6193792 - DNA, 20 bp, Homo sapiens
cttatctcagtcatgcataa

SEQ ID NO: 6193793 - DNA, 21 bp, Homo sapiens
cttatctcagtcatgcataaa

SEQ ID NO: 6193794 - DNA, 23 bp, Homo sapiens
cttatctcagtcatgcataaata

SEQ ID NO: 6193795 - DNA, 16 bp, Homo sapiens
cttatctcatttctca

SEQ ID NO: 6193796 - DNA, 18 bp, Homo sapiens
cttatctccacaacctct

SEQ ID NO: 6193797 - DNA, 14 bp, Homo sapiens
cttatctccagcca

SEQ ID NO: 6193798 - DNA, 16 bp, Homo sapiens
cttatctccctgcttc

SEQ ID NO: 6193799 - DNA, 22 bp, Homo sapiens
cttatctccctgcttcatatct

SEQ ID NO: 6193800 - DNA, 21 bp, Homo sapiens
cttatctcgaatttgaagaga

SEQ ID NO: 6193801 - DNA, 17 bp, Homo sapiens
cttatctctagctcaga

SEQ ID NO: 6193802 - DNA, 14 bp, Homo sapiens
cttatctcttctca

SEQ ID NO: 6193803 - DNA, 14 bp, Homo sapiens
cttatctctttcca

SEQ ID NO: 6193804 - DNA, 12 bp, Homo sapiens
cttatctctttt

SEQ ID NO: 6193805 - DNA, 16 bp, Homo sapiens
cttatctgaaacttcc

SEQ ID NO: 6193806 - DNA, 18 bp, Homo sapiens
cttatctgatcttcctca

SEQ ID NO: 6193807 - DNA, 15 bp, Homo sapiens
cttatctgcccctcc

SEQ ID NO: 6193808 - DNA, 16 bp, Homo sapiens
cttatctgctaactct

SEQ ID NO: 6193809 - DNA, 17 bp, Homo sapiens
cttatctgtgcgtgaaa

SEQ ID NO: 6193810 - DNA, 16 bp, Homo sapiens
cttatcttacaaagtg

SEQ ID NO: 6193811 - DNA, 20 bp, Homo sapiens
cttatcttacaactccccca

SEQ ID NO: 6193812 - DNA, 17 bp, Homo sapiens
cttatcttacgaaaaaa

SEQ ID NO: 6193813 - DNA, 13 bp, Homo sapiens
cttatcttctgga

SEQ ID NO: 6193814 - DNA, 15 bp, Homo sapiens
cttatcttctggatt

SEQ ID NO: 6193815 - DNA, 14 bp, Homo sapiens
cttatcttgtttca

SEQ ID NO: 6193816 - DNA, 17 bp, Homo sapiens
cttatctttattggctt

SEQ ID NO: 6193817 - DNA, 22 bp, Homo sapiens
cttatctttctaaaactgcctt

SEQ ID NO: 6193818 - DNA, 15 bp, Homo sapiens
cttatctttctttcc

SEQ ID NO: 6193819 - DNA, 22 bp, Homo sapiens
cttatgaaaacaccactgaaca

SEQ ID NO: 6193820 - DNA, 11 bp, Homo sapiens
cttatgaaaag

SEQ ID NO: 6193821 - DNA, 14 bp, Homo sapiens
cttatgaaaagaat

SEQ ID NO: 6193822 - DNA, 13 bp, Homo sapiens
cttatgaaaatta

SEQ ID NO: 6193823 - DNA, 21 bp, Homo sapiens
cttatgaaatctcacagatgt

SEQ ID NO: 6193824 - DNA, 15 bp, Homo sapiens
cttatgaacagatat

SEQ ID NO: 6193825 - DNA, 15 bp, Homo sapiens
cttatgaactacagt

SEQ ID NO: 6193826 - DNA, 18 bp, Homo sapiens
cttatgaatatttataac

SEQ ID NO: 6193827 - DNA, 12 bp, Homo sapiens
cttatgaatgtt

SEQ ID NO: 6193828 - DNA, 15 bp, Homo sapiens
cttatgaatgtttcc

SEQ ID NO: 6193829 - DNA, 18 bp, Homo sapiens
cttatgactaaattttct

SEQ ID NO: 6193830 - DNA, 15 bp, Homo sapiens
cttatgagaacatgg

SEQ ID NO: 6193831 - DNA, 19 bp, Homo sapiens
cttatgagactcttaaata

SEQ ID NO: 6193832 - DNA, 18 bp, Homo sapiens
cttatgagcgtcactgcc

SEQ ID NO: 6193833 - DNA, 16 bp, Homo sapiens
cttatgagctcagcct

SEQ ID NO: 6193834 - DNA, 23 bp, Homo sapiens
cttatgatagcaaatggcctcat

SEQ ID NO: 6193835 - DNA, 20 bp, Homo sapiens
cttatgatgagccatattaa

SEQ ID NO: 6193836 - DNA, 22 bp, Homo sapiens
cttatgatgttttcccttaact

SEQ ID NO: 6193837 - DNA, 21 bp, Homo sapiens
cttatgattaaacttccttct

SEQ ID NO: 6193838 - DNA, 23 bp, Homo sapiens
cttatgattcagattgttatcta

SEQ ID NO: 6193839 - DNA, 15 bp, Homo sapiens
cttatgattgcagat

SEQ ID NO: 6193840 - DNA, 19 bp, Homo sapiens
cttatgattttattacaga

SEQ ID NO: 6193841 - DNA, 14 bp, Homo sapiens
cttatgcaaaatgg

SEQ ID NO: 6193842 - DNA, 23 bp, Homo sapiens
cttatgccacccccgctggagga

SEQ ID NO: 6193843 - DNA, 15 bp, Homo sapiens
cttatgccatttgtt

SEQ ID NO: 6193844 - DNA, 18 bp, Homo sapiens
gaagggccagagcctggt

SEQ ID NO: 6193845 - DNA, 14 bp, Homo sapiens
gaagggccagccct

SEQ ID NO: 6193846 - DNA, 14 bp, Homo sapiens
gaagggccaggaga

SEQ ID NO: 6193847 - DNA, 11 bp, Homo sapiens
gaagggccagt

SEQ ID NO: 6193848 - DNA, 14 bp, Homo sapiens
gaagggccagtcct

SEQ ID NO: 6193849 - DNA, 19 bp, Homo sapiens
gaagggccagtctgggctg

SEQ ID NO: 6193850 - DNA, 20 bp, Homo sapiens
gaagggccagtctgggctgc

SEQ ID NO: 6193851 - DNA, 15 bp, Homo sapiens
gaagggcccccggct

SEQ ID NO: 6193852 - DNA, 16 bp, Homo sapiens
gaagggccggcttctg

SEQ ID NO: 6193853 - DNA, 14 bp, Homo sapiens
gaagggcctgctct

SEQ ID NO: 6193854 - DNA, 17 bp, Homo sapiens
gaagggcctgctctgct

SEQ ID NO: 6193855 - DNA, 18 bp, Homo sapiens
gaagggccttgagcatct

SEQ ID NO: 6193856 - DNA, 20 bp, Homo sapiens
gaagggccttgagcatctgg

SEQ ID NO: 6193857 - DNA, 19 bp, Homo sapiens
gaagggcgctgagggcagg

SEQ ID NO: 6193858 - DNA, 16 bp, Homo sapiens
gaagggcgttctaggt

SEQ ID NO: 6193859 - DNA, 22 bp, Homo sapiens
gaagggctgcttccctgaagct

SEQ ID NO: 6193860 - DNA, 13 bp, Homo sapiens
gaagggctgggcc

SEQ ID NO: 6193861 - DNA, 14 bp, Homo sapiens
gaagggctgggcca

SEQ ID NO: 6193862 - DNA, 21 bp, Homo sapiens
gaagggctttggttccttctc

SEQ ID NO: 6193863 - DNA, 15 bp, Homo sapiens
gaaggggaaaaatgg

SEQ ID NO: 6193864 - DNA, 17 bp, Homo sapiens
gaaggggaacacagacc

SEQ ID NO: 6193865 - DNA, 16 bp, Homo sapiens
gaaggggacccccgcc

SEQ ID NO: 6193866 - DNA, 20 bp, Homo sapiens
gaaggggacccccgccccct

SEQ ID NO: 6193867 - DNA, 15 bp, Homo sapiens
gaaggggactgccac

SEQ ID NO: 6193868 - DNA, 19 bp, Homo sapiens
gaaggggactgccacctcc

SEQ ID NO: 6193869 - DNA, 13 bp, Homo sapiens
gaaggggaggaag

SEQ ID NO: 6193870 - DNA, 17 bp, Homo sapiens
gaaggggaggagggcgg

SEQ ID NO: 6193871 - DNA, 14 bp, Homo sapiens
gaaggggaggcaca

SEQ ID NO: 6193872 - DNA, 23 bp, Homo sapiens
gaaggggagggtgttcagaggca

SEQ ID NO: 6193873 - DNA, 16 bp, Homo sapiens
gaaggggatgggaaat

SEQ ID NO: 6193874 - DNA, 11 bp, Homo sapiens
gaaggggcagc

SEQ ID NO: 6193875 - DNA, 13 bp, Homo sapiens
gaaggggcagccc

SEQ ID NO: 6193876 - DNA, 16 bp, Homo sapiens
gaaggggcagccctga

SEQ ID NO: 6193877 - DNA, 17 bp, Homo sapiens
gaaggggcagccctgag

SEQ ID NO: 6193878 - DNA, 16 bp, Homo sapiens
gaaggggccagaggct

SEQ ID NO: 6193879 - DNA, 13 bp, Homo sapiens
gaaggggccatca

SEQ ID NO: 6193880 - DNA, 22 bp, Homo sapiens
gaaggggccatcacaggatgcc

SEQ ID NO: 6193881 - DNA, 20 bp, Homo sapiens
gaaggggcccaagagagaca

SEQ ID NO: 6193882 - DNA, 23 bp, Homo sapiens
gaaggggccccatggcagctcct

SEQ ID NO: 6193883 - DNA, 14 bp, Homo sapiens
gaaggggccccggg

SEQ ID NO: 6193884 - DNA, 21 bp, Homo sapiens
gaaggggccccggggctggca

SEQ ID NO: 6193885 - DNA, 22 bp, Homo sapiens
gaaggggccccggggctggcaa

SEQ ID NO: 6193886 - DNA, 20 bp, Homo sapiens
gaaggggccggggagggggc

SEQ ID NO: 6193887 - DNA, 15 bp, Homo sapiens
gaaggggcctgggct

SEQ ID NO: 6193888 - DNA, 13 bp, Homo sapiens
gaaggggcggccc

SEQ ID NO: 6193889 - DNA, 23 bp, Homo sapiens
gaaggggcggggttagagccaag

SEQ ID NO: 6193890 - DNA, 21 bp, Homo sapiens
gaaggggcgtctgttccccct

SEQ ID NO: 6193891 - DNA, 15 bp, Homo sapiens
gaaggggctgaggac

SEQ ID NO: 6193892 - DNA, 14 bp, Homo sapiens
gaaggggcttctaa

SEQ ID NO: 6193893 - DNA, 20 bp, Homo sapiens
gaaggggcttctaatgaccc

SEQ ID NO: 6193894 - DNA, 20 bp, Homo sapiens
gaagggggaaaaggtgggat

SEQ ID NO: 6193895 - DNA, 13 bp, Homo sapiens
gaagggggatatg

SEQ ID NO: 6193896 - DNA, 22 bp, Homo sapiens
gaagggggattggagggaagac

SEQ ID NO: 6193897 - DNA, 19 bp, Homo sapiens
gaagggggcatctggcctt

SEQ ID NO: 6193898 - DNA, 22 bp, Homo sapiens
gaagggggccacagcctgggtg

SEQ ID NO: 6193899 - DNA, 14 bp, Homo sapiens
gaagggggccatga

SEQ ID NO: 6193900 - DNA, 14 bp, Homo sapiens
gaagggggccctgc

SEQ ID NO: 6193901 - DNA, 14 bp, Homo sapiens
gaagggggcggcct

SEQ ID NO: 6193902 - DNA, 17 bp, Homo sapiens
gaagggggctctgcccc

SEQ ID NO: 6193903 - DNA, 15 bp, Homo sapiens
gaagggggctgggac

SEQ ID NO: 6193904 - DNA, 16 bp, Homo sapiens
gaagggggctgggaca

SEQ ID NO: 6193905 - DNA, 17 bp, Homo sapiens
gaagggggtcaaagcaa

SEQ ID NO: 6193906 - DNA, 15 bp, Homo sapiens
gaagggggtctctgt

SEQ ID NO: 6193907 - DNA, 13 bp, Homo sapiens
gaagggggtgaca

SEQ ID NO: 6193908 - DNA, 20 bp, Homo sapiens
gaagggggtgacagtcctcc

SEQ ID NO: 6193909 - DNA, 17 bp, Homo sapiens
gaagggggttgtggcaa

SEQ ID NO: 6193910 - DNA, 22 bp, Homo sapiens
gaaggggtaggattactaggtg

SEQ ID NO: 6193911 - DNA, 16 bp, Homo sapiens
gaaggggtcctgcagg

SEQ ID NO: 6193912 - DNA, 16 bp, Homo sapiens
gaaggggtgccctctg

SEQ ID NO: 6193913 - DNA, 14 bp, Homo sapiens
gaaggggtgggagc

SEQ ID NO: 6193914 - DNA, 17 bp, Homo sapiens
gaaggggttggattgca

SEQ ID NO: 6193915 - DNA, 17 bp, Homo sapiens
gaagggtaaacaatata

SEQ ID NO: 6193916 - DNA, 13 bp, Homo sapiens
gaagggtagctgg

SEQ ID NO: 6193917 - DNA, 19 bp, Homo sapiens
gaagggtccaccctagcct

SEQ ID NO: 6193918 - DNA, 19 bp, Homo sapiens
gaagggtctctctccaggt

SEQ ID NO: 6193919 - DNA, 22 bp, Homo sapiens
gaagggtctctctccaggtcag

SEQ ID NO: 6193920 - DNA, 16 bp, Homo sapiens
gaagggtctgtttaaa

SEQ ID NO: 6193921 - DNA, 17 bp, Homo sapiens
gaagggtgacatcccag

SEQ ID NO: 6193922 - DNA, 14 bp, Homo sapiens
gaagggtgcatagc

SEQ ID NO: 6193923 - DNA, 14 bp, Homo sapiens
gaagggtgcctggc

SEQ ID NO: 6193924 - DNA, 15 bp, Homo sapiens
gaagggtgcctggct

SEQ ID NO: 6193925 - DNA, 16 bp, Homo sapiens
gaagggtgcctggctg

SEQ ID NO: 6193926 - DNA, 23 bp, Homo sapiens
gaagggtgctcagtctccttggt

SEQ ID NO: 6193927 - DNA, 14 bp, Homo sapiens
gaagggtggatgtc

SEQ ID NO: 6193928 - DNA, 19 bp, Homo sapiens
gaagggtggatgtgctgga

SEQ ID NO: 6193929 - DNA, 22 bp, Homo sapiens
gaagggtggatgtgctggaggg

SEQ ID NO: 6193930 - DNA, 23 bp, Homo sapiens
gaagggtggatgtgctggagggg

SEQ ID NO: 6193931 - DNA, 17 bp, Homo sapiens
gaagggtggcctgttcc

SEQ ID NO: 6193932 - DNA, 23 bp, Homo sapiens
gaagggtggcctgttccctagag

SEQ ID NO: 6193933 - DNA, 18 bp, Homo sapiens
gaagggtgggagtggggc

SEQ ID NO: 6193934 - DNA, 11 bp, Homo sapiens
gaagggtgggg

SEQ ID NO: 6193935 - DNA, 12 bp, Homo sapiens
gaagggtgggga

SEQ ID NO: 6193936 - DNA, 12 bp, Homo sapiens
gaagggtggggt

SEQ ID NO: 6193937 - DNA, 19 bp, Homo sapiens
gaagggtggtctgagcacc

SEQ ID NO: 6193938 - DNA, 13 bp, Homo sapiens
gaagggtgtgtga

SEQ ID NO: 6193939 - DNA, 16 bp, Homo sapiens
gaagggttagacaagc

SEQ ID NO: 6193940 - DNA, 19 bp, Homo sapiens
gaagggttagacaagcctg

SEQ ID NO: 6193941 - DNA, 22 bp, Homo sapiens
gaagggttagacaagcctggag

SEQ ID NO: 6193942 - DNA, 16 bp, Homo sapiens
gaagggttctgccctg

SEQ ID NO: 6193943 - DNA, 15 bp, Homo sapiens
gaagggtttgtggct

SEQ ID NO: 6193944 - DNA, 21 bp, Homo sapiens
gaagggtttgtggctgggggc

SEQ ID NO: 6193945 - DNA, 18 bp, Homo sapiens
gaagggtttttagagaat

SEQ ID NO: 6193946 - DNA, 13 bp, Homo sapiens
gaaggtaaaaagt

SEQ ID NO: 6193947 - DNA, 21 bp, Homo sapiens
gaaggtaatactataaatata

SEQ ID NO: 6193948 - DNA, 15 bp, Homo sapiens
gaaggtagaatgttt

SEQ ID NO: 6193949 - DNA, 13 bp, Homo sapiens
gaaggtagcccag

SEQ ID NO: 6193950 - DNA, 19 bp, Homo sapiens
gaaggtagcccagcactgt

SEQ ID NO: 6193951 - DNA, 21 bp, Homo sapiens
gaaggtagcccagcactgtga

SEQ ID NO: 6193952 - DNA, 22 bp, Homo sapiens
gaaggtagcccagcactgtgaa

SEQ ID NO: 6193953 - DNA, 18 bp, Homo sapiens
gaaggtatacctgggaag

SEQ ID NO: 6193954 - DNA, 18 bp, Homo sapiens
gaaggtatatcaggaggg

SEQ ID NO: 6193955 - DNA, 14 bp, Homo sapiens
gaaggtattggcct

SEQ ID NO: 6193956 - DNA, 14 bp, Homo sapiens
gaaggtcaaggtca

SEQ ID NO: 6193957 - DNA, 13 bp, Homo sapiens
gaaggtcagcaaa

SEQ ID NO: 6193958 - DNA, 20 bp, Homo sapiens
gaaggtcagcaaagggtggg

SEQ ID NO: 6193959 - DNA, 16 bp, Homo sapiens
gaaggtcccacagccc

SEQ ID NO: 6193960 - DNA, 18 bp, Homo sapiens
gaaggtcccacagccctg

SEQ ID NO: 6193961 - DNA, 20 bp, Homo sapiens
gaaggtcccacagccctgag

SEQ ID NO: 6193962 - DNA, 22 bp, Homo sapiens
gaaggtcccacagccctgagat

SEQ ID NO: 6193963 - DNA, 16 bp, Homo sapiens
gaaggtcctagcttta

SEQ ID NO: 6193964 - DNA, 16 bp, Homo sapiens
gaaggtccttgcctga

SEQ ID NO: 6193965 - DNA, 15 bp, Homo sapiens
gaaggtcgcccttgc

SEQ ID NO: 6193966 - DNA, 19 bp, Homo sapiens
gaaggtctcatgcctgaga

SEQ ID NO: 6193967 - DNA, 13 bp, Homo sapiens
gaaggtctccaag

SEQ ID NO: 6193968 - DNA, 22 bp, Homo sapiens
gaaggtctccaagacaataatt

SEQ ID NO: 6193969 - DNA, 14 bp, Homo sapiens
gaaggtctccaagg

SEQ ID NO: 6193970 - DNA, 16 bp, Homo sapiens
gaaggtctgatttgca

SEQ ID NO: 6193971 - DNA, 19 bp, Homo sapiens
gaaggtctgatttgcagga

SEQ ID NO: 6193972 - DNA, 14 bp, Homo sapiens
gaaggtctgtggtg

SEQ ID NO: 6193973 - DNA, 13 bp, Homo sapiens
gaaggtcttgatt

SEQ ID NO: 6193974 - DNA, 19 bp, Homo sapiens
gaaggtctttgttatgaca

SEQ ID NO: 6193975 - DNA, 21 bp, Homo sapiens
gaaggtctttgttatgacagt

SEQ ID NO: 6193976 - DNA, 20 bp, Homo sapiens
gaaggtgaaacattttctcc

SEQ ID NO: 6193977 - DNA, 22 bp, Homo sapiens
gaaggtgaatagccatatttgt

SEQ ID NO: 6193978 - DNA, 21 bp, Homo sapiens
gaaggtgacactgctccctga

SEQ ID NO: 6193979 - DNA, 19 bp, Homo sapiens
gaaggtgataagggaaaag

SEQ ID NO: 6193980 - DNA, 14 bp, Homo sapiens
gaaggtgcagttga

SEQ ID NO: 6193981 - DNA, 18 bp, Homo sapiens
gaaggtgcatctttccct

SEQ ID NO: 6193982 - DNA, 15 bp, Homo sapiens
gaaggtgccagaagg

SEQ ID NO: 6193983 - DNA, 17 bp, Homo sapiens
gaaggtgccagaaggaa

SEQ ID NO: 6193984 - DNA, 13 bp, Homo sapiens
gaaggtgcccagg

SEQ ID NO: 6193985 - DNA, 16 bp, Homo sapiens
gaaggtgcccaggagc

SEQ ID NO: 6193986 - DNA, 20 bp, Homo sapiens
gaaggtgccgtgagcaggct

SEQ ID NO: 6193987 - DNA, 16 bp, Homo sapiens
gaaggtgcctcagact

SEQ ID NO: 6193988 - DNA, 21 bp, Homo sapiens
gaaggtgcctcagactccgcc

SEQ ID NO: 6193989 - DNA, 23 bp, Homo sapiens
gaaggtgcctctggatgctgtga

SEQ ID NO: 6193990 - DNA, 21 bp, Homo sapiens
gaaggtgcctgccatagccag

SEQ ID NO: 6193991 - DNA, 23 bp, Homo sapiens
gaaggtgcctgccatagccagga

SEQ ID NO: 6193992 - DNA, 18 bp, Homo sapiens
gaaggtgctgacggccag

SEQ ID NO: 6193993 - DNA, 19 bp, Homo sapiens
gaaggtgctgacggccagg

SEQ ID NO: 6193994 - DNA, 15 bp, Homo sapiens
gaaggtgctgccacc

SEQ ID NO: 6193995 - DNA, 16 bp, Homo sapiens
gaaggtgctgccaccc

SEQ ID NO: 6193996 - DNA, 17 bp, Homo sapiens
gaaggtgctggaggtgg

SEQ ID NO: 6193997 - DNA, 19 bp, Homo sapiens
gaaggtgctggaggtggga

SEQ ID NO: 6193998 - DNA, 23 bp, Homo sapiens
gaaggtgctggaggtgggagcag

SEQ ID NO: 6193999 - DNA, 20 bp, Homo sapiens
gaaggtggaagttgcagtga

SEQ ID NO: 6194000 - DNA, 17 bp, Homo sapiens
gaaggtggacctggcag

SEQ ID NO: 6194001 - DNA, 18 bp, Homo sapiens
gaaggtggcctctgtgga

SEQ ID NO: 6194002 - DNA, 22 bp, Homo sapiens
gaaggtggccttcctgctgtta

SEQ ID NO: 6194003 - DNA, 17 bp, Homo sapiens
gaaggtggggccctgcc

SEQ ID NO: 6194004 - DNA, 20 bp, Homo sapiens
gaaggtggggccctgcccct

SEQ ID NO: 6194005 - DNA, 19 bp, Homo sapiens
gaaggtggtctgcacccca

SEQ ID NO: 6194006 - DNA, 22 bp, Homo sapiens
gaaggtggtggcatttttgctt

SEQ ID NO: 6194007 - DNA, 23 bp, Homo sapiens
gaaggtggtgggggtgcagatga

SEQ ID NO: 6194008 - DNA, 15 bp, Homo sapiens
gaaggtgtcatttga

SEQ ID NO: 6194009 - DNA, 15 bp, Homo sapiens
gaaggtgtctctggt

SEQ ID NO: 6194010 - DNA, 23 bp, Homo sapiens
gaaggtgttgggtcagtggccag

SEQ ID NO: 6194011 - DNA, 14 bp, Homo sapiens
gaaggttaaaggaa

SEQ ID NO: 6194012 - DNA, 16 bp, Homo sapiens
gaaggttcccaaggac

SEQ ID NO: 6194013 - DNA, 20 bp, Homo sapiens
gaaggttctggtgtgaacta

SEQ ID NO: 6194014 - DNA, 20 bp, Homo sapiens
gaaggttggaactgctgcca

SEQ ID NO: 6194015 - DNA, 15 bp, Homo sapiens
gaaggttgtgatgaa

SEQ ID NO: 6194016 - DNA, 22 bp, Homo sapiens
gaaggtttattgttaatacaag

SEQ ID NO: 6194017 - DNA, 16 bp, Homo sapiens
gaaggtttgatgccaa

SEQ ID NO: 6194018 - DNA, 19 bp, Homo sapiens
gaaggtttgatgccaaagc

SEQ ID NO: 6194019 - DNA, 20 bp, Homo sapiens
gaaggtttgtgtttttctgc

SEQ ID NO: 6194020 - DNA, 23 bp, Homo sapiens
gaaggtttttaagggccggggat

SEQ ID NO: 6194021 - DNA, 14 bp, Homo sapiens
gaaggtttttgata

SEQ ID NO: 6194022 - DNA, 15 bp, Homo sapiens
cttatgctaaattaa

SEQ ID NO: 6194023 - DNA, 16 bp, Homo sapiens
cttatgctacacagac

SEQ ID NO: 6194024 - DNA, 21 bp, Homo sapiens
cttatgctacacagacattaa

SEQ ID NO: 6194025 - DNA, 16 bp, Homo sapiens
cttatgctcagaagcc

SEQ ID NO: 6194026 - DNA, 19 bp, Homo sapiens
cttatgctcagaagccagt

SEQ ID NO: 6194027 - DNA, 21 bp, Homo sapiens
cttatgctcagaagccagtct

SEQ ID NO: 6194028 - DNA, 22 bp, Homo sapiens
cttatgctcttaattgccacct

SEQ ID NO: 6194029 - DNA, 14 bp, Homo sapiens
cttatgcttaaatt

SEQ ID NO: 6194030 - DNA, 12 bp, Homo sapiens
cttatgcttcca

SEQ ID NO: 6194031 - DNA, 13 bp, Homo sapiens
cttatggaacact

SEQ ID NO: 6194032 - DNA, 20 bp, Homo sapiens
cttatggaacactctgagac

SEQ ID NO: 6194033 - DNA, 14 bp, Homo sapiens
cttatggaattgat

SEQ ID NO: 6194034 - DNA, 16 bp, Homo sapiens
cttatggaattgattt

SEQ ID NO: 6194035 - DNA, 21 bp, Homo sapiens
cttatggaattgatttgcatt

SEQ ID NO: 6194036 - DNA, 14 bp, Homo sapiens
cttatggactgttt

SEQ ID NO: 6194037 - DNA, 19 bp, Homo sapiens
cttatggactgttttgata

SEQ ID NO: 6194038 - DNA, 16 bp, Homo sapiens
cttatggagctcacac

SEQ ID NO: 6194039 - DNA, 22 bp, Homo sapiens
cttatggagtgtgcctctctct

SEQ ID NO: 6194040 - DNA, 15 bp, Homo sapiens
cttatggcatgactc

SEQ ID NO: 6194041 - DNA, 18 bp, Homo sapiens
cttatgggatccttgtct

SEQ ID NO: 6194042 - DNA, 23 bp, Homo sapiens
cttatgggctgggttctacccag

SEQ ID NO: 6194043 - DNA, 19 bp, Homo sapiens
cttatggtaccagatgcag

SEQ ID NO: 6194044 - DNA, 20 bp, Homo sapiens
cttatgtaaagtatgttttt

SEQ ID NO: 6194045 - DNA, 21 bp, Homo sapiens
cttatgtacttgatactgaat

SEQ ID NO: 6194046 - DNA, 15 bp, Homo sapiens
cttatgtagacaaaa

SEQ ID NO: 6194047 - DNA, 14 bp, Homo sapiens
cttatgtagagttt

SEQ ID NO: 6194048 - DNA, 17 bp, Homo sapiens
cttatgtagatatttgg

SEQ ID NO: 6194049 - DNA, 18 bp, Homo sapiens
cttatgtagatatttggc

SEQ ID NO: 6194050 - DNA, 19 bp, Homo sapiens
cttatgtatcagtgtcctt

SEQ ID NO: 6194051 - DNA, 18 bp, Homo sapiens
cttatgtccaccacttca

SEQ ID NO: 6194052 - DNA, 19 bp, Homo sapiens
cttatgtcctccaccacaa

SEQ ID NO: 6194053 - DNA, 14 bp, Homo sapiens
cttatgtcctgtca

SEQ ID NO: 6194054 - DNA, 15 bp, Homo sapiens
cttatgtctctgcct

SEQ ID NO: 6194055 - DNA, 16 bp, Homo sapiens
cttatgtctctgcctt

SEQ ID NO: 6194056 - DNA, 14 bp, Homo sapiens
cttatgtgaaaaat

SEQ ID NO: 6194057 - DNA, 16 bp, Homo sapiens
cttatgtgtgtaggag

SEQ ID NO: 6194058 - DNA, 14 bp, Homo sapiens
cttatgtgttacat

SEQ ID NO: 6194059 - DNA, 17 bp, Homo sapiens
cttatgttgaaaaaatt

SEQ ID NO: 6194060 - DNA, 21 bp, Homo sapiens
cttatgttgatcgatgttaaa

SEQ ID NO: 6194061 - DNA, 15 bp, Homo sapiens
cttattaaagtattc

SEQ ID NO: 6194062 - DNA, 17 bp, Homo sapiens
cttattaaagtttcaaa

SEQ ID NO: 6194063 - DNA, 18 bp, Homo sapiens
cttattaaagtttcaaaa

SEQ ID NO: 6194064 - DNA, 19 bp, Homo sapiens
cttattaaagtttcaaaaa

SEQ ID NO: 6194065 - DNA, 22 bp, Homo sapiens
cttattaaagtttcaaaaatct

SEQ ID NO: 6194066 - DNA, 18 bp, Homo sapiens
cttattaaggaaatactt

SEQ ID NO: 6194067 - DNA, 15 bp, Homo sapiens
cttattaatgctaag

SEQ ID NO: 6194068 - DNA, 13 bp, Homo sapiens
cttattacaattt

SEQ ID NO: 6194069 - DNA, 16 bp, Homo sapiens
cttattacataactga

SEQ ID NO: 6194070 - DNA, 15 bp, Homo sapiens
cttattacatttaaa

SEQ ID NO: 6194071 - DNA, 16 bp, Homo sapiens
cttattacattttatt

SEQ ID NO: 6194072 - DNA, 22 bp, Homo sapiens
cttattaccctgattgaatgtg

SEQ ID NO: 6194073 - DNA, 14 bp, Homo sapiens
cttattactattat

SEQ ID NO: 6194074 - DNA, 21 bp, Homo sapiens
cttattactgagagtgcaaat

SEQ ID NO: 6194075 - DNA, 20 bp, Homo sapiens
cttattactgcttgcagtaa

SEQ ID NO: 6194076 - DNA, 13 bp, Homo sapiens
cttattagcagct

SEQ ID NO: 6194077 - DNA, 20 bp, Homo sapiens
cttattagctaaaaatatat

SEQ ID NO: 6194078 - DNA, 17 bp, Homo sapiens
cttattagggagaaaat

SEQ ID NO: 6194079 - DNA, 14 bp, Homo sapiens
cttattataaaatg

SEQ ID NO: 6194080 - DNA, 22 bp, Homo sapiens
cttattcaaagatgataattta

SEQ ID NO: 6194081 - DNA, 12 bp, Homo sapiens
cttattcacttt

SEQ ID NO: 6194082 - DNA, 22 bp, Homo sapiens
cttattcaggaagataaaaatc

SEQ ID NO: 6194083 - DNA, 22 bp, Homo sapiens
cttattcatgctttctcctttt

SEQ ID NO: 6194084 - DNA, 14 bp, Homo sapiens
cttattcattttct

SEQ ID NO: 6194085 - DNA, 18 bp, Homo sapiens
cttattccaagtgcattt

SEQ ID NO: 6194086 - DNA, 16 bp, Homo sapiens
cttattccaggagaag

SEQ ID NO: 6194087 - DNA, 18 bp, Homo sapiens
cttattccatgactgctt

SEQ ID NO: 6194088 - DNA, 20 bp, Homo sapiens
cttattcccccctaagcttc

SEQ ID NO: 6194089 - DNA, 14 bp, Homo sapiens
cttattcccttcct

SEQ ID NO: 6194090 - DNA, 21 bp, Homo sapiens
cttattccgagaatgccgagg

SEQ ID NO: 6194091 - DNA, 17 bp, Homo sapiens
cttattccgagcattcc

SEQ ID NO: 6194092 - DNA, 19 bp, Homo sapiens
cttattcctaatggctatt

SEQ ID NO: 6194093 - DNA, 13 bp, Homo sapiens
cttattcctaatt

SEQ ID NO: 6194094 - DNA, 15 bp, Homo sapiens
cttattcctaattcc

SEQ ID NO: 6194095 - DNA, 15 bp, Homo sapiens
cttattcctcagtga

SEQ ID NO: 6194096 - DNA, 16 bp, Homo sapiens
cttattcctctaggca

SEQ ID NO: 6194097 - DNA, 21 bp, Homo sapiens
cttattctatactttcttgta

SEQ ID NO: 6194098 - DNA, 18 bp, Homo sapiens
cttattctctgtttgctt

SEQ ID NO: 6194099 - DNA, 15 bp, Homo sapiens
cttattctgacataa

SEQ ID NO: 6194100 - DNA, 17 bp, Homo sapiens
cttattcttttataata

SEQ ID NO: 6194101 - DNA, 20 bp, Homo sapiens
cttattgaaaaaaaaaatgt

SEQ ID NO: 6194102 - DNA, 13 bp, Homo sapiens
cttattgaagtga

SEQ ID NO: 6194103 - DNA, 18 bp, Homo sapiens
cttattgaatttgttaga

SEQ ID NO: 6194104 - DNA, 22 bp, Homo sapiens
cttattgacaaccgagaaggtt

SEQ ID NO: 6194105 - DNA, 14 bp, Homo sapiens
cttattgaccattt

SEQ ID NO: 6194106 - DNA, 18 bp, Homo sapiens
cttattgagcgtgattct

SEQ ID NO: 6194107 - DNA, 19 bp, Homo sapiens
cttattgatattctaagaa

SEQ ID NO: 6194108 - DNA, 23 bp, Homo sapiens
cttattgatattctaagaaatat

SEQ ID NO: 6194109 - DNA, 18 bp, Homo sapiens
cttattgattaagtatat

SEQ ID NO: 6194110 - DNA, 12 bp, Homo sapiens
cttattgcccac

SEQ ID NO: 6194111 - DNA, 16 bp, Homo sapiens
cttattgcccaggctg

SEQ ID NO: 6194112 - DNA, 21 bp, Homo sapiens
cttattgcctgggcagtgccc

SEQ ID NO: 6194113 - DNA, 16 bp, Homo sapiens
cttattgctgatttta

SEQ ID NO: 6194114 - DNA, 11 bp, Homo sapiens
cttattgctgc

SEQ ID NO: 6194115 - DNA, 13 bp, Homo sapiens
cttattgctgcca

SEQ ID NO: 6194116 - DNA, 16 bp, Homo sapiens
cttattgctgccaaaa

SEQ ID NO: 6194117 - DNA, 18 bp, Homo sapiens
cttattgctgccaaaacc

SEQ ID NO: 6194118 - DNA, 19 bp, Homo sapiens
cttattgctgccaaaacca

SEQ ID NO: 6194119 - DNA, 14 bp, Homo sapiens
cttattgcttagta

SEQ ID NO: 6194120 - DNA, 18 bp, Homo sapiens
cttattgcttcatctgta

SEQ ID NO: 6194121 - DNA, 14 bp, Homo sapiens
cttattggaaatgt

SEQ ID NO: 6194122 - DNA, 21 bp, Homo sapiens
cttattggaaatgtacttttg

SEQ ID NO: 6194123 - DNA, 16 bp, Homo sapiens
cttattggatatttga

SEQ ID NO: 6194124 - DNA, 17 bp, Homo sapiens
cttattggatatttgat

SEQ ID NO: 6194125 - DNA, 18 bp, Homo sapiens
cttattgtaacaggcttt

SEQ ID NO: 6194126 - DNA, 13 bp, Homo sapiens
cttattgtacctc

SEQ ID NO: 6194127 - DNA, 19 bp, Homo sapiens
cttattgtgtgcgctgcct

SEQ ID NO: 6194128 - DNA, 20 bp, Homo sapiens
cttattgtgtgcgctgcctg

SEQ ID NO: 6194129 - DNA, 21 bp, Homo sapiens
cttattgtgtgcgctgcctgg

SEQ ID NO: 6194130 - DNA, 16 bp, Homo sapiens
cttattgttctttcat

SEQ ID NO: 6194131 - DNA, 17 bp, Homo sapiens
cttattgtttgtaaaca

SEQ ID NO: 6194132 - DNA, 19 bp, Homo sapiens
cttatttaaaaatatttca

SEQ ID NO: 6194133 - DNA, 21 bp, Homo sapiens
cttatttaaaaatatttcaga

SEQ ID NO: 6194134 - DNA, 14 bp, Homo sapiens
cttatttaaatgac

SEQ ID NO: 6194135 - DNA, 18 bp, Homo sapiens
cttatttaaattttcaga

SEQ ID NO: 6194136 - DNA, 20 bp, Homo sapiens
cttatttaagtatggaatat

SEQ ID NO: 6194137 - DNA, 18 bp, Homo sapiens
cttatttaatgaaagact

SEQ ID NO: 6194138 - DNA, 16 bp, Homo sapiens
cttatttacccttttc

SEQ ID NO: 6194139 - DNA, 18 bp, Homo sapiens
cttatttacccttttccc

SEQ ID NO: 6194140 - DNA, 19 bp, Homo sapiens
cttatttacccttttcccc

SEQ ID NO: 6194141 - DNA, 23 bp, Homo sapiens
cttatttacctataaaatgagat

SEQ ID NO: 6194142 - DNA, 21 bp, Homo sapiens
cttatttacttgtagaaatct

SEQ ID NO: 6194143 - DNA, 14 bp, Homo sapiens
cttatttagaaaaa

SEQ ID NO: 6194144 - DNA, 15 bp, Homo sapiens
cttatttagaaaaaa

SEQ ID NO: 6194145 - DNA, 23 bp, Homo sapiens
cttatttagattcacttaacaaa

SEQ ID NO: 6194146 - DNA, 18 bp, Homo sapiens
cttatttatattcatcaa

SEQ ID NO: 6194147 - DNA, 14 bp, Homo sapiens
cttatttatgaatt

SEQ ID NO: 6194148 - DNA, 13 bp, Homo sapiens
cttatttattatt

SEQ ID NO: 6194149 - DNA, 23 bp, Homo sapiens
cttatttattttagcaaatcagt

SEQ ID NO: 6194150 - DNA, 16 bp, Homo sapiens
cttatttcaaaaggaa

SEQ ID NO: 6194151 - DNA, 17 bp, Homo sapiens
cttatttcaaaaggaag

SEQ ID NO: 6194152 - DNA, 11 bp, Homo sapiens
cttatttcact

SEQ ID NO: 6194153 - DNA, 22 bp, Homo sapiens
cttatttcactatcttcttcaa

SEQ ID NO: 6194154 - DNA, 23 bp, Homo sapiens
cttatttcactttagtttttgaa

SEQ ID NO: 6194155 - DNA, 18 bp, Homo sapiens
cttatttcatcattcact

SEQ ID NO: 6194156 - DNA, 12 bp, Homo sapiens
cttatttccaag

SEQ ID NO: 6194157 - DNA, 20 bp, Homo sapiens
cttatttcccctttccaatt

SEQ ID NO: 6194158 - DNA, 20 bp, Homo sapiens
cttatttcctttccaagtat

SEQ ID NO: 6194159 - DNA, 19 bp, Homo sapiens
cttatttctagaagcacat

SEQ ID NO: 6194160 - DNA, 16 bp, Homo sapiens
cttatttctcagctgt

SEQ ID NO: 6194161 - DNA, 20 bp, Homo sapiens
cttatttctctctcctggtg

SEQ ID NO: 6194162 - DNA, 18 bp, Homo sapiens
cttatttctgctctggaa

SEQ ID NO: 6194163 - DNA, 19 bp, Homo sapiens
cttatttctgctctggaat

SEQ ID NO: 6194164 - DNA, 14 bp, Homo sapiens
cttatttgaaagtg

SEQ ID NO: 6194165 - DNA, 15 bp, Homo sapiens
cttatttgaaagtgt

SEQ ID NO: 6194166 - DNA, 11 bp, Homo sapiens
cttatttgagt

SEQ ID NO: 6194167 - DNA, 12 bp, Homo sapiens
cttatttgagtg

SEQ ID NO: 6194168 - DNA, 12 bp, Homo sapiens
cttatttgcaat

SEQ ID NO: 6194169 - DNA, 14 bp, Homo sapiens
cttatttgccttct

SEQ ID NO: 6194170 - DNA, 18 bp, Homo sapiens
cttatttgctcataagta

SEQ ID NO: 6194171 - DNA, 15 bp, Homo sapiens
cttatttgcttcatt

SEQ ID NO: 6194172 - DNA, 19 bp, Homo sapiens
cttatttggaattgacatt

SEQ ID NO: 6194173 - DNA, 18 bp, Homo sapiens
cttatttggcgtgacccg

SEQ ID NO: 6194174 - DNA, 18 bp, Homo sapiens
cttatttgtatttttcct

SEQ ID NO: 6194175 - DNA, 16 bp, Homo sapiens
cttatttgtcaaaata

SEQ ID NO: 6194176 - DNA, 18 bp, Homo sapiens
cttatttgtttggtcact

SEQ ID NO: 6194177 - DNA, 16 bp, Homo sapiens
cttattttaatgtgat

SEQ ID NO: 6194178 - DNA, 14 bp, Homo sapiens
cttattttagtata

SEQ ID NO: 6194179 - DNA, 15 bp, Homo sapiens
cttattttatttcca

SEQ ID NO: 6194180 - DNA, 14 bp, Homo sapiens
cttattttcaagaa

SEQ ID NO: 6194181 - DNA, 19 bp, Homo sapiens
cttattttcaagaaactga

SEQ ID NO: 6194182 - DNA, 21 bp, Homo sapiens
cttattttcagtgcatcatta

SEQ ID NO: 6194183 - DNA, 16 bp, Homo sapiens
cttattttcatgtata

SEQ ID NO: 6194184 - DNA, 20 bp, Homo sapiens
cttattttccacttatcttg

SEQ ID NO: 6194185 - DNA, 17 bp, Homo sapiens
cttattttctcaatctc

SEQ ID NO: 6194186 - DNA, 15 bp, Homo sapiens
cttattttctctgtg

SEQ ID NO: 6194187 - DNA, 22 bp, Homo sapiens
cttattttgattgtttgatgaa

SEQ ID NO: 6194188 - DNA, 18 bp, Homo sapiens
cttattttggagagatag

SEQ ID NO: 6194189 - DNA, 14 bp, Homo sapiens
cttattttgtaata

SEQ ID NO: 6194190 - DNA, 18 bp, Homo sapiens
cttattttgtaataaact

SEQ ID NO: 6194191 - DNA, 19 bp, Homo sapiens
cttattttgtaataaactc

SEQ ID NO: 6194192 - DNA, 20 bp, Homo sapiens
cttattttgtaataaactct

SEQ ID NO: 6194193 - DNA, 15 bp, Homo sapiens
cttattttgtactag

SEQ ID NO: 6194194 - DNA, 20 bp, Homo sapiens
cttattttgtcttattctta

SEQ ID NO: 6194195 - DNA, 21 bp, Homo sapiens
cttattttgtcttattcttaa

SEQ ID NO: 6194196 - DNA, 17 bp, Homo sapiens
cttatttttaaaataaa

SEQ ID NO: 6194197 - DNA, 16 bp, Homo sapiens
cttatttttagatggt

SEQ ID NO: 6194198 - DNA, 23 bp, Homo sapiens
cttatttttataattaaagatgc

SEQ ID NO: 6194199 - DNA, 13 bp, Homo sapiens
cttatttttccta

SEQ ID NO: 6194200 - DNA, 14 bp, Homo sapiens
cttatttttcctgt

SEQ ID NO: 6194201 - DNA, 17 bp, Homo sapiens
gaaggtttttgtttctt

SEQ ID NO: 6194202 - DNA, 21 bp, Homo sapiens
gaaggttttttttttaagtgc

SEQ ID NO: 6194203 - DNA, 22 bp, Homo sapiens
gaaggttttttttttaagtgca

SEQ ID NO: 6194204 - DNA, 13 bp, Homo sapiens
gaagtaaaataaa

SEQ ID NO: 6194205 - DNA, 17 bp, Homo sapiens
gaagtaaaatgtggcag

SEQ ID NO: 6194206 - DNA, 20 bp, Homo sapiens
gaagtaaacagctgtgcatc

SEQ ID NO: 6194207 - DNA, 13 bp, Homo sapiens
gaagtaaactttt

SEQ ID NO: 6194208 - DNA, 16 bp, Homo sapiens
gaagtaaactttttgt

SEQ ID NO: 6194209 - DNA, 19 bp, Homo sapiens
gaagtaaaggcattccaca

SEQ ID NO: 6194210 - DNA, 15 bp, Homo sapiens
gaagtaaagtgaaga

SEQ ID NO: 6194211 - DNA, 17 bp, Homo sapiens
gaagtaaagtgaagaat

SEQ ID NO: 6194212 - DNA, 17 bp, Homo sapiens
gaagtaaagtttatttc

SEQ ID NO: 6194213 - DNA, 14 bp, Homo sapiens
gaagtaaattattt

SEQ ID NO: 6194214 - DNA, 11 bp, Homo sapiens
gaagtaaattt

SEQ ID NO: 6194215 - DNA, 15 bp, Homo sapiens
gaagtaaatttgtcc

SEQ ID NO: 6194216 - DNA, 14 bp, Homo sapiens
gaagtaacagtaac

SEQ ID NO: 6194217 - DNA, 22 bp, Homo sapiens
gaagtaacatgcatactttatt

SEQ ID NO: 6194218 - DNA, 23 bp, Homo sapiens
gaagtaaccaactgaacgacaaa

SEQ ID NO: 6194219 - DNA, 20 bp, Homo sapiens
gaagtaactcccactcctaa

SEQ ID NO: 6194220 - DNA, 22 bp, Homo sapiens
gaagtaactccccttaaaatgt

SEQ ID NO: 6194221 - DNA, 18 bp, Homo sapiens
gaagtaactggtgatata

SEQ ID NO: 6194222 - DNA, 22 bp, Homo sapiens
gaagtaactgtccgctagaagt

SEQ ID NO: 6194223 - DNA, 18 bp, Homo sapiens
gaagtaacttatttgact

SEQ ID NO: 6194224 - DNA, 17 bp, Homo sapiens
gaagtaacttattttgt

SEQ ID NO: 6194225 - DNA, 15 bp, Homo sapiens
gaagtaagaagagga

SEQ ID NO: 6194226 - DNA, 17 bp, Homo sapiens
gaagtaagaagaggagc

SEQ ID NO: 6194227 - DNA, 17 bp, Homo sapiens
gaagtaagcaaacaaat

SEQ ID NO: 6194228 - DNA, 16 bp, Homo sapiens
gaagtaagggagtcat

SEQ ID NO: 6194229 - DNA, 15 bp, Homo sapiens
gaagtaagttcatca

SEQ ID NO: 6194230 - DNA, 17 bp, Homo sapiens
gaagtaagttctgaaaa

SEQ ID NO: 6194231 - DNA, 14 bp, Homo sapiens
gaagtaattttctt

SEQ ID NO: 6194232 - DNA, 22 bp, Homo sapiens
gaagtacaataagcagaggtgg

SEQ ID NO: 6194233 - DNA, 16 bp, Homo sapiens
gaagtacagtcccagc

SEQ ID NO: 6194234 - DNA, 19 bp, Homo sapiens
gaagtacatgaagagcagc

SEQ ID NO: 6194235 - DNA, 14 bp, Homo sapiens
gaagtaccagacta

SEQ ID NO: 6194236 - DNA, 21 bp, Homo sapiens
gaagtacccgttcacattttt

SEQ ID NO: 6194237 - DNA, 15 bp, Homo sapiens
gaagtacctttgtta

SEQ ID NO: 6194238 - DNA, 21 bp, Homo sapiens
gaagtacgaatcttatttttc

SEQ ID NO: 6194239 - DNA, 21 bp, Homo sapiens
gaagtacgttattgttgactt

SEQ ID NO: 6194240 - DNA, 19 bp, Homo sapiens
gaagtacttgccagaagtt

SEQ ID NO: 6194241 - DNA, 23 bp, Homo sapiens
gaagtacttgccagaagttgtgg

SEQ ID NO: 6194242 - DNA, 21 bp, Homo sapiens
gaagtacttggcccccttcag

SEQ ID NO: 6194243 - DNA, 19 bp, Homo sapiens
gaagtagatgtgaaaaagc

SEQ ID NO: 6194244 - DNA, 13 bp, Homo sapiens
gaagtagcacagg

SEQ ID NO: 6194245 - DNA, 16 bp, Homo sapiens
gaagtagcacaggctg

SEQ ID NO: 6194246 - DNA, 18 bp, Homo sapiens
gaagtagcacaggctgag

SEQ ID NO: 6194247 - DNA, 22 bp, Homo sapiens
gaagtagcctgatctttctaga

SEQ ID NO: 6194248 - DNA, 20 bp, Homo sapiens
gaagtagctgtcagatgtca

SEQ ID NO: 6194249 - DNA, 23 bp, Homo sapiens
gaagtaggaagtgaaaataggta

SEQ ID NO: 6194250 - DNA, 18 bp, Homo sapiens
gaagtaggggtggcccga

SEQ ID NO: 6194251 - DNA, 14 bp, Homo sapiens
gaagtagtccttgg

SEQ ID NO: 6194252 - DNA, 23 bp, Homo sapiens
gaagtagtgtctggatcagtaaa

SEQ ID NO: 6194253 - DNA, 17 bp, Homo sapiens
gaagtagttatcatgtt

SEQ ID NO: 6194254 - DNA, 14 bp, Homo sapiens
gaagtataaagaat

SEQ ID NO: 6194255 - DNA, 21 bp, Homo sapiens
gaagtatagatggtagaaact

SEQ ID NO: 6194256 - DNA, 19 bp, Homo sapiens
gaagtatatttttgcaggt

SEQ ID NO: 6194257 - DNA, 21 bp, Homo sapiens
gaagtatccaattatgtgaca

SEQ ID NO: 6194258 - DNA, 16 bp, Homo sapiens
gaagtatccttcagcc

SEQ ID NO: 6194259 - DNA, 14 bp, Homo sapiens
gaagtatgtgtggg

SEQ ID NO: 6194260 - DNA, 13 bp, Homo sapiens
gaagtattaaaaa

SEQ ID NO: 6194261 - DNA, 22 bp, Homo sapiens
gaagtattaagcctaccgtatt

SEQ ID NO: 6194262 - DNA, 20 bp, Homo sapiens
gaagtattacatgatttaaa

SEQ ID NO: 6194263 - DNA, 19 bp, Homo sapiens
gaagtattagacttctaaa

SEQ ID NO: 6194264 - DNA, 21 bp, Homo sapiens
gaagtattcccttctttccta

SEQ ID NO: 6194265 - DNA, 15 bp, Homo sapiens
gaagtattgctgaaa

SEQ ID NO: 6194266 - DNA, 16 bp, Homo sapiens
gaagtattttcctcca

SEQ ID NO: 6194267 - DNA, 15 bp, Homo sapiens
gaagtatttttagaa

SEQ ID NO: 6194268 - DNA, 19 bp, Homo sapiens
gaagtatttttagaataag

SEQ ID NO: 6194269 - DNA, 18 bp, Homo sapiens
gaagtatttttttaattt

SEQ ID NO: 6194270 - DNA, 23 bp, Homo sapiens
gaagtatttttttaatttctgaa

SEQ ID NO: 6194271 - DNA, 15 bp, Homo sapiens
gaagtcaaacatttc

SEQ ID NO: 6194272 - DNA, 19 bp, Homo sapiens
gaagtcaaaccttaagata

SEQ ID NO: 6194273 - DNA, 20 bp, Homo sapiens
gaagtcaaagacaaagtgtg

SEQ ID NO: 6194274 - DNA, 16 bp, Homo sapiens
gaagtcaagctcaaca

SEQ ID NO: 6194275 - DNA, 22 bp, Homo sapiens
gaagtcaataggcctatttatt

SEQ ID NO: 6194276 - DNA, 20 bp, Homo sapiens
gaagtcacaacaaaaggaag

SEQ ID NO: 6194277 - DNA, 13 bp, Homo sapiens
gaagtcacacagt

SEQ ID NO: 6194278 - DNA, 16 bp, Homo sapiens
gaagtcacagggcagt

SEQ ID NO: 6194279 - DNA, 23 bp, Homo sapiens
gaagtcacattagtgtgttgtct

SEQ ID NO: 6194280 - DNA, 21 bp, Homo sapiens
gaagtcacattccacatctgt

SEQ ID NO: 6194281 - DNA, 16 bp, Homo sapiens
gaagtcacattcctga

SEQ ID NO: 6194282 - DNA, 20 bp, Homo sapiens
gaagtcacattcctgaacag

SEQ ID NO: 6194283 - DNA, 22 bp, Homo sapiens
gaagtcaccttgtgtgttccaa

SEQ ID NO: 6194284 - DNA, 17 bp, Homo sapiens
gaagtcactcacactgg

SEQ ID NO: 6194285 - DNA, 21 bp, Homo sapiens
gaagtcactcacactggccac

SEQ ID NO: 6194286 - DNA, 18 bp, Homo sapiens
gaagtcactgaacaaaac

SEQ ID NO: 6194287 - DNA, 18 bp, Homo sapiens
gaagtcagagaaaacact

SEQ ID NO: 6194288 - DNA, 22 bp, Homo sapiens
gaagtcagatctgcctaaggac

SEQ ID NO: 6194289 - DNA, 18 bp, Homo sapiens
gaagtcagccacactggg

SEQ ID NO: 6194290 - DNA, 23 bp, Homo sapiens
gaagtcagccacactgggcctgg

SEQ ID NO: 6194291 - DNA, 20 bp, Homo sapiens
gaagtcagcccgaatgcctg

SEQ ID NO: 6194292 - DNA, 22 bp, Homo sapiens
gaagtcagcccgaatgcctgtc

SEQ ID NO: 6194293 - DNA, 21 bp, Homo sapiens
gaagtcagctaattggacttt

SEQ ID NO: 6194294 - DNA, 19 bp, Homo sapiens
gaagtcagctactctagtt

SEQ ID NO: 6194295 - DNA, 23 bp, Homo sapiens
gaagtcagctactctagttctgt

SEQ ID NO: 6194296 - DNA, 12 bp, Homo sapiens
gaagtcaggagc

SEQ ID NO: 6194297 - DNA, 16 bp, Homo sapiens
gaagtcaggagccagc

SEQ ID NO: 6194298 - DNA, 18 bp, Homo sapiens
gaagtcaggagccagcag

SEQ ID NO: 6194299 - DNA, 19 bp, Homo sapiens
gaagtcaggagccagcagg

SEQ ID NO: 6194300 - DNA, 13 bp, Homo sapiens
gaagtcaggggag

SEQ ID NO: 6194301 - DNA, 21 bp, Homo sapiens
gaagtcaggggagaagctgaa

SEQ ID NO: 6194302 - DNA, 13 bp, Homo sapiens
gaagtcagtacga

SEQ ID NO: 6194303 - DNA, 23 bp, Homo sapiens
gaagtcagtgtagacctgagctg

SEQ ID NO: 6194304 - DNA, 20 bp, Homo sapiens
gaagtcagttggagaaaatg

SEQ ID NO: 6194305 - DNA, 16 bp, Homo sapiens
gaagtcatcataaaag

SEQ ID NO: 6194306 - DNA, 19 bp, Homo sapiens
gaagtcatgaagcccaagt

SEQ ID NO: 6194307 - DNA, 16 bp, Homo sapiens
gaagtcattgtcgctc

SEQ ID NO: 6194308 - DNA, 22 bp, Homo sapiens
gaagtccaagcatttagatgta

SEQ ID NO: 6194309 - DNA, 14 bp, Homo sapiens
gaagtccaatgtgg

SEQ ID NO: 6194310 - DNA, 13 bp, Homo sapiens
gaagtccagaacg

SEQ ID NO: 6194311 - DNA, 15 bp, Homo sapiens
gaagtccagctcctt

SEQ ID NO: 6194312 - DNA, 19 bp, Homo sapiens
gaagtccaggactgggtct

SEQ ID NO: 6194313 - DNA, 19 bp, Homo sapiens
gaagtccagtgaccctgga

SEQ ID NO: 6194314 - DNA, 20 bp, Homo sapiens
gaagtccagtgaccctggag

SEQ ID NO: 6194315 - DNA, 16 bp, Homo sapiens
gaagtccccaggcccc

SEQ ID NO: 6194316 - DNA, 23 bp, Homo sapiens
gaagtccccaggccccaggaagc

SEQ ID NO: 6194317 - DNA, 16 bp, Homo sapiens
gaagtccctcagaggc

SEQ ID NO: 6194318 - DNA, 20 bp, Homo sapiens
gaagtccctgttctcagctc

SEQ ID NO: 6194319 - DNA, 21 bp, Homo sapiens
gaagtccctgttctcagctcc

SEQ ID NO: 6194320 - DNA, 14 bp, Homo sapiens
gaagtcccttcctg

SEQ ID NO: 6194321 - DNA, 18 bp, Homo sapiens
gaagtcccttcctgtcct

SEQ ID NO: 6194322 - DNA, 18 bp, Homo sapiens
gaagtcccttgccatcct

SEQ ID NO: 6194323 - DNA, 15 bp, Homo sapiens
gaagtccgaggcctg

SEQ ID NO: 6194324 - DNA, 23 bp, Homo sapiens
gaagtccgaggcctggctctgga

SEQ ID NO: 6194325 - DNA, 15 bp, Homo sapiens
gaagtcctagcccct

SEQ ID NO: 6194326 - DNA, 18 bp, Homo sapiens
gaagtcctatggaaaccc

SEQ ID NO: 6194327 - DNA, 22 bp, Homo sapiens
gaagtcctatggaaacccgagg

SEQ ID NO: 6194328 - DNA, 17 bp, Homo sapiens
gaagtcctctgtggcca

SEQ ID NO: 6194329 - DNA, 18 bp, Homo sapiens
gaagtcggccaggtagga

SEQ ID NO: 6194330 - DNA, 15 bp, Homo sapiens
gaagtctaattcaca

SEQ ID NO: 6194331 - DNA, 14 bp, Homo sapiens
gaagtctacctgct

SEQ ID NO: 6194332 - DNA, 15 bp, Homo sapiens
gaagtctacctgctg

SEQ ID NO: 6194333 - DNA, 16 bp, Homo sapiens
gaagtctacctgctgg

SEQ ID NO: 6194334 - DNA, 16 bp, Homo sapiens
gaagtctaggagctgg

SEQ ID NO: 6194335 - DNA, 13 bp, Homo sapiens
gaagtctcagcct

SEQ ID NO: 6194336 - DNA, 18 bp, Homo sapiens
gaagtctcatctggggag

SEQ ID NO: 6194337 - DNA, 19 bp, Homo sapiens
gaagtctcatctggggagc

SEQ ID NO: 6194338 - DNA, 21 bp, Homo sapiens
gaagtctccatgaagagcttg

SEQ ID NO: 6194339 - DNA, 20 bp, Homo sapiens
gaagtctccccgcagccctc

SEQ ID NO: 6194340 - DNA, 11 bp, Homo sapiens
gaagtctctga

SEQ ID NO: 6194341 - DNA, 16 bp, Homo sapiens
gaagtctctgaagtga

SEQ ID NO: 6194342 - DNA, 23 bp, Homo sapiens
gaagtctctgattagttgacagt

SEQ ID NO: 6194343 - DNA, 13 bp, Homo sapiens
gaagtctcttcct

SEQ ID NO: 6194344 - DNA, 18 bp, Homo sapiens
gaagtctcttcctgcctc

SEQ ID NO: 6194345 - DNA, 21 bp, Homo sapiens
gaagtctcttcctgcctccca

SEQ ID NO: 6194346 - DNA, 15 bp, Homo sapiens
gaagtctcttttctt

SEQ ID NO: 6194347 - DNA, 17 bp, Homo sapiens
gaagtctctttttcttc

SEQ ID NO: 6194348 - DNA, 14 bp, Homo sapiens
gaagtctgcgccct

SEQ ID NO: 6194349 - DNA, 20 bp, Homo sapiens
gaagtctgcttaccaaaaca

SEQ ID NO: 6194350 - DNA, 12 bp, Homo sapiens
gaagtctggaaa

SEQ ID NO: 6194351 - DNA, 24 bp, Homo sapiens
gaagtctggctttgctctattaag

SEQ ID NO: 6194352 - DNA, 19 bp, Homo sapiens
gaagtctgtccaaatttaa

SEQ ID NO: 6194353 - DNA, 14 bp, Homo sapiens
gaagtctgttctca

SEQ ID NO: 6194354 - DNA, 17 bp, Homo sapiens
gaagtcttaaggacaaa

SEQ ID NO: 6194355 - DNA, 16 bp, Homo sapiens
gaagtcttaattgtgt

SEQ ID NO: 6194356 - DNA, 17 bp, Homo sapiens
gaagtcttcatgaaatg

SEQ ID NO: 6194357 - DNA, 18 bp, Homo sapiens
gaagtcttcatgaaatgc

SEQ ID NO: 6194358 - DNA, 18 bp, Homo sapiens
gaagtcttccatcagcag

SEQ ID NO: 6194359 - DNA, 20 bp, Homo sapiens
gaagtcttccatcagcagtg

SEQ ID NO: 6194360 - DNA, 21 bp, Homo sapiens
gaagtcttccatcagcagtga

SEQ ID NO: 6194361 - DNA, 17 bp, Homo sapiens
gaagtcttccctcagat

SEQ ID NO: 6194362 - DNA, 16 bp, Homo sapiens
gaagtcttctatttat

SEQ ID NO: 6194363 - DNA, 17 bp, Homo sapiens
gaagtcttctatttatt

SEQ ID NO: 6194364 - DNA, 15 bp, Homo sapiens
gaagtcttgcattga

SEQ ID NO: 6194365 - DNA, 14 bp, Homo sapiens
gaagtcttgtataa

SEQ ID NO: 6194366 - DNA, 18 bp, Homo sapiens
gaagtctttgttgcacca

SEQ ID NO: 6194367 - DNA, 15 bp, Homo sapiens
gaagtctttttcatt

SEQ ID NO: 6194368 - DNA, 16 bp, Homo sapiens
gaagtgaaaaacagaa

SEQ ID NO: 6194369 - DNA, 18 bp, Homo sapiens
gaagtgaacccatatttt

SEQ ID NO: 6194370 - DNA, 14 bp, Homo sapiens
gaagtgaaggagaa

SEQ ID NO: 6194371 - DNA, 18 bp, Homo sapiens
gaagtgaaggagaaagga

SEQ ID NO: 6194372 - DNA, 18 bp, Homo sapiens
gaagtgacaaggccccag

SEQ ID NO: 6194373 - DNA, 21 bp, Homo sapiens
gaagtgacagggaagctacag

SEQ ID NO: 6194374 - DNA, 22 bp, Homo sapiens
gaagtgacagggaagctacagg

SEQ ID NO: 6194375 - DNA, 22 bp, Homo sapiens
gaagtgacattgtaagaggtgg

SEQ ID NO: 6194376 - DNA, 19 bp, Homo sapiens
gaagtgaccccagctccag

SEQ ID NO: 6194377 - DNA, 15 bp, Homo sapiens
cttatttttcctgtc

SEQ ID NO: 6194378 - DNA, 17 bp, Homo sapiens
cttatttttcctgtcct

SEQ ID NO: 6194379 - DNA, 16 bp, Homo sapiens
cttatttttctaaacg

SEQ ID NO: 6194380 - DNA, 16 bp, Homo sapiens
cttatttttgaattct

SEQ ID NO: 6194381 - DNA, 22 bp, Homo sapiens
cttattttttaatgtgagacag

SEQ ID NO: 6194382 - DNA, 14 bp, Homo sapiens
cttattttttccca

SEQ ID NO: 6194383 - DNA, 19 bp, Homo sapiens
cttattttttcccaaagcc

SEQ ID NO: 6194384 - DNA, 19 bp, Homo sapiens
cttatttttttctgattgt

SEQ ID NO: 6194385 - DNA, 20 bp, Homo sapiens
cttatttttttctgattgta

SEQ ID NO: 6194386 - DNA, 16 bp, Homo sapiens
cttcaaaaactaaaat

SEQ ID NO: 6194387 - DNA, 14 bp, Homo sapiens
cttcaaaaagccac

SEQ ID NO: 6194388 - DNA, 20 bp, Homo sapiens
cttcaaaaagccacagcaga

SEQ ID NO: 6194389 - DNA, 21 bp, Homo sapiens
cttcaaaaagccacagcagag

SEQ ID NO: 6194390 - DNA, 22 bp, Homo sapiens
cttcaaaaataaaaaatctgaa

SEQ ID NO: 6194391 - DNA, 12 bp, Homo sapiens
cttcaaaaatac

SEQ ID NO: 6194392 - DNA, 17 bp, Homo sapiens
cttcaaaaatacagaat

SEQ ID NO: 6194393 - DNA, 19 bp, Homo sapiens
cttcaaaaatgtgctgcct

SEQ ID NO: 6194394 - DNA, 20 bp, Homo sapiens
cttcaaaaatgtgctgccta

SEQ ID NO: 6194395 - DNA, 13 bp, Homo sapiens
cttcaaaacattc

SEQ ID NO: 6194396 - DNA, 20 bp, Homo sapiens
cttcaaaaggaatgaacttg

SEQ ID NO: 6194397 - DNA, 22 bp, Homo sapiens
cttcaaaaggaatgaacttgtt

SEQ ID NO: 6194398 - DNA, 20 bp, Homo sapiens
cttcaaaagtaatgcctctg

SEQ ID NO: 6194399 - DNA, 21 bp, Homo sapiens
cttcaaaagtaatgcctctgt

SEQ ID NO: 6194400 - DNA, 21 bp, Homo sapiens
cttcaaaagtttgtttgctta

SEQ ID NO: 6194401 - DNA, 14 bp, Homo sapiens
cttcaaaatcagtg

SEQ ID NO: 6194402 - DNA, 18 bp, Homo sapiens
cttcaaaatgttctattt

SEQ ID NO: 6194403 - DNA, 20 bp, Homo sapiens
cttcaaaatgttctatttaa

SEQ ID NO: 6194404 - DNA, 21 bp, Homo sapiens
cttcaaaccctcaagagggga

SEQ ID NO: 6194405 - DNA, 22 bp, Homo sapiens
cttcaaacctaaaaatcaagtt

SEQ ID NO: 6194406 - DNA, 11 bp, Homo sapiens
cttcaaactac

SEQ ID NO: 6194407 - DNA, 14 bp, Homo sapiens
cttcaaactttcac

SEQ ID NO: 6194408 - DNA, 17 bp, Homo sapiens
cttcaaactttcacttt

SEQ ID NO: 6194409 - DNA, 17 bp, Homo sapiens
cttcaaagaaacttgaa

SEQ ID NO: 6194410 - DNA, 19 bp, Homo sapiens
cttcaaagatagggaggga

SEQ ID NO: 6194411 - DNA, 17 bp, Homo sapiens
cttcaaagattatctga

SEQ ID NO: 6194412 - DNA, 18 bp, Homo sapiens
cttcaaagattatctgat

SEQ ID NO: 6194413 - DNA, 11 bp, Homo sapiens
cttcaaagcag

SEQ ID NO: 6194414 - DNA, 14 bp, Homo sapiens
cttcaaagcagagt

SEQ ID NO: 6194415 - DNA, 19 bp, Homo sapiens
cttcaaagctgaatatttt

SEQ ID NO: 6194416 - DNA, 16 bp, Homo sapiens
cttcaaagcttgaaga

SEQ ID NO: 6194417 - DNA, 22 bp, Homo sapiens
cttcaaagtctcaatgaaatag

SEQ ID NO: 6194418 - DNA, 13 bp, Homo sapiens
cttcaaagtgcct

SEQ ID NO: 6194419 - DNA, 16 bp, Homo sapiens
cttcaaagtgcctggg

SEQ ID NO: 6194420 - DNA, 18 bp, Homo sapiens
cttcaaagtgcctgggct

SEQ ID NO: 6194421 - DNA, 17 bp, Homo sapiens
cttcaaagtgtgtctgg

SEQ ID NO: 6194422 - DNA, 16 bp, Homo sapiens
cttcaaagtttaataa

SEQ ID NO: 6194423 - DNA, 14 bp, Homo sapiens
cttcaaataaagaa

SEQ ID NO: 6194424 - DNA, 21 bp, Homo sapiens
cttcaaataaagaaatttggt

SEQ ID NO: 6194425 - DNA, 16 bp, Homo sapiens
cttcaaataattaaat

SEQ ID NO: 6194426 - DNA, 13 bp, Homo sapiens
cttcaaataattg

SEQ ID NO: 6194427 - DNA, 18 bp, Homo sapiens
cttcaaatacaaagtaaa

SEQ ID NO: 6194428 - DNA, 17 bp, Homo sapiens
cttcaaatacattctaa

SEQ ID NO: 6194429 - DNA, 16 bp, Homo sapiens
cttcaaatatagagat

SEQ ID NO: 6194430 - DNA, 14 bp, Homo sapiens
cttcaaatccatcc

SEQ ID NO: 6194431 - DNA, 16 bp, Homo sapiens
cttcaaatccatccag

SEQ ID NO: 6194432 - DNA, 16 bp, Homo sapiens
cttcaaatctcagcaa

SEQ ID NO: 6194433 - DNA, 18 bp, Homo sapiens
cttcaaatgatccttcct

SEQ ID NO: 6194434 - DNA, 24 bp, Homo sapiens
cttcaaatgggagactctttgaaa

SEQ ID NO: 6194435 - DNA, 23 bp, Homo sapiens
cttcaaatgtcatttcatacaaa

SEQ ID NO: 6194436 - DNA, 22 bp, Homo sapiens
cttcaaattaaagtgctgttta

SEQ ID NO: 6194437 - DNA, 17 bp, Homo sapiens
cttcaaattatagaaac

SEQ ID NO: 6194438 - DNA, 18 bp, Homo sapiens
cttcaaattcaaggcctt

SEQ ID NO: 6194439 - DNA, 20 bp, Homo sapiens
cttcaaatttgattctaaat

SEQ ID NO: 6194440 - DNA, 19 bp, Homo sapiens
cttcaacaactttgtgctt

SEQ ID NO: 6194441 - DNA, 15 bp, Homo sapiens
cttcaacacagcttg

SEQ ID NO: 6194442 - DNA, 22 bp, Homo sapiens
cttcaacacagcttgtctcttg

SEQ ID NO: 6194443 - DNA, 23 bp, Homo sapiens
cttcaacagaccccctctagaaa

SEQ ID NO: 6194444 - DNA, 14 bp, Homo sapiens
cttcaacagccaag

SEQ ID NO: 6194445 - DNA, 21 bp, Homo sapiens
cttcaacagccaagctggcac

SEQ ID NO: 6194446 - DNA, 22 bp, Homo sapiens
cttcaacagccaagctggcaca

SEQ ID NO: 6194447 - DNA, 23 bp, Homo sapiens
cttcaacagccaagctggcacaa

SEQ ID NO: 6194448 - DNA, 17 bp, Homo sapiens
cttcaacagctccccat

SEQ ID NO: 6194449 - DNA, 16 bp, Homo sapiens
cttcaacatcaatgtt

SEQ ID NO: 6194450 - DNA, 20 bp, Homo sapiens
cttcaacatcaatgttcatt

SEQ ID NO: 6194451 - DNA, 19 bp, Homo sapiens
cttcaacatgctccaaata

SEQ ID NO: 6194452 - DNA, 14 bp, Homo sapiens
cttcaacatgtgct

SEQ ID NO: 6194453 - DNA, 14 bp, Homo sapiens
cttcaacatgtgtg

SEQ ID NO: 6194454 - DNA, 22 bp, Homo sapiens
cttcaaccagggattgtttctg

SEQ ID NO: 6194455 - DNA, 23 bp, Homo sapiens
cttcaaccccacttcctactgta

SEQ ID NO: 6194456 - DNA, 15 bp, Homo sapiens
cttcaaccccctcgc

SEQ ID NO: 6194457 - DNA, 21 bp, Homo sapiens
cttcaaccccctcgcctccta

SEQ ID NO: 6194458 - DNA, 19 bp, Homo sapiens
cttcaaccccgaggtccct

SEQ ID NO: 6194459 - DNA, 16 bp, Homo sapiens
cttcaaccctcagcct

SEQ ID NO: 6194460 - DNA, 14 bp, Homo sapiens
cttcaaccctgccc

SEQ ID NO: 6194461 - DNA, 16 bp, Homo sapiens
cttcaacgtttcttca

SEQ ID NO: 6194462 - DNA, 17 bp, Homo sapiens
cttcaacgtttcttcac

SEQ ID NO: 6194463 - DNA, 22 bp, Homo sapiens
cttcaacgtttcttcacttttg

SEQ ID NO: 6194464 - DNA, 13 bp, Homo sapiens
cttcaactcctgg

SEQ ID NO: 6194465 - DNA, 15 bp, Homo sapiens
cttcaactcctggct

SEQ ID NO: 6194466 - DNA, 15 bp, Homo sapiens
cttcaactcctgggc

SEQ ID NO: 6194467 - DNA, 16 bp, Homo sapiens
cttcaactgtctgtct

SEQ ID NO: 6194468 - DNA, 23 bp, Homo sapiens
cttcaagaaagaattcctgcagc

SEQ ID NO: 6194469 - DNA, 18 bp, Homo sapiens
cttcaagaactctgggct

SEQ ID NO: 6194470 - DNA, 17 bp, Homo sapiens
cttcaagaatcagaaga

SEQ ID NO: 6194471 - DNA, 14 bp, Homo sapiens
cttcaagaatgcag

SEQ ID NO: 6194472 - DNA, 18 bp, Homo sapiens
cttcaagacgaggggcag

SEQ ID NO: 6194473 - DNA, 13 bp, Homo sapiens
cttcaagaggaaa

SEQ ID NO: 6194474 - DNA, 22 bp, Homo sapiens
cttcaagaggaaaggcgccccc

SEQ ID NO: 6194475 - DNA, 23 bp, Homo sapiens
cttcaagatcctcttgccacatc

SEQ ID NO: 6194476 - DNA, 20 bp, Homo sapiens
cttcaagatgagcctgggct

SEQ ID NO: 6194477 - DNA, 16 bp, Homo sapiens
cttcaagcaaagacag

SEQ ID NO: 6194478 - DNA, 15 bp, Homo sapiens
cttcaagcacctgca

SEQ ID NO: 6194479 - DNA, 18 bp, Homo sapiens
cttcaagccagctctagg

SEQ ID NO: 6194480 - DNA, 16 bp, Homo sapiens
cttcaagcctggccca

SEQ ID NO: 6194481 - DNA, 17 bp, Homo sapiens
cttcaagcgctccaggg

SEQ ID NO: 6194482 - DNA, 12 bp, Homo sapiens
cttcaagctctc

SEQ ID NO: 6194483 - DNA, 20 bp, Homo sapiens
cttcaagctctgagggaaag

SEQ ID NO: 6194484 - DNA, 18 bp, Homo sapiens
cttcaagctgctttttgt

SEQ ID NO: 6194485 - DNA, 23 bp, Homo sapiens
cttcaagctgttatttcttccct

SEQ ID NO: 6194486 - DNA, 15 bp, Homo sapiens
cttcaaggaaaataa

SEQ ID NO: 6194487 - DNA, 17 bp, Homo sapiens
cttcaaggactgtttca

SEQ ID NO: 6194488 - DNA, 21 bp, Homo sapiens
cttcaaggactgtttcagtgt

SEQ ID NO: 6194489 - DNA, 17 bp, Homo sapiens
cttcaaggatcctgagc

SEQ ID NO: 6194490 - DNA, 18 bp, Homo sapiens
cttcaaggatcctgagcc

SEQ ID NO: 6194491 - DNA, 21 bp, Homo sapiens
cttcaaggatcctgagccaga

SEQ ID NO: 6194492 - DNA, 15 bp, Homo sapiens
cttcaaggcttcagt

SEQ ID NO: 6194493 - DNA, 19 bp, Homo sapiens
cttcaaggcttcagtctca

SEQ ID NO: 6194494 - DNA, 18 bp, Homo sapiens
cttcaagggaagaaacac

SEQ ID NO: 6194495 - DNA, 17 bp, Homo sapiens
cttcaagggctgcttca

SEQ ID NO: 6194496 - DNA, 15 bp, Homo sapiens
cttcaaggtgacaga

SEQ ID NO: 6194497 - DNA, 19 bp, Homo sapiens
cttcaagtaagatcaagaa

SEQ ID NO: 6194498 - DNA, 17 bp, Homo sapiens
cttcaagtaatacgttt

SEQ ID NO: 6194499 - DNA, 16 bp, Homo sapiens
cttcaagtctgtgcct

SEQ ID NO: 6194500 - DNA, 17 bp, Homo sapiens
cttcaagtctgtgcctg

SEQ ID NO: 6194501 - DNA, 18 bp, Homo sapiens
cttcaagtctgtgcctgg

SEQ ID NO: 6194502 - DNA, 21 bp, Homo sapiens
cttcaagtgatatatgtattt

SEQ ID NO: 6194503 - DNA, 12 bp, Homo sapiens
cttcaagtgcca

SEQ ID NO: 6194504 - DNA, 12 bp, Homo sapiens
cttcaagtgcct

SEQ ID NO: 6194505 - DNA, 23 bp, Homo sapiens
cttcaagtgccttttgctgcgca

SEQ ID NO: 6194506 - DNA, 20 bp, Homo sapiens
cttcaagtgttgctcttgga

SEQ ID NO: 6194507 - DNA, 19 bp, Homo sapiens
cttcaataaaatggttcat

SEQ ID NO: 6194508 - DNA, 20 bp, Homo sapiens
cttcaataaaccacaagcat

SEQ ID NO: 6194509 - DNA, 15 bp, Homo sapiens
cttcaataaatcttt

SEQ ID NO: 6194510 - DNA, 18 bp, Homo sapiens
cttcaataaattttttct

SEQ ID NO: 6194511 - DNA, 16 bp, Homo sapiens
cttcaataattgtcca

SEQ ID NO: 6194512 - DNA, 16 bp, Homo sapiens
cttcaatactgaaaat

SEQ ID NO: 6194513 - DNA, 17 bp, Homo sapiens
cttcaatacttaaaaat

SEQ ID NO: 6194514 - DNA, 20 bp, Homo sapiens
cttcaatcaataacagccgc

SEQ ID NO: 6194515 - DNA, 13 bp, Homo sapiens
cttcaatcactgt

SEQ ID NO: 6194516 - DNA, 13 bp, Homo sapiens
cttcaatcccagc

SEQ ID NO: 6194517 - DNA, 17 bp, Homo sapiens
cttcaatccttgaaggt

SEQ ID NO: 6194518 - DNA, 21 bp, Homo sapiens
cttcaatcggcttgtgggtga

SEQ ID NO: 6194519 - DNA, 15 bp, Homo sapiens
cttcaatctcgttta

SEQ ID NO: 6194520 - DNA, 13 bp, Homo sapiens
cttcaatctctgg

SEQ ID NO: 6194521 - DNA, 18 bp, Homo sapiens
cttcaatgaattaattca

SEQ ID NO: 6194522 - DNA, 16 bp, Homo sapiens
cttcaatgctagaaaa

SEQ ID NO: 6194523 - DNA, 18 bp, Homo sapiens
cttcaatgctagaaaatc

SEQ ID NO: 6194524 - DNA, 14 bp, Homo sapiens
cttcaatggaatac

SEQ ID NO: 6194525 - DNA, 19 bp, Homo sapiens
cttcaatggaatacagtca

SEQ ID NO: 6194526 - DNA, 16 bp, Homo sapiens
cttcaatgggagtgaa

SEQ ID NO: 6194527 - DNA, 16 bp, Homo sapiens
cttcaattaaaattac

SEQ ID NO: 6194528 - DNA, 22 bp, Homo sapiens
cttcaattaaaattacaaaaga

SEQ ID NO: 6194529 - DNA, 16 bp, Homo sapiens
cttcaattaatggaaa

SEQ ID NO: 6194530 - DNA, 22 bp, Homo sapiens
cttcaattaatggaaaactgtt

SEQ ID NO: 6194531 - DNA, 16 bp, Homo sapiens
cttcaattggtggaat

SEQ ID NO: 6194532 - DNA, 22 bp, Homo sapiens
cttcaattggtggaattcctct

SEQ ID NO: 6194533 - DNA, 20 bp, Homo sapiens
cttcaatttattactgaaaa

SEQ ID NO: 6194534 - DNA, 17 bp, Homo sapiens
cttcaatttcaaacttt

SEQ ID NO: 6194535 - DNA, 22 bp, Homo sapiens
cttcaatttctagtacctgtga

SEQ ID NO: 6194536 - DNA, 22 bp, Homo sapiens
cttcaatttgtagactcttgct

SEQ ID NO: 6194537 - DNA, 14 bp, Homo sapiens
cttcacaaagccaa

SEQ ID NO: 6194538 - DNA, 17 bp, Homo sapiens
cttcacaaagccaagcc

SEQ ID NO: 6194539 - DNA, 15 bp, Homo sapiens
cttcacaaagcccaa

SEQ ID NO: 6194540 - DNA, 17 bp, Homo sapiens
cttcacaaagcccaagg

SEQ ID NO: 6194541 - DNA, 22 bp, Homo sapiens
cttcacaaatgtcattgtctac

SEQ ID NO: 6194542 - DNA, 17 bp, Homo sapiens
cttcacaaccagccaca

SEQ ID NO: 6194543 - DNA, 21 bp, Homo sapiens
cttcacaaccagccacacaga

SEQ ID NO: 6194544 - DNA, 22 bp, Homo sapiens
cttcacaaccagccacacagag

SEQ ID NO: 6194545 - DNA, 23 bp, Homo sapiens
cttcacaaccagccacacagagc

SEQ ID NO: 6194546 - DNA, 21 bp, Homo sapiens
cttcacaacctccgtgctggg

SEQ ID NO: 6194547 - DNA, 22 bp, Homo sapiens
cttcacaacctccgtgctgggc

SEQ ID NO: 6194548 - DNA, 15 bp, Homo sapiens
cttcacaatttcaat

SEQ ID NO: 6194549 - DNA, 14 bp, Homo sapiens
cttcacacaaagtg

SEQ ID NO: 6194550 - DNA, 17 bp, Homo sapiens
cttcacacaaagtgaaa

SEQ ID NO: 6194551 - DNA, 19 bp, Homo sapiens
cttcacacaaagtgaaatt

SEQ ID NO: 6194552 - DNA, 20 bp, Homo sapiens
cttcacacaaagtgaaatta

SEQ ID NO: 6194553 - DNA, 22 bp, Homo sapiens
cttcacacagcacctcctctct

SEQ ID NO: 6194554 - DNA, 14 bp, Homo sapiens
gaagtgacttgaat

SEQ ID NO: 6194555 - DNA, 17 bp, Homo sapiens
gaagtgacttgaatgta

SEQ ID NO: 6194556 - DNA, 23 bp, Homo sapiens
gaagtgacttgaatgtacaaaga

SEQ ID NO: 6194557 - DNA, 15 bp, Homo sapiens
gaagtgactttggct

SEQ ID NO: 6194558 - DNA, 20 bp, Homo sapiens
gaagtgactttggctgcatg

SEQ ID NO: 6194559 - DNA, 16 bp, Homo sapiens
gaagtgagaaaatgaa

SEQ ID NO: 6194560 - DNA, 21 bp, Homo sapiens
gaagtgagagaaaaaggtcct

SEQ ID NO: 6194561 - DNA, 17 bp, Homo sapiens
gaagtgagagctttgct

SEQ ID NO: 6194562 - DNA, 19 bp, Homo sapiens
gaagtgagagctttgctta

SEQ ID NO: 6194563 - DNA, 16 bp, Homo sapiens
gaagtgagatacaaag

SEQ ID NO: 6194564 - DNA, 21 bp, Homo sapiens
gaagtgagcagtcgcctgcct

SEQ ID NO: 6194565 - DNA, 17 bp, Homo sapiens
gaagtgagcccccccct

SEQ ID NO: 6194566 - DNA, 15 bp, Homo sapiens
gaagtgaggcccaag

SEQ ID NO: 6194567 - DNA, 12 bp, Homo sapiens
gaagtgaggcct

SEQ ID NO: 6194568 - DNA, 22 bp, Homo sapiens
gaagtgagggctcactcagcca

SEQ ID NO: 6194569 - DNA, 18 bp, Homo sapiens
gaagtgagtttgtaaata

SEQ ID NO: 6194570 - DNA, 17 bp, Homo sapiens
gaagtgatatggtgaag

SEQ ID NO: 6194571 - DNA, 18 bp, Homo sapiens
gaagtgattctaagattt

SEQ ID NO: 6194572 - DNA, 18 bp, Homo sapiens
gaagtgcacaggagccaa

SEQ ID NO: 6194573 - DNA, 18 bp, Homo sapiens
gaagtgcagaactgcagt

SEQ ID NO: 6194574 - DNA, 24 bp, Homo sapiens
gaagtgcagtcagcagatgctgtt

SEQ ID NO: 6194575 - DNA, 23 bp, Homo sapiens
gaagtgcatcctgattattttca

SEQ ID NO: 6194576 - DNA, 15 bp, Homo sapiens
gaagtgcatgggtca

SEQ ID NO: 6194577 - DNA, 18 bp, Homo sapiens
gaagtgcatgggtcaggg

SEQ ID NO: 6194578 - DNA, 20 bp, Homo sapiens
gaagtgcatgggtcagggtg

SEQ ID NO: 6194579 - DNA, 22 bp, Homo sapiens
gaagtgcatgggtcagggtgtg

SEQ ID NO: 6194580 - DNA, 12 bp, Homo sapiens
gaagtgcatgtt

SEQ ID NO: 6194581 - DNA, 23 bp, Homo sapiens
gaagtgcatttctgaatagaaat

SEQ ID NO: 6194582 - DNA, 14 bp, Homo sapiens
gaagtgccacatga

SEQ ID NO: 6194583 - DNA, 15 bp, Homo sapiens
gaagtgccatctcaa

SEQ ID NO: 6194584 - DNA, 13 bp, Homo sapiens
gaagtgcccagcc

SEQ ID NO: 6194585 - DNA, 17 bp, Homo sapiens
gaagtgcccagcccctg

SEQ ID NO: 6194586 - DNA, 16 bp, Homo sapiens
gaagtgccccctcccc

SEQ ID NO: 6194587 - DNA, 13 bp, Homo sapiens
gaagtgcccctgc

SEQ ID NO: 6194588 - DNA, 16 bp, Homo sapiens
gaagtgcccttcctgc

SEQ ID NO: 6194589 - DNA, 14 bp, Homo sapiens
gaagtgcctactgg

SEQ ID NO: 6194590 - DNA, 20 bp, Homo sapiens
gaagtgccttctccttcccc

SEQ ID NO: 6194591 - DNA, 16 bp, Homo sapiens
gaagtgcgtgaatgta

SEQ ID NO: 6194592 - DNA, 19 bp, Homo sapiens
gaagtgcgtggtataatct

SEQ ID NO: 6194593 - DNA, 18 bp, Homo sapiens
gaagtgctccccacacgt

SEQ ID NO: 6194594 - DNA, 20 bp, Homo sapiens
gaagtgctcccctctgaaag

SEQ ID NO: 6194595 - DNA, 12 bp, Homo sapiens
gaagtgctccct

SEQ ID NO: 6194596 - DNA, 21 bp, Homo sapiens
gaagtgctctaacttttctta

SEQ ID NO: 6194597 - DNA, 20 bp, Homo sapiens
gaagtgctcttggctgaccc

SEQ ID NO: 6194598 - DNA, 21 bp, Homo sapiens
gaagtgctgccgcgcagtgtg

SEQ ID NO: 6194599 - DNA, 14 bp, Homo sapiens
gaagtgctgctcca

SEQ ID NO: 6194600 - DNA, 22 bp, Homo sapiens
gaagtgcttaacgttttcttaa

SEQ ID NO: 6194601 - DNA, 18 bp, Homo sapiens
gaagtgcttgatatgtaa

SEQ ID NO: 6194602 - DNA, 12 bp, Homo sapiens
gaagtggaatgg

SEQ ID NO: 6194603 - DNA, 20 bp, Homo sapiens
gaagtggactggcccctggg

SEQ ID NO: 6194604 - DNA, 18 bp, Homo sapiens
gaagtggaggttgctgta

SEQ ID NO: 6194605 - DNA, 18 bp, Homo sapiens
gaagtggcaggaggacag

SEQ ID NO: 6194606 - DNA, 12 bp, Homo sapiens
gaagtggcccct

SEQ ID NO: 6194607 - DNA, 21 bp, Homo sapiens
gaagtggctcagacccctcag

SEQ ID NO: 6194608 - DNA, 12 bp, Homo sapiens
gaagtggctggt

SEQ ID NO: 6194609 - DNA, 20 bp, Homo sapiens
gaagtggctggtagaaaaag

SEQ ID NO: 6194610 - DNA, 18 bp, Homo sapiens
gaagtggctggtctggag

SEQ ID NO: 6194611 - DNA, 20 bp, Homo sapiens
gaagtggctggtctggagtc

SEQ ID NO: 6194612 - DNA, 18 bp, Homo sapiens
gaagtgggaaaaaataga

SEQ ID NO: 6194613 - DNA, 12 bp, Homo sapiens
gaagtgggagaa

SEQ ID NO: 6194614 - DNA, 16 bp, Homo sapiens
gaagtgggagaagtgg

SEQ ID NO: 6194615 - DNA, 20 bp, Homo sapiens
gaagtgggagaagtggcccc

SEQ ID NO: 6194616 - DNA, 22 bp, Homo sapiens
gaagtgggagcagcttcttggg

SEQ ID NO: 6194617 - DNA, 21 bp, Homo sapiens
gaagtgggagtgggagaggaa

SEQ ID NO: 6194618 - DNA, 21 bp, Homo sapiens
gaagtgggattcaggaatggg

SEQ ID NO: 6194619 - DNA, 16 bp, Homo sapiens
gaagtgggccaggaca

SEQ ID NO: 6194620 - DNA, 18 bp, Homo sapiens
gaagtgggccagtcctgg

SEQ ID NO: 6194621 - DNA, 20 bp, Homo sapiens
gaagtggggaccccacccct

SEQ ID NO: 6194622 - DNA, 21 bp, Homo sapiens
gaagtggggaccccacccctc

SEQ ID NO: 6194623 - DNA, 22 bp, Homo sapiens
gaagtggggaccccacccctca

SEQ ID NO: 6194624 - DNA, 23 bp, Homo sapiens
gaagtggggaccccacccctcat

SEQ ID NO: 6194625 - DNA, 16 bp, Homo sapiens
gaagtgggggccgctg

SEQ ID NO: 6194626 - DNA, 22 bp, Homo sapiens
gaagtgggggccgctggcccag

SEQ ID NO: 6194627 - DNA, 14 bp, Homo sapiens
gaagtggggtctgg

SEQ ID NO: 6194628 - DNA, 15 bp, Homo sapiens
gaagtggggtgttct

SEQ ID NO: 6194629 - DNA, 19 bp, Homo sapiens
gaagtggggtgttcttctt

SEQ ID NO: 6194630 - DNA, 13 bp, Homo sapiens
gaagtggtccaga

SEQ ID NO: 6194631 - DNA, 13 bp, Homo sapiens
gaagtggtgacat

SEQ ID NO: 6194632 - DNA, 20 bp, Homo sapiens
gaagtggtgtgatcccagct

SEQ ID NO: 6194633 - DNA, 16 bp, Homo sapiens
gaagtggtgttttttt

SEQ ID NO: 6194634 - DNA, 16 bp, Homo sapiens
gaagtggttcagtcta

SEQ ID NO: 6194635 - DNA, 15 bp, Homo sapiens
gaagtgtaacagctg

SEQ ID NO: 6194636 - DNA, 18 bp, Homo sapiens
gaagtgtaggcagacaca

SEQ ID NO: 6194637 - DNA, 14 bp, Homo sapiens
gaagtgtataatat

SEQ ID NO: 6194638 - DNA, 21 bp, Homo sapiens
gaagtgtataatataaaaaat

SEQ ID NO: 6194639 - DNA, 20 bp, Homo sapiens
gaagtgtcaccctgtgggtg

SEQ ID NO: 6194640 - DNA, 22 bp, Homo sapiens
gaagtgtcaccctgtgggtgtc

SEQ ID NO: 6194641 - DNA, 16 bp, Homo sapiens
gaagtgtcgaaagcaa

SEQ ID NO: 6194642 - DNA, 15 bp, Homo sapiens
gaagtgtctgccagc

SEQ ID NO: 6194643 - DNA, 17 bp, Homo sapiens
gaagtgtctgccagctg

SEQ ID NO: 6194644 - DNA, 20 bp, Homo sapiens
gaagtgtcttctgttcccaa

SEQ ID NO: 6194645 - DNA, 20 bp, Homo sapiens
gaagtgtgccttctctctcc

SEQ ID NO: 6194646 - DNA, 14 bp, Homo sapiens
gaagtgtgctgagg

SEQ ID NO: 6194647 - DNA, 18 bp, Homo sapiens
gaagtgtgctgaggtggg

SEQ ID NO: 6194648 - DNA, 17 bp, Homo sapiens
gaagtgtgggtctgtgt

SEQ ID NO: 6194649 - DNA, 19 bp, Homo sapiens
gaagtgtgtgtttcttgct

SEQ ID NO: 6194650 - DNA, 16 bp, Homo sapiens
gaagtgtgttctgatg

SEQ ID NO: 6194651 - DNA, 11 bp, Homo sapiens
gaagtgttaat

SEQ ID NO: 6194652 - DNA, 16 bp, Homo sapiens
gaagtgttaatacatc

SEQ ID NO: 6194653 - DNA, 18 bp, Homo sapiens
gaagtgttaatacatcac

SEQ ID NO: 6194654 - DNA, 22 bp, Homo sapiens
gaagtgttatttcatccaggga

SEQ ID NO: 6194655 - DNA, 15 bp, Homo sapiens
gaagtgttcctgtct

SEQ ID NO: 6194656 - DNA, 17 bp, Homo sapiens
gaagtgttcctgtctca

SEQ ID NO: 6194657 - DNA, 18 bp, Homo sapiens
gaagtgttgaagggaggt

SEQ ID NO: 6194658 - DNA, 15 bp, Homo sapiens
gaagtgttgcatgga

SEQ ID NO: 6194659 - DNA, 22 bp, Homo sapiens
gaagtgtttcacgagagcccgg

SEQ ID NO: 6194660 - DNA, 12 bp, Homo sapiens
gaagtgtttctg

SEQ ID NO: 6194661 - DNA, 22 bp, Homo sapiens
gaagttaaactattttgagcat

SEQ ID NO: 6194662 - DNA, 18 bp, Homo sapiens
gaagttaacagtctcatt

SEQ ID NO: 6194663 - DNA, 23 bp, Homo sapiens
gaagttaagcagcctttctgtgg

SEQ ID NO: 6194664 - DNA, 17 bp, Homo sapiens
gaagttacatgcataaa

SEQ ID NO: 6194665 - DNA, 19 bp, Homo sapiens
gaagttacatgcataaaag

SEQ ID NO: 6194666 - DNA, 20 bp, Homo sapiens
gaagttacctggatgccatt

SEQ ID NO: 6194667 - DNA, 12 bp, Homo sapiens
gaagttaccttt

SEQ ID NO: 6194668 - DNA, 22 bp, Homo sapiens
gaagttaccttttataagacaa

SEQ ID NO: 6194669 - DNA, 18 bp, Homo sapiens
gaagttactgttatagag

SEQ ID NO: 6194670 - DNA, 14 bp, Homo sapiens
gaagttagaattcc

SEQ ID NO: 6194671 - DNA, 20 bp, Homo sapiens
gaagttagaattccttcagg

SEQ ID NO: 6194672 - DNA, 19 bp, Homo sapiens
gaagttagagataattctg

SEQ ID NO: 6194673 - DNA, 20 bp, Homo sapiens
gaagttagagataattctga

SEQ ID NO: 6194674 - DNA, 11 bp, Homo sapiens
gaagttagcct

SEQ ID NO: 6194675 - DNA, 21 bp, Homo sapiens
gaagttagcctttatctacca

SEQ ID NO: 6194676 - DNA, 22 bp, Homo sapiens
gaagttagcctttatctaccaa

SEQ ID NO: 6194677 - DNA, 19 bp, Homo sapiens
gaagttagctttaacttaa

SEQ ID NO: 6194678 - DNA, 22 bp, Homo sapiens
gaagttaggttcttaaaagtgc

SEQ ID NO: 6194679 - DNA, 15 bp, Homo sapiens
gaagttagtggaaat

SEQ ID NO: 6194680 - DNA, 20 bp, Homo sapiens
gaagttatctgctgggaaca

SEQ ID NO: 6194681 - DNA, 13 bp, Homo sapiens
gaagttatctgtg

SEQ ID NO: 6194682 - DNA, 14 bp, Homo sapiens
gaagttattttcca

SEQ ID NO: 6194683 - DNA, 21 bp, Homo sapiens
gaagttattttctacagtggt

SEQ ID NO: 6194684 - DNA, 15 bp, Homo sapiens
gaagttcaagatcaa

SEQ ID NO: 6194685 - DNA, 16 bp, Homo sapiens
gaagttcaccagccct

SEQ ID NO: 6194686 - DNA, 20 bp, Homo sapiens
gaagttcaccagccctgagc

SEQ ID NO: 6194687 - DNA, 19 bp, Homo sapiens
gaagttcaccattaaaagg

SEQ ID NO: 6194688 - DNA, 22 bp, Homo sapiens
gaagttcaccattaaaagggat

SEQ ID NO: 6194689 - DNA, 18 bp, Homo sapiens
gaagttcagaaatttaaa

SEQ ID NO: 6194690 - DNA, 20 bp, Homo sapiens
gaagttcagaaggtgtgtcc

SEQ ID NO: 6194691 - DNA, 15 bp, Homo sapiens
gaagttcatacctaa

SEQ ID NO: 6194692 - DNA, 14 bp, Homo sapiens
gaagttcattttta

SEQ ID NO: 6194693 - DNA, 14 bp, Homo sapiens
gaagttcccattat

SEQ ID NO: 6194694 - DNA, 16 bp, Homo sapiens
gaagttctaggaaatt

SEQ ID NO: 6194695 - DNA, 15 bp, Homo sapiens
gaagttctagtgttt

SEQ ID NO: 6194696 - DNA, 20 bp, Homo sapiens
gaagttctcaaagttaattc

SEQ ID NO: 6194697 - DNA, 18 bp, Homo sapiens
gaagttctcagaataact

SEQ ID NO: 6194698 - DNA, 15 bp, Homo sapiens
gaagttctgaaattt

SEQ ID NO: 6194699 - DNA, 18 bp, Homo sapiens
gaagttctgcctctgatg

SEQ ID NO: 6194700 - DNA, 16 bp, Homo sapiens
gaagttctggcaagat

SEQ ID NO: 6194701 - DNA, 19 bp, Homo sapiens
gaagttcttcaagaggaaa

SEQ ID NO: 6194702 - DNA, 14 bp, Homo sapiens
gaagttctttgatt

SEQ ID NO: 6194703 - DNA, 20 bp, Homo sapiens
gaagttgaataaacataaaa

SEQ ID NO: 6194704 - DNA, 18 bp, Homo sapiens
gaagttgatatagaacag

SEQ ID NO: 6194705 - DNA, 16 bp, Homo sapiens
gaagttgattcatatt

SEQ ID NO: 6194706 - DNA, 22 bp, Homo sapiens
gaagttgattcttatttgatgg

SEQ ID NO: 6194707 - DNA, 16 bp, Homo sapiens
gaagttgccaagagtt

SEQ ID NO: 6194708 - DNA, 14 bp, Homo sapiens
gaagttgctgcttc

SEQ ID NO: 6194709 - DNA, 15 bp, Homo sapiens
gaagttggaaatttt

SEQ ID NO: 6194710 - DNA, 14 bp, Homo sapiens
gaagttggcacatt

SEQ ID NO: 6194711 - DNA, 15 bp, Homo sapiens
gaagttggccacctt

SEQ ID NO: 6194712 - DNA, 19 bp, Homo sapiens
gaagttggggcactgggcg

SEQ ID NO: 6194713 - DNA, 22 bp, Homo sapiens
gaagttggtttagctttggaaa

SEQ ID NO: 6194714 - DNA, 15 bp, Homo sapiens
gaagttgtctccttc

SEQ ID NO: 6194715 - DNA, 17 bp, Homo sapiens
gaagttgtctccttcca

SEQ ID NO: 6194716 - DNA, 19 bp, Homo sapiens
gaagttgtgaaactaaaat

SEQ ID NO: 6194717 - DNA, 19 bp, Homo sapiens
gaagttgtgctaaaccaag

SEQ ID NO: 6194718 - DNA, 18 bp, Homo sapiens
gaagttgtggaggaggtg

SEQ ID NO: 6194719 - DNA, 14 bp, Homo sapiens
gaagttgtttgtca

SEQ ID NO: 6194720 - DNA, 13 bp, Homo sapiens
gaagtttaaaaca

SEQ ID NO: 6194721 - DNA, 14 bp, Homo sapiens
gaagtttaaatctt

SEQ ID NO: 6194722 - DNA, 23 bp, Homo sapiens
gaagtttaacaagtatttattcc

SEQ ID NO: 6194723 - DNA, 17 bp, Homo sapiens
gaagtttaagtaagtaa

SEQ ID NO: 6194724 - DNA, 16 bp, Homo sapiens
gaagtttacattgtaa

SEQ ID NO: 6194725 - DNA, 17 bp, Homo sapiens
gaagtttacattgtaaa

SEQ ID NO: 6194726 - DNA, 21 bp, Homo sapiens
gaagtttacatttttatttat

SEQ ID NO: 6194727 - DNA, 17 bp, Homo sapiens
gaagtttagctctgaga

SEQ ID NO: 6194728 - DNA, 19 bp, Homo sapiens
gaagtttattattttcaaa

SEQ ID NO: 6194729 - DNA, 17 bp, Homo sapiens
gaagtttattctcattt

SEQ ID NO: 6194730 - DNA, 14 bp, Homo sapiens
gaagtttatttcct

SEQ ID NO: 6194731 - DNA, 22 bp, Homo sapiens
gaagtttatttgagaaaatata

SEQ ID NO: 6194732 - DNA, 13 bp, Homo sapiens
cttcacacccctc

SEQ ID NO: 6194733 - DNA, 21 bp, Homo sapiens
cttcacactatcaacactgca

SEQ ID NO: 6194734 - DNA, 20 bp, Homo sapiens
cttcacactgcaagagcctt

SEQ ID NO: 6194735 - DNA, 21 bp, Homo sapiens
cttcacactgcaagagccttg

SEQ ID NO: 6194736 - DNA, 22 bp, Homo sapiens
cttcacactggtttgccaggcc

SEQ ID NO: 6194737 - DNA, 15 bp, Homo sapiens
cttcacagaggaaga

SEQ ID NO: 6194738 - DNA, 20 bp, Homo sapiens
cttcacagagtgtgctggag

SEQ ID NO: 6194739 - DNA, 23 bp, Homo sapiens
cttcacagagtgtgctggaggac

SEQ ID NO: 6194740 - DNA, 13 bp, Homo sapiens
cttcacagatgcc

SEQ ID NO: 6194741 - DNA, 14 bp, Homo sapiens
cttcacagatgcct

SEQ ID NO: 6194742 - DNA, 16 bp, Homo sapiens
cttcacagatgcctac

SEQ ID NO: 6194743 - DNA, 12 bp, Homo sapiens
cttcacagcgtc

SEQ ID NO: 6194744 - DNA, 15 bp, Homo sapiens
cttcacagcgtctgc

SEQ ID NO: 6194745 - DNA, 18 bp, Homo sapiens
cttcacagcgtctgctca

SEQ ID NO: 6194746 - DNA, 16 bp, Homo sapiens
cttcacagctctgtgt

SEQ ID NO: 6194747 - DNA, 15 bp, Homo sapiens
cttcacaggcagtgc

SEQ ID NO: 6194748 - DNA, 18 bp, Homo sapiens
cttcacaggcagtgcatg

SEQ ID NO: 6194749 - DNA, 19 bp, Homo sapiens
cttcacaggcagtgcatgt

SEQ ID NO: 6194750 - DNA, 20 bp, Homo sapiens
cttcacaggcagtgcatgtg

SEQ ID NO: 6194751 - DNA, 19 bp, Homo sapiens
cttcacagggacagatctg

SEQ ID NO: 6194752 - DNA, 16 bp, Homo sapiens
cttcacagtacttccc

SEQ ID NO: 6194753 - DNA, 18 bp, Homo sapiens
cttcacagtacttcccaa

SEQ ID NO: 6194754 - DNA, 18 bp, Homo sapiens
cttcacagtagagccagc

SEQ ID NO: 6194755 - DNA, 22 bp, Homo sapiens
cttcacagtagagccagcttgg

SEQ ID NO: 6194756 - DNA, 15 bp, Homo sapiens
cttcacagtcccagg

SEQ ID NO: 6194757 - DNA, 16 bp, Homo sapiens
cttcacagtcccaggt

SEQ ID NO: 6194758 - DNA, 15 bp, Homo sapiens
cttcacagtctggtg

SEQ ID NO: 6194759 - DNA, 17 bp, Homo sapiens
cttcacagtctggtgct

SEQ ID NO: 6194760 - DNA, 12 bp, Homo sapiens
cttcacagtgtt

SEQ ID NO: 6194761 - DNA, 13 bp, Homo sapiens
cttcacagtgttt

SEQ ID NO: 6194762 - DNA, 14 bp, Homo sapiens
cttcacagtgtttc

SEQ ID NO: 6194763 - DNA, 20 bp, Homo sapiens
cttcacataagctcagaatc

SEQ ID NO: 6194764 - DNA, 14 bp, Homo sapiens
cttcacatattgat

SEQ ID NO: 6194765 - DNA, 12 bp, Homo sapiens
cttcacatttaa

SEQ ID NO: 6194766 - DNA, 23 bp, Homo sapiens
cttcacatttgtatgtgtgtaga

SEQ ID NO: 6194767 - DNA, 13 bp, Homo sapiens
cttcaccaaatat

SEQ ID NO: 6194768 - DNA, 16 bp, Homo sapiens
cttcaccaagaagcaa

SEQ ID NO: 6194769 - DNA, 17 bp, Homo sapiens
cttcaccaccccctgtc

SEQ ID NO: 6194770 - DNA, 18 bp, Homo sapiens
cttcaccagagcccatgc

SEQ ID NO: 6194771 - DNA, 23 bp, Homo sapiens
cttcaccagcaactctgactctt

SEQ ID NO: 6194772 - DNA, 13 bp, Homo sapiens
cttcaccaggaag

SEQ ID NO: 6194773 - DNA, 14 bp, Homo sapiens
cttcaccaggtgca

SEQ ID NO: 6194774 - DNA, 19 bp, Homo sapiens
cttcaccagtctgtctact

SEQ ID NO: 6194775 - DNA, 23 bp, Homo sapiens
cttcaccagtctgtctactgtgg

SEQ ID NO: 6194776 - DNA, 17 bp, Homo sapiens
cttcaccatcaatcctg

SEQ ID NO: 6194777 - DNA, 21 bp, Homo sapiens
cttcaccatcttggccaggct

SEQ ID NO: 6194778 - DNA, 17 bp, Homo sapiens
cttcaccatctttctga

SEQ ID NO: 6194779 - DNA, 22 bp, Homo sapiens
cttcacccaccacccccatcat

SEQ ID NO: 6194780 - DNA, 16 bp, Homo sapiens
cttcacccaccaggcc

SEQ ID NO: 6194781 - DNA, 19 bp, Homo sapiens
cttcacccaccaggccagc

SEQ ID NO: 6194782 - DNA, 18 bp, Homo sapiens
cttcacccaccccatgga

SEQ ID NO: 6194783 - DNA, 14 bp, Homo sapiens
cttcacccagagct

SEQ ID NO: 6194784 - DNA, 16 bp, Homo sapiens
cttcacccagagctgc

SEQ ID NO: 6194785 - DNA, 22 bp, Homo sapiens
cttcacccagctaatctgtagg

SEQ ID NO: 6194786 - DNA, 14 bp, Homo sapiens
cttcacccatgaaa

SEQ ID NO: 6194787 - DNA, 14 bp, Homo sapiens
cttcaccccagtgg

SEQ ID NO: 6194788 - DNA, 19 bp, Homo sapiens
cttcaccccggcaggccct

SEQ ID NO: 6194789 - DNA, 21 bp, Homo sapiens
cttcacccctacactgtgaag

SEQ ID NO: 6194790 - DNA, 18 bp, Homo sapiens
cttcacccggctgggctc

SEQ ID NO: 6194791 - DNA, 21 bp, Homo sapiens
cttcaccctgaatggttccat

SEQ ID NO: 6194792 - DNA, 15 bp, Homo sapiens
cttcaccgcattcca

SEQ ID NO: 6194793 - DNA, 18 bp, Homo sapiens
cttcaccgcattccaggg

SEQ ID NO: 6194794 - DNA, 16 bp, Homo sapiens
cttcaccgtggctacc

SEQ ID NO: 6194795 - DNA, 15 bp, Homo sapiens
cttcacctcactgaa

SEQ ID NO: 6194796 - DNA, 13 bp, Homo sapiens
cttcacctcagag

SEQ ID NO: 6194797 - DNA, 13 bp, Homo sapiens
cttcacctccttc

SEQ ID NO: 6194798 - DNA, 15 bp, Homo sapiens
cttcacctccttctg

SEQ ID NO: 6194799 - DNA, 11 bp, Homo sapiens
cttcacctcta

SEQ ID NO: 6194800 - DNA, 22 bp, Homo sapiens
cttcacctctgggaccccagct

SEQ ID NO: 6194801 - DNA, 13 bp, Homo sapiens
cttcacctgccac

SEQ ID NO: 6194802 - DNA, 14 bp, Homo sapiens
cttcacctgccacc

SEQ ID NO: 6194803 - DNA, 16 bp, Homo sapiens
cttcacctgccaccac

SEQ ID NO: 6194804 - DNA, 19 bp, Homo sapiens
cttcacctgttatgtatga

SEQ ID NO: 6194805 - DNA, 11 bp, Homo sapiens
cttcaccttct

SEQ ID NO: 6194806 - DNA, 16 bp, Homo sapiens
cttcaccttctgtaat

SEQ ID NO: 6194807 - DNA, 16 bp, Homo sapiens
cttcacctttcctctc

SEQ ID NO: 6194808 - DNA, 21 bp, Homo sapiens
cttcacctttcctctccctca

SEQ ID NO: 6194809 - DNA, 16 bp, Homo sapiens
cttcacctttggtgca

SEQ ID NO: 6194810 - DNA, 22 bp, Homo sapiens
cttcacctttggtgcagaggtt

SEQ ID NO: 6194811 - DNA, 17 bp, Homo sapiens
cttcacctttgtcccca

SEQ ID NO: 6194812 - DNA, 22 bp, Homo sapiens
cttcacgacaatgttgagaagt

SEQ ID NO: 6194813 - DNA, 15 bp, Homo sapiens
cttcacgcccttggc

SEQ ID NO: 6194814 - DNA, 13 bp, Homo sapiens
cttcacgcctggg

SEQ ID NO: 6194815 - DNA, 14 bp, Homo sapiens
cttcacgctggctt

SEQ ID NO: 6194816 - DNA, 17 bp, Homo sapiens
cttcacgctggcttcca

SEQ ID NO: 6194817 - DNA, 18 bp, Homo sapiens
cttcacggactctttgct

SEQ ID NO: 6194818 - DNA, 16 bp, Homo sapiens
cttcacggcaggacaa

SEQ ID NO: 6194819 - DNA, 14 bp, Homo sapiens
cttcacgtattctt

SEQ ID NO: 6194820 - DNA, 23 bp, Homo sapiens
cttcactacaacattagaatatt

SEQ ID NO: 6194821 - DNA, 20 bp, Homo sapiens
cttcactacgtgttcacagg

SEQ ID NO: 6194822 - DNA, 18 bp, Homo sapiens
cttcactattcagaactt

SEQ ID NO: 6194823 - DNA, 13 bp, Homo sapiens
cttcactcacttt

SEQ ID NO: 6194824 - DNA, 13 bp, Homo sapiens
cttcactcagcca

SEQ ID NO: 6194825 - DNA, 17 bp, Homo sapiens
cttcactcagctggact

SEQ ID NO: 6194826 - DNA, 17 bp, Homo sapiens
cttcactccaaagagaa

SEQ ID NO: 6194827 - DNA, 19 bp, Homo sapiens
cttcactccaaagagaaac

SEQ ID NO: 6194828 - DNA, 14 bp, Homo sapiens
cttcactccggtgt

SEQ ID NO: 6194829 - DNA, 23 bp, Homo sapiens
cttcactccggtgtgcctgcagc

SEQ ID NO: 6194830 - DNA, 14 bp, Homo sapiens
cttcactcctgctg

SEQ ID NO: 6194831 - DNA, 17 bp, Homo sapiens
cttcactcgcccccggg

SEQ ID NO: 6194832 - DNA, 15 bp, Homo sapiens
cttcactctctgaag

SEQ ID NO: 6194833 - DNA, 22 bp, Homo sapiens
cttcactctgacagtattaaca

SEQ ID NO: 6194834 - DNA, 13 bp, Homo sapiens
cttcactctggct

SEQ ID NO: 6194835 - DNA, 19 bp, Homo sapiens
cttcactcttcaaatgcct

SEQ ID NO: 6194836 - DNA, 13 bp, Homo sapiens
cttcactgaccag

SEQ ID NO: 6194837 - DNA, 18 bp, Homo sapiens
cttcactgaccagcggct

SEQ ID NO: 6194838 - DNA, 19 bp, Homo sapiens
cttcactgcaattttgtgt

SEQ ID NO: 6194839 - DNA, 17 bp, Homo sapiens
cttcactgcagcctttc

SEQ ID NO: 6194840 - DNA, 22 bp, Homo sapiens
cttcactgcagcctttcacagg

SEQ ID NO: 6194841 - DNA, 14 bp, Homo sapiens
cttcactgccatga

SEQ ID NO: 6194842 - DNA, 13 bp, Homo sapiens
cttcactgcccag

SEQ ID NO: 6194843 - DNA, 23 bp, Homo sapiens
cttcactgccccacttctggcat

SEQ ID NO: 6194844 - DNA, 24 bp, Homo sapiens
cttcactgccccacttctggcatg

SEQ ID NO: 6194845 - DNA, 14 bp, Homo sapiens
cttcactgcctttg

SEQ ID NO: 6194846 - DNA, 17 bp, Homo sapiens
cttcactgcctttgctc

SEQ ID NO: 6194847 - DNA, 15 bp, Homo sapiens
cttcactgctacatg

SEQ ID NO: 6194848 - DNA, 15 bp, Homo sapiens
cttcactgctctgcc

SEQ ID NO: 6194849 - DNA, 16 bp, Homo sapiens
cttcactggcgccttc

SEQ ID NO: 6194850 - DNA, 14 bp, Homo sapiens
cttcactgggccag

SEQ ID NO: 6194851 - DNA, 15 bp, Homo sapiens
cttcactgggccagt

SEQ ID NO: 6194852 - DNA, 21 bp, Homo sapiens
cttcactggtgtacatcgttt

SEQ ID NO: 6194853 - DNA, 12 bp, Homo sapiens
cttcactgtata

SEQ ID NO: 6194854 - DNA, 18 bp, Homo sapiens
cttcactgtatataaaca

SEQ ID NO: 6194855 - DNA, 19 bp, Homo sapiens
cttcactgtatataaacat

SEQ ID NO: 6194856 - DNA, 21 bp, Homo sapiens
cttcactgtcctccaagccag

SEQ ID NO: 6194857 - DNA, 16 bp, Homo sapiens
cttcactgtctgttgt

SEQ ID NO: 6194858 - DNA, 19 bp, Homo sapiens
cttcactgtgaccttgaga

SEQ ID NO: 6194859 - DNA, 21 bp, Homo sapiens
cttcactgtggccacagcccc

SEQ ID NO: 6194860 - DNA, 12 bp, Homo sapiens
cttcactgttcc

SEQ ID NO: 6194861 - DNA, 21 bp, Homo sapiens
cttcactgttccctctggctt

SEQ ID NO: 6194862 - DNA, 23 bp, Homo sapiens
cttcactgttccctctggcttcc

SEQ ID NO: 6194863 - DNA, 15 bp, Homo sapiens
cttcacttaaaatca

SEQ ID NO: 6194864 - DNA, 20 bp, Homo sapiens
cttcacttaaaatcaaattt

SEQ ID NO: 6194865 - DNA, 14 bp, Homo sapiens
cttcacttcctcca

SEQ ID NO: 6194866 - DNA, 19 bp, Homo sapiens
cttcacttctgaccacact

SEQ ID NO: 6194867 - DNA, 21 bp, Homo sapiens
cttcacttctgactcttcccc

SEQ ID NO: 6194868 - DNA, 19 bp, Homo sapiens
cttcacttgagttggctgt

SEQ ID NO: 6194869 - DNA, 20 bp, Homo sapiens
cttcacttgagttggctgtg

SEQ ID NO: 6194870 - DNA, 16 bp, Homo sapiens
cttcactttcctcagt

SEQ ID NO: 6194871 - DNA, 18 bp, Homo sapiens
cttcactttcctcagttg

SEQ ID NO: 6194872 - DNA, 13 bp, Homo sapiens
cttcactttctcc

SEQ ID NO: 6194873 - DNA, 13 bp, Homo sapiens
cttcactttctta

SEQ ID NO: 6194874 - DNA, 15 bp, Homo sapiens
cttcagaaaagacac

SEQ ID NO: 6194875 - DNA, 11 bp, Homo sapiens
cttcagaaaga

SEQ ID NO: 6194876 - DNA, 12 bp, Homo sapiens
cttcagaaagac

SEQ ID NO: 6194877 - DNA, 22 bp, Homo sapiens
cttcagaacaatctgagtccag
